United States Patent 11,078,247 (RNA ENCODING A THERAPEUTIC PROTEIN) - sequence listing, part 41

SEQ ID NO: 68851 - RNA, 2778 nt, Artificial Sequence
  derived and/or modified sequence opt5 from ENPP1__Homo_sapiens__NP_006199
auggagagagacggcugcgccgggggaggcagccgcgggggagaaggcgggcgggcucccagagagggaccugccggcaacggccgggaucgcgggagaucccacgcggcugaagccccgggagacccccaggccgcugccucucugcucgcuccuauggaugugggcgaggaaccccuggagaaggccgcgcgggcccgcaccgcuaaagacccuaauacauacaagguccuuagccugguucucuccgugugugugcugacgaccauccuugggugcauuuucggacugaaacccucuugugccaaggaggucaaaagcugcaagggcagauguuuugaacggacauucgggaacugccgcugugaugcugccugcguggagcucggaaauuguugccuggacuaucaagaaaccuguaucgagccugagcauauuuggacaugcaacaaguuuagaugcggcgaaaaacggcugacccgcucccucugugcgugcucugaugacuguaaggauaaaggcgacugcuguaucaauuacagcuccguuugccagggggaaaagagcuggguggaagaaccgugugaaucuauuaacgagccccagugcccugccggauucgagacacccccuacccugcuguuuucccuugauggcuucagagcugaauaucuccacacguggggagggcugcuucccgucaucagcaaacugaagaaguguggcaccuacaccaaaaauaugcggccgguguauccuacaaagacauuucccaaccauuacucuaucguuaccgggcucuauccugagucccacggaauuaucgacaauaaaauguacgaucccaagaugaacgccagcuucucucugaaauccaaggaaaaauuuaaucccgagugguacaagggcgaaccuauuugggugacggcuaaguaucagggccugaaaagcgggacauucuuuuggccgggauccgacgucgagaucaacggcauuuuccccgacaucuacaagauguauaaugggucugugccuuuugaggaacgcauucucgccgugcugcaauggcuucagcugcccaaagaugagagaccucauuucuacacccucuaucuggaggagcccgacagcuccggacacagcuacggcccggucucuuccgaaguuaucaaggcccuucagcggguggaugggauggugggcaugcugauggacggacucaaagagcugaaccugcacagaugccucaaucugauccuuauuagcgaucauggcauggagcaggggucuuguaagaaguauaucuaccugaacaaauaccucggagacgucaagaacauuaaagugaucuauggcccugcugcgcgccugcggcccagcgauguuccugacaaguacuauuccuucaauuacgaagggauugccagaaaccuuucuugccgcgagcccaaucaacacuuuaaaccuuaucugaagcauuuccuccccaagcggcugcacuuugcuaaaagcgauagaaucgaaccgcugacauucuaccucgacccucaguggcagcuggcccuuaaccccuccgagcgcaaguauugcggaagcggcuuucacgggucugauaauguguucuccaacaugcaggcccuguuugucggcuacggacccggcuucaaacaugggaucgaggcugacaccuuugaaaauauugagguguacaaccucaugugugaccugcugaaucuuaccccugccccgaacaauggaacacacggcagccucaaccaucugcugaagaaucccguuuauacgccuaaacaccccaaggaagugcauccucucguccaaugccccuucacccggaacccuagagauaaucugggguguucuugcaaccccuccauccuuccgauugaggacuuucagacacaguucaaccugaccguggcggaagagaagaucauuaaacacgagacacucccuuacggacgcccccggguccugcaaaaggaaaauaccaucugucugcuuagccagcaccaguuuauguccggcuauucucaggauauccucaugccucuguggacgagcuacacaguggacagaaacgauuccuucucuaccgaggacuucagcaauugccuguaucaagauuuucgcauuccccucuccccgguucauaaauguagcuucuacaagaacaauaccaaagugucuuauggguuucuguccccuccccagcuuaacaagaauagcucuggcaucuacuccgaagcucugcucacaaccaacauugucccuauguaccagagcuuccaggugaucuggcgguauuuucacgacacacugcugagaaaauacgccgaggaacggaauggaguuaacguggucucuggccccguguucgauuuugacuaugaugggcgcugcgacagccuugagaaucucagacaaaagcggagagugauucgcaaccaggagauccugauucccacgcauuucuuuaucguucugaccuccuguaaggauacaagccagaccccucuccacugcgaaaaucuggacacacuugccuucauccugccgcaccggaccgacaacucugaguccuguguccauggaaaacacgauagcuccuggguggaggagcuccugaugcugcauagagcucgcauuacggacguggaacacaucaccggccuuucuuuuuaccagcaaagaaaggagcccgucagcgauauucucaaacugaagacacaucugccuaccuucucccaggaggacuga

SEQ ID NO: 68852 - RNA, 2592 nt, Artificial Sequence
  derived and/or modified sequence opt5 from ENPP2__Homo_sapiens__NP_001035181
auggccagacggagcuccuuccagucuugccaaaucauuagccuguuuaccuucgcugugggcgucaacaucugucucggguuuacagcccaccgcauuaagagagcggagggaugggaagaggggcccccuacgguucuguccgauucuccguggaccaauaucagcggcuccugcaaaggacgguguuucgaacuucaggaggcugggcccccugauugccgcugugacaaccugugcaagucuuacacaagcuguugccaugauuuugacgaacucugucugaaaaccgccagaggcugggagugcacaaaggaucgguguggagaggugcgcaaugaagagaacgccugccacugcuccgaagacugucuugcuagaggcgauugcuguaccaauuaucagguggucugcaaaggcgagagccauuggguggacgaugacugugaggaaauuaaggccgcugagugccccgccggguucguucggccuccccugaucaucuuuucuguggauggauuccgcgcguccuacaugaagaaaggcagcaaggucaugccuaacauugaaaaacucagaucuugugggacacacuccccguauaugcggcccguguacccuaccaagacguuucccaaucuguauacccuggccacaggacucuacccugagagccauggcaucguugggaacucuauguaugaccccguguucgaugcuaccuuucaucugcgcggaagagaaaaauucaaucaccggugguggggcggccagccgcuuuggauuacagccaccaagcaaggggucaaggcuggaacguuuuucugguccguggugaucccucacgagcgccggauucugacaauccuccaguggcugacccuucccgaccacgagagaccuagcgucuacgccuucuacuccgaacagcccgacuuuucuggccauaaauaugggcccuucggaccugagaugacaaacccgcugagagaaauugauaagaucguuggccagcucauggacgggcugaaacaacugaagcuccaccgcugcgugaaugugaucuuugucggagaucacggcauggaggacgugaccugugaucggaccgaauuucugagcaacuaccuuacaaauguugacgauauuacgcuggugcccggcacccucgggagaauccgcuccaaauuuagcaacaaugcgaaguaugacccuaaagccauuaucgcuaaccugacaugcaagaagcccgaucagcauuucaaaccuuaccuuaagcagcaucugcccaaacggcuccacuaugccaacaauagacgcauugaggacauccaucugcuggucgagcggagauggcacguggcucgcaagccgcucgauguuuacaaaaagccuucuggaaaguguuucuuccagggcgaccacggguuugacaacaaagucaauuccaugcaaaccgucuucgugggauauggcagcacauuuaaguacaaaaccaaggugcccccuuucgaaaacaucgagcuguacaaugugaugugcgaucuucuggggcucaaacccgccccuaacaauggcacgcacggaucucugaaccaucuucugcggacaaauaccuuuagacccaccaugccggaagagguuacacgcccuaacuaucccggcauuauguaccuccagagcgacuucgaucuggggugcaccugugacgauaagguggaacccaagaauaaacuggacgagcucaacaagcggcugcacacaaaaggauccacggaggaaagacaucuucuguauggccggccugccguccucuaccgcaccagauaugauauccuguaccacacagacuucgagucuggguauagcgaaauuuuucugaugccgcuuuggaccuccuacacagugagcaagcaggcugagguuucuuccgugcccgaucaccucaccagcugcguccggccugacgugagagugucucccuccuucagccaaaauugucuggcguacaaaaacgauaagcagauguccuauggauuucuguucccucccuaccucucuagcuccccugaggccaaguaugacgcuuuucugguuacgaauaugguccccauguacccggccuucaaacgcguguggaacuauuuucagcgggugcuugucaagaaauacgccucugaaagaaacggcgugaauguuaucagcgggccuauuuucgauuaugacuacgacggccugcaugauaccgaggacaagaucaaacaguacguggaaggauccagcauccccgucccuacacacuauuacucuauuaucaccuccugccucgauuuuacacaacccgcugacaagugugauggcccgcugagcgugucuuccuucauucugccucaucgccccgacaacgaggaaagcugcaauucuagcgaggaugaguccaaauggguugaggaacuuaugaagaugcacaccgccagagugcgggacaucgaacaucucacgagccuggacuuuuuccgcaagacaucuagauccuauccugagauucugacccucaaaacauaccugcacaccuaugaaagcgagaucuga

SEQ ID NO: 68853 - RNA, 2628 nt, Artificial Sequence
  derived and/or modified sequence opt5 from ENPP3__Homo_sapiens__NP_005012
auggagagcacccugacacucgccacggaacagcccgugaagaaaaacacccugaagaaauacaagaucgcuugcauuguccuucuggcccuccugguuaucaugucccuuggccuggggcucggacugggccugagaaaacucgagaagcaagggucuugucggaagaaaugcuucgacgcgagcuuucgcggacuggaaaauuguagaugcgauguggcuuguaaggaccggggcgauugcuguugggacuucgaggauacaugcguggaauccacccgcauuuggauguguaacaaauuuagaugcggggagacacggcuugaggccucucuguguagcugcuccgacgauugccuccagcgcaaggacuguugcgccgauuauaaaucugucugucagggagaaaccagcuggcuggaggaaaauugcgacacagcucagcaaucccaguguccugagggcuucgaucuuccgcccgugauccuguuuagcauggacggcuucagagccgaguaccucuauaccugggauacgcugaugccuaacauuaauaagcugaagaccugcgggauccacucuaaauacaugcgggcuauguaucccacaaagaccuuuccuaaccauuacacaaucguuaccggacucuaucccgaaucccacggcauuaucgacaauaacauguacgacgugaaucugaacaaaaauuucagccuuucuuccaaggagcagaacaauccugccugguggcaugggcagccgauguggcugacggcgauguaccaaggacucaaagccgcuacauauuuuuggcccggcagcgaagucgccauuaacgggucuuucccuuccaucuacaugcccuauaauggaagcgugccuuuugaggaacgcauuuccacccugcuuaaguggcuggaucuccccaaagcugagagaccgcgguucuacacaauguauuuugaggaaccugacucuagcggccacgccggcgggcccguuuccgcgcgcgugaucaaggcccugcaggucguggaucaugcuuucggaaugcugauggagggccucaagcagagaaaccugcacaacugugugaauauuauccuucuggccgaccacgggauggaucagaccuacugcaacaaaauggaauauaugaccgacuacuucccucggaucaacuuuuucuacauguaugagggacccgcuccccgcauuagagcccauaauaucccucacgacuuuuucagcuuuaauucugaagagauuguccggaaccucuccuguagaaagccggaucaacauuucaaacccuaccugacaccugaucuucccaagcgccugcacuaugccaaaaauguucggaucgacaaggugcaccucuuuguggaucagcaguggcuggcugucagaagcaagucuaacacgaauugcggcgggggaaaccauggcuacaauaacgaguuccgcagcauggaagcgauuuuucuggcccacggcccuuccuucaaagagaagaccgaaguggagcccuuugaaaauaucgagguuuauaaccucaugugugaccugcuucggauccaaccggcuccuaauaacgggacacauggaucucugaaccaccuccugaaagugcccuucuacgagccuagccaugccgaagaggucuccaaguuuagcgugugcggcuucgccaauccccugccuaccgaaucucuugacugcuucuguccccaccuccagaacuccacacagcuggagcagguuaaucaaaugcugaaccucacccaggaggaaauuacggcuacagugaaagucaaucugccguuugggagaccucgcgugcuucagaagaacgucgaucacugccugcucuaucaucgggaguacgugagcggauucggcaaggccaugagaaugcccauguggucuuccuacaccguuccccagcugggggacaccagcccucugccgcccacagugccugauugucuucgcgcggacguccgggugcccccuuccgaaucucaaaaaugcagcuuuuaucucgcugauaagaauaucacccacggcuuccuguaucccccugccuccaacagaacaucugacagccaguacgaugcccugauuacguccaaucucguucccauguacgaggaauuucgcaaaaugugggacuauuuccauagcgugcugcuuaucaagcacgcuaccgagcggaacggagucaauguggugucuggcccgauuuuugauuacaacuaugacgggcacuucgaugccccugacgagaucacaaaacaucuggcuaauaccgauguucccaucccuacacacuacuuugucgugcucaccuccuguaagaacaagagccauacgcccgaaaauugcccgggauggcuggacgugcugccuuucauuaucccccacagaccuaccaacgucgagucuugucccgaaggcaaacccgaggcccuuuggguggaggaacgguuuacagcgcauauugcccgcguuagagacguggagcuccugaccgggcuggauuucuaccaggacaagguccagccuguguccgaaauccuccaacugaaaacauaucuuccgaccuuugagacgacaauuuga

SEQ ID NO: 68854 - RNA, 1434 nt, Artificial Sequence
  derived and/or modified sequence opt5 from ENPP5__Homo_sapiens__XP_005249317
augaccagcaaguuccugcucguguccuuuauccuggccgcucuuucucugagcacaacguucucccuccagcccgaccaacagaaaguccugcuuguuucuuuugauggcuucagaugggacuaccuguauaaggugccuaccccgcacuuucauuacauuaugaaauauggggugcacgucaaacaggugacaaacguuuucaucaccaagacauaccccaaucauuauacccucgugacaggacuguuugccgagaaccacggcauugucgcgaaugauauguucgacccuauccggaacaagagcuuuucccuggaucauaugaauauuuacgacucuaaguucugggaagaggcuacccccaucuggaucacgaaccagcgcgccgggcacaccagcggagccgcuauguggccuggcacagaugugaaaauucacaagagauuucccacccauuauaugccuuacaaugaauccguuagcuucgaggaccggguggccaaaaucauugaaugguuuacaucuaaggagccgaucaaccucgggcugcuuuacugggaggaucccgacgauaugggacaccaucugggcccugacagcccccucaugggcccugucauuuccgauaucgacaaaaagcugggguaucuuauucaaaugcugaagaaagcuaagcucuggaauacccugaaccugaucaucacgucugaccacggaaugacacagugcuccgaggaacgccucauugaacuggaucaguaccuugacaaagaucacuauacccugaucgaccagagccccguggccgcgauucucccgaaggagggcaaauucgaugagguguacgaagcccugacacaugcucacccuaaucuuaccgucuauaagaaagaggacguucccgaaagauggcauuacaaguauaacucucggauccaaccuauuaucgccguggcugaugagggguggcacauccugcagaauaaguccgacgauuuccuccugggaaaccauggcuacgacaaugcccuggcggauaugcaccccauuuuucucgcccacgggcccgcuuuccgcaaaaacuuuagcaaggaagccaugaacuccaccgaccuguacccucuucugugucaucuccugaauaucacagcuaugccgcacaacggaucuuucuggaaugugcaggaccuucugaacagcgccaugcccagagucgugccuuauacgcaguccaccauucuccugcccggcagcguuaaaccugccgaguacgaucaagagggcucuuaucccuacuuuaucggggugucccugggaagcauuaucgucaucguguucuuuguuauuuucaucaagcaucucauucacucucagaucccggcucugcaggacaugcacgcggaaauugcccaaccucuucugcaggcuuga

SEQ ID NO: 68855 - RNA, 1377 nt, Artificial Sequence
  derived and/or modified sequence opt5 from ENPP7__Homo_sapiens__NP_848638
augagaggccccgccgugcugcucaccgucgcucuggccacacuucuggcgccuggggcuggagccccgguucagagccaaggcucccagaacaagcuccugcuugugucuuucgacggguuucgguggaauuacgaucaggacguggauacgcccaaccuggacgccauggcucgcgauggagucaaagccagauauaugaccccugcuuucgugacaaugaccagccccugccacuuuacacucguuaccggcaaguacaucgagaaucauggggugguccacaacauguauuacaauacaaccuccaaagugaagcugccuuaucaugccacgcugggcauucagcgguggugggacaacggaucuguucccaucuggauuaccgcgcaacgccagggccucagagccgggagcuucuuuuacccuggaggcaaugugacauaucagggggucgcugugacccggucccgcaaagaaggaaucgcccacaacuacaagaaugagacagaauggagagcuaacauugauaccgugauggccugguucacggaggaagaccuggaucuugucacacuguacuuuggcgagccggacucuaccgggcaucgguauggacccgagagcccugaacgcagagagaugguucgccagguggaucggacagugggcuaccucagagaauccaucgcgcggaaucaccugaccgaccgccuuaaccugaucauuaccagcgaucacggcaugacaacggucgacaagagagccggggaccucguggaguuccauaaauuucccaauuucaccuuucgggauaucgaguucgaacugcuggacuauggaccuaacggcaugcuccugcccaaggaggggagacuugaaaaaguuuacgaugcucugaaggacgcccacccgaaacuccauguguauaagaaggaggcuuuuccugaagccuuccacuacgccaauaacccccgcgucacaccucugcuuauguauucugaucugggauacgugauucacggccggaucaacguucaauucaauaacggggagcauggauuugacaauaaagauauggacaugaagaccauuuucagagcugugggccccuccuuucgcgcgggccucgaggucgaacccuucgagagcgugcacgucuacgaacugaugugucggcugcucgggaucgugccugaggccaacgauggacaucuggcuacacuucugccgaugcuccacaccgaaucugcccugcccccugacggcagacccacgcuucugccuaaagggcgcuccgcccugcccccgagcucucggccucuccugguuaugggacuccugggcacagugauucuucuguccgaggucgcuuga

SEQ ID NO: 68856 - RNA, 1578 nt, Artificial Sequence
  derived and/or modified sequence opt5 from ENTHD2__Homo_sapiens__NP_653280
auggccgcugcgcccccucugagagaccggcucagcuuccugcaccgccuuccgauccugcucaagggcaccuccgaugacgaugugcccugcccuggguaccuguuugaggaaauugccaaaaucucucaugagagccccggauccucucagugucuucuggaauaucuccugagcagacugcacuccucuagcggccaugggaagcucaaaguccugaagauucuucuguaccucugcucccacggaagcucuuucuuucugcuuauccugaaacggaacuccgcuuucauucaagaggccgccgcuuuugccggcccucccgacccucuccaugggaauagccuguaucagaagguucgcgcugccgcgcaggaucugggaucuacacucuucuccgacacggugcugccgcuugcccccagccagccucugggcacacccccugcuaccggcauggggucucaagccagaccccacuccacccuccagggauuuggcuacagcaaggaacacgggcggacagcugugcgccaucagccgggacaggccggcgggggaugggaugagcuggacuccggcccuucuagccaaaacuccagccaaaauucugaucuuuccagagucagcgacucuggcagccacuccgggucugauagccauuccggagcgagccgggagcccggcgaccuggccgaacgcguggagguuguggcucucucugauugucagcaggaacugucccuggucagaaccgugacacgggggccucgcgccuuccucagcagagaggaggcucagcacuuuaucaaagccugcggacugcuuaacugugaagccguucugcagcuccugaccugccaccuucggggcacgucugaguguacccagcugcgcgcucucugcgcgaucgccucccuggggagcuccgaccugcucccccaagaacauauucugcuuagaacacggcccuggcugcaggagcucucuaugggaagcccuggcccggugaccaauaaggcuacaaaaauccugagacacuucgaagccuccuguggccagcugucucccgcccgcgggaccagcgcugagccuggacccacggccgcgcuuccuggccccuccgaccuccugacagaugcugucccgcugccugggagccagguguuucuccaaccccugucuuccaccccugugagcucucggucccccgccccuagcucuggaaugcccagcuccccggucccuacacccccucccgacgccagcccgauucccgcuccuggcgaucccucugaggccgaagcuagacuugccgagucccgccgguggagaccugaacgcauccccgggggcaccgacagcccuaagcggggacccuccucuugcgcguggagcagagauucccuguucgccggcauggagcucguugcuuguccgcgccuggugggggccggagcugccgcgggcgaaucuugcccugacgcuccccgggccccucagaccagcucccagagaacagccgcuaaagagcccccggggucugagccuagcgccuuugccuuccugaacgcuuga

SEQ ID NO: 68857 - RNA, 1554 nt, Artificial Sequence
  derived and/or modified sequence opt5 from ENTPD1__Homo_sapiens__NP_001091645
augaagggcaccaaagaccugacaagccagcaaaaggaguccaacgugaaaacguucugcucuaagaauauccucgccauucugggguuuagcuccaucauugcugucaucgcccuucuggcgguuggacucacccagaacaaagcucugcccgaaaaugugaaguacggcauugugcuugaugccgggucuagccacacaucccuguauaucuacaaguggccugccgagaaagaaaacgacaccggagucgugcaucagguugaggaauguagagugaagggcccggggaucucuaaauucguccagaaggugaaugagauuggaaucuaucucacagauugcauggagcgggcucgcgaaguuauucccagaagccaacaccaggagaccccuguguaccugggcgccacagcuggcaugcggcugcuccgcauggaauccgaggagcuggccgacagaguccuugaugugguggaacggagccugucuaacuaucccuuugacuuccagggggcgcgcaucauuaccggacaggaggaaggcgccuacggguggaucacgauuaauuaucuccugggaaaauuuucccaaaagaccagaugguucagcaucgucccuuacgagacaaacaaucaggaaaccuuuggcgcucuugaucucgggggagccucuacacagguuaccuucgugccccagaaccaaacgaucgaguccccugacaaugcucugcaguuucggcuguacggcaaggauuauaacguguacacacauagcuuccuguguuauggcaaagaccaggcccucuggcaaaagcuggcgaaagauauucaggucgccucuaaugagauccuucgcgacccgugcuuucaccccggguacaagaaagugguuaacguguccgaucuguauaagaccccuuguacaaaaagauucgaaaugacccuccccuuucagcaguucgagauucaaggaaucggcaauuaccagcagugccaucagagcauucuggaacuuuucaacaccuccuauuguccuuacucucaaugcgcuuuuaacgggaucuuccugcccccgcuccagggagacuuuggcgccuucagcgcuuuuuacuucgucaugaaguuucugaaucugacauccgagaaggugagccaggaaaaaguuacggagaugaugaagaaauucugugcccagccuugggaggaaaucaagaccucuuaugccggggugaaagagaaguaccucuccgaauauugcuuuagcggaacauacauucugucucuucugcuccaaggcuaucacuucaccgcugacagcugggagcacauccauuuuauuggcaagauccagggguccgaugcgggauggacacugggcuacaugcuuaaccugaccaauaugauucccgccgaacagccucucucuacgccccugagccacuccacauaugucuuccugauggugcucuuuagccugguccuuuucaccguggcuaucaucgggcugcucauuuuccauaaacccucuuacuuuuggaaggacaugguuuga

SEQ ID NO: 68858 - RNA, 1419 nt, Artificial Sequence
  derived and/or modified sequence opt5 from ENTPD2__Homo_sapiens__NP_001237
auggccggcaaggugagaagccugcugcccccucuccuucuggcugccgcggggcucgcuggacugcuucugcucugcgucccgacccgggacguucgcgagcccccugcccugaaauacggcaucgugcuggaugccggguccucucacacaagcauguucauuuauaaguggcccgcugacaaagaaaacgauacgggaaucgugggccagcauuccucuugugacgucccugggggaggcauuagcuccuacgccgauaaucccucuggcgcuagccaaucccucguggggugccuggagcaggcccuucaggacguuccuaaggaaagacacgcgggaaccccgcuguaucucggcgccacagcugggaugcggcugcuuaaccugaccaaucccgaggccagcacaucugugcucauggcugucacccauacacugacccaguacccuuuugauuuccgcggagccagaauccuguccggccaagaagaggggguguuuggauggguuacggcgaacuaucuccuggagaauuucauuaaauacggcugggugggccggugguuucgccccagaaaggggacccuuggagccauggaccugggcggggcuagcacacagaucaccuucgaaacaaccucuccugccgaggaucgggcuuccgaaguccagcuccaccuguauggacagcauuaccgcguguacacgcacagcuuucuuuguuauggcagagaccaagugcugcagcggcuccuggccucugcccugcagacacacggguuccaucccugcuggccgcgcggauuuuccacccagguccuccugggcgauguuuaccaaagcccuuguacaauggcucagagaccccagaacuucaauuccucugcgcgggugagccuuuccggcagcucugacccucaccugugccgcgaucucguguccgggcuguuuagcuucucuagcugucccuuuuccagaugcucuuucaacggagucuuccaacccccuguggccggcaauuuuguugcuuucagcgccuuuuucuauaccguggacuuucuucggaccuccauggggcugccggucgccacacuccagcagcuggaggcugccgcggugaacguuuguaaucagacgugggcucaacagcugcucagcagaggauacggcuucgacgagcgcgccuuugggggcgugaucuuccagaagaaagccgcugauaccgccgucggaugggcucugggcuauaugcuuaaccugacaaaucucauucccgccgacccucccgggcugcggaagggaaccgauuuuucuuccugggugguccugcuucuccuguucgcgagcgcccugcucgcugcccuggugcuucugcucagacagguucauucugcuaaacugccuuccacaaucuga

SEQ ID NO: 68859 - RNA, 1827 nt, Artificial Sequence
  derived and/or modified sequence opt5 from ENTPD4__Homo_sapiens__NP_001122402
augggcagaaucgggauuagcugccuguuccccgccuccuggcacuuuucuaucagcccugugggauguccgcggauucucaacaccaaucugcgccagaucauggucauuuccguucuugcugccgcggugucucugcucuacuucagcguggucaucaucagaaacaaguauggccggcugacacgcgacaaaaaguuucaaagauaccuugcucgggugacggauauugaggccaccgacacaaauaaccccaauguuaacuaugggaucguggucgauugcggauccucuggcagccgcguguucguuuacuguuggccuagacauaaugggaacccccacgaccugcucgauauucggcagaugcgcgacaaaaauagaaagccuguggucaugaaaaucaagcccggaauuuccgaauuugccaccagcccugagaaggugucugauuauaucuccccgcugcugaacuucgcugccgaacaugugccccgggcuaaacacaaggagacaccucucuacauucugugcaccgccggcaugcgcauccuucccgaaagccagcagaaagcgauccuggaggaccuccugacagauauuccuguccauuuugacuuccuuuucucugauucccacgccgagguuaucagcggcaagcaagaagggguguaugcuuggauuggaaucaauuucgugcugggcagauuugagcacauugaagacgaugacgaggccgucguggagguuaacauccccgggucugaauccagcgaggcuaucgugcggaaacgcaccgccggcauucucgacaugggaggggucuccacgcagaucgcguacgaagugccgaagaccgaggaaguugccaagaaucugcuggcugaguucaaccucggaugugaugugcaucagacagagcacgucuacagaguguaugucgccaccuuucugggcuucggcgggaaugcugcccggcagagauacgaagaccgcauuuucgccaacacaauccagaaaaaccggcuucugggaaagcaaaccggccucacgccugauaugcccuaucuggacccuugccuuccccuggauauuaaagacgagauccagcagaaugggcaaacaaucuaccucagaggaaccggcgauuuugaccugugucgcgaaacaauucagcccuucaugaacaagaccaaugagacccagacaucucugaacgggguguaucaaccuccgauccauuuucagaauagcgaauuuuacggauuuuccgaguucuauuacugcacggaggauguucuccggaugggcggcgacuacaacgcugcgaaauuuaccaaggccgcuaaagauuauugugccacaaaguggagcauucugagagaacgcuucgaccgggggcuuuacgccucucacgcugaccugcacagacucaaguaucagugcuuuaaauccgccuggauguucgagguguuucaucgcggauucagcuuucccgucaauuacaagucucugaaaaccgcgcuucagguguaugauaaggaaguucaauggacacugggcgcuauccucuaccggaccagauuccugccucugcgcgacauucagcaggaggccuuccgggccagccacacgcauuggagagggguguccuuugucuauaaccacuaccucuucucuggauguuuucugguggugcuucuggcuauccuccuguaccugcuucggcuccgccggauucauagaagaacaccccgcagcuccagcgccgcugcccuguggauggaagagggccugccugcgcagaaugcccccgggacccucuga

SEQ ID NO: 68860 - RNA, 1287 nt, Artificial Sequence
  derived and/or modified sequence opt5 from ENTPD5__Homo_sapiens__XP_006720387
auggccaccagcuggggcacaguguucuuuaugcuggucguuuccugcguguguucugcugugagccacagaaaccagcaaacgugguucgaggggaucuuucucuccucuaugugccccauuaaugucagcgccuccacccuguacggaaucauguucgacgcgggcucuacagggacccggauucauguguauacauuuguucagaagaugccuggacagcuuccgauccuggaaggcgagguguucgauagcgucaaacccgggcucuccgcuuuuguggaccagccuaagcaaggagccgaaaccguucagggccugcuugagguggccaaagauagcauuccccgcucucacuggaagaaaacaccugucgugcugaaggcuaccgccggccucagacugcugcccgaacauaaggcuaaagcccuccuguucgaggugaaggagaucuuucggaaauccccuuuccuugucccgaaggggagcguuucuaucauggacggauccgaugaaggcauucuggcgugggugacggugaacuuucucaccgggcagcugcacggacaucgccaggagacagucggcacccuugaccucgggggagccagcacacaaaucaccuuccugccccaguuugagaaaacgcuggaacagacaccuagaggcuaccugaccucuuucgagauguucaauuccacauauaagcucuacacccacagcuaucugggcuuugggcuuaaggcugcccggcuggcuacccucggagcccuggaaacagagggcacggaugggcacaccuuccgcuccgcgugucuucccagauggcuggaagccgaguggauuuuuggaggcgugaaauaccaguaugggggaaaccaagaaggcgagguuggcuucgagccuugcuacgcugaagugcuccgggucgugcgcgggaagcugcaucagcccgaggaaguucagagaggaucuuuuuacgccuucagcuauuacuaugaccgggcuguggauacagacaugaucgauuacgagaaaggcgggauucugaaggucgaagacuuugagcgcaaagccagagaggugugugauaaucucgaaaacuucaccuccggaagcccguuucugugcauggaccuuucuuauaucacagcccugcucaaggacggcuucggguuugcugauuccaccguccugcaacuuacgaaaaaggugaauaacauugagacaggcugggcgcugggagccaccuuccaccuccugcagagccugggcaucucucauuga

SEQ ID NO: 68861 - RNA, 1404 nt, Artificial Sequence
  derived and/or modified sequence opt5 from ENTPD6__Homo_sapiens__NP_001107561
augcagccccaacacggcccuuggcagaccagaaugcggaagaucagcaaccaugggucccugcgcguggccaaagucgcuuacccgcucggacugugcguuggcguguucauuuauguggccuacaucaaguggcacagagcgacagcuacgcaggccuuuuucucuauuacccgggccgcucccggggcccgcuggggacagcaagcucauagcccucuuggcacagccgcggacgggcacgaggucuuuuauggaaucauguucgaugccggcuccaccggcacaagagugcauguuuuucaguucacccggcccccucgcgaaacacccacccugacgcacgagaccuuuaaagcucucaagccugggcugucugccuacgcugacgauguggagaaaagcgcccagggaauuagagaacuucuggacgucgcgaagcaggauaucccguucgacuuuuggaaggccacaccccucgugcugaaagcuaccgccggccugcggcuccugccuggggaaaaggcucaaaaacuucugcagaagguuaaagagguguucaaggccucccccuuucucgucggagaugacugugugucuaucaugaauggcacagaugagggggugagcgccuggauuaccaucaacuuccugacgggaucccuuaagacaccuggcggcagcucugucgggaugcuggaccucggaggcggguccacccagauugcuuuucugccccgcguugaaggaacacugcaggcgagcccgccuggcuaucucaccgcccugagaauguucaaucggaccuacaaacuuuauucuuacuccuaccuggggcucggacugaugagcgcucgccuugccauccugggcggcguggaggggcaacccgccaaggauggaaaagaacucgugucuccuugccugucccccagcuucaagggcgagugggagcacgcugaagucacauauagaguguccgggcagaaagccgcggcuucucugcaugagcucugugccgcccggguuagcgaagugcugcagaaccgcguccacagaacggaggaagugaagcauguugacuuuuacgcuuucuccuauuacuaugaucuugccgcuggagugggccugauugacgccgagaaagggggcagccucgucgugggagacuuugagaucgcggccaaguacgucugccggacccuggaaacacaaccccagucuuccccuuucagcuguauggaucuuaccuaugugucucugcuccugcaggaguuuggcuucccgagaagcaagguucugaaacucacacgcaagauugacaauguggaaaccuccugggcucugggggccaucuuucacuacaucgauucucuuaaccggcagaaaagccccgcuuccuga

SEQ ID NO: 68862 - RNA, 1815 nt, Artificial Sequence
  derived and/or modified sequence opt5 from ENTPD7__Homo_sapiens__NP_065087
auggccagaaucagcuucuccuaccugugccccgccucuugguauuuuaccgugccuacagucagcccguuccuccggcagcgcguugccuuucugggccuuuucuuuauuuccugucugcuccugcuuaugcugaucauugacuucagacacuggucugcgagccucccccgggaucgccaauacgagagauaucuggcucgggugggggaacuggaggccacggacaccgaagauccuaaccucaauuacggacugguggucgacugcggcuccucugggagccgcaucuuuguguauuucuggcccagacauaacggaaauccucacgaucuucuggacauuaagcagaugcgggaucgcaacucccagcccguugugaaaaagaucaaaccuggcaucagcgccauggcugacacaccggagcaugccucugauuaccucagaccccugcuuuccuuugcugccgcgcacgucccugugaagaaacauaaggaaacaccccuguauauucucuguaccgccgggaugcggcugcugccugagcgcaagcagcucgcuauccuggccgaccuuguuaaagaucugccccucgaguucgacuuucuguucagccaaucucaggcugaagugauuuccggaaagcaggagggcgucuacgccuggaucggcauuaauuuugugcuugggagauucgaucacgaagacgagagcgacgcggaggccacccaggaacuggcugccggacggcgcagaacagugggcauccucgauaugggaggggcuucucugcaaauugccuacgaggucccgaccuccacgagcguucugccugccaaacaggaagaggcugcgaagauccuccuggccgaguucaaccuuggcugcgacgugcagcacaccgaacauguguaucgggucuacgugacaaccuuucugggguucggaggcaauuuugcuagacagcgcuaugaggaucucguucugaacgaaacacuuaauaaaaaccggcugcucggccaaaagaccgggcugucccccgacaauccuuuccuggaucccugucuccccgugggacugacggacgucguggagagaaacucucagguucuucacgugcgcggcagaggggauugggucagcugcggagccaugcuguccccucuccuggcccggagcaauacaucucaggcuucccugaacggcaucuaccaaagcccgauugacuuuaauaacucugaauuuuauggguucagcgaguucuuuuacuguaccgaagaugugcuucgcaucggaggccgguaucauggccccacauucgccaaggcggcucaggacuacugcgggauggccugguccguccucacccagagauuuaaaaacggacuguucucuagccacgccgaugagcaccgccugaaguaccaguguuuuaaauccgcuuggauguaucaagugcuccaugagggcuuccacuucccuuacgacuaucccaaucugcggaccgcccagcuuguuuacgacagagaagugcaguggacacugggggcuauucucuauaagacgcgcuuucugccucugcgggaucuuagacaggagggaguccggcaagcccauggcagcugguuccgccucucuuuuguguacaaccacuaucuguucuuugcgugcauccugguugugcuccuggccauuuuccuuuaccugcucagacugcggagaauccaucaccgccagacccgggcuuccgcuccccuggaccuucucuggcuggaagaggucgugccgaugaugggggugcagguuggcccuuga

SEQ ID NO: 68863 - RNA, 1584 nt, Artificial Sequence
  derived and/or modified sequence opt5 from EOGT__Homo_sapiens__NP_001265618
augcugaugcuguucguguuuggcguccuccuucacgagguuagccuguccgggcagaacgaagcucccccuaauacccauucuaucccgggagagccccucuacaacuaugccagcauuagacugccugaagaacacauccccuucuuucuucauaauaaccggcacauugccacagugugccgcaaggacucccuguguccuuacaaaaagcaucucgaaaaacugaaguauugcuggggcuacgagaaaucuuguaagcccgaguucagauuuggguauccugugugcagcuacgucgauaugggauggacggacacccuggaauccgcggaggauaucuucuggaagcaagcugacuuuggcuaugcccgggaacgccucgaggagaugcacgugcugugucagccgaaagaaacaucugauagcucccuuguuugcagcagauaccugcaguacugucgggccaccaaucucuaucuggaccuucgcaacauuaagagaaaucacgaucgguucaaagaggacuuuuuccagucuggggaaaucggaggccauugcaagcuggauauccgcacacucaccuccgagggccaaagaaaaagcccccugcagucuugguuugcugaacugcaguccuacacacagcucaacuuccggccuauugaggacgccaagugugauaucgugauugagaagcccaccuauuuuaugaaacuggacgcuggggucaauauguaccaccauuucugcgauuucaucaaccuuuauauuacgcaacacgugaauaacagcuuuucuaccgacguuuacaucgugaugugggacacauccagcuauggauacggcgaucuguucuccgacaccuggaaugccuuuacagauuacgacgucauucaccucaagaccuaugauucuaaacgcguguguuucaaggaagcgguguuuagccugcuuccuagaaugcgguacgggcuguucuauaacacgccccucaucuccggaugccagaauacaggccuguuucgcgccuucgcucagcauguccugcacagacucaacaucacccaggaggggccgaaagacggaaagauucggguuacaauccuggccagaagcaccgaauaccgcaaaauucuuaaccaaaaugagcuggugaacgcucucaagaccgugucuacauuugaaguccagaucguggauuauaaguaccgggagcugggcuuccuugaccagcugagaauuacgcauaauaccgauaucuuuaucggcaugcacggggccggacucacacaucugcuguuccucccugacugggcggccguuuuugagcuguauaacugcgaagaugagcgcuguuaccuugaccuggcucggcucagaggcgugcacuacauuaccuggcgccggcaaaauaaagucuucccccaggacaaggggcaccauccuacacugggagaacaccccaaauucaccaacuauuccuuugauguggaggaguucauguaccugguucuucaggccgcugaccaugugcuccagcaccccaaguggccuuuuaaaaagaagcacgaugagcuguga

SEQ ID NO: 68864 - RNA, 2118 nt, Artificial Sequence
  derived and/or modified sequence opt5 from EOMES__Homo_sapiens__NP_001265111
augcagcugggcgagcaacuccuggugagcuccgucaaccuucccggggcccacuucuacccucuggaaucugcuagaggaggcagcgggggauccgccggccaucucccgucugcggcucccagcccucagaagcuggaccuugauaaagccuccaagaaauuuucugggagccuguccugcgaggccguuagcggagaacccgcugccgcuucugccggcgcgccugccgcuaugcucuccgacaccgaugccggcgacgcuuucgccagcgcggccgcuguggccaagcccgggccuccggauggacggaaaggcucucccuguggggaggaggaacugccuuccgcugccgccgcugcggccgcugccgccgcugccgcggcugccacagcccgcuauagcauggacucucuguccagcgagagauacuaucuccagucccccggaccucagggcucugaacuggcugcccccugcagccuuuuuccguaccaagcugccgcgggggccccucacggacccguguauccugcucccaauggcgcccgguaccccuauggcuccaugcugccuccgggcggauuccccgcugccgucuguccucccggccgcgcgcaguuugggccuggagccggcgcugggagcggagccggcgggucuuccgggggaggcgggggacccggcacguaccaguacagccagggggcuccgcucuauggcccuuaccccggagccgccgcugcgggcucuugcgggggacugggcgggcuuggagugccuggcagcggguucagagcccauguuuaucuguguaaccggccccucuggcugaaguuucaccgccaucaaaccgagaugaucauuacaaagcagggcagacggauguucccuuuucuguccuucaauaucaacggacucaaucccaccgcucacuacaacguguuugucgaagugguucuggccgauccgaaucacuggcgcuuccagggcgggaaaugggugacaugcggaaaggccgacaacaauaugcagggcaacaaaauguauguccauccugagucucccaauaccgggagccacuggaugagacaagagauuuccuuuggaaaacuuaagcugacaaacaauaagggcgcuaacaauaacaacacccagaugaucgugcuccagagccugcauaaguaccaaccccggcuucacauuguggaagucacggaggaugggguugaagaccugaaugagccuucuaaaacccagacauucaccuucuccgaaacacaguuuaucgccgugaccgcguaucagaacacggauaucacacaacucaagauugaccacaauccguucgcuaaaggcuuucgcgauaacuacgacagcauguacaccgccucugagaaugacagacugacacccuccccuaccgauagcccccggucccaucagaucgugccuggaggccgcuaugggguccagucuuucuuucccgagccuuucgugaacacccugccccaggccagauacuauaauggagaacggacaguuccgcaaacgaacggccuccugagcccucagcaguccgaggaaguggcuaaucccccucagagauggcuugucacccccgugcaacagccggggacaaacaagcuggacauuucuagcuacgaguccgaauauaccagcucuacacuccugccuuacggaaucaaaucccuuccccugcagaccagccacgcccucggcuauuacccugaucccacguuucccgcgauggcuggguggggcggacgcggcucuuaccagcggaagauggccgccgggcugccuuggacauccagaaccagcccgaccguuuucucugaggaccaacugagcaaagagaaggugaaggaagagauuggauccagcuggaucgaaacacccccuucuauuaaaucccucgauagcaaugacuccggcgucuauaccucugcuuguaagcgccggagacugagccccuccaacucuagcaaugagaacuccccuucuaucaaaugcgaagauaucaaugccgaggaguacagcaaggacacauccaaagggaugggaggcuauuacgcuuuuuauacgacccccuga

SEQ ID NO: 68865 - RNA, 7245 nt, Artificial Sequence
  derived and/or modified sequence opt5 from EP300__Homo_sapiens__NP_001420
auggccgaaaacgugguggaacccggcccuccgagcgcuaagagacccaaacuguccucuccugcccucagcgcguccgcuucugacgggaccgauuucggaagccuguuugaccuugagcacgaucugcccgacgaacucaucaauuccaccgagcugggccuuacgaacgggggagauauuaaucagcugcagaccucucucggcaugguucaggacgccgccagcaagcacaaacagcuguccgaacugcuccggagcgggucuuccccuaaccugaauaugggagugggcggccccgggcaagugauggcuagccaagcccagcagucuuccccuggacuuggccugaucaacagcauggucaagucuccgaugacccaggcugggcucaccucccccaauaugggaaugggcacaagcgggccuaaccaaggacccacccaguccaccggcaugaugaacucuccugugaaccagcccgccaugggcaugaauaccgggaugaacgcgggaaugaauccgggcaugcuggccgcugggaacggacagggcauuaugccuaaucaaguuaugaacgggagcaucggagccggccgcggcagacagaacaugcaguaccccaauccugggaugggauccgcuggcaaccuucugacggagccccuccaacaggggagcccccagaugggaggccagaccgggcugcggggcccucaaccgcugaaaaugggaaugaugaauaaccccaauccuuauggcucucccuacacacagaacccugggcagcagauuggagccuccggccucgggcugcaaauccagaccaagacagugcuuagcaauaaccugucucccuucgcgauggauaagaaagccgucccgggaggcgggaugccuaauaugggccagcagcccgcuccucaagugcagcagcccggacucguuaccccuguggcccagggcauggggagcggagcucacacggccgaccccgagaagcgcaaacugauccaacagcagcuuguccugcuccugcaugcccacaagugccaaagacgggaacaggcuaacggcgaggugcgccagugcaaucugccgcauugcagaacaaugaaaaacgugcucaaucacaugacccacugucaguccgggaagucuugccaagucgcgcauugugccagcucccggcagauuaucagccacuggaagaacugcacacgccaugauuguccuguuugccugccccuuaaaaaugcuggagacaagagaaaccagcagcccauucugaccggcgccccuguggggcucggcaacccgucuucccugggagugggccaacagagcgcccccaaucuuucuaccgucucccagaucgauccuagcuccauugaacgggcuuaugccgcgcuggggcuccccuaccaggugaaccaaaugccuacacagccccagguucaagcuaaaaaucagcagaaccagcaaccuggacagucuccccagggcaugcgcccgaugagcaauauguccgccucuccuaugggggugaacggaggcgucggggugcagacgcccagccugcuguccgacagcaugcuccacucugccaucaauucccaaaacccuaugaugagcgagaaugcuucuguucccucccugggcccgaugccuaccgccgcucagcccagcacaaccggaauuagaaagcaguggcacgaggauaucacacaggaccuucggaaccaucuggugcacaaacucguccaagccaucuuuccuacccccgaccccgcggcccugaaggaucgcagaauggaaaaucugguggcuuaugcccggaaagucgagggcgacauguacgaaucugcuaacaauagagccgaguauuaccaucuucucgcggaaaagauuuacaagauccagaaagagcuggaggaaaagcgccggacgagacugcagaaacagaacaugcucccuaaugccgcugggauggugccgguuagcaugaaccccggaccuaacaugggccaaccccagccugggaugacauccaauggaccccugccugauccgagcaugauucgcggcucugugcccaaccagaugaugccucggaucacaccccaguccggccuuaaucaguucgggcagaugagcauggcccagccucccauugucccgagacaaaccccuccccugcagcaccauggacagcucgcucagcccggcgcccugaacccucccaugggguauggaccucgcaugcaacagccguccaaucagggccaguuucugccccaaacacaguucccuucucaggggaugaacgugaccaauaucccccuugccccuagcuccggacaagcucccguuucucaggcgcagaugagcuccucuagcuguccggugaacuccccuaucaugcccccuggcagccagggcucucacauucacugcccccaacucccucagcccgcccugcaucaaaauuccccgagcccuguccccucucggacacccacgccucaccauaccccgcccuccaucggggcucagcaaccucccgccacaaccauuccugcccccgugccuacaccgcccgcuaugccucccggaccucagagccaggcccugcaucccccucccagacagacccccacgcccccuaccacacaacucccccaacaggugcagccuucucugccggcggcucccuccgccgaccaaccucagcagcaaccccgcagccagcaguccaccgccgcuagcguuccuacacccaccgccccgcuucugccuccccagccugcgacgccccucucucaaccugcugucagcaucgagggccagguguccaaucccccgucuacaagcuccaccgaagucaauucucaggccauugccgagaagcagccuagccaagaagucaaaauggaggcuaagauggagguggaucagcccgaacccgccgacacacagccugaggauaucuccgaaucuaagguugaggacuguaaaauggaaagcaccgagaccgaggaacgguccacagagcugaagacggaaaucaaagaggaggaagaucagccgagcaccucugcuacacaauccagccccgccccugggcagucuaagaaaaagauuuuuaagcccgaggaacugagacaggcgcuuaugccuacccucgaggcccuguaccgccaagaccccgaaucccugccuuuccggcagcccguggauccgcagcuccugggaaucccugacuauuuugacauugucaaaagccccauggaucuuuccacaaucaagagaaaacuggacaccggccaguaccaagagccuuggcaguauguggaugacauuuggcucauguucaacaaugcuuggcuguacaaccggaagacgucucgcguuuauaaauacugcagcaagcuguccgagguguuugaacaggagaucgaucccgucaugcagagccuuggguacugcuguggaagaaagcucgaguucucuccgcaaacacugugcuguuauggcaaacagcugugcaccauuccucgggacgccaccuacuauuccuaccagaauagauaucacuuuugugagaagugcuucaacgaaauccagggcgagagcgugucucucggggaugaccccagccaaccccagacaaccaucaacaaagagcaguucuccaagcgcaaaaaugauacacuggacccugaacuuuuuguugaguguacggaaugcggacggaagaugcaucaaauuugugugcugcaccaugagaucauuuggcccgcuggcuucgucugcgaugggugucucaaaaagucugccagaacccgcaaggaaaacaaauuuagcgccaagagacugccuuccacacggcugggaaccuuccuugagaaucgcgugaacgacuuucugagacggcagaaucacccggagucuggcgaagugacaguccgcguugugcaugcuagcgauaaaaccguggaggucaagcccgggaugaaagcgagauucguggacuccggagaaauggccgagagcuuuccuuaccggacgaaggcucucuucgccuuugaggaaaucgacggcguugaucugugcuucuuuggcaugcacgugcaggaguaugggucugacugucccccucccaaccagcgcagagucuacauuuccuaccucgauagcgugcacuucuuucggccuaagugucugcgcaccgccguuuaucaugaaauccuuaucggauaccuggaguaugugaaaaagcucggcuacacaaccgggcacauuugggcuugcccgcccuccgaaggagacgauuauaucuuccauugucacccucccgaccagaaaauuccuaagcccaaaagacugcaggagugguacaagaagaugcuggauaaagccgucucugagcggaucgugcaugacuauaaggauauuuucaaacaggcgacagaagacagacuuaccagcgcuaaggagcugccguacuuugaaggcgauuucuggccuaauguucucgaggaauccaucaaagagcuggagcaggaagaggaagaacgcaagcgggaagagaacacaucuaaugagagcaccgacgugacgaagggggauuccaaaaacgccaagaaaaagaauaacaaaaagacaagcaaaaauaagucuucccucagcagaggaaacaagaaaaagcccggcaugcccaaugucucuaacgaccugucccaaaaacuuuacgccaccauggaaaagcacaaagagguguuuuucgugauccgccugauugcuggcccugccgcgaauagccugcccccuaucgucgacccggauccccugauuccuugcgaccugauggaugggcgggacgcuuuucuuacccuggccagagauaagcaccucgaguucucuagccugcgccgggcccagugguccacaauguguaugcucguugagcugcauacccagucucaggacagauuuguguauacgugcaacgaguguaagcaccauguggaaacacgcuggcacugcaccgucugugaggauuacgaccuuugcaucacauguuauaacaccaaaaaucacgaucauaagauggaaaaacugggacugggccucgacgaugagagcaacaaucaacaggcugccgcuacacagucccccggggacagccggagacuguccauucagcggugcauccaaucucuugugcacgccugccagugucgcaacgcgaauugcagccugccuuccugucagaagaugaaaagaguugugcaacauaccaagggaugcaagcggaaaacgaacggcgggugucccaucugcaagcagcucauugcccuguguugcuaccacgcuaaacauugucaggaaaauaagugcccggucccuuucugucucaacaucaaacagaagcugcgccaacagcagcuucagcacagacugcaacaggcccagaugcugcggagacgcauggcuucuaugcagcggaccggagugguuggccaacagcagggccuccccagcccuacacccgccaccccgacaaccccuacggggcaacagcccacaacaccccagacaccucagcccaccucccaaccucagccgacacccccuaauucuaugcccccuuaucugcccagaacacaggccgcuggaccugugagccagggcaaggcggccgggcaagucacgccgcccaccccuccccagacagcucagccuccccuuccgggaccuccgcccgccgccguggagauggcuaugcagauucaacgcgccgcggagacccagcggcagauggcucacguccagaucuuucaaagaccuauucagcaucagaugcccccuaugacaccgauggcccccaugggcaugaacccucccccuaugacccgcgggcccuccggacaccuggaaccgggcaugggcccuacggggaugcaacagcagcccccuuggagccagggaggccucccccaaccucagcagcugcagucugggaugccccggccggccaugauguccguggcucaacauggacagccccucaauauggccccucagcccggccuggggcagguuggcaucagcccucuuaaaccgggaacagugucucaacaggcgcugcagaaccugcucagaacccugcgcucccccagcucuccucuucaacagcagcagguccuguccauucuccacgccaauccccaacugcucgcugccuucaucaagcagagagcugccaaauacgcuaacagcaauccucagcccaucccuggccagcccgggaugccgcaaggacagccuggccugcagcccccuaccaugcccgggcagcaaggagugcacuccaacccggccaugcagaacaugaauccuaugcaggcgggcguucaacgggccgggcuuccccagcagcagccccaacagcagcugcagccucccaugggcggaaugagcccucaagcucagcagaugaacaugaaucauaacacaaugccgucucaguuucgcgacauucugagacggcaacagaugaugcagcagcaacagcagcaaggcgccgggcccggaaucggcccugggauggcuaaucacaaccaguuccagcagccccaaggagugggcuauccuccccagcagcagcaacgcaugcagcaucacaugcagcagaugcaacaggggaauaugggccagauuggacaacucccgcaggcccugggcgccgaggcuggggcgagccuucaggccuaccagcaaagacugcuccagcagcagaugggauccccuguccaacccaacccuaugucuccccagcagcauaugcugccuaaucaggcucaaagcccccaccuccagggccagcagaucccgaacucccucucuaaucaagugcggagcccccagccugugcccuccccuagaccccagucucaaccuccgcacagcucccccagcccucgcaugcagccccagccuucuccccaucacguuuccccgcagaccagcucuccucaucccgggcuugucgccgcccaagcuaacccuauggaacagggacacuuugccucccccgaucagaauagcaugcugucccagcuggcgucuaacccgggcauggccaaucuccacggcgcuagcgccacagaccuggggcuuuccacggauaacagcgaccugaacucuaaucucucccaaagcacccuggauauucauuga

SEQ ID NO: 68866 - RNA, 9372 nt, Artificial Sequence
  derived and/or modified sequence opt5 from EP400__Homo_sapiens__NP_056224
augcaccacggcaccgggccccagaacgugcaacaccagcugcagagaagccgggccugcccuggaagcgagggcgaggaacagccggcucaucccaauccucccccuucucccgccgcgccuuucgcuccgagcgccucccccucugccccucaaagccccuccuaccagauccagcagcucaugaacagaucuccugcuaccgggcaaaaugucaacauuacgcugcagagcguuggacccguggugggcgggaaucagcagaucacccuugccccgcugccucuccccuccccuacaagccccggauuucaauucucugcucagcccagacgguuugaacacggcuccccuagcuauauccaggugaccucuccgcugucccaacaggugcagacacagagccccacccaaccuucucccggcccugggcaggcccuucagaacguucgcgccggagcccccggcccggggcugggacucuguuccagcuccccuacaggcggguucguggacgcuucuguccuggugagacagaucagccugucccccagcucuggaggccauuuuguuuuccaagauggcuccgggcucacccagauugcccagggagcucaggugcaacugcagcacccuggcacgcccaucaccguccgggagcgcagaccuagccagccccacacacagucugggggaaccauccaucaccuuggcccgcaaagcccugccgccgccgggggagcuggccugcagccccucgccucccccucucauauuacaaccgcuaaucugccuccgcagaucagcuccauuauccaaggccagcuugugcagcagcaacaggugcugcaggggcccccucucccccggccucugggauuugaacgcacgcccggcguccugcucccuggggccggaggcgccgcuggguucggcaugacauccccgcccccucccaccucuccuuccagaacagcgguucccccgggacugagcucucuuccucugaccuccgugggcaacaccgggaugaagaaagugcccaagaaacucgaggagauuccucccgccagccccgaaauggcucagaugcggaagcaaugccuggacuaccacuaucaggagaugcaggcccuuaaagaagucuuuaaggaguaccugaucgaacucuucuuucugcagcacuuccaaggaaauaugauggauuuucuggccuucaagaaaaagcauuaugcuccucuccaggccuaccugcgccagaacgaccuugauauugaagaggaagaggaagaggaggaagaggaagaggaaaaauccgaggugaucaaugacgagcaacaggcgcuggcuggcucucucguugccggggccggaagcacaguggaaacggaucuguucaagagacagcaggcuaugccguccaccggcauggccgagcaaucuaaacggccccgccuugaagucgggcaccagggcgugguuuuucagcauccuggagcugacgccggcgugccccugcagcaacucaugccuacagcgcaaggcgggaugcccccuaccccgcaggccgcucagcuggccgggcaaagacagagccagcagcaauaugaucccuccacagggccucccguccagaacgcugccagccugcacaccccucucccccagcugccgggacggcuuccucccgcgggcgugcccacggccgcucugucuuccgcccuccaauucgcucagcagccucaggucguggaggcccaaacacagcugcagauccccguuaagacccagcaaccuaaugugccgauucccgccccucccagcucucagcugccuauucccccgucccagccugcucagcuugcgcuccauguccccaccccugggaaggugcaaguucaggccagccagcugucuagccugccccaaaugguggcuuccacaagacucccugucgaccccgccccgccuuguccccgcccccugccuaccagcucuacauccagccuugccccgguguccggcucuggacccggcccuagccccgcucgguccucuccugugaacagacccagcuccgccacgaauaaagcgcugucuccuguuaccagccgcacaccgggggucguggcuuccgcccccaccaagccucagagccccgcccagaacgcuacaucuucccaggauagcucucaagacacccucacggaacagauuacccuggagaaccaggugcaccagcggaucgccgagcugagaaaagcgggacuuuggucccaacgccggcucccuaagcugcaggaagcucccagaccgaaaagccacugggauuaccugcucgaggaaaugcaguggauggccacagacuuugcccaggagcgccgguggaaggucgcugccgcuaaaaagcuggugagaaccguugugcgccaucacgaggaaaagcaacuucgggaggaaagaggcaaaaaggaggaacagucucggcugcgcagaauugccgcguccacagcccgggagaucgagugcuucuggagcaauaucgaacaggucguggagauuaaacucagaguugaacuggaggaaaagcgcaaaaaggcucugaaccuucagaaggugucccggagagggaaagagcuccgcccuaagggauuugacgcccugcaagagagcucucuggauagcggcauguccgggagaaaacggaaggcuucuaucagccucaccgacgaugaagucgacgaugaggaagagacgauugaagaggaggaagccaaugagggcgugguugaccaucagacagaacuguccaaccuugccaaagaggcugagcugccccuccuggaucugaugaaacuuuacgaaggagcguuccuccccucuagccaguggccucgccccaagccugacggcgaggauaccuccggggaagaggacgccgaugacuguccgggagacagagaaucucggaaagaucuggugcugaucgacagccucuuuauuauggaucaauucaaggcugccgagcgcaugaauaucggcaaacccaacgccaaggacaucgcugaugucacagccguggcggaggcuauucugccuaaaggguccgccagagugaccaccagcgucaaguuuaaugcccccucucuucuguauggagcucuccgggacuaccagaagaucggccuggauuggcuggccaaacuuuaucgcaagaaccugaauggcauucucgcggacgaagcugggcugggaaaaacaguucagaucauugccuucuuugcccaccucgcuugcaacgagggcaauugggggccucaccuggugguggucagauccuguaacauccuuaagugggaacuggagcucaaacgguggugccccggacugaagauucugagcuacaucggcucucaucgcgaacuuaaagccaagagacaggagugggcugagccgaauagcuuccacguguguaucacgagcuauacccaauuuuuccgggggcugacagccuucaccagaguucgcuggaagugccucgugauugaugaaaugcagcgggucaaaggaaugacagagagacauugggaagcgguguuuacccugcagucccagcaacgccuccugcuuaucgacucuccucugcacaacacguuccucgagcuguggacaaugguucauuuucuggugcccggcauuagccggccuuaccuuuccagcccccugagagccccuucugaagagucccaggauuauuaccacaaggucgugauccgccuccaccggguuacccagcccuucauucugagacgcaccaaacgggacguggagaagcagcucaccaagaaguacgaacauguccugaaguguagacuuagcaaucggcaaaaagcucuguaugaggaugugauccugcagccgggcacccaggaagcccucaagucugggcacuuugugaacguccugagcauccuuguucgccugcaaagaauuugcaaccauccuggacucguggagccccggcaccccggcuccucuuacguggcugggccucuggaguauccgagcgccucccucauccugaaagcccuugaacgcgacuucuggaaggaggcugaccugucuauguuugaucugauuggacucgaaaauaaaaucacaagacaugaggcggaacugcuuagcaagaagaaaauuccccggaagcugauggaggagaucuccacgagcgccgcuccugccgccagacccgcugccgcgaaacucaaggcuucucgccuguuccagccuguccaguacggccagaaacccgaagggcggaccguggccuuuccuuccacacaucccccgagaaccgccgcuccuacaaccgccagcgcggcgccccaaggaccucuccgcggccggcccccgaucgcuacguucuccgccaacccugaggcuaaggccgcugccgcgcccuuucagaccucucaggccagcgcuuccgcccccagacaccagccugcuucugccagcuccacagccgcuagccccgcgcauccugccaagcugcgcgcucaaaccacagcccaggccucuaccccgggccagcccccuccccagccucaagcucccucccacgccgcggggcagagcgcccuuccucagcggcugguucugccgucucaagcucaggccagacuccccuccggagaaguggucaaaauugcucagcuggccagcaucacaggcccucagucucgcguggcgcaacccgagaccccuguuacgcuucaguuccaggggagcaaguuuacacugucccauucucagcucagacaacugaccgccggacagccccuccagcugcagggcagcgugcuucaaauugucuccgcuccggggcagccuuaucugcgggcccccggacccguggucaugcagaccgugagccaggcuggcgccguucacggcgcucugggguccaaaccucccgccggaggcccuucuccggcgccccucacaccucaaguggggguccccggacgcguggccguuaaugcucuggccgugggcgaaccugggaccgcuagcaagcccgccuccccgaucggaggcccuacgcaggaggagaaaacaagacuucugaaggaacggcucgaccagauuuaccuggucaacgagcgcagaugcucucaagcccccguguauggccgggaucugcucagaaucugugcgcuuccuagccacgggcgcgugcaguggcggggaucccuggacggcagacgcgggaaagaagcuggacccgcccauucuuacaccagcuccagcgagucuccguccgaacugaugcucacacugugccgguguggcgagagccuucaggauguuaucgacagagucgcuuucgugauuccucccguggucgccgcgcccccuucucugcgggugccccgcccuccgccccucuacucccacagaaugcggauccugcgccaggggcugagagagcaugcugccccuuauuuccaacagcuccggcagaccacagcgccccgccuucugcaguuuccugaacugagacucguucaauucgauagcggaaagcuggaggcccuugcuauucugcuccagaagcugaaaucugaaggccggcgcgugcugauccucucccagaugauucuuaugcuggacauccuggagauguuucucaauuuccacuaccugaccuaugucagaauugaugagaacgccagcuccgaacagcggcaagagcuuaugcgcagcuuuaaucgcgaccggagaaucuucugcgcuauccugucuacgcauagccgcaccacaggcauuaaccucguggaagccgauaccguuguguuuuacgacaaugaucugaaccccgucauggacgcgaaggcccaggaguggugugaccggaucgggagaugcaaagauauucacaucuaucgccugguguccggaaauucuauugaagagaagcuccuuaaaaacggcacaaaggaccugauccgggagguugcugcccaggggaaugauuacagcauggcuuuccugacccaaagaacgauccaggaacucuuugagguguauuccccuauggacgaugccggauucccggucaaggcugaagaguuuguggugcugucucaggaacccagcgucacagagaccauugccccuaaaaucgcgcgccccuucauugaggcccuuaaguccaucgaauaccuggaggaagacgcucagaaaucugcccaagagggcguucucgggccucacacagaugcucugagcuccgacagcgaaaacaugcccugugaugaggagccgucucagcuggaggaacucgccgacuucauggaacagcuuaccccuauugagaaguacgcccugaauuaucuggagcucuuucauaccuccaucgaacaggagaaagaacggaacagcgaggaugcggugaugacagcugugagagccugggaguucuggaaccugaagacgcuucaagagcgcgaggcccggcugagacucgaacaggaggaagcugagcugcugaccuacacacgcgaagacgccuauucuauggaguacgucuaugaggacguggauggacagaccgaaguuaugccccucuggacacccccuacacccccucaggacgauuccgacaucuaccuugauagcgugaugugccugauguaugaggcuacgccgauucccgaagccaagcugccucccgucuacgugagaaaagagcggaagcgccacaaaacagacccuuccgcggccggcagaaagaaaaagcaacggcauggcgaagcuguugugcccccgagaucucucuuugaucgggccaccccugggcugcuuaagauccgcagagagggaaaagagcagaagaaaaauauucugcucaagcagcagguccccuucgcuaaaccucugcccaccuuugccaagccuacagcggaacccggccaagacaacccggaguggcugaucagcgaagauugggcccuccuucaggcugugaagcagcugcuggagcucccccugaaucuuaccauugucuccccugcccacacacccaacugggaccuggugagcgauguugucaauucuuguucccggaucuaccgcagcucuaaacaaugcagaaaccgguaugagaaugugauuaucccucgcgaagagggaaagagcaaaaacaauagaccgcuccggacgucccagaucuacgcucaggacgaaaacgccacccacacacagcuguauaccucucauuucgaucugaugaagaugacagcuggaaaacgcucucccccuauuaagccccuccuuggcaugaauccuuuucagaaaaaccccaagcacgccuccguccuggcggaguccgggaucaauuacgacaagccucugcccccgauucagguugccagccucagagcugaacggaucgccaaagagaagaaagcccuggcugaccagcagaaggcccaacagccugcgguggcucagcccccucccccgcagccucaaccgcccccucccccucagcagccgcccccuccccuuccucaaccccaggccgccggcucccagccgccugcuggacccccugccgugcagccccaaccucagccccagccgcagacccaaccccagccuguccaggcucccgccaaagcgcagccugccauuacgaccggcgggagcgcugccgugcuggcuggaacaaucaagaccucuguuacaggcaccuccaugcccacaggggccgugagcggaaacgucaucgugaauacgauugcgggcgucccugccgcuaccuuccaauccaucaacaagcgccucgccucuccgguggcucccggggcccugacaaccccuggcggaagcgcccccgcucagguugugcauacccagccucccccgagagcggucggcuccccugccacagcuacgcccgaucuggugucuauggccaccacacaagggguucgggccgugaccagcgucacagcuuccgccguggugaccacgaaccucacaccuguucagacccccgcgcgcagccuugucccccaggugucucaggcuaccggagugcaacugccuggcaaaacaauuacccccgcccacuuucagcugcucagacagcagcaacagcagcagcaacagcagcagcaacagcagcaacagcagcagcaacagcagcagcaacagcagcagcaacagcagcaaacaaccacgacaucccagguccagguuccccagauccaagggcaggcccagagcccugcucagauuaaggccgugggaaaacugacccccgagcaucuuaucaagaugcaaaaacagaagcugcagaugccuccgcagcccccucccccucaagcucagucugcgcccccucagccgacagcccaggugcaaguccagaccucccagcccccucaacagcagagcccccagcucacgaccgugacagccccucggcccggcgcucugcugaccgggacaaccguugccaaucuccaaguggcuagacugacacgcgucccgaccucucagcuucaggcccagggccaaaugcagacgcaggcgccccagccugcccaaguggcucuggccaagcccccuguuguguccguccccgcugccguggugagcucuccuggagucacaacccucccgaugaacguugccggcaucagcguggcuauugggcagccccagaaagcggccggacaaaccguggucgcucagccugugcacaugcagcagcugcuuaagcugaaacaacaggccguucagcagcaaaaggccauccagccccaggcugcccagggcccugcggcugugcaacagaaaauuacagcccagcagaucaccacacccggggcccaacagaaggucgcuuaugccgcucagccggcccucaagacgcaauuccugaccacaccuauuucccaggcgcagaaacuggccggagcucagcaagugcagacccagauccagguugccaagcucccccaagugguccagcagcagacaccuguggcuagcauucaacagguugccuccgcgucucagcaagccagcccccagaccguggcucugacgcaggccaccgcugccggccagcaaguccagaugaucccugccgugacagcuaccgcgcaggucgugcagcaaaaacuuauccagcagcagguugugacaaccgccuccgcuccccugcaaacgccgggcgcccccaauccugcccagguccccgcuucuagcgacuccccuucucagcaacccaagcuccagaugcgggugccggccgugagacugaaaacaccuaccaagcccccuugucaguga

SEQ ID NO: 68867 - RNA, 2613 nt, Artificial Sequence
  derived and/or modified sequence opt5 from EPAS1__Homo_sapiens__NP_001421
augaccgccgacaaggagaaaaagagaagcuccucugaacggcgcaaagaaaagagcagagaugcugcccggugccgcagauccaaagaaacagagguguucuacgaacuggcgcacgagcucccccugccucauucugucagcucccaccuugacaaggcuucuaucaugcggcuggccauuagcuuucuccgcacgcauaagcugcuuuccagcguuuguucugagaacgaauccgaggccgaagcugaucagcaaauggacaaucuguaucucaaagcccuggagggcuucaucgcuguggugacccaggauggggacaugauuuuucugagcgagaacaucucuaaguucaugggacucacacaggucgaacugaccggccacuccauuuuugauuucacacauccgugcgaccacgaggaaaucagagagaaucuuagccugaaaaacgggucuggauuuggcaagaaauccaaggauaugagcaccgaacgggacuucuuuaugcgcaugaaguguacagugaccaauagagggcggacgguuaaccucaaauccgccaccuggaaggugcugcacugcacaggacaggucaaaguguacaauaacugucccccucauaauucucuuugcggcuauaaggagccccugcucagcugucugaucauuaugugcgagccuauccaacaccccucccauauggauauuccucuggacagcaaaaccuuccucucucgccacuccauggauaugaaguuuacauacugugacgacagaaucaccgaacugauuggcuaucacccggaggaacuucuggggcggagcgcguacgaguucuaucaugcccucgauucugaaaacaugacgaaaagccaccagaaucugugcacaaagggacagguuguguccggccaguaccgcaugcuugcuaagcaugggggauacgucuggcuggagacccaaggcacagugaucuauaaccccagaaaucuccagccucaguguauuaugugcgugaacuacguccugucugagaucgaaaagaaugacguuguguuuagcauggaucagaccgagucccuguucaagccccaccucauggccaugaacagcaucuucgacucuuccgggaaaggagcugugagcgaaaagucuaacuuucuguucaccaaacuuaaggaggaaccugaggagcuggcccaacucgcgcccacaccgggcgaugccauuaucucccuggacuuuggcaaucagaacuucgaagagagcuccgcuuaugggaaggccauucuuccucccucucagccuugggcuacggaacugcggagccauuccacccaaucugaggccggaagccuccccgccuuuacagucccccaggcugcggccccuggcuccaccacaccgagcgcuaccucuuccucuagcuccugcagcacgcccaauucuccugaggauuacuauacaagccuggacaacgaucugaaaaucgaagugauugagaaacucuucgccauggacaccgaagccaaagaucaguguuccacccagacagacuuuaaugagcuggaccuugaaacccuggcucccuacaucccuauggauggggaggacuuccaacucagccccaucugcccggaggaaagacugcuggccgagaacccucagucuacaccccagcacuguuuuuccgcgaugacgaauauuuuccagccucuugcucccguugccccucacagccccuuucuccuggauaaguuccaacagcagcuggaauccaaaaagaccgagccggaacaucgcccuaugucuagcaucuuuuucgacgccggauccaaggcuucucucccucccugcuguggccaggccagcacaccccuguccucuaugggagggcggagcaacacccaauggccgcccgauccuccccuucacuucggcccuacaaaaugggcugugggcgaccagagaaccgaguuucugggggccgcgccccucggaccucccgucuccccgccucaugugagcacguucaagacccgcucugccaaaggcuuuggggcucggggacccgauguucuguccccugccaugguggcucugagcaauaaacuuaagcucaagagacagcuggaguaugaggagcaggccuuccaagaccugucuggcggggaucccccgggcggauccacaagccaccucauguggaagcgcaugaaaaaccugcggggcgggucuugcccucuuaugcccgacaagccucuguccgcgaauguccccaacgauaaauuuacccagaaucccaugagaggacucggccacccucugcgccaucugccgcuuccccagccucccagcgccauuuccccuggggaaaacagcaagucucgguuucccccucaauguuacgcuacacaguaccaggacuauagccucuccucugcccacaaagugagcggaauggcuuccagacugcugggcccgucuuucgagagcuaccuccugcccgaacuuacccgcuaugauugcgaggucaaugugccuguucugggguccucuacgcuccugcagggcggagaccugcuucgggcccucgaccaagccacauga

SEQ ID NO: 68868 - RNA, 2643 nt, Artificial Sequence
  derived and/or modified sequence opt5 from EPB41L1__Homo_sapiens__NP_001245258
augaccacagagacgggccccgacagcgaagugaagaaagcccaggaggaagcuccucaacagccggaggccgcggcugccgucaccacacccguuaccccugccgggcacggacaucccgaagcuaacuccaaugagaagcacccuucucagcaggauacaagacccgccgagcaaagccuggacauggaagagaaagauuacuccgaagcugacggccucucugagcggaccacaccuagcaaggcccagaaauccccgcagaagaucgcgaagaaauauaagucugccauuugccgcgugacccugcuugaugcuagcgaguacgaaugugagguggaaaaacaugggagaggacagguccuguucgaccucgugugcgagcaccugaaccuucuggaaaaggauuauuuuggccucacguucugugacgccgauucccagaaaaauuggcuggaccccagcaaggagaucaagaaacaaauucggucuuccccuuggaacuuugcuuucaccguuaaguuuuaucccccugaucccgcccagcugacagaggacaucacccgcuacuaccucugccugcagcuuagagcggauauuaucacagggcggcugccguguagcuucgugacccaugcccuccugggaucuuaugcuguccaagccgaacuuggcgacuacgacgcugaggaacacgugggcaauuacguuuccgagcugcgcuuugccccuaaccagacgagagaacucgaggagcggaucauggaacugcacaaaacauaucgcgggaugacccccggagaggccgaaauucauuuccuggagaaugcuaagaaacucagcauguacggcguggaucugcaccaugcgaaggacucugaagggaucgauauuaugcuuggagucugcgccaacggccugcucaucuauagagaccggcugcgcauuaauagauuugcuuggccuaaaauccuuaagauuuccuacaagcggagcaacuucuauaucaaaauccgccccggggaguacgagcaguuugaauccacaauuggauucaagcugcccaaucacagaucugccaaacggcucuggaagguguguaucgagcaccauaccuuuuucagacuggugagcccugaaccgcccccuaaaggcuuccuggucaugggcuccaaguuucgcuauagcgggcggacccaagcccagacaagacaggcuucugcccucauugaucgccccgcgccuuucuuugagcgguccagcucuaagagauacacgaugagccgcucccuggacggagcugaguucucucggcccgccagcguuuccgaaaaccacgaugccggcccggacggggauaaaagagacgaggauggagaaagcggcgggcagcgcucugaggcugaagagggagaggugcggaccccuacaaagaucaaagaacuuaagcccgagcaagaaaccacaccuagacauaaacaggaguuucuggacaagcccgaagacgugcuccugaagcaccaggccuccauuaaugagcuuaaacgcacccugaaggagccuaacagcaaacucauccaucgggauagagacugggaacgggagcgcagacugcccucuuccccggcuagcccuucccccaagggcacgcccgaaaaagccaaugagcgggcgggccugagagaagggucugaggagaaggucaagccuccgcgcccccgggccccugaaagcgauacaggagacgaggaucaggaccaagaaagagauaccguguuccucaaagacaaccaccuggcuaucgagcgcaagugcuccucuauuaccguuagcuccacaagcucucuugaggccgaaguggauuuuaccgucaucggcgacuaccacggguccgcuuucgaggauuuuagcagaucucugcccgaacucgaccgggauaaauccgacagcgacacagagggacugcuguucucucgcgaucuuaacaagggcgccccuagccaggacgaugaauccgggggcauugaggacagccccgauagaggagcguguucuacgccugacaugccccaguuugagccggugaaaaccgaaacaaugaccguuuccagccucgccauccggaagaaaauugagccugaagcugugcugcagacacgcgucuccgccauggauaauacccaaguggacggcucugcuagcgucgggagagaguucaucgccacgacccccuccaucacaaccgaaacaauuucuaccacgauggagaacagccugaaguccggaaagggcgccgcugcgaugaucccugggccccagacaguggccaccgagauucggucucucagcccgaucauuggaaaagauguucugacauccaccuauggcgcuaccgccgaaacacuuagcacgucuaccacaacccaugugacaaagaccgucaaagggggcuuuuccgagacgcgcaucgaaaagagaauuaucaucacaggagacgaggauguggaccaggaucaggcccuggcucucgccauuaaagaagcgaagcugcaacacccugacaugcugguuaccaaggcuguggucuaccgggagaccgaccccagcccugaggaacgcgauaaaaagccccaggagucuuga

SEQ ID NO: 68869 - RNA, 2022 nt, Artificial Sequence
  derived and/or modified sequence opt5 from EPB41L2__Homo_sapiens__NP_001129026
augaccacagaggugggcagcgucuccgaaguuaagaaagacucuagccagcuggggacggaugccaccaaggagaaacccaaggaaguggcugagaaccaacagaaucaguccucugacccugaagaggagaaaggaagccagccgcccccugccgcggaaucccaaucuagccucagacggcagaagcgcgagaaggaaacauccgagagcagaggcaucucucgguucauucccccuuggcugaaaaagcagaaauccuacacccuuguggucgcuaaggaugggggagacaaaaaggagcccacacaggccgugguugaagaacaagugcuggauaaggaagaaccucucccggaggagcagcgccaggccaaaggcgacgcugaggaaauggcccagaagaaacaagagaucaaggucgaagugaaagaggaaaagcccagcguuucuaaagaggagaagccuuccgugagcaaggucgaaaugcagcccaccgagcuggugucuaaagaaagagaggaaaaggugaaagagacacaggaggauaaacuugaagggggagcugccaagcgggagaccaaggaaguccaaacgaacgagcugaaggcggagaaagccucccagaagguuaccaaaaagacaaaaaccgugcagugcaaggugacacuccuggacggcaccgaauauagcugugaucuggagaagcacgcuaaaggccagguccucuuugacaaggugugcgaacaucugaaucuucuggagaaagauuacuucgggcuccuguuucaagaauccccugagcagaagaacuggcuugaccccgccaaagagauuaagcgccagcugagaaaucucccguggcuguucacguuuaacguuaaguucuauccucccgauccuucucagcugacagaagacaucacccgguacuuucucugucugcaacuucgccaggacauugcuagcggaagacugcccugcuccuucgugacacacgcccuccugggcagcuauacccuucaggcggagcugggggauuacgaccccgaggagcauggaucuaucgaucucuccgaauuucaguucgccccuacccaaacaaaagagcuggaggaaaaggucgcugagcugcacaaaacgcaucggggccucagcccggcccaggcugacucucaguuucuggaaaaugccaagcgccuuagcauguaugggguggaucugcaccacgccaaagacuccgagggaguugauaucaagcucggcgugugugcuaacggccugcuuauuuacaaagacagacugcggaucaaucgcuucgcguggcccaagauucucaagaucucuuacaaaagaagcaacuuuuauauuaagguccggccugccgaacuggagcaguucgaguccaccaucggguucaaacugcccaaucauagagcugccaagcgccucuggaaagugugcgucgaacaccauacauuuuaccggcuggugagcccugagcaacccccgaaggccaaguuccuuacccugggaucuaaauuuagauauuccggccgcacacaggcucagacccggcaagccagcacgcucauugauagaccugcgccccacuucgaacgcacaucuuccaagcggguuagcagaucccuggacggggcuccuaucggagugauggaucagucucugaugaaagacuuucccggcgccgccggggagaucagcgcuuacggaccuggccuugucuccauugccgugguucaggacggcgaugggcgccgggaggugagaucucccaccaaggcuccgcaccuccagcugaucgaaggaaaaaccgucaagggcgggauuagcgagacacgcaucgaaaagcggauugugaucaccggagacggcgauaucgaccaugaucaagcccuggcgcaggccauuagagaggcucgggaacagcacccugacauguccgugacacgcguugucgugcauaaagagacggagcucgccgaagagggggaagauuga

SEQ ID NO: 68870 - RNA, 2652 nt, Artificial Sequence
  derived and/or modified sequence opt5 from EPB41L3__Homo_sapiens__NP_001268462
augaccacagagagcggcuccgacucugaaagcaagcccgaucaggaggccgaaccucaagaggcugccggggcgcagggacgggcuggcgccccggugcccgaaccucccaaagaggagcagcagcaagcccuggaacaguucgcugccgcugccgcgcacuccacgccuguccggcgcgagguuaccgacaaggaacaggaguuugccgcuagagccgcuaaacagcucgaguaccaacagcuggaagaugacaagcugucucagaaaagcuccucuagcaagcugucccggagcccccucaagaucgugaaaaagccuaaaucuaugcagugcaaggugauucugcuugauggguccgaguauacaugugacgucgaaaaacgcagcagaggacaagugcuguucgauaagguuugcgagcaucucaaccugcuggaaaaggacuacuuuggccucaccuaucgggaugccgagaaucagaaaaacuggcuggacccggcgaaggagaucaaaaagcaagugcgcucuggggccuggcacuucuccuuuaaugucaaauucuaucccccugaucccgcucagcuuagcgaagacauuacaagauacuaccugugucuccagcugcgggaugacaucgugucuggacgccuuccuugcuccuuuguuacccuggcccuccugggcagcuauacagugcaguccgagcugggcgacuacgaucccgacgaaugugggucugauuacauuagcgaguucagauuugcuccgaaccauaccaaggaacucgaggacaaagucaucgagcugcacaagucccaucggggaaugacgccugccgaagccgagaugcacuuccuugaaaaugcuaagaaacugagcauguauggcguggaucuccaccaugcgaaggacucugaggggguggaaaucaugcugggagucugcgccuccggccuucugauuuaccgcgauagacuccggaucaaccgcuuugcuuggcccaaaguucugaagauuagcuauaaaagaaauaacuucuacaucaagauucggccuggggaguuugagcaguucgaaucuaccaucggauucaagcugcccaaucacagagccgccaaacgccucuggaagguguguguggagcaucacacauuuuuccggcugcuucugcccgaagcuccuccgaaaaaguuucucacccugggcagcaaauucagauauuccggccgcacacaagcccagacccggagagcgucugcucuuauugaccgccccgccccuuacuuugagcggagcuccagcaagagauauacgaugucucgcucccuggauggggccagcgucaacgagaaucacgaaaucuacaugaaggacucuauguccgcugccgaggugggaacaggccaguacgcuaccacaaaagggaucagccagaccaaccucauuaccacaguuacgcccgaaaagaaagccgaggaagagagagaugaggaagaggacaagagacgcaaaggagaagaggugaccccuaucuccgcgauucggcaugaaggcaagacagacucugagagaaccgauacagccgcugacggggagaccacggccacagaaagcgaucaagaggaagacgcugagcugaaggcccaggaacuggagaaaacccaggaugaccucaugaagcaccagaccaauaucuccgagcugaaacggacauuccuugaaaccucuacagauacggcggucaccaacgagugggaaaagcgccugagcacaucccccgugagacucgccgcucggcaagaggacgccccgaugauugagccucugguucccgaagagaccaaacagagcucuggagaaaagcugauggauggcuccgagaucuuuagccuucucgaaucugcuagaaaaccuacagaguucaucggcggggugaccuccacgagccagucuuggguccagaagauggagaccaagacagaaagcuccggaauugagaccgaacccacagugcaucaccuuccucugagcaccgagaaagucgugcaagaaacgguucucguggaggagcgccgggucgugcaugccucuggcgacgccuccuauagcgcuggggauuccggagacgcggccgcucagcccgccuuuacaggcaucaaggggaaagaaggcucugcccugaccgagggagcuaaggaagagggcggggaagagguugccaaagcggugcuugagcaggaagagacagcugccgccagcagagaacgccaagaggagcaguccgcugccauucacaucucugaaacccuggagcagaagccgcacuucgaaagcuccaccgucaagacagagacgauuucuuuuggaagcguguccccuggcggggugaaacucgaaaucagcaccaaggagguucccgucgugcauacagagaccaaaacaaucaccuacgaaucuucccagguggaucccggaacggaccuggagccuggcguccugaugagcgcgcaaacaauuaccucugaaaccacauccaccacaacgaccacacacaucaccaagacagugaaagggggcauuagcgagaccagaaucgaaaagcggauuguuaucacgggagacgcugauauugaccaugaucaggaguga

SEQ ID NO: 68871 - RNA, 2061 nt, Artificial Sequence
  derived and/or modified sequence opt5 from EPB41L4A__Homo_sapiens__NP_071423
augggcugcuucugugccgugcccgaggaauuuuacugcgagguccugcuccuggacgaaagcaaacuuacccugacaacgcagcaacaggggaucaaaaaguccaccaaaggaucuguugugcucgaucacguguuccaucacgucaaccugguggagauugacuauuuuggccuuagauacugugaucggagccaucagacauauuggcuggacccugcuaagacccucgccgaacacaaagagcugaucaauacagggccgcccuacacccuguauuucggaauuaaguuuuacgcggaggauccuugcaagcucaaagaagagaucacacgcuaucaguucuuucugcaaguuaagcaggacgugcuucagggcagacugcccuguccugucaacaccgcugcccagcucggggccuacgcuauucaauccgaacugggagauuacgaccccuauaaacauacggccggcuacgugucugaguaucgguucguuccugaucagaaggaggaacuugaggaagcuaucgagcgcauccacaaaacccugaugggccagauuccgagcgaagccgagcucaauuaccugagaacagcgaagucccuggagauguaugggguggaccuccaccccgucuacggagaaaacaagucugaguauuuucugggccuuaccccuguggggguggucguuuacaaaaauaagaaacaggugggaaaguacuucuggccccggaucacaaaagugcauuuuaaggaaacccaauucgagcugcgcguccucggcaaagauugcaacgaaacgagcuuuuucuucgaggccagauccaagacagcuuguaagcaccuguggaaaugcagcguggagcaucacaccuuuuuccggaugccugaaaaugagucuaacucccuuagccgcaagcugucuaaauuuggguccauuagauauaagcaccgguacagcggacgcacagcccuccagaugucuagagaccuguccauccagcugccccggccggaucaaaauguuacccgcagcagauccaaaaccuauccuaagcggauugcucagacacagcccgccgaaucuaacagcaucuccagaauuacggcgaauauggagaacggcgaaaaugagggcaccaucaagaucauugccccuagccccgugaaaucuuucaagaaagcuaagaacgaaaauucccccgacacacagcgcagcaaaucucaugccccuugggaagagaacgggccgcaaagcggacucuacaacucccccucugaccggaccaagagcccuaaguuucccuauacaagacgccggaauccuuccuguggcagcgauaacgacucuguccagcccgugagacgccggaaagcucacaauuccggggaagauagcgaccugaagcagagacgccggucuagaucccgcugcaacaccagcuccggaucugagagcgaaaauuccaaccgggaauacagaaagaagcggaaucgcaucagacaggagaacgauaugguugacucugccccgcaaugggaagccgugcuucggagacagaaagagaagaaucaggcugauccuaacaaucgccggagcagacaucgcuccagaagccggucucccgacauucaggcgaaggaggagcuguggaaacacauccaaaaggagcucgucgauccuuccggccugagcgaggagcagcuuaaagaaauucccuauacgaagaucgagacacagggggacccuauccgcauuagacauucucacagcccccgguccuaccgccaguacagacggucucaauguagcgauggagaacgcuccgugcugagcgaggucaacucuaaaaccgaccucgugccgccucugcccguuacccacuccagcgacgcccagggcuccggcgaugcuacagugcaucagagacggaaugggucuaaggacagccugauggaggaaaaaccccaaaccuccacaaacaaucucgccggaaagcacacggccaagaccaucaaaacaauucaggcuucucgccugaagaccgagacauga

SEQ ID NO: 68872 - RNA, 1557 nt, Artificial Sequence
  derived and/or modified sequence opt5 from EPB41L4B__Homo_sapiens__NP_060894
augcugagauuccuccggcgcaccuuuggcagacggagcaugcagcgcuacgccagaggggcugccggacggggcgcggcugggcugggagacgagcgcgauggcgggcccagaggaggcccugccgccgcugccuccucuagcgcccuuccggcugcgcccggcggguccguguucccugccggaggcgggccccugcucacaggaggcgcugccguccacaucucugcugccggggcggccaaggcuacgcuguauugccggguuuuucuucuggacggaaccgaagugagcguggaucucccuaaacaugccaagggccaagaccuguucgaucagauugucuaccaccuggaccucguggagacagauuauuuuggccugcaguuccuugacuccgcucagguugcccauuggcuggaucacgccaaacccaucaagaaacaaaugaagauugggccugcuuacgcgcuccauuuucgcgugaaguauuacucuagcgaaccgaacaaucugagagaggaguucacccgguaucuuuuuguccugcagcuccgccacgacauccuguccggaaaacugaagugucccuacgaaacagccguggagcucgcugcccugugccuucaggccgaacugggcgagugugaacucccugagcacacccccgagcugguuagcgaguucagauuuauuccuaaccagacagaagcuauggaguucgauaucuuucaacgguggaaagaaugccgcgggaagucucccgcccaggcggaacuuuccuaccugaauaaagcuaaguggcucgagauguauggaguggacaugcaugucgugagaggccgggaugggugugaguacagccugggacugaccccgacgggcauccucauuuucgaaggcgccaacaagaucgggcuguucuuuuggccuaaaauuaccaagauggacuucaaaaagucuaaacuuacacugguggucguugaggacgaugaccagggaagagaacaggagcacaccuuuguguuccgccucgauuccgcccggacaugcaagcaucuguggaaaugugcuguggaacaccacgccuuuuucagacuucgcacccccggcaauagcaagucuaaccgguccgacuuuaucagacuggggagccgcuuccgguuuuccggaagaacggaguaucaagcuacacauggcucucgccuccggagaaccagcacauucgagcgcaagccuuccaaacgguaccccagcagacggcacucuaccuuuaaggccuccaaucccgucauugcggcccagcugugcagcaaaaccaacccugaagugcauaauuaucagccgcaauaccaccccaacauccauccuucucagccccgcuggcacccucacagccccaauguuagaccguccuuccaggaugaccggucucauuggaaggcuagcgccuccggggaugacagccacuuugauuaugugcaugaccagaaccagaaaaaucugggcggaaugcaaucuaugauguacagagauaagcucaugacagcucuguga

SEQ ID NO: 68873 - RNA, 2076 nt, Artificial Sequence
  derived and/or modified sequence opt5 from EPB42__Homo_sapiens__NP_001107606
augggccaggcccuggggaucaagagcugcgacuuccaagcugccagaaacaaugaggaacaccauaccaaagcgcucuccucucggcgccuguuugugagacggggacagcccuucacaauuauccuuuacuuucgcgcuccugucagagccuuccugccggcccucaagaaaguugcucugacggcccagaccggcgagcagcccagcaagauuaaccggacacaagcuaccuuuccuaucuccucucuuggggaucgcaaaugguggagcgccgugguggaagagagagacgcgcaguccuggacaauuucugucaccacacccgccgaugcugugaucggacacuauagccugcuccugcagguuuccggccggaagcagcugcuccuggggcaauucacccuucuguuuaauccuuggaaccgcgaagacgccguguuccucaagaaugaggcucagagaauggaguaccugcuuaaccagaauggacugaucuaucucggcacggccgauuguauucaggcggaaagcugggacuuuggccaauucgagggggaugucaucgaccugucucugcggcuccuguccaaagauaaacagguggaaaaguggagccagcccguucauguggcccgcguccuuggagcucugcuccacuuucugaaggagcaaagagugcuuccuaccccgcagacacaggccacccaggagggcgcucugcucaacaaacggcgcgggucugugcccauucugagacaauggcugacaggacggggcagaccugucuacgacgggcaggccuggguucucgccgcuguggcgugcaccgugcugcgcugucuuggaauccccgcccgggucgugacgacauucgcuuccgcccagggcaccggcgggagacugcucauugaugaauauuacaaugaggaaggacugcagaacggcgaggggcaacgcggacggaucuggauuuuucagacaagcaccgaaugcuggaugaccagaccugcccuuccccagggcuaugacggguggcagauccugcauccgucugcuccuaauggaggcggcguucucggguccugugaucuggugcccguccgcgccgugaaggagggaacacugggccucacgccugcgguuagcgaccuguucgcugccaucaacgccuccugcguggucuggaaguguugcgaggacgggacccuugaacugacagauucuaauaccaaauacgugggaaacaauauuagcacaaagggcgucggguccgaccggugugaggauaucacccaaaacuacaaauaucccgaaggcagccuccaggagaaggaagugcuggagagaguugagaaagaaaagauggagcgcgaaaaagacaacggcauucggcccccuucucuggagacggcuuccccgcuuuaccuccugcugaaggcccccagcucucucccucugagaggagaugcucagaucagcgugacacuugucaaucacuccgaacaggagaaggccgugcaacuggcgauugggguucaggccgugcacuauaacggaguccucgcugccaaacuguggcgcaagaaacugcaucuuacccucucugcuaaucuggagaagaucaucaccauuggccuguucuuuagcaacuucgaacggaaucccccugagaacacauuucucagacugaccgccauggcgacacacuccgaaagcaaucuuucuugcuucgcccaggaggacaucgcuauuugucggccccaucuggccaucaaaaugccggagaaggcugaacaauaccagccucucacggccuccgugagccugcagaacucucuggaugcccccauggaggacugcgugauuuccauccuugggcgcggacucauccacagagaacggagcuauagauuucgcuccguuuggccugagaauaccaugugcgcuaaguuccaguuuacacccacccacgucggccugcaacggcugacaguggaaguggauuguaacauguuccagaaucucaccaacuacaaaucugucacggugguugcgccugagcugagcgccuga

SEQ ID NO: 68874 - RNA, 2442 nt, Artificial Sequence
  derived and/or modified sequence opt5 from EPC1__Homo_sapiens__NP_001258933
augagcaagcuguccuucagagcccgggcucucgacgccucuaaaccccugccuguguuucgcugcgaggaucuuccggaccugcacgaauacgcgagcaucaacagagcugucccccagaugccuaccggcauggagaaggaagaggaauccgagcaucaccuccaacgggccauuucugcccagcagguuuauggggagaaacgcgauaauauggugauccccgugccugaagcugagagcaacauugccuacuaugaauccaucuaccccggagaguucaagaugccuaaacagcugauucauauccaaccguuuucucuugacgcugagcagcccgauuaugaccuggauagcgaagacgaggucuucgugaauaagcucaagaaaaagauggauaucuguccucugcaguuugaagagaugauugacagacuggaaaaaggcuccgggcagcaacccguuagccuccaggaggccaagcugcuucugaaagaggaugacgaacucauccgggagguguacgaauauuggauuaagaagcgcaaaaacugcagaggaccuucucugauccccuccgucaagcaggagaaacgggauggcagcucuacaaaugacccguacguggcguuccgcagacggacggaaaagaugcagacccgcaaaaacagaaagaaugacgaggccuccuacgagaaaaugcuuaagcugcggcgcgaucucagcagagcuguuacaauucuggaaaugaucaagcggagagagaaaucuaagcgcgaacugcuccaccugacccuugagauuauggaaaaacgguauaaccugggggacuacaauggagagaucauguccgaggugauggcccaaagacagccuaugaagcccacauaugcuaucccuauuauccccauuaccaacagcucccaguuuaaacaucaagaagccauggaugucaaggaguucaaggugaauaaacaggacaaggcggaucucauccgccccaaacggaaguacgaaaagaaaccuaaggugcugccgucuagcgccgcugccacaccccagcagaccuccccugcugcccuucccgucuuuaacgccaaagaccugaaucaauaugauuucccuagcucugacgaggagccccucucccagguucugagcggcucuagcgaagcugaggaagauaacgacccggauggcccuuuugcguucagacgcaaggccgggugucaguacuaugcuccccaccuggaccagacgggaaauuggccuuggaccucccccaaagacggcgggcucggagaugugcgguacagauacugccugacaacccuuacagugccucaacgcuguauuggcuuugcccggagacgcgucgggcggggaggcagagugcugcucgaccgggcccacucugauuaugacagcguuuuccaucaccuggaucuugagaugcuguccagcccccagcauucuccggugaaccaguucgcuaacaccuccgaaacgaauacaagcgacaagucuuuuuccaaagaucucagccagauccuggucaacaucaaguccugccgcuggagacacuuccggccuagaacccccucucugcacgacagcgauaaugacgagcucuccugucgcaagcuguaccggucuauuaacagaacaggcaccgcccaacccgggacccagacaugcagcacguccacccagagcaaaucuuccagcggaucugcgcauuuugcuuucacagccgagcaguaucaacagcaccagcaacagcuugcccugaugcagaagcagcaacucgcucagauccagcagcaacaggccaauuccaacagcucuaccaauacaagccagggcuuuguguccaaaacccuggauagcgcuucugcccaguucgcggccuccgcucugguuacgagcgaacaacuuaugggguuuaagaugaaagacgaugugguccucggaauuggcgugaacgggguccugccugccuccggaguguacaagggccugcaucucucuagcacaaccccgaccgcucugguucacacaucccccucuaccgccggcagcgcgcuucugcagccuuccaauaucacacagacgucuagcucccauagcgcccucucucaccaagugaccgcugccaacuccgcuacaacccagguccugauugggaauaacauccgccugacagugcccagcucuguugccaccgucaauuccaucgccccuauuaacgcuagacacaucccccggacgcuuagcgcggugccuucuuccgcccucaaacuggcugccgccgcuaauugucaggugagcaaggugcccuccagcucuagcguugacuccgucccgcgcgagaaccaugaaucugagaagccugcccugaacaauauugcggacaacaccguggcuauggaagugacauga

SEQ ID NO: 68875 - RNA, 2424 nt, Artificial Sequence
  derived and/or modified sequence opt5 from EPC2__Homo_sapiens__NP_056445
augagcaagcuguccuucagagcccgggcucucgacgccgcgaaaccccugccuaucuaccgcggcaaggauaugccggaccuuaacgauugcgugucuauuaauagagcugucccccagaugccuaccgggauggagaaagaagaggaaagcgagcaccaucugcaacgggccaucuccgcccagcagguuuuucgcgaaaagaaagagucuauggugauucccgugccugaggcugaaagcaacgucaauuauuacaacagacucuauaagggagaguucaagcagcccaaacaauuuauccacauucagccuuucaaucuggacaacgaacagccggauuacgacauggauuccgaggacgagacacuucugaaucggcucaaccgcaagauggaaaucaaaccccugcaguuugagaucaugauugauagacuggaaaaggccucuagcaaucaacucgugacgcugcaggaggcuaaacuucugcucaacgaagacgauuaucugaucaaggccguuuacgacuauugggugcggaagcgcaaaaauuguagaggcccuucccuuauuccccagaucaagcaggagaaacgggaugggagcaccaacaaugacccuuacgucgcguuccgcagacggacagagaagaugcaaacccgcaaaaacagaaagaaugacgaagccucuuacgagaaaaugcugaagcuccggagagaauuuucccgcgcuauuacaauccuggagaugauuaagcggagagagaaaaccaagcgcgaacugcuccaucugacacuugaggugguugaaaaacgguaucaccugggagauuacggcggggagauccucaacgaagugaagaucagcagaucugagaaagaacuguaugccacccccgcuacgcuucauaacggaaaucaccacaagguccaggagugcaagaccaaacauccgcaccaucugucccucaaggaggaagccagcgacguggugcgccagaaaaagaaauacccuaagaagcccaaagcggaggcccugauuacaucucaacagccuacccccgaaacacugcccgucaucaacaaguccgauauuaaacaguaugacuuccacagcuccgaugaggacgaguuuccucagguucucucuccggugagcgaacccgaggaagagaaugauccugacggccccugugcuuuccggagacgcgccggcugccaauacuaugcuccucggcuggaucaggccaaccacuccugugaaaauagcgagcuugccgaccuggauaagcucagauaccgccauugccugaccacgcuuacagugccccggagauguaucggguuugcucggcgcagaauuggacggggcgggagagucaucauggaccgcaucucuaccgagcacgacccggugcugaaacagauugauccugaaaugcucaacuccuucagcucuagcucccagacaaucgacuuuucuagcaauuucucccggaccaacgcgagcucuaagcauugcgagaauagacugucccugagcgaaauucucucuaacauccgcuccuguagacugcaaugcuuccagccccggcuucugaaucuccaggauagcgacuccgaggaauguaccucucgcaagccuggacagacaguuaacaauaaaagagugagcgccgcuuccgucgcccugcugaacacgucuaagaauggcauuagcgugaccgggggaaucacagaggagcaauuucagacccaccagcagcaacuuguucagaugcagcggcaacagcucgcccagcugcagcaaaaacagcagucccagcauagcucucaacagacacaccccaaggcucagggcuccagcaccucugauugcauguccaaaacgcuggacagcgccucugcgcacuucgcugccagcgccguggucuccgcuccugugcccagccgcucugaagucgccaaggagcagaacacaggccauaacaauaucaacggggugguucaaccguccggaaccagcaaaacccucuacuccacaaauauggcucugucuagcuccccuggcauuucugccgugcagcuugucagaaccguggggcacacaacgaccaaccaucugauccccgcgcucugcacaagcucuccccagacccugccuaugaauaacuccugucugacaaaugccguucaccuuaacaaugugagcgucguguccccggugaacguucacauuaauacccggacgagcgcucccucuccuaccgcccucaagcuggcuacagucgccgcguccauggaucgcgugcccaaggugaccccuagcucugccaucuccagcauugcuagagaaaaccaugagcccgaacggcugggacucaauggcaucgccgagacaaccgucgcuauggaggugacguga

SEQ ID NO: 68876 - RNA, 945 nt, Artificial Sequence
  derived and/or modified sequence opt5 from EPCAM__Homo_sapiens__NP_002345
auggcucccccucaggugcuggccuucggccuccugcuugccgcggcuaccgccacauuugccgcugcccaagaggaaugcgucugugagaacuacaagcuggcuguuaauugcuucgugaacaauaacagacagugucagugcacgagcgugggggcccagaauaccgucaucuguuccaaacucgcggccaagugccuggugaugaaagcugaaaugaacggaucuaaacuuggccggcgcgccaagccggagggggcucugcaaaauaacgacggacucuaugaucccgacugugaugaaagcggccuguuuaaggccaagcagugcaaugggacauccauguguuggugcguuaacaccgcgggagugagacggacagacaaagauaccgagauuacauguucugagcgcgucagaaccuacuggaucauuaucgaacugaagcacaaagcccgggagaagccuuaugacagcaaaucccuccgcacggcucugcagaaggaaauuaccacaagauaccagcuugaucccaaguucaucaccucuauccuguaugagaauaacgugauuacaaucgaccucguucaaaauagcucccagaaaacccagaacgauguggacauugccgaugucgcuuacuauuuugagaaggacgugaaaggcgaaagccuguuccauucuaagaaaauggaucuuacggugaauggcgagcagcuggaccucgacccugggcaaacacugaucuacuacgucgaugaaaaggcccccgaguuuuccaugcagggacugaaagccggcguuauugcugugaucguggucgugguuauugcgguggucgccgggaucgugguucucgugaucagccggaagaagcgcauggcuaaauaugaaaaggccgagauuaaagagaugggagaaaugcacagagagcugaacgccuga

SEQ ID NO: 68877 - RNA, 675 nt, Artificial Sequence
  derived and/or modified sequence opt5 from EPDR1__Homo_sapiens__NP_060019
augcccggcagagccccucugcggaccgugccgggggcucucggagccuggcugcuuggcgggcugugggcguggacacucugcggacuguguagccuuggcgcugucggggcuccccgcccuugccaggcuccccaacagugggagggaagacagguuauguaccagcaauccucuggccggaacagccgcgcccugcucuccuaugacggccugaaucagagagugcgggugcuggaugaacgcaaggcccucaucccuuguaaaagacuguucgaguacauucuucuguauaaggacggggucauguuucagaucgaucaggccacgaaacaaugcucuaagaugacccucacacagcccugggacccucuggauauuccgcagaacagcaccuucgaagaccaguacuccaucggaggcccccaagagcagauuacagugcaggaauggucugaucggaaaagcgcccgcuccuaugagaccuggaucgggaucuacacaguuaaggacuguuauccugugcaagagaccuuuacgauuaauuacagcgucauccuuucuaccagauucuuugauauucagcugggaaucaaggaccccuccguguucacaccucccucuaccugccagauggcgcagcucgagaaaaugagcgaagauuguuccugguga

SEQ ID NO: 68878 - RNA, 7740 nt, Artificial Sequence
  derived and/or modified sequence opt5 from EPG5__Homo_sapiens__NP_066015
auggccgaggcugugaagccccagagacgggccaaagcgaaggcuagccgcaccaaaacaaaggaaaaaaagaaguacgagacgccucaaagagaagaguccucugaagucagccugccgaaaaccucccgggagcaggagauccccucucucgccugcgaauucaagggcgaccaccugaaaguugugacagauagccagcuucaggacgaugccuccgggcaaaacgagucugaaauguuugacgugccucugaccagccucacaauuuccaaugaggagagccugaccuguaacacagaacccccuaaggagggaggcgaagcucgccccugcgucggggauucugccgugaccccuaaaguucauccgggagacaaugugggcacgaaggucgagacccccaagaacuucacagaaguggaggagaauauguccguucaggggggacuuagcgaaucugcuccucaguccaacuuuagcuauacccagcccgccauggagaauauccaagugagagaaacacagaacucuaaagaggauaagcagggccuggucuguuccagcgaagugccucagaaugugggccuccaauccucuugccccgcgaaacacggguuccagaccccgcgggucaagaaacuguacccucagcugcccgccgagauugcuggagaggccccugcucucguugccgugaagccccugcuucgcagcgaaagacuguaucccgagcucccuucccaacuggaacuugugccguuuacgaaagagcagcugaagauccucgaacccggcagcuggcuggagaacgucgagucuuaccuggaagaguucgacuccauggcgcaucaggaucggcacgaauuuuaugagcuccugcuuaauuacagccgcuguagaaagcagcugcuccuggccgaggcugaacuucugacacucaccucugacugccaaaacgccaaaagccggcuguggcaguucaaggaggaacagauguccgugcaggggauuugugcugaucaaguuaaaguguuuucuuaucaucgcuaccagagagucgagaugaaugaaaacgcccugguggagcucaagaaacuguucgacgccaagagcgagcaccuucaccagacacuggcucuccauuccuacaccagcguucugucucggcuucagguggaauccuauaucuacgcgcugcucagcucuuccgccguccugcgcagcuccgcuauccaccaacagggaagagccucuaagcagaccgagagcauuccuuccgaucugugccagcucaaagaauguaucucugugcuguuuauguucacacggagagucaaugaggacacgcaauuucaugacgauauucuucuguggcuccagaagcuggugagcguucugcagcgcgugggcugccccggggaccaccuuuuccuccugaaccacauccugcgguguccugccggagucuccaaaugggcugugcccuucauucaaaucaagguucuccauaacccgagcggcguguuucacuucaugcagucucuggcccuucugauguccccugucaaaaauagagcggaauuuaugugccauaugaagcccagcgagcgcaagccuucuuccagcggccccgggucuggaaccuggacacucguggaugagggcggggaagaggacgaagauccugagaccagcuggauucugcugaacgaagacgaucuugugacaauccucgcucaguuccccuuucacgagcuguuccagcaucugcucggauuuaaagccaagggcgacuaucugccggagaccacgcggccucaagaaaugaugaaaaucuucgccuuugcuaauucccuuguugagcugcucgccgucgggcuggaaacauucaacagagcucgcuaccggcaguuugugaagagaauuggauauaugauccgcaugacccugggcuacgugagcgaucacugggcccaguaugucucucacaaucagggcuccgggcuugcgcaacagcccuacagcauggagaaacuccagguggaguucgacgaacuguuucugcgggccguucuccaugugcugaaggcuaagagacuuggaauuuggcuguucauguccgagaugcccuucggcacccucucuguccagaugcuguggaaacuguuuuaccuuaugcaccaaguggaaagcgagaaccuccagcagcuguccucuagccugcaaccugcccagugcaagcagcagcuccaagauccggaacauuucacaaauuuugagaaaugucuguccucuaugaacagcuccgaggaaaucugccuucugaccacauucgcucagauggcccaggcgcgccggacgaauguugacgaggacuuuauuaagaucaucgugcucgaaauuuaugaggucagcuacgugacccugucuacaagagaaaccuucuccaaaguugggcgggagcugcuuggaacaaucaccgccgugcaccccgagauuaucagcguccugcucgaucgcgugcaggaaacgauugaccaagugggcauggucucucuguaucucuuuaaggagcugccucuuuaccuguggcagcccuccgcuagcgaaaucgccguuaucagagauuggcuccugaacuauaaucugaccguggugaaaaacaagcuugcuugugucauucuggaggggcucaauuggggcuucgccaagcaggccacacugcaccucgaccaggcugugcaugcggaaguugcccugauggugcuugaggcuuaccaaaaauaucuggcccagaagccuuacgccggaauccucucugaguccaugaaacaggucagcuaccuggcuuccauugugcgguauggcgaaacccccgagacaagcuuuaaccagugggccuggaaucugauccuuagacugaagcuccacaaaaacgauuacgggauucaaccuaacugccccgcgguuccguucucugugaccgucccugacaugacggaaagccccacauuucauccucugcucaaggcugugaaggccggaaugcccaucggcuguuaucuggcccuuuccaugaccgcuguugggcacucuauugagaaauucugcgccgagggaaucccgcugcugggcauccucgugcagagccgccaucugcggacagucgugcacgugcuugauaagauucugccucucuuuuaccccugucaguauuaccugcucaaaaaugaacaauuccugucccaccuucugcuguuccuccaucuggacucuggggucccucagggcguuacccagcaggugacccacaagguggcgcaacaucuuacaggagcuagccacggcgauaacgucaaacugcucaauuccaugauccaggcccauauuucugugagcacgcagcccaacgagguugggcccguggccguccuggaauuuugggugcaggcucucaucucccaacaccugugguauagagagcagccuauucuuuuccugauggaccaccugugcaaggccgcuuuucagcucaugcaggaagauuguauccaaaagcugcuuuaccagcagcauaaaaaugcccugggauaccacugcgaccgcagccuccugucuucccucguuagcuggaucguggcgggcaacauuaccccgucuuucgucgaggggcuggccacacccacccaagugugguuugcuuggacaguccuuaauauggaguccaucuucgaagaggauagccagcugagacgggugauugaaggagagcugguuaucaacuccgccuuuaccccugaccaggcucucaagaaagcccagacgcaacugaagcuucccauugugccuucucugcagcgccuccugaucuauagaugggcccaucaggcucuggucacacccagcgaccacccucuccuuccgcugaucuggcagaaauucuuucugcucuaccugcaccggcccggcccucaauaugggcuucccauugauggcuguaucggacgcagauucuuucaguccccugcgcauauuaaucugcucaaggaaaugaagcggcgccugaccgagguggccgacuuccaccaugcugccagcaaagcccugagaguucccgcugagggcucugaagggcucccggagucccacagcggaaccccuggcuaccuuacaucucccgaacugcauaaggagcuggugcggcucuucaacgucuauauccuguggcuugaagaugagaauuuucagaaaggggacaccuacauucccagccugccuaagcacuaugauauccaccgccucgccaaagugaugcagaaccaacaggaccuguggauggaguaccugaauauggaaagaaucuaccaugaguuccaggaaacagugggacucuggacgcaggcgaagcuugagucccacucuacccccugcagccuguccguucaacuggauuuuacagacccucuccuggcuaaagagcggguccuuucuaaccugagaaagcaugaagccccgcagcccccucucgcccugcaccccaccaagccucccgugccggugauuagcuccgcuguccugcucagccagaaagaugccacacaacuugugugcaccgaccugaaucugcuccagcagcaggcgcgcacggcugcccugcgggagucucaacagguugcccuugauggcgaacugcucgacaccaugccuaagcaguaugugaacagagaggaacagacaacccugcaccuggagugucgcggguccagcggcaaaaagugccaaggagcugccgucgugacaguucaguucgagggcaugcauaaaaacgaagcuaucucccagcagcuccacgugcuucggaaggaggucaagcaacugcaggccgaagcggccaaacccccuucucugaauauuguggaggcugccguucaugcugaaaaccucaucaccgcccuggugaaugccuacaagcuucagcccacaccugggauucaaaaagucggaaucagccuguuuuucaccauuguggauuauguguccgacgagacgcagagacaccccccgacacgccaguuuuucaccucuuguaucgagauccucggccaggucuuuauuagcgggaucaaguccgaaugccggaaaguucuggagaccauucugaagaacagcagacucuguucucuucuguccccuuucuuuacacccaaugcugcgcccgccgaauucauccaacuguacgagcagguggugaaguuucucagcgaagacaacucugauaugauuuucaugcugcuuaccaaauucgaccugaagcaguggcucuccgcuacgaaaccuccgcugagcgaucgcacacggcugcucgagucuauccaucuugcccugaccgccuggggacuggagcccgacgaagauauccucaugccuuuuaaucuguucugcaagcacuggacauaucuucugcucuaccaguuucccgaccaauauagcgauauucugagacugcucaugcaguccucugcugagcagcuucugagcccugaauguuggaaagccacccugcgggcgcucggcugcugugcucccuccugccagcaaggcgccgccagcacagagggggcuguccugccuuccucuagcgacgcccuucuguccgauaagcaggugauggagaccauccaguggcucucugacuucuuuuacaagcugcgccugagcaaaauggauuucaaguccuuuggacucuucucuaaauggagcccguacauggcggacguuaagacguuucuuggcuaucuggugaaaagacugauugaccucgaaaugaccugucuggcccaagaucccacagcuucccggaagaccguccuuaagagccugcacucugugaucauucagcucuucaaaccuuggauccugguucuggaggacaacgaauccagccagcagcgccauuaccccuggcucgagucugauacaguggucgccuccagcaucgugcaacuguuuaccgacugcauugauucucuucacgaauccuucaaggacaaacugcucccuggggaugcuggagcccuguggcuucaucugaugcacuauugcgaggcuuguacggcccccaagaugccggaguuuauccucuacgcguuccacagcacauauagaaaacugccuuggaaggaccugcaucccgaucagaugcucauggaagccuucuuuaaagucgagcggggcucccccaagagcugcuuccuguuucuugggucugugcugugugaaguuaauugggugagcgugcucuccgacgcuuggaacucuagcccucaccccgagaccagauccaugauugucugccugcuuuucaugaugauccugcucgccaaggaaguucagcugguggaucagacagacucuccucugcucagccugcuuggacaaaccuccucucugagcuggcaucucguggauauugucuccuaccagagcgugcugucuuauuuuuccagccacuacccgcccucuaucauucuugcuaaagaguccuacgccgagcugaucaugaagcuccugaaaguuagcgccggccuguccaucccuaccgacucucagaagcaucucgacgcugugcccaaaugucaggcguucacacaccaaaugguccaguuucugagcacgcuugaacagaauggcaagauuacccuggccgugcucgagcaggaaauguccaagcugcuugaugacaucauugucuucaacccucccgauauggacagccaaacacgccacauggcucugucuucccucuuuauggaggugcugaugaugaugaauaacgccaccaucccgacagccgaauuccugcgggggagcauuagaaccuggaucggacagaaaaugcauggccucguugugcugccucuucugacggcugccugccagucucucgcgagcguccgccacauggccgagacaaccgaggcuuguaucaccgccuauuuuaaggaauccccccugaaucaaaacucuggguggggaccuauucuugugagccugcagguucccgagcucacaauggaagaguuccugcaggagugccugacccucggcuccuaccugacacuuuauguguaccugcuccagugucugaacucugaacaaacgcuucggaaugagaugaaaguccugcucauccugagcaaguggcuggaacagguguauccuuccagcguggaggaagaggcuaaacucuuucugugguggcaucagguucuucagcugucucucauucaaaccgagcagaacgauuccguccugacagaaagcgugaucagaauucuucugcucgugcagucccgccagaaucuggucgccgaggaacggcugucuagcgggauccuuggagcgaucggcuucggcagaaaguccccccugucuaaccgcuucagaguuguggcccggagcauggcugccuuucucuccgugcaagucccgauggaggaccagauucgccugagaccugggagcgaacuccaccugacccccaaggcucagcaagcccuuaaugcucuggagucuauggccuccagcaaacaguacguggaguaucaggaucagauccugcaagcgacacaguucauucggcaucccggacacugccuccaggacggcaagucuuuucuggcccuucugguuaacugucucuacccugaagugcacuaccuggaucauauccgcuga

SEQ ID NO: 68879 - RNA, 465 nt, Artificial Sequence
  derived and/or modified sequence opt5 from EPGN__Homo_sapiens__NP_001257918
auggcccugggcgugcccaucagcgucuaccuccuguucaacgcuaugaccgcccuuacagaggaagcggcuguuacggugaccccuccgauuacagcccagcaagggaauuggaccgugaacaagacagaggccgacaauaucgaaggacccauugcucugaaauuuucccaccucugccuggaggaucauaacucuuauuguaucaauggcgccugcgcuuuccaccaugaacuugagaaggccauuuguagaugcuuuaccggguacacaggagagcggugugaacaccugacccucacgagcuaugcggucgacuccuacgagaaauauaucgccaucggcauuggggugggacugcugcucucuggcuuccugguuaucuuuuacugcuauauucgcaagagaugucuuaaacucaagagcccuuacaacgugugcuccggcgaacggcgcccccuguga

SEQ ID NO: 68880 - RNA, 2931 nt, Artificial Sequence
  derived and/or modified sequence opt5 from EPHA1__Homo_sapiens__NP_005223
auggagagacgguggccccugggccucgggcuggugcuucugcucugcgccccucugccgcccggagcucgcgccaaggaagucacccuuauggacacaagcaaagcgcagggcgagcugggguggcuccuggauccucccaaggacggaugguccgaacaacagcagauccugaacggcacgccucucuacauguaucaggauugucccaugcaagggagacgggacaccgaucacuggcugcgcucuaauuggauuuacagaggagaggaagcuagccggguucauguggagcuucaguucacagugcgcgacugcaaauccuuuccuggcggcgccgggccgcugggauguaaggagaccuucaaccuccuguauauggaaucugaucaggacgucggcauccagcuuagacggccccuguuucaaaaagugacaaccguugccgcugaucagagcuucacaauucgcgaccucguguccgggucugucaagcugaauguggagagaugcagccugggacggcucacccgcagaggccuguaccuugccuuucacaacccuggggcuuguguugcccugguguccguccggguguucuaucagcgcugccccgaaacgcucaauggacuggcgcaguuuccugauacccuucccggcccggccggccugguggaggucgcugggacaugucucccucaugccagagcuagcccccggccuucuggagcccccagaaugcacugcucccccgacggcgaguggcugguuccuguggggcgcugucauugcgaaccgggauacgaggaaggcgggagcggagaggcguguguggccugccccucuggcuccuaucggauggauauggacaccccucacugccugacauguccccaacagagcaccgcugaaucugagggcgccacgaucugcacaugugaguccgggcacuacagagcuccuggagaaggcccccaggucgccugcaccgggccgccuagcgcuccccgcaaccucuccuucucugccagcggaacacaacugucccuucggugggagccucccgcggacaccggcgggagacaggaugugcgcuacagcguucgguguucucagugccagggcaccgcccaagacggaggcccuugucagcccugcggggugggaguccauuuuuccccgggcgcuagagggcugacaacgccugccgugcacguuaauggacucgaacccuaugccaacuacaccuucaauguggaggcucagaacggcgucagcgggcugggcucuagcggacaugccuccacaucugugagcauuuccaugggccacgcggaaagccuuucugggcugucccuccgccuggucaagaaagagccccggcagcuggagcucaccugggcuggaagcagaccucgcucuccgggcgccaaucugacauaugaacuucacgugcugaaccaagaugaggaacgguaccagaugguucucgagcccagagugcugcugaccgaacuucagccugacacgacauauaucguccgggugcgcaugcucacaccccuggggccuggacccuuuuccccugaucaugaguucagaaccagcccgccgguuucccggggccugaccgggggcgagaucguggccgucauuuuuggacuccugcuuggcgcugcccugcuccuggggauccugguguucagaucucgccgggcucagagacaacgccagcagagacagcgggaccgcgccaccgauguggacagagaagauaaacuuuggcucaagccuuacguugaccugcaagcguaugaggaucccgcccagggagcucuggacuucacacgggaacucgacccugccuggcugauggucgauacggugauuggcgagggggaguuuggagaaguguaccgcggcacccuuagacugcccagccaggacuguaagacagucgcuaucaaaacccucaaggauacaucccccgggggccaaugguggaauuuccugcgggaggccaccauuaugggacaguuuucucacccucauauccugcaccuugaaggcgugguuacgaagcgcaaacccauuaugaucaucaccgaguucauggaaaacggggcgcucgacgccuuucugagagagcgggaggaucagcuggugccuggacagcucgucgcuaugcugcaaggcauugccagcgggaugaauuaccuuuccaaccauaacuaugugcaccgcgaccuggcugccagaaauauccucguuaaccagaaucugugcuguaaggugagcgauuucggacugacacggcuucucgacgauuuugacggcaccuacgaaacacagggcgggaaaauucccaucagauggaccgcccccgaggcuauugcgcaccgcaucuucacgacagccucugaugucugguccuuuggaaucgugaugugggaaguucugagcuucggcgacaagccuuauggggagaugucuaaccaggaagugaugaaauccauugaggauggauaccggcugccgcccccugucgacugccccgcuccucucuaugagcugaugaagaauugcugggccuacgacagagcccgccggccccauuuucaaaaacuucaggcucaccuggaacagcuccuggccaacccucauagccugagaaccaucgcgaauuucgauccgcgcaugacacuucggcugcccucucucagcggcuccgacgggauuccuuauagaaccgugagcgaguggcuggaaucuauccgcaugaagcgguacauucuccacuuucacuccgcuggacuggauaccauggagugugugcuugaacugacagccgaggaccucacgcagaugggcaucacccugcccggccaucaaaagagaauccugugcagcauucagggguucaaagauuga

SEQ ID NO: 68881 - RNA, 2952 nt, Artificial Sequence
  derived and/or modified sequence opt5 from EPHA3__Homo_sapiens__NP_005224
auggacugccagcugagcauccuccugcuucuguccuguucugugcucgauagcuucggcgagcugauuccccaaccuuccaacgaagucaaucuucuggacucuaagaccauccagggggagcucggauggauuagcuacccgucccacggcugggaagagaucucugggguugaugaacauuauacacccauuagaacguaccaggugugcaacgugauggaccacagccagaauaacuggcugcggaccaauugggucccucgcaacuccgcccaaaagaucuauguggagcugaaguuuacacucagagauuguaauagcaucccccugguucuuggaaccugcaaagagacauucaaccuguacuauauggaaucugacgaugaccauggcgugaaguuucgggagcaccaguucaccaaaauugauacaaucgcugccgacgaauccuuuacccagauggaucucggggaccgcauucugaaacuuaauacggagaucagagaggucggaccugugaacaagaaaggcuucuaccuggcguuucaggauguuggcgcuuguguggcccucgucagcgugcggguguauuucaagaaaugccccuuuaccgucaagaaucuggccauguucccugacacaguuccgauggacucucaaucccugguggaagugcgcgggagcugugucaacaauucuaaagaggaagaucccccuagaauguacugcuccaccgagggagaauggcucgugcccauuggcaaguguagcugcaacgcuggguacgaggagcggggauuuaugugucaggccugccgcccuggcuucuauaaggcucuggacgggaauaugaaaugcgccaagugucccccgcauuccucuacacaggaagauggaagcaugaacugcagaugugagaacaauuacuuucgggcggacaaagauccucccuccauggccugcacccgcccucccagcucucccagaaacguuaucuccaauauuaacgaaacgagcgugauccuugacuggucuuggccucuggauacaggcggccggaaggacgucaccuucaauaucauuuguaaaaagugcggguggaacaucaaacagugugagccgugcagccccaaugugcgcuuccucccuagacaauuuggacugacaaacaccaccguuacagugacggaucuucuggcucacaccaauuauacauucgaaauugacgccgucaacggcguguccgagcucucuucucccccucggcaguuugcugccgucuccaucaccacaaaucaggcggcccccagcccggugcugaccauuaagaaggauagaacgucucgcaacuccaucagccugucuuggcaagagccugaacaccccaaugggaucauucucgacuacgagguuaaauauuacgaaaagcaggagcaggaaacauccuauaccauccugcgggcuagaggaaccaacgugacaauuagcucccuuaaaccugacaccaucuacgucuuccagauucgcgcccggacagcugccggcuacgggaccaauucuagaaaguuugaguucgagacgagccccgauuccuuuucuaucagcggagaauccagccaagugguuaugaucgccauuucugcugcgguggccaucauucugcucacagucgugaucuaugugcugauuggccgcuucuguggcuacaaauccaagcauggggcugacgagaagcggcuucacuuuggaaacggccaucugaaacucccugggcugagaaccuauguugauccccacacauacgaagacccgacccaggccguccacgaguucgccaaggagcuggaugcuacgaacaucagcauugacaaaguggugggagccggcgaauuuggggaggucugcucuggccgccucaagcugccuuccaaaaaggaaaucagcguggcgaucaagacccuuaaaguuggauauacagagaagcagcggagagauuuccugggcgaagcuagcauuauggggcaguuugaccaucccaauaucauucgccucgagggaguggucaccaaaagcaagcccgugaugaucguuacagaguacauggaaaacggcucccuggauagcuuccugcggaaacacgacgcccaauucaccgugauucagcuugucgggaugcucagaggaaucgccucuggcaugaaguaucuguccgauaugggguacgugcaucgggaccuggcugcccgcaauauccucauuaacagcaaucugguuuguaagguguccgauuuuggccuuucuagaguccuggaggacgacccugaagcugccuacacgacacggggaggcaaaaucccgauuagauggaccagccccgaggcgaucgccuaucgcaaguucacauccgcuucugauguguggagcuacgggauugugcucugggaagucauguccuauggagagcggccuuacugggagaugucuaaccaggacguuaucaaagccguggaugaaggcuauagacugcccccucccauggacugcccugcugcccuguaccagcuuaugcucgauugcuggcaaaaggaccgcaauaacagacccaaauuugagcagaucgugagcauucuggauaagcugauccggaauccggggucccucaaaauuaucaccagcgcggccgcucgcccuucuaaccugcuucuggaccaguccaaugucgauauuaccacauucagaacgaccggagacuggcucaacggcguguggacagcccacuguaaggaaaucuuuaccgggguugaguauagcucuugcgauacaaucgcuaagauuuccaccgacgauaugaaaaaggugggcgucacggugguuggaccccagaaaaagaucauuagcucuaucaaagcccuggaaacacaauccaagaauggcccugugcccgucuga

SEQ ID NO: 68882 - RNA, 2961 nt, Artificial Sequence
  derived and/or modified sequence opt5 from EPHA4__Homo_sapiens__NP_001291465
auggccggcaucuucuacuuugcucuguucagcugccucuuugggauuugugacgccgugaccggauccagagucuaucccgcgaacgagguuacacugcuugauucucggagcgugcagggcgaacugggguggaucgcuuccccucucgagggaggcugggaagaggugucuauuauggacgaaaagaauacgccgauccgcaccuaccaagucugcaacgugauggagcccagccagaauaacuggcugagaacagauuggauuacccgggagggggcccagcgcguuuauaucgaaaucaaauucacacuuagagacuguaauucccugccuggagugauggggaccugcaaggagacauuuaaccucuacuauuacgaaucugauaaugacaaagagcgguucauucgcgagaaccaguuugucaagaucgauaccauugccgcugacgagagcuucacgcaaguggauaucggcgacagaauuaugaaacugaauaccgaaauccgggauguuggcccccuguccaagaagggauuuuaucucgccuuccaggacgugggcgcuuguauugcccuggucagcgugcgcguguuuuacaaaaagugcccucuuacagucagaaaccuggcgcaguuccccgauaccaucacaggggccgacaccucuucccucguugaagugcggggaagcugugugaauaacucugaggaaaaagacgucccuaagauguacugcggcgcugauggggaguggcuggugccgaucggaaauugucuuugcaacgccggccacgaggaacgcuccggcgagugucaggcuugcaaaauuggguauuacaaggcccugagcacggacgcgacaugcgccaagugucccccucauucuuauuccguuugggaaggagcuaccagcugcacaugugauagaggcuuuuuccgggccgacaaugaugcugccuccaugcccugcacccgcccucccucugccccgcucaaccugaucagcaacgugaaugagaccuccgucaaccuggaauggagcucuccucaaaauacagggggaagacaggacauuuccuacaacgugguuuguaaaaagugcggcgcuggggaucccagcaaaugucggccuugcggaucuggcgugcacuauacgccccagcagaauggccucaagaccacaaaagucagcaucaccgaccugcuugcgcauacaaacuacaccuucgagauuugggccgugaauggggucuccaaguauaaccccaauccugaucaaucugugagcguuacggugacaaccaaccaggcugccccguccagcaucgcccugguccaggcuaaagaggugaccagauacucuguugcccucgcguggcuggaacccgaccgcccuaauggagugauccuugaguacgaagucaaguauuacgagaaggaucaaaacgaacgguccuauagaauugugcgcacagcugcccggaauaccgacaucaaaggccugaacccccucacaagcuacguguuucacguuagagcccgcacggcugccggguauggagacuucucugagccucuggaggucaccacaaauaccgugcccucccggauuaucggcgauggggcuaacagcacagugcugcucgucuccgugucuggcagcguugugcuggucgugauucuuaucgccgcguuuguuaucuccagacgccggucuaaguacagcaaagccaagcaggaagcugacgaggaaaaacaucugaaccagggagugagaaccuaugucgauccguucacguacgaggacccuaaucaggccgugcgcgaguuugcuaaggaaauugaugccuccuguaucaagauugagaaaguuaucggcgugggggaguucggagaagucugcagcggccggcucaaggugcccgggaaaagagaaauuuguguggcgaucaagacccugaaagccggauacacagacaagcaacggcgcgauuuucuuucugaggcuuccauuaugggccaguucgaccacccuaacaucauccaccuggagggggucguuaccaagugcaaacccgugaugauuaucacagaauauauggagaauggcagccucgaugccuuucugagaaagaacgacggacgguucaccgugauucagcuggucggcaugcucagagggaucggaucuggcaugaaauaccuguccgauaugagcuaugugcaucgcgaccuugcugcccggaauauucugguuaacucuaaucucgugugcaaggucagcgauuuugggauguccagagugcuggaagacgacccugaggccgcuuacacgacacgcggaggcaaaauccccaucagauggaccgcgccggaagccauugcuuaucggaaguucacaagcgccucugauguuugguccuacgggaucgugaugugggaggucaugagcuauggcgagcgcccuuacugggacauguccaaccaggaugugauuaaggccaucgaagagggauacagacugcccccucccauggacuguccgauugcucuccaccaacuuaugcuggauugcuggcagaaagaacggucugaccgccccaaguuuggccagaucguuaauaugcuggauaaacucaucagaaacccuaauagccugaagcggaccgggaccgaguccucucgccccaacacagcccuucuggacccuagcucccccgaguucucugcgguggucagcgugggagauuggcuccaggcuauuaaaauggacagauauaaggauaauuucacggccgccggcuacaccacacuggaagcugugguccauguuaaccaagaggaccuggcccggaucgggauuaccgcgaucacacaccagaauaaaauucuuuccagcgugcaggcuaugcgcacccagaugcaacagaugcacggaagaauggugccugucuga

SEQ ID NO: 68883 - RNA, 3117 nt, Artificial Sequence
  derived and/or modified sequence opt5 from EPHA5__Homo_sapiens__NP_001268694
augagaggcagcgggccccggggagccggccgcagacggccuccguccgggggaggcgacacccccaucacacccgcuucucuggccgggugcuacagcgcgccccgcagagcuccucucuggacgugucugcuucugugcgccgcccuccggacccugcuugcuucccccucuaacgaggugaaucugcucgauagccgcacagucaugggagaccugggcuggauugccuucccuaagaacggcugggaagagaucggggaaguugaugagaauuaugcuccgauucacaccuaccagguguguaaagugauggaacaaaaccagaauaacuggcugcucacauccuggaucucuaaugagggagccagcagaauuuuuaucgagcugaaguucacccuucgggacugcaacucccugcccggcgggcucggaacauguaaagaaaccuuuaauauguauuacuucgagagcgaugaccagaacggccgcaauaucaaggaaaaccaguauauuaaaaucgauacgauugcggccgacgagucuuuuaccgagcuggaucuuggggacagagucaugaagcugaauacagaagugcgggauguuggaccucucuccaagaaaggcuucuaccuggcuuuucaagacgugggcgccugcaucgcucuggucagcgugcgcguuuauuacaagaaaugucccucuguggucagacaucucgccguguucccugauaccauuacaggggcggacuccagccagcugcuugaggugucuggauccugcgucaaccacagcguuaccgacgaacccccgaagaugcauuguuccgccgagggcgaauggcuggugccuaucgggaaaugcauguguaaggcuggauacgaggagaagaauggcacgugccaggugugccggcccggguuuuucaaagccucuccucacauucagagcuguggaaagugcccuccccauuccuauacacacgaagaggcuagcaccucuugugucugcgaaaaagauuacuuucgcagagaguccgacccuccgacaauggccuguacccggcccccuagcgcccccagaaacgcuaucucuaacgugaaugaaaccagcguuuuccucgaguggaucccucccgcggauacaggcggccgcaaggacguguccuauuacauugccugcaaaaaguguaacucucacgcuggggucugcgaggaauguggaggccaugugcgguaucugccgagacaaagcgggcuuaaaaauacguccguuaugaugguggaucugcucgcccacaccaacuacacauuugagaucgaagccgucaauggagugagcgaccugucuccuggcgcucgccaguaugucuccgugaacguuaccacaaaucaggccgcgcccagcccugugaccaacgucaagaaggggaaaauugcuaaaaauucuaucucccugagcuggcaggagcccgaucggccuaacggcauuauccucgaauacgagaucaaguacuucgagaaggaccaagaaacguccuauacaauuaucaaaucuaaggagaccaccauuacagccgaaggacugaagcccgccagcguguacguuuuccagaucagagcucgcaccgccgcuggcuaugggguguuuucccggagauucgaguuugagacaacgccggucucuguggccgcgagcuccgaucagagccaaauuccugugaucgccguuucugucaccgugggagugauccuucuggcugucgugauuggcguucuccuguccgggagcugcugugaaugcggaugcggccgcgccucuucccuuugugcuguggcccaucccagccugaucuggcggugcggguacucuaaagcgaagcaggaccccgaggaagagaaaaugcacuuccacaauggccauauuaagcucccuggagucagaacauauaucgauccgcacaccuacgaagaccccaaccaggccgugcaugaguuugcuaaagagauugaagccagcuguaucacaauugagcgcguuaucggcgcuggggaguucggagaagugugcuccggccggcugaagcugccugggaagagagaacuccccgucgccaucaaaacccugaaggugggauauacggagaaacagcggcgcgacuuucuuggcgaggccagcauuauggggcaauucgaucacccuaauaucauucaucuggaaggcguugugaccaagucuaaacccgucaugaucgugacagaguacauggaaaacggaucccucgacaccuuucugaagaagaaugauggccaguucacagugauucagcuggucgggaugcuuagaggaaucagcgcuggcaugaaauaccucuccgacaugggguauguucaccgggaucuggcggccagaaacauccugauuaacucuaaucucguguguaaggugagcgacuuuggacugucccgcguccuugaggaugacccugaagcugccuacaccacgcggggcgggaaaauccccauuagauggacagccccggaggcuaucgccuuccgcaaguuuaccucugcgagcgaugugugguccuauggcauuguuaugugggagguggucucuuacggagaaagaccuuauugggagaugacaaaccaggacgugaucaaagcuguugaagagggcuaccggcugcccagcccuauggauugccccgccgcccucuaucaacugaugcuggacuguuggcagaaggagcgcaauuccagaccgaaauucgaugaaaucgugaacaugcuugacaagcucauucggaauccuagcucucugaagacccuggucaacgcuuccugccgcgugagcaaucuccuggccgagcacucuccccuuggguccggagcguacagaagcguuggcgaauggcuggaggcuaucaaaauggggcgguacaccgaaauuuucauggagaacggauauucuuccauggacgccguggcccaggucacacucgaggaucugcgcagacugggcgugacgcuugugggccaucagaagaaaaucaugaauagccuccaagaaaugaagguccagcugguuaacgggauggugccucuguga

SEQ ID NO: 68884 - RNA, 3393 nt, Artificial Sequence
  derived and/or modified sequence opt5 from EPHA6__Homo_sapiens__NP_001073917
augcaguuccccagcccuccggccgcuagauccucucccgccccucaagcggcuagcuccucugaggccgccgcucccgccaccggccagccugggcccagcugcccugugccgggaacaucccggcgcggcagacccgggacgccucccgcuggacgggucgaagaggaagaggaagaggaggaagaggacguugauaaggacccucaccccacccagaacacaugucugcgcugcagacauuuuucucuccgggaacgcaaaagagagccgcggcgcaccaugggcgggugugaggugagagaguuccugcuucaguuuggauucuuucugccucuccugacagccuggcccggcgauugcagccacguguccaauaaccaagucgugcuucuggacaccacaaccguucucggcgaacugggguggaagacguacccucugaauggaugggaugcgaucaccgaaauggacgagcauaaccggcccauucacacauaucagguguguaaugucauggaacccaaccagaauaacuggcuccgcaccaauuggaucagcagagaugccgcucagaaaauuuacguggagaugaaguucacacugcgggacugcaacucuaucccuuggguucuuggcaccuguaaagagacguuuaaucuguucuauauggaauccgaugagagccaugggauuaaguuuaagccgaaccaauacacaaaaaucgacaccaucgccgcugaugaaucuuucacacagauggaccucggagaucgcauucugaaacuuaauaccgagaucagagaagugggccccauugagcggaagggguuuuaucuggccuuccaggacaucggagcgugcauugcccucgucuccgugagaguguuuuacaagaaauguccuuucaccguccgcaaccuggcuauguuccccgacacaaucccucggguugauucuagcucccugguggaggugagaggcagcugcgucaaguccgccgaggaacgcgacacgcccaagcucuauuguggcgcugauggggacuggcuggugccgcuuggacggugcauuugcucuaccggcuacgaagagaucgaagggagcugucacgccugcagaccuggauuuuacaaagccuucgcuggcaauacaaaguguuccaaaugucccccucacagccugaccuauauggaggcgacaucuguuugccagugcgagaagggguacuuucgcgccgaaaaagaucccccuuccauggcuuguacccggcccccgagcgccccuagaaacguggucuucaacaucaaugagacggcccucauucuggaauggucuccucccagcgacacaggaggccgcaaggaucuuaccuauuccgugaucugcaaaaaguguggccuggacaccucucaaugcgaggauugugggggaggccuccgguuuauucccagacauacagggcugaucaacaauagcguuauugugcuggacuucgucucccacgugaacuacaccuuugagaucgaagcuaugaauggagucagcgagcucucuuucuccccgaagcccuuuacagccaucacggugaccacagaucaggacgcgccuagccugauuggcguugugcgcaaagacugggcuucucagaacuccaucgcccuuagcuggcaagcccccgcuuucuccaauggggccauucuggauuaugaaaucaaguacuaugagaaagaacaugagcagcucaccuacucuagcacacgguccaaggcuccuucugucauuaucaccggccugaaacccgccacgaaguacguguuucacaucagaguucggaccgcgacaggauauagcggcuacucccagaaguucgaguuugaaaccggggacgagacaagcgauauggccgcugaacagggacaaauucuugugaucgccaccgcugccgucggcggguucacgcugcucgugauucugacacuguucuuucucaucaccggacgcugccagugguauauuaaagcgaagaugaaaucugaggaaaagagacggaaccaucugcagaauggccaccuuagauucccugggaucaaaacauacauugaccccgauaccuaugaggacccgucccuggccgugcacgaguuugcuaaggaaaucgauccuagccgcauccggauugagagaguuaucggcgccggagaguucggcgaagucugcucugggcgccucaagacccccggaaaaagagaaauuccuguggcuaucaagacacugaaaggcgggcauauggaccggcagcgcagagauuuucugcgggaggccuccauuaugggacaauucgaccaccccaacaucauccgccuugagggcguggucacgaagcggagcuuuccggccauugggguggaagccuucuguccuucuuuucucagagcgggcuuccugaauagcauccaggcuccccauccuguucccggaggcgggucccugcccccucgcauuccggcuggaagacccgugaugaucgucguggaguacauggaaaacggcagccucgauucuuuucugcggaaacacgacgggcacuucaccguuauucagcuugugggaaugcugcgcggcaucgccuccgggaugaaguaucucagcgauaugggcuacguccauagagaccuggccgcucggaauauccuggugaacuccaaucuuguuugcaaggugucugacuuuggacucagcagaguccuggaggaugacccugaggccgcguacacaaccacaggcgggaaaauucccauccgcuggaccgcuccugaagccauugccuaucggaaguucuccucugcuagcgaugccugguccuacggaaucgugaugugggaggugaugucuuauggcgaaagacccuacugggagaugagcaaccaggacgucauucuguccaucgaagagggguaucgccucccugcgccgaugggaugucccgcuagccugcaccaacuuaugcugcauugcuggcagaaagagcggaaccacagaccuaaguucacggauaucguuucuuuucucgacaaacugauucgcaaucccuccgcccugcacacacuuguggaagauauccucgugaugccugagagccccggcgaagucccggaguacccucuguucgugaccguuggcgacuggcuggauucuauuaagauggggcaguauaaaaacaauuuuguggccgcuggauucaccacauuugaccucaucucccggaugagcauugaugacaucagacgcauuggcgucauccugaucgggcaucagcggagaauugugucuuccauccaaacccuucggcugcacaugaugcauauucaggaaaagggauuccacguuuga

SEQ ID NO: 68885 - RNA, 840 nt, Artificial Sequence
  derived and/or modified sequence opt5 from EPHA7__Homo_sapiens__NP_001275559
augguguuccagaccagauaccccagcuggaucauucugugcuauaucuggcuccugcgguuugcccacacaggcgaggcucaagccgcgaaggaaguccuucugcucgacuccaaagcucagcagacggagcuggaauggauuucuagcccuccgaacgggugggaggaaaucuccggacuugaugagaauuacacccccauucgcacauaucagguuugucaagugauggagccuaaccagaauaacuggcugagaaccaauuggaucucuaagggcaacgcccagcggaucuucguggaacucaaauuuacacugcgcgacugcaauagccugcccgggguccucggaaccuguaaggagacauucaaccuguacuauuacgaaaccgauuaugacacgggcagaaauauucgggagaaccuuuacgugaaaaucgauaccauugccgcugacgaguccuuuacacagggggaucugggagaacgcaagaugaagcucaauaccgagguuagagaaaucggcccucugucuaaaaagggcuucuaccuugccuuucaagacgugggggcuugcauugcccuggucagcgugaaaguuuauuacaagaaauguugguccaucauugagaaccucgcgaucuuccccgauacagugaccggaagcgaauuuucuucccuggucgaggugcggggcacgugcgugagcucugccgaggaagaggcugaaaaugccccucgcaugcauuguuccgcugagggggaauggcuggucccgaucggaaagugcauuuguaaggccggcuaucagcagaaaggggacacaugcgagagaaaguga

SEQ ID NO: 68886 - RNA, 2955 nt, Artificial Sequence
  derived and/or modified sequence opt5 from EPHB1__Homo_sapiens__NP_004432
auggcccuggacuaccuccugcuucugcuccuggcuagcgccguggcggcuauggaggaaacccuuauggauacaagaacggccaccgccgagcugggcuggacagcuaaccccgccuccgggugggaagaggucucuggauaugacgaaaaucucaacaccauccggacauaccagguuugcaauguguucgagccuaaccaaaauaacuggcugcugaccacauuuauuaaucgcagaggcgcucaccggaucuauaccgagaugcgcuucacggugagagauuguagcucccucccgaacguccccgggucuugcaaggaaaccuuuaaucuguacuauuacgagacagacagcgugauugccaccaaaaaguccgcguucuggucugaagccccuuaucuuaaaguugauacaaucgcugccgacgagagcuuuucccagguggauuucggaggccggcugaugaaggucaacaccgaggugcgcagcuuugggccccucacgagaaauggauucuaccuggcuuuucaggacuacggcgccuguaugucucuucuguccguucggguguucuuuaaaaagugcccuagcauuguccagaacuucgcgguguuucccgaaacaaugaccggcgccgagucuacaucccucgugaucgcucgcgggaccuguaucccuaaugccgaagaggucgauguuccgauuaagcuguauugcaacggagacggcgaauggauggugcccaucgggagauguaccugcaaaccuggauacgagcccgagaauagcguggcuuguaaggccugcccugccggcacauucaaggcuucucaagaagcggagggguguucccauugccccagcaacucccggucuccggccgaagcuagcccuauuugcacgugucgcaccggauauuacagagccgauuucgaucccccugaggucgccugcacauccgugcccagcggcccccggaacguuaucucuauugugaaugaaaccuccaucauucuggaguggcacccuccgcgcgagacaggcgggagagacgacgucaccuauaacaucaucuguaagaaaugccgggcugacagacgcagcuguucucggugcgaugacaauguggaauuuguucccagacagcucggacugacggagugucgcgugagcauuuccucucuuugggcccauacaccuuacaccuucgauauccaggcgauuaacggcgucagcuccaagagccccuuuccuccccagcacgugucugucaauaucaccacaaaccaagcugccccguccaccgugccuauuaugcaucagguuagcgccacaaugcggucuaucacgcuguccuggccccagccugaacagcccaaugggaucauucucgacuaugagaucagauacuacgaaaaggagcacaacgaguucaauagcuccauggcucgcucucaaaccaacacagcccggauugauggacugagaccuggcaugguguaugucgugcagguucgcgcucggaccguggccggguacggaaaauuuagcggcaagaugugcuuccagacacuuaccgacgaugacuauaaauccgaacugagagagcaacucccccugaucgcgggcucugccgcugccggggucguguuugugguuagccuggucgcuauuuccaucguguguagccgcaagcgggccuacucuaaagaagcgguguauuccgauaagcuccagcacuacagcacgggaagaggcucuccggggaugaaaaucuauauugacccuuucaccuacgaggaucccaaugaggccguccgggaauuugcuaaggagaucgacguguccuucguuaagauugaagaggugaucggagccggcgaauuuggggaggucuacaaaggccgccugaaacuucccggaaaaagagagauuuauguggcuaucaagacacugaaagccggcuacagcgaaaagcagcggagagacuuccucucugaggccagcauuauggggcaguuugaucauccuaacaucauccgccuggaaggaguugugaccaagucccggccggucaugauuaucacagaguucauggaaaauggcgcucuugacagcuuccugagacaaaacgaugggcaguuuaccgugauucagcucguuggaaugcugcgcggcaucgcggccgggaugaaauaucuggcugagaugaauuacgugcacagagaccucgccgcccggaacauucuggucaacucuaaucuugugugcaagguguccgauuucggccugagccgcuaucuccaggacgauacguccgaccccacauacaccucuagccugggaggcaaaaucccugucagauggacagcucccgaggccaucgcguaucggaaguuuaccuccgcuucugauguuuggagcuacgggauugugaugugggaagugauguccuucggagagcgcccuuacugggacaugucuaaccaagaugucaucaaugccauugaacaggacuauagacugcccccucccauggauuguccggccgcccuucaucagcucaugcuggacugcuggcagaaagaccggaacagccgcccuagauuugcugagaucgugaauacccuggauaagaugauucggaaccccgcgucccucaagacaguugcuacgaucaccgccgugccuagccaaccccugcuugaccgcucuaucccggauuucacagccuuuaccacagucgacgauuggcuguccgcuauuaaaauggugcaguacagagacagcuuccucaccgccggcuuuacgucucugcagcugguuacacagaugaccuccgaagaucuucuccggaucgggauuacccuggcuggacaccaaaagaaaauccugaauagcauucacucuaugagagugcagaucucccagagcccuacagccauggcguga

SEQ ID NO: 68887 - RNA, 2997 nt, Artificial Sequence
  derived and/or modified sequence opt5 from EPHB3__Homo_sapiens__NP_004434
auggccagagcucggcccccuccgcccccuagcccuccucccggccugcucccccugcuuccgccccugcuccugcuuccucugcuccugcugcccgccgggugccgcgcgcucgaggaaacccugauggacacaaagugggugacguccgagcuugcuuggaccucucacccugaaagcggaugggaggaagucuccggcuacgaugaggccaugaaccccaucagaacauaucagguuuguaaugugcgggagucuagccaaaacaauuggcugcgcaccggguucauuuggagacgggacgugcagcgcgucuacguggaacucaaauuuacaguuagagauugcaacuccaucccgaauauuccuggaucuuguaaggagaccuucaaccuguuuuauuacgaagccgacagcgauguggcuuccgccagcucucccuucuggauggagaauccuuaugucaaaguggacacaaucgcucccgaugaguccuuuagccggcuugacgccggccgcguuaacaccaaggugagaucuuucgggccccuguccaaagcgggauuuuaccucgccuuccaggaucagggcgcuugcaugagccugauuucuguccgggccuuuuauaagaagugugcuuccacgaccgccggcuucgcgcuguuuccugaaacacucaccggggccgagccgacaagccuggugaucgcucccggaaccugcaucccuaaugccguggaagucuccguuccccuuaaacuguacuguaacggcgacggggaguggauggugccugugggagcuugcacgugugccacaggccaugaacccgccgcuaaggagucucaaugccgcccguguccucccgggagcuacaaagcgaagcagggagagggcccuugccuccccugcccucccaauuccagaaccacaagcccggccgcuucuauuuguaccugccacaacaauuucuaucgggccgauuccgacagcgccgauucugcuuguaccacagucccuagcccuccccgcggcgugaucuccaacguuaaugaaacgucucugauucuugaguggagcgaacccagagaccucgggggacgggacgaucugcuguacaacgugaucugcaaaaagugucauggcgccgggggagcguccgcuugcagcagaugugacgauaacgucgaguuugugccgcgccagcugggccucaccgaacggagaguucacauuucucaucugcuugcccacacacgcuauaccuucgaggugcaggccgucaaugggguguccggaaagagcccccugccuccccgguacgcugccgucaacaucacaaccaaucaagcugccccuucugaggugcccacgcucagacugcacuccagcuccggcucuagccuuacacuguccugggcgccucccgaacgcccgaacggcguuauucucgacuaugagaugaaauacuucgaaaagucugaggggaucgccagcaccgugaccucccagaugaauagcguccagcuggauggacugcggccugacgcuagauaugugguucaggugcgcgcccggacagucgcuggcuacgggcaauacucuagacccgccgaauuugagaccacauccgagcgcggaagcggcgcgcagcagcuccaagaacagcugccucuuaucguggggucugccacggcuggccugguguucguugucgccgugguggucauugcuaucgugugccuccggaaacagagacauggauccgauagcgaguauaccgaaaagcugcagcaauacauugcccccggcaugaaaguuuauaucgacccguuuacauacgaggauccuaacgaggccgugcgggaguucgcuaaggaaauugacgucucuugugugaaaaucgaagagguuaucggggcgggagaauuuggcgaggugugccgcgggagacugaagcagcccggacggagagaggucuucguggccauuaagacccuuaaaguuggcuauacagaacgccagcggagagauuuucucagcgaggcuuccaucauggggcaguucgaccacccuaauauuauccgccuggaaggcguggucaccaagagcagacccgugaugauucugacggaguuuauggaaaacugugcccucgacucuuuccugcggcuuaaugauggacaauuuaccgugauccagcuggucggcaugcuccgcgggaucgccgcuggaaugaaauaccuguccgagaugaacuauguucauagagaccuggccgcgcggaauauucuugugaacagcaaucucgugugcaaggucuccgauuucggccugucucgcuuucuggaggacgaucccagcgacccuacauacaccuccucucucgggggaaaaaucccgauuagauggacagcucccgaagccaucgccuaccggaaguucaccagcgcuuccgauguguggucuuauggcauuguuaugugggaggugaugagcuacggggaacgcccuuauugggacauguccaaccaggaugucaucaaugccguggagcaggacuacagacugcccccucccauggauugcccuacggcgcuucaccaacugaugcucgacuguuggguucgggaucgcaaccugagaccgaaguucagccagauugugaacacacuggacaaacuuauccggaaugcugccucucucaaggucaucgccuccgcucagagcggcaugucucagccccugcuggacagaaccgugccugauuauacaaccuuuaccacaguuggagacuggcucgaugccauuaaaaugggccgcuacaaggaauccuucgugagcgcuggguuugccucuuucgaccuggucgcgcaaaugacggccgaggaucuucugcggaucggagugacccucgcuggccaccagaaaaagauucuguccagcauccaggacaugagacugcaaaugaaccagacacuucccgugcaggucuga

SEQ ID NO: 68888 - RNA, 2964 nt, Artificial Sequence
  derived and/or modified sequence opt5 from EPHB4__Homo_sapiens__NP_004435
auggagcugagagugcuccugugcugggccagccuugcugccgcgcuggaagagacccuccugaacacaaagcuggaaacggcugaccugaaaugggucaccuucccccagguugauggccaaugggaggaacucuccgggcuggacgaggagcagcacucugugcggacauacgaagugugugauguccagcgcgccccuggacaggcccauuggcugagaaccggcugggugccgcggcgcggggcuguucacguguaugccacacucagauuuaccaugcuggagugccuuagccugccccgggcuggacgcuccuguaaggaaacauucaccgucuuuuacuaugagucugacgccgauacggcgaccgcccucaccccugcuuggauggagaaucccuacaucaaaguggacacaguugccgcugaacaucugacaagaaagcggccuggcgccgaggcgaccgggaaagugaacgucaagacgcuucgccugggaccccucagcaaggccggcuucuaucuggcuuuucaagaucagggcgccugcauggcucugcucucccugcaccuuuucuacaaaaagugugcccagcugacagugaaucucaccagauuuccugaaacagugccgcgggagcuggucguucccguggccgggucuugcguggucgacgcugugccugcgcccggaccuagccccucccuuuauugucgcgaagauggccagugggccgagcaaccgguuaccgggugcagcugugcuccuggauucgaggccgccgaaggcaacaccaaaugcagagcuugugcccaggggacauuuaagccccugucuggagagggcuccugccagccuugccccgcgaauagccauucuaacacgauuggcuccgcugugugucagugccgggucggguacuuccgcgccagaaccgacccccggggagccccuuguacaaccccgcccagcgcuccuagaucugugguuucccgccucaauggcagcucccugcaccuggaauggucugcuccccucgagagcgggggacgggaagaucugacauacgcucuuagaugccgcgagugucggccuggcggguccugcgcccccuguggaggcgaccugaccuuugauccgggcccuagagaccucguggagcccugggucgugguccgcgggcugcggccugacuucacguauacauuugaagugaccgcgcuuaacggaguuagcucucuggccaccggccccgugccuuucgagcccgucaaugugacaaccgauagagaaguuccgccugcuguguccgacauccgcgucacacggagcucucccagcucccucucucuggccugggcugugcccagagccccuagcggggcggugcuggauuacgagguuaaauaucacgaaaagggagccgagggcccguccagcguccgcuuccucaagacgucugagaaccgggcugaacugagagggcuuaaacggggcgccuccuaccuggugcaagugcgcgcuagaagcgaggccggauauggccccuuugggcaggaacaucacucucagacccaacucgacgaguccgagggauggcgggaacagcuggcccugauugcuggcacagcggucguggggguugugcuuguccucgugguuaucguggucgccgugcugugccugagaaagcagagcaauggacgcgaggcugaauacuccgauaaacauggccaguaucucauugggcacggcaccaagguuuacaucgacccuuucacauacgaggaucccaacgaagccgugcgggaguuugccaaagagaucgacgucucuuaugugaagauugaagaggugaucggagcuggcgaguucggggaagucuguagaggacgccugaaagccccuggcaagaaggaaagcugcguugcgauuaaaacccuuaaagggggauacacggagagacaacggcgcgaguuucuguccgaagccucuaucaugggccaguucgagcaccccaauauuaucagacucgaagggguggugaccaacagcaugccugucaugauucugacagaguuuauggaaaauggcgcccuggauuccuuccuucggcucaacgacggacaguuuaccgugauccagcugguuggcaugcugcgcgggaucgccagcggaaugagauaucucgcugagaugucuuacgugcaucgggaucuggccgcgcgcaacauucuugucaauuccaaccugguguguaaaguuagcgacuucggccucucuagauuucuggaggaaaauuccagcgaccccacauauaccucuagccuugggggaaagaucccgauucgguggacggcuccugaggccaucgccuuccgcaaauuuacauccgcuagcgaugccuggucuuacggcauugugaugugggaagucauguccuucggggagagacccuauugggacaugagcaaccaagaugugaucaaugcuaucgagcaggacuaccggcuuccucccccgccugauugccccaccucccuccaccagcugaugcuggacugcuggcagaaggauagaaacgcccgcccucgguucccccaaguugugucugcgcucgacaagaugauuagaaaucccgccagccugaaaaucgucgcucgcgaaaacggcggagccucccauccucuucuggaucagcggcagccgcacuacucugcuuuuggcagcgugggggaguggcucagagccauuaagaugggacgcuaugaagaguccuucgccgcugcgggcuuugggucuuucgaacuggugagccagaucuccgccgaggaccugcuucggauuggagucacacucgcuggccaucaaaagaagauccuggccagcguucagcacaugaaaucucaggccaagcccggcaccccugggggaaccggcgggcccgcuccucaauacuga

SEQ ID NO: 68889 - RNA, 2190 nt, Artificial Sequence
  derived and/or modified sequence opt5 from EPHB6__Homo_sapiens__NP_001267724
augguggccgucggcgggugcagaugucagcccggauaccaaccugcucggggcgacaaggccugccaggcguguccgcgcgggcuguauaaagcuagcgccggaaacgcccccugcuccccuugucccgcuagaucucacgccccuaaucccgcugccccuguuugcccgugucucgagggcuucuaccgggcgagcuccgaucccccugaagcccccugcaccgggccucccucugcuccgcaggagcugugguuugaagugcagggaagcgcccuuaugcugcauuggcgccucccuagagagcugggcggccgcggggaccuucuguucaacguggucuguaaggaaugcgagggacggcaagagcccgcuuccggcgggggaggcacaugucacagaugccgggaugaagugcauuuugacccucgccagagagggcucacggagucucggguucuggugggaggccugcgcgcccacguccccuauauccucgaagugcaggcgguuaauggcgugagcgagcugucccccgauccuccgcaggccgcugccauuaacgucagcaccucucaugaggugcccuccgcugugccugucguucaccaagugagcagagccucuaauuccaucacagugagcuggccccagccugaccagaccaacgggaauauucuugauuaccagcugcgguauuacgaccaagccgaagaugagucucacuccuucacacucaccagcgaaacaaacaccgcuacggucacccagcugucccccggacauaucuauggcuuucaggugcgcgcgagaacagccgcugggcacggaccguacggcgggaaaguuuacuuccaaacccuuccucagggagagcugucuagccagcuccccgaacggcugucccuggugauuggcagcauccucggcgcccuggccuuucuucugcucgcugccaucacaguccuggcggugguuuuccagagaaagcgccgggggaccggauauacggagcaacuucagcaguacucuuccccuggccugggggugaaauauuacauugaccccagcacauaugaggauccuugccaggcuaucagagaacucgcccgcgaggucgaccccgccuacauuaagaucgaagaggugauuggaaccggcucuuuuggggaaguccggcaaggcagacugcagccgcgcggacggagagagcagacaguggcuauccaggcccugugggcuggcggggccgagagccuccaaaugaccuuccugggacgcgcggccguucuuggccaguuucagcauccuaauauucugcggcucgaagggguggucaccaaguccagaccccugauggugcuuacagaguucauggaacugggaccccucgauucuuuucugcgccagcgggagggccaauucagcucccugcagcucguugcuaugcagagagggguggccgcugccaugcaauaucugagcucuuucgcguuuguccaccggucccuuagcgcccacucugugcuggugaacucccaucucguuuguaaagucgcucgccugggccacagcccucagggaccguccugccugcuuagaugggccgcucccgaagugaucgcccauggcaagcacacgaccucuagcgacgugugguccuucgggauccucaugugggaggucaugucuuacggagagcggccuuacugggacaugagcgaacaggaggugcugaaugccauugaacaggaguuuagacugcccccucccccuggcugucccccggggcuccaucugcuuaugcuggauacauggcaaaaagaccgcgcucggagaccucacuucgaucagcucguugcggccuuugacaagaugauccgcaaacccgauacccugcaggcuggaggcgacccuggggagagacccucccaggcccugcuuacaccgguggcccucgauuucccuugccuggacagcccccaggcuuggcugucugccauuggccucgaauguuaucaagauaacuuuuccaaguucggacugugcaccuuuagcgacgucgcgcagcuuucucuggaggaucucccugcucugggcaucacgcuggccgggcaccagaagaaacuucuccaucacauucaacugcugcagcagcaucuccggcaacagggauccguggaaguuuga

SEQ ID NO: 68890 - RNA, 1368 nt, Artificial Sequence
  derived and/or modified sequence opt5 from EPHX1__Homo_sapiens__NP_000111
auguggcuggagauccuccugaccagcgugcuuggcuucgccauuuacugguuuaucuccagagacaaggaagagacacugccccucgaagaugggugguggggaccuggcacgcggucugcugcccgcgaggacgauagcauuagaccguucaaagucgaaaccuccgacgaggagauccacgaucugcaucagcggauugacaaguuucgcuucacacccccucuugaagauucuugcuuucacuauggguucaacagcaauuaccugaaaaagguuaucuccuauuggagaaacgaguuugacuggaaaaagcaaguggaaauccucaaucgguacccccauuucaagaccaaaauugagggacuggauauccacuuuauucaugugaagccuccccagcugccugcgggccacacaccgaaaccccuccugaugguccacggguggccuggaucuuucuaugaguuuuacaagaucauuccccuucugaccgacccuaaaaaccauggccucagcgaugaacacguguucgagguuaucugucccuccauuccgggcuauggguuuagcgaggcuucuuccaagaagggauucaauagcguggccacagcccgcaucuucuacaaacugaugcuuagacugggcuuucaggaguucuacauccaagggggagacuggggcucucucauuugcaccaacauggcucagcuggucccuucccaugugaaggggcugcaccucaauauggcccugguucuuagcaacuuuucuacgcugacccuccugcuuggacagcgguucggccgcuuucugggccucacagaaagagauguggagcugcuguaucccgucaaagagaagguguucuacucccucaugcgggaaagcggguauaugcacauccaguguaccaaaccugacacagugggauccgcucugaaugacucucccgucggccuugccgcguacauucuggagaaguuuagcaccuggacgaacacagaguuccgcuaucucgaagaugggggacuggaaagaaaauuuucccuugacgaucugcucaccaauguuaugcuguacuggacaaccggcaccaucauuagcucucagcgguucuauaaggagaaccuggggcaaggauggaugacacagaagcaugagcgcaugaaaguguacgugcccacgggcuuuuccgccuucccuuuugaacuccugcacaccccggagaagugggucagauucaaauaccccaaacuuaucagcuauucuuacauggugcggggcgggcauuucgcugccuuugaagaaccugaacugcucgcucaggacaucagaaaguuccugagcguucuggagcgccaguga

SEQ ID NO: 68891 - RNA, 1509 nt, Artificial Sequence
  derived and/or modified sequence opt5 from EPHX2__Homo_sapiens__NP_001243411
augaagggcgagaucacccugagccaguggauuccccucauggaagagaacugcagaaaauguuccgaaacagccaaggugugccugccuaaaaauuucucuaucaaggagauuuuugacaaagcuaucagcgcccggaagauuaaccgcccgaugcuucaagcggcucugaugcucagaaagaaaggguucacgaccgccauccugacaaauaccuggcuugaugaccgggccgaacgcgauggacuggcucagcucaugugugagcugaagaugcacuuugacuuccugaucgaguccugccaggucggcaugguuaaacccgaaccucagauuuacaaguuucuccuggauacacuuaaagccucucccagcgaggugguguuccuggacgauaucggggcuaaccucaagccugccagagaccugggaauggucaccauucuugugcaagauacagacaccgcgcugaaggaacucgagaaaguuacgggcauccagcugcugaauacccccgccccucucccgacauccuguaaccccucugauaugagccauggguaugugaccgucaagccucgggugcgccugcacuuuguugagcuuggauccggccccgcugugugccugugucauggcuucccugaaagcugguacucuuggagauaucagauucccgcccucgcucaggccggguaccggguccuggcgauggacaugaaaggauauggcgaguccagcgccccgccugaaaucgaggaauacugcauggaggugcuuuguaaggagauggugacauuucuggauaaacucgggcugucucaagcugucuucauuggacacgacuggggcgggaugcugguuugguauauggcccucuuuuaccccgaacgcgugagagcuguggccucccugaauaccccuuucauccccgccaaccccaauaugagcccucuugagucuaucaaggcuaacccggucuuugacuaccagcuguauuuccaggaacccggaguggcggaggccgaacucgagcagaaucugucccggacguucaaaagccuuuuucgcgcuuccgaugagucuguucugagcaugcauaaggugugcgaagccggcggccucuucgucaacuccccugaggaacccagccugucuagaauggugacagaggaagagauucaauuuuacguucagcaguucaagaaauccggguuucggggaccucugaauugguaucgcaacauggagagaaauuggaagugggccuguaaaagccucggccggaagauccugauucccgcucuuauggugaccgccgaaaaagacuucguccuggugccgcaaaugucucagcacauggaggauuggaucccucaccucaagagagggcauauugaagacugcggacacuggacacagauggauaagcccaccgaggucaaccagauccugaucaaauggcuggacagcgaugcgcgcaacccucccgugguuuccaagauguga

SEQ ID NO: 68892 - RNA, 1083 nt, Artificial Sequence
  derived and/or modified sequence opt5 from EPHX3__Homo_sapiens__NP_001136358
augcccgagcugguggucaccgcccuccuggcuccuagcagacuuucccugaagcuccugcgggccuucauguggucucuuguuuuuagcguggcgcugguggcugccgccgucuacggcugcaucgcucucacacacgugcugugucgcccgagacgggggugcuguggacgcagacgguccgccucucccgcuugccugagcgacccuucccucggcgaacauggguuccugaaccuuaaaucuagcggacugcgccuccacuauguuuccgccggcagagggaauggaccccugaugcuuuuucugcauggcuucccugagaacugguuuagcuggcgguaccagcuccgcgaguuccaaucuagauuucacguggucgcgguggaucugcggggcuaugggcccuccgacgccccucgcgauguugacuguuacacgauugaucugcuccugguggacaucaaggaugucauucuuggacugggcuauagcaaaugcauccucguggcucaugacuggggagcccugcuugcuuggcacuucucuauuuacuauccgucccugguggaaagaauggucguugugagcggggcccccaugucuguguaccaggauuacucccuccaccauaucagccaguuuuuccggucccacuauauguuucuguuccagcugccuuggcuccccgaaaagcugcuuucuaugagcgacuuucaaauccugaaaaccacacucacccaucgcaagacaggcauuccuugucugacccccuccgagcuugaggcguuccuguacaauuucagccagccugggggacucacaggcccgcugaacuauuacagaaaucuguuucggaacuucccccucgaaccucaggagcugaccacgcccacccuucugcucuggggcgaaaaggauacauaucuggagcuggggcuugucgaggccaucggaucuagauuugugcccggccgccucgaagcucacauucugccugggaucggacacuggauuccgcaguccaauccccaagagaugcaucaguacaugugggccuuccugcaggaccuccuggauuga

SEQ ID NO: 68893 - RNA, 954 nt, Artificial Sequence
  derived and/or modified sequence opt5 from EPM2A__Homo_sapiens__NP_001018051
augagauuccgguuuggcguggucguucccccugccguggcuggggcccgcccggagcugcucguggucggaagcagacccgaacugggccggugggagccucgcggggcggugagacuucggcccgcuggaaccgccgccggcgacggggcucuggcccuccaggaaccuggacuguggcuuggcgagguugaacuggcugccgaggaggcggcccaagauggcgcugaacccgggcgcguggacacauucugguacaaguuucucaaaagagagccuggaggcgaacuguccugggaggggaacggaccgcaccaugaucggugcuguacguauaaugagaacaaucuggucgacggcguguacugccuccccaucgggcacuggauugaagccaccggacauacaaacgagaugaagcacaccacagauuucuauuuuaauaucgcuggccaucaggccaugcacuacucucgcauucugccuaacaucuggcuuggcagcugucccagacagguugaacacgugaccauuaaacugaagcaugagcucgggaucacagcggucaugaauuuccagaccgaaugggacaucgugcaaaacuccucuggaugcaaucgguauccugagcccaugacgccggauaccaugauuaaacuguaccgcgaggaaggccuugccuauaucuggaugccuacacccgacaugagcaccgaggggagagugcagaugcugccucaggcugucugucuccugcacgcccugcucgaaaagggacauauuguuuacgugcacugcaacgcuggcguggggcgguccacagccgccgucuguggauggcugcaguacgugaugggcuggaaucuucgcaagguucaauauuuucugauggcuaaaagacccgcgguguacaucgaugaggaagccgcuucucaggacaccuucccccucuga

SEQ ID NO: 68894 - RNA, 1824 nt, Artificial Sequence
  derived and/or modified sequence opt5 from EPM2AIP1__Homo_sapiens__NP_055620
auguggaugacccccaagagaagcaaaauggagguggacgaagcccuggucuuccggccugaguggacacagcgcuaccucguuguggaaccgcccgagggcgauggggcucugugccuuguguguagacggcugaucgucgccacgcgcgaaagagacgugcggcgccacuaugaggcggagcaugaauacuaugagagauacguugcugauggagaacgggccgcccucguggagcgccugagacaaggcgaccuuccugucgcuuccuuuacccccgaggaacgggccgcucgcgccgggcugggacucugcagacugcuggcgcucaagggccggggguggggagagggcgauuucguguaucaguguauggaaguucugcuucgcgaggugcugccugaacacgucucugugcuccagggcguggaccugagccccgauauuacaagacagcggauccuuuccauugacagaaaccugcgcaaucaacucuuuaaccgggccagagauuucaaggcuuacucucuggcccuggacgaucaggcuuuugucgccuaugagaauuaccuccugguuuucauccgcggggugggaccugagcuugaagugcaggaggaccugcucaccauuaucaaccugacacaucacuuuagcgucggcgcgcuuauguccgccauccuggaaucucuccagaccgcugggcugagccugcaacggauggugggacucacaaccacgcauacccugagaaugauuggcgaaaauuccgggcuuguuagcuacaugcgcgaaaaggccgugucuccgaacugcuggaaugucauccacuauuccggauuccugcaccucgagcugcuuagcucuuacgauguggacguuaaccagauuaucaauacaauuuccgaguggaucgugcugauuaaaacccggggcgucagacgccccgaauuucagacacuccugaccgagagcgaaucugagcauggcgaacgggugaacgggagaugucugaauaacuggcuccgccggggaaagacgcugaaacuuaucuucucccugagaaaagagauggaggcuuuucucgucagcgugggcgccacaaccguucacuucuccgacaagcaguggcugugcgauuuuggguuccugguggacaucauggaacaucuucgggagcucucugaggagcugcgcgucagcaaaguguucgccgcugcggccuuugaucacauuuguacauucgagguuaagcugaaucucuuucaaagacacaucgaagagaaaaaccugaccgacuucccugcccuucgggaaguggucgaugagcugaagcagcagaauaaggaagacgagaaaauuuuugaucccgacagauaucaaauggugaucugccgccuccagaaggaguucgaacggcauuuuaaagaucugagauucauuaagaaagaccuggagcucuuuuccaacccuuucaacuuuaagcccgaauacgcuccgaucagcgugcgcguugagcuuaccaaacugcaggccaauacaaaccuguggaaugaauauagaaucaaggaucucggacaguucuacgcuggccugucugccgaguccuauccuauuaucaagggggucgcguguaaaguggcuagccuuuuugacucuaaccaaauuugcgagaaggccuucagcuaccugacgcggaaucagcacacccucucccagccccugacagacgaacaucugcaggcccuuuuccgcguggcuaccacagagauggaaccuggaugggaugaccucgucagagagcggaacgaaucuaaucccuga

SEQ ID NO: 68895 - RNA, 1989 nt, Artificial Sequence
  derived and/or modified sequence opt5 from EPN1__Homo_sapiens__NP_001123543
augggcgaccagagcuggcuguggaaccaagccgcucccggggugagauccccugucuucgccugcucuguugagaagggaaaugugccgcucgugcugagcgaacaccuugcgcauucccgggaucccggcucuggggcuguccgcuuucugaucagcccugagcccugggccuccgccauucucggaaccucuggccugcuugcuagcccugugcugcccgccgcucucgacgccguuacaugucagcaucugccucagccguccagcgggucuagacccaucuccccucggauuggagcgcugugcccccuccugcuucagccuggcacgaugagcaccucuucccugcgcagacaaaugaaaaacaucgugcacaauuacagcgaagccgagauuaagguccgggaagcuacaucuaacgaucccuggggcccguccagcucccucaugucugagaucgccgaccugaccuauaaugugguugcuuucagcgagaucauguccaugauuuggaaacgccuuaacgaucacgggaagaauuggagacauguguacaaagccaugacacugauggaauaucucaucaagaccggaagcgagcgggucucucagcaguguaaggaaaacauguacgcggugcagacacugaaagacuuucaauauguggaucgcgacggcaaggaucagggggucaauguuagagagaaagccaagcagcugguggcucuccugcgggacgaggaucgccuuagagaggaacgggcccacgcucugaaaaccaaggaaaagcucgcccagacggccaccgcuuccagcgcggccgugggaucuggcccucccccugaggcugaacaagccuggccccagagcuccggggaggaggaacugcagcuucaacuggcccucgcuaugucuaaagaggaagccgaccaggaggaacgcauuagacggggagaugaccugagacugcagauggcgaucgaggagagcaagcgcgaaacaggcggcaaagaggaauccagccucauggaccuggcugaugucuucaccgcccccgccccugcuccgacaaccgaccccuggggcggaccugcccccauggcugccgcggugccuacggccgcucccacaucugauccguggggcgggccucccguuccucccgccgcugacccuuggggaggccccgccccgaccccugcguccggggaucccuggcggcccgccgcuccugccggaccgagcguggaccccuggggcggcaccccugcucccgccgccggggagggaccuacacccgauccuugggggucuuccgacgggggaguccccgugagcggcccguccgcuucugauccuuggacccccgcgccugccuuuagcgaccccuggggcggguccccggcuaagccuucuacaaacggaacgaccgccgccggcggguucgauacagaacccgacgaguuuagcgacuucgauagacuucgcaccgcucugccuacauccggaagcucugccggcgagcucgaacugcuugcgggggagguucccgcucggucccccggagccuuugacaugagcggcgugagagggucucuggccgaagcugucggcuccccuccgcccgccgcgaccccuacgcccacaccucccacccgcaaaaccccugagagcuuccucggaccgaaugcugcccugguggaucuggacucucucgucagccggcccggcccuacacccccuggggccaaggcuuccaaccccuuucugccgggaggcgggccugccaccggacccagcgugacaaaucccuuccagccugcucccccugccacgcuuacccugaaccaacucagacugucuccgguucccccugugcccggcgcgccucccacauacauuuccccgcuugggggcggaccuggccugcccccuaugaugcccccugggcccccggccccuaauaccaaccccuuucuccuguga

SEQ ID NO: 68896 - RNA, 582 nt, Artificial Sequence
  derived and/or modified sequence opt5 from EPO__Homo_sapiens__NP_000790
augggcgugcacgagugccccgccuggcuguggcuccugcuuagccugcucucccugccucuugggcugccgguccucggagcucccccuagacugaucugugacucucggguucuggaacgcuaccuccuggaggccaaggaagcggagaacauuaccacaggcugcgcugaacauuguagccuuaaugagaacaucacggugcccgauaccaaagugaauuucuaugccuggaagagaauggaggucgggcagcaagccguggaaguuuggcagggacuggcucuccuguccgaggccgugcuucggggccaggcucugcucgucaacucuagccagccuugggaaccccugcaacugcacguggacaaagccguuuccgggcuccgcucucugacaacccuucugagagcgcucggagcccagaaggaggcuauuagcccuccggaugccgcuuccgccgcgccccugcggacaaucaccgccgacacauuucgcaaacuuuucagaguguacagcaauuuucugcggggcaagcucaagcuguauaccggcgaggcuugccgcacgggggauagauga

SEQ ID NO: 68897 - RNA, 1527 nt, Artificial Sequence
  derived and/or modified sequence opt5 from EPOR__Homo_sapiens__NP_000112
auggaccaccugggcgccagccucuggccccagguggggucccugugccuucugcucgcuggagccgcgugggcuccuccgcccaaccugccugaucccaaguucgagucuaaagccgcccuucuggcugccagaggcccugaggaacuccuguguuuuaccgaacggcuggaggaccucgucugcuucugggaagaggcugccagcgcggggguuggacccggcaauuacuccuuuucuuaucaacuggaggaugaaccuuggaagcucugucgccugcaucaggccccgacagcuagaggggccgugcgguucuggugcagccuccccacggcugacaccuccucuuuugugccucuggagcuucgcgucacagccgcgagcggagcccccagauaccaccgggugauccauauuaacgaaguugugcugcucgaugcuccugucggccugguggcccgccuggcugacgaguccggccacguugugcucagauggcugcccccgccugagacccccaugacaagccauauccgguaugaagucgaugugucugccgggaauggagccggcuccgugcagcgcgucgagauucuugaagggagaaccgaguguguucugagcaaccuccggggacgcacaagauacaccuucgcugugcgggcgcgcauggccgaaccuucuuuuggcggguucugguccgcuuggagcgagcccgugucucugcuuacgcccuccgaccuggauccucucauccugacccugagccucauucuggucgugauccuuguucugcucacagugcuggcccuucugucccacagacgggcccucaaacagaagaucuggccggggauucccucuccugagagcgaauuugagggccuguucaccacacacaaaggcaauuuucaacuguggcucuaucagaacgacgggugccugugguggucccccuguaccccuuucacggaagaucccccggcuagccuugagguccugucugaaagaugcuggggaacaaugcaggccguggagccuggcaccgacgaugaggggccccuccuggaaccuguuggauccgagcaugcgcaggacacauaccuggugcuugacaaguggcuccugccccgcaauccucccagcgaagaucugccgggcccugggggaucugucgacaucguggcuauggaugagggcagcgaagccuccucuuguagcuccgcccucgcuagcaagcccucucccgagggcgccuccgcugccagcuuugaguauaccauucuggacccuucuucccaacuucugcggccguggacccucugccccgaacugccucccacaccuccccaccugaaauaccuuuaccucgucgugagcgauuccgggaucucuacggacuauagcuccggagauucucagggcgcgcagggaggacugagcgacggcccuuacuccaaccccuaugagaauagccugauuccggccgcugaaccucuucccccuucuuacguugccuguuccuga

SEQ ID NO: 68898 - RNA, 384 nt, Artificial Sequence
  derived and/or modified sequence opt5 from EPPIN__Homo_sapiens__NP_001289790
augggcagcuccgggcugcucucucugcuugugcuguucguccuccuggccaacguucagggacccggccuuaccgacuggcuguuuccuagacggugcccgaagauccgcgaggaaugugaguuccaagaaagagaugugugcacaaaagaccggcagugucaggauaauaagaaaugcuguguguuuagcugcgggaagaaaugucucgaccugaagcaggucucccugcaaauguacgcuaagugccagaaaaagcucgcccccgcguggcugauuuucuuuaucggaggcaugacgcgcaaaauuauccuugcuccuugucugucuaugguggccgccagagagaccauuacaaccagcaaccccaagccuacagcuuga

SEQ ID NO: 68899 - RNA, 540 nt, Artificial Sequence
  derived and/or modified sequence opt5 from EPPIN-WFDC6__Homo_sapiens__NP_001185915
augggcagcuccgggcugcucucucugcuugugcuguucguccuccuggccaacguucagggacccggccuuaccgacuggcuguuuccuagacggugcccgaagauccgcgaggaaugugaguuccaagaaagagaugugugcacaaaagaccggcagugucaggauaauaagaaaugcuguguguuuagcugcgggaagaaaugucucgaccugaagcaggaugucugcgagaugcccaaggaaacgggaccuugucuggcuuacuuccuccacuggugguaugacaaaaaggauaauaccugcuccauguuuguguacggcgggugucaaggaaacaacaauaacuuccagucuaaagccaauugccugaacacaugcaagaauaaacagcccuguccuaagauuaagguugagugcgagguggaagagaucgaccaguguaccaaaccccgcgauugcccugaaaacaugaaguguugcccguuuagcagaggcaaaaagugucuugacuuccggaaagcgucccugucuacauga

SEQ ID NO: 68900 - RNA, 15267 nt, Artificial Sequence
  derived and/or modified sequence opt5 from EPPK1__Homo_sapiens__XP_011515627
augagcggacacacccugcccccucucccggugcccgggacgaacuccacggagcaggcuucugugccuagagcuauggcugcgacccugggagcuggaacacccccucggccccaagcucgcagcaucgccgggguuuacguggaggcuagcggacaggcccagucuguguaugcugccauggagcagggccuucugccugcggggcucggacaagcccugcuugaagcucaggccgcuaccggcggccuggucgaccucgccagagggcagcugcugccggugagcaaggcgcuccagcaaggacugguuggccuugagcugaaagaaaagcuccuggccgcugagcgggccacaaccggguaccccgauccuuauggaggcgagaaacuugcucuguuccaggccauugggaaggaaguggucgaccgcgcccucggacaguccuggcuggaggugcagcuggcuacaggcggccucguugaucccgcgcaaggggugcuggucgccccugaacccgcuugccaucagggacuucuggacagagagaccuggcacaaacucucugagcuggaaccgggcacgggggaucuucgguuucuggacccuaauacccucgagcgccugacauaccaucagcugcucgaaagaugugugcgggcccccggaagcggccuggcccuucugccucucaagaucaccuuccgcuccaugggaggggcugugagcgccgcggagcugcuugaagucggcauucuggaugagcaagcuguucagggccucagagaggggcggcuggccgccguggacgugucugcucgcgccgaagucagacgguaucuggagggaacaggcuccguggcugggguugugcuccugcccgaaggacacaaaaagagcuuuuuccaggccgcgaccgagcaucuucugcccaugggcacggcccucccucugcuggaagcucaggccgcuacacacacccuugucgauccgaucacagggcaacgccucuggguggacgaggccguuagagcgggccuggugucucccgagcugcacgaacagcuccuggucgccgagcaggcugugaccggacaucacgauccuuuuuccggcagccagauuccccuuuuccaagccaugaagaaggggcuggucgaccggccucucgcucugagacugcuugaugcccagcucgccaccggaggccuggugugccccgcucgccggcugagacucccgcuggaagcggcccuucgcugugggugccuggacgaggacacacagcggcagcucucucaagcuggauccuuuagcgauggcacgcaugggggccugagauacgaacagcugcuugcccucuguguuaccgacccugagacaggacuggccuuccugccccucuccggcgggccucgcggaggcgagccccaggggccucccuuuaucaaguauucuacccggcaggcucugagcacagccaccgcgacgguguccgucggaaaauucagaggccgcccggugagccuuugggaacugcucuuuucugaggcuaucuccagcgaacaacgggccaugcuggcccagcaguaccaagaggggacacugucuguugagaaacuugcugccaagcucagcgcgacccuggaacaggcugccgccaccgcuagagugacauucuccggccugcgcgauaccgucacaccuggagagcuccugaaagccgaaauuaucgaccaggaucuuuacgagcggcuggaacacggccaggcuacggccaaggacguggggucucucgcgagcgugcaaagauaucugcagggaaccggcugcauugccgggcugcuucugcccggaucccaggagcggcucagcaucuacgaggcucgcuguaaaggccugcucagacccgggacagcccugauucuucuggaagcucaggccgccaccggcuuuaucauugauccuaaggcuaacaaaggacacucuguugaggaagcgcuccgggccgcugucaucggcccggacguguucgccaagcugcuguccgccgagagagcugugacaggguauaccgaucccuacacgggacaacagaucagccuuuuccaggccaugcagaaaggccugauuguccgcgaacaugggauccggcuccuggaggcgcaaauugcuaccggaggcgugaucgacccuguucacucucauagagugcccgucgauguggccuaucgcagaggcuacuuugaccagaugcucaaucugauucuucuggacccuuccgaugacacaaagggguucuuugaucccaacacccacgagaaucucacauaucugcagcugcuugaacggugcguucgcgacccugagaccggacuguaccuccugccccucagcuccacgcaaucuccgcugguggauagcgccacacagcaggcuuuccagaaccuucugcuguccgucaaguacggcagauuucaagggcagcgggugucugccugggaacucaucaauagcgaguauuucuccgaaggacgcagacggcagcugcuucgcagauaccggcagcgcgagguuacccugggccaaguggcgaaacuccuggaggcugaaacacagagacaggccgacaucaugcucccugcccugcggagcagagucaccgugcaucagcuucuggaggcugggauuaucgaucaacagcugcucgaccaggugcuggccggaaccauuucucccgaagcccuucugcucauggauggcguccgccgguaucuguguggccucggggccguuggaggcgugagacugcuuccuuccgggcagcgccugagccuguaccaagcgaugcggcagaagcuccugggacccagaguggcccuugcucugcucgaggcccaggcugccacaggcacgaucauggacccgcacucuccugagucccugagcgucgaugaagccgugcgcagagggguugugggacccgagcucuauggcagacugaaacgcgcugaaggcgcgauugccggguuucgggacccuuucucuggaaagcaagucagcguguuucaggcuaugaaaaagggccuuauccccugggagcaggccgccagacugcuggaagcucagguugccaccgggggaaucauugaucccacaucccaccaucaccucccuaugccgguggcgauccaacggggcuacgucgaccaggagauggagaccgcucuguccucuuccagcgaaacauuccccaccccugacgggcagggacgcacguccuaugcccagcuucuggaggaaugccccagagaugagacaucuggccuccaucugcugccucuccccgaaagcgccccugcccuuccgaccgaggagcaagugcagcggucccugcaggccguucccggcgcgaaggacgggaccucucugugggaucuccugagcuccugucacuuuacagaagaacagcgcagaggacuucuggaagacgugcaagagggccggaccacagucccucagcuccuggccucugugcagagaugggugcaagaaacgaaacugcucgcucaggcccgcgucaugguucccgggccucggggagaggugcccgcuguguggcuucuggaugccggcauuaucacccaggagacacuggaagcucucgcccaggggacccaaagcccggcgcaggucgccgagcagccugcugugaaggccugccuguggggaacaggcugcguugcuggcgugcuucugcagcccuccggggccaaagccagcauugcucaagcggucagagacggacuccugcccaccggccuggggcagcgccuccuugaagcccagguggcuucuggauuccugguugauccucugaacaaucagcggcucuccguggaggacgccgucaaggugggccuggucgggagagagcuuagcgaacaacugggacaggccgagcgcgcugccgcgggcuaccccgauccuuacucucgggccucccucagccuguggcaggcuauggaaaaaggccuggugccgcagaacgaggggcucccccuucugcaaguucagcuggccacgggaggcguggucgacccugugcacgggguucaucucccccaggcugccgcguguagacugggacuucuggauacccaaacaucucaggugcucaccgccgucgacaaggauaauaaguuuuucuucgacccuuccgcucgcgaccaggugacauaucagcaacugagagaacggugcgugugugauagcgagaccggccugcuccuucugccccugccguccgacacaguucucgaggucgaugaccacaccgccguggcucugcgcgccaugaaagugccugucagcacggggagauuuaagggaugcucugugagccuuugggaucugcuccuguccgaauacguuggcgcugacaaacggcgcgagcugguggcccucuguagaucuggccgggcggccgcucuuagacaggucgugagcgccguuacaacccugguggaagcugccgagcgccagccccugcaggccaccuuccgggggcucagaaagcaagucuccgcgcgcgaucuguuucgggcucagcuuaucucuagaaaaacacuggacgaacucagccagggaaccacgacagugaaggagguugccgagauggauuccgugaagcggucucuggaaggcgggaacuucauugcuggaguccugauccagggcacccaagagcgcaugagcaucccugaagcccucagacggcauauucuucgccccgggacagcccuggugcugcucgaggcucaggccgcgaccggcuuuaucauugacccuguggaaaauagaaaacugacagucgaggaggccuucaaggcuggaauguuuggcaaagaaaccuauguuaaacuucuguccgccgagcgggcugugacgggguacaccgaucccuauacaggacagcaaaucagccucuuccaggccaugcagaaagaccugauugugcgcgaacacggcaucagacugcucgaggcgcagaucgccaccgggggaauuaucgacccgguccauucucaccgggugccuguugauguggcuuaccgcugcggcuauuuugacgaggaaaugaaccggauucuugccgaucccuccgacgauacaaagggguucuuugaccccaauacccacgagaaccugacguaccugcaacuccuggaacggugugucgaggauccugaaacaggccuuuaccugcuccagaucauuaaaaagggagagaacuauguguacaucaaugaggcuaccagacauguucugcagagccgcacagccaagaugcgggugggcagauucgcugaccaggucgugucuuuuugggaucugcucuccagcccguauuucaccgaagaccgcaaacgggagcuuauccaagaauacggggcccaguccggaggccuggagaagcugcucgaaauuaucaccacaacgauugaggagaccgaaacacagaaccaggggaucaaagucgcggccauuagaggagaggugaccgcugccgaucuguucaauucucgcguuaucgaccaaaagacacuucacacccugcgggugggcagaacagggggacaggcucucagcacacuggaaugcgugaaacccuaucuggagggauccggcuguaucgccggggucaccguuccuagcacccgcgaagugaugucucuccaugaggccucccggaaggagcugauucccgcggcuuuugccacauggcuucuggaagcccaggcugccaccggauuccuccuggauccuugcacaagacaaaaacuuagcguggacgaggcugucgacgugggccugguuaacgaagaacuccgcgagcggcugcugaaagccgaaagagcggccacgggguaccgcgaucccgcuaccggagacacaaucccucucuuucaggccaugcagaagcagcugauugagaaagcugaagcccuuagacugcucgaggugcaagucgcgaccggcggcgugaucgauccgcagcaccaucaccggcugccccuugaaacagccuaucgcagagggugucugcacaaggacauuuacgcucucaucucugaucagaaacauaugcggaagagauucgucgacccuaauacccaggagaaggugagcuaccgggagcugcaagaacgcugcagaccccaggaggauacgggauggcugcucuuuccuguuaacaaagccgcucgggacuccgaacacauugaugacgagacccgcagagcccuggaagcugaacagguggagaucacagucggccgguuccgcgggcagaagcccacccuuugggcccugcucaauucugaauaugugacagaggagaagaagcugcaacuuguuagaauguaccggacccauacacgcagagcgcugcagacgguggcccagcucauccuggagcugauugaaaaacaggagaccagcaacaagcaccucugguuucaaggaauccggcgccagauuacagcuuccgagcugcuuucuagcgccaucauuaccgaagagaugcugcaggaucucgaaaccggcagauccacaacgcaagagcugauggaggacgaucgggucaagcgcuaucuugaagggaccagcugcaucgccggagugcuggugccggcuaaagaccagccuggcagacaggagaagaugucuaucuaccaggccauguggaaaggcguucuccggcccgggacagcgcugguccugcucgaagcucaagccgccaccggauucgugauugaccccgugagaaaucugcgccuuuccgucgaggaagcuguugccgcuggcguggucgggggagagauccaggagaagcugcucagcgccgaacgggcggucacaggcuauaccgauccuuacacggggcagcagauuucccuguuucaagccaugcagaaagaccuuaucgugagagagcacggcauucgccugcucgaagcucagaucgccacaggcggcguuaucgaucccgugcauucucaccgggucccuguggacguugcuuauagacgcggguacuucgaugaggaaaugaaccgggugcuggccgacccgagcgaugacaccaagggauuuuucgaucccaauacccaugagaaccugacauacguccagcuccugagacgcugugugccugaccccgauaccggccuuuauaugcugcaacucgcggggcggggauccgccgugcaccagcugucugaggaacuuagaugcgcucugcgcgacgcccgggucacaccuggcagcggggcucuccagggacaauccguuagcgugugggagcugcuguucuacagagaagugucugaggaccggagacaggaucuccugucccgcuaucgggccggcacccuuacggucgaagaacugggcgccacacucaccagccugcuugcucaggcgcaggcccaagcuagagccgaggccgaagcugggucuccccgcccggacccuagagaggcccugcgggcggcuacaauggaagugaaaguuggacgccucagaggccgggccgugcccgucugggaugugcuggccuccggguacguuagccgcgcugccagagaggagcugcuugcugaauuuggaucuggcacccuggaccucccugcccugacgcggcgccucaccgcgauuaucgaggaagccgaggaagcucccggggccagaccucagcugcaggaugcuuggcggggaccccgcgagccgggcccugccggcagaggggacggagauagcggccggucccagcgcgaggggcaaggagaaggcgagacacaggaagcggccgcugccgcugccgccgcugcggccagacggcaggagcagacccuuagagacgcuacaauggaagugcaacgcgggcaguuccagggacggcccgucucugugugggauguucuguuuagcuccuaucugagcgaggccagacgcgacgagcuccuggcccagcaugcugccggcgcgcuuggccugcccgaucucguggcuguccugacccgggugauugaagagacagaagagagacucuccaaggucucuuuccgcgggcugcggagacaagugagcgccuccgaacugcacaccucuggaauccuuggcccugagacgcugcgcgaccucgcccaggggacaaagacccugcaggagguuaccgaaauggauagcgugaaacgguaccuugagggaacauccuguauugcuggcguccuggugccggccaaggaccaacccgggagacaggagaagaugucuaucuaucaggcuauguggaagggagugcuccggccuggcaccgcccugguucuccuggaggcgcaggccgcuacaggcuuugugauugaccccguccgcaaucugagacuuagcguggaggaagccguugcugccgggguggucggaggcgagauccaagaaaaacugcucuccgcggagcgggccgugacgggguacaccgauccuuacacaggacagcagaucagccuguuccaggcuaugcaaaaggaccuuauuguccgcgaacacggcaucagacugcucgaggcccagauugcuaccgggggcgugaucgaucccguucauucucaccgggugccugucgacguggccuaucagagaggauacuuugaugaggaaaugaaccgcguucuggccgaccccuccgaugacacaaagggcuucuuugauccgaauacccaugagaaccugacguaugugcagcuccugcggagaugcgucccugaccccgauaccgggcuuuacaugcugcaacucgcuggacgcggcagcgcggugcaccagcugucugaggaacuucggugugcccugagagacgcucgcgugacaccuggguccggagcccuccagggccaaagcguuucugucugggaacugcuguucuauagagagguguccgaggaccggcgccaggaucuccugagcagauaccgggccgggacccuuacaguggaagaacugggcgcuacccucacgucccugcuugcccaggcgcaggcucaagcccgcgccgaagcugaggccggaagccccagaccggacccucgggaagcucugcgcgccgcgacaauggaggucaaagugggcagacuccgggggagagccguucccgugugggauguccuggcuucuggauaugugagccgcgccgcucgggaggaacugcucgccgaguuuggcuccgggacccuggaccuucccgcgcugacaagacgccucaccgccauuaucgaagaggcugaggaagccccuggagcucggccccagcugcaggaugccuggagaggcccucgcgagccggggcccgcgggccggggagacggcgauucugggagaagccagcgggaaggacaaggcgagggggaaacccaggaggccgcugccgcugcccgcagacaggagcagacacuucgggacgccacgauggaaguucaacgcggacaguuccagggcagaccuguguccgucugggaugugcuguuuucuagcuaccucuccgaggcucggcgcgacgaacugcuggcccaacacgcggcuggggcccucggccugcccgaucuuguugccgugcugaccagagucaucgaggaaacagaggagcggcucucuaaggugagcuucagaggacugcgcugccagguguccgcuagcgaacuucauaccucuggcauucuggggccugagacacuccgggaccuggcccagggaaccaaaacgcugcaggaagucacagagauggauuccguuaagagauaccucgaaggcaccagcuguaucgcgggggugcuggugcccgcuaaagaccaaccuggacgccaggagaagaugucuauuuaucaggccauguggaagggcguccuucggccgggcaccgcccuggugcuccuggaggcucaggccgcuacaggguucguuaucgaccccgugagaaaccuucgccuguccgucgaagaggccguggcggccggaguugugggcggggaaauucaagagaaacuccugagcgcugagcgggccgucaccggauacacagauccuuauacgggccagcagaucucccuguuucaggcuaugcaaaaggaccucaucgugagagaacacgggauucgccugcuugaggcccagaucgcgaccggaggcgucauugaucccgugcauucucaccggguuccuguggacgucgccuacagacgcggcuauuucgaugaagagaugaauagagugcuggcugaccccagcgaugacacaaaaggguuuuucgauccgaacacccaugaaaaucucacauacguucagcugcugcggcgcugcgugccugaccccgauaccggacucuauaugcuucagcuggccggcagaggguccgcuguccaccaacugagcgaggagcuccggugugcccugagagacgcccgcgugacgcccggaucuggcgcccuucaggggcaguccgugagcguuugggaacugcucuuuuaccgggaggucucugaagauagacggcaagaccugcugagccgcuacagagccggaacccuuacaguggaggaacucggcgcgacccugacaucccugcucgcucaggcccaggcccaggcucgggccgaggcggaggcuggcucuccucgccccgacccuagagaagcccugcgggccgcuaccauggaggugaaggucgggcgccuuagaggacgggccgugccgguuugggaugugcuggcuagcggcuaugucucccgcgccgcgagagaggaacuccuggccgaguucgggucuggaacacuggaccuucccgcucucacccggcgccugacggccaucauugaggaggcugaagaggccccuggcgcgagaccccaacugcaggaugccuggcgggggccuagagaacccggaccggcuggccgcggcgacggggauagcggacggucccagagagagggccagggggagggagaaacacaagaggccgcugccgccaccgcugccgcgcgccggcaggaacagacccucagagacgcuacaauggaggugcagcgcggccaauuucaggggcggccuguuagcgugugggauguccuguucucuuccuaccuuagcgaagccagacgcgacgagcugcucgcccagcacgcugccggagcgcugggccugcccgaucuuguggcugugcucacgcggguuaucgaggaaaccgaggaaagacuguccaaagucucuuuucgcggccugcggagacaagugagcgccuccgagcuccauacaucugggauucugggaccugaaacccuucgcgaccuggcccagggcacaaagacccuccaggaggugacagagauggauagcgucaagcgguaucuggaagggaccuccugcaucgcuggaguucuggugcccgccaaagaccagccgggcagacaagagaagaugagcaucuaccaggcuauguggaaaggggugcuuagaccuggaacggcccucguccugcuggaagcgcaggccgcuaccggcuucgugauugaccccguucggaaccuccgccugucuguggaggaagccgucgcugccggcgugguugggggagagauccaggagaaacuucuguccgcggaaagagccgugacaggcuauaccgaucccuacacagggcaacagauuagccucuuucaggcuaugcagaaagaccugaucguccgggagcacggcauucgccugcuugaagcccaaaucgcuaccggcggggugaucgauccugugcauucucacagaguccccguugacguggccuaucggcgcggauacuucgaugaggagaugaauagagugcucgccgacccuuccgaugacacgaagggcuuuuucgauccgaacacacacgaaaaucugaccuacguccagcugcuccggcgcuguguucccgacccugauacaggccuguauaugcuucagcuggcugggagaggaagcgccgugcaucagcucucugaggaacugcggugcgcgcugcgcgacgcuagagugacccccggcuccggggcccuucaaggacagagcgucucugugugggagcuccuguucuaccgggaaguuagcgaggaucgcagacaggaccugcucucccgguauagagccggcacgcugaccguggaggaacuuggggcuacacugaccagccuccuggcccaagcgcaggcucaggcccgcgccgaggcugaagccggcuccccucggcccgacccuagagaggcucugcgcgccgcgacaauggaagucaaggugggacggcuuagaggccgcgccguuccggugugggauguccucgcuucuggguacgugagccgggccgcuagagaggagcugcuggccgaauuuggauccggcacccucgaccugcccgcgcuuacacgccggcugaccgccauuaucgaggaagcugaggaagccccuggggcuagaccccagcuccaagaugccuggcgcggaccucgggagcccggcccggccgggagaggcgacggagauucuggccggagccagcgcgaggggcagggagaaggcgagacgcaggaagcugccgcggcuacagccgccgcuagacggcaagagcagacccugagagacgccaccauggagguccagcgcgggcaguuccaaggacggccuguguccguuugggaugugcuguuuucuagcuaucuuuccgaagcgagacgcgacgagcuccuggcucagcacgccgccggcgcucuggggcuccccgaucuggucgccgugcuuacaagagugauugaagagaccgaggaacggcugagcaaaguuucuuuccgcggccucagacggcaggucuccgcuagcgagcugcauacaucuggaauccugggccccgaaacgcuucgcgaccucgcccaagggaccaagacacugcaggaggugaccgaaauggauuccgugaaaagauaccuggagggaacaagcugcauugcgggcguucucgucccugccaaggaccagcccgggcaccaggagaagaugucuaucuaucaagcuauguggaagggagugcugcggccuggcaccgcccuugugcugcucgaggcucaggccgcgacgggguuugucaucgauccggugcgcaaccugagacuguccguugaggaagccguggcugccggcgucgugggaggcgagauucaggaaaaacuucucagcgcugagcgggccguuaccggguacacagaccccuacaccggacagcaaaucucucuguuccaggccaugcagaaggaccugauugugcgcgaacauggcaucagacuccuggaggcucagauugccacagggggagucaucgauccugugcacucccaccgggugcccguugacgucgcguauagacgcggcuacuuugaugaggaaaugaaucgggugcuugcucauccuagcgacgauaccaagggcuucuuugaccccaacacgcacgagaaucugacauaugugcaacuccugagacgcugugucccggauccugacaccgggcuguacaugcuucagcucgccggacggggcagcgccgugcaucagcuguccgaggaacugagaugcgcucuccgcgaugcccggguuaugcccgggucuggagcgcugcagggccaaagcguguccgucugggagcuucuguucuauagagaagugucugaggaccgccggcaggaucuccugagcagauaccgggccgggacacugaccguugaggaacuuggagcuacccugacaucccuccuggcccaggcucaagcccaggcucgcgccgaagcggaggccgaggcuggcucuccuagacccgacccucgggaagcccuccgcgcugccacgauggaggugaaagucggcagacugcgggggagagcggugcccguuugggacgugcuugccagcggauaugucuccggcgcugcccgcgaggaacugcucgcugaauuugggagcggaacccuggaucugccggcccuuacacggagacugaccgccauuaucgaggaggcugaagaggcgcccggcgcccgcccucagcuccaggacgcuuggcgggggcccagagaaccuggaccggccggccgcggcgauggggacucuggacggucccaaagagagggccagggggaaggagagacacaggaggccgcugccgcggcccgcagacaggaacaaacccugcgggaugcuacgauggaggugcagcgcggccaguuccaggggagacccgugagcgucugggacguucucuuuucuuccuaccugagcgaagcccaccgggaugagcuucuggcucaacaugccgcuggagcccucggccugccugaccugguggcggugcuuacacgcgucaucgaggaaaccgaggaaagacuguccaaggugucuuuccggggccuccgcagacagguuagcgccuccgagcugcacaccucugggauucucggacccgaaacacugcgggaucuugcucagggcaccaaaacacugcaagaggugacggagauggacagcgucaagagauaccuggaagggaccuccuguaucgccggagugcucguuccugcuaaagaucagcccggccgccaggagaagaugagcauuuaucaggccauguggaagggggugcugcggccuggaacagcgcuuguccugcucgaagcccaagcugccaccggcuucgugaucgaccccgucagaaaccugcgccucucuguggaggaagcuguugccgccggcguggucgggggagagauucaggagaaacugcuuuccgcugaacgggcggugacaggcuacaccgauccguauacggggcagcagaucagccuguuucaagccaugcagaaggaccugaucguuagagagcacggcauucggcuccuggaagcccagaucgcuaccggcggggugauugacccuguccauucucaccgcgugcccguggauguugccuacagacggggauauuucgacgaggaaaugaaucgcguccuugcugauccuagcgacgauacaaaaggcuuuuucgaccccaacacccaugagaaucugacauaccuccagcugcuccaaagagccacccuggauccggagacaggccuucuguuucugucccucucucugcaguga

SEQ ID NO: 68901 - RNA, 4539 nt, Artificial Sequence
  derived and/or modified sequence opt5 from EPRS__Homo_sapiens__NP_004437
auggccacccugagccucacagugaacuccggcgaucccccucugggggcccuucuggcugucgagcacguuaaggacgacgugucuaucagcguggaagagggaaaagaaaauauucuccaugucuccgagaacgugaucuucacggauguuaauucuauucugagauaccuugcgcggguggcuaccacagccggccuguaugggagcaaccucauggaacacaccgagaucgaccauuggcuggaguuuuccgccacaaagcugucuagcugcgauuccuucaccagcacaauuaaugaacucaaccacugucugucucuucgcaccuaccuggucggaaauucccucagccuggcugaccuuugcgugugggccacgcugaaaggcaacgcugccuggcaggagcaacucaagcagaaaaaggcgccgguucaugugaagagaugguuuggguuccuggaagcccagcaggcuuuucaaucugucggaaccaaaugggauguguccacaaccaaggcccggguggcucccgagaaaaagcaggacgucggcaaauucguugagcugccuggcgccgaaauggggaaggugacagugcgcuuucccccugaggcgagcggauaucuccacaucggccacgccaaggcugcccugcuuaaucagcauuaccaggucaacuucaaagggaagcugaucaugagauuugaugacaccaaucccgaaaaagagaaggaagauuucgagaaagugauucucgaggacguugcuaugcugcacaucaagccugaucaauuuacguauacaucugaccauuucgaaaccauuaugaaauacgccgagaaacuuauccaggaaggaaaggccuauguggacgauacaccggcugagcagaugaaagcggaacgggagcagcgcauugacuccaagcacagaaagaaccccaucgagaagaaucugcaaaugugggaagagaugaaaaagggcagccaguuugggcaguccuguugccuccgggccaagauugauaugucuagcaacaauggauguaugcgcgacccuacccuguacagaugcaaaauccaaccccacccucggaccggcaacaaguacaacgucuaucccacauacgauuucgcuuguccgaucguggacuccauugaaggcguuacgcaugcccugcgcaccacagaguaucacgauagagacgaacaguucuacuggaucauugaggcccucgggauccggaaaccuuauauuugggaguacagccgccugaaucuuaacaauaccgugcugucuaagagaaaacucacaugguuugucaacgaaggacugguggauggcugggacgauccccgguucccuaccgucagaggggugcuucgccggggaaugacgguugagggccugaagcaguuuaucgcugcccagggguccagcagaucuguggucaauauggaaugggacaagaucugggcguucaacaaaaaggugauugaccccguugcuccccgcuauguggcccuccugaaaaaggaggucaucccugugaaugugccggaggcccaagaagagaugaaagaaguugcuaagcaucccaagaacccugaggucggacugaaacccgugugguacagcccuaagguguuuauugaaggcgccgaugcugagacauucuccgagggcgaaauggucaccuuuaucaauugggggaaccucaauauuaccaaaauccacaagaacgccgacggaaaaaucauuucucuggaugcgaaacuuaaucuggagaacaaagacuacaagaagacaaccaaagugacauggcucgccgaaacgacccaugcucugcccaucccgguuauuugcgugacauaugagcaccugaucaccaagccuguccuuggcaaagaugaagacuucaagcaguacgugaauaaaaacagcaagcacgaggagcucaugcugggggaucccugucugaaggaccucaaaaagggagauauuauccagcugcagcggagaggcuuuuucauuugcgaccaaccuuaugaacccguuuccccuuacagcuguaaagaggcccccugcgugcuuaucuauaucccggaugggcauacaaaggaaaugccuaccucuggcuccaaagagaagacgaaggucgaagcuaccaaaaacgagacaagcgcccccuuuaaggagcgccccaccccuucucugaauaacaauugcacaaccuccgaagacagccucgugcuguacaaccggguugcggugcagggagaugucgugagagagcugaaagccaagaaagcuccgaaggaagacguggacgccgcugucaagcagcuucucucccugaaagccgaguauaaggagaaaacgggccaggaauacaagcccgggaauccucccgccgagauuggacaaaacaucucuagcaauuccucugcuagcauucuggaauccaaaagccucuacgaugagguugcggcccagggcgaaguggugcgcaagcugaaagcugagaagucuccuaaggccaaaaucaacgaggccgucgaaugucuucugucccucaaggcucaguauaaagagaagacagggaaagaauacauucccggacagccuccccugagccaaucuuccgacagcucuccgacccggaauagcgagccugccggccuggaaacacccgaggcgaaggugcuuuucgauaagguugcuucccagggggagguggucagaaaacucaagaccgaaaaagccccuaaggaccagguggauaucgccguucaagagcugcugcagcucaaagcucaguauaagagccugaucggcguggaauacaagcccgucucugccaccggagcggaggacaaagauaagaaaaagaaagaaaaggagaacaaguccgagaaacagaauaagccgcaaaaacagaacgacggccagcgcaaggauccuagcaaaaaucaagggggaggccuuuccucuagcggggcuggagaaggccaggggcccaagaagcagacacggcugggccucgaggccaaaaaggaagagaaccuggccgacugguauucccaggugauuacgaaaucugagaugaucgaauaccacgauauuagcggaugcuauauccugagaccuugggcuuacgccauuugggaggcuaucaaggacuuuuucgaugccgaaaucaaaaagcucggcguugagaauuguuacuuccccauguuugugucccagucugcgcucgaaaaagagaagacccaugucgccgacuucgcucccgagguggccugggugacacggagcgggaagaccgaacuggcugagccuauugccauccgcccgacauccgaaaccgucauguaucccgccuacgcuaaauggguucaaagccacagagaccugccuauuaagcucaaccaguggugcaacguggugcggugggaguuuaaacacccccagccuuuccugagaacgcgcgaauuucuuuggcaagagggacauucugcguucgccacaauggaggaagcugccgaggaaguccugcagauccucgaucuguaugcccagguguacgaggaacugcuugcuauucccguugugaagggccggaaaaccgagaaggagaaguuugccgggggagacuauaccacaaccaucgaagcguucaucuccgcuagcggcagagccauucaagggggcacaucucaccaucugggacagaauuuuuccaaaauguucgagaucgucuuugaagauccuaagauuccgggcgagaaacaguucgccuaccagaacagcugggggcucacgacccgcacaaucggagugaugaccaugguucacggcgacaauauggggcuggugcuucccccuagagucgcuugugugcaggucgugauuauccccugcggaauuacaaacgcccugucugaggaagauaaggaggcgcuuaucgcuaaauguaaugacuaucggcgcagacugcucuccguuaacauccgggugcgcgccgaucugagagacaauuacagcccuggcuggaaguuuaaccauugggaacugaagggcguccccauucggcuugagguggggccgcgcgauaugaaauccugccaauucguugccgugagacgggacaccggagaaaagcugacggucgcugagaaugaggccgaaaccaaacuccaggcuauccuggaggauauucaggugacacucuucacccgcgccagcgaagaccugaagacacacauggugguugcgaacaccauggaggacuuucagaaaauccuugauucuggcaagauuguccaaaucccuuucuguggggaaaucgacugcgaggauuggauuaagaaaacaaccgccagagaccaggaucuggagcccggagcucccagcaugggcgccaagucccucuguaucccuuuuaaaccccugugcgaacugcagccuggggcuaagugcguguguggaaagaauccggccaaguacuauacgcuuuucggccggucuuacuga

SEQ ID NO: 68902 - RNA, 2733 nt, Artificial Sequence
  derived and/or modified sequence opt5 from EPS15L1__Homo_sapiens__NP_001245303
auggccgcuccccugaucccucucagccagcaaauuccgaccggcaacucccuguacgagucuuauuacaaacagguggaccccgccuauacagggagagucggagcgagcgaagcugcccuuuuccugaaaaaguccggccucucugauaucauucuggggaaaaucugggaccuugccgauccugagggaaagggcuuucuggacaaacagggguucuacguugcucuccggcugguggccugcgcucagagcggacacgaagugacgcuguccaaucucaaccugucuaugcccccucccaaguuucaugauaccagcuccccucuuauggucacaccgcccagcgccgaggcgcacugggccgugcgcguugaagagaaggcuaaauucgacggcauuuuugagucucugcucccuaucaauggccugcuuuccggggauaaggugaaacccguccugaugaacagcaagcucccucuggacgugcugggaagaguuugggaucucucugacaucgauaaagacggccaucuggaucgggacgaguucgccguggcuaugcaccuugucuaucgcgcccuggagaaggaacccgugccguccgcgcucccucccagccugauuccucccucuaagagaaagaagaccguguuucccggggccgucccuguucuuccggcuucucccccucccaaagacagccugcgguccacaccuucucauggaagcguguccagccucaauucuaccggcucccugagccccaagcacucucugaaacaaacacagccgaccgugaacugggucgugccuguugccgauaagaugcgcuucgacgagaucuuucucaaaacggaucuggaccuugauggguacgugagcggacaggaggucaaggaaauuuucaugcacuccggccugacccagaaucuccuggcucauaucugggcccuugccgacacaagacaaaccggcaagcugucuaaagaucaguuugcucucgcgauguauuucauucagcagaaggugagcaaagggaucgaucccccucaaguucugucccccgacauggugccucccagcgagcggggaacaccgggcccugacucuuccgggagccugggaucuggcgaauuuaccggggucaaggagcucgaugacauuucccaggaaaucgcccagcugcaacgcgagaaauacagccuugagcaggacaucagagaaaaggaggaagcuauucggcagaagacguccgaggugcaggaacugcaaaacgaucucgaccgcgagacaucuagccugcaggagcuggaagcccagaaacaggaugcccaagacagacuugaugagauggaccagcagaaggcuaaacuccgggauaugcuguccgacguccgccagaagugucaagaugaaacccagaugaucucuagccugaaaacacagauucagucccaagagagcgaccucaagucucaggaagaugaccugaauagagccaaguccgagcuuaaccggcugcagcaagaggaaacccagcucgagcagagcauccaggcgggaagagugcaacuggaaaccauuaucaaaucucugaaguccacacaggaugagaucaaucaggcucgcagcaaacuuucucagcuccacgagagccggcaagaagcccauagaucccuggagcaguacgaccagguucuggacggcgcccacggcgcuagccucacggaucuggccaaccuuucugaaggggugucccuggcugagcgcggcagcuucggagccauggacgaucccuucaagaauaaagcgcuccuguuuuccaacaauacccaggaacugcaccccgacccuuuccaaacagaggauccguuuaagucugaccccuucaagggggccgauccuuuuaaaggagaccccuuccagaacgauccuuuugcugagcagcaaaccacaagcaccgaccccuucggcggggauccuuuuaaggaauccgaccccuuccggggcucugccacggaugacuuuuucaaaaagcagaccaaaaacgacccguuuacaagcgauccuuucaccaagaaucccucccuuccuucuaaacucgaccccuucgagagcuccgauccguuuagcuccuccagcgucucuuccaagggaagcgacccuuucggcacacuggaucccuuugggucuggauccuucaacagcgcugaaggcuuugccgacuucucccagaugagcaagccuccucccucugggcccuuuaccagcucccugggaggcgcgggguucucugaugacccguuuaaaagcaagcaggauacacccgcccucccucccaaaaagccugcucccccuagaccgaaacccccuuccggcaagucuacgcccgugagccaacugggauccgccgacuucccugaggcucccgauccguuucagccucuuggcgccgacucuggggaccccuuccagagcaagaaaggauuuggcgaucccuucuccgggaaggacccuuucguucccagcucugccgcuaaaccuuccaaggcgagcgccucuggauuugcugauuucaccuccuuuggcaaugaagaacagcaacuggccugggccaaacgcgagagcgaaaaggcugagcaggaacggcucgccagacugcgccggcaggagcaggaagaccuggagcuugcgauugcucucuccaaggccgauaugccggccgcuuga

SEQ ID NO: 68903 - RNA, 2502 nt, Artificial Sequence
  derived and/or modified sequence opt5 from EPS8__Homo_sapiens__XP_005253396
augagcaaccugaauacccaggugaaggacacaaugaacggccacaucuccaaucaucccucuagcuucgggauguacccuucccaaaugaacggauauggcucuagcccgacguuuucccagaccgauagagagcacgggucuaaaacaagcgccaaggcucucuacgaacagcggaaaaauuaugcccgcgacuccgucagcucuguuuccgauauuagccaguacagaguggagcaucugaccacauucgugcuugaccggaaggaugcgaugaucaccgucgacgaugggauucgcaaacugaagcuccuggacgcuaagggcaaaguguggacacaagauaugauccuucagguugacgauagagccgugucucugauugaccucgaauccaagaacgagcuggaaaauuuuccccugaacaccauccagcacugccaggccgucaugcauagcuguucuuaugauuccgugcucgcucugguuugcaaagagccuacgcaaaauaagcccgaccuucaccuguuccagugugacgaggugaaagccaaccucaucagcgaagauauugaguccgcuaucucugacagcaagggaggaaagcagaaacggcgcccugaugcccugagaaugauuuccaaugcggaccccagcaucccuccgcccccucgggcccccgcuccugcucccccgggcaccgucacacagguggaugugcgcucuagagucgccgccugguccgcgugggccgcugaccaaggcgauuuugaaaagccucggcaguaccacgagcaggaggaaacccccgagaugauggccgcucgcauugacagagauguucaaauccuuaaccauauucuggacgauaucgaauuuuucaucacaaaacuccagaaggccgccgaggcuuucagcgaacugucuaaacggaagaaaaauaagaaggggaaacgcaagggaccuggcgagggggugcugacccucagagcgaaaccucccccuccggacgaguuucuggacugcuuccagaaguuuaaacacggauucaaccuucuggccaagcucaagagccauauucagaaucccuccgcugccgaucuggugcacuuucuuuucacgccucugaacauggucgugcaagccacaggcgggcccgaacucgcuucuagcguucuguccccucugcucaacaaagacaccaucgauuuccugaauuauacagugaacggagacgagcggcagcuuuggaugagccugggcggcaccuggaugaaggccagagcggaauggcccaaagagcaguuuauuccgccuuacgucccccgcuuccggaaugggugggaaccucccaugcucaacuuuaugggagcuaccauggagcaggaucuguaccaacuugccgagucuguggccaauguugcugaacaccagagaaagcaggagaucaaacgccuguccacagaacauagcucuguguccgaguaucacccugccgacggcuacgcuuucagcuccaacauuuauacgcgggggucucaucucgaucagggagaagccgcggucgccuuuaagcccaccagcaauagacacaucgaccgcaacuacgagccgcugaagacacaaccuaaaaaguaugcuaaauccaaguacgauuucguggcccggaauaacucugagcugagcguccucaaagacgauauccuggaaauucuugacgauagaaagcagugguggaaggugcgcaaugcuuccggcgacagcggguuuguucccaacaauauccuggacauugugcggcccccugagucuggacucggcagagccgauccgcccuauacccauacaauccagaaacagcgcauggaauacggcccucggcccgcggacaccccucccgccccuuccccgcccccuacgcccgcuccuguccccgugccgcugccucccagcacacccgcccccguucccgugucuaaggucccugcuaacauuaccagacaaaauuccagcucuagcgauuccgggggaagcaucgugcgggacucucagcgccacaaacagcugccgguggauagacggaagucccaaauggaggagguucaggacgaacuuauccacagacucaccauuggccgcagcgccgcccagaaaaaguuccaugucccccggcagaacgugccugugaucaacauuacauacgauuccacccccgaggacgucaaaacauggcugcaaucuaagggguuuaauccugugacgguuaacagccugggagugcucaauggcgcucagcuguucucccuuaacaaggaugaacugagaaccgucugucccgagggggcgcgcguguauucucagaucacaguucagaaagccgcucucgaagacagcuccggcucuagcgagcugcaagagauuaugagacggcgccaggaaaagaucuccgccgccgcuagcgauucuggaguggaguccuuugacgaaggcagcucucacuga

SEQ ID NO: 68904 - RNA, 2148 nt, Artificial Sequence
  derived and/or modified sequence opt5 from EPS8L2__Homo_sapiens__NP_073609
augagccaguccggcgccgugucuugcugucccggggcuaccaacggaagccugggcagauccgacggggucgccaagaugucuccuaaagaucucuucgagcaacggaagaaauacagcaauuccaacguuaucaugcacgaaacaucucaguaucaugugcagcaccuggcgacguuuauuauggacaagagcgaggcuaucaccuccguggaugacgccauucgcaaacuuguccagcugagcucuaaggaaaagaucuggacacaagagaugcuccuucaggugaaugaucagucccuuagacugcucgacauugaaagccaggaggagcuggaagauuucccgcugcccaccguucaacggucucagacagugcucaaccagcugcgcuacccuuccguccuucugcucgugugccaggacagcgagcaaucuaaacccgauguucacuuuuuccauugugacgaaguggaggccgagcugguccaugaagauaucgaguccgcucuugccgacugcagacugggaaagaaaaugcggccucagacccucaagggccaccaggagaaaauccgccaaagacagagcauucugcccccuccgcaggggcccgcuccuauccccuuucagcaccggggaggcgauuccccugaggccaagaaucgcgugggcccccaagugccgcugucugaaccuggguucagacggcgcgagagccaggaggaacccagagcgguccucgcccagaagauugagaaagaaacacagauccugaacugugcucuugacgacauugagugguuuguugcccggcugcaaaaggcugccgaagcguucaaacagcucaaucagcgcaagaaaggaaagaaaaagggcaagaaagccccugcugagggggugcugacccuuagagcccggccucccuccgagggagaauuuaucgauugcuuccagaagauuaaacuggcuaucaaccuccuggccaagcugcaaaaacauauccagaauccuagcgccgcugagcucgugcacuuucuguucggcccgcuugaccugauugucaacacguguucugggcccgauaucgcgagauccgugagcugcccucuccugucucgcgacgccguugauuuucuucggggacaucuggugcccaaggaaaugagccucugggagucccugggcgaaucuuggaugagaccucgcagcgaguggccccgggagccgcaggucccucuguaugugcccaaguuccacuccggcugggaaccucccguugacgugcuccaggaggcuccuugggaagucgaggggcuggccagcgcccccauugaggaagugucuccggucuccagacaaagcauccgcaauucucagaaacacuccccuaccagcgagcccacacccccuggagaugcucugccgcccguguccucuccucauacccaccggggcuaccagcccacacccgccauggcgaaguauguuaaaauucuguacgacuucaccgcuagaaacgccaaugaacucagcgugcugaaggaugagguccuggaagugcuugaggacgggcgccaaugguggaaacuccgguccagaucuggacaggccggcuauguucccuguaacauccugggggaggcucgcccugaagaugccggagcucccuuugagcaggccggccagaaguacuggggcccggcgagcccuacgcauaagcugcccccuuccuuccccgggaauaaagacgaacucaugcaacacauggacgaggugaacgaugaacugauccggaagauuagcaacaucagagcccagccgcagcggcauuuucgcgucgagagaucucagccugugucccaaccccuuacauacgagagcggaccugacgaagugcgggcuuggcuggaggccaaggcuuucucucccagaauuguugaaaaucucggcauccugaccgggccccagcuguuuucccuuaacaaagaggaacucaaaaaggucugcggagaggagggcgugcgcguguauagccagcugacaaugcagaaggccuuccuggaaaaacaacagucugggagcgagcucgaagaacugaugaauaaguuucacuccaugaaccagcggagaggcgaggauagcuga

SEQ ID NO: 68905 - RNA, 1233 nt, Artificial Sequence
  derived and/or modified sequence opt5 from EPSTI1__Homo_sapiens__NP_001002264
augaacaccagaaaucggguggucaacagcggccugggggccucccccgcuucucgcccuacaagagacccgcaggaucccagcggacggcaaggcgagcucuccccuguugaagaccagcgcgaggggcuggaagccgcgcccaagggaccuucuagagagagcguggugcacgcuggccagcggcgcacguccgccuacacccuuaucgcccccaauauuaacagacggaaugaaauccagcgcauugcugagcaagagcuggccaaccucgaaaaauggaaggagcagaauagagcuaaaccuguccaucuggugccgcggcgccuugggggaucucagagcgaaacagagguuagacagaagcaacagcugcagcucaugcaguccaaauauaagcaaaagcugaaacgggaggaaagcgugcgcaucaagaaagaggccgaagaggcggaacugcagaagaugaaagccauucagagagagaagucuaacaagcucgaggagaaaaagcggcugcaagaaaaucuuagacgcgaggcuuuccgggaacaccagcaguacaaaaccgccgaauuucuguccaagcucaacacagagagccccgauagaucugcuugccaguccgccgucuguggcccucaaagcucuaccuggaaacugcccauccuuccucgcgaccauuccugggcgcggagcugggccuauagagauucccugaaggcugaggaaaaucgcaaacuccagaagaugaaggacgagcagcaccagaaaucugaacugcuggagcucaagcggcaacagcaggaacaggagagagccaaaauccaucaaacagagcaccgccgggugaacaaugcuuuccuggauagacuucagggcaagagccagcccgggggacuggaacaguccggcgggugcuggaacaugaauagcggaaacucuuggggcucccuccugguuuuuagccgccaccuucggguguacgagaaaauucugaccccgaucuggccuucuagcacggaccucgaaaagccccaugagaugcuguuccugaacgucauucucuuuucccugaccguguucacacuuaucucuaccgcccacacacuggauagagccgugcggagcgacuggcuccugcuuguccugauuuaugcuugucucgaggaacugaucccugagcugauuuuuaaucucuacugccaagggaacgcgacccuguucuuuuga

SEQ ID NO: 68906 - RNA, 2148 nt, Artificial Sequence
  derived and/or modified sequence opt5 from EPX__Homo_sapiens__NP_000493
augcaccuucuccccgcccuggcuggcgugcuugccacccugguccucgcgcagccuugcgaggggacagacccggcuagccccggagccguugaaacguccgugcugagagauuguaucgccgaggcuaagcugcugguggacgccgcuuacaacuggacccaaaaaucuauuaagcagcggcuccgcagcggcuccgccucuccuauggaucugcugagcuauuucaaacagcccgucgcggccacaagaaccgugguucgggcugccgacuacaugcauguggcucucgggcugcuugaagagaagcugcagccucaacgcuccggacccuuuaaugucacagaugugcucaccgaaccucagcugagacuucugucucaggccagcggcugcgcgcuccgggaccaggccgagcgcuguuccgauaaauauagaacaaucaccgggcggugcaacaauaagcgcagaccgcugcugggagcuagcaaccaagcccucgcucgguggcugcccgccgaguacgaagacggccuuucucugccuuucggcuggacgcccucccgcagacggaauggguuucuccugccucuuguucgcgccgugagcaaccagauugucagauuccccaaugagcggcugaccucugauagaggacgcgcucucauguuuaugcaguggggccaguucaucgaccacgaucuggacuuuuccccggaaagcccugcgcggguggccuucacagcugggguggauugugagagaaccugcgcccaacugcccccuuguuuucccauuaagauucccccuaacgacccgcgcaucaaaaaucagcgggacugcauccccuucuuuagaucugccccuuccuguccccagaacaagaaucgcguccggaaccaaaucaaugcucucaccagcuucguugaugccuccaugguguauggaucugaggugagccugucccuuagacugcgcaaccggacaaauuaccucggccugcuugcgauuaaccagagauuucaggacaacgggcgcgcucugcucccuuucgauaaucugcaugacgaucccugccugcucacgaaccggagcgccagaaucccguguuuccuggccggagacacacggucuaccgaaacaccuaaacuugcugccaugcacacccuguuuaugcgcgagcauaauagacucgcuaccgaacugcggagacugaacccccgcuggaauggcgauaaacuuuauaacgaggcccggaagauuaugggcgcgaugguccagaucauuacauacagagacuuccucccucuggugcuggggaaggcccgcgcuagacggacgcucggacacuaccgcggcuauugcuccaauguugaucccagaguggccaacgucuuuacccuggcuuuccgguuugggcacacaaugcuucaaccuuucauguuucgccuggacagccaguacagagccucugcgcccaauagccaugugccgcucuccucugccuucuuugcuagcuggcggaucguuuaugaaggaggcaucgauccuauucugcgcgggcugauggccacccccgcuaaacuuaacagacaggacgccaugcucguggacgagcugcgggaucgccuguucagacagguccggagaaucggacucgaccuggccgcucuuaauaugcaacgcucccgggaucacggccugcccggcuacaacgcguggagacgcuuuugcgggcucagccagccucggaaucuggcccagcugucuagagugcuuaagaaccaggaccucgcucgcaaguuccugaaucuguauggaacaccggauaacauugacaucuggauuggcgccaucgccgagccccuccugccuggggcucgggucggaccccuucuggccugucucuuugaaaaccaauucagacgcgcgcgggauggcgacagauucugguggcagaaacgcgggguguuuaccaagcggcagagaaaagcucugucccggaucagccugucucgcauuaucugcgauaauacgggcauuacaaccguuuccagagacaucuuccgggccaacauuuacccuagaggauuugugaauuguagccgcaucccccggcuuaaccucuccgccuggagaggcaccuga

SEQ ID NO: 68907 - RNA, 969 nt, Artificial Sequence
  derived and/or modified sequence opt5 from EPYC__Homo_sapiens__NP_004941
augaagacccuggccggccucgugcuggggcuugucaucuucgacgcugccguuacagcgcccacgcuggagagcauuaacuacgauuccgaaaccuaugacgcuacacucgaggaucuggacaaucuuuacaacuaugaaaauaucccuguggauaaaguggagauugaaaucgccaccgucaugccgucuggaaacagagagcugcucacacccccuccccagccugagaaggcccaagaagaggaagaggaggaagagagcacaccccggcugauugacggcuccucuccucaggaaccggaguuuaccggggugcugggaccccacaccaaugaagauuucccuacgugccuccuguguaccugcaucagcacaaccguuuacugugacgaucaugagcuugacgcuauucccccucugcccaaaaacacagccuauuuuuacucccgcuucaauagaaucaagaaaaucaacaagaaugauuuugcuucucucagcgaccugaagcggauugaucuuaccuccaaccugaucagcgagauugacgaagacgccuuccgcaaacucccgcagcugagagagcuggugcuccgggauaauaagauccgccagcugccugaacuucccacgacacugaccuuuauugacaucucuaacaauagacucggccggaaagggaucaagcaagaggcguucaaagauauguaugaccugcaccaucuuuaccugacagauaacaaucucgaccacauuccucugccccugcccgaaaaccuccgcgcccugcaucuucagaacaauaacauccuggagaugcacgaggauaccuuuugcaaugucaagaaccucaccuacauuagaaaggcucuggaagacauccggcuugauggaaauccuauuaaccuguccaaaacaccgcaggccuauaugugucucccccgccugccugugggcagccugguuuga

SEQ ID NO: 68908 - RNA, 1314 nt, Artificial Sequence
  derived and/or modified sequence opt5 from ERAL1__Homo_sapiens__NP_005693
auggccgcucccagcuggagaggcgcccggcuggugcaguccguccuccgcguuuggcaaguggggccucacguggcgagagagcgggucaucccguucucuagccugcuuggauuucagcgcagaugcguguccuguguugcuggcucugccuucagcgggccccggcuggccuccgcuucucgcagcaacggacagggcuccgcccucgaccauuuucugggguucagccagccugauucuuccgugacccccugcgucccugcugugagcaugaauagagacgaacaagauguucuucuggugcaccaucccgacaugccugagaacucucggguccuccgcguggugcugcugggagccccgaaugcgggcaaguccacacucagcaaccagcugcuuggcagaaaagucuuucccguuucucggaaggugcacacgacccgcugucaggcccugggggugauuacagaaaaagagacccaggucauccuccuggauacaccuggaauuaucucccccggcaagcaaaagagacaucaccuugaacugagccuccuggaggacccuuggaaguccauggagucugcugaucuggugguugugcucgucgacgugagcgauaaguggacccggaaucagcugagcccccagcuucugcgcugccucacaaaauacucccagauuccgucuguucuggugaugaacaaggucgacugucuuaaacaaaaguccgugcugcucgaacugaccgccgcucugacggagggggucgugaauggaaagaagcucaagaugagacaggccuuccacagccauccuggcacccacugccccucuccugcgguuaaagaucccaacacacagagcguggggaauccccaacggaucggauggccucauuuuaaggaaaucuucaugcuguccgcccuuucucaggaggacgucaaaacccugaagcaguaucuccugacacaggcucaaccgggccccugggaguaccacagcgccgugcuuaccucccagacgccugaagagauuugugcuaacaucauuagagaaaaacugcucgagcaucugccccaggaaguuccuuauaaugugcagcaaaagacagccgucugggaggagggccccgggggagaacuggugauccagcagaaacuccuggugccgaaggagagcuacguuaaacuucugauuggcccuaaagggcacgucaucucucagauugcccaagaagcuggacacgaucucauggacaucuuucugugcgacguggauauccgccuguccgugaaacuucucaaauga

SEQ ID NO: 68909 - RNA, 2826 nt, Artificial Sequence
  derived and/or modified sequence opt5 from ERAP1__Homo_sapiens__NP_001185470
augguguuccugccccucaaguggagccuggccaccauguccuuucuucugucuagccuccuggcucugcugacagucuccacgccuucuuggugccagagcaccgaggccuccccgaaaagaucugacggcacacccuucccuuggaacaagauccggcuccccgaauacguuauuccugugcacuaugaucugcugauccaugcgaaucucaccacacugaccuuuugggggacaaccaaaguggagauuacggcuagccaacccaccuccacaaucauucuucacagccaucaucugcagaucucucgcgccacccucagaaagggagccggcgaacggcuguccgaggaaccucuucagguccuggagcacccgcgccaggagcaaaucgcucuccuggcccccgaaccucugcucguggggcugcccuacacaguugugauucacuaugcuggaaaccuuagcgagaccuuccacggcuuuuacaaaucuacguauagaacaaaggaaggggagcugcggauccucgccuccacccaguucgagccuacagcggcccgcauggcuuuucccuguuucgacgaaccggccuuuaaggcuagcuucucuauuaaaaucagacgggagccucgccaucuggccauuuccaauaugccccuugucaagagcgugaccguugcggaaggacugaucgaggaucacuuugacgugaccgucaaaauguccacauaccucguggccuucauuaucucugauuuugaaagcguguccaagaucacgaaaagcggcgucaagguuucuguguaugcugugccugacaagauuaaccaggccgauuacgcucuggacgccgccgucacccugcucgaguucuacgaggauuauuucuccauccccuacccccugccuaaacaggaccuugcugcgauuccggauuuucaaagcggcgccauggaaaauugggggcugacaaccuauagagagucugcucuccuguucgacgccgaaaagagcuccgccucuagcaaacuuggaaucacaaugaccguggcucaugagcuggcccaccagugguuuggcaaccucguuacgauggaaugguggaaugaucuguggcugaacgagggguucgcgaaguuuauggaguucguguccgucagcgugacacaccccgaacucaaaguuggagacuacuuuuucggcaagugcuuugacgcuauggagguggaugcccuuaauucuucccauccugucagcacccccguggaaaacccugcccagauucgggagauguucgacgaugucucuuaugacaaaggggcuuguauccuuaauaugcugcgcgaauaccucuccgccgaugcuuuuaagagcggaaucgugcaguaucugcaaaagcacuccuacaaaaacaccaagaaugaggaccugugggauucuauggccagcauuugccccacagacggcguuaaaggcauggauggguucuguuccagaucucagcauagcuccucuucuucccacuggcaucaggagggaguggacgucaagaccaugaugaacacauggacgcuucaaaaaggcuuuccgcucaucaccauuacagugcgggggcgcaauguucacaugaagcaggaacacuacaugaagggaagcgauggcgcgccugacaccggguaucuguggcaugugccccugacauucaucaccucuaaauccgacaugguccacagauuccuccugaagacgaaaaccgaugugcuuauucugccugaggaaguggaguggaucaaguuuaacguuggaaugaacggcuacuauaucguccauuacgaggacgauggcugggacagccucacagggcugcugaaaggaacccacacagccgugucuagcaaugaucgggcuucccuuauuaacaaugccuuccagcucgugagcaucggcaagcugucuauugaaaaggcucuggaccucucccuguaucuuaaacacgagaccgaaaucaugcccgucuuucaggggcugaacgagcucauuccuauguacaagcugauggagaaaagagauaugaaugaaguggagacgcaauucaaggccuuucugauccgccuucuccgggaccugauugauaaacagacauggaccgacgaaggaagcguuuccgagagaaugcugcgcucucagcuccugcuucuggcgugcgugcauaacuaucagcccuguguccaacgggccgaaggcuacuucagaaaguggaaggagagcaaugggaaccucucccugccgguggauguuacacuggcuguguuugccgucggcgcucagucuaccgaaggaugggacuuccuuuacagcaaauaucaguuuucccucucuagcaccgagaagucccagaucgaguucgcccugugccgcacacaaaauaaagaaaagcugcaguggcuccuggaugagagcuuuaaaggcgacaagaucaaaacgcaggaguucccucagauucuuacccugaucgggcggaaccccgugggauacccccucgccuggcaauuucugagaaagaauuggaacaagcugguucagaaauucgaacuuggcagcuccagcauugcucacauggugauggggacaaccaaucaguucucuacacgcacccggcuggaagaggucaagggauuuuucuccagccucaaagagaacggcucucaacugagaugugugcagcagacgaucgaaacaauugaggaaaauaucggguggauggacaagaacuuugauaaaauccgcguguggcuccaguccgagaagcuggagcggauguga

SEQ ID NO: 68910 - RNA, 2883 nt, Artificial Sequence
  derived and/or modified sequence opt5 from ERAP2__Homo_sapiens__NP_001123612
auguuccacagcuccgccauggugaacucucauagaaagcccauguuuaauauccaccggggcuucuacugccugaccgcuauucucccucagaucuguauuugcagccaauuuuccgucccgucuagcuaucauuucacagaggaccccggggccuuuccuguugcgacgaacggagaacgcuuccccuggcaggagcugagacuuccuuccguggugaucccccugcacuacgaucucuuuguccauccuaaucugaccucucuugacuucguggcuagcgagaaaauugaaguucugguguccaacgccacacaguuuaucauccuccacagcaaggaucuggaaauuaccaaugccacacugcagucugaggaggacucccgguauaugaaaccgggcaaggaacucaaaguccugagcuaccccgcucacgagcaaaucgcccuucuggugccugaaaagcucacaccccaucugaaguauuacguugcuauggauuuccaggccaaacuuggggacggauuugagggcuucuauaagucuaccuaccgcacccuugggggagagacgcggauucucgcggugaccgauuuugaaccuacacaggccagaauggcuuuccccuguuucgacgagccgcuguuuaaagccaacuucuccaucaagauucgcagagaaagccggcacaucgcucugucuaauaugccuaaagucaagaccauugagcucgaaggcggccugcuugaggaucauuuugagacaaccgugaagauguccacguaccugguggccuauaucgucugcgacuuccacagccucuccggguuuacaucuagcggaguuaaaguguccaucuacgcgagccccgauaagcgcaaccagacccacuaugcccugcaagcuagccuuaaacugcucgacuucuacgaaaaguauuuugauauuuacuauccucuguccaaacuggaccucaucgccauucccgacuucgcucccggcgccauggagaauugggggcugaucacauacagagaaaccagccuucuguuugauccuaagaccucuagcgccuccgacaaacucugggugacacgggucauugcucaugagcuggcgcaccagugguucggaaaccuugugacgauggaaugguggaaugauaucuggcugaaggagggcuuugccaaguacauggagcucaucgcuguuaacgccaccuauccggaacugcaguucgacgauuacuuucugaauguguguuucgaggucauuacaaaagacucucucaacagcucccgccccaucagcaagccugccgaaacccccacacagauucaagagauguucgaugaagugucuuauaauaaaggggcuugcauccugaacaugcuuaaggacuuucugggagaggagaaauuccagaagggcauuauccaguaccucaagaaauuuuccuauagaaacgccaagaaugaugaccuguggagcucucuguccaacagcugucuugaauccgauuucaccucuggcgggguuugccauagcgacccuaaaaugacguccaauaugcucgcguuucugggagagaacgcugaagugaaggagaugaugacaaccuggacccugcaaaaaggcaucccccuccuggucgugaagcaggacggguguucucuucggcugcagcaggagcgcuuccuccaaggagucuuucaggaagauccggaguggagagcccugcaggaacgguaccuguggcacauuccucuuacauauagcaccuccagcucuaaugugauccauagacacauucucaaguccaaaacagacacgcuggaucugcccgagaagaccagcuggguuaaauucaacguggacucuaauggcuacuacaucguccacuaugaagggcauggaugggaucagcucauuacacaacugaaccagaaucacacccuucugcgcccuaaggaccgggugggccucauccaugauguuuuucagcuggugggcgccgggagacugacacuugacaaagcucucgauaugaccuacuaucugcagcacgagacguccagccccgcccugcucgagggacugucuuaccuugaaucuuucuaucacaugauggaccgccggaacauuuccgauaucagcgagaaucugaagagauaccuccugcaauauuuuaagccugucaucgaccgccagucuugguccgauaaaggcagcgugugggaccggaugcugagauccgcucugcucaagcuggccugcgaccugaaccaugcgcccuguauucagaaagccgcugaacucuucucucaguggauggagagcuccgggaagcugaauaucccgaccgaugugcuuaaaauuguuuacucugucggagcccaaacaaccgcuggcuggaacuaccugcucgaacaguaugagcugagcauguccucugccgagcagaauaagauccuguacgcgcuuagcacauccaaacaccaagaaaagcugcucaagcugauugagcucgggauggaaggcaaagugaucaagacccagaaccuggccgcccuucugcaugcuaucgcucgccggccuaaaggacagcagcucgccugggacuuugugagagagaacuggacgcaucugcugaagaaauucgaucuuggcagcuaugacauucgcaugaucauuucugggacaaccgcccacuucuccagcaaggauaagcugcaagaagucaaacucuuuuucgagucucuggaggcucagggaucccaccucgacaucuuucagacagugcuggaaaccauuaccaagaauaucaaauggcuugagaagaaccugcccacacuccggacguggcugaugguuaauaccuga

SEQ ID NO: 68911 - RNA, 702 nt, Artificial Sequence
  derived and/or modified sequence opt5 from ERAS__Homo_sapiens__NP_853510
auggagcugcccaccaagccuggcacauucgaccucgggcuggccacguggagcccguccuuucagggagaaacccacagagcucaagcccggcgcagagaugugggccggcagcuucccgaguacaaagcggucguugugggggcuucuggagugggcaagagcgcccugacaauccagcucaaccaucagugcuucgucgaagaccacgauccuaccauucaagacuccuauuggaaagagcugacacuugauucuggggacuguauccugaaugugcucgauaccgccggacaggcuauucaucgcgcccugagagaccagugccuggcuguuugugauggcgugcucggcgucuuugcccuggacgaucccagcucccuuauccagcugcaacagauuugggcgacaugggggccucaccccgcccagccucucgugcugguuggaaacaagugcgaccuugugaccacggcuggcgaugcccaugcugccgcggccgcucuggcccacucuuggggagcucacuucgucgaaaccagcgccaaaacacggcaggggguggaggaggccuuuucccuccuggugcaugaaauccaacgcguccaggaggcuauggcgaaggaaccgauggccagaagcugucgggagaagacccgccaccagaaagcuacaugccauuguggcugcucuguugccuga

SEQ ID NO: 68912 - RNA, 3678 nt, Artificial Sequence
  derived and/or modified sequence opt5 from ERBB2__Homo_sapiens__NP_001005862
augaagcugagacuccccgccagcccugagacccaccuggacaugcuucggcaucuguaccagggcugccaagugguccaggggaaccucgaacugacauaucuuccgacgaaugcuucccugucuuuccuccaggauauccaggagguucaaggauacgugcugauugcccacaaccaggugcgccaggucccccugcagagacuccggaucgugcgcggcacccaacuguuugaagacaauuaugcgcuugcuguucuggauaacggggacccucucaauaacacaacccccgugacaggagccagcccuggcgggcugagagagcuucagcugcggucccucaccgaaauucugaaaggaggcguccugauccagcgcaauccccagcucuguuaccaagauacaauucuguggaaggacaucuuccauaaaaacaaucagcuugcccugacccucaucgauacgaacagaucucgggcuugccacccuuguagcccgaugugcaagggcucccgcuguuggggagagucuagcgaggacugccagucccugaccagaacagugugugccgggggcugcgcucgguguaaagggccccuuccuaccgauugcugucaugaacaaugcgccgcgggaugcacaggccccaagcacagcgacugucuggccugccuccacuuuaaucauucugggauuugugagcugcacugcccugcucugguuaccuauaacacggauacauucgaauccaugcccaauccggagggacgcuacaccuuuggcgccagcugugugacagcuugcccuuauaacuaccucucuaccgacgucggcuccuguacccuggugugcccccuucauaaucaggaggugacagccgaagaugggacgcagagaugugagaagugcagcaaaccuugugcgcgggucugcuacggacugggcauggaacaccuccgcgagguuagagccgugaccucugcuaacauccaggaauuugccgggugcaagaaaauuuucggaucccuggcuuuccuucccgagagcuuugacggcgaccccgccuccaacacagccccucugcaaccggagcagcuccagguguucgaaacccuggaggaaaucacaggguaucuguacauuucugcuuggcccgauagccucccugaccuguccgucuuucagaaucuucaagugauccggggacgcauucugcacaacggcgcguauagccucacccugcagggccuggggaucucuuggcuuggacuccgcucccugcgggagcugggcagcgggcucgcccugauccaucacaauacgcaucuuuguuucguucacacagugcccugggaucagcuguuuagaaacccucaucaggcucuccugcacaccgccaaucgccccgaagacgagugcgucggagagggccuggccugucaccaacuuugcgcucgggggcauuguuggggcccgggaccuacccagugcgugaacuguucucaguuccucagaggccaggaaugcguugaggaaugucgcgugcugcaagggcugccccgggaguacgucaaugccagacacugccucccuugucaucccgaaugccagccucagaacggaagcgugacaugcuucggccccgaggcggaucaaugugucgcuugcgcccacuauaaggacccgccuuuuuguguggcccgcugccccuccgggguuaaacccgaucugucuuacaugccuauuuggaaguucccggacgaggaaggagcuugucagcccugcccuaucaauuguacccacagcugcguggaucuugacgauaagggcugucccgccgagcagcgggcuuccccucugacaagcauuaucucugccgucguggggauucuccugguugugguccugggcgugguguuuggaauccuuaucaaaagacgccagcaaaagauucggaaauauacgaugagacggcuccugcaggaaaccgagcugguugagccccucacaccuuccggcgcgaugcccaaccaggcccagaugcgcauccugaaggaaaccgagcuuagaaaagucaaggugcuggggagcggagcuuucggcacaguguacaaagggauuuggaucccggacggagaaaaugucaagauuccuguggccaucaagguucuccgggagaacaccucucccaaagcuaauaaggaaauccuggacgaggccuacgugauggcgggcgucggguccccuuaugugagcagacugcuuggcauuugccucacguccaccguucaacuggugacacagcugaugcccuacggaugucuccuggaucauguccgcgagaaccggggcagacuugggucucaggaccugcucaauuggugcaugcagaucgccaaaggaaugagcuaucuggaagaugugcgccugguucacagagaccuugcugcccggaacgugcuggucaaguccccgaaccaugugaaaauuaccgauuuuggccucgcucgccugcucgacaucgaugagacagaauaccacgccgacgggggaaaggugccuauuaaguggauggcccuggagucuauccuuagacggcgcuucacccaucaaagcgaugucugguccuauggcguuacggugugggaacugaugacauuuggggcuaaacccuacgacggcauuccugcgagagagauccccgaucuccuggagaagggagaacggcugccccagccuccgaucugcaccauugacguguauaugaucauggucaaauguuggaugauugauagcgagugccgccccagauuccgggaacuugugucugaguuuucccgcauggccagagacccucagcgguucguugugauccaaaaugaagaccugggccccgcuagcccucucgauucuacauuuuacagaucccugcucgaggacgaugacaugggggaucuggucgacgccgaggaauaccuugugccccagcagggauucuuuuguccugauccggcccccggcgcugggggaaugguucaccaccgccaucggagcucuagcaccagauccggcggcggggaccugacccucggacuggagccuagcgaagaggaggcccccagaucuccucuggcgcccuccgaaggcgcugggagcgauguguucgacggagaucuuggcaugggggccgccaagggacugcagucccucccgacacacgacccuucuccccugcaacgguauagcgaggaucccacggucccucuccccuccgaaaccgacggcuacguggcuccucugacaugcucuccgcagcccgaguauguuaaccagccugacgugagaccccagccucccagcccgcgcgaaggcccucuucccgccgcgcggccugcuggggccacccuggagagacccaaaacacuguccccuggaaagaauggcgucgugaaggauguguucgccuuugggggagcugucgagaaccccgaauaccucaccccgcaaggcggggccgcuccucagccccaucccccuccggccuucucucccgcguuugacaaucuguauuacugggaucaggacccucccgagcgcggagccccucccagcacguucaaaggcacaccuaccgcugaaaacccggaguaucuuggccuggauguucccguguga

SEQ ID NO: 68913 - RNA, 3909 nt, Artificial Sequence
  derived and/or modified sequence opt5 from ERBB2IP__Homo_sapiens__NP_001006600
augaccacaaagagaagccuguucgugcggcucguccccugccgcugucugagaggcgaggaagagacgguuaccacacuugacuacucccacugcucucuggaacaggugccuaaagagaucuuuaccuucgaaaagacacucgaggagcuguaucuugaugccaaccaaauugaagaacugccgaaacagcucuuuaauugucagagccugcauaagcugucccuccccgacaacgaucugaccacacuuccugcuucuaucgccaaucugauuaaccuccgggaacuggacgugagcaaaaaugggauccaggaguuccccgagaacauuaagaauugcaagguccuuaccaucguggaagcguccguuaacccuaucucuaaacugcccgauggauuuagccaacuccugaaucugacgcagcucuaccugaacgacgcuuuccuugaguuucugccugccaauuucggccgccucaccaagcugcagauucuugaacugagagagaaccagcucaaaaugcugccgaagacaaugaaucggcugacccaacucgaacgccuggaucuuggguccaacgaguuuacagaggugcccgaaguccuggagcagcucagcggacugaaagaguucuggauggacgccaauagacuuaccuuuaucccuggcuucauugggucucugaagcagcucacguaucuggauguguccaagaacaacaucgagaugguugaagagggaauuagcacaugugagaaucugcaggaccuccugcuuucuuccaacagccugcaacagcuccccgaaaccaucggcucucugaaaaauauuacaacccugaagaucgaugagaaccagcuuauguaccucccugacuccaucggcgggcugauuagcguggaagaacuggauugcuccuuuaaugaagucgaggcucuccccucuagcaucggacaacugaccaaccuucggacauucgccgcugaccacaauuaucugcagcagcucccgccugagauuggcuccuggaaaaacaucacggugcuguuccugcauagcaauaaacuugaaacccuccccgaggaaaugggggacaugcagaagcugaaggugauuaaccugucugauaaucgccucaaaaaccugccuuuuuccuucacaaaacuucaacagcugaccgccauguggcucagcgacaaucagucuaagccccugaucccccugcagaaggagacagauagcgagacccaaaagaugguccuuacgaacuacauguuuccucagcagccgagaacagaagacguuauguucaucuccgauaaugagucuuuuaaccccagccucugggaggagcagcggaaacaacgcgcccagguggcguucgaaugugacgaggauaaggacgagagagaagcuccuccccgggagggaaaccugaaacgcuauccuacccccuacccggaugaacugaagaauauggugaagaccguccagacaauugugcacagacucaaagacgaggaaaccaacgaggauuccggccgggaccugaagccucaugaggaccagcaagauaucaauaaagacguuggggugaagacaagcgaaucuacgaccacagucaaauccaagguggaugagagagaaaaguacaugauuggaaacagcguucagaaaaucucugagcccgaagccgagauuuccccuggcagccuucccgugaccgcuaauaugaaggccuccgagaaccugaaacacaucgucaaucacgacgauguguuugaagagucugaggaacucagcuccgacgaggaaaugaagauggcggagaugcgcccuccccugaucgaaacaucuauuaaccagccgaaagucguggcccugagcaauaacaagaaggaugacaccaaagagacggauucccuuagcgacgaaguuacccauaauucuaaccaaaauaacuccaauugcagcucuccuucccggaugagcgauucugugagccucaacacagacuccagccaggauaccucucuguguucccccgucaagcagacacacaucgacauuaacagcaaaaucagacaggaggacgagaauuucaacucccugcuccaaaauggcgauauucugaacucuagcaccgaagagaaguuuaaagcucaugacaagaaagauuucaaucuucccgaauaugaccugaacguggaggaacgccucguucugaucgagaaguccguggauucuacggccacagcugacgauacccacaagcuggaccacauuaauaugaaccuuaauaaacugaucacaaacgauaccuuucagccugagaucauggaacggagcaagacccaggacauuguccucgggacauccuuccugucuaucaauagcaaagaggaaacggagcaucucgaaaacggaaauaaguacccgaaccuggaguccgugaauaaagugaacggccacagcgaggaaaccucucagucccccaacagaacagagccucaugauagcgacugcucuguugaucuugggauuuccaagagcaccgaagaccugucuccccaaaaguccggaccugucggcagcguggugaaaucccacagcaucacaaauauggagauugggggacucaagaucuaugacauccugucugauaacggcccccagcagccuagcaccacggucaaaauuacauccgccguggacggcaagaauaucguucgcucuaaaagcgccacccugcuuuacgaucagccccugcaaguguuuaccggguccucuagcuccucugaccucauuagcggaacaaaggcuaucuucaaguucgauuccaaccauaauccggaggaaccuaacauuauccggggccccaccagcgggccucagucugcgccccagaucuauggaccgccucaauacaauauucaguauuccagcucugccgcugucaaagacacacuguggcacuccaagcagaacccccagaucgaucacgccagcuuuccuccccaacuccugcccagauccgagucuacggaaaaucagagcuacgccaaacauuccgcuaacaugaauuucagcaaccacaauaacgugcgcgccaauaccgcguaccaucuucaccagcggcugggcccugcuagacacggggagaugugggccauuucuccgaacgaccgccucauccccgccguuacacgguccaccauucagagacaaagcucugugagcuccacagcuucugucaaucugggcgauccuggaagcacccggcgcgcccagauccccgaaggcgacuaucuguccuacagagaguuucauucugcugggcggacgccucccaugaugccuggaagccagagaccgcuuuccgcccgcaccuauagcaucgauggccccaacgcgucucggccucaguccgccagacccagcauuaacgagaucccugaacgcacaauguccgugucugacuucaauuacagcagaaccucccccucuaagcggccgaacgcucgcguugggagcgagcacucccugcucgacccucccggaaaaagcaaggugcccagagauuggcgggaacaaguccugcgccauauugaggccaagaaacucgaaaagaucagagugcggguggagaaagacccugagcugggcuuuucuauuuccgggggcgucggaggccgcgggaaucccuucagaccugaugacgauggaaucuuuguuacacgggugcagccggaaggccccgcuagcaaacuucugcagccuggggacaagauuauccaggccaacggauauucuuucaucaauauugagcacggccaagcggugucccugcucaagaccuuucagaacacagucgaacugaucauugugcgcgagguuagcucuuga

SEQ ID NO: 68914 - RNA, 552 nt, Artificial Sequence
  derived and/or modified sequence opt5 from ERBB3__Homo_sapiens__NP_001005915
augagagccaacgacgcucuccaggugcugggccugcuuuucagccuggcccggggguccgaggucggaaauucucaagcgguuugccccggcacccucaacgggcugagcgugacaggagaugcugaaaaucaguaccagacgcuuuauaagcuguacgagcgcugugaaguggucaugggcaaccucgagaucgugcugaccgggcacaaugccgaccuguccuuucuccaguggauuagagaaguuacaggauaugugcuggucgccaugaacgaguucucuacccuuccucugccgaaucuccgggugguucgcggcacacaaguguacgauggcaaauuugcuaucuucgucaugcugaacuauaauaccaacagcucccaugcccuuagacagcugcggcucacacagcugaccgggcaguuucccauggugccuucuggacugacgccccaaccugcucaggacugguaccuccuggaugacgauccccgccuucugacccucagcgccuccagcaaggugccugucacacuggcggccguuuga

SEQ ID NO: 68915 - RNA, 3879 nt, Artificial Sequence
  derived and/or modified sequence opt5 from ERBB4__Homo_sapiens__NP_001036064
augaagcccgccaccggccugugggugugggucagccuccugguugcugccgggacagugcagccuuccgacucucaaagcgugugcgcgggaacggagaacaaacuuuccucucugagcgaucucgaacagcaguacagagcucugcggaaguauuacgagaauugugaagucgugaugggcaaccuugagaucaccuccauugaacacaaucgcgaccugucuuuccucagaagcguucgggaggugacaggguauguccugguggcccugaaccaguuucgcuaccucccgcuggagaaucuuagaaucauucggggaaccaaacuguaugaagaucgcuacgcccucgcuaucuuccugaacuauagaaaggacggcaauuuugggcuucaagagcugggacucaaaaaccugacagaaauucugaauggcggcguuuacguggaucagaacaaguuccucugcuacgccgacaccauccauuggcaggauaucguccggaaucccuggccuuccaaccugacacuugugagcaccaaugggucuuccggauguggccgcugccacaagagcuguacggggagaugcuggggacccaccgagaaccauugucagacacugacccggacagugugcgcugagcaaugugacggccgcugcuaugggccuuacgucucugauuguugccacagagaaugcgccggaggcuguuccggccccaaagacaccgauugcuuugcguguaugaauuucaacgacagcggggccugcguuacgcaguguccucagacauuuguguauaacccgaccacauuccagcucgagcauaauuuuaacgcuaaguacaccuauggagccuucugcgugaaaaaguguccccacaauuuugucguggauucuuccagcugcguucgggcuuguccuuccucuaaaauggaaguggaggaaaacggcauuaagaugugcaagcccuguaccgacaucugcccuaaagccugcgacgggauuggaacaggcagccugauguccgcgcaaacggucgauagcucuaauaucgacaaguucauuaacuguaccaaaaucaaugggaaccuuauuuuucuggugacaggaauccacggcgaucccuacaaugccaucgaggcuauugacccggagaagcucaacguuuuccgcaccgugagagaaaucacaggcuuccugaauauucaguccuggccucccaacaugaccgauuuuagcgucuucucuaaucuggugacgaucgggggacggguccucuauagcggccugucccuucugauucucaaacagcaagggaucacaucucugcaguuucagagccuuaaggagaucuccgccggaaacauuuacaucaccgacaauagcaaccugugcuacuaucauaccauuaacuggacaacccucuucucuacaaucaaucagagaauugugauccgcgauaaccggaaagcugaaaauuguacggccgagggcaugguuugcaaccaccuguguuccagcgacgggugcuggggcccuggacccgaucaaugucugucuugcagacgcuuuucccggggcagaaucuguauugaaagcugcaaucucuacgacggggaguuccgcgaguuugaaaacggauccaucuguguggagugcgauccccagugcgaaaagauggaggacggccugcuuaccugucaugggccuggaccggacaauugcacaaaguguucucacuucaaagauggccccaacugcgucgaaaaguguccugacgggcugcagggcgccaauagcuuuauuuucaaauaugcugaucccgaccgggagugccacccuugucaucccaacugcacccagggauguaauggcccgacaucccacgauugcaucuacuauccuuggaccgggcauucuacgcucccccaacacgcgagaaccccucugauugccgcuggagugaucggcgggcuguuuauucuuguuaucgugggacucacauucgccgucuacgugcgcagaaagagcaucaaaaagaagagagcccugcgccgguuucuggagaccgaacucguggagccccugacaccuuccggcaccgcucccaaccaggcccagcuucggauucugaaagaaacggagcucaagcggguuaaaguccuggggagcggcgcguucggaacaguguauaagggcaucugggugccggagggggaaaccgucaaaauuccuguggcuaucaagauucugaaugagacaaccggacccaaggccaacguugaguucauggacgaagcccuuaucauggcuucuauggaucauccccaccucgugcgccugcugggcgucugucucuccccuaccauccagcuggugacacaacuuaugccgcacgggugccugcucgaauacguucaugagcacaaagacaauauuggaagccagcugcugcuuaacuggugcgugcagaucgccaagggcaugauguaccucgaggaaagacggcugguccauagagaucuggcugcccgcaacgugcucguuaaaucucccaaucacgugaagauuacggacuuugggcuggcgcggcuucuggagggcgaugaaaaagaguauaacgccgacggaggcaagaugccuaucaaguggauggcucucgaauguauucacuacagaaaauucacccaucaguccgaugucuggagcuauggggugacaaucugggagcugaugaccuuuggaggcaagcccuacgacgggaucccuacacgcgagauucccgaccugcuugaaaaaggagagagacucccucaacccccgaucugcaccauugauguguauauggucaugguuaaguguuggaugaucgacgccgauucucggccuaaauucaaggaacuggcugccgaguuuagccgcauggcgagagacccccagcgguaccuggugauucagggcgaugaccgcaugaaacucccuucccccaaugauagcaaguucuuucaaaaccugcuugacgaagaggaucuggaggacaugauggaugccgaagaguaucucgugccgcaggcuuucaauaucccucccccuaucuacacgucuagagcccggauugacuccaaccgcaaucaguuugucuacagagauggcggguucgcugccgaacagggagugagcguucccuaucgggcccccacauccaccaucccugaggcuccgguggcgcaaggcgccaccgcugagauuuuugacgacucuugcuguaacgggacacugcgcaagcccgucgccccucacgugcaggaagauagcuccacccagagauacucugccgaccccacaguuuucgcuccugagcggagccccagaggagaacuggaugaggaaggcuauaugacgccuaugcgcgacaaaccgaagcaggaguaccuuaaucccguggaggaaaacccuuuugucucccggcgcaaaaauggggaucugcaagcccucgacaaccccgaguaucauaaugcgucuaacggaccucccaaggcugaagaugaguacgugaaugaaccgcuguaucucaacaccuucgccaacacacugggcaaagccgaguaccuuaagaauaacauccugagcaugccugagaaggcuaaaaaggccuucgacaaucccgauuacuggaaccacucccugcccccuagaagcacccuccagcaucccgacuaucugcaggaauacucuacaaaauauuuuuacaagcagaauggccggauuagaccuaucguugcggagaacccggaauaucuuuccgaguucagccugaaacccgggaccgugcucccucccccucccuaccgccaccggaauacggucguguga

SEQ ID NO: 68916 - RNA, 3456 nt, Artificial Sequence
  derived and/or modified sequence opt5 from ERC1__Homo_sapiens__XP_011519238
auguacggcagcgccagauccguggggaaggucgagcccucuagccaguccccuggacggucuccgcgccugcccagaagcccucggcucggccaccgcagaaccaacuccacagggggaucuagcggcuccagcguugggggaggcucuggcaaaacgcuguccauggaaaauauccaaagccuuaacgcugccuaugcgaccucugggcccauguaccuguccgaccaugagaaugugggaagcgaaacaccuaagucuaccaugacacucggccgguccgggggacgccugcccuauggcgugagaaugaccgcuauggggagcuccccuaacauugccucuagcggagucgccuccgauacaaucgcuuucggcgagcaccaucuuccgcccgugagcauggccucuaccguuccucacucccugcggcaggcucgcgacaauacgauuauggaucuccagacccagcugaaagaagugcugagagagaacgaccuccugcggaaggaugucgaggugaaagaaagcaagcucucuagcuccaugaauagcaucaagacauuuuggagccccgagcugaaaaaggaacgcgcccucagaaaagacgaggcguccaagauuaccaucuggaaagagcaauaccggguugugcaggaagagaaccagcauaugcagaugacaauccaagcccugcaggaugaacuucgcauucagagagaccugaaucagcuuuuccaacaggauucuucuucccggaccggcgagccuugcgucgcugaacugacggaggagaacuuucagagacugcacgccgaacacgagcgccaagcuaaggaacucuuccugcuucggaagacacuggaggaaauggagcucagaaucgagacccagaaacagacacugaaugcccgcgacgaaagcauuaagaaacuucuggagaugcuccagucuaaggggcuguccgcgaaagccaccgaagaggaucaugaacggaccagacgccuggcugaggccgagaugcacgugcaucaccucgaaagccugcuugagcaaaaggaaaaagagaacuccaugcugcgggaggaaaugcacagacgcuuugagaaugcucccgacucugccaagacaaaggcccuccagacggugaucgaaaugaaagauagcaagauuuccucuauggagcggggacugagagaccuugaagaggagauccagaugcugaaaagcaacggcgcucucuccaccgaggaacgcgaagaggaaaugaagcagauggaggucuaucggagccauucuaaauucaugaagaauaagauugggcaaguuaaacaggagcuguccagaaaggacacagaacugcucgcgcugcagaccaaacuugagacacugaccaaccaguuuagcgauucuaagcaacacaucgaagugcucaaagagucccugacggccaaggaacagcgggcugccauccugcagacagagguggacgcccuucgccucagacuggaggaaaaggagaccaugcugaacaaaaagaccaaacagauucaagauauggcugaagagaagggaacacaggccggcgagauccaugaccucaaagauaugcuggacgucaaggaacggaaggugaauguucuucagaaaaagauugagaaccugcaagaacagcucagagauaaagagaagcagaugagcucucugaaagaacgcgucaagagccugcaggcggacaccacaaauacggauaccgcucuuacaacccucgaggaggcccuggccgaaaaagagcggacaaucgaaagacugaaggagcaacgcgacagagaugaacgggagaagcaggaggaaauugacaacuacaaaaaggaccucaaagaucugaaggagaaagugucccuucugcagggggaccucagcgaaaaggaggcuucucugcuggaucuuaaggaacacgccuccagccucgcuuccucuggacugaaaaaggacagccgccugaaaacccucgagaucgcccuggagcagaagaaagaagagugucuuaagauggaaucccaacugaagaaagcgcaugaggccgcucucgaggccagagcuucuccggaaaugagcgaucggauccagcaccuggagcgcgaaauuacgagauauaaggacgaguccucuaaagcccaggcggaaguggaucggcugcuugagauccucaaggagguugaaaaugagaaaaacgacaaggauaagaaaauugccgaacuggagagccugaccucccgccaggugaaggaccaaaauaaaaaggucgcuaaccucaaacacaaggaacagguggagaaaaagaaaagcgcccagaugcuggaggaagcuagacggcgcgaggauaaucuuaacgacucuucccaacagcugcaggauagccucagaaagaaggacgaccggaucgaggaacuggaagaggcccugagagagucuguccagauuacagccgaacgcgagauggugcuugcucaagaagaguccgcgcggaccaaugccgagaaacagguugaggaacugcucauggcuauggaaaaggugaaacaggagcuggaaagcaugaaggccaagcucucuuccacacagcaaagccuggccgagaaagagacccaucuuacgaaccugagagcugaacgccggaagcaccucgaggaaguccuggagaugaaacaggaagcccugcuugcggcuaucuccgagaaggaugccaauaucgcccugcucgagcugagcucuagcaaaaagaagacacaggaagagguggcugcccucaaaagagaaaaggaccgccugguucagcaacuuaaacagcagacccagaaccggaugaagcugauggcggauaauuacgaggacgaucauuucaaauccucucacagcaaccaaacaaaccacaagccuucccccgaccagauuauccagccucuccuggaacuggaucaaaauagaucuaaacuuaagcuguacauuggccaucucaccacccugugccacgaccgcgauccccucauccugcggggccuuacacccccugcuagcuauaaccuggacgaugaccaggccgccugggagaaugagcugcagaagaugacgagagggcagaacaccccgcauuuucucaaacccgcuuccgccaaucuguggccugauaaggacuuccaaucucccagcgugcaccuucugcuccaggacuguacauccagcaaacauucuacccagaaggaauccgucgcuagccagucucacggaaagacagccuuuuuccacgugaugcugaugcuccaagaugagcuggaaaaaggcgagcgggacaacgcggagcuucaggaauuugccaaugcuauucugcagcagaucgccgaucauugcccugacauucuggagcaagugguuaacgcucucgaagaguccagcuga

SEQ ID NO: 68917 - RNA, 2874 nt, Artificial Sequence
  derived and/or modified sequence opt5 from ERC2__Homo_sapiens__NP_056391
auguacggcagcgccagaaccaucacaaaccuggaggggucccccucucggagcccucgccucccgagaagcccccggcugggacaccgcagaacgucuagcggcgggggaggcgggaccggaaagacacuuuccauggaaaauauucagucucugaacgcugccuaugcgaccagcggcccuauguaccucuccgaccaugagggcguggcuagcacaaccuaucccaaagggacaaugacccugggacgggccacgaaucgcgccgucuacggcgggagaguuaccgcuaugggaucuuccccuaacaucgccagcgcuggccuuucucacacagaugugcuguccuauaccgaccaacaugggggacucacaggcagcucucaccaucaccaccaucaggugcccuccaugcugcggcagguccgcgauagcaccaugcuggaccuccaggcccaacugaaggaacuucagagagagaaugaucugcuccggaaagaacuggacauuaaggauuccaaacuuggcucuagcaugaacuccaucaagacguucuggagcccugagcugaagaaagagcgcgugcucagaaaggaagaggcggcccggaugucuguucugaaagaacagaugcgcgugucccacgaggagaaucagcaucugcaacucacaauucaggcucugcaggacgaacuuagaacccagcgggaucugaaccaccuccugcaacaggagagcgggaauagaggagccgaacacuuuacaaucgagcuuaccgaagagaacuuccgccggcugcaggcugagcaugacagacaagccaaggaacucuuucugcugcgcaaaacccucgaggaaauggagcugcggaucgaaacacagaagcagacgcuuaaugcgagagaugagucuauuaagaaacugcucgagaugcugcagagcaagggccuuccguccaaaucucuggaagacgauaacgagcgcacccggagaauggccgaagcugagagccaagucucccaccucgaagugauccuggaccagaaggagaaagagaauauucaucugcgcgaggaacuccaccggagaagccagcugcagcccgaaccugccaagacaaaagcucugcaaaccguuaucgagaugaaggacacaaagauugccucucuggagcgcaacauccgggaucucgaagacgagauucagaugcugaaagccaauggggugcugaacaccgaagauagagaggaagagaucaagcagaucgaggucuacaaaucccauagcaaguucaugaaaacgaagauugaccagcuuaagcaagaacucucuaaaaaggaguccgaacugcuggcucuccagacaaaacuggagacccuuagcaaccaaaauuccgauugcaagcagcacaucgaagugcugaaagagucucucaccgcgaaggagcagcgggccgcuauucugcagacagaaguggacgcccugcgccuuagacucgaggaaaaggagagcuuucugaacaaaaagaccaaacagcugcaagaucucacagaagagaagggaacgcuggccggcgagauccgggacaugaaagauaugcuugaagucaaggagagaaagauuaauguucugcagaaaaagaucgaaaaccuccaggagcagcugcgcgacaaagauaagcaacugaccaaucuuaaagaccgggugaagucccuccagacagacucuagcaacaccgauacagcucuggccacccuggaggaagcgcucuccgagaaagaaagaaucauugagcgccugaaggaacagagagagcgggacgaucgcgagagacuugaagagaucgaauccuuccggaaggagaauaaagaccugaaggaaaaagugaacgcucuccaggccgagcugacggagaaggaaucuucccugauugaucuuaaagagcacgccagcucucucgcuuccgccgggcugaagcgcgacagcaagcugaaaucucucgaaaucgcuauugagcaaaagaaagaagaguguagcaagcuggaggcccagcuuaaaaaggcgcauaauaucgaagaugacuccagaaugaaccccgaguuugccgaucagaucaagcagcuggacaaagaagcuagcuauuaccgggaugagugcggaaaggcccaagcugaggucgaccgccuccuggaaauucugaaagagguggaaaaugagaagaacgauaaagacaagaagaucgccgaacuugagucucugacccucagacacaugaaagaccagaauaagaaaguugcgaaccugaagcauaaucagcaacucgagaaaaagaaaaacgcccagcugcuugaagaggugcggcgcagagaagauuccauggcugacaacagccagcaccuucagauugaggaacucaugaaugcccuggagaagacacggcaagagcuggaugcuaccaaggccagacuugccuccacacagcagucucuggcugaaaaagaggcgcaccucgccaaccugcgcaucgaacggagaaagcagcucgaggaaauucuggagaugaaacaagaggcccuucuggcugccaucagcgaaaaggacgcuaauauugcccuccuggagcuguccgcgucuaaaaagaagaaaacccaggaagaggucauggcucuuaagcgcgagaaagaucggcuggugcaucagcucaagcagcaaacgcagaacagaaugaaacugauggccgacaauuacgaugacgaucaccaucacuaucaucaccaccaucaccaucaccaucaccgcagcccuggccggucccagcacucuaaccauagacccagcccggaccaggaugacgaagagggcaucugggccuga

SEQ ID NO: 68918 - RNA, 822 nt, Artificial Sequence
  derived and/or modified sequence opt5 from ERCC1__Homo_sapiens__NP_001159521
auggaccccggcaaggauaaagagggggugccucagccgagcggacccccugccagaaagaaauucgucaucccccuggacgaagaugagguuccucccggcguggcuaagccucucuuucgguccacccaaucucugccgacaguggacacgagcgcccaggcggcuccccagaccuacgccgaauaugccauuucccagccucuugagggggcuggagccacaugccccaccggcucugaaccucuggcuggggagacacccaaccaagcccucaaaccgggagcuaagagcaauuccaucauugucucuccucgccagagaggcaaccccgugcugaaguucguucggaaugugccuugggaguuuggcgaugucauccccgacuacgugcuugggcagagcaccugugcccuguuccucucccugcgcuaucacaaccugcaucccgauuacauucacggaagacuccagagccugggcaaaaauuuugcgcuucggguucugcucgugcaagucgacgugaaggauccucagcaggcccugaaagaacuugcuaagaugugcauccuggccgacuguacacucauccuggcguggucuccggaggaagccgggcgcuaucuggagaccuacaaggcuuaugagcagaagcccgccgaucuccugauggaaaaacuugagcaagacuucguguccagaagccuggaacagcucauugcugccucucgggaggaucuggcccuuugcccuggacugggcccccagaaagcucgcagacucuuugacguccugcaugaaccuuuccugaagguucccuga

SEQ ID NO: 68919 - RNA, 2283 nt, Artificial Sequence
  derived and/or modified sequence opt5 from ERCC2__Homo_sapiens__NP_000391
augaagcugaacguggacggccuccuggucuacuuccccuaugauuacaucuauccugagcaguuuagcuacaugagagaacuuaaacggacccuggacgccaaggggcacggaguucucgagaugccguccggcacagggaaaacggugucucugcuugcucugauuauggccuaucaacgcgcguacccccucgaagugaccaagcugaucuauugcagcagaacagucccugagauugaaaaagugaucgaggagcugcggaagcuccugaauuucuacgaaaagcaggagggagaaaaacuucccuuucugggccucgcucuguccucucgcaagaaccuuuguauucauccugagguuacaccccugagauucgggaaagauguggacggaaagugccacagccucaccgccuccuacguccgggcccaguaucagcaugauaccucucugccucacugucgcuuuuacgaggaguucgacgcucauggcagagaagugccgcugcccgccggcaucuauaaucucgaugaccugaaagcucuugggcggcgccaaggauggugcccuuacuuucuggccagauauagcauccuccacgcgaacguuguggucuacuccuaucacuaccugcuugaucccaagauugccgaccuggugagcaaggaacucgcucggaaagccguggucguuuucgaugaggcucauaauaucgacaacguguguauugauucuauguccgugaaucugacacgcagaacccuggaccggugccagggcaaccucgaaacgcugcagaagaccguccuucgcaucaaagagacagacgagcagagacugcgggaugaauacagacgccucguggaggggcugcgggaagccagcgcggccagagagaccgacgcucaccuugccaauccuguucugcccgaugaagugcuccaagaggcugucccgggaucuauucgcacagccgagcauuuucugggcuuccugcggagacuccuggaauaugugaaguggcgccuucggguucagcacgugguccaggaguccccucccgccuuucugagcgggcucgcucagagaguguguauccaacgcaaaccucugcgguucugcgcggaaagacugcgcucucuucuccacacccuggagauuacggaccuggccgauuuuagcccccucacacugcuugcuaacuucgccacccuggucuccacauacgccaagggauucaccaucaucauugaacccuuugacgaucggaccccuacaaucgcuaauccgauucuccauuucuccuguauggacgccucucuggcgaucaaacccguguuugagagauuccagagcguuauuaucacguccggcacccugagcccucuugauaucuaucccaagauucucgacuuucacccugugacaauggcuaccuucacaaugacccuggcccgggucugccugugucccaugaucauuggccgcgggaacgaucagguggccaucucuuccaaguuugagacgagagaagacauugcuguuauccggaauuacggaaaccuccugcuugagaugagcgccguggucccggacggcaucguggcuuucuuuacaucuuaucaauacauggaaagcaccguggccuccugguaugagcaggggauucuggagaauauccagagaaacaaacuccuguucauugaaacccaggauggagcggagacaucuguugcccuggaaaaguaccaagaggcuugcgaaaacggccgcggggccauccuucucagcgucgcucggggaaaaguguccgagggcauugacuuugugcaucacuacggcagagccgucaucauguucggggugccuuauguuuacacccagagccgcauucugaaggcgagacuggaguaucuccgggaucaguuucagauccgcgaaaaugacuuccugacauucgaugccaugagacaugcugcccaaugcgugggacgggcuauccgcggcaaaacggacuacgggcuuauggucuuugccgauaagagauucgcccggggagacaagcgcggcaaacugcccagauggauucaggagcaccucaccgaugcuaaccugaaucugacaguggacgaagggguucagguggcgaaguauuuucuucggcagauggcccaaccuuuccaccgcgaggaucagcucggccugucucugcucucccuggaacagcuugagagcgaggaaacccugaaaagaaucgagcagauugcucaacagcucuga

SEQ ID NO: 68920 - RNA, 2349 nt, Artificial Sequence
  derived and/or modified sequence opt5 from ERCC3__Homo_sapiens__NP_000113
augggcaagagagaccgggccgaucgcgacaaaaagaaaagcagaaagcggcacuacgaggaugaagaggacgaugaagaggacgcucccgggaacgauccucaggaagccgugccguccgcggcuggaaaacaagucgacgagucuggcaccaagguugaugaguauggggccaaggacuaccgccugcagaugccccucaaagaugaccauacaagcagaccucuguggguggcccccgauggacacaucuuccuugaggcuuuuuccccuguguauaaguacgcccaggacuuccuggucgcuauugccgaacccgugugccggccuacgcauguucacgaauauaaacucaccgcguacucucuguaugccgcugugagcgucggccuucagacauccgacaucaccgaguaccugcgcaagcucucuaaaacaggggugccggauggaauuaugcaauuuaucaagcuguguaccguuagcuacggcaaggugaaacugguccucaagcauaauagauauuucguggaguccugccaccccgacgugauucagcaucugcuucaggauccugucauccgggaaugucgccugagaaacagcgagggcgaagccacagagcucaucaccgaaacguuuaccucuaaauccgcuauuagcaagacagccgagucuuccgggggacccagcaccucucggguuacagacccucagggcaaauccgauauccccauggaccuguucgauuuuuacgagcaaauggacaaggaugaagaggaagaggaagagacccagacggugagcuucgaggugaaacaggaaaugauugaggaacuucagaagcgcugcauccaccuggaguauccgcuccuggcggaauacgacuuuagaaaugauuccgucaacccugacauuaauaucgaccugaagcccacagccgugcuccggccuuaucaagagaaaucucugcgcaagauguucgggaacggcagagcucggagcggaguuauugugcuucccuguggggccggaaaaucccuggucggcgugaccgcugccugcacaguuagaaagcgcugucucgugcugggcaauagcgccgucucuguggagcaguggaaagcucaguuuaagaugugguccaccaucgaugacagccaaaucugccgguucaccucugaugcgaaggacaaacccauuggguguagcgucgccaucuccacauacucuaugcuuggacacacgaccaagagaagcugggaagcugagcgcgugauggaauggcugaaaacacaggaguggggccucaugauucuggaugagguucauaccaucccugccaagauguuucggagagugcugacaauuguccaggcccacugcaaacucgggcugaccgcuacgcuugugcgcgaagacgauaagaucguugaccugaacuuccucaucggaccgaagcuguaugaggccaauuggauggaacuucagaacaauggcuacauugcgaaagugcaaugugcugaggucuggugccccauguccccugaguucuaccgggaauauguggccaucaagaccaaaaagcgcauucugcucuacacaaugaaccccaauaaauuuagagccugccaguuccugaucaaguuucacgagcggagaaacgauaagauuaucguguucgcugacaauguuuuugcccugaaagaauaugcuauccgccucaacaagccuuacauuuaugggcccaccagccagggagagcggaugcagauccugcaaaacuucaaacauaauccgaagauuaacacaaucuuuauuucuaaagucggcgauaccuccuucgaccuuccugaagccaaugugcugauccagauuagcucucacggcggguccagacggcaggaggcgcagcgccucggaagagugcugcgggccaagaaaggcauggucgcugaagaguacaacgccuuuuucuauagccuggugucccaagauacacaggagauggcuuacucuacgaagagacagcgcuuucuuguugaccagggguacagcuucaaggugaucaccaaacucgccggaauggaagaggaagaccuggcguuuuccacaaaggaggaacaacagcagcugcuccaaaaaguccuggccgcuaccgaucuugacgccgaggaggaagugguugcuggcgaguucgggucucggagcucccaggccagcagacgcuucggcacaaugucuuccaugagcggagccgaugacaccguguauauggaauaccauucuuccagaagcaaggcucccucuaaacacguccauccucuguuuaagcgguuccgcaaguga

SEQ ID NO: 68921 - RNA, 2751 nt, Artificial Sequence
  derived and/or modified sequence opt5 from ERCC4__Homo_sapiens__NP_005227
auggagagcggccagcccgccagacggaucgcuauggccccucugcucgaauacgagcgccaacuggugcuugaacugcucgacaccgaugggcuggucguuugcgcgagaggacuuggcgcugaccggcugcucuaucacuuccugcagcugcauugucacccggccugccucgugcuggugcuuaacacacagcccgccgaggaagaguacuuuauuaaucagcugaagaucgagggggucgaacaucucccucgcagagugacgaacgagauuaccuccaauucucgguaugaaguuuacacacaaggaggcgugaucuucgcuaccagccgcauucuggucguggauuuucuuacagacagaauccccuccgaucugaucaccgggauucucguuuaucgggcccaccgcaucauugagucuugucaggaggcuuucauccugagacuguuucggcagaaaaacaagcgcggauucauuaaagccuuuacagacaaugcgguggccuucgauaccggcuuuugccaugucgaaagagugaugcggaaccucuucgugcgcaagcuguaccuuuggccuagauuucacgucgcuguuaauagcuuccuggagcagcacaaacccgaagugguggagauccaugucuccaugacgccuaccaugcucgccauucaaacagcuauccuggacauccuuaacgccugucugaaggaacucaagugccacaauccgucucuggagguggaggaucugagccucgaaaacgcgauuggcaaacccuuugacaagaccauccggcauuaucuggauccucuuuggcaccagcugggggccaaaacaaagucccucguucaggaccugaaaauucuuagaacccugcuccaguaccugagccaauacgauugugugacguuccugaaucuccuggagucucuucgcgcuacagaaaaggccuucggacagaacuccggcuggcuguuucucgacagcucuaccuccauguucaucaaugcucgggccagagucuaucaucugcccgacgccaagaugagcaaaaaggagaaaauuucugaaaagauggagaucaaagagggggaagagacaaagaaagaacuggugcuugaguccaacccuaagugggaagcucucaccgagguucugaaggagaucgaagcggagaauaaagaaagcgaggcccugggaggccccggacaggugcucauuugcgcuuccgaugaccgcaccuguucucaacugcgggauuacaucacacuuggggccgaggccuuucugcucagacuguaucgcaagacguucgaaaaagacagcaaggcugaggaagucuggaugaaauuucggaaggaggauuccagcaagcggauucgcaaaucucacaagcggccgaaagacccucagaacaaggaaagagccuccaccaaagagcgcacacugaagaagaaaaagcggaaacuuacccucacacagauggugggcaagcccgaggaacuggaggaagagggcgaugucgaagagggguacagacgggagaucagcucuagcccugaauccugccccgaggaaauuaaacacgaggaguucgacgugaaccugucuagcgaugcggcuuuuggaauccucaaggagccccugaccaucauucauccucuucugggcuguuccgacccguaugcccucacgcgcguucugcacgagguggaacccagauacgucgugcuguaugaugccgagcuuacauucguucggcagcucgaaaucuacagagcuagccgcccugggaagccccugcggguguacuuucugauuuauggaggcucuaccgaggagcaaagauaccucaccgcccugcgcaaagaaaaggaggcuuucgaaaaacuuaucagagagaaggccuccauggucgugccugaagagagagaggggcgcgacgaaacaaaucuggaccucgugagaggaaccgcgagcgccgauguuucuacagacacgcggaaagcuggcggccaggagcagaacgggacccagcaauccauugucguggauaugcgcgaauuuagaagcgagcugcccucccugauccaucggcgcggaauugacaucgaaccggugacacuugaggucggcgauuauauccucaccccugagaugugcguggaaagaaagucuauuagcgaccugaucgggucccugaauaacggacggcucuacucucagugcauuagcaugucccgcuauuacaaaagacccguucugcuuaucgaguucgauccuagcaagcccuuuucucugacaucccggggcgcccucuuccaggaaauuagcucuaaugacaucuccagcaagcugacccugcuuacgcugcacuucccuagacuccgcauccuguggugucccucuccgcacgcuaccgccgagcucuuugaagaacugaaacagagcaagccucaacccgaugcggccacagcucuugccauuaccgcugacuccgagacacugcccgaaagcgagaaauauaacccugggccgcaggauuuccuccugaagaugcccggcgugaaugccaaaaacugccggucucugaugcaucacgucaagaauaucgccgaacuugcugcgcugucccaggacgagcucaccagcauucugggaaacgccgcuaaugccaagcagcucuacgauuuuauccauacguccuucgccgaggugguuucuaaaggcaaggggaaaaaguga

SEQ ID NO: 68922 - RNA, 3561 nt, Artificial Sequence
  derived and/or modified sequence opt5 from ERCC5__Homo_sapiens__NP_000114
augggcgugcaggggcuguggaagcuccuggagugcagcggaagacaagucucccccgaagcccuugagggcaaaauccuggcuguugacauuucuaucuggcucaaccaggcccugaagggggugcgggaucgccacggaaauagcauugaaaacccucaucuucugacccucuuccacagacuguguaaacugcucuuuuuccggauccgcccgauuuuuguguucgacggcgaugcgccccugcuuaagaaacagacacuggucaagagacggcagcgcaaggaccucgcuuccucugauagcagaaaaacgaccgagaagcugcuuaaaacauuucugaagcggcaagccaucaaaaccgccuuccgcuccaagagagacgaagcucucccuucucugacacaggugcggcgcgagaaugaucuguacguucugcccccucuccaggaggaagagaagcauagcuccgaagaggaggacgaaaaagaguggcaggaaagaaugaaccaaaagcaggcccuucaggaggaauuuuuccacaauccccaggcuaucgauauugagagcgaggacuuuucuucccugccuccggaagugaaacaugagauccucaccgauaugaaggaguucacaaaacggcgcagaacccuguuugaagccaugcccgaagagagcgacgauuucucucaauaucagcuuaaggggcugcucaaaaagaacuaccugaaucagcacauugagcacguccaaaaggaaaugaaccagcagcauuccggacacauccggagacaguaugaggacgaaggcggcuuucugaaagagguggaaagccgccggguugugucugaggacacgucccauuacauucucaucaaggggauucaagcgaaaaccgucgccgagguggauagcgaaucccugccuucuagcuccaagaugcacggaaugagcuucgacgugaaaucuucccccugcgagaaacuuaagacagaaaaagagccugaugcuacgcccccgagcccuagaacacugcucgccaugcaggcugcccugcuuggcucuagcuccgaggaggaacuggaaucugagaaucgccggcaggcgagagggcgcaacgcccccgcugccgucgacgaaggaagcaucuccccucggacccucagcgcuaucaagagagcccuggaugacgaugaggacguuaaagugugugccggcgaugacgugcagaccgggggacccggcgcugaggaaaugcgcauuaauucuuccacagagaacagcgaugaaggccugaagguccgggacgggaaaggaauccccuucaccgcgacacucgccucuuccagcguuaauuccgcugaggaacacguggccucuaccaacgagggcagagagccuaccgacagcgugccgaaggaacaaaugucccugguccauguggggacagaggccuuucccauuucugaugaaagcaugaucaaggaccgcaaagaucggcuuccucuggaguccgcuguugugagacacagcgacgcccccggacucccuaauggccgggaacugacgcccgcgucuccgaccugcacaaacuccgucagcaagaacgagacccaugcugaggugcuggaacagcagaaugagcuuuguccuuaugaaucuaaauucgauuccagccuccugucuagcgacgaugagacaaagugcaaacccaacuccgccagcgaggucauugggccugugucucugcaggaaaccuccagcaucguuuccgugcccucugaggccgucgacaauguggaaaacguugugagcuuuaaugcuaaggagcacgaaaacuuccucgagacgauccaagagcagcagacaaccgaauccgccggacaggaucugauuucuaucccuaaggcugucgagcccauggaaauugacagcgaggaauccgagucugauggcagcuuuaucgaggugcaauccgugauuagcgacgaggaacuucaggccgaguucccggaaaccucuaaaccucccuccgaacagggcgaggaggaacugguugggacacgcgagggagaagcgcccgccgagagcgagucucuccugagagauaauuccgaacgggacgacgucgauggcgagccucaagaagcugagaaggacgccgaagauagccugcaugaguggcaggacaucaaccuugaggaacucgagacccuggaaucuaaucugcucgcucagcagaacucccugaaagcccaaaagcagcagcaggagagaaucgcggccacagugacggggcaaauguuucuugaaagccaggagcugcuccgccuguucggcauuccguacauccaggcucccauggaggccgaagcucagugugccauucuggaucuuaccgaccaaacauccggaaccaucacagaugacagcgauauuuggcucuuuggggcccggcacguguauagaaauuucuuuaacaaaaauaaguucgucgaguacuaccaguauguggacuuucacaaccagcugggccuggaucgcaauaaacucaucaaccuggcuuaccuucugggaucugacuauaccgaaggcauuccuacgguugggugcgugaccgcgauggagauccucaacgaguuccccggacauggccuggaaccucugcuuaaguucagcgagugguggcacgaagcccaaaagaaucccaaaaucagaccuaacccccaugauacaaaggucaaaaagaaacuccggacccugcagcugacaccgggguuuccuaaucccgcuguggccgaggccuaccucaagccuguuguggacgacuccaagggaucuuuccuguggggcaaacccgaucuugacaagauucgcgaauuuugucagagauauuucggguggaaccggaccaaaacggaugagagccuguuuccgguccucaagcagcuggacgcucaacagacacagcugcgcaucgauuccuucuuuagacuugcccagcaagagaaagaagacgcgaagcggauuaagucucagcgccugaauagagcugugaccugcaugcuccggaaagagaaggaagccgccgcuagcgagaucgaagccguuuccguggcgauggagaaagaguucgaacugcucgauaaggcuaaacgcaagacacagaagagaggcauuaccaacacccuggaggaaucuagcucccuuaaacggaagagacugagcgacucuaaacgcaagaauacauguggaggcuuucucggggagacgugccuguccgaaagcucugauggauccagcuccgaggacgccgagucuagcucccugaugaacguccagcggagaaccgccgcuaaagaaccuaagacaagcgccucugauucccaaaauagcgugaaagaggcucccgugaagaacggcggggccaccacaucuagcuccucugacagcgacgaugacggaggcaaggaaaagaugguccuuguuaccgcgcgcuccguguucgggaagaaacggagaaagcugcgccgggccagaggccgcaaacggaagacguga

SEQ ID NO: 68923 - RNA, 4482 nt, Artificial Sequence
  derived and/or modified sequence opt5 from ERCC6__Homo_sapiens__NP_000115
augcccaacgagggcaucccucacagcucccagacccaagaacaggacugccugcagucucagccggugagcaauaacgaggaaauggccauuaagcaagaguccgggggagauggcgaagucgaggaguaccucucuuucagaagcguuggggacggacuguccacaucugcugugggcugugccagcgcggcuccccggcgcgggccugcccuucugcauaucgauagacaccagauucaggccguggaacccuccgcucaggcccucgagcugcaaggacuuggcgucgacguguaugaucaggacguucuggaacagggcgugcuccagcaagucgauaaugcuauccaugaggccagccgggcgucucagcugguggacguugagaaagaauaccgcuccgugcuggaugaccucacgagcugcaccacaucucugagacagauuaacaagaucaucgagcaacuuuccccucaggccgcuaccagccgggauauuaaucgcaaacuggacucugucaagagacagaaauauaacaaggaacagcaacucaagaaaaucacagccaagcagaaacaucugcaggcuauucuugggggagccgaggugaagaucgaacuggaucacgcgucccucgaggaggacgccgaacccggcccuagcucccuggggucuaugcugaugccggugcaggagaccgcuugggaggagcucauucggacaggacaaaugacccccuuuggcacgcagaucccucagaaacaggaaaagaagccccgcaaaauuaugcugaaugaggccagcggguucgagaaguaccuugcugaccaagccaaacuguccuuugaaagaaagaaacagggauguaacaagcgggccgcucgcaaagcgccugcccccgucaccccgccugcucccguucagaauaagaacaagccuaauaaaaaggccagagugcucagcaaaaaggaggaacggcugaaaaagcacaucaagaaacuucagaagcgcgcccugcaauuccagggcaaagugggccuccccaaggcuagacggcccugggagucugauaugagaccugaagccgagggggacuccgagggagaagagagcgaauauuuuccgacagaggaggaagaggaagaggaagaugacgaggucgagggcgcggaagcugaucugucuggggacggaaccgauuacgagcugaaaccccucccuaagggcgggaagcgccagaaaaaggugcccguucaagaaaucgacgaugacuucuuuccuagcuccggagaggaagccgaggccgcuucugugggcgagggcgggggaggcgggcggaaagucggaagauaucgcgaugacggcgacgaagauuacuacaagcagcggcugagacgcuggaacaaacuucggcugcaggacaaggagaagagacucaaacuggaagaugacagcgaggaauccgaugccgaguucgacgagggguuuaaggugcccggcuuccuuuuuaaaaagcuguucaaauaucagcaaacaggaguucgcuggcucugggaacugcacugccagcaggcuggcgggauucugggagaugagaugggccucgggaagaccauccagauuaucgccuuucuggcgggacuuagcuacucuaaaauucggacgagaggcuccaauuaucgcuucgaagggcugggcccgacagugaucgucuguccuaccacagugaugcaucaaugggucaaggaguuccacaccugguggcccccuuuucggguggccauccuccaugagaccggaagcuacacacacaagaaagaaaagcugauuagagacguugcucacugccauggcauccugauuacgucuuauuccuacauccggcuuaugcaggaugacauuagccgcuaugauuggcacuacgugauccucgacgaggggcauaaaaucagaaaccccaaugccgcugucacccuggccuguaagcaguuccggacaccucacagaauuauccuguccggaucucccaugcagaacaaccuccgcgaacuguggagccuuuuugauuucauuuuuccgggcaaacuggggacccucccuguguucauggagcaauuuuccguucccaucacaaugggaggcuacucuaaugcgagccccgugcaggucaagaccgccuauaagugcgcuugugugcugcgggacacgauuaacccuuaccugcuuagacgcaugaaauccgacgugaagaugagccucucucugccggauaaaaaugaacagguucuguucugcagacucacagacgagcaacauaaggucuaucagaacuuuguggauuccaaagagguguaccggauccugaauggggaaaugcagauuuucagcggccuuaucgcccugcgcaagaucuguaaccaccccgaccucuuuucuggaggcccuaagaaucugaaagggcugcccgaugacgagcuugaagaggaucaguucggauauuggaagagauccggcaaaaugauugucguggaaagccuccugaagaucuggcacaaacaagggcagcggguucugcucuuuucucagagccgccagaugcuggacauucuugagguguuccugagagcucaaaaguacaccuaucucaagauggauggaaccacaaccaucgccucccggcagccucugauuacacgcuacaacgaggacacgagcaucuucgucuuucugcuuaccacaagagugggcgggcucggcguuaaucugaccggagccaaccggguggucaucuacgaucccgacuggaauccuucuacagauacccaggcucgcgaaagagcguggcggauuggccagaaaaagcaagugacgguuuauagacugcucaccgccgggacaaucgaggaaaagauuuaccaucgccagaucuucaagcaguuucugaccaaccgggugcuuaaagaccccaagcagagacgcuucuuuaaauccaaugaccuguaugaacucuucacacugaccagcccggaugcuucccaaucuacggaaacaagcgccauuuuugccggaaccggcuccgacguccagacaccuaagugccaccugaagcggagaauccagcccgcuuucggggccgaucaugacgugccuaaacgcaagaaauuucccgcgucuaacaucagcgugaaugaugcuaccuccucugaggaaaagagcgaagccaaaggagccgaggucaacgcuguuaccuccaaccggagcgacccgcuuaaggaugacccucacaugucuuccaaugugacaagcaacgauagacugggcgaagagacgaaugccgugucuggccccgaggaacucuccgucauuagcgggaacggagagugcucuaauuccagcggcaccgggaagacauccaugccuagcggagacgaaucuaucgaugagaaacugggccucagcuacaagcgcgaacggcccucccaagcgcagaccgaggcuuucugggagaacaaacagauggaaaauaacuuuuauaagcacaaaucuaagacaaagcaucacagcguggccgaggaagagacccuggaaaaacaucuuagacccaagcagaaaccuaaaaauuccaaacacugucgggacgccaaguucgaggggacgcgcauuccgcaucugguuaagaaaagacgguaccaaaagcaggacucugagaacaaaagcgaagcuaaggagcaguccaaugaugacuaugugcucgaaaaacuguuuaagaagucugucggagugcacagcguuaugaaacacgaugccaucauggacggcgcuucccccgauuacgugcuggucgaggccgaagcgaaccgcguggcccaggacgcucuuaaggcccugagacucagccggcaaagaugccugggcgcuguuucuggggugccuacauggaccggacaucgcggcauuuccggggcccccgccggaaagaaaagccgguucggcaaaaagagaaauucuaacuucuccguccagcacccuagcuccaccucucccacagagaaaugucaggaugggaucaugaagaaggagggaaaagacaaugugccugaacauuuuagcggccgcgcugaggaugcggacuccagcucuggcccgcucgccuccagcucucugcuugcuaagaugcgggccagaaaccaccugauccuccccgaacgccuggagagcgaguccgggcaucugcaggaagccucugcccuucugccuaccacagagcacgaugaccuccugguggaaaugcggaacuucauugcuuuucaagcgcacacggauggacaggcuagcaccagagagauccuccaggaguucgaguccaaacugucugccagccaauccugcgucuuucgcgagcuucugagaaaucuguguacauuccaucggaccagcggcggggaaggaauuuggaagcucaaacccgaguacugcuga

SEQ ID NO: 68924 - RNA, 2139 nt, Artificial Sequence
  derived and/or modified sequence opt5 from ERCC6L2__Homo_sapiens__NP_001010895
augcagcccggcagcgccccuccgcccgggagaauggacccuuccgcuccccaaccucgggccgagaccucuggaaaggauaucuggcaccccggcgaacgcugccuggcgccuagcccggacaacgggaaacucugugaggcuuccauuaagucuaucacaguggaugaaaauggaaagagcuucgccgucguucuguacgccgacuuucaggagagaaaaauuccccuuaaacagcugcaggaagugaaguucgugaaggauugcccucggaaccucaucuuugacgaugaggaccuggagaaacccuauuucccuaaucgcaaguuucccuccucuagcgucgcuuucaaacuuuccgauaacggcgacagcauuccguacacgaucaauagauaucugcgggauuaccaacgcgaagggaccagauuucucuauggacauuacauccacggcggcggguguauucugggagacgauaugggccuggggaagacagugcagguuaucucuuuccucgccgcugugcugcauaaaaagggaacccgggaggacauugaaaacaauaugccugaguuucuucugcgcuccaugaagaaagagccccucagcucuacagccaagaaaauguuccugaucgucgcgccucuuuccgugcuguauaacuggaaggacgaacucgauaccuggggcuacuuuagaguuacagugcugcacgggaaucggaaagacaacgagcugauucgcgucaagcagagaaaaugcgaaaucgcccucaccacguacgagacccugcggcuuugucuggaugaacucaauagccuggaguggucugcugugauuguggacgaggcccaucgcaucaagaaccccaaggcuagagucacagaaguuaugaaagcccuuaagugcaaugugcggaucggacugaccggcacaauucuccagaacaauaugaaagagcuguggugugugauggauugggcgguccccggccugcucggguccggaaccuauuucaagaaacaauuuagcgacccuguggaacacggccagagacacacggccacaaagcgcgagcuggcuaccgggcggaaggccaugcagagacuugcuaaaaagauguccggaugguuccugcgccggacaaaaacccucaucaaggaucagcugccgaaaaaggaagacagaaugguuuacugcucucuuaccgauuuccaaaaggccguguaucagacaguccuggagacggaggacgugacccucauucugcagagcuccgaacccuguacaugccgcagcggccaaaaacggagaaacuguugcuacaagaccaacucucauggggagacaguuaaaacccuguaucucuccuaccugacggugcuucagaaggucgccaaucacguggcucugcuccaggcggccagcacaucuaaacagcaagaaacccugaucaagcgcauuugcgaucaggucuuuagccgguucccugacuuugugcagaaguccaaagacgcugccuucgagacccugucugaucccaaguauagcggaaaaaugaagguucuucagcaacuccugaaccauugucggaaaaaucgcgacaaggugcugcucuuuuccuucagcacaaaacugcuugauguccugcagcaguacugcauggccucuggccucgacuaccggagacuggauggcuccaccaagagcgaagagagacugaagaucgugaaagaguuuaacucuacacaggacguuaauaucugucuuguguccacgauggcugggggacucggccugaacuucgucggggccaauguggugguucuguuugauccuaccuggaaccccgcgaaugaccuccaagcuauugaucgcgccuauagaaucggacagugccgggacgucaaggugcugagacuuauuagccugggcacaguggaagagaucauguaccuccgccagauuuauaaacagcaacugcacugugucgugguuggguccgaaaacgccaagcgguacuucgaggcugugcagggcucuaaagagcaccagggagaacuguuuggcauccauaaucuuuucaaguuuagaagccaaggguccugccucaccaaggauauccuggaggucuga

SEQ ID NO: 68925 - RNA, 3186 nt, Artificial Sequence
  derived and/or modified sequence opt5 from ERCC6-PGBD3__Homo_sapiens__NP_001263988
augcccaacgagggcaucccucacagcucccagacccaagaacaggacugccugcagucucagccggugagcaauaacgaggaaauggccauuaagcaagaguccgggggagauggcgaagucgaggaguaccucucuuucagaagcguuggggacggacuguccacaucugcugugggcugugccagcgcggcuccccggcgcgggccugcccuucugcauaucgauagacaccagauucaggccguggaacccuccgcucaggcccucgagcugcaaggacuuggcgucgacguguaugaucaggacguucuggaacagggcgugcuccagcaagucgauaaugcuauccaugaggccagccgggcgucucagcugguggacguugagaaagaauaccgcuccgugcuggaugaccucacgagcugcaccacaucucugagacagauuaacaagaucaucgagcaacuuuccccucaggccgcuaccagccgggauauuaaucgcaaacuggacucugucaagagacagaaauauaacaaggaacagcaacucaagaaaaucacagccaagcagaaacaucugcaggcuauucuugggggagccgaggugaagaucgaacuggaucacgcgucccucgaggaggacgccgaacccggcccuagcucccuggggucuaugcugaugccggugcaggagaccgcuugggaggaacucauucggacaggacaaaugacccccuuuggcacgcagaucccucagaaacaggaaaagaagccccgcaaaauuaugcugaaugaggccagcggguucgagaaguaccuugcugaccaagccaaacuguccuuugaaagaaagaaacagggauguaacaagcgggccgcucgcaaagcgccugcccccgucaccccgccugcucccguucagaauaagaacaagccuaauaaaaaggccagagugcucagcaaaaaggaggaacggcugaaaaagcacaucaagaaacuucagaagcgcgcccugcaauuccagggcaaagugggccuccccaaggcuagacggcccugggagucugauaugagaccugaagccgagggggacuccgagggagaagagagcgaauauuuuccgacagaggaggaagaggaagaggaagaugacgaggucgagggcgcggaagcugaucugucuggggacggaaccgauuacgagcugaaaccccucccuaagggcgggaagcgccagaaaaaggugcccguucaagaaaucgacgaugacuucuuuccuagcuccggagaggaagccgaggccgcuucugugggcgagggcgggggaggcgggcggaaagucggaagauaucgcgaugacggcgacgaagauuacuacaagcagcggcugagccccaaaaugccgagaacacuuucccugcacgagauuaccgaccuccuggaaacggaugacagcaucgaggccucugcuauugugauccagccucccgaaaacgccacagcgccuguuuccgaugaggagagcggggacgaagagggcggaaccauuaauaaccuucccggcucucugcuccauacagccgcuuaucugauccaggauggguccgacgccgaaagcgauuccgacgauccuucuuacgcucccaaggacgauagcccggacgaggugccuuccaccuucaccguccaacagcccccucccucucgccggagaaagaugacaaaaauccugugcaaguggaaaaaggccgaccucacggugcagccggucgcgggacgcgugaccgcucccccuaaugacuuuuucacaguuaugcggacccccacagagauucuggaacuuuuucuggaugaugaggugaucgaacucauugucaaauauagcaaccuguacgccuguuccaagggcgugcaccuggggcuuaccagcucugaguucaaaugcuuucucggaaucauuuuccuguccggcuauguuagcgugccuagacgccggauguucugggaacagagaacggacguccauaacgugcuggugucugccgcuaugcggcgcgauagauuugagacaaucuucuccaaucuccacguugccgacaacgccaaucuggaucccgucgacaaguuuagcaaacuucggccucugaucucuaagcucaacgagagauguaugaaguucgugcccaaugaaaccuacuuuagcuucgaugaguuuauggugccguauuucgggcgccacggcugcaaacaauuuauucggggaaagccuaucagauucggcuacaaauuuugguguggggcuaccugccugggauacauuuguugguuccagcccuaucagggcaagaacccuaauacaaagcaugaagaguacggggucggagcgucccuggugcuucaguuuagcgaagcccucaccgaggcucaccccggccaauaucauuucguuuucaacaacuuuuucacaucuaucgcccugcuggacaaacucuccagcauggggcaccaggccacgggcaccgugcgcaaggaucauauugacagagucccgcuggaguccgauguggcucuuaaaaagaaagaacggggaacauuugacuaccgcaucgacggcaaggggaauauuguuugcagauggaaugauaacucuguggucaccguggccagcuccggagcgggcauccacccucugugccucguuucucgguauagccagaagcugaaaaagaaaauccaagugcagcagcccaauaugauuaaggucuacaaccaguucaugggagggguggaccgcgcugaugagaauaucgacaaauauagagccuccauucggggcaagaagugguacucuagcccucugcucuuuuguuucgaacuugugcugcaaaacgccuggcagcugcacaaaacauacgaugagaagcccgucgacuuucucgaguuccgcagacggguugugugccauuaucuggaaacccacgggcaucccccugagccgggccagaaaggacgcccccagaagagaaacaucgauucccgguacgacggcauuaaucacgugaucgucaaacaagggaagcagacgagaugugcugaaugccacaaaaacaccacauuucgcugugagaagugcgauguggcccuucauguuaaguguagcguggaauaucacaccgaguga

SEQ ID NO: 68926 - RNA, 1191 nt, Artificial Sequence
  derived and/or modified sequence opt5 from ERCC8__Homo_sapiens__NP_000073
augcugggcuuccucagcgccagacagaccgggcuggaggacccccuucggcugcgcagagcugaauccacacggcgcgugcucggacuggagcuuaacaaggauagagacgucgaacggauccacggcgggggaauuaauacgcuggauaucgagccuguugaaggccgcuacaugcucucugggggaagcgacggcgugauugugcuguaugaucuggagaacuccucuagacaaagcuacuauaccugcaaagccgucuguuccaucggccgggaccauccggaugugcaccgcuacucuguugagacagugcagugguauccccaugacaccgggauguuuacaagcuccagcuucgauaagacccucaaagucugggacacaaauacccugcagacggcggauguguuuaacuucgaagagaccguuuacucucaccauauguccccugugagcacaaagcacugccuugucgcugugggaaccagaggccccaaagugcagcugugugaccucaagucuggguccugcagccacauucugcaaggacaucggcaggaaauccuugccgucucuugguccccucgcuaugauuacauccuggccacagcuagcgccgacuccagaguuaagcucugggacgugcggcgcgcuucuggcugucugauuacccuggaucagcacaaugggaaaaagagccaggccguggaguccgcgaacacggcccauaauggaaaagucaacggccucugcuuuacaagcgacggccugcaccuucugaccguggggacagauaauagaaugcggcucuggaacucuuccaauggagagaacacccugguuaauuacggcaagguguguaacaauagcaaaaaggggcuuaaguucaccgucucuugcggauguagcuccgaauuuguguucguucccuauggcucuacaaucgcuguguacacggucuauagcggggagcaaauuaccaugcugaaaggacacuacaagacaguggacugcugugucuuucaguccaacuuccaggaacucuauagcggcucuagagauugcaacauccuggccugggugccuucccuguacgagccgguucccgacgaugacgaaaccacaaccaaaagccagcucaauccugcuuuugaggaugccuggucuuccagcgacgaggaaggcuga

SEQ ID NO: 68927 - RNA, 510 nt, Artificial Sequence
  derived and/or modified sequence opt5 from EREG__Homo_sapiens__NP_001423
augaccgccggcagacggauggagaugcugugcgcugggcgcgugcccgcccuccugcuuugucugggauuccaccuccugcaggcgguccuuagcacaacgguuaucccuuccugcauuccgggcgaaucuagcgacaacuguaccgcucuggugcaaacagaggauaaucccagaguggcccaggucuccaucaccaagugcucuagcgacaugaacggguacugucuccauggacagugcauuuaucugguggauaugucccagaauuacugucggugcgaaguuggcuauacaggggugcgcugugagcacuuuuuccugaccguccaucaaccucucucuaaagaauacguggcccugacaguuauccuuauuauccuguuucucaucaccguggucggaagcacguauuacuucugcagaugguaucggaaccgcaaguccaaagagcccaagaaagaguacgaaagagugaccagcggcgacccugagcugccccagguguga

SEQ ID NO: 68928 - RNA, 1422 nt, Artificial Sequence
  derived and/or modified sequence opt5 from ERF__Homo_sapiens__NP_001287964
augaacuacgacaagcugagcagagcccuccgguauuacuauaauaaacgcauccugcacaagaccaaaggcaagagauucacauacaaauuuaacuucaauaaacuugugcuggucaacuaucccuuuauugauguugggcucgcuggaggcgccgugccucaguccgcgccgcccgugccuucugggggaagccauuuccgguuucccccuuccacgcccucugagguccugagcccuaccgaagacccgcgcucuccucccgcuugcucuagcuccagcuccucccuuuucagcgccgugguugccagacggcugggccgcgggucuguguccgauuguagcgacggaacaucugagcucgaggaaccccugggcgaagaucccagagcucggcccccgggcccucccgaccugggggccuuucgcggaccuccccucgcuagacugccccacgauccuggcgucuuccggguguacccgcgccccagagggggaccugagccccuuuccccuuuucccguuagcccgcuggccggcccugggucccuccugcccccucaacuuucucccgcgcugccuaugacccccacacaucucgccuauaccccgagcccuacacugucccccauguaccccagcggaggcggcgggccuucuggauccggcgggggaagccacuucucuuuuagcccggaggacaugaagcgguaccugcaggcucauacccaguccguguauaauuaccaccucucuccccgcgccuuccugcacuauccuggccuugucgugccccagccucaaagacccgauaagugcccucugcccccgauggcuccugaaacgcccccugugcccagcuccgccagcuccucuagcuccucuagcuccucuccguuuaaguucaaacuccagccucccccucuggggcggagacagcgcgcggccggagagaaggcugucgccggcgcugacaaaagcggcggguccgccggaggccuugccgaaggggcuggagcgcuggccccucccccuccgcccccucagaucaagguugagcccauuucugagggcgaaagcgaggaaguggaggugaccgauaucuccgacgaagaugaggaggacggggaagucuucaagacaccucgggcucccccugccccgcccaaaccugagcccggcgaagccccuggagcuagccaauguaugccccucaagcugagauuuaaacgccgguggucugaggacugcagacuggaaggcgggggaggcccggccgggggauucgaggaugagggcgaagacaagaaagugcgcggggagggcccuggagaagcgggcgggccccucacaccccggagaguuuccagcgaucugcagcaugcuaccgcccagcuuucucuggagcaccgcgacuccuga

SEQ ID NO: 68929 - RNA, 1461 nt, Artificial Sequence
  derived and/or modified sequence opt5 from ERG__Homo_sapiens__NP_001129626
augauccagaccgugcccgacccugccgcucacauuaaggaggcccugagcgucguuuccgaagaucaaucucucuucgagugcgcguacggcacaccgcaucuggcuaaaacggaaaugaccgccagcuccucuagcgacuaugggcagacauccaagaugucucccagagugccucagcaggauuggcuuagccaacccccugcccgggugaccaucaaaauggaguguaaccccucccaggucaauggaagccgcaacucuccugacgaaugcuccguggcuaagggcgggaaaaugguuggaagcccggauacagugggcaugaauuacgggucuuauauggaggagaagcacaugcccccucccaacaugaccacaaaugaaagacgggucauugugccugccgaccccacccugugguccacggaucauguucgccaguggcucgagugggcugugaaggaauacggacugccggacgucaacauccuucuguuucagaauauugauggcaaagagcucuguaagaugaccaaagacgauuuccaaagacugacaccuagcuauaacgccgacauccugcucucucaucugcacuaccuucgggagacaccccugccucaccucaccuccgaugacguggacaaggcgcugcagaauagcccccgccuuaugcacgccagaaacaccggcggggcugccuuuaucuuccccaauacguccguguauccugaagcuacacagcggauuaccacacgcccggaucugcccuacgagccucccagacggucugccuggaccggacauggccacccuacaccccagagcaaagcggcccaaccguccccuagcaccguccccaagacggaagaccagcgcccucagcucgaucccuaccaaauccuggggccuaccucuuccagacuggcuaaccccggaagcggccagauucagcucuggcaguuucugcuugagcugcucucugacagcuccaauucuagcugcaucacaugggaagggaccaacggagaguucaagaugacagauccggacgagguugcccggcgcuggggcgaaagaaaauccaagccuaauaugaacuaugauaaacugagccgggcucuuagauacuauuacgacaagaacauuaugaccaaagugcauggcaagcgcuaugccuacaaauuugauuuccacgggaucgcccaagcucugcagccccaucccccugagucuucccucuauaaguacccgagcgaccugcccuacaugggaucuuaucacgcgcacccucagaagaugaauuuuguggcuccccauccucccgcccugccugucacguccagcuccuucuuugccgcccccaacccguacuggaacucuccuacaggcgggauuuaucccaauacccggcucccuaccagccacaugcccucccaucugggaacauacuauuga

SEQ ID NO: 68930 - RNA, 873 nt, Artificial Sequence
  derived and/or modified sequence opt5 from ERGIC1__Homo_sapiens__NP_001026881
augcccuucgacuuuagacgguucgauaucuaccgcaaggugccuaaagaccugacccagccgacauauacgggcgccauuaucagcauuugcuguugccucuuuauccuguuccuuuuucuguccgagcucaccggguucauuacaaccgaagucguuaacgagcuguacguggaugaccccgauaaggacucuggaggcaaaaucgaugugagccuuaauaucucccugccuaaccuccacugugaacuggucgggcuggacauucaagaugagaugggaagacaugaagugggccacaucgacaauucuaugaagauuccccucaacaauggggcuggaugccgguuugagggccaguucagcaucaacaaaguuccuggcaauuuucauguguccacacacucugccaccgcgcagccccagaacccugauaugacacaugucauucacaagcugagcuucggggacacccuucaagugcagaauauccacggagcuuuuaacgcccugggcggggccgaucgccucacguccaauccgcuggcuagccaugacuauauucuuaagaucguucccaccguguacgaggacaaaucuggaaagcagagauauuccuaccaguauacagucgccaacaaagaauacguggcuuacagccacaccggccggaucauuccugccaucugguuccgcuaugaucugucucccauuacagugaaguacaccgagagacggcaaccucucuaucgcuuuaucacgacaauuugugcgaucaucgggggaaccuucacagucgccggcauucuggacuccugcaucuucaccgcuagcgaagccuggaaaaagauucagcugggcaagaugcauuga

SEQ ID NO: 68931 - RNA, 1134 nt, Artificial Sequence
  derived and/or modified sequence opt5 from ERGIC2__Homo_sapiens__NP_057654
augagacggcugaaccgcaagaaaacccucagccuggugaaggagcuugacgccuuccccaaagucccugaauccuacguugagacaucugcuagcggcgggacggugucccugaucgccuuuaccacaauggcgcuccugaccauuauggaguucucuguguaucaggauacauggaugaaguacgaguaugaagucgacaaagauuuuagcuccaaacuuagaaucaauauugacaucaccguggcuaugaagugccaauacguuggagccgaugugcuggaccucgccgagacaauggucgcuucugccgauggccugguguaugagccgaccguuuucgaccugagcccccagcagaaggaauggcagcggaugcuccaacugauucagucccgccuucaggaggaacacagccugcaggaugugaucuuuaagucugcuuucaaauccacgagcaccgcccucccucccagagaggacgauucuucccaaagcccuaacgcgugucggauccaugggcaccuguacgucaauaagguggccggaaacuuucauauuacagugggcaaagcuaucccccacccucgcgggcaugcccaccuugcugcccuggucaaucacgagucuuauaacuucucccauagaauugaccaccucagcuuuggagaacugguuccggcgaucauuaauccccuggauggcaccgagaagaucgccauugaccauaaccagauguuccaguacuuuaucacaguggugccuaccaagcuccacacguacaaaaucuccgcugacacacaccaguucucugucaccgaacgggagcgcauuaucaaucaugccgcuggcagccacgggguguccggaauuuuuaugaaguaugaucugagcucucuuaugguuacagugaccgaagaacauaugcccuucuggcaauucuuugucagacugugcggcaucguugggggaauuuucuccaccacaggcaugcuccacgggaucggaaaauuuaucguggagauuaucuguugccgguuccgccugggcagcuacaagccugugaacucuguccccuuugaagacggccauacggauaaucaccuuccgcugcucgagaacaauacccacuga

SEQ ID NO: 68932 - RNA, 1152 nt, Artificial Sequence
  derived and/or modified sequence opt5 from ERGIC3__Homo_sapiens__NP_057050
auggaggcccugggcaagcucaaacaguucgacgcuuaccccaagacccuggaagauuuuagagugaaaacaugcgggggagccacggucaccaucguuagcggccuucugaugcuccugcuuuuccuguccgagcuccaauauuaccugacaaccgaagugcacccugagcuguauguggacaagucucgcggggauaaacucaagauuaacaucgacguccuguuuccgcauaugcccugugcguaccuuagcauugaugcuauggacguggccggagaacagcagcuggauguugagcacaaucucuucaagcagcggcuggacaaagauggcaucccuguguccucugaggccgaaagacaugagcuugggaaggucgaagugacaguuuuugaccccgauagccuggacccugaucggugcgaguccuguuauggagcugaggccgaagacauuaaaugcuguaauaccugcgaggacgugcgcgaggcuuacagacggcgcggcugggccuucaagaaccccgauacaaucgaacaauguagacgggaaggcuuuucucagaaaaugcaggagcagaagaacgaggggugccaagucuauggauuccucgaagugaauaagguggcgggcaacuuucacuucgccccugggaaauccuuucagcagagccauguccacguucacgaccugcagagcuucggacuggauaauaucaacaugacccauuacauucaacaccucucuuuuggcgaggacuacccggggaucgugaauccccuggaucauacgaacgugaccgcuccucaggccuccaugauguuccaguauuucgucaaggugguucccacaguguacaugaaagucgacggagaagugcuucgcaccaaucaauuuagcguuacaagacacgagaagguggcuaacggccugcucggcgaucaggggcugccuggagucuucgugcuuuaugaacugucucccaugauggucaaacucaccgagaagcaccgguccuuuacgcauuuccugacaggcgugugugccauuaucgggggaauguuuaccguugcgggccugauugacagccucaucuaccacucugcccgcgcuauucagaaaaagaucgaucuggggaagacaaccuga

SEQ ID NO: 68933 - RNA, 780 nt, Artificial Sequence
  derived and/or modified sequence opt5 from ERI3__Homo_sapiens__NP_001288628
augcuggcuccccuccagaccggcgccgccagauucagcuccuaccugcuuucucgggcgcgcaaggugcuggggagccaccucuuuuccccuugcggagucccggaguucuguucuaucagcacaagaaaacuggcugcccauggcuuuggggccuccauggcugccaugguuucuuuucccccucaacgguaucacuacuuccuugugcuggacuucgaagcuacgugcgauaagccccagauucauccucaggagaucauugaauuucccauccucaaacugaacggacgcaccauggagauugaaagcacauuccacauguaugugcagccugucgugcauccgcaacugacccccuuuuguacagagcucaccggcaucauccaggccaugguugacgggcagccuucccugcagcaagugcuugagagagucgaugaauggauggcgaaggagggacugcucgaccccaaugugaaaagcauuuucguuacaugcggcgauugggaccugaaggugaugcuuccuggccagugucaguaccuggggcuccccgucgccgauuauuuuaagcaguggaucaaccugaaaaaggcuuacucuuucgccaugggaugcuggccgaaaaauggccugcucgacaugaacaaggggcugucccuucaacacauuggacggccucacagcggcaucgaugacuguaaaaauauugcuaacaucaugaagacccuggccuaucgcggguuuauuuucaagcagacgucuaaacccuucuga

SEQ ID NO: 68934 - RNA, 171 nt, Artificial Sequence
  derived and/or modified sequence opt5 from ERICH5__Homo_sapiens__NP_001164277
augggcugcagcuccucugcccugaacaaggcuggggacagcuccagauuccccucuggagagaccggcgaaaaaguggagacagauauggaaaaugagaaggucagcgaaggggccgagacgaaagaggaagagaccggagaaguuguggaccucuccgcggcuacauga

SEQ ID NO: 68935 - RNA, 2091 nt, Artificial Sequence
  derived and/or modified sequence opt5 from ERICH6B__Homo_sapiens__NP_872348
augagcgccgagaacaaucagcuguccggcgcuucucccccucacccgcccaccacaccucaauacagcacgcagaaccuccccuccgaaaaggaggacaccgaaguggagcuggaugaagagucucuucaggacgagagcccuuucucccccgaaggggagucucuggaagauaaagaguaucucgaggaagaggaagaccuggaggaagaggaguaccuuggaaaggaagaguaucugaaagaagaggaauaccucggcaaggaggagcaucuggaagaggaagaguaucuggaaaaagccggguaccucgaggaggaagaguauaucgaagaggaggaauaccugggaaaggagggcuaccuugaagaggaagaguaucuggggaaggaggaacaccucgaggaagaggaauaccugggaaaagagggcuaucuugagaaggaagauuacauugaggaagucgacuaucugggcaaaaaggcguaccucgaggaagaggaguaucuggggaaaaagagcuaccuggaagaggaaaaggcucucgagaaagaggaaaaucuggaggaagaggaagcccuugagaaggaggaaaaccuggauggaaaagagaaucucuacaagaaauaucugaaggaaccuaaagccuccuacagcucucagacaaugcuucugagagacgcucgguccccggaugccggccccagccaaguuaccacauuucucaccgugccucugacauucgcuacccccucuccuguguccgagagcgccacggaaucuuccgagcugcuccugacccuuuaucgcagaagccaggcgucccagacagacuggugcuacgaucggaccgccgucaagucucuuaagagcaaauccgagacagaacaggagaccacgacaaagcucgcucccgaggaacaugugaacaccaaaguucaacagaagaaagaagagaaugugcuggaguuugccagcaaggaaaacuucugggacgggaucacagaugagucuauugacaagcuggaagucgaggaccuggaugagaauuuucucaacuccagcuaucagaccguguucaaaaccaucauuaaggaaauggcugcccacaaugagcuggaagaggacuuugauaucccgcugacaaaacuccuggaaucugagaaccgcuggaaacuuguuaucaugcugaagaagaauuacgagaaguucaaagaaacgauucucagaaucaagcggcgcagagaggcgcagaaacugaccgaaaugaccagcuuuacauuccaucugauguccaagccuacacccgagaaaccugaaaccgaggagauucaaaagccccagcgggugguccaccaccgcaagaaacuugaaagagacaaggaguggauccagaaaaagacgguggugcaucaaggagauggcaaacucauucuguaucccaacaagaaugucuaccagauccuguuuccugacgggacaggacagauucacuacccgucuggcaaccucgccaugcugauccuuuaugcuaaaaugaagaaguucaccuacaucauucuggaagauagccucgagggccggauccgcgcccugauuaacaauuccgggaacgcuaccuuuuaugacgaaaauagcgauaucuggcugaaccuuucuuccaaucucggauacuauuuccccaaagacaagagacagaaagccuggaacugguggaaucugaacauucauguucacgccccucccgugcaaccuaucagccugaagaucaaugaguacauucaggugcagauccggucucaggauaaaauuaucuucuguuuuacauaugagcaaaagcagauuugccucaaccugggcacccgcuacaaguucgucauccccgaagugcuuuccgagaugaaaaagaaaacaauccuggaagcugagccggggccuacggcgcagaagauuagaguucuccugggaaaaaugaaucggcugcuuaacuacgccaccacacccgaccucgagaauuuuaucgaagcugugagcauuucccugauggacaacaaguaucugaagaaaaugcucucuaagcugugguucuga

SEQ ID NO: 68936 - RNA, 1374 nt, Artificial Sequence
  derived and/or modified sequence opt5 from ERLEC1__Homo_sapiens__NP_001120869
auggaggaaggcgggggaggcgugagaagccugguccccgggggaccuguucuccuggugcuuugcggccugcucgaggccuccgggggaggccgggcucugccgcagcuuucugacgauauccccuuccgcgugaacuggccuggcaccgaauuuagccugcccacaacggggguccucuacaaggaggacaauuaugugauuaugaccacagcccacaaagaaaaguacaaauguauccugccucugguuaccuccggagaugaggaggaagagaaggacuauaaaggccccaacccuagagaacuccuggagccgcuuuucaagcaaucuagcugcuccuaccggauugagucuuauuggacauacgaagugugucaugggaagcacauccgccaguaucaugaggaaaaagagaccggacagaagauuaauauccacgaauacuaccugggcaacaugcucgcgaaaaaucugcuuuuugagaaggagagagaagcugaggaaaaagaaaagagcaacgaaauccccacaaagaauauugaggggcagaugaccccuuauuaccccgucggaaugggcaacggcacgccuugcucccugaaacaaaaucggccccgcagcucuaccgugauguauaucugucauccggaguccaagcacgaaauucucagcguugccgaggugacaaccugcgaauacgaggucgugauccugacaccucugcucuguucucaccccaaauauagauuccgggccuccccugugaacgauaucuuuugccagagccugcccgggucucccuucaagccucuuacccugcgccagcucgaacagcaagaggagauucugagagucccguuucggcgcaauaaagaagaggaccuucaguccacgaaggaagagagauuccccgcuauucauaaaagcaucgccaucggaucccagccuguucugacagugggcaccacacacauuucuaagcucaccgaugaccagcugaucaaggaguuucugagcggguccuacuguuuccggggaggcguggggugguggaaauaugaauuuugcuacggaaagcauguccaccaauaccacgaggauaaagacagcggcaagaccucugugguugugggcacauggaaccaggaggagcauauugaaugggcuaaaaagaauacggcccgcgcguaucaccuccaggaugacgggacccaaacagucagauguaaggaguccgauagcccccaugccgugaccguuuacaugcuggagccucacucuugccaguauauccuuggaguggaaagccccgucauuugcaaaauccuggacacagcugacgagaacggccuccugucccuuccgaauuga

SEQ ID NO: 68937 - RNA, 1047 nt, Artificial Sequence
  derived and/or modified sequence opt5 from ERLIN1__Homo_sapiens__XP_005269499
augaacaugacccaggccagagugcuggucgcugccguugugggccucguggcgguccugcuuuacgcuagcauccacaagauugaggaagggcaucuggccguguauuaccggggaggcgcccuccugacaucccccucugggccuggauaucacaucaugcuuccguucauuacgaccuuucgcagcguucaaacaacccugcagacagacgaggugaaaaauguccccugcggcaccuccgggggagugaugaucuacauugauagaaucgaaguugugaacaugcucgcuccuuaugccgucuucgacaucgugcggaauuacacagcugauuaugacaagacccugauuuuuaacaaaauccaucacgagcugaaucaguucuguucugcccauacgcuccaggaaguguacauugagcuguuugaucaaaucgacgagaaccuuaagcaggcgcugcagaaagaucucaaucugauggcccccggccuuaccauucaggcuguccgcguuacaaagccuaagauccccgaagccauuagacggaacuucgagcugauggaagcugagaaaaccaagcuccugaucgccgcgcaaaaacagaaggugguggagaaagaagccgagacagaacgcaagaaggcugucaucgaggccgagaaaauugcucagguggccaagaucagauuucagcaaaaaguuauggaaaaggagaccgaaaaacggauuagcgagaucgaagacgccgcuuuccuggcgcgcgagaaggccaaagcugaugccgaauacuaugccgcucacaaguacgccacguccaauaagcacaaacucacaccugaguaucuggagcuuaagaaauaccaggcgauugcuucuaacagcaagaucuauuuuggcuccaauaucccgaacauguucguggacagcucuugcgcccugaaauacuccgauauuagaaccgggcgggaaagcucucuccccuccaaggaggcccuggaaccuagcggagagaaugucauccagaacaaggaaucuacaggcuga

SEQ ID NO: 68938 - RNA, 459 nt, Artificial Sequence
  derived and/or modified sequence opt5 from ERLIN2__Homo_sapiens__NP_001003791
auggcccagcugggcgcuguggucgccguugcgagcuccuucuuuugcgcuucucucuucagcgccgugcacaagaucgaggaagggcauauuggaguguacuauagaggcggggcccugcuuaccuccacaucuggacccggcuuucaccugaugcucccuuucaucacgagcuacaaauccguccaaaccacacugcagaccgacgaggugaagaacguuccgugugggacaucuggaggcgugaugauuuauuuugaucggaucgaagucgugaauuuccuuguucccaacgcuguguacgacauugucaaaaauuauaccgccgauuacgacaaggcucugaucuuuaacaaaauccaucacgagcucaaucaguucugcagcgugcauacacugcaggaaguguauauugagcuguuuggccucgagaacgauuucucccaagaaagcucuuga

SEQ ID NO: 68939 - RNA, 1428 nt, Artificial Sequence
  derived and/or modified sequence opt5 from ERMAP__Homo_sapiens__XP_011538872
auggagauggccagcuccgcuggcucuuggcugagcgggugccucaucccccugguguuccuuagacuguccgugcacguuucuggacaugccggcgacgcggggaaguuucacguggcucuccugggaggcaccgccgaacuucuguguccucucagccuguggccggggacagugcccaaagagguccgguggcugcgcuccccuuucccccagagaucucaagccgugcauauuuuucgggauggaaaggaccaggaugaagaccucaugccugaguacaaaggccgcacgguucuggugagagaugcucaggaaggcagcgucacccuucagauccuggacgugcggcucgaggaucaaggguccuaucgcugccugauucagguuggaaaccuuagcaaggaggacacagugauccugcaggucgccgcucccucugugggcucccucagcccuucugccguggcgcuggccgucauucugccgguucucgugcugcuuaucauggugugucugugccucaucuggaaacagagacgggcuaaggaaaagcugcuuuacgagcacgucaccgaaguggauaaucugcucuccgaccaugccaaagagaaggggaaacugcacaaggcuguuaaaaagcugcgcagcgagcucaagcugaaaagagccgcggccaacucuggauggcggcgcgcuagacuucacuucguggccgucacacuggaucccgacaccgcucauccuaagcucauucuguccgaagaucaacggugugugcgccuuggcgacagacggcagcccguuccugacaauccccagagauuugauuucguggucagcauccugggguccgaguauuuuacaaccggaugccacuacugggaaguguaugucggcgacaaaacgaaguggauucucggcguguguucugagagcguuucccgcaaagggaaggugaccgccagcccggccaacggacauuggcugcugcggcagucuagaggcaaugaauacgaggcucucacauccccucaaaccagcuuccgccugaaagagcccccucggugcgucgggaucuuucuugauuaugaagcgggagugauuucuuucuacaacguuacaaauaagagccacaucuuuaccuucacgcacaacuuuuccggcccccugagacccuucuucgagccuugucuccaugacgggggaaagaauacagccccgcuggugauuugcucugaacugcacaaaagcgaggaauccaucgucccccgcccugagggcaagggccaugcuaacggggaugugagccuuaaagucaauucuucccuccugcccccuaaggcccccgagcugaaagacaucauucucagccugccgccugaucuuggacccgcccugcaggaacucaaggcuccuucuuuuuga

SEQ ID NO: 68940 - RNA, 1896 nt, Artificial Sequence
  derived and/or modified sequence opt5 from ERMARD__Homo_sapiens__NP_001265460
auggaggugcugaucggcgaccccauuaccacaugccucagcccuuccgucuacgauaucauuuguaaccugggguuccagcuuagagaaaauugcgacaucaacucuauuguuacgcaaaauggagagguguguuggaagaccaucacagauugcgugagcuauaccgaauccgagcagggccuggacuacugggggucuguccggcuccugggaccggugugugaagccguucacagccauuuucuuucccugacaaaaggccaguucgagauccgcuaugcucccugguuucaguggaccucuuucccugagcucuuucccgaaauuuucgaugcccuggagagccugcaauccccugcgaucagccucucucugaugaaacuuacauccugccuggaaagagcucucggggacguguuucugcuuauuggaaaggagugucccuuccugcuccgggaucugcugagcucugaggaacucgcccaggucuuuucccagagcgugaugaacguucugaagguguucgucggcucuccuugcggccuuaaucugcgcaacgugcucuggcacggguuugccuccccggaggaaaucccgccuaaauacuguagcaugaugauucugcuuaccgcuggacugggccagcuccugaaguccuaucugcaaaauacgaagcucacccuggcccauagaucuuucaucagccuuacaaaccuggaggaccucauuguguuucccgaugucaccuacgaaguucuguccgugcuugaggaggugaugaugaaaagcgcuuucauccugaagaucaugcucccuuauugggaagucgcccuggugaaauucaagucucaccgguuugcggacugcgccauucugcuccugacacagcuugagaccgggcugcgcaauguuuucgcuacgcucaacagaugucccaaacggcugcugacagccgaauccaccgcucuuuacacaaccuuugaucagauccucgccaagcaucugaaugacggaaagauuaaccagcugccccucuuccugggcgagccugcgauggaauuucuuugggauuuccugaaucaccaagaggggccccgcaucagagaccaccucagccauggagagauuaaccugcacgaauuuucuaaagagaccacaaaucagcugcuugccuucagccucgugcugcugcuccgguuugucgacgauugccugcuuuccguguucaaggaaaaaucugcuguugagcugcucaucagccuggccgaaggcuacuccagccgcugccauccuguguuucagcugaagaaacaaguccuuucuugugaggaguccaucagagugugggcucuccugcccuuccccgaggaacugacgcggcaggccguccgccucgaagacaacagcgagaccaacgccugccacucucugauuacaaagaugaccgaugagcuuuaucaccauaugccugaaaauagaugugugcugaaagaccucgaucggcugccgacagagacccccacguccgacacaccucuggcucuugcgcccagaaagccucagcccugccgcugucggagacgcguucggccgagcaucagacuccuguccccugugcugucucucauucugcuucugaucgcccucgaacuggucaacauucacgcugugugcggcaagaaugcccaugaguaccagcaauaucugaaauuuguuaagagcauccuucaguacaccgaaaaccugguggccuauaccuccuacgagaaaaauaaguggaacgagacaaucaaucucacccacacagcucugcucaaaauguggacguucucugaaaagaagcagaugcugauucaucuugccaaaaagagcaccuccaaaguccugcucuga

SEQ ID NO: 68941 - RNA, 2715 nt, Artificial Sequence
  derived and/or modified sequence opt5 from ERMP1__Homo_sapiens__NP_079172
auggaguggggcagcgaauccgccgcugugagacggcaccgcgucgggguugagagacgggaaggagccgcggcugcucccccuccggagcgcgaagccagagcucaggagccccugguggacggcugcucugggggaggccggacccgcaagagaagcccugggggauccggcggcgccucucgcggggcuggaacaggccucagcgaggugcgggccgcgcuggggcuugcccuguaccucaucgcucugagaacgcuuguccaacugucccuccagcagcuggugcugcggggagccgcuggccaucgcggggaguucgaugcccuccaggcgagagacuaucuggaacacauuaccucuaucggaccccggacaaccggcagcccugaaaacgagauucuuacaguucauuaccugcucgagcaaaucaaacugauugaagugcaguccaauagccuucacaagaucucugucgaugugcagcgccccaccggcuccuuuagcaucgacuuccucgggggauuuacaucuuauuacgauaacauuaccaauguuguggucaaacuggagccuagagacggcgcccagcaugcugugcuggccaacugucacuucgauuccguggcuaauagcccgggggccucugacgaugccgucuccugcagcguuaugcuggaagugcuccgggugcuguccacgucuagcgaggcccuucaccaugcggucaucuuucuguucaacggagccgaagagaaugugcuccaggcuucccacggcuuuauuacccaacaucccugggccagccugaucagagccuucauuaaccuugaggcugccgggguuggaggcaaggaacugguguuucagacaggcccugagaaucccuggcucguccaggcguaugugucugcugccaaacacccuuucgccuccguuguggcucaagaagucuuucagagcgggaucauucccucugacaccgauuuccgcaucuaccgggacuuuggaaacaucccgggcauugaucuggccuucaucgagaauggguauauuuaccacacaaaguacgacaccgcugacagaauccugacggauagcauucagcgcgccggagacaacauccucgcggugcugaagcaucuugccacauccgauaugcuggcugccgcuucuaaauaucggcacggcaauauggucuucuuugacgugcucgggcuguucguuaucgccuacccuagcagaauuggcuccaucauuaacuauaugguggucaugggagugguucuuuaccugggcaagaaauuucuccaacccaagcauaaaaccgggaauuauaagaaggauuuccuguguggacugggcaucacacucauuagcugguuuaccucucuggugaccguccuuaucaucgcgguguucauuucccugaucgggcagagccucucuugguacaaccacuuuuauguguccguuugccuguacggaacagccacggucgcuaaaauuauccugauucauacccuugccaagcgcuucuacuauaugaacgcuagcgcccaguaccucggcgaaguguuuuucgacaucucccuguuugugcacuguugcuuccuggucacacucaccuaucaggggcuguguucugccuuuauuagcgcuguguggguugcguucccucuucugacaaaacucugcgugcacaaggauuucaaacaacauggcgcccagggaaaguuuaucgcuuucuaccugcugggcauguuuauccccuaucuuuacgcccucuaucugauuugggccgucuucgagauguuuacccccauccuggggcgguccggaucugagauuccuccggacgugguucucgcuagcauccuggccggcuguacgaugauucuuuccagcuacuucaucaauuuuaucuaccuggcgaaaucuacaaagaagaccaugcucacccugacacuggugugcgcuauuaccuuccuucucgucuguuccgggacauuuuuccccuauagcucuaacccugccaaucccaaaccuaagagaguguuucugcagcacaugacgcgcaccuuccaugaucuggaaggaaacgccguuaaacgggacuccggcaucuggauuaauggguuugauuacacaggcaucagccacauuacaccccacaucccggagaucaacgacucuauuagagcucauugcgaagagaaugccccucucugcggauuccccugguaucugccugugcacuuccuuauccgcaagaacugguaccugcccgcgccugaagucagcccccggaauccgccucauuuuagacucauuuccaaagagcagacccccugggacagcaucaagcugaccuucgaggcuacgggccccucucacauguccuuuuaugugcgggcccauaaggggagcacccugucccaauggucucuuggaaacggcacaccugugaccagcaaagggggagauuacuucgucuuuuauucccacggccuccaggccucugcuuggcaguucuggauugaaguucaggugagcgaggaacacccggaggggauggugacagucgccaucgcugcccauuaccuguccggcgaggacaagcgcucuccccaacuggaugcgcucaaagaaaaguuuccugacuggaccuuccccagcgccuggguguguacguacgaucuguuuguuuucuga

SEQ ID NO: 68942 - RNA, 2934 nt, Artificial Sequence
  derived and/or modified sequence opt5 from ERN1__Homo_sapiens__NP_001424
augcccgccagacggcugcuccugcuucugacccuccugcuuccuggccuggggaucuucggaagcacauccacggugacccucccggagacacugcuguuugucucuacccucgacggcagccugcacgcuguuuccaagcgcacagggucuauuaaauggacccuuaaggaagaucccgugcuccaggugccuacacaugucgaggaacccgccuuccugccugaccccaacgauggaagccuguacacccuuggcuccaaaaauaacgaggggcugacgaagcucccuuuuaccaucccggaacuggugcaagcgucucccugcagaagcuccgacggaauccuguauaugggcaaaaagcaggauauuugguacguuauugaccuccugacaggcgagaagcagcagacccuuagcucugcuuucgccgauucccuguguccuagcacaucucuccuguaucuugggcggaccgaguacacgaucacaauguaugacaccaaaacacgcgaacugagauggaaugccaccuacuuugauuaugcugccucccuccccgaggacgauguggacuacaagaugagccacuucgucucuaacggagauggccuggugguuaccguggacuccgaaagcggggacguccuguggauccaaaauuacgcuuccccugugguggccuuuuaugucuggcagcgggagggacuccgcaaaguuaugcauauuaacguggcgguggagacacugagauaccuuacguucaugucuggcgaagucgggcggaucaccaaguggaaauaucccuuuccgaaggagacagaagccaagagcaaacugaccccuacacucuacgugggaaaguauuccaccagccuguacgcuucucccuccaugguucacgagggcguggccgucgugccucgcggcagcacgcuuccccugcucgaagggccccagacagauggaguuaccauuggcgacaaaggggagugcgugaucaccccuucuacagaugucaaguucgacccgggacugaaaagcaagaauaaacugaacuaucucagaaauuacuggcugcuuauuggccaucacgagacaccccuguccgcuucuaccaagaugcucgaacgguuuccuaacaaucugcccaagcaccgcgagaacgugaucccugccgauagcgagaaaaaguccuucgaagaagucauuaaucugguggaccagacgagcgagaacgcgcccaccacaguuucuagagauguggaggaaaaaccggcccaugcuccugcccggcccgaggcuccugucgacuccaugcuuaaggauauggccaccaucauccucagcacauuucugcugauuggguggguggccuucaucauuaccuacccccucucuaugcaccaacagcagcagcugcaacaucagcaguuccaaaaagaacuugagaagauccagcugcuccagcagcaacagcagcagcugccuuuucaucccccgggagacacggcucaagauggcgaacugcuugacaccuccggcccuuauagcgaguccucugggacaagcucccccucuaccagcccccgcgcguccaaucacagccucuguucuggauccagcgccucuaaggcuggcuccagcccuucucuggagcaggacgauggggacgaagagacaagcguugugauugucggaaaaaucuccuucugcccgaaggaugugcugggccacggggccgaaggcaccaucguguacagaggaauguuugacaaccgggauguugccgucaaacgcauucuccccgaguguuucagcuuugcugacagagaggugcagcugcuucgggaaucugaugagcacccuaacgugaucagauauuucugcacggaaaaggaccgccaguuucaauacauugccaucgagcugugugcggcuacacuccaggaauaugucgagcagaaagauuucgcccaucugggccuggagcccauuacccuucuccagcaaacaaccuccgggcuggcccaucugcacagccucaauaucgugcaccgggaccugaagccucacaacauccuuauuuccaugcccaaugcucauggaaagaucaaagccaugauuucugauuuuggccugugcaagaaacucgcuguugggagacacagcuucucccgccggucuggagugccuggcaccgaaggguggaucgcccccgagaugcugagcgaagacuguaaggagaacccgacauacacggucgauaucuuuuccgcgggcugcguguucuauuacguuauuucugaaggaagccauccuuuuggcaaaucccugcagagacaggccaauauucuucucggggcuuguagccuggacugccugcaccccgagaagcacgaggacgugaucgcccgcgaacucaucgagaagaugauugcuauggauccucaaaaacggcccucugccaagcauguccugaaacacccguucuucuggucccuugaaaagcagcugcaguuuuuccaggacgugagcgauagaaucgagaaagaaucucucgacggaccuauuguuaagcaacuggagcgcggcgggcgggcgguggucaaaauggauuggagagagaacaucaccgugccccugcagacagaccuucggaaguuucgcaccuacaagggaggcuccgugagagaucugcuccgggccaugagaaauaaaaagcaucacuaucgcgaacugccugcugagguccgggaaacacucgggagccugcccgacgauuucguuugcuacuuuaccucuagauucccccaucuucuggcccacacguaucgcgcuauggagcucuguucccacgagagacuguuucagccuuacuauuuccaugaaccgcccgagccucagcccccugugacacccgacgcccuguga

SEQ ID NO: 68943 - RNA, 2781 nt, Artificial Sequence
  derived and/or modified sequence opt5 from ERN2__Homo_sapiens__NP_150296
auggccagcgcugugagaggcucccggcccuggccucgccuggggcuccagcugcaauucgccgcgcuucugcucggaacccugucuccgcagguccacacacuuagacccgagaaccugcuccugguuagcacgcuggacggcucccuccaugcucugucuaagcagaccggggaucuuaaauggacacugcgggacgauccugugaucgaaggacccauguacgugaccgagauggccuuucucagcgacccugccgauggcucccuguauauucuugggacacagaagcaacagggacugaugaaacuccccuucaccaucccugaacugguccacgcuucuccgugccgcagcuccgacggcguguuuuacacaggcagaaagcaggaugccugguucguuguggaccccgagagcggggaaacccagaugacgcugaccacagagggaccuucuaccccucggcucuauauuggccgcacacaauacaccgucacgaugcaugauccuagagcucccgcccugcgguggaauacaaccuaucgcagauacuccgcgccgccuauggacgggagccccggaaaauauaugucucaccuugccuccuguggcauggggcugcuccugacaguggauccuggaagcggcaccguucuuuggacccaggaccugggcgugcccgucauggggguguacacauggcaucaggauggacuccggcagcugccccaccugacgcucgcucgcgacacccugcacuuucuugcccugagauggggccauauccggcucccugcuucugggccgcgcgacacagccacccuguucuccacacuugauacccaacugcucaugacgcuguacgugggaaaggacgagacaggcuuuuaugucagcaaggcgcugguucacaccgggguggcccucgugcccagaggacugacccuugcuccugccgauggccccacaaccgacgaagucacacuccagguguccggcgagcgggaagggucuccuagcacggcuguuagauaccccuccggaagcguggcccugccgucucaguggcugcugauuggccaucacgagcuuccucccguccuccacaccacaaugcugcgcgugcauccuacccugggguccggaacagccgagacccggcccccugaaaacacgcaagcucccgcguucuuucucgagcugcuuagccugucuagagaaaaacucugggauagcgagcugcacccggaagagaagaccccugacuccuaucugggccuugggccccaggaucuccuggccgcuucucugacagccguucuccugggcggauggauccuuuucgugaugcgccagcagcaaccccaggucguggagaaacagcaggaaaccccucuggccccggcugacuuugcccauaucagccaagaugcgcagucccuccacagcggcgcuucucggagaucccagaagcgccugcagagccccucuaaacaagcccagccucuggacgaucccgaggccgaacagcuuacagucguggggaagauuuccuucaauccuaaggacguucucggacggggcgcugggggaaccuuuguguucagaggccaguucgaggggcgcgccgucgcugugaaacggcugcugagagaaugcuuuggccucguucgccgggaggugcaacugcuucaggagagcgacagacaucccaacguccugcgguacuucuguacggaacgcggaccucaguuucacuauaucgcccucgagcugugcagagcgucccugcaagaauacguggagaaucccgaucuugaccggggcgggcucgaaccggaggugguucugcagcagcugaugucuggacucgcccaucugcacagccuucacauuguccauagagaucugaagccuggcaacauccucauuacagggcccgacucccagggacugggccgcguggugcugucugauuucgggcuuuguaaaaagcugccugcuggccggugcagcuuuucccuccacagcggaauccccggcaccgagggguggauggccccggaacugcuccaacugcuuccucccgacucuccuacauccgcugucgauauuuucagcgccggauguguguuuuauuacguucugucuggcgggucccaccccuucggagacagccucuacagacaggcgaauauccugaccggcgcccccugccuggcucaucuugaggaagaggugcacgauaaagucguggcccgcgaccugguuggggcuaugcucucuccucugccgcagcccagaccuagcgcuccccaggugcucgcccaucccuuuuucuggucccgggccaagcaacugcaguuuuuccaggaugucagcgacuggcuugagaaagaaucugagcaggaaccccuggugcgcgcgcucgaggccggcggaugugcuguugugagagauaacuggcacgaacauaucuccaugccucugcaaaccgaccugcggaaguuucgcagcuauaagggcacauccgucagagaccuucugcgggccgugcgcaauaaaaagcaccacuacagagagcucccgguggagguccggcaggcccuggggcagguucccgauggauucgugcaauauuucacgaaccgcuuuccuagacuccugcuucauacccaccgggcuaugagaucuugcgccagcgaaucccuguuccugcccuacuauccucccgacucugaggcgcgccggccguguccuggcgcuacagggagauga

SEQ ID NO: 68944 - RNA, 1404 nt, Artificial Sequence
  derived and/or modified sequence opt5 from ERO1LB__Homo_sapiens__NP_063944
augagccagggcgugagacgggccggggcuggacaaggcgucgccgcggcuguucagcugcucgugacccuguccuuccuucgcucuguggucgaggcccaggugacagggguucuggacgauugccucugugacaucgauagcauugacaacuuuaauacguacaagaucuuccccaaaauuaagaaacugcaggaaagagauuauuuucgguacuauaaggugaaccuuaaacgcccuugcccguucugggccgaggacggacacuguuccaucaaggauugccaugucgaacccuguccugagucuaagauucccgugggcaucaaagcugggcacagcaauaaguaccugaaaauggccaacaauaccaaggaacucgaggacugcgagcaagcuaacaaacugggagccaucaauuccacacugucuaaccagagcaaggaagcguuuauugauugggccagauaugacgauucccgggaccauuucugugagcucgaugacgaacgcagcccugcugcccaguacguugaccugcuucugaaucccgagagauauaccggcuacaagggcacaucugcuuggcggguguggaacuccaucuacgaggaaaauugcuuuaaaccucgcagcgucuauagaccgcucaacccccuggccccuucucgcggggaggaugacggagaauccuucuacaccuggcuugagggccugugucucgaaaagcggguguuuuauaaacugauuagcgggcugcacgcgucuaucaaucuccaucugugcgccaacuaccuucuggaggagacauggggaaagcccuccuggggcccuaauauuaaagaguucaagcacagauuugaucccguggagaccaaaggggaaggaccgcggcgccucaagaaccuguauuuccuuuaccugaucgagcucagagcucugagcaaggucgccccuuauuuugaacgguccauuguugaccuguacacgggcaacgcugaggaggaugccgacaccaaaacacuccugcuuaauaucuuccaggauaccaagucuuuccccaugcacuuugacgagaaaagcauguucgccggcgauaagaaaggggcuaagucccugaaggaagaauuuagacuccauuucaaaaacaucagccgcauuauggacugugugggaugcgauaagugccggcuguggggcaaacuucaaacacaggggcugggaaccgcgcucaagauccuguuuucugagaaagaaauucagaagcugccugaaaauucccccagcaagggcuuccagcucacgagacaagagaucguggcccugcuuaacgcuuuugggcgccugucuacaagcauucgggaccuccagaauuucaaaguccugcugcagcacuccagauga

SEQ ID NO: 68945 - RNA, 1407 nt, Artificial Sequence
  derived and/or modified sequence opt5 from ERO1L__Homo_sapiens__NP_055399
augggcagaggguggggauuccuguuuggccuccugggggccguguggcuucugagcuccggacacggcgaggaacagcccccugagaccgcugcccaacggugcuucugucaggucucuggguaccucgacgauugcacaugugacguugaaacgaucgaucgcuuuaacaauuauagacuguucccgcggcuucagaagcugcucgagagcgacuacuuucgcuauuacaaagugaaccugaagagacccugcccuuucuggaaugauauuucccaguguggacggcgcgacugcgcggugaaacccugucaaucugaugaagucccugacggcaucaagagcgcuuccuauaaauacucugaggaggccaacaaucugauugaagagugcgaacaggccgagagacucggcgcuguggaugagagccuguccgaagagacccagaaggccguucuucaguggacaaagcaugacgauagcucugacaacuuuugugaagcugaugacauccaaucccccgaggccgaauauguggaccugcuccugaauccugagcgguacaccggguacaaaggaccggaugcguggaagauuuggaacgucaucuaugaggaaaauugcuucaaaccccagacaaucaagcgcccucuuaacccccuggccagcggccaggggaccucugaggaaaauacauuuuacuccuggcucgagggacuguguguggagaaaagagcuuucuaucggcugauuagcggccuccacgccucuaucaacguucaucuguccgcucgcuaccuucugcaggaaaccuggcucgagaagaagugggggcacaauauuacggaauuucaacagagauucgacggaauccugaccgagggcgaaggcccucggcgccuuaaaaaccuguauuuucucuaccugauugagcugagagcccucagcaaggugcugcccuucuucgaacggccggauuuucagcuuuucacagggaauaaaauccaagacgaggagaacaagaugcugcuccuggaaauucuucaugagaucaaauccuuuccucugcacuucgaugaaaacagcuuuuucgcgggagacaagaaagaggcccacaagcucaaggaggauuuuagacugcauuuccgcaauaucucucggauuauggacugcgucggcugcuuuaaauguagacugugggggaagcuccagacccagggacugggcacagcucuuaaaauccuguucuccgaaaagcucauugccaacaugcccgagagcgggccuucuuaugaauuucaccugacccgccaggagaucgugucccuguucaaugcuuuuggacggauuagcacgucugugaaagaacuugagaacuucagaaaucuccugcaaaacauccauuga

SEQ ID NO: 68946 - RNA, 162 nt, Artificial Sequence
  derived and/or modified sequence opt5 from ERP29__Homo_sapiens__NP_001029197
auggccgccgccgugcccagagcggcuuuccugagcccucuccugccgcuucugcucggcuuucugcuucuguccgcuccccacgggggaucuggccuccauaccaagggggcccugccucuggacacagucacguucuacaaaaucaugguuaccagcuga

SEQ ID NO: 68947 - RNA, 1221 nt, Artificial Sequence
  derived and/or modified sequence opt5 from ERP44__Homo_sapiens__NP_055866
augcaccccgccguguuccugagccucccugaccugagaugcucccuucugcuccuggucaccuggguuuuuacaccggugacgaccgagaucacaucucuugauaccgaaaacauugacgagauccugaauaacgcugauguggcccucgucaauuucuacgcggacuggugucgguuuagccagaugcugcaucccauuuucgaagaggcuuccgaugugaucaaggaagaguuuccuaacgagaaucaaguuguguucgcccgcgucgacugcgaucagcacucugacauugcccagagauaucggaucagcaaauaccccacacugaagcucuuucgcaacggcaugaugaugaaaagagaauaucgggggcagcgcuccgugaaggcucuggccgauuacaucagacaacagaaaucugacccuauucaggagauccgggaucuugcugaaauuaccacacuggaccgcagcaagagaaauaucauuggauauuucgagcagaaggauuccgacaacuaccggguuuuugagcgcguggccaauauccuccaugacgauugugcguuccugagcgccuuuggcgacgucucuaaacccgaaagauauuccggggauaacauuaucuacaagccuccgggacacagcgcucccgacaugguguaccuuggcgccaugaccaauuucgaugugacguauaacuggauccaagacaaaugcgucccucugguucgggagauuaccuuugaaaauggggaggaacucacagaggagggacugcccuuccugauccucuuccauaugaaggaagauaccgagucucuggaaauuuuucagaacgagguggcucgccagcuuaucuccgaaaaaggcacaauuaauuuccugcacgccgacugugauaaguuuagacacccucuccugcauauccagaagacccccgcggacugcccggugaucgccauugauagcuuccggcacauguacgucuuuggcgacuucaaagacgugcuuaucccugggaagcugaaacaauuuguuuucgaucuccauucuggaaagcugcacagagaguuucaccauggccccgacccuacggauacagcucccggggagcaggcccaggacguggcuuccagcccucccgaauccucuuuccaaaaacuggccccgagcgaguaucgcuacacccuccugcgggauagagacgaacuuuga

SEQ ID NO: 68948 - RNA, 1815 nt, Artificial Sequence
  derived and/or modified sequence opt5 from ERV3-1__Homo_sapiens__NP_001007254
augcugggcaugaacaugcuccugaucacccuuuuccugcuccugccccuuagcaugcugaagggggagccuugggaaggaugccuccacuguacacauacgaccugguccggcaauauuaugacaaaaacccugcuguaccacacauauuacgagugcgccgggaccugucucggaacaugcacccauaaccagacgaccuauucugugugugacccgggcagagggcaacccuacgucugcuaugauccuaagagcucccccggaacaugguuugaaauccacguuggcucuaaagagggcgaccugcuuaaucagaccaagguguucccuagcgggaaagauguggucucccuguacuuugacgugugucagauuguuucuaugggaagccucuuccccgugaucuuuuccagcauggaauauuacucuuccugccauaagaaccgguacgcucacccugccuguagcacagauucuccggucaccacgugcugggacuguacaaccugguccacaaaucagcaaagccugggccccauuaugcuuaccaagaucccucuggagcccgauugcaaaaccucuacaugcaacuccgugaaucucacgauccuggagccugaccagcccauuuggaccacagggcugaaggcgccgcucggagcucgcguuagcggcgaagagaucgggccuggagccuauguguaccuguauauuaucaaaaagaccagaacacgguccacccagcaguuccgcgucuuugaaucuuucuacgagcacgugaaccaaaaacuucccgagccuccuccccuggccagcaaucucuuugcucagcuggccgaaaacauugcuuccagccuucauguggccucuuguuaugucugcggcggcaugaauaugggggaucaguggcccugggaggcgagagaacugaugccgcaggacaacuucacgcucacagccuccagccuggagcccgcuccuucuagccaauccaucugguuucugaagaccucuauuaucggaaaguucuguaucgcccgguggggcaaggcuuuuaccgaucccguuggggaacucacaugccugggacagcaguacuauaaugagacccuuggcaaaacacuguggcgcgggaaaagcaacaauuccgagagcccucaccccucuccguucuccagauucccuagccucaaccauucuugguaccaacuggaagcccccaacacguggcaggcgccuuccggacuuuacuggauuuguggcccccaggccuaucggcagcugccugcuaaguggagcggcgccugcgugcucgggaccauccgccccuccuuuuuccugaugccgcugaaacaaggagaggcucucggcuacccuauuuaugacgaaacaaagagaaaaucuaagcgggggaucaccauuggagauuggaaggacaaugaguggccucccgaacgcaucauccaguacuauggccccgccacaugggccgaggacgggauguggggcuacagaaccccgguguauaugcugaaccggauuauccgccuucaggcuguccuggagauuaucacgaaugaaaccgcgggagcccucaaccugcuggcucagcaagccacaaaaaugagaaaugugauuuaccagaaccggcuugcccucgauuaccugcuggcucaggaggaaggcguuugugggaaguuuaaucucaccaacugcugucuggagcuugacgaugaaggaaaagugaucaaggagaucacagccaaaauucagaagcuggcgcacauccccguccaaaccuggaagggcuga

SEQ ID NO: 68949 - RNA, 1617 nt, Artificial Sequence
  derived and/or modified sequence opt5 from ERVW-1__Homo_sapiens__NP_055405
auggcccugcccuaccacaucuuccucuuuaccgugcugcuuccuagcuucacacugacggcuccgcccccuugcagauguaugaccuccucuagccccuaucaggaguuucucuggcggaugcaacgcccuggcaacauugacgcccccuccuacagaucucugagcaaggggacaccuaccuucacagcgcauacccacaugccgcggaauugcuaucauuccgcuacacuuuguaugcacgccaacacccauuacuggacgggaaaaaugaucaaucccucuugcccuggcgggcugggagucaccguuuguuggacauauuuuacccagacaggcaugagcgaugggggaggcgugcaggaccaggcccgcgaaaagcacgugaaagaggucauuucccaacucaccagagugcacggcacgagcucucccuacaaggggcuggaucuguccaaacuccaugaaacacugcggacccacacacgccuuguuagccuguucaacaccacccucacaggacugcaugaggugucugcucagaauccuacgaacugcuggaucugucuuccccugaauuuuagaccguaugucuccauuccugugcccgaacaguggaacaauuucagcaccgagaucaacacaaccucuguucucgugggcccucuggucuccaaucuggagaucacacacaccagcaaccucacgugcgugaaguuuuccaauacaaccuacaccacaaacucucaguguauucggugggugaccccucccacacaaaucgucugccugcccagcgggauuuucuuuguuuguggaacguccgccuaccgcugccuuaauggcagcucugaauccaugugcuuccugagcuuucucgugccgcccaugaccaucuauacagagcaggaccuguacucuuaugugauuagcaagccuagaaacaaacggguccccauccuuccuuucgugauuggggcuggaguucugggcgcccucggcaccgggaucggaggcaucacaaccuccacgcaguucuacuauaagcugucucaggaacugaacggggauauggagcgcguggcggacagccucgucacccugcaagaucagcuuaauucccuggccgcugugguucuccagaacagacgggcccuggaccuucugacagcugagcgcggaggcaccugucucuuucugggggaagagugcuguuacuaugugaaucaaagcggaauugucacagaaaaagugaaggagaucagagaucggauucagagacgcgccgaggaacugcggaacaccggccccuggggccuccugucucaguggaugccguggauccuuccuuuccuggggccccucgcggccauuauccugcugcuucucuuuggaccuugcaucuucaaucugcuggucaacuuuguguccagcagaauugaggcuguuaaacuccagauggaacccaagaugcaaucuaagacgaaaaucuaccgccggccucuggacagacccgccuccccgcgcagcgaugugaaugacauuaagggcacaccucccgaggaaaucuccgcugcccagccccuucugcggccuaacucugccgggagcuccuga

SEQ ID NO: 68950 - RNA, 1173 nt, Artificial Sequence
  derived and/or modified sequence opt5 from ESAM__Homo_sapiens__NP_620411
augaucagccugcccggcccucucgugaccaaccugcuuagauuccuguuucucgggcuguccgcccuugcuccgcccucucgggcccagcugcaacuccaucugccugcgaaucgccugcaggcugucgagggaggcgaaguugugcuccccgccugguacacacugcacggggaggugagcuccucucagccuugggaaguccccuucgugaugugguuuuucaagcagaaagagaaggaagaccaaguucuuagcuauauuaacggagugacgaccuccaaaccuggcgucucucugguguacagcaugccguccagaaaucucagccugcggcuugaggggcugcaggagaaggauucuggacccuauuccugcagcguuaacgugcaggacaaacagggcaagucucgcggccacuccaucaagacacucgaacugaauguccuggugccucccgccccucccagcuguagacuccaaggggugccgcaugucggagcuaacguuacccugucuugccaguccccucggagcaaacccgccgugcaguaccagugggaucgccaacuuccuuccuuucagacauucuuugcucccgcccuggacgugauuagaggcucucucagccugaccaaucuuuccagcucuauggcgggggucuauguguguaaggcccacaacgagguuggaacagcucagugcaaugugacccuggaagucuccacgggccccggggccgcugugguugccggagcgguggucggcacccucgugggccuggggcugcucgccggacugguccuucuguaccaucggcgcggcaaagcucucgaggagccugccaacgauaucaaggaagacgcuauugccccgagaacacugcccuggccuaaaagcucugauaccaucagcaagaaugggacacuuuccucugugaccagcgcccgggcucugagacccccucacggacccccgcgcccuggcgcgcucacgcccacaccuucccugagcucucaagcccugcccuccccucggcuccccaccacagacggggcucacccgcagccuaucagccccauucccggaggcguuucuuccagcggccugucccgcaugggggccgugccugucauggugccggcccagucucaggcuggaagccuuguuuga

SEQ ID NO: 68951 - RNA, 2523 nt, Artificial Sequence
  derived and/or modified sequence opt5 from ESCO1__Homo_sapiens__NP_443143
augaugagcauccaggagaaguccaaagaaaacucuagcaaggugaccaaaaaguccgacgauaaaaauucugagacagaaauucaagacagccagaagaaccuggccaagaaauccggccccaaggagacgaucaaaucucaggcuaagagcuccagcgaaucuaaaauuaaucagccugagcucgagaccagaauguccacacggagcucuaaggccgcguccaacgauaaggcuaccaaaagcaucaauaagaacacagucaccguucgcggguacucucaagaauccacaaagaagaaacugagccagaagaaacuugugcacgagaauccgaaggccaacgaacagcugaauagacggucccagcgccuccaacagcugaccgaggugucuagacggagccuucgcuccagagagauucagggacagguccaagccgugaagcagagccugcccccuacgaaaaaggaacaguguucuuccacccaaagcaaaucuaacaagacaagccagaaacauguuaagcggaaggugcucgaggucaaauccgacucuaaggaagaugagaaucuggugaucaacgaaguuaucaauagccccaaaggcaagaaacgcaagguggagcaccagaccgcuugcgccugcuccagccaguguacacaagggucugagaagugcccucagaaaaccacgagacgggacgaaacaaagcccgucccugugaccuccgaggugaaacgcagcaagauggcuacaucugucguuccgaaaaagaacgaaaugaagaaauccgugcauacccaggugaauaccaacacaacgcugcccaagagcccucagcccuccgucccugagcaaucugauaacgaacucgagcaggccggaaaaagcaagagaggcuccauucugcagcuuugugaggaaaucgcgggggagauugaaucugacaauguggagguuaaaaaggaaagcucccagauggagagcgugaaagaggaaaagcccaccgagaucaagcuggaagagacaucugucgagcggcaaauucuccaccagaaagaaaccaaccaggaugugcagugcaaucgcuucuuuccguccagaaagacaaaaccuguuaaguguauccugaacggaauuaauagcucugccaaaaagaacuccaauuggaccaagaucaaacuuagcaaguucaacucugugcaacauaauaaacuggacagccaggucucccccaagcucggccugcugcggacgagcuuuucuccucccgcucucgagaugcaccaccccgugacacaguccaccuuccugggcaccaaacuucaugauagaaacaucacaugccaacaggaaaagaugaaggagauuaauagcgaagaggucaaaaucaacgacauuaccguggagaucaauaagacaacggaacgcgccccugagaacugucaccuggcuaaugaaauuaaaccguccgaucccccucucgacaaccagaugaagcauucuuuugacagcgccuccaacaaaaauuucucucagugccuggagagcaagcuggaaaacucccccguugagaaugugaccgcggccucuacacugcucagccaagcuaagaucgauaccggggagaacaaauuuccuggauccgcuccccagcagcacagcauccugucuaaucagacauccaagagcucugacaaccgggaaaccccgagaaaucacucccugccuaaauguaacagccaucucgagauuacgauccccaaggaucugaaacuuaaggaagcugagaaaaccgacgaaaagcaacugauuaucgaugccggccagaagcgcuucggggccgucucuugcaaugugugcggaaugcucuauacagcuuccaacccugaggacgagacccagcaccuucuuuuucauaaucaguucauuagcgcgguuaaauacgugggcuggaagaaagaacggauccuggccgaguaucccgaugggagaaucauuaugguccucccugaagaccccaaguacgcucugaaaaagguggaugagauccgcgagaugguggacaacgaucugggauuucaacaggccccgcucauguguuauucccggacaaagacccugcuuuucauuagcaaugacaaaaagguugucggcugccugaucgccgaacacauucaguggggcuacagagugaucgaggaaaaacucccugugauucgcucugaggaagagaagguccgguuugagagacaaaaagccugguguugcagcacgcugcccgaacccgccaucugugggaucucccgcauuuggguguucucuaugaugcggagaaagaagaucgcgagccggaugauugagugccugcgcuccaacuucaucuauggaucuuaccuuagcaaagaagagauugcuuuuuccgacccuacaccggauggcaaacucuucgccacccaguacugugggacaggacaguuucugguuuauaauuucaucaacggccagaacucuaccuga

SEQ ID NO: 68952 - RNA, 1806 nt, Artificial Sequence
  derived and/or modified sequence opt5 from ESCO2__Homo_sapiens__XP_011542723
auggccgcucugacccccagaaagcggaaacaggacagccucaagugcgauucccugcuucacuucacagagaaccuguuuccuucuccgaauaaaaagcauuguuucuaccaaaacagcgacaaaaaugaagagaaccuccacugcucccagcaggaacauuuugugcugucugcccuuaagacgaccgagaucaaucgccugcccagcgcgaaccagggcuccccuuucaagucugcucucagcacagucuccuuuuauaaucaaaacaaaugguaccugaauccccuggaaagaaagcucauuaaagagagccggucuaccugucugaagacaaacgaugaggacaaauccuucccuaucguuaccgaaaagaugcaggggaagcccgugugcagcaaaaagaauaacaaaaagccucagaaaucucuuacagccaaguaucagccgaaauaccgccacauuaagcccguguccagaaauagccggaacucuaagcaaaaucgcgucaucuauaaaccuauuguggagaaggaaaacaacugucauuccgccgagaauaacagcaaugcucccagaguucugucccagaaaaucaagccucaggugacccuccagggaggcgccgccuuuuucguccggaaaaagucuagccugcgcaaguccagccuugagaacgaacccucucuggggagaacgcaaaaauccaagagcgaggugaucgaagauucugacguugagaccgugagcgagaaaaagacauuugcuacccggcaggucccgaaaugccucgugcuggaagagaagcugaagauuggacuccuguccgcgucuagcaaaaauaaggaaaaacuuaucaaggauuccagcgacgaucgcgugucuuccaaagagcacaaggucgacaagaacgaagccuucagcucugaggauucccugggcgaaaauaaaacaauuagcccuaaguccaccguuuaccccaucuuuucugcuagcuccgugaacucuaaaagaagccucggggaggagcaguucuccgugggaagcgucaauuuuaugaagcaaacgaacauucagaaaaauacaaacacccgggacacaucuaagaaaaccaaggaucagcugaucauugacgccggccagaagcacuucggcgcuaccguguguaaauccugcgggaugaucuauacagccagcaauccugaagacgagaugcaacauguucagcaccaucaccgcuuccuugaaggaaucaaguacgugggcuggaaaaaggagagagucguggcggaauuuugggaugggaaaauuguucuggugcucccccacgaccccucuuucgccaucaagaaggucgaggaugugcaggagcuggucgacaacgaacugggauuucagcaagugguuccuaaauguccgaauaagauuaaaacguuccucuuuaucuccgaugagaagcggguggucggcugccugauugcugaacccaucaaacaggccuucagagugcuuagcgagccuaucgggcccgagucuccuagcuccaccgaauguccccgcgcuuggcagugcagcgacguuccggagccugccgugugcggaauuucucggaucugggucuuuagacugaagcgccggaagagaauugcccgccggcucguggauacacugagaaacuguuucauguuuggcugcuuccuuuccaccgacgaaaucgcuuuuagcgaucccacaccugacggcaaacuguucgcgaccaaguacuguaacacgcccaauuuucucguguauaacuucaauuccuga

SEQ ID NO: 68953 - RNA, 849 nt, Artificial Sequence
  derived and/or modified sequence opt5 from ESD__Homo_sapiens__XP_011533256
auggcccugaagcagaucagcuccaacaaaugcuucggcgggcuccaaaagguguuugagcacgacucugucgaacugaauuguaaaaugaaguucgcuguuuaccuucccccuaaagccgagaccggaaagugcccggcgcuguauuggcucagcggccugacauguacggaacagaacuuuauuuccaagucuggguaccaucagagcgcuuccgagcacggacuuguggugaucgcccccgauaccucuccuagaggcugcaauauuaaaggggaagacgagagcugggauuucggaacaggcgccggcuuuuaugucgacgcuaccgaggaucccuggaagacaaacuaccggauguauuccuacgugaccgaagaacugccucagcucaucaaugccaacuuccccguugacccucaacgcaugagcauuuuugggcauucuaugggaggccacggggcucugaucugugcccugaaaaauccgggaaaguauaaauccgugagcgcguucgcccccaucugcaacccuguccucugucccuggggcaagaaggcuuuuucuggguaccugggaacagaucaguccaaauggaaggccuacgacgcuacccaucuugugaaaagcuauccuggcucucagcuggauauucucaucgaccagggcaaggaugaccaauuccugcuugaugggcagcugcuccccgacaauuuuauugccgcgugcacggagaaaaagaucccgguuguguucagacugcaggagggauacgaccacuccuauuacuuuauugccaccuucaucacagaucacauucggcaucacgcuaaauaucugaacgccuga

SEQ ID NO: 68954 - RNA, 2556 nt, Artificial Sequence
  derived and/or modified sequence opt5 from ESF1__Homo_sapiens__NP_001263309
augagcuccaagcaggagaucaugucugaccaaagauuccggcgcguggccaaagaucccagauuuugggaaaugccugagaaggaccggaaagucaagauugauaaacgcuucagagcuauguuucacgacaagaaguucaaacugaacuacgccguugauaagcggggccgcccgaucagccauuccaccacagaagaccucaaaagauuuuaugaucugucugacagcgauuccaaucuuucuggggaggacagcaaggcgcugucccagaaaaagauuaagaaaaagaaaacgcagaccaagaaagaaaucgauagcaagaaccucguggagaaaaagaaggagaccaaaaaggcuaaucacaaaggaucugaaaacaagacagaccuggauaauuccauuggcaucaaaaagaugaagacaagcugcaaauucaagaucgacucuaacauuucccccaaaaaggacagcaaagaguuuacccagaagaauaagaaagaaaagaaaaacaucgugcaacauacaaccgauucuucccuugaggagaagcagcggacgcuggacagcgggaccuccgaaauugucaaaucuccucgcaucgaguguagcaagacaagacgggaaaugcaguccgugguucagcucauuaugacccgcgauagcgacggauacgaaaauucuacagauggcgaaaugugcgacaaggaugcccuggaggaggacuccgaaagcgugucugagaucgggagcgaugaagaguccgaaaacgagauuaccucugucggcagagccagcggagacgaugacggcuccgaggacgaugaagaggaagacgaggaugaagaggaggacgaagaugaggacagcgaagaugacgauaaaucugacuccgggcccgaucuggcucggggaaagggcaauaucgagacgagcucugaggacgaagaugacacagccgaccucuucccugaggaauccggguuugagcacgcuuggcgcgaacuggauaaagacgcccccagagcggaugagaucacccggagacuugccguguguaacauggacugggaucgccugaaggcuaaagaccuccuggcccuuuucaauagcuuuaagccuaaaggaggcguuauuuucuccgugaagaucuauccgucugaguuugggaaggaacggaugaaagaggaacaaguccagggacccguggagcugcucagcauuccugaagaugcucccgagaaggacuggacauccagagagaaacugcgcgauuaccaguucaagcggcugaaauauuacuaugccguggucgacugcgauucuccugaaaccgcgagcaagaucuacgaggacugugauggccucgaguucgaguccagcugcucuuuuauugaccugagauucauccccgacgauaucaccuuugacgaugaaccgaaggacguugccuccgaggugaaccuuacagcuuacaaaccuaaguauuucacgagcgccgcuaugggcaccucuacaguggagauuaccugggaugaaacagaccaugagcgcaucaccaugcugaaucggaaauuuaagaaagaggaacuccuggauauggacuuccaggccuaccuugccuccagcucugaggaugaagaggaaauugaggaggaacugcaaggggacgauggagucaacguggaggaagacggcaagacgaagaaaagccagaaggacgaugaggaacagaucgcuaaauauagacaacuccugcagguuauucaggagaaggagaaaaaggggaaggaaaacgacauggagauggaaaucaaaugggugcccggacugaaggaguccgcggaagagauggucaaaaauaagcucgaaggcaaagauaagcugacaccuugggagcaguuucuugagaaaaagaaggagaaaaagcgccugaaacggaagcaaaaagcccucgcugaagaagccagcgaggaggaacugcccucugacguggaucuuaacgaccccuacuucgccgaggaaguuaagcagaucgggauuaauaagaaauccgucaagagcgcuaaagauggaaccuccccugaggaagagaucgagauugaaagacagaaggccgagauggcgcugcucaugauggacgaagaugaggacucuaaaaagcacuuuaacuauaauaagaucguggaacaccagaaccugagcaaaaagaaaaagaaacaacugaugaagaagaaagagcucauugaggaugacuucgaagugaaugucaacgaugcucgcuuucaggccauguacaccucccaucuguucaaucuugacccgucugaccccaacuuuaagaaaacaaaggccauggagaaaauccuggaagagaaggcucggcagagagaacggaaggagcaggagcucacccaagccauuaaaaagaaagaaagcgagaucgaaaaggagucccagcgcaaaucuaucgauccugcucugagcaugcugauuaaguccaucaaaacaaagacggagcaguuccaggccagaaagaaacaaaaggugaaauga

SEQ ID NO: 68955 - RNA, 405 nt, Artificial Sequence
  derived and/or modified sequence opt5 from ESM1__Homo_sapiens__NP_001129076
augaaaagcgugcugcuccugaccacacuucugguccccgcccaccucguugcugccugguccaacaauuacgcgguggacugcccucagcauugugauucuagcgagugcaaguccucuccgagauguaagcggacggugcuggacgauugcggcuguugccgcgucugugcugccgggagaggagaaaccugcuaucggacagugagcggcauggacgggaugaaauguggacccggccuucgcugccaaccuuccaacggggaggaucccuucggagaagaguuuggcaucuguaaggaacacgacauggccucuggcgaugggaauauuguuagagaggagguggucaaagaaaacgcugccggaagcccugugaugcggaaguggcugaauccccgcuga

SEQ ID NO: 68956 - RNA, 6363 nt, Artificial Sequence
  derived and/or modified sequence opt5 from ESPL1__Homo_sapiens__NP_036423
augcggagcuucaagagagugaacuuuggcacccugcucuccucucagaaagaggcugaagaacugcuucccgcucugaaagaguuccucagcaauccucccgccggguuucccuccucucgcagcgacgccgagagacggcaggcuugcgaugccauccugcgcgccuguaaccagcagcuuacagcuaaacuggccugcccuagacaccucggcucccugcuggaacucgcugagcuggccugugacggcuaccuugucucuacgccccagcggccuccccuguaucucgagcgcauucuguucguucuucugagaaaugccgccgcucaagggagcccugaagccacccuccggcuggcucagccgcugcaugccugccucgugcaguguucccgcgaggcggcuccccaggauuacgaagccguggccagaggcagcuuuucucugcuuuggaagggagcugaggcccugcucgagcggcgcgccgcuuucgcggccagacugaaagcucuuuccuuucugguccuccuggaagacgagagcacaccuugcgaagugccccacuucgccucuccuaccgccugucgggcuguugccgcgcaucaacuguuugaugcuuccgggcacggacucaacgaggccgacgccgauuuccuggacgaucuucugagccgccaugugaucagagcucucgucggcgaacggggaucuuccagcgggcugcuuagcccccaaagagcccugugccuccuggagcugacacucgagcacugucgccgguuuugcuggucuagacaccaugacaaggcuauuagcgccguggaaaaggcgcacuccuaucugcgcaauaccaaccuugccccgagccugcagcucugucagcugggaguuaaacugcuucaagugggcgaggaagggccucaggcugucgccaagcuccugaucaaggcuucugccgugcuguccaagagcauggaggcgcccucuccuccccuccgggcccuguacgaaagcugccaguucuuucuuuccggacuggagagaggcacaaaacgccgguauagacucgaugcuauucugucucuguucgccuuccuugggggauacugcagccuccugcaacagcugcgcgacgauggcguguauggcggguccagcaagcagcagcaaucuuuucuccagauguacuuccagggacugcaucuuuacaccgucguuguguaugacuuugcucagggcugucaaaucguggaccuggccgaucucacgcagcuggucgacuccugcaagagcaccgugguuuggaugcuggaggcccuugaagggcucucuggacaggagcugacagaucacaugggcaugaccgcuuccuacacaagcaaucuggcguauuccuucuacucucacaaacucuaugccgaggcuugugccaucagcgagccccugugccagcaucuugggcuggugaagccuggaaccuacccggaagugcccccugagaaacuccaccgguguuuuagacugcaaguggagucccugaagaaacuuggcaagcaggcccagggcugcaaaaugguuauucucuggcuggcugcccugcagcccuguucuccugaacauauggcggagcccgugacguucuggguccgcgugaagauggacgcugcccgggccggggauaaggaacuccaacugaaaacacuuagagacagccuguccggaugggauccggagacccucgcucugcugcuucgggaggaacugcaggccuauaaggcgguccgcgcugacacaggccaggagagauuuaacaucauuugcgaucuccuggaacucagcccugaggaaacccccgccggggccugggcucgggccacccaccugguggagcuugcucaaguucuguguuaccaugacuucacacagcagacgaauugcucugcccucgaugcgaucagagaggcccugcagcugcuugacuccgugcgcccugaagcucaagcccgggaccagcugcucgaugacaaagcucaggcccugcucuggcuguacauuuguacccuugaggccaagaugcaggaaggaaucgagagagaucgcagagcucaagcgcccggcaaccuggaagaguuugaggucaaugaccucaacuaugaagauaaacugcaggaggaccgguuccuguacagcaauauugccuuuaaccuugcugccgaugccgcucagucuaagugccuggaccaggcccucgcgcuguggaaggaacuccugacaaaagggcaagcuccugccgugcgcugccuucagcagaccgccgcuucccugcaaauccuggccgcgcucuaucagcugguugcuaagcccaugcaggcccuugaggugcugcuccugcucagaaucgucagcgaacggcugaaagaucacucuaaggccgcuggcagcuccugucacauuacacagcuucugcugacccucggaugcccgagcuacgcccaacugcaucuugaggaggcugccucuucccugaaacaccucgaccagacgacagauaccuaucugcuccugagccuuaccugugaccugcugcgcucccagcucuacuggacacaucagaaggugaccaagggcgugucucugcuucugagcguucucagagauccugcgcugcaaaaauccucuaaggccugguaucuccugcggguccaggugcuucagcugguggcugccuaccugagccuccccuccaauaaccugucucacagccuuugggaacagcugugcgcucaaggguggcagacacccgagaucgcccucauugacucccacaaacugcugcgcagcaucauucuccuucugaugggaucugacauccuguccacgcagaaggccgcugucgaaaccagcuuccucgauuacggcgagaaccuggugcagaaauggcaaguucuuucugaggugcuguccuguagcgaaaagcucgucugccaucuggggagacugggaucuguguccgaggcgaaggccuuuugucucgaagcucuuaaacugacaaccaagcugcagaucccucggcagugcgcccucuuccugguucuuaaaggcgagcuggaacucgcccgcaaugacauugaucugugucaaagcgaccugcagcagguccucuuccuucuggaguccugcacagaguuugggggcgucacccagcaccuggauagcgugaagaaaguucaucuccaaaagggaaaacagcaggcucaggugccgugucccccucaacugcccgaagaggaacuuuuccugagaggcccugcccucgagcuggucgcgacgguggcuaaggaacccgggccuaucgcccccucuaccaacagcuccccggugcugaagacaaaaccucagcccauuccuaauuuucucucucacagcccgaccugcgacugcucccuuugugccucuccgguccugacagcuguuugccugcggugggugcucgugaccgccggagucagacuggcgaugggccaucaggcccaggggcuugaucugcuccaagugguucugaagggauguccugaggcugccgagcgccugacgcaggcucuccaggccagccuuaaccacaaaacacccccuucccuggugcccucucugcucgacgaaauccuggcucaagccuauacccuucuggcgcucgagggccugaaucagcccagcaacgaaucccugcagaagguccuccagagcgggcuuaaauucguggccgcucggauuccucaccuggagccguggagagccucucugcuccugaucugggcucuuacaaagcugggcggacucuccugcuguaccacccaacuguuugccagcucuuggggcuggcagcccccucugaucaaguccguucccgggagcgaaccuuccaaaacacagggacagaagcgcucuggccgggggagacaaaaacucgccagcgcuccccuucgccugaauaacacgucccagaagggacuggagggccgggggcucccuugcaccccgaaacccccugaucgcauuagacaggcgggcccccaugugccuuucacagucuuugaggaagugugucccaccgagagcaagccggaaguuccucaggcgccccgggugcaacagagaguccagacacggcugaaggugaauuucucugacgauuccgaccuugaggaucccgugagcgcugaggccuggcuggccgaagaaccuaaacgcagaggaaccgcuucucggggccgcgggagagcccggaagggacucagccugaaaacggacgcggucguugcccccggcuccgcuccugggaacccgggacugaauggcagaucucgccgggccaagaaaguggcuagcagacacugcgaggaacgccggccccagagagccuccgaccaagcgcgcccuggccccgaaaucaugcggacaauuccugaggaggaacucaccgauaacuggagaaagaugucuuuugagauccuucgcgggagcgacggagaagauuccgccagcggcgggaagacccccgcuccgggaccugaggccgcuucuggcgaaugggagcugcugagacucgacuccagcaaaaagaaacugcccuccccuugucccgauaaggagucugacaaagaucuugggccucggcugcgccuccccagcgccccgguggcuacaggacuguccacccuggacucuauuugcgauagccucuccgucgccuucagaggcaucagccauuguccucccucuggccuuuacgcgcaccugugccgguuucuggcccucugccuggggcaucgcgaccccuaugcuacagccuuccuugugacggaauccguuagcauuaccuguagacaccagcugcucacacaucugcaccggcagcugucuaaggcucaaaaacacagaggaucccucgagaucgccgaucagcugcagggccuuagccugcaggaaaugccuggggacgugccgcucgcccgcauccaacggcuguuuucuuucagagcgcuugagagcggacauuucccccagccugaaaaggaguccuuucaggagcgccuggcucucauucccucuggcgucaccgugugcguucuggcccuggcuacacuccagccugggaccgugggaaauacgcugcuucugacccggcucgaaaaggacuccccucccgucuccgugcaaaucccgacaggccagaacaaacugcaccuuagaagcguccugaaugaguucgaugccauucagaaggcccagaaagaaaacuccucuuguaccgacaagcgggagugguggacaggccgccucgcucuggaucacagaauggaggugcugaucgccagccucgaaaaauccguucuggggugcuggaagggacuucugcuccccucuagcgaggaaccuggccccgcgcaagaggccucccggcugcaggaacuucugcaggacuguggguggaaguacccugaucgcacccuccugaaaauuaugcugucuggagcuggcgcccucacaccccaagacauccaggcucuggccuaugggcuuugcccgacccagccugagagagcgcaggagcugcucaacgaagccgugggacggcugcaaggccuuacgguccccagcaauucccaucuggugcucguucuggauaaggaccugcagaaacuccccugggagagcaugccuucucugcaggcccuucccgugacacgccugccuuccuuuagauuccuccugagcuacucuaucauuaaggaauauggcgccuccccgguccuuagccaggggguggauccccggucuaccuuuuacgugcugaacccucacaauaaccucuccagcaccgaggaacaauuccgcgcuaauuuuuccagcgaggccggauggagaggcguugucggggaggugccccggccugaacaggugcaggaggcucugacaaaacaugaccuguacaucuaugccggacacggcgcgggggccagauuccucgauggacaggcuguccugcgccuuucuugucgggccguggcucugcucuuuggcugcagcuccgccgcccuggcgguuagaggcaaccuugaaggggcuggaauugugcugaaguacaucauggccggcuguccccucuuccuggggaaucugugggacgucaccgaucgcgacauugaccgguauacggaggcccuccugcaaggauggcuuggcgcugggccgggagccccucugcucuacuaugugaaccaggcuagacaggcgccccgccugaaguaccuuaucggcgcggccccuaucgcuuauggccugcccguuucucuccgguga

SEQ ID NO: 68957 - RNA, 2475 nt, Artificial Sequence
  derived and/or modified sequence opt5 from ESPN__Homo_sapiens__XP_011540537
auggcccuggagcaggcucuccaagccgcgagacagggcgaacuggacgugcuucggagccugcacgcugccgggcuccugggacccucccuucgcgauccucuggacgcccucccgguccaucacgcugccagagcuggcaagcugcauugccugcgguuccucguugaggaagccgcgcugcccgccgcugcccgcgcuagaaacggggccaccccugcgcacgaugccucugcuacaggacaucuugccugucugcaguggcuccugagccagggcgggugccgggugcaagacaaagauaauuccggagcuacggugcuucaccuggccgcccgcuuuggccaccccgaggucgugaacuggcuccugcaucacggcgggggagacccuaccgcugcgacagauaugggcgcccugcccauccauuacgcugccgccaagggggacuucccuucucucagacugcuuguugaacacuauccggagggagugaaugcucagaccaaaaacggcgccacaccccuguaccucgcgugucaggaggggcaccuggaagucacccaguaucuugugcaagagugcggagcugauccucaugcccgggcccacgacggcaugacaccccugcaugcugccgcucagaugggccacagcccuguuauuguguggcucgucuccuguaccgaugugucucugagcgaacaggacaaggauggggccacggcgaugcauuuugccgcuucccgcggacacaccaaagugcugagcuggcuccugcuucacggcggggagaucucugccgaccuguggggaggcacaccccuccaugacgcugccgagaauggggaacuggagugcugucagauucuugucguuaacggagcggaacuggaugugagagaccgggauggcuacaccgccgcugaccucuccgauuucaauggccacagccauugcacacgcuaucugagaaccguggagaaccugucugucgaacaccgggugcucucccgcgacccgagcgccgagcuggaggcuaagcaaccugauucugggauguccagccccaauacgacaguuuccgugcagccucuuaacuuugaccugucuagccccaccuccacacucagcaauuacgauucuuguuccagcucucacagcuccaucaagggacagcaucccccuugcggccugucuagcgccagagccgcugacauucaauccuauauggauaugcugaacccggaacuugggcucccccggggaaccaucggcaaaccuacacccccucccccgccucccagcuucccucccccucccccgccucccgggacacagcugcccccuccgcccccuggcuaccccgcgccuaagcccccugucggaccccaggccgcugacaucuacaugcagacgaaaaauaagcugagacacguggagaccgaagcccucaaaaaggagcugucuuccugugacggccaugaugggcuucgccggcaagacagcucuagaaagccgcgcgccuuuuccaaacagccuagcacaggagauuauuaccggcagcugggcagaugccccggggaaacccucgcugcccgcccuggaauggcgcacuccgaggaggcugcccugcugcccggcaaccauguuccgaaugggugcgccgcugacccuaaggccucucgggaacuucccccucccccucccccgcccccucccccucuccccgaggcggcuagcuccccuccgcccgccccuccccugccucuggaaucugccggccccggauguggccagagacgcagcuccagcucuacaggguccaccaaauccuucaacaugaugucuccgacgggagauaacuccgagcuccuggcugaaauuaaggccggcaaaagccuuaagccuacaccccaaucuaaagggcugaccaccguguuuagcggaaucggccagcccgcuuuccagccugacagcccccucccuagcgucucuccggcccugucccccgugcggagcccuacacccccugcggccggguuucagccccugcuuaauggcucccucgucccggugccucccaccaccccugcucccggaguucaacuggauguggaggcccugauuccuacgcacgacgagcagggcagacccaucccggaauggaagcgccaggucauggugcggaagaugcagcucaaaaugcaagaggaagaggagcagagacggaaggaagaggaagaggaagcucgccuggccucuaugccugccuggagacgggaucuucugcgcaaaaagcucgaggaggaaagagagcagaaacggaaggaagaggaaagacaaaagcaggaggagcugcgcagagaaaaagagcagagcgaaaagcugcggacccuuggguaugacgaguccaaacucgcucccuggcagcgccaaguuauucugaagaaaggagauaucgcgaaguacuga

SEQ ID NO: 68958 - RNA, 1794 nt, Artificial Sequence
  derived and/or modified sequence opt5 from ESR1__Homo_sapiens__NP_001278159
augaccaugacacugcacacgaaggccagcggcauggcucuccugcaucagauccaagggaacgagcuugaaccccugaauagaccucagcucaaaauuccgcuggagcggccccuuggagaaguguaccuggacuccucuaagccugccgucuauaacuaccccgagggcgcggcuuaugaguucaaugccgccgcugccgcuaacgcccagguuuacgggcagaccggacucccuuauggccccgggagcgaagcggccgcuuuuggauccaauggccugggcggguucccuccgcugaacucugugagccccuccccucucaugcugcuucaucccccuccccaacugucuccguuucuccagccucacggacaacaggugcccuacuaucuggagaaugaaccuagcggcuacacaguccgcgaggccgggccucccgcuuucuacagacccaacuccgauaaucggcgccagggaggcagagaacggcuugccagcaccaacgacaaagggucuauggcgauggaguccgccaaggagacacgcuauugcgcuguguguaaugauuacgccagcggauaucacuacggcguuuggucuugcgaaggcuguaaagccuuuuucaagagauccauccaggggaaccggcauaaugacuauaugugcccggcuaccaaccaguguacaauugauaagaaucgcagaaaaagcugccaggccugucggcugcgcaagugcuacgaggugggaaugaugaaaggcgggaucagaaaggaccggcgcggaggcagaaugcucaaacacaagcggcaaagagaugacggggaaggacgcggcgaggucggcucugcuggggauaugcgggcggccaaccuguggcccuccccucugaugauuaagagaagcaaaaagaacucccucgcucugucucuuaccgccgaccagauggugagcgcccugcucgaugcugaacccccuauccuguauuccgaguacgaccccacgcgcccguuuagcgaggccucuaugaugggacuucugaccaaucucgcggaucgggaacugguucacaugaucaacugggcuaaaagagugccuggcuucgucgaccugacacuccaugaccaggugcaucugcuugagugugccuggcuggaaauucucaugaucgggcugguguggcgcuccauggagcaccccggaaagcugcuguuugccccuaaucuccugcuggaucggaaccaaggcaaaugcgucgaagggaugguugagauuuucgacaugcuccuggcuaccagcucuagauuucgcaugaugaaucuucagggcgaggaguucgugugucuuaagagcaucauucuccugaacuccggaguguacacauuucugucuagcacccuuaaaucccucgaagaaaaggaucacauccaccggguccuggacaagauuacggauacacugauccaucucauggccaaagcuggccugacccuucagcagcaacaccagagacuggcccagcuccugcugauccuuagccauauucgccacaugucuaauaaggggauggagcaucucuauuccaugaaaugcaagaacgugguuccccuguacgaccugcuccuggaaaugcuugaugcgcaccggcugcacgccccuacaagcagaggaggcgcuucuguggaggagaccgaccagucccaucucgccaccgcugggagcacauccucucacagccugcaaaaauauuacaucacgggagaagccgagggcuuccccgcgaccgucuga

SEQ ID NO: 68959 - RNA, 1446 nt, Artificial Sequence
  derived and/or modified sequence opt5 from ESR2__Homo_sapiens__NP_001201831
auggacaucaagaacagccccuccucucugaauagcccuuccucuuacaacugcagccaguccauucucccgcuggagcacgggucuaucuauauucccagcuccuacguggauagccaucacgaauauccugccaugaccuucuacucucccgcugucaugaauuauuccaucccuagcaacguuacaaaucuugaagggggacccggcagacaaacgaccucuccuaacgugcuguggccgacacccgggcaucucuccccucuggugguccaccggcagcuuagccaucuguacgccgagccccagaaaucuccuuggugugaggcgcgcucccucgaacacacccugcccgugaauagagagacacugaagcggaaaguuagcggaaaccgcugcgcuuccccggugaccggcccugggucuaagagagacgcccacuuuugugccgucugcagcgauuaugcuuccggauaccauuacggcguguggagcugugagggcugcaaagccuucuuuaagcggucuauucaggggcacaaugacuauaucugucccgcuacaaaccaaugcaccaucgauaagaaucgcagaaaauccugucaggccugccggcuccgcaaguguuacgaaguuggaauggugaaaugcggcagcagacgggagcgcugcggguauagacugguccggcgccagagaucugcggacgaacagcuucauugugccggaaaggcuaaacggagcggcgggcacgccccuagagugcgcgagcugcuccuggaugcucuuucccccgagcaacuggugcucacgcugcuggaagccgagcccccucacguccucauuucucggccgagcgcgcccuucaccgaagccuccaugaugaugagccugacaaagcuggcugacaaggagcugguucauaugaucucuugggccaaaaagauuccuggauuuguggaacucucccuguucgaucaggugagacuucuggagagcugcuggauggagguccucaugaugggccugauguggcgcucuaucgaccaccccggcaaacugauuuuugcuccugaucucgugcuggaccgggaugaagggaaguguguugagggaauccuugaaauuuucgacaugcugcucgccaccacauccagauuucgcgagcugaaacuucagcauaaggaauaccugugcgugaaagccaugauccuccugaacagcuccauguauccccuggucaccgcuacgcaggacgcggauucuagccggaagcucgcccaccuucuuaaugcugugacagacgcccugguuugggugaucgccaaguccggcauuucuagccaacagcaguccaugagacucgcuaaccugcugaugcuucucagccauguccgccacgcccgguggggcgagaaacaauucauccaccugaagcugucuuga

SEQ ID NO: 68960 - RNA, 2034 nt, Artificial Sequence
  derived and/or modified sequence opt5 from ESRP1__Homo_sapiens__NP_001030087
augaccgccagccccgacuaccuggugguccucuucggcaucacagcuggggccacgggagcgaagcugggcuccgaugagaaagaacuuauucugcucuuuuggaagguuguggaccuggcuaacaaaaagguggggcagcuucacgagguccuggugagaccugaucaacucgaacugaccgaggacugcaaagaagagacaaagaucgauguugagucucugagcuccgccucucagcucgaccaggcccugcggcaguucaaucaaagcguguccaacgaacuuaauauuggagucggcaccucuuuuugucugugcacagaugggcagcuccaugugcgccagauccugcacccggaggcuagcaagaaaaacguucuucugcccgaauguuucuauuccuuuuucgaccucagaaaggaguuuaaaaagugcuguccuggaagccccgauauugacaaacuggauguggccaccaugacagaguaccugaauuucgaaaagucuuccagcgucucucgguauggcgcuucccagguggaggacaugggcaacaucauccucgccaugauuagcgaaccuuacaaucaucgcuuuucugaucccgagagagugaacuauaaguucgaauccgggaccugcagcaaaauggagcugaucgacgacaauacggucguucgggcgcgcggacuuccuuggcaauccucugaucaggacauugccagauuuuucaagggccugaacaucgcuaaagggggagccgcucucugucugaaugcccagggccggcgcaacggggaggcgcuugugagauuugugagcgaggaacaccgggaucuggcccuccagcgccauaagcaccacaugggaaccagauacauugaagucuauaaagcuacaggcgaggacuuccugaagaucgccggcgggaccuccaaugaaguggcucaauuccugagcaaagagaaccagguuauugugcggaugcgcggacucccguuuacagccaccgccgaggaagucguggcuuucuuuggccagcauugccccaucacagggggaaaggagggcauccuguucguuacguacccugaugggagacccaccggagacgcguuugugcuuuucgccugugaagaguacgcucaaaaugcccugcggaagcacaaagaucuccugggcaagagauauauugaacuuuuucgcucuacagccgcugagguccaacaggugcugaaccgguucuccagcgccccucucaucccccugccgaccccucccauuaucccuguccugccccagcaguuugugcccccuaccaacguuagagacugcauucgccuccggggccugccguacgcggcuacaaucgaggauauccuugacuuccugggggaauuugccacggauauuagaacccauggagugcacaugguccucaaucaccagggccgccccucuggggacgccuucauccagaugaaaagcgcugaccgggccuuuauggcugcccagaagugucauaaaaagaacaugaaggauagauauguggagguuuuccaaugcuccgcggaagagaugaauuucgugcugaugggaggcacacugaaccgcaaugggcuuucuccucccccuugccucagcccgcccuccuacaccuuuccugcccccgcugccgucauuccuacagaggcugccaucuaucagcccagcgugauucugaacccucgggcgcugcagcccucuaccgccuacuauccggcuggcacgcaacucuucaugaauuacacagccuacuauccuuccccucccggaagccccaacucucugggcuacuuuccgaccgcugccaaucuuuccggggugcccccucagcccggaaccguugucagaaugcagggccuggccuauaacacaggggugaaagaaauccucaauuucuuucagggauaccaguaugcuaccgaggacggccugauccacacaaacgaucaagcgcgcacgcugccuaaggaauggguguguauuuga

SEQ ID NO: 68961 - RNA, 2154 nt, Artificial Sequence
  derived and/or modified sequence opt5 from ESRP2__Homo_sapiens__NP_079215
augacacccccuccgcccccucccccucccccuggcccggaccccgccgcugauccugccgcggaccccugcccuuggcccgggagccuggugguccucuucggagcuaccgccggcgcccuggggagagaucuuggauccgacgagacggaucugauccuccugguuuggcaagugguggaaccgcggucucgccaggucggcacccuucacaagagccuggugagagcugaggccgcugcccucuccacacagugucgggaagcgucugggcugagcgccgacucccuggcucgcgccgagccucucgauaaaguucugcagcaguuuucucaacuugugaacggagacgucgcucugcucggcggcgggcccuacaugcugugcaccgauggacagcagcuucugagacaggugcuccauccugaagccagccggaagaaucugguucugcccgacauguucuuuuccuucuaugaucuccgcagagaguuucacaugcaacaucccagcacauguccugcgcgggaccugaccguggccacaauggcucagggccuugggcuggagaccgaugccacggaagacgacuucggagucugggaggugaaaaccaugguggcugucauucuccaucugcuuaaggaaccgucuucccagcuguuuagcaaacccgagguuaucaagcagaaguacgagacaggcccuugcucuaaagccgaugugguggacuccgaaaccgucgugcgcgccagagggcuccccuggcaaagcucugaucaggacguugcucgguucuuuaagggacugaacguggcgcgcggcggcgucgcccugugucucaaugcucaggggagacggaacggagaggcccugauucgcuucguggauuccgaacaaagagaccuugcccugcagcggcacaaacaccacaugggcguuagauauaucgagguguacaaggcuacaggggaagaguuugucaaaauugccggaggcaccagccucgagguggcgcgcuuccugucccgggaagaucaggucauccuuagacugcgcgggcucccuuuuucugcuggacccacggacgugcugggcuuccugggcccggagugcccuguuacagggggaaccgaaggccuccuguucgugcggcaucccgaugggagaccuacaggagacgccuuugcccuuuucgcuugugaggaacuggcccaggcugcccuccgccggcacaagggcaugcuggggaagagauauaucgagcuguuucgcagcaccgcggccgagguccaacaggugcuuaaucgguacgcuuccggcccccuccugccuacccugacagcuccccuccugccgauuccuuucccccuugcccccggaacgggcagagauugcguucgccugcgggggcucccuuauaccgccacaaucgaagacauucugagcuuucugggagaggcggccgcugacaucagaccgcauggcgugcacaugguccuuaaccagcaggggcggcccucuggagaugccuucauucaaaugaccuccgcugaacgcgcccucgccgcugcgcagagaugucacaaaaaggugaugaaagagcgguacguggaaguugucccuugcagcacagaggagaugucuagagugcugaugggcgggacccugggccgcagcggaauguccccuccucccuguaagcuccccugccugucucccccgacguacacaaccuuucaggccaccccuacacuuauccccaccgaaacagcugcccuguauccuagcuccgcccuccugcccgcugcccgggugccggcggcuccuacgcccgucgccuacuauccuggccccgccacccagcuguaccuuaauuauacagcuuacuaucccagcccuccggugucucccaccacaguuggguaccucaccacgccuaccgccgcgcuggcuuccgcccccacaagcgugcugucucaauccggagcccucgucagaaugcagggcgugccuuacaccgcugggaugaaagaccugcuuagcguuuuccaggccuaucagcugcccgcugaugacuacacaucccucaugccugugggagauccgccccgcaccguccugcaagccccuaaggagugggugugccuguga

SEQ ID NO: 68962 - RNA, 1272 nt, Artificial Sequence
  derived and/or modified sequence opt5 from ESRRA__Homo_sapiens__NP_001269379
augagcucccagguggucggcaucgagccccuguacauuaaggccgaaccugcuucuccggacagccccaaaggguccucugagaccgaaacagagccucccguugcccucgcgccuggacccgcuccuacgagaugccugccgggccacaaggaagaggaggauggggaaggagccggccccggggagcaaggaggcggcaaacuugugcugagcucccucccuaagcggcugugucuugugugcggggacgucgccucuggauaucauuacggcguggcuagcugugaagccugcaaggcuuucuuuaaacgcaccauccagggguccauugaguauagcugucccgccucuaacgagugcgaaaucacaaagagacggcgcaaagcgugucaggccugcagauucaccaagugucugcggguuggaaugcucaaagagggcgugcgccuggauagaguccgcgggggacggcagaaguacaaaagacggccugaaguggacccccugccguuuccuggccccuucccugcuggcccccucgccguugcugggggaccccgcaagacagccgcgccugugaaugcccuggucucccaccuucuggugguggagccggaaaagcucuaugcuaugcccgauccugccggccccgacgggcaucugccugcugucgccacccuuugcgaucuguuugacagagagauuguugugacaaucagcugggccaaaucuauccccggauucuccagccucucucuguccgaucaaaugagcgugcugcaguccgucuggauggaggugcucguucugggcguggcucagcggucucuuccgcugcaggacgaacucgcguuugccgaggaucugguccuugacgaagagggggcucgcgccgccggacugggcgaacucggcgcugcccugcugcaacucgugagacggcugcaggcgcuuagacuggagcgcgaggaauacguucuccugaaggcucuugcccuggccaacagcgauuccgugcacauugaggacgcugaagccgucgagcagcuccgggaagcucugcaugaggcccugcucgaguaugaagcggggagagccggaccuggcgggggagcugagcgccggagagccggccgccugcuucugacccucccccugcugcggcagacggcugggaaagugcuugcccacuucuacggcgucaagcucgaaggaaaagugccuaugcacaagcuguuucuggagaugcucgaggcgaugauggacuga

SEQ ID NO: 68963 - RNA, 1527 nt, Artificial Sequence
  derived and/or modified sequence opt5 from ESRRB__Homo_sapiens__NP_004443
augagcuccgacgauagacaccugggcucuagcugcggguccuucaucaagaccgagcccucuagcccuuccucuggaauugacgcccucagccaucacuccccgagcgggucuuccgaugcuagcggcggauuuggccuggcccuugggacacaugcgaacggacuggacucucccccuauguucgcuggcgccggccucgggggaacgcccugucggaaauccuacgaagauugcgccagcggcaucauggaggacucugcuauuaagugugaauauaugcugaaugccaucccuaaacgccuuugccugguguguggggauauugcuuccggauaccacuauggcgucgccagcugcgaggcguguaaggccuuuuucaaaagaaccauccaggggaacaucgaauacuccugccccgcuacaaaugagugugagauuaccaagcggcgcagaaagucuugccaagccugucgguuuaugaaaugccucaagguuggaaugcugaaagaaggcgugcgccuggacagagugcggggcgggcgccagaaguauaaaagacggcucgauagcgaguccagcccuuaccugucucuucagaucuccccgcccgcuaagaagccucugacaaaaauugucagcuaucuccugguggccgaacccgacaaacuuuacgcgaugccucccccgggaaugccugagggcgauaucaaggcccugaccacacucugcgaccuggcugaucgcgagcugguugugauuaucgggugggccaagcauauucccggauucucuagccucucccugggcgaccagaugucucuucugcaaagcgcuuggauggaaauccucauccuggggauugucuacagaucccuuccuuaugacgauaaacugguguacgccgaggacuauaucauggaugaggaacacagccggcucgccggacugcuggaacucuaccgcgcuauucugcagcuuguuagacgguauaagaaacugaagguggagaaggaggaauuugucacccucaaagcgcuggcccuugcuaacucugacuccauguacaucgaggaucuggaagccgugcagaagcuccaggaccugcugcacgaggcccuccaagauuaugaacugagccagagacaugaggagcccuggcgcacgggcaaacuucugcucacccugccccugcuucggcagacagcugccaaggcggugcagcacuucuacucugucaaacuccaaggcaagguuccuaugcauaagcuguuucuggaaaugcucgaggcuaaaguggggcaggaacagcugagaggauccccgaaggacgagcgcaugagcucccacgauggcaaaugucccuuccaaucugccgccuuuaccagccgggaccaguccaauucuccugggauucccaacccuagacccagcuccccgacaccucuuaaugaacgcggacggcagaucagccccucuaccagaacgccuggcgggcagggcaagcaccuguggcucacaauguga

SEQ ID NO: 68964 - RNA, 1191 nt, Artificial Sequence
  derived and/or modified sequence opt5 from ESRRG__Homo_sapiens__NP_001230436
augagcaacaaggacagacacaucgauuccucuugcagcuccuucauuaaaaccgagcccucuagcccugccucccugacagacucugugaaucaucacagcccgggcggguccagcgaugcuucuggauccuacagcucuacgaugaacggccaucagaaugggcucgacuccccuccccuguaucccagcgccccuauccuuggaggcucugggcccguccggaagcuguacgaugacuguuccagcaccauuguugaagauccucaaacaaaaugcgaguauaugcucaacuccaugccgaagcgccugugucuugugugcggagacaucgcgucuggcuaccacuauggcguggcuagcugugaagccugcaaagccuuuuucaagagaaccauucaggggguccggcuggaucgcgugagaggaggccggcagaaguacaaacgcagaaucgacgcugaaaauucccccuaucucaacccucagcugguucaacccgccaagaaaccuuacaauaagaucgugagccaucugcucgucgcugagcccgagaaaauuuacgccaugccggauccuacagugcccgacucugauaucaaggcgcugaccacacuuugugaccuggccgaccgggagcucguugugauuaucgggugggcuaagcacauuccuggauuuuccacccugagccuugccgaucagaugucucugcuccagagcgcuuggauggaaauccugauucugggcgucguguaucgcucccucucuuucgaggacgaacugguguacgccgaugacuauaucauggaugaggaccagagcaaacuugcggggcugcucgaucugaacaaugccauccuucaacuggucaagaaauacaaguccaugaaacucgagaaggaagaguuuguuacgcugaaagcuauugcccuggcuaacagcgacucuaugcacaucgaagauguggaggccgugcagaagcuccaggacguccugcaugaagcccuucaggauuaugaggcuggacaacacauggaggaccccagacgggcgggcaagaugcugaugacccucccccugcuucgccagacauccaccaaagccgugcagcauuucuacaauauuaagcuggaaggcaaaguuccuaugcacaagcucuuucuggagaugcuggaagcuaaaguguga

SEQ ID NO: 68965 - RNA, 1221 nt, Artificial Sequence
  derived and/or modified sequence opt5 from ESX1__Homo_sapiens__NP_703149
auggagagccugagaggcuacacccacuccgacaucggguaucggucucucgccgugggagaagauauugaggaagucaacgacgagaagcugacaguuacgagccuuauggcucgcggcggggaagaugaggagaauaccagauccaaacccgaauacggaacagaggccgaaaacaaugugggcaccgaggggucugugccuagcgacgaucaggaccgggagggaggcggcgggcaugaaccggagcaacagcaggaggaacccccucugacaaagcccgaacagcaacaggaggagccuccccuccuggaacuuaaacaggagcaggaggaaccuccgcaaaccacagucgaaggaccccagccugcggagggcccccagaccgcugaggggccucagcccccggaacgcaagagacggcgcagaacggccuucacccaauuucagcugcaggagcucgaaaacuucuuugaugagucccaauauccugacgugguugcccgggaacgccuggcugccagacugaaucucacagaggaucgggugcaggucugguuccagaaccgcagagcuaaauggaagcggaaucagcgcgugcugaugcuuagaaacaccgccacagcggaccuggcccacccccucgauauguuucugggaggcgcuuacuaugccgcuccugcccuugaccccgcgcugugcguucaucucgugccccaacugccucggccgcccguccugccugugcccccuaugcccccgagaccucccauggugccuaugcccccucggcccccgaucgccccuaugccucccauggcucccgucccgcccgggucucgcauggccccuguucccccuggacccagaauggcuccugugcccccguggccucccauggccccugugcccccguggccucccauggccccuguccccaccgggcccccuauggcuccggugcccccuggacccccuauggcgcgcguucccccuggcccgcccauggcccgggugccucccggcccucccauggcuccgcucccucccggcccucccauggcuccccugccuccggggcccccuauggcgccccuuccucccggaccgccuauggcuccccugccucccagaagccacgucccucauacgggccucgcccccgugcacauuacaugggccccgguuaucaauuccuacuaugccuguccuuucuuuuga

SEQ ID NO: 68966 - RNA, 3345 nt, Artificial Sequence
  derived and/or modified sequence opt5 from ESYT1__Homo_sapiens__NP_001171725
auggagagaagccccggcgaagggccuuccccgucucccauggaccagccuagcgcccccuccgauccuaccgaccaacccccugcugcccacgcgaagccggaucccggaucuggcgggcagccugcuggacccggcgccgccggggaggcucuggccgugcucacgagcuucggacggcgccugcuuguccugaucccuguuuaccucgcuggcgccgugggccuguccgugggguuuguccuuuucggacuggcgcucuaucugggcuggagacgggugcgcgacgaaaaagagagaucucugcgggccgcucgccagcuccuggaugacgaggaacagcuuacagccaagacccuguacaugagccauagagagcuccccgcuuggguuuccuuuccggauguggaaaaagccgaguggcugaacaagauugucgcgcaaguguggccuuuccuugggcaguauauggaaaaacugcucgccgagacaguugcucccgccgugcggggaagcaauccucaucugcagaccuuuacauucacccgcgucgagcugggcgaaaagccccucagaaucauuggggugaaggugcaccccggacagcggaaagagcaaauccugcuugaccugaacauuucuuacgucggcgauguucagaucgacguggaagugaagaaauauuuuugcaaggcuggcgucaaagggaugcagcuccacggagugcugcgcguuauccuugagccucugauuggcgaucucccguucgugggggccgucuccauguuuuucaucagacggcccacacuggacauuaauuggaccggaaugacgaaccugcucgauaucccuggccugagcucucuuuccgacaccaugauuauggacagcaucgccgcuuuucuggugcuccccaaucgccugcuuguuccucuggugcccgaucuccaggacgucgcgcaacugagaucuccgcugccucgggggauuaucagaauccaucuccuggccgcucgcggacuuuccagcaaggauaaguacgugaaaggccugauugaaggcaaguccgaccccuaugcccucguccggcuggggacacagaccuucuguucuagagugaucgaugaggagcugaacccucaguggggagaaacauacgagguuauggugcacgaaguccccggccaagagauugaaguggagguuuuugacaaagauccugacaaggaugacuuccuugggcgcaugaaacucgaugugggaaagguccugcaggccagcgugcuggacgacugguucccccuccagggcgggcagggccaagugcaucugcggcuugaguggcugucccuccugagcgaugcugaaaaacuggagcagguucuucaguggaauuggggagucucuuccagaccggacccucccagcgccgcgauccucgugguguaccuggaucgcgcucaggaccugcccauggucaccucugaacucuauccuccgcaacugaagaagggcaacaaagagcccaauccuauggugcagcuuagcauucaggauguuacgcaggaauccaaggccguguacucuacaaacugccccgucugggaggaggccuuucgguucuuucugcaagacccucagagccaggaacucgaugugcagguuaaagacgauuccagagcucugacccugggggcccuuacacucccccuggcucgccugcucaccgccccugagcugauccuugaccaaugguuccagcugagcagcuccggacccaauagccggcucuauaugaagcuggugaugagaauccuguaccuugauucuuccgaaauuuguuuuccgaccgucccuggcugccccggggcgugggacguggauagcgagaacccucagcgcggauccucuguugacgcucccccgcggccuugucacacaacgcccgacagccaauucggcaccgagcacgugcucagaauccauguccuggaagcccaggaucugauugccaaagaccgguuucucgggggccuggugaagggaaaguccgauccuuaugugaaacuuaagcuggcuggccgcucuuucagaagccacgucguucgggaggaccucaaucccagauggaacgaaguguuugaggugaucgucacauccgugcccgggcaggaacuggagguugagguguucgauaaagaccuggauaaggacgauuuucuuggacgcugcaaaguccggcugaccacagugcucaauagcggcuuccuggacgaauggcucacccuggaggauguuccuucugggagacuucaucugcgccucgaaagacugacgccgcggcccacagccgcggagcuggaagaggugcuucaggucaacucccugauucaaacccaaaagagcgccgagcucgcugccgcucugcucucuaucuacauggaacgcgccgaggaccugccucuuagaaagggaaccaaacaccugucccccuaugccacacucaccgugggcgauagcucucacaagacaaaaacgaucagccagaccuccgcuccuguuugggacgaaagcgcgucuuuucugauucggaagccccauacagagucccuggaacuucaggugcgcggggagggcaccggaguccugggcagccucucccugccucucucugagcugcuuguggccgaccagcugugucuggauagaugguucacacucagcuccgggcagggacaggugcugcuucgggcucagcugggcauccucgucucucaacacagcgggguugaagcccauucccacucuuacagccacuccucuucuucccugagcgaggaaccggagcucucuggagggcccccucauauuaccuccagcgcccccgagcugcgccagagacuuacgcacguggacucuccucuggaagcucccgccggcccgcugggccaggugaaacucacccugugguacuauuccgaggaacggaaacuugucagcaucgugcauggaugccgcucccugagacaaaacggccgggauccucccgaccccuacguuagccuccugcuccugccugauaagaauagagggacaaagcgccggaccucucagaagaaaagaacacuuagccccgaguucaacgaacgcuuugagugggagcugccucuggacgaagcgcagcggagaaagcucgauguguccgucaaaucuaauagcuccuucaugucucgcgagcgggaacugcuuggaaaggugcagcuggaccucgcugagaccgaucugagccaaggcguugccagaugguaugaccucauggauaacaaagacaagggguccucuuga

SEQ ID NO: 68967 - RNA, 2682 nt, Artificial Sequence
  derived and/or modified sequence opt5 from ESYT2__Homo_sapiens__NP_065779
augacacccccuagcagagccgaggcuggcgugcggcgcuccagagucccgucugaagggcgguggcgcggagccgagcccccuggcaucagcgcguccacccagcccgcuucugccgggagagccgcucggcacugcggagccaugagcggcgcucgcggggaaggaccugaggccggcgcgggcggggccggaggcagagcugcccccgaaaacccugggggaguucuguccguggagcucccgggccugcuugcucaacuggcccggucuuucgcgcuccugcuucccguguacgcccugggguaucucggacugagcuuuuccuggguccugcucgcucuggcccuucuggcuuggugucgcagaagccggggccucaaggcccugcgccuuugcagagcccuggcucuccuggaggacgaagaacgggugguucgccugggcgugagagcgugugaucucccugccuggguccauuuccccgacacggaacgggcugaguggcugaauaaaaccgugaagcacauguggccuuuuauuugccaguucaucgagaaacuuuuuagagaaacaauugagcccgccguucgcggggccaacacccaucugucuacauucuccuuuaccaagguggaugucggacagcagccgcuccggaucaauggcgugaaaguguacacagaaaacgucgacaagagacaaauuauccuggaucuucagaucagcuucguugggaauugugagauugaccuggaaaucaagcgcuauuuuugccgggcuggagugaaaucuauucagauccacggcaccaugagagugauucucgagccucugaucggggauaugccccuggucggagcccucuccauuuucuuucugcgcaagccucuucuggagaucaacuggacgggccucaccaaucugcuugacgugcccggccugaacgggcucagcgauacaaucauucuggacaucauuucuaauuaccugguucuccccaaccggaucaccgugccucuggucuccgaagugcagauugcgcaacuuagauucccgguucccaaaggagugcugcgcauccauuuuaucgaggcucaggaucuccagggcaaggacacauaucugaaagggcuggucaagggaaagagcgauccuuacggcauuauccggguggggaaucagauuuuccaauccagagucaucaaagaaaaccuuucucccaaguggaaugagguguaugaagcccucguuuacgagcacccuggccaggagcuggaaauugagcuguucgacgaagaccccgauaaagacgauuuucucggaagccugaugaucgaccuuaucgagguggaaaaggagcgccugcucgaugagugguucacccuggacgaagucccgaaaggcaagcugcaccuucggcucgaguggcugacgcugaugccuaacgccuccaaucucgauaaagugcugacagacauuaaggcugauaaggaccaggccaacgaugggcuuagcucugcucugcucauccuguaccuggacuccgccagaaaccuucccagcggaaagaagauuucuagcaauccuaaccccguugugcaaauguccgucggccauaaagcgcaggaaucuaagauccgguauaaaaccaaugagccugugugggaggaaaacuuuacauucuuuauucacaaucccaagcgccaggaccucgagguggaaguuagagaugagcagcaucaauguagccuggggaaccugaaggucccgcucucccagcugcuuaccagcgaagacaugaccgugucucagcgguuccagcuguccaauagcggaccuaacucuacaaucaaaaugaagauugcccucagagugcugcaccuggagaaacgcgagcggccucccgaucaccaacauuccgcucaggucaagagacccagcguguccaaagaaggccgcaagacgucuaucaagagccacauguccgggucuccgggccccggaggcagcaauaccgccccuuccacacccguuaucgggggaagcgacaaaccuggcauggaggaaaaggcucagcccccugaggccgggccccagggacuucaugaucucggcagaucuuccagcucucugcuggcguccccggggcacauuagcgugaaagaaccuacccccucuaucgccagcgacauuucccucccuaucgcuacacaagagcugcggcagcgccuuagacagcuggagaacggcaccacgcucggacagagcccccugggccaaauucagcugacaauccggcauucuucccagcgcaauaaacuuaucgucgugguucacgccugcagaaaccugauugcuuuuagcgaagauggguccgacccguacgugcggauguaucuccugccugauaaacgcagaucuggacggcgcaagacccacgucagcaagaaaacccucaaucccguguucgaccaauccuuugauuucucuguuagccugccugaggugcagagacggacacuugacgucgccgugaagaacuccggcggguuucugucuaaagauaagggacuccugggcaaagugcuggucgcccuugcuagcgaggagcuggcgaagggguggacccagugguacgaccucacagaagacggcacgagaccccaggccaugaccuga

SEQ ID NO: 68968 - RNA, 2661 nt, Artificial Sequence
  derived and/or modified sequence opt5 from ESYT3__Homo_sapiens__NP_114119
augagagccgaggaacccugcgcuccuggcgccccgagcgcgcugggggcucagcggacccccggaccugagcuccgccuguccucucaacuucugcccgaacucuguacauucguggucagaguucuguuuuaccuuggcccuguguaucuggccggguaccucggacugagcaucacguggcugcuccugggcgcccuucuguggaugugguggcggcgcaacagacgggggaagcucggacgccuggcugccgcuuucgaguuucuugacaaugaaagagaguucauuucccgggagcugcgcggccagcaccuccccgccuggauccauuuuccugauguggaaagagucgagugggcgaacaaaauuaucucucagaccuggccguaucugagcaugauuauggaauccaaguuccgggagaaacuggagcccaagauccgcgaaaaaucuauccaccucagaacauuuaccuucacaaagcuguacuuuggccagaagugcccucgggugaaugggguuaaagcccauaccaacacauguaaucgcagacgggugaccgucgaccuucaaauuugcuauaucggagauugugagauuagcguggaacugcagaagauccaggcuggcguuaacgggauucagcuccaaggaacgcugagagugauccuugagccccugcucgucgacaaaccuuucgugggcgccgugaccgucuuuuuccugcagaagccccaucugcagauuaauuggacagggcucaccaaccugcuugaugcuccgggaaucaaugacguuuccgauagccugcucgaagaccugaucgccacacaccuugugcugccuaaccgcgugaccguccccgugaaaaagggccucgaucugacgaaucugcgguuuccucuccccugcggcguuauuagagugcaucugcuugaggcggagcagcuggcccaaaaggacaacuuccucgggcugcgcggaaaaucugaucccuacgcuaaggucuccaucggccugcagcacuuccggagcagaacaauuuaucgcaaucuuaacccuaccuggaaugaaguguuugaguucaugguuuacgaagugccggggcaggaccucgaggucgaucuguacgacgaagacacagaucgggacgauuuucugggaucucuccaaaucugucugggcgacgugaugaccaacagagucguggaugagugguucguucuuaacgacaccacauccgggcgccugcaccuccggcuggaguggcugagccuucucacggaucaggaagugcugaccgaggaccacggaggccugucuacagccauucucgucguguuucuggaauccgcuugcaaucuucccagaaacccuuucgauuaucugaauggcgaguaccgcgccaaaaagcucagccgguuugccagaaacaaaguuuccaaggaccccucuagcuaugugaaacuguccgucgggaagaagacccauacaagcaaaaccuguccucacaauaaggaucccguguggucucagguguucuccuuuuucguucacaacgucgcuacggaacggcugcaucuuaaagugcucgacgacgaucaggagugcgcgcugggaaugcuggaggugccgcucugucaaauccugccuuacgccgaccuuacacuggaacagcgcuuucagcucgaucacagcggccuggacucucugaucagcaugagacuuguccuccgguuccuccagguggaggaaagagagcuggggucccccuauaccggaccugaggcucugaagaaaggcccccugcuuauuaagaagguugccaccaaucaagggccuaaagcccagccccaggaagagggcccgacagaucugccuugcccucccgaccccgcuucugauaccaaggacgugagccgcuccacaacgaccacaaccagcgccacaaccgucgcgacggaaccgaccucucaggagacaggacccgaaccuaaaggcaaggauuccgcuaaacgguuuugcgagcccaucggggagaaaaagagcccugccaccauuuuccucacagugcccggaccucauucucccggcccgaucaaauccccuagacccaugaaguguccugccagccccuucgcuuggccgccuaaacgccuggcccccuccaugucuagccugaacucccuugcuucuagcugcuuugaccuggccgauauuucccucaauaucgaagggggagaccugagacggcgccaacucggcgagauccagcugaccguuagauacgugugucuucggcgcugccugagcguccucauuaacggguguagaaaucugacgccuugcacaucuuccggcgcggaucccuaugugcggguuuaccugcuucccgaacgcaagugggccuguagaaagaagaccagcgugaagcggaaaacacuggagccucucuucgacgaaaccuuugaguucuuugucccgauggaggaagugaagaaacgcucucuggacguggcugucaagaacuccagaccccucggaagccaccggagaaaagagcugggcaagguucuuaucgaucugucuaaagaagaccucauuaagggguucagccagugguacgagcugaccccuaauggacagccccgcuccuga

SEQ ID NO: 68969 - RNA, 2781 nt, Artificial Sequence
  derived and/or modified sequence opt5 from ETAA1__Homo_sapiens__NP_061875
augagcagacggcgcaagcacgacgauucccccucuccuaaaaagaccccgcauaaaacaguggccgcugaggaaugcggcagcgucguugagcccgggagacggcgccugagauccgcccggggaucuuggccuuguggcgcgcgcgaagggcccccuggacccgugagacagcgggagcaaccuccgacggcugcccucugcagcaaguccaaccccgaggaacgcuacgagaccccuaaaagagcccugaagauggacucucuuagcuccagcuucucuucccccaaugauccugacggccagaacgauaucuuuugggaccagaauagcccccugacaaagcagcucgggaaaggacggaagaaacaaauuuauaccacagauucugacgaaaucucccacauugugaaccgcaucgcuccgcaggaugagaagccuaccacaaauagcaugcuggacauguggauuggcgaaaccgccauccccuguacgccuucugucgcuaaaggcaaguccagagccaagaucagcugcaccaaacuuaagacacagucccaggaggaggaacugaugaaacucgcgaagcaauucgauaaaaacauggaggaacuggacgugauucaggagcagaauaagcggaacuacgauuuuacccagaugaucucugaaacagagauucugagcaauuauaaagacaacauccaaauguggucccuccauaauauuguucccgagaucgacaacgccaccaagaagcccauuaaagggaauacgaagaucagcguggcuaacaaucagaacucuucccagaaaccuuucgaucaaaucgccgaagcugccuuuaacgcgauuuucgacggaagcacacagaaguguucuggccagcugagccaggagcuuccggaagccuuuugguccaccucuaauacaaccuucgucaaaaccaacgcucugaaggaggaaaagaucauuacaaaugagacgcucgugaucgagaaacugagcaacaagacaccccgcucccuuagcucucaaguugauaccccuauuaugaccaaauccugcgugacaagcuguaccaaggaacccgagacgucuaauaaauacaucgacgccuuuacaaccuccgauuucgaagacgauugggagaaccugcucgggagcgaaccuuuugcuaugcagaauaucgacaugcccgagcuguucccguccaagaccgcccacgucacagaucagaaggagauuugcaccuuuaacucuaaaacagugaagaauacgagcagagccaacaccuccccugacgcucggcugggagauucuaaagugcuccaggaccugagcuccaagacauaugacagagaacuuaucgaugcggaguaccgcuucagccccaauucuaacaaauccaauaagcugagcaccggcaacaagaugaaauucgaaaauucuuccaacaagauugucauccaagacgagauucagaacuguaucguuacaagcaaucucaccaaaaucaaggaggauauucugacgaacucuaccgaagccagcgagcggaaauccgcucuuaauacaagauauagcaacgaacagaagaauaaaugcauccugaaccagucuauuaaggccccugugaauaccgaccucuuuggguccgccaaccugggaagcaagacauccgugucuaaucccaaccaaaccagcgcuuccaaagucggcucuuucuuugaugacuggaaugauccuagcuucgccaacgagaucauuaaggcgugucaucagcuggacaauacgugggaagcugaugacguggaugacgaucuccuguaccaggccugcgacgacaucgagcgccuuacacagcaacaggauauucggaaagacuccaagaccucugagagcaucugcgaaaucaacaauaacuccgagcacggcgccaaacugacacagcaacaggauauuagaaaggacagcaagaccucugaauccaucugugagauuaacaauaacagcgaacacggggcuaaaaauauguuugccaucucuaagcagggauccaaccucguucagagcaaacaucugaaucccggcucuauuuccgugcaaaccagccuuacaaacuccagccagaucgauaagccgaugaaaauggagaagggggagauguacggaaauucuccucgcuuccugggcgcuacgaaccucaccauguauagcaagaucuccaauugccagauuaacaaucugcacgucucuuacacaaacaccgacgugcccauccagguuaauagcuccaaacuggugcuccccgggucuagcucccugaacgucacaucugaucauaugaauaccgaaauuacgacauauaagaaaaagcugagcaccaaccaaccuugucacaaaaccgugacagacgaggcccaguccaaccuuaauaccacagucggauuuagcaaguucacguuuacccggaugaagaacucucagauccucucccaguucaaucaaaacugcauuacaggcagcaugucugauaccaaaaucacacagggcguggaaaagaaaaaggggguuaauccgcugcuggaggaagcggugggacagcaaucccuugucaaacucagcgagucccugaagcagucuagcaaagaggaagaggaaaagaacagaaaguguucccccgaggagauccagcgcaaacggcaggaagcccuggugagacgcauggcuaaggcccgggcuagcucuguuaaugccgcgccuaccuccuuucucuga

SEQ ID NO: 68970 - RNA, 1272 nt, Artificial Sequence
  derived and/or modified sequence opt5 from ETF1__Homo_sapiens__NP_001269114
augaagcaggacgugcugaacugcaccgagggccccauccacagcaaugggacauccaugauuucucucaucauuccuccgaaagaucaaaucagcagagucgccaagaugcuggcugacgaguucggaacggccuccaacauuaaaucucggguuaaucgccuuagcgugcugggcgcgaucaccuccgugcagcagagacucaagcuguacaacaaagugcccccuaaugggcuugucguuuauuguggaacaaucgugaccgaagaaggcaaggagaagaaagucaacauugauuuugaacccuucaagccuaucaauacaucucuguaccucugcgacaacaaauuucauaccgaggcucugacagcccugcucagcgaugacuccaaguucggguuuauugugaucgauggaagcggcgcccuguucggcacccuucaggggaauacgcgggagguucugcacaaauuuaccguggaccuccccaagaagcauggacgcggcgggcaaucugcucugagauucgcccggcuucgcauggaaaagagacacaacuauguccggaagguggcugagacagccgugcagcuguuuauuuccggagauaaagucaauguugcgggccucgugcuggccgggagcgcugacuucaagaccgaacugucucaguccgauauguuugaccagcgccuccaaagcaaagugcugaaacuugucgauaucucuuacggaggcgagaacggcuucaaucaggccauugagcuguccacagaagugcucagcaacguuaaauuuauccaggagaagaagcugaucgggagauauuucgacgaaauuucccaggacaccggaaaauacuguuucggcguggaggauacgcuuaaggcucuggaaaugggggccgucgagauccucauuguguaugagaaucuggacaucaugcgguacguucugcauugccaaggaacagaagaggagaaaauucucuaccugaccccugaacaggaaaaggauaaaucucacuuuacagacaaggagaccggccaggagcacgaacuuaucgagagcaugccgcugcucgaaugguucgcgaacaacuauaagaaauuuggggccacccuggagaucgugacagauaagucccaagaaggaagccaguucgucaaaggcuuuggcgggauuggaggcauccuucgcuacagaguggacuuccaggggauggaguaucagggaggcgaugacgaguuuuucgaucuggacgauuacuga

SEQ ID NO: 68971 - RNA, 1002 nt, Artificial Sequence
  derived and/or modified sequence opt5 from ETFA__Homo_sapiens__NP_000117
auguucagagccgcugcccccggccagcugcggcgcgcggcuagccuccugagauuucaauccacccuugugaucgccgagcacgccaacgacucucuggcuccuauuacacucaauacgaucaccgccgcuacacggcuugggggagaagucagcugccugguugccggcaccaagugugauaaaguggcgcaggaccugugcaagguggccgggauugcuaaaguccucguggcccagcaugauguuuacaagggacugcugccggaggaacucacaccccugauccuugcuacccagaaacaauucaacuauacacacauuugugccggcgcguccgccuuugggaagaaucugcucccucgcguggcugccaagcuggaggucgcucccaucucugacaucauugccaucaaaagcccugauaccuucgugagaacgauuuacgccggaaacgcucuuugcaccguuaagugugacgaaaaagugaaggucuuuuccgugcggggcacaucuuucgaugcggccgcuaccagcggcggguccgccagcucugagaaagccuccagcacaucucccguggagaucuccgaauggcuggaccagaagcucaccaagagcgaucgcccugagcugacgggagcuaaagucguugugucuggcgggagaggacugaaguccggcgaaaauuuuaaacuccuguaugaccuugccgaucagcugcaugcggcugugggggccagccgggccgcugucgacgccggauucgugccgaacgauaugcagguuggccaaacaggcaagauuguggcucccgagcucuacaucgccgucgggauuuccggagcgauccagcaccuggccggcaugaaagacucuaagaccaucguggcuauuaauaaagacccugaggcccccaucuuucagguugcugauuaugggauuguggccgaccuuuucaaggucgugccugaaaugacagagauccugaagaaaaaguga

SEQ ID NO: 68972 - RNA, 1041 nt, Artificial Sequence
  derived and/or modified sequence opt5 from ETFB__Homo_sapiens__NP_001014763
auguaccugagccucugggugaccaucaacacagucaaucugagaaacacgcuuuccggccugcgcggggccguuaccacagugggaaugauuaagucugacgugcccggcacccaggaguggcucgaugaacggagacggcaaggggaccugccucuuccgacaaauagcaaccccguccugucccucgagcugugcgauccuggacagggccccgcuccuuuccaggccgugguugugcugauccagcccgggcgcggacucgcgcugagaccuccgcccucuugucuuuuuccucccgacccuacccccagcccgccugcuggccaaauucgggucaaacccgaucgcacaggcgugguuaccgacggggugaagcacuccaugaauccuuucugcgaaaucgccgucgaggaagccgugagacugaaagagaagaaacucgugaaggaggucauugcuguuucuuguggacccgcccagugccaggaaacgauccggaccgcucuggccaugggcgcggaucgcgggauccauguggaggugcccccugccgaagcugagagacuuggaccgcugcaggucgcccgggugcucgcuaagcuggccgagaaagaaaagguugaccuggugcuccugggcaaacaagcgauugaugacgauuguaaccagacagggcagaugaccgccggauuucuugacuggccccagggcacauucgcuagccaagucacccuggagggcgauaagcucaaaguggaacgcgagaucgacgggggacuggaaacgcuuagacugaagcucccugccguugugacagcugaccugcggcugaaugagccccgcuaugccacccucccuaacauuaugaaggccaaaaagaaaaagaucgaggucauuaaacccggcgaucuggggguggaccuuacauccaagcugagcgucaucucuguggaagauccgccucagagaaccgcuggaguuaaaguggagaccacagaagaccucgucgcgaagcugaaggagauuggccggaucuga

SEQ ID NO: 68973 - RNA, 1713 nt, Artificial Sequence
  derived and/or modified sequence opt5 from ETFDH__Homo_sapiens__NP_001268666
augcuggugccccucgccaagcugagcugccuuggcgucaacauggagagauucgcugaagaggccgacguugugaucgugggggcgggaccugcuggccuguccgccgccguccggcucaaacagcuggcuguggcccacgaaaaggauauucgcguuugucuuguggagaaagcugcccaaaucggggcgcauacccugucuggagccugccucgacccgggcgcuuuuaaggaacuguuccccgauuggaaagagaagggggccccucugaauacacccgucacggaggacagauuuggcauucucaccgaaaaguaccggaucccugugcccauucugccuggacuuccgaugaacaaucacggcaacuauaucguucgccuggggcaucucgugagcuggaugggagagcaggcugaagcccugggcgucgagguguaccccggguaugcggccgcugaggugcuuuuccacgaugacggauccgucaaaggcaucgccacaaaugauguugggauucagaaggacggagcuccuaaagccaccuuugaaagaggccuggagcuccaugccaaggugacaaucuucgcugaaggcugucacgggcaccuggcgaaacagcuguacaagaaguuugaucuccgggccaacugcgagccccaaaccuauggaauuggccugaaagaacuuugggugaucgacgagaagaauuggaaaccugggcgcgucgaucauacagugggauggccccuggacagacacaccuacggcgggucuuuccucuaucaucugaacgagggagaaccgcuuguugcucugggccucguggucggccuggauuaccagaauccuuaccugagccccuuucgggaguuccagcgcuggaagcaccacccuuccauuagacccacgcucgaagggggaaaacggaucgccuauggcgcccgcgcucugaacgaagggggauuucagucuauucccaaacuuaccuucccuggcgggcugcucaucggcuguagcccgggauuuaugaaugugcccaagaucaagggcacacauaccgccaugaaguccgggauucuggcggcugaaagcaucuucaaccaacuuacaucugagaaucugcaguccaaaaccauuggacuccacguuacggaguacgaagacaaccugaagaauagcuggguguggaaagagcuguauucugucagaaacauccggccuuccugccauggcgugcucggggucuacggaggcaugauuuauacagggaucuucuacuggauccugcgcggcauggaacccuggacccuuaagcacaaaggaagcgacuuugagagacugaagccugccaaggauuguacacccauugaauauccgaaaccugacggccagaucucuuucgaucuccuguccagcguggcccuguccgggaccaaccaugagcacgaccagcccgcucaccuuacccuccgggaugacucuauuccuguuaauagaaaccugagcaucuacgauggacccgagcaacgcuuuugcccugccggcguguacgaguucguccccguggagcagggggacggauuucggcugcagauuaaugcucaaaacuguguucauugcaagacaugugauaucaaagacccgucccagaauaucaacuggguggucccugaaggcgggggcggacccgccuauaauggcauguga

SEQ ID NO: 68974 - RNA, 765 nt, Artificial Sequence
  derived and/or modified sequence opt5 from ETHE1__Homo_sapiens__NP_055112
auggccgaggcugugcugagagucgcccggcgccagcucagccaaagaggcggguccggagcgcccauccugcuucggcagauguucgaaccuguuucuugcaccuuuacauaccugcucggcgaccgcgagagcagagaagcugugcugauugauccggugcuugagacggcuccccgggacgcccagcugaucaaggaacucgggcugcgccugcucuaugccgucaacacccacugucaugccgaucacauuacaggauccggccugcuuagaucucugcucccugggugccagagcgugaucucccggcugucuggagcucaagccgaccuucauauugaggauggcgacagcauccgcuucggcagauuugcgcuggagacccgggccucccccgggcacacaccuggauguguuaccuucgugcucaaugaucauagcauggcuuuuacaggcgacgcccugcugauccgcgggugcggaagaaccgauuuccagcagggcugugcuaaaacgcucuaccacucuguccacgaaaagauuuuuacccugcccggggacugccuuaucuauccugcccaugauuaccacggauucacaguguccaccguugaggaggaacggacacugaacccgcgccucacccugagcugugaggaauuugugaaaauuaugggcaaucuuaaccugcccaagccucagcaaaucgacuucgcgguccccgccaauaugagaugcggcgugcagacgccuacagcuuga

SEQ ID NO: 68975 - RNA, 777 nt, Artificial Sequence
  derived and/or modified sequence opt5 from ETNK1__Homo_sapiens__NP_001034570
augcugugcggcagaccccggagcuccucugacaaccgcaauuuccucagagagcgggccgggcugagcuccgcugccgugcagacccgcaucggaaacucugcggcuagcagacgguccccugccgcccgcccgcccgucccugcucccccugcccuucccagaggccggccugggacagaaggaucuacgagccuguccgcuccggccguucucgugguggcggucgccgugguuguggucgugguuagcgcuguggccugggcuauggccaauuacauucacgugcccccuggcucucccgaggucccuaagcugaacgugaccguccaagaucaggaggaacaucgcuguagagaaggggcgcuuucccugcuccagcaucugcggccccacugggacccgcaggagguuacacugcaacucuuuaccgauggaaucacaaauaaacugauuggcugcuaugugggcaacaccauggaggacgugguccuugugcgcaucuacgggaauaagacagaacugcucguugauagagacgaggaagugaaaucuuuccggguccugcaggcccacggaugugcuccucagcuuuauugcaccuuuaacaauggccuguguuacgaguucauucagggggaggcccucgaucccaagcaugugugcaacccugcuaucuuuagccuguccagccugacgcucuguaaaggaaagaccacacgcugcuucggccugaccggguguagaggaucucggcuucugcucuccuuuuucuga

SEQ ID NO: 68976 - RNA, 1185 nt, Artificial Sequence
  derived and/or modified sequence opt5 from ETNK2__Homo_sapiens__NP_001284689
auggccgugcccccuagcgcuccgcagcccagagccuccuuccaucugcggcgccacaccccuugcccccaauguucuuggggcauggaggaaaaggcggcugccagcgccuccugcagagagccucccgggccuccgcgggcugccgcugucgccuacuuuggaaucucuguugaccccgaugacauucucccuggcgcgcugcgccuuauccaggaacugagaccccacuggaaaccugagcagguucggacaaagcgcuucacggaugggauuaccaacaaacucguggccuguuaugucgaagaggacaugcaggauugcgugcugguuagaguguacggagagcggacagaacuucuggucgaccgcgagaaugaagugagaaacuuucaacuccugcgggcucauagcugugcccccaagcuguauugcaccuuccagaauggccucuguuacgaguauaugcaggggguugcucuggagccggaacacauccgcgagccuagacuuuuucggcugauugcccucgaaauggcgaaaauccauacaauccacgccaacggaucccugcccaagccuauucuuuggcacaagaugcauaauuacuucacccuggugaaaaacgagaucaaucccucucucagcgcugauguccccaagguggaagugcuggagcgcgagcuggccuggcucaaagaacaccugucccagcuugagagcccugucguguuuugccauaacgaccugcucuguaagaauauuaucuaugauucuauuaaaggccacgugagauucaucgacuacgaauacgcuggcuauaacuaccaagccuuugauauugggaaucacuucaacgaguuugccggagugaaugaagucgacuauugccuguacccggcucgggagacacagcuucaguggcugcauuauuaccuccaggcgcaaaagggcauggccgugacccccagagagguucagcgccuguaugugcaggucaacaaguucgcucuggggccuuccugugugagcucuacgaugaccgccucccuccaaugcugccggguuggaaauagacacggcgaaaucgcccgccugacacuuagcgggcuguuucccggagugucucuccugcuuggcucccugggcccucaucccgagccgguccuccaccaucggcuguga

SEQ ID NO: 68977 - RNA, 1482 nt, Artificial Sequence
  derived and/or modified sequence opt5 from ETNPPL__Homo_sapiens__NP_001140062
augugcgagcuguacagcaagagagacacccucggccugcggaaaaagcacaucgggcccuccuguaaaguguucuuugccucugauccuauuaagaucguccgcgcucagagacaauauauguucgacgaaaacggagagcaguaccuugauugcauuaauaacguugcccauggcguggugaaagcggcucugaagcagauggaacuccugaauacaaacagccgguuucuucacgacaauaucgucgaguaugccaagcgccuguccgccacgcucccggaaaaacugucuguguguuacuucaccaacagcggguccgaggcuaaugaucuggcccucagacuggcucggcaguuucgcggacaucaagacguuauuacacuugaucacgccuaucauggccaccugucuagccucaucgagaucucccccuacaaguuccagaaagggaaggacgugaaaaaggaauuuguccacguggcgccuacccccgauacauauagaggaaaguaccgggaggaccaugccgauagcgcuucugccuacgcugacgaaguuaaaaagauuaucgaggaugcccacaacuccggccgcaaaauugcggccuucaucgcugagagcaugcagucuugcggcgggcagauuaucccucccgccggauauuuucaaaagguggcugaauacguccauggcgccgggggaguguucauugccgacgaggugcaggucggcuuugggagaguuggaaaacacuucugguccuuucagauguauggcgaagacuucgugccugauaucgugaccaugggcaagccgauggggaauggacaccccgucgcuugugugguuacaaccaaagagaucgcggaagccuucucuagcuccggcauggaguacuuuaacacguaugggggaaauccugugagcugcgcugucggccuggccgugcuugacauuaucgagaacgaagaucugcaggggaaugccaagcggguuggaaacuaccucaccgagcugcugaagaaacaaaaggcuaaacauacacucauuggcgacauccgcggcauugggcuguucaucggaaucgaucuugugaaggaccaccugaaaagaacccccgccacagcggaagcucagcauauuaucuauaagaugaaggagaaacggguccuccuguccgccgauggcccucaccgcaaugugcuuaagauuaaacccccgauguguuuuaccgaagaggacgccaaguucauggucgaucagcuggacagaauccucacggugcuggaggaagcuauggggacaaaaaccgagucuguuacaagcgaaaacaccccuugcaagaccaagaugcugaaagaggcccauauugaacuccugcgggauuccacaacggacagcaaggagaaccccucuagaaaacgcaauggaauguguaccgacacacacucccuucugagcaagcggcucaaaaccuga

SEQ ID NO: 68978 - RNA, 1458 nt, Artificial Sequence
  derived and/or modified sequence opt5 from ETS1__Homo_sapiens__NP_001137292
augagcuacuucguggacuccgccggcucuagccccgucccuuauuccgcuccgagacccgccguugugcggcaggggccuucuaacaccuacgaggauccccgcaugaauugcggauuucaaagcaacuaucaccagcagagaccuuguuaccccuucugggacgaaauggcgacacaggaggugccuacgggccuggaacauugcgucuccgauauggagugugcugacgugccgcuccugacccccucuagcaaggaaaugaugucccaagcccuuaaagccacauuuagcggguucaccaaggagcagcagcggcugggaaucccuaaagauccccgccaguggacagagacccacguuagagacugggugaugugggcugucaaugaauuuucucucaagggcguggauuuccaaaaauuuugcaugaacggggccgcucugugugcccuuggaaaggacugcuuccuggagcucgcgccugauuuuguuggcgacauucugugggaacaucuggagauccuccagaaggaggaugugaaacccuaucaggucaauggcgugaacccggccuacccugaaucccgguauacaagcgacuacuucauuucuuacgggaucgagcacgcucagugugugcccccuuccgaauuuagcgagcccucuuucauuaccgaauccuaucaaacgcugcaucccaucagcuccgaggagcuucugucucucaaguacgaaaaugauuauccuagcgucauccugcgcgacccgcuucagaccgacacacugcagaacgauuacuuugccauuaaacaagagguugugacccccgacaauaugugcaugggaagaacaucccggggcaagcucgggggacaggauagcuucgaaucuaucgaguccuaugacagcugugaucgccugacccagucuuggagcucccagucuagcuucaacucccugcaaagagugccuagcuacgacucuuuugauuccgaagacuaucccgcugcccucccuaaucacaaacccaagggcacguucaaggauuacguccgggaccgcgcggaucugaacaaagacaagccggugauuccugccgcugcccuugcuggguacacaggaagcggccccauccagcuguggcaguuucuccuggagcuucugaccgacaaaucuugccaguccuucauuagcuggacaggcgaugggugggaguuuaagcucuccgacccugaugaaguugccagacgguggggaaaacgcaagaauaaacccaagaugaacuaugagaagcugucuagaggccugcgguacuauuacgacaaaaauaucauucacaagaccgccgggaaaagauauguguaccgcuucgucugugaucuccaaagccugcuuggauauaccccugaggaacugcaugcuaugcucgacgugaagcccgaugcggacgaauga

SEQ ID NO: 68979 - RNA, 1830 nt, Artificial Sequence
  derived and/or modified sequence opt5 from ETS2__Homo_sapiens__NP_001243224
augggcagcgcccaguuccaagggcugaucacccaggcuagacuccccuuuggagccacauccacgaccgcgccuucucugcggaacagcaagggccgcuucggggugagagcucuugccccggagcggacacccuccgccccucgcaaagucucugcuagacugcccggacggacccucgcccgcacauggggcagagggccugcucccggagccagcggcccugcgggcgaagggccgucccggguuaccgccggaggcgggggaaagcugcgcgcucccggcgccgcuagaccugccucugggcuucccgaccggcuguggccugcgcccagcccguccccuggagcccaccgcgcugccgcuggcgccgagcagcccccuagcagacccucugccggccccgcucgguccgggcgcaugaaugauuuuggaauuaaaaacauggaccagguggcgccuguggccaauagcuacagaggcacacucaagcggcaaccggcuuucgauaccuuugacgggucucuguucgccgucuuucccucccugaacgaagaacagacgcuccaggaagugccuaccggacuggauagcaucucucaugacuccgccaauugcgagcuuccccugcucacaccuuguagcaaagcuguuaugucccaggcccugaaggcgaccuucucuggcuuuaagaaagagcaaagacgccuugggauucccaagaacccguggcuguggagcgaacaacaggugugccaguggcuccugugggcuacaaaugaguucucccuggucaacgugaaucuccaacgguuuggaaugaacggccagaugcuguguaaucuuggcaaagaaagauuccuggagcucgccccugauuuuguuggggacauccugugggagcaccuugaacagaugauuaaggagaaccaagaaaagaccgaggaucaguaugaagagaauagccaucugacgucugugccccacuggaucaacuccaauacacucggauucggcaccgagcaggccccuuacgggaugcagacacaaaacuaucccaagggaggccugcuggacagcaugugcccugcuucuacccccagcguccucuccucugaacaggaguuccagauguuuccuaagagccgccuguccagcgugucugugaccuacuguuccgucagccaggauuucccggggucuaaccuuaaucugcucacaaacaauuccggcacgcccaaagaccaugauagccccgaaaacggagccgacuccuuugagucuagcgacucccugcuucaaucuuggaauagccaguccagccugcucgauguucagcgggugccuucuuucgaauccuuugaggacgauugcagccagucucugugucugaacaagccgaccauguccuucaaagacuauauccaagagagaagcgaucccguggaacagggcaagccugucauucccgcugccgugcucgcgggguuuacaggaucuggcccuauccagcuguggcaguuccuucuggagcuccugagcgacaaauccugccagagcuuuauuucuuggaccggggauggaugggaguucaagcuggccgaccccgaugagguugcucgccgguggggcaaaagaaagaauaagccuaaaaugaacuacgaaaaacuuucccgcgggcuccgguauuacuacgacaaaaauaucauucacaagacaagcggcaaaagauauguguaccgcuuugucugugaucugcagaaccugcucggauucacccccgaggagcugcacgccauccuuggcgugcagccggacacggaagacuga

SEQ ID NO: 68980 - RNA, 1365 nt, Artificial Sequence
  derived and/or modified sequence opt5 from ETV1__Homo_sapiens__NP_001156619
auggacggcuucuacgaucagcaagugcccuauauggucaccaacagccagagagggcggaauugcaacgagaagccuacaaauguucgcaaaagaaaguuuaucaaccgggaccuggcccacgauuccgaagaacucuuccaggaccugucucagcuucaagagacguggcuggcugaggcccaggugccggauaaugacgaacaguuugugcccgauuaccaggcggagagccucgcuuuccauggacugccucuuaaaauuaagaaagagccccacuccccuuguucugaaaucagcuccgccugcucucaagagcagcccuuuaaguucagcuauggcgaaaagugucuguacaacgucuccgccuaugaccagaaaccucagguggggaugcgcccgagcaaucccccuacccccucuuccacaccuguuagcccccuccaucacgcuucuccgaacuccacccauacaccuaagcccgauagagccuuuccugcucaucugccucccagccaaucuauucccgacuccagcuacccgauggaucaccgguuccgcagacagcuguccgagcccugcaauucuuuuccuccccucccuaccaugccccgggagggacgcccgauguaucagagacaaaugagcgaaccuaacauccccuucccuccccagggcuuuaaacaggaguaccacgacccuguguacgaacacaauacaauggucggguccgccgcgagccagucuuuucccccgccucugaugauuaagcaagagccccgggauuucgccuaugacuccggauguauguucgaaaaaggcccccgccaguucuacgacgauaccugcgugguuccugagaaguuugacggcgauaucaagcaggagccggggauguauagagaaggacccacguaccagcggcgcggcagccuucaacuguggcaguuccucguggcucugcuugacgauccuucuaacagccauuuuaucgccuggaccgggagaggaauggaguucaaacugauugaacccgaggaagucgcucggagauggggcauccagaagaaucgcccugccaugaacuaugacaaacucucccggucucugagauacuauuacgagaaggggauuaugcagaaaguggcgggagagcgcuacguguauaaguuugucugugaucccgaagcccuguucagcauggcuuuuccugacaaucaacggccccuccugaaaacagauauggagagacacaucaacgaagaggacaccguuccgcuuucccacuucgaugaaagcauggccuacaugccugagggcggcugcuguaacccccauccuuauaaugagggguacguguauuga

SEQ ID NO: 68981 - RNA, 432 nt, Artificial Sequence
  derived and/or modified sequence opt5 from ETV3__Homo_sapiens__NP_005231
augaaggccggcugcagcaucguggagaaacccgaagggggaggcggguaccaguucccugacugggcuuauaagaccgaguccucuccgggaagcagacaaauucagcuguggcacuuuauccucgaacugcuucagaaagaggaguuccggcaugucauugccuggcagcaaggcgaauacggggaguuuguuaucaaggaucccgacgaaguggcgcgccuguggggaagacggaaauguaagccucagaugaacuaugauaagcucucccgcgcucugagauacuauuacaauaaacggauucuucacaagacaaaaggcaagcgcuucacguauaaauuuaacuucaauaagcuggugaugcccaacuacccuuuuaucaauaucagaucuagcggcaagauucagacccuccuggucgggaacuga

SEQ ID NO: 68982 - RNA, 1455 nt, Artificial Sequence
  derived and/or modified sequence opt5 from ETV4__Homo_sapiens__NP_001073143
auggagagacggaugaaggccggcuaccuggaccagcaagugcccuauaccuucagcuccaaaucuccugggaacggaagccuccgcgaagcucugaucggcccgcuugggaagcugauggaucccggaucccucccuccccuggacucugaggaucuuuuucaggaccugagccacuuccaggaaacauggcucgccgaggcgcaggucccugauuccgacgaacaauuuguucccgauuuccauucugagaaucuggcuuuucacagcccuacgaccagaauuaaaaaggagccgcagagcccccggacagacccugcccuguccugcucucgcaaacccccucuccccuaccaucacggcgaacagugucuguauuccagcgccuacgauccgccuagacagaucgcuauuaagucucccgccccuggggcucuuggacaaagcccccugcagcccuucccucgggccgagcagcgcaacuuucucagauccucuggcaccucccagccgcaucccggccacggguaucugggagaacacagcuccguguuccaacagccucuugacaucugccauucuuuuacaagccagggcgggggacgggagccccugccugcgcccuaccaacaccagcucuccgagccguguccucccuauccucagcagagcuucaagcaagaauaccaugauccccuguacgagcaggccggccagccugcuguggaccaagggggagucaauggccaccgcuaucccggcgccggggugguuauuaaacaggaacagaccgauuuugcuuacgacucugacgugacaggaugcgccuccauguaucugcacaccgagggcuucagcgggccgucuccuggagauggcgcgaugggguacggauaugaaaagccccucagacccuuuccugacgaugucugugugguuccggagaaauucgagggcgacaucaagcaggaaggcgugggggccuuccgggagggacccccuuaccagcgcagaggcgcucugcaacuuuggcaguuucuggucgcccuccuggaugaccccacgaacgcucauuucaucgccuggaccgggcggggaauggaauuuaaacuuauugagccugaagagguggcccgccuguggggcauccagaagaauagacccgcuaugaacuaugauaagcucagccggucccugagauacuacuaugagaaagggauuaugcagaagguggcgggcgaacgcuacgucuauaaauucguuugcgagccugaagcccuguuuucucucgcuuuccccgacaaucaacggccggcccugaaggccgaguuugauagaccugugagcgaagaggacacagugccccuuucccaccuggaugagagcccugcuuaccuccccgaacuggccggaccggcgcagccuuucggccccaaagggggauauucuuacuga

SEQ ID NO: 68983 - RNA, 1533 nt, Artificial Sequence
  derived and/or modified sequence opt5 from ETV5__Homo_sapiens__NP_004445
auggacggcuucuacgaucagcaagugcccuuuauggucccuggcaagagcagauccgaggaaugccggggacgcccgguuaucgacagaaaacggaaguuccuggauaccgaccucgcccacgauucugaggaacuguuucaggaccuuagccagcugcaggaggcuuggcucgccgaagcgcaagugcccgaugacgagcaguucgugccugauuuucaguccgacaaccugguccuucaugcucccccucccacaaaaauuaagcgcgagcugcacucuccuagcuccgaacucucuagcuguucccaugagcaggcccugggcgccaauuauggggaaaaaugccuguacaacuauugugcuuacgauagaaagccgcccagcggauucaagccucucacgcccccuaccacaccccugucuccgacccaccaaaauccucuuuuucccccuccccaggccacacugcccaccuccggccaugcuccugccgcggggccggugcagggaguuggccccgccccugcuccccacagccucccugagcccggcccgcagcaacagacauucgccgugccucggcccccucaccagccccugcaaaugccuaaaaugaugcccgagaaccaguauccgucugaacagcgcuuucagagacaacuuuccgagccuugccaucccuuucccccucagccggggguccccggagacaaucggccuagcuaccaccgccagaugucugaacccaucgugccugcugcgcccccucccccgcagggcuucaagcaagaguaucaugauccucuguacgaacacgggguucccggaaugccugggcccccggcccacggguuccaguccccuaugggaauuaaacaggagcccagagacuacuguguggacagcgaggucccuaacugccaguccucuuauaugcggggcggcuacuuuagcuccagccaugaaggguucucuuaugagaaggauccccgccucuacuucgacgauaccuguguggugcccgaaagacuggagggaaaagucaagcaagaaccuacgauguaucgggagggcccgcccuaccagcgcagagggucccugcagcucuggcaguuucugguuacccuucuggacgauccugccaaugcucacuucaucgccuggacaggacggggcauggaguuuaagcucauugaacccgaggaaguggcuagacgcugggggauccagaaaaaccggccugccaugaauuaugacaagcugagcagaucucuucgcuacuacuaugagaaaggaaucaugcaaaagguggccggcgaacgguacgucuauaaauucgugugcgaucccgacgcucuguuuagcauggcguucccugauaaccagagaccguuucucaaggccgaguccgagugucaucugucugaagaggacacccugccccucacacacuucgaagauagcccugcuuaccugcuugacauggaccgcugcuccagccugcccuaugccgagggcuuugccuacuga

SEQ ID NO: 68984 - RNA, 1359 nt, Artificial Sequence
  derived and/or modified sequence opt5 from ETV6__Homo_sapiens__NP_001978
augagcgagacccccgcccagugcuccaucaagcaagaaagaauuucuuacacaccuccggagagccccgugccuuccuaugcuucuagcacgccccugcacgucccuguuccccgggcccuccgcauggaagaggacuccaucagacugccugcgcaucuucggcugcagccgauuuacuggucucgcgaugacguggcucaguggcucaaaugggccgaaaacgaguucagccugagacccaucgauuccaauaccuuugagaugaacggcaaggcccuucugcuccugacaaaagaagacuuccgguaucgcagcccucacucuggggaugugcuguacgagcuccugcagcauauucuuaagcaaagaaaaccccggauccuguuuuccccuuucuuucaccccggaaauagcauccauacccagccggaagucauucuccaccagaaccacgaggaggacaauugugugcagcgcacaccuagacccucuguugauaacgugcaucacaauccucccaccaucgaacugcuucaucggucccgcagccccauuacaaccaaccacagaccuucuccggaccccgagcaacggccucugcgcagcccccucgauaauaugaucagacggcuguccccugcugaaagagcccagggcccccgcccgcaccaggagaacaaucaucaggaauccuauccucugucugucagccccauggagaacaaucacugcccugcuuccagcgagucucaucccaagccuuccagcccccggcaagaaucuacgagagugauucagcucaugccgagcccuaucaugcacccccugauucuuaacccccgccauuccguugacuucaagcagucucggcugagcgaggaugggcuccacagagaaggaaaaccuaucaaucugucccaccgcgaggaccuugccuacaugaaccauaucauggugagcgucucuccgcccgaagaacacgcgaugccuauuggccggaucgccgauuguagacugcucugggacuauguguaccaacugcuguccgacagccgcuacgagaacuuuauucggugggaagauaaggagucuaaaaucuucagaauuguggaccccaaugggcucgcucgccuguggggaaaccauaagaaucggaccaacaugacauaugagaaaauguccagagcccuucggcacuacuauaagcugaauaucauccgcaaggagccuggccagagacuccuguuucgguucaugaaaacccccgaugaaauuaugagcggcagaacagaccgccuugagcaccuggagucccaggaacucgaugagcagaucuaccaagaagacgagugcuga

SEQ ID NO: 68985 - RNA, 954 nt, Artificial Sequence
  derived and/or modified sequence opt5 from ETV7__Homo_sapiens__NP_001193964
augcaggagggcgaacuggccaucagccccauuuccccuguggcugccaugccgccccucgggacccacguccaagcgagaugcgaggcucagaucaaccugcuuggagaaggcgggauuuguaagcugccuggacggcuccgcauccagcccgcccuguggucuagagaggacguucuucauuggcugcggugggccgaacaggaguacagccucccuugcacagcugagcacggcuucgaaaugaaugggcgcgcccuguguauucugacgaaagaugacuuuagacaucgggcucccuccucuggagaugugcucuaugagcugcuucaauacaucaagacccagcgcagagcccuggugugcggcccuuucuuuggcgggaucuuccggcucaaaacaccgacccagcacagccccgucccucccgaagaggugacaggaccuucccagauggacacccgcagaggccaucugcuucaacccccggauccugggcugacaucuaacuuuggacaccucgacgaucccggccuggcgcgguggaccccugggaaggaggaaagccugaaucucugucacugcgccgagcugggaugucgcacgcagggcguuugcuccuuccccgcuaugccccaggccccuauugacggcagaaucgcugauugucggcuucugugggacuauguguaccagcuccugcuugauacccgcuaugaaccguacauuaaaugggaggacaaggaugccaagaucuuuagagucguggaccccaacgggcuggcgcggcucuggggaaaucauaaaaacagaguuaauaugacauaugaaaagaugagccgcgcccugcggcacuacuacaaacugaacauuaucaagaaagagccuggccaaaagcuccuguucagaaaugggcuucagcugauuuuuaucuucaucuggucuuuucaguga

SEQ ID NO: 68986 - RNA, 459 nt, Artificial Sequence
  derived and/or modified sequence opt5 from EVA1A__Homo_sapiens__NP_115557
augagacugccccucagccacuccccugagcauguggaaauggcccugcuuucuaacauccuggcugccuacagcuucgucuccgagaauccggaacgggcggcucucuauuuuguuucuggcgugugcauugggcuggugcuuacccuggccgcccucgucauccgcauuagcugucacacagacugcagacggcgccccggaaagaaauuccugcaggauagagaguccucuagcgacuccagcgauucugaagacggcuccgaggauacggugagcgaccugucuguucggcgccauagacgguuugagcgcacccucaacaagaauguguucacauccgcugaggaacuggaaagagcccaacggcuugaggagcgcgaaagaaucauucgggagaucuggaugaacgggcagccugaaguccccggaacccgcagccugaauagauacuauuga

SEQ ID NO: 68987 - RNA, 1326 nt, Artificial Sequence
  derived and/or modified sequence opt5 from EVA1C__Homo_sapiens__NP_478067
augcugcuccccggcagagcccggcagccuccgacaccccaaccugugcagcaccccgggcugcgcagacaggucgagccucccggacagcuucugcgccucuucuacugcaccguucugguguguagcaaggaaaucuccgcucuuacggacuuuucuggcuaucugaccaaacuccugcaaaaccauacaaccuacgccugcgauggggacuaucugaaucuccaguguccucggcacagcacaauuuccgugcagucugcguucuacggacaggauuaucaaaugugcagcucccagaagccggcuucucagagagaggacagccugaccugugucgccgccacaaccuuucagaaagugcuugaugaaugccaaaaccagcgggcuugucaucugcucguuaauucccgcguguucggccccgaccugugcccugggagcucuaaguaccuucuggucuccuuuaaaugucagcccaacgagcucaagaauaagacggugugcgaagaucaagagcugaaacugcacugucaugagagcaaguuccucaacaucuauucugccaccuacggaagacggacacaggaacgcgacauuugcuccagcaaagcugagagacugccucccuuugauugccuuucuuacuccgcccugcagguucucagccggcgcuguuauggcaagcagagaugcaaaaucauugugaauaaccaccacuucggcuccccgugucugccuggggucaagaaguaccuuaccgugacauaugcgugcgugcccaaaaauauccugaccgccaucgacccugcuauugccaaccucaagcccucucugaaacaaaaggauggagaauacggcaucaauuuugaccccagcggguccaaaguccugcggaaggauggcauucucguuagcaacucucuggcugccuucgcguauauccgcgcccauccugagagagcugcccuucuguuuguguccagcguguguauuggacucgcucugacgcuuugcgcccuggucauccgggagucuugugccaaagacuucagagaccuccagcuggggcgcgaacagcuggugccgggaagcgauaagguugaggaagacuccgaggaugaagaggaggaagaggaccccucugaaagcgauuuuccuggcgagcucuccggcuucugccggacaagcuaccccauuuauucuuccaucgaagcugcggagcuggccgagagaaucgaacgccgggagcagauuauccaagaaauuuggaugaauagcgggcuugacaccucucugccuagaaacaugggacaguucuacuga

SEQ ID NO: 68988 - RNA, 3687 nt, Artificial Sequence
  derived and/or modified sequence opt5 from EVC2__Homo_sapiens__NP_001159608
augaucuggcccaaggucgagugcugucacuucaaaaccgccgucgaagcuccucugggcaugaagcucgacaaaaagauggagguuuuuauuccgcugagcacauccgccgcgucuagcgggcccugggcucauucccuuuucgccuuuaucccuucuuggcccaaaaagaaccuguucaagagagaaagcccuauuacgcaccggcucuacggagauaucucccgcgaggugcagggcaccucugaaaauggggugauuuuucaaaaaugcgcccuggucagcggauccagcgaggcucagacagccagaaucuggcuucuggugaacaauaccaagacaaccucuuccgcuaaccucagcgagcugcugcuccuggacucuaucgccggccuuacaauuugggauuccguugggaaucggaccagcgaaggauuccaggcguuuucuaaaaaguuccuccaggugggcgacgccuuugcugucuccuaugccgcuacgcuccaagccggcgaucuggggaacggagagagccuuaaacugcccgcgcagcucaccuuccaguccucuagccgcaauagaacacagcugaaggugcuguuuuccaucaccgccgaagagaacguuacagugcucccucaucacggccugcaugcugccggguucuuuauugcuuuccuucugagccucguccugaccugggccgcccuuuuccugauggugcgguaccaaugucucaagggaaauaugcugacgcgccacagaguguggcaguaugagucuaaacuggaaccgcuccccuuuacauccgcugacggcgucaacgaggaucugagccuuaaugaccagaugaucgauauucugucuagcgaagacccuggguccaugcuccaggcgcuggaggaacuugagaucgccacccugaaccgggcugaugccgaccucgaggccugccgcacacaaauuucuaaggauaucaucgcucugcugcucaaaaaucugaccagcuccggacaccuuagcccccagguugaaagaaagaugucugccguguucaaaaagcaguuucugcuccuggagaacgaaauucaagaggaauacgaccggaaaaugguggcgcugaccgcugagugugaccuugagacacgcaagaagauggaaaaucaguaucagagagagaugauggccauggaagaggccgaagaacuccugaaacgggcuggcgagcgcuccgccgucgaaugcagcaaccugcucagaacgcugcauggccuugagcaggaacaucugcggaagucucucgcucugcaacaggaggaggauuucgccaaagcgcacagacagcuggccguguuucagcgcaacgaacuucacuccaucuucuuuacccaaauuaagagcgcuaucuucaaaggggagcucaagccugaagccgcuaagaugcugcugcagaauuacuccaaaauucaggagaacguugaagaacucauggacuuuuuccaggccucuaagcgguaucaccugagcaaaagauuuggacaucgcgaguaccuugugcaaaaucugcaguccucugaaacacggguccagggccuccugagcaccgcggccgcucagcugacacaccuuauccaaaagcaugagagagccggguaccucgaugaagaccagauggagaugcugcuggaacgcgcucagaccgagguguucuccaucaaacaaaagcucgauaacgaccugaagcaggagaaaaagaaacuucaccagaagcugauuacgaaacggagacgcgaacuccugcagaagcaucgggagcaaagacgcgaacaggccagcguuggagaggccuuucggacaguggaagaugcuggccaguaucugcaccagaagagaucucuuauggaggagcacggggcgacccucgaggagcugcaagaacggcuggaccaggccgcucucgaugaccugcgcacccuuacacugucccucuucgagaaagccaccgaugagcugagacggcugcagaauagcgccaugacacaggaacuucugaagagaggaguccccuggcuguuccugcaacagauccucgaggaacauggcaaagagauggcugcccgcgcggaacagcuggagggcgaggaacgggacagagaccaagagggggugcagucuguccgccagagacuuaaggaugacgcuccggaagccgugacggaggaacaggccgagcugcggcgcugggagcaccucauuuuuaugaaacuguguuccagcguuuucucucugagcgaagaggaacuucugagaaugcggcaagaggugcauggaugcuuugcucagauggaucgcucccucgcccugccuaagaucagagcgcggguccuccugcagcaguuccaaaccgcuuggcgcgaagccgaguuugugaaacuugaccaggccguugcugcccccgagcugcagcagcaaagcaaggugagaaagucucgguccaaaagcaaguccaaaggcgaacuccugaagaaauguauugaggauaagauccaccugugcgaggagcaggcuucugaggaccuugucgaaaaggugcgcggggagcugcucagagaacgggugcagagaauggaggcccaggaaggaggcuucgcgcaaagccugguugcccuccaguuucagaaggcuucccgcgucacagagacccugucugccuacacagcccuucugagcauccaagaucugcuccuggaggaacuuuccgcuucugagaugcugaccaagagcgccuguacgcagauucucgaaucccacagccgggagcugcaggaacucgagagaaaacuggaggaccagcuugugcaacaggaagcugcgcagcagcaacaggcccuggcuucuuggcagcaguggguggccgaugggccuggcauccugaacgagcccggagaagucgacuccgagcgccaagugagcaccguucuccaucaggcccugucuaagucccagacacuucuggaacaacaccagcagugccuccgggaggagcagcaaaauagcgugguccuggaagaucuccuggagaacauggaagcugacaccuucgccacacuuugcucucaggagcugagacuggcguccuaucucgcucgcauggccauggugcccggcgccacccugcggagacuucugagcguugugcucccuacggcuucccagccgcagcugcucgcccugcuugauagcgcgacagagcgccaugucgaccacgcugccgaaucugacgggggagccgagcaagcugaugugggccggagacggaaacaucagagcugguggcaggcccuggacgggaagcugcgcggagaucucauuuccagaggccuggaaaagaugcuuugggcucggaaacgcaagcagucuauccugaaaaagaccugucucccccugagagagcggaugauuuuuagcgggaaaggcuccuggccucaccugucucucgaacccaucggagagcuugccccuguucccauugugggcgcggagacaaucgaccugcugaauaccggggaaaaacucuucaucuuuagaaacccgaaggagccugaaauuagccugcacgugcccccucgcaaaaagaaaaauuuccuuaacgccaagaaagcuaugcgggcccugggaauggauuga

SEQ ID NO: 68989 - RNA, 2979 nt, Artificial Sequence
  derived and/or modified sequence opt5 from EVC__Homo_sapiens__NP_714928
auggccagaggcggggcugccugcaagagcgacgcgcggcugcuccugggacgcgaugcucuuagacccgccccugcccugcucgcuccggccgugcugcuuggcgcugcccuggggcucggacugggccuguggcucgggugucgggcgggacgccagagaacccggcaccaaaaagacgauacacagaaccugcuuaagaaucuggaguccaacgcccagacgcccucugaaaccggcagcccuucccgcagacggaaacgcgagguccagaugucuaaggacaaagaagcuguugaugagugcgaacccccuagcaauuccaacaucacagccuucgcucucaaggccaaggugauuuaccccaucaaucaaaaauuuagaccucuggcggacggcucuagcaacccgucccuucaugagaaucugaagcaggccgugcucccccaccagccugucgaggcuagccccucuuccagccuggggucucugucccagggagaaaaagaugacuguuccucuuccagcuccgugcauucugccaccagcgaugaccgguuccucucccgcacauuucugagaguuaacgcuuucccugaggugcuugccugcgaaagcgucgauguggaccuguguauuuauucucuccaccugaaggaucuucugcaucucgacaccgcccugcggcaagagaaacacaugauguuuauccagauuuucaagaugugccugcucgaccugcuucccaagaaaaaguccgaugacgagcuguaccagaaaauccucagcaagcaggaaaaagaucuggaggaacuugagaagggccugcaaguuaaacucucuaauacagaaaugagcggggcuggagacuccgaguauaucacccuggcggauguggagaagaaggaacgcgaguacucugaacagcugauugacaacauggaggccuuuuggaaacagauggcuaauauccaacacuuccucgucgaucaguuuaaguguagcuccagcaaagccagacagcugaugaugacgcuuaccgaacggaugauugccgcugagggccugcucugcgacucucaggagcugcaagcccuggaugcgcuugaaagaacaauggggcgcgcucauauggccaaggugaucgaguuccucaaacuccaggugcaggaagagacccgguguagacuggccgcuauuucccacggacuggaacugcuugccggcgagggcaagcugagcgggcgccagaaggaggaacuccugacacaacagcauaaggcuuuuuggcaggaggccgaacgguucucuagagaguuuguccagcgcggaaaggaccugguuaccgcgucccuugcccaccaaguggagggcacggcuaaacucacacuggcccaggaagaggaacagcggagcuuccuggcugaggcccagccgaccgcggauccugaaaaguuccucgaggccuuucacgaggugcuggaaagacaacgccuuaugcagugcgaccuggaggaagaggaaaacguccgggcuacagaggccgugguugcucucugucaggagcuguauuucuccaccguggacaccuuucaaaaauucgucgaugcccuguuucuucagacacuccccgggaugacgggacugccucccgaagagugcgacuaccugagacaggaagugcaggagaaugccgcuuggcaacucggcaagucuaaccgcuuccggagacagcaguggaagcuguuucaggaacuucuggagcaagaucagcagguuuggauggaggaaugcgcgcucagcuccgugcugcagacccaucugcgggaggaccacgaagggacaauccgcggaguccuuggcagacucggcgggcugaccgaggagucuacacggugugugcugcaaggacaugaucuccugcuuagaagcgcccugcgccggcucgcucugagaggcaaugcccuggccacccuuacgcagaugcgccuguccgggaaaaagcaccuccugcaggaacucagagagcaacgggcucuggaacagggaagcucucagugccuugacgagcaucaguggcaacugcuccgcgcccuggaagcgagaguccuggaggaggcuucccggcuugaagaggaagcccagcagacacgccugcagcuccaacagagacugcucgccgaggcucaggaagugggccagcugcuucaacagcacauggagugugccauugggcaggcgcugcucguucacgcucggaacgccgccaccaaaagccgcgcuaaggauagagacgauuucaaacggacccugauggaggccgcuguggaaucugucuaugugacauccgccggcguuagccgccuggugcaggcguacuaccaacagaucggaagaaucauggaggaccaugaggaacggaaacuucagcaccugaagacccuccaaggcgaaagaauggagaacuauaaacugcgcaagaaacaggagcucucuaaucccagcuccgggagccggacagccggaggcgcucaugaaacgucucaggccguccaccagagaaugcugucccaacagaagcgcuuucuugcucaguucccugugcaccagcaaaugcggcugcaugcccagcagcagcaagccggggugauggaucugcucgaggcucagcuggaaacccagcuucaagaggcggagcagaacuuuauuagcgaacuggccgcucucgccagaguuccgcuggccgaguccaaacuccugcccgcuaagcgcggacuucuggaaaaaccucugcggacaaagagaaagaaaccccucccucaggagcgcggcgaccuggggguccccaauaacgaagaucuugccucuggcgaccagaccagcggaucccugucuagcaagcggcucucccaacaggagucugaggcgggcgacagcgggaauagcaaaaagaugcugaaaagacggagcaaccucuga

SEQ ID NO: 68990 - RNA, 780 nt, Artificial Sequence
  derived and/or modified sequence opt5 from EVI2A__Homo_sapiens__NP_001003927
augcugcucagaagcugguucggcaacaaggacuuucaggcccugcccauccuugcucggcugccuuccaugccgaccgauauggagcacacagggcauuaccuccaccuggccuuccuuaugacgaccguguuuucucugagccccggaacaaaagcgaauuauacccgccucugggcuaacuccacaucuagcugggacuccgucauucaaaauaagaccggcagaaaccagaaugaaaacaucaauacaaacccuauuacccccgagguugauuacaaaggaaauucuacgaacaugccugaaaccagccauaucguggcccugacauccaagagcgagcaggaacuguauauucccucuguggucuccaauagcccuucuaccgugcaguccaucgagaacacaagcaaaucucacggggagaucuucaagaaggacguuugcgccgaaaauaacaauaacauggcuaugcucauuugucugaucauuaucgccgugcuuuuucugauuugcaccuuccucuuucuguccacggucgugcuugcuaacaaaguuagcucccugcggcgcucuaagcaagugggcaaaagacagccgcggagcaauggggauuuccucgccuccggacuguggcccgcggagagcgacacauggaagcgcaccaaacagcugacaggcccuaaccucgucaugcagucuaccggcgugcugaccgccacaagagaacggaaggaugaggaggggacggaaaaacuuaccaauaagcaaaucggauga

SEQ ID NO: 68991 - RNA, 1347 nt, Artificial Sequence
  derived and/or modified sequence opt5 from EVI2B__Homo_sapiens__NP_006486
auggaccccaaguacuucauccugauccucuuuugcggccaccugaacaauaccuucuuuagcaaaacagagacgaucaccacagaaaagcagucccaaccuacccuuuucacaucuagcaugucccaggugcuggccaacucucagaauaccacagggaacccgcucggacagcccacccaauuuagcgauacguucuccggccagucuauuagcccugcuaaagucaccgccgggcagcccaccccugcgguuuauaccuccagcgagaagcccgaagcucauacaucugccggacagccucuggccuacaauaccaaacaaccgacgcccaucgcuaacacauccagccagcaggccguguuuaccucugcuagacagcuuccuuccgcccggacaagcaccacccaacccccuaagucuuucguguauacauuuacgcagcaguccagcuccguccaaauucccucucgcaagcagaucaccgugcacaauccgagcacacagccuaccuccacaguuaaaaacagccccagaucuaccccuggcuucauccuggacacgacauccaauaagcagacaccccaaaagaacaauuacaacagcauugcggccauccucauuggggugcugcugaccucuaugcucgucgcuaucauuaucauugugcuguggaagugucuucggaaacccguucugaaugaucagaacugggccggacgcagcccuuuugcugacggcgagacaccggauaucugcauggacaauaucagagaaaacgagauuuccaccaagcggacaucuaucauuagccucacgcccuggaagccuuccaaaagcacccugcuugccgaugaccuggagaucaaacucuucgaaucuuccgagaacauugaagauagcaauaaccccaaaacagagaagaucaaagaccaggugaauggcaccucugaggauuccgcggacgggagcacagucggaaccgccguguccucuagcgaugacgcugaccugccucccccgccuccccugcucgaucuggaaggccaggaguccaaccaaucugacaagccuacgaugaccaucgugagcccccuuccuaaugauuccacaagccugcccccgucucucgacugucugaaccaggauugcggggaccauaaauccgaaauuauccagagcuuuccuccccuugauucucugaaucucccccugccuccggucgacuucaugaagaaccaggaggauuccaaucuggaaauucaaugucaggaguucagcauucccccuaacucugaccaggaucucaaugagagccugcccccucccccugccgaacuucuguga

SEQ ID NO: 68992 - RNA, 2685 nt, Artificial Sequence
  derived and/or modified sequence opt5 from EVI5__Homo_sapiens__XP_011540402
augaccagcggcgccucccugaagcucacaucuggguuccccguggcuacggacaaagucgccgagaagcugagcuccacccuuucuuggguuaaaaacacagugagccacaccgugucccagauggcgucucaagucgcuagcccuuccacaagccugcauaccacaucuuccagcaccacgcucucuaccccggcccugucccccagcucuccuucccagcuuagccccgaugaccuggaacuccuggccaagcuggaggaacagaauagacuccuggagacagauuccaaaucucuucggagcgugaacggaucccgcagaaauagcgggucuucccugguuagcucuagcuccgcuucuagcaaccucucccaccuggaagaggacagcuggauccuuuggggccggauugugaaugagugggaagauguccgcaagaagaaagagaaacaggugaagccuuuugaaugcuggguucuguaccaucacucucaacucuguagauuccaggugcauuaucugaagcggucccacaccgaggagcugguccacaaaggaaucccccaucacuuucgcgccauuguguggcagcuccugugcagcgcucagucuaugccuaucaaggaccaauacuccgaacuucugaagaugacaagcccgugugagaaacucauuagacgggauaucgcccgcaccuaucccgaacauaacuucuuuaaggagaaagacucccugggccaggaagugcuuuucaaugucaugaaggcguacucucugguugauagagaggugggguauugccagggaagcgccuuuaucgugggccuccugcugaugcagaugccugaggaagaggcuuucugugucuuugugaaacucaugcaagacuaccggcugcgcgaacuuuucaagcccuccauggccgagcugggccucugcauguaucaguuugaauguaugauucaggagcaccuuccugagcuuuucguucacuuucaaucucagagcuuccauacguccauguacgcuagcucuugguuccugacaaucuuucucaccacauucccccugccgauugccaccagaaucuuugauauuuucauguccgaagggcuggagaucguguuucgggucggacucgcgcugcuucagaugaaccaggccgaacugaugcaacucgacauggagggcaugcugcagcacuuccagaaagugauuccucaucaguuugaugggguucccgacaagcugauccaagcugccuaccaggugaaguauaauagcaaaaagaugaaaaagcuggaaaaagaguacaccacaaucaagacgaaggagauggaggaacaggucgaaauuaaacgccucagaaccgagaaccggcugcugaagcagagaaucgagacacucgaaaaagagucugcuucccuggccgaccgccuuauucaaggacaggugacccgggcccaggaagcugaggaaaauuaucugaucaagagagagcucgcgacaauuaaacagcaaagcgaugaggccucugcuaagcuggaacaggccgagaacaccauccgcaagcugcagcaccaacagcaguggcauaaaugcagcuccaauuacaacgaagacuucguccuucagcucgagaaggaacuggugcaagcccggcugagcgaggcugagucucagugugcccucaaagaaaugcaggauaagguucuggacaucgagaaaagaaauaacucccuuccugaugaaaacaauauugcgcgccugcaggaggaacucaucgcugugaagcugcgggaggccgaggccauuaugggccugaaggaacuuagacaacaggucaaagaccucgaggaacacuggcagcgccaccuggcucggacgacagggagauggaaggauccucccaaaaagaacgccaugaaugagcugcaggacgagcucaugaccauccgccugcgggaagcugagacccaagccgaaauuagagagaucaaacagcggaugauggaaauggagacacagaaccaaaucaauagcaaccaucuucgcagagcggagcaggaagugauuucccugcaggagaagguucaguaucucucugcccaaaauaaaggacugcugacccagcuuagcgaagcuaagcggaagcaggccgagaucgaaugcaaaaacaaggaggaggugauggcugucagacuccgcgaagccgauuccauugcggccguggcugagcugcggcagcacaucgccgaacuggagauucaaaaagaagagggcaagcuccagggccagcugaauaaaucugacagcaaccaguacaucggggagcuuaaggaucaaauugcugaacugaaucaugagcucagaugucugaagggacagcgcggcuuuuccgggcagcccccguucgacggaauccacaucgugaaccaccugauuggcgacgaugaaucuuuucauagcuccgacgaggauuucaucgacaauagccuucaggagacagggguuggauuuccccugcacggcaaaucuggcuccaugagccucgauccugccgucgccgacgggucugaauccgagacggaagauagcgugcuggagaccagagaaucuaaccaagugguccagaaggagcggcccccucgcagacgggaguccuauagcacaaccguguga

SEQ ID NO: 68993 - RNA, 1257 nt, Artificial Sequence
  derived and/or modified sequence opt5 from EVL__Homo_sapiens__NP_057421
auggccaccagcgagcaguccaucugccaagcuagagccucugugauggucuacgacgauacaagcaagaaauggguucccauuaagccuggccagcagggguucucccggaucaacauuuaucacaauacggcgucuaacaccuuucgcguggugggagucaaacugcaggaccaacaggugguuaucaauuacagcauugugaagggccucaaauauaaccaggcuacaccgaccuuccaucaguggagagaugcccggcaagucuacgggcugaauuuugccuccaaggaagaggcuacaaccuucucuaacgccaugcuuuuugcucugaauaucaugaacagccaggaaggaggccccuccagccagcgccaggugcaaaaugggccuucucccgacgagauggauauccagagacggcagguuauggaacaacaccagcagcagcgccaagagucccucgagagacggacaagcgccaccggaccuauucugcccccuggccauccgucuuccgcggccagcgcucccgugucuuguuccggcccucccccucccccgccucccccugugcccccucccccgacgggggccacacccccucccccucccccgcuuccugcuggaggcgcccaggggagcucccacgacgaaucuagcauguccggacuggcggccgcuaucgccggcgcuaagcuccgcagaguccagcggcccgaggaugccagcgggggaucuuccccuagcggcaccucuaaaagcgacgccaaccgcgcuuccucuggcgggggaggcgggggacugauggaagagaugaauaagcugcucgcgaaaagacggaaggccgcuagccaguccgauaaacccgccgagaagaaggaagacgagagccaaauggaagauccuucuaccucccccagcccgggcacacgcgccgcuucucagccucccaacuccagcgaggccgggagaaaacccugggaacgguccaauucuguggagaagccugucagcuccauucugucuagaaccccgagcguugcgaaaucccccgaggcuaagagcccucuucagucucagccccauucccgcaugaaaccugccggaagcgugaacgacauggcccuggaugcuuucgaccucgaccggaugaagcaagaaauccuggaggaaguggucagagagcuucacaaagugaaggaagagauuaucgaugccauucgccaggagcugucuggcaucuccacgacauga

SEQ ID NO: 68994 - RNA, 6102 nt, Artificial Sequence
  derived and/or modified sequence opt5 from EVPL__Homo_sapiens__NP_001979
auguucaagggccugagcaaagggucccagggaaagggcucucccaaagggagcccugccaagggauccccgaaaggcucucccagcagacacucccgggcugccacccaagagcucgcccugcuuaucucucgcaugcaggcuaacgccgaccagguggaaagagauauucuggagacacagaagcggcuccaacaggaccgccugaauagcgaacagucccaggcccuucaacaucagcaggagacggggagaagccugaaggaagcugagguccuccugaaagaucuguuucucgacguugauaaggcccggcgccugaaacacccucaggcugaggaaaucgagaaggacauuaaacaacuucaugaaagagugacccaggagugcgccgaguaccgggcgcuguaugaaaagauggugcugcccccugaugucggaccccgcguggacugggccagaguucuggagcagaagcaaaaacaggugugugcuggccaguacggcccugggauggccgaacuugagcagcaaaucgcugaacacaacauucugcagaaggagaucgaugccuauggacagcagcuccggucucuggucggcccggacgcggccacaauccgcucccaauacagagaucugcucaaagcugccagcuggcgggggcagucucugggaucccuuuauacccaucugcagggcugcacacgccagcucagcgcucuggccgagcaacagagacggauucuucagcaggacuggucugaucugauggccgaccccgcuggggugagacgcgaauacgagcacuucaagcaacacgaacuccugucccaggagcagagcguuaaucaacuggaagacgauggagagcggaugguggagcucagacauccugcggucggccccauccaggcccaccaggaagcucugaaaauggaguggcagaacuuucuuaaucuguguauuugccaagaaacccagcuccagcauguggaggacuaucgccgguuccaggaagaggccgauuccgugucucaaacacuggccaaacuuaacagcaaucuggacgcuaaauacuccccugcccccggcgggccgccuggagcgcccaccgagcuccugcagcagcuggaagcugaggaaaagagacucgccgucacggagcgcgccaccggcgaucugcagcggagaagccgcgacguugcuccucuuccccaacggagaaaucccccucagcagccgcugcacguggauucuaucugugacugggauuccggggaggugcaacuccugcagggagaacgcuacaagcuggucgacaauacagauccccacgccugggugguucagggcccugggggagagaccaaacgggcucccgccgcgugcuuuuguauuccugcccccgacccggacgcuguggccagagcuagccggcuugccucugaacuccaggcgcugaagcaaaaacuggccacaguccagagccgccucaaggcuuccgccguggagucucugagaccuagccagcaggcucccuccggcagcgaucuugccaacccucaagcccagaaacugcucacccagaugacgcggcuggacggcgaucuggggcagaucgaaagacaaguucuugcuugggcgcgcgcgccccucucucggccuacaccccuggaggaccuggagggacgcauucauucccacgaaggcaccgcucagcgccuccagagccuggggacagagaaggaaaccgcccagaaggagugcgaagccuuccuuucuaccagaccggugggaccugcugcccugcaacuccccgucgcgcucaacuccgugaaaaacaaguuuagcgauguccaggugcuguguucccuuuauggcgagaaagcuaaggccgcccucgaccuggagcggcagauccaagaugcugaccgcguuaucagaggguucgaagccacacuggugcaggaggcgcccauuccugcugaaccgggcgcccuccaggagcgggucucugaacugcagcgccaaagacgggagcuucuggagcagcagacgugcgugcuccgccugcauagagcccugaaagcuagcgaacacgccugugcugcccuucagaauaacuuucaagaguucugccaggaucucccccggcagcagcgccaaguuagagcgcugaccgaccgguaccaugccgugggagaucagcuggaccucagagaaaaggucgugcaggaugcugcccugacauaucaacaguuuaagaauugcaaagacaaccuuuccucuuggcuggagcaccucccucgcagccaggugcggcccuccgacggcccuagccagaucgcuuacaagcugcaagcccagaaaagacugacccaggagauucagucucgcgaacgggauagagccacagcuucccaccuuagccaagcgcugcaggccgcucuccaggacuaugagcugcaggccgauaccuaccgcuguucucucgaacccacgcuggccguuuccgcuccuaagcggcccagagucgccccgcuucaagagagcauccaggcgcaggagaagaaccuggcuaaggccuauacagagguggccgcugcccagcaacagcuccugcagcaacuggaguucgcgcgcaagaugcuugagaagaaggagcugucugaagacauucggagaacccaugaugcuaaacaggggagcgaguccccugcccaggccggacgggaaagcgaggcucucaaggcccagcuggaggaagaaagaaaaagaguggcucggguccaacacgaacucgaggcccagcgcucucagcugcuucagcugagaacccaacggccccucgaaagacuggaggagaaggaagugguugaguuuuaccgcgacccucagcuggaaggcucccuuagccgggugaaagcgcaggucgaggaggaagggaagagacgcgccggacugcaggcugaucucgagguggccgcucaaaagguugugcagcuggaauccaaacggaagacaaugcagccccaucuccugaccaaagaggucacacaaguggaaagagacccgggccuugauucucaggccgcccagcugcgcauccagauccaacagcugagaggggaggacgcuguuauuagcgcgcggcucgagggccugaagaaagaacuucuggcccucgagaagcgcgaaguggaugucaaggagaaagugguggucaaggaaguugugaaaguggagaagaaucuggagauggucaaagcugcccaggcccucagacugcagauggaagaggacgcugcccggcgcaagcaagcggaagaggcuguggccaaacuucaggccagaaucgaagaucuggagcgggcuauuuccucuguugagccuaaagugaucgucaaggaagugaaaaagguugagcaggaccccggacugcuccaggaaagcucccgccugagaucucuucuggaggaggaacggacgaaaaacgccacccucgcgagagagcugagcgaccuccacuccaaguacagcguggucgaaaagcaacgcccuaaagugcagcugcaggagcggguucacgaaauuuuccaaguggaucccgagacagagcaggaaaucaccagacuuaaggccaaacugcaggagauggcuggcaagcgcucuggggucgaaaaagagguggaaaagcugcuccccgaccuggaggugcuucgggcccagaaaccuacagucgaguauaaggaaguuacccaagagguggugagacaugaacgguccccggagguccugcgcgaaaucgauagacucaaggcucagcugaaugagcucgugaacagccacggacggucucaggagcagcugauucgccuucaaggcgaaagagacgaguggcggcgcgaaagagccaaaguugagacgaagaccguguccaaagaggucgugcggcaugaaaaggaucccguucuggagaaagaagcugagcgccugagacaggaagugcgggaggccgcgcagaagagacgcgccgcugaggacgccgucuacgaacuccagagcaagcggcugcuucuggagagacgcaaaccugaagagaagguggucgugcaagaaguuguggucacacagaaagaucccaagcuccgggaggagcacucuagacuguccgggagccuggacgaagaggugggacgccggagacagcucgaacuugagguucagcaacugcgcgcuggcguggaagaacaggaggggcugcucuccuuccaggaagaucggagcaaaaagcuggccgucgagagagaacuucgccaacugacccuccggauccaggagcuggagaagagaccucccacagugcaggagaaaauuaucauggaggaagugguuaagcuggagaaagacccugaucucgaaaagucuaccgaggcccuucgcugggaccuggaccaggagaaaacgcaagucacagaacugaauagagagugcaagaaccuccaggugcagauugaugugcugcagaaggcuaaaagccaagaaaagaccaucuauaaagaggucauucgggugcagaaggaccgcguucuugaagaugagagagcgcgggugugggagaugcugaauagagaacggacagcccgccaggcuagagaggaagaggcccggcgccucagagaacggaucgaccgcgccgagacccugggcagaaccuggucccgggaggaaucugagcugcagcgcgcuagagaucaagccgaccaggaauguggacggcuccagcaagagcuucgcgcgcuggagagacagaaacagcagcaaacacugcagcuccaggaagagagcaagcugcuuucccagaagacggaaucugagcggcaaaaagccgcucagcgcggccaggaacugagcagacucgaggccgcuauccugcgggagaaggaucagauuuacgaaaaagagagaacccugcgcgaccuccaugccaaggucucccgggaagaacuuucucaagaaacacagaccagagagacaaaccugagcaccaaaaucuccauucuggagccggaaacggggaaggauaugagccccuaugaggcguacaaacgcggaaucauugaccggggccaguaucuccagcugcaagaacuugagugcgauugggaagaggugacaaccucugggccuuguggagaggaauccguucugcucgacagaaagagcggcaagcaguacucuaucgaggccgcucugcgcugccggagaaucuccaaagaagaguaccaccuguauaaggaugggcaccuccccauuagcgaguuugcccuucugguggcuggcgaaaccaaaccuuccucuagccuguccaucggaagcauuaucucuaagagcccccucgccagcccggcuccucagucuacauccuucuuuucccccucuuucagccugggccuuggggacgacuccuuucccauugccggaaucuacgauaccacaacggacaauaaauguucuaucaagaccgcggucgccaagaacaugcuggauccuauuacaggccaaaaacuccuggaggcucaggccgcuaccgggggaaucguggaccugcucagccgcgaacgguauuccguucauaaggccauggagagaggccuuauugaaaauacaagcacccagcgccugcugaacgcccagaaagcguucacgggcaucgaggaucccgugaccaagaaacggcucucugucggggaggcugugcaaaagggauggaugccuagagaauccgugcugccgcaccuucagguccagcaucugacaggcgggcucauugaccccaagcggaccggaagaaucccuauccagcaagcccugcugagcggcaugauuuccgaggaacucgcucagcuucugcaggaugagucuagcuacgaaaaagaccugacagaucccaucuccaaggagcgccucucuuauaaagaggccauggggcggugcagaaaggacccucugagcggacuucugcuccugcccgccgcucuggaaggcuaccgcuguuauagauccgccagcccgaccguuccucggucucuccgcuga

SEQ ID NO: 68995 - RNA, 678 nt, Artificial Sequence
  derived and/or modified sequence opt5 from EVX1__Homo_sapiens__NP_001291449
augagacgguaccgcaccgccuucacaagagagcagaucgcucggcuggaaaaggaguuuuaucgcgaaaacuacgugagcagaccccggcgcugcgagcucgccgcggcucugaaucuuccugaaacgaccauuaaagucugguuccaaaacagacggaugaaggacaaacgccagagacuggccaugacauggccgcaccccgccgauccugcuuuuuauaccuacaugaugucccaugccgcugccgcgggcgggcuccccuauccuuuccccucucaucugccucuuccguacuauagccccguuggacugggcgccgcuuccgccgcuucugccgcggccagcccuuuuuccgggucucuccggccccuggacacauuccgcgugcugagccagccuuaccccagaccggagcuccugugugcuuuucggcacccuccccuuuacccuggacccgcccacggccugggggcuuccgccggaggccccugcagcugucucgccugccauucuggcccugcuaaugggcuggcgccgcgcgccgcugccgccuccgauuucaccugugcuagcacaucuagauccgacagcuuucuuaccuucgcccccucugugcuguccaaggcgagcuccgucgcucucgaucagcgggaggaagugccucugacgagauga

SEQ ID NO: 68996 - RNA, 1431 nt, Artificial Sequence
  derived and/or modified sequence opt5 from EVX2__Homo_sapiens__XP_011509410
augauggagagaauccggaaggaaaugauucugauggagcgcggccuccacagccccaccgccgggaaaagauucuccaaccugucuaauagcgccggaaacgccgugcuugaagcgcuggaaaauucccagcauccugcucggcucucuccgcgccugcccagcgccccucuucacuccgcccugggcgaacuccccgcuaaggggaaauuugagaucgacacacuguucaaccugcaacauacgggaucugagagcaccgucuccagcgaaauuucuuccgccgcugagagcagaaagaaaccuggccacuacucugaagccgcggccgaggcugauauguccagcgacguugagguggggugcucugcccuccggucccccggaggccugggcgcugcccagcuuaaggaaaauaacgggaagggauaugcggagagcggcuccgccgcugggacaaccacaucugccagcggauccggccuggggagccuccauggaggcucuggcggguccggaggcagcgcugcccuugggggaucuggcagcggggccgaucaggugcgcagauaccggaccgcuuuuacacgcgaacagaucgcgagacuggagaaagaguucuaucgggagaauuacgucucccgcccuagacggugugagcuggccgcugcccucaaccugccggaaaccacgauuaaggugugguuucaaaaucgcagaaugaaagacaagcggcagagacuggccaugucuuggccccacccugcugaucccagcuucuauaccuacaugaugacacacgccgcggcuaccggaucccucccuuaucccuuucauagccacguuccgcugcauuacuacccucacgugggcgucacagccgccgcugccgcugccgcggccucuggcgcugccgcugccgcguccagccccuucgccaccucuauccgcccucuugacacguuucgggcucugucccaccccuauagcagacccgagcuccugugcuccuuccgccauccugggcuuuaccaggccccggcugccgccgcuggacugaacucugcggccagcgcugccgccgcugccgcggcugccgccgcugccgcguccucugcugccgccgcuggcgcucccccuagcgggggauccgcccccuguagcugccucucuugucacuccagccagucugccgcggccgcugccgcugccgccgcugcggcccugggcuccagagggggcggaggcgggggaggcgggggaggcgggggcggaggcgggggagcuggcgccgggggaggcagcgauuuugggugcucugccgcugccccucggagcgaauccggcuuccugcccuauagcgcggcugugcucucuaaaacagccguuuccccgccugaccaacgcgaugaggcuccccugacccgguga

SEQ ID NO: 68997 - RNA, 1968 nt, Artificial Sequence
  derived and/or modified sequence opt5 from EWSR1__Homo_sapiens__NP_001156757
auggccagcaccgacuacuccacauauucucaggcugccgcgcaacagggcuacagcgcuuauacggcccagcccacccagggguacgcccaaacaacccaggcuuauggacagcaguccuacggcacauaugggcaaccuaccgaugugucuuacacacaggcccagaccacggcuaccuacggacagacagccuaugcgaccagcuacggccaaccgcccacaggguauaccacgccuacagcuccccaggccuacucccagccuguccaaggauauggcaccggcgccuacgacacaaccaccgcuacaguuacgaccacacaggccucuuaugcggcccagagcgcuuacgggacccagcccgccuacccugcuuauggacaacagccggccgccacagcucccaccagaccucaggauggcaacaagcccacggagacaucccagccucaaagcucuaccgggggauacaaucagcccucccugggcuaugggcagagcaacuacucuuauccccaggugccuggauccuaccccaugcaaccugugaccgcgccgcccagcuauccuccgacaucuuacuccagcacccagcccacauccuacgaccagucuagcuauucccagcaaaauacguacggccagccuagcucuuauggccagcaauccagcuacgggcagcagucuagcuauggacagcaacccccuaccuccuaucccccgcagacaggcucuuacagccaggccccuucccaguacagccaacagucuuccagcuacgggcagcagucuuccuuccggcaagaucaccccagcuccaugggagucuauggccaggaaucugggggauuuagcggcccuggcgagaaccgcuccaugucugggcccgacaauagaggacggggccgcgggggauucgauagaggcgggaugagccggggcggacgcggcgggggaagaggcgggaugggagcuggcgaaagagggggcuuuaacaaaccuggaggccccauggacgaggggccggaucucgaccugggaccucccguggaucccgacgaagauuccgacaauagcgccaucuacguucagggccuuaacgacucugugacccuggaugaccucgccgauuucuuuaagcaaugcggggucgugaaaaugaauaagcgcacaggacagccuaugauucauaucuaucuggacaaagagaccggcaagccgaagggggaugcuacgguuuccuacgaggaucccccuaccgccaaagcggcuguggaaugguucgacggcaaggacuuucagggaagcaaacuuaaggucucucuggcccggaaaaagcccccuaugaacuccaugcggggcgggcugcccccucgcgagggaagaggcaugcccccgccucuccgcgggggacccggcgggccuggcggacccggcgggccgaugggacggaugggcgggagaggaggcgaucggggcggguucccucccagaggaccucgcggcagccgggggaaucccucuggaggcgggaacgugcagcacagagccggagacuggcaaugucccaauccuggcugcggcaaccagaauuuugcuuggcgcacagaauguaaccagugcaaggccccgaaacccgagggguuccugccucccccuuuucccccuccgggaggcgaucgggggagaggaggccccgggggaaugcgcggcggcagagggggacucauggaccggggcgggccuggaggcauguuccgcgggggacggggcggcgacagagggggauuucgcggcgggcggggaauggauagaggcggguucggaggcggccggcgcgggggacccggcgggccucccggaccgcugauggagcagaugggcgggagacggggaggcagaggcgggccuggaaagauggacaaaggcgaacaucgccaagagcggagagaucgccccuauuga

SEQ ID NO: 68998 - RNA, 1866 nt, Artificial Sequence
  derived and/or modified sequence opt5 from EXD2__Homo_sapiens__NP_001180292
augagcagacagaaccugguggcccucaccgucacaacgcugcuuggcguugcugucgggggauucgugcuguggaagggcauccaacggcgcagacgguccaaaaccucucccgugacacagcagccucagcaaaaggugcucgggagccgcgagcugccgcccccugaagacgaucagcuucacuccucugcccccagaagcuccuggaaagagcggauucugaaggcgaaaguugugaccgucucucaggaagcugagugggaccagaucgaaccucuccugcgcagcgagcuggaggauuuucccgugcucggaauugacugcgaauggguuaaucuggagggcaaggccuccccucuuagccugcuccaaauggccucuccguccgggcugugugugcuugucagacugcccaagcucaucugcggaggcaaaacacugccucggacccugcucgauauucuggcugacggcacaauccuuaaggugggggugggauguagcgaagaugccucuaaacugcuccaggacuacggccuggucguucgcgggugccuugaucugagauaucucgcuaugcggcagcgcaacaaucugcuguguaacggacucucccuuaagagccuggccgagaccgugcugaauuucccccucgacaaaucucugcuucugagaugcuccaacugggaugcggagacgcucaccgaagaccaggugaucuacgccgcucgggaugcccaaauuagcgucgcucuguuucugcaucuccugggcuauccuuucucccgcaauucucccggggagaagaacgacgaccacagcuccuggagaaaggugcuugaaaaaugucagggaguuguggauaucccguuucggagcaagggcaugucuagacugggcgaggaagucaauggggaggccacagagucccagcaaaaaccucgcaacaagaaaagcaagauggacggaauggugcccggcaaucaucaggggcgggauccuagaaaacacaagcgcaagccccucggaguuggcuacucugcgcggaaaagcccccuguaugacaacugcuuccugcaugccccugaugggcagccgcuuuguaccugcgacagacgcaaggcucagugguaccucgauaaaggaauuggcgaacugguguccgaggaacccuuugucgugaagcugcgguucgagccugccggcagacccgaaucuccuggggacuauuaccucauggucaaagagaaucugugugugguuugcggaaagcgcgauagcuacauccggaagaacgugauuccccacgaguauagaaaacacuuuccgaucgaaaugaaggaccauaauucccacgauguccuucugcucugcacaagcugucaugcuauuucuaacuacuaugacaaccaccugaaacaacagcuggccaaggaguuccaggccccuaucggcuccgaagaggggcuucgccuccuggaagaccccgagcggagacaggugcggagcggagcucgcgcgcugcucaaugccgagucucugccuacccaaagaaaagaggaacuucugcaggcucuccgggaauuuuacaacacggauguugugacagaggagaugcugcaggaagccgccucccuggagaccagaaucagcaaugaaaacuaugucccccacggccuuaagguggugcagugccauucccaagggggccuccgcucucugaugcagcuggagagccgguggagacagcacuuccucgacuccaugcagccuaagcaucugccccaacaguggucuguugaucacaaucaucagaaacuucugcgcaaguuuggagaagaccucccgauucaacugagcuga

SEQ ID NO: 68999 - RNA, 2631 nt, Artificial Sequence
  derived and/or modified sequence opt5 from EXD3__Homo_sapiens__NP_060290
auggaccccggcgauccugccggggacccggcugccggagagagacaccggaugggccgcgauccccugcuccugcuucaggcgcugcaaacccucuggagcacaagagaacggaagcagcugcgcgaggaggcuuggagaggguucgccgcccuugacgauccucuggcuggacuccuggacaugcuggaguccugccggggccagcgcggggaaggacccucucucgccgcuuggaucagccaucagcugcaauguuggcuucaggcccagccuugccccucccuggcgcagcacucucucagacugaaacaacuucaggcccgggcugugaagguccugacggagagcccuccgucccucgccgcuccccuggccucuauuuuucagcugcaggaugcggaccgcagcugucuccuggcccauguucacagacuucaucacgagggccgguuccgcgaagcugccacccugggcgcuacacucaaacugcaauccgagcuugggguggaaaagaugagcaucccucugcuccugcaggauaaaguggcccuggucgagagauacguggccggauuucccgaccuccagcggcgccugcuuguucugauggauucuuggugccaaccuggcuucgacauuaaggauguggcuagacgguaucccgaggucaccucccucagccuggaaaaacuuucuccgaaagcgcuguccagacaggugcuccgccugcaggagcgguacgggguugccccugcucugugucccaacgccgccauccagcaaagacucgcugcccugcgccaccuuugccauaagcgguuuguggaaaagagccugucucaggagaauuggacagaccacguccagggacucgugggccaguccccuuggcugcaagaacagcugagccagcuucucgugucccauucugaccccgucaccgcggcucagugugccauggagcugcugcuccccgaggaaagacugccugccgcuguugccguggagcuucgccgguucagacugcaagggcgcgcuacagaagccgauagccggcucgaggugaaggacaugaaagauagauauuaccagcugccgauuccccgcgaaaacguccaucugcuugcguccugggaggaccucacccggcacgagggagcccugcugcagugccaccaggugguuggcguggaugucgaauggacgccuguguuuguugcuggcgggagaccccggccuagccuccugcaaguggccgucgagggacacguguuccuucuggacguccucgcucugucucagcccccgaccggccagggggcccaagcguuuucccgccugguggcccagcuucucagcgauccuucuaucacaaagcugggauauggcaugguuggggaccugcagaagcucggaaccagcugucccgcucuggcccauguggaaaaacagauccuuggcggcauggaucugcuccugguccacagacaaaugcggguggcuuccguuccugcccccgccguggacagagcucgcgagcugcgggggcuuucucuccugguccaacaggugcugggaacagcgcucgauaagacccagcagcugagcaauugggacagacgcccucuuugcgaagaacaggugauuuacgccgcugccgacgccuauugucugcucgagguucaucaggcucugugcagagaacccgcccgguuccaccuguccgaggaucuugcgggcagccgcagaccgcggcaccgcgaaagaccuggggcucggaaaccucccggacugcagaaggccucugcccccgcugccccgcgccaaguccccguggcgguggcugucuccgagggcgccgccccucagauccccgcuagagccuuucgggugguuugcgacaacaugcuccaggggcuggcucgcagccucagaugucugggcguggaugcccggaugcuuggaaauggcgaggaccauagacgcgcggccgaagucgcucggcaagaggggagaauuauccugacgucuggacagccuuuccacaaacuccgcgcccaggugggcgcugggcggugccuguccguugauuguagccugaaggcccagcaacaggccaaagcugugcuuaagcauuuuaacgucagagugacacacgcggacauuuucucccgcugccaggccuguaauugcgaucaguaccugaagguuucucgggacaugaugaaacaacucauguggcugagcucccaccaggaaggacccagaucuagcggcgaugaggcuacccagucccaggccgugcaagaaccugggcccgccccggacgcugccccugagggcuguacauacgaucgccccugccgguggcuccagauggcggaccugagagcugagaccccugauaugcuugccgacggaacccggcugcagcucgccggcguccccgugggggugcugcgcacaccgggacugagauguuucuauugcuguacgggcugcgggaaggucuuuugggacggaagccaucuuggccggguugcuacccacuuccgcgauaugcuggaaucugccccuucccccugcgagccuagccccgcgcccucuccugcuuccagcccguuuuga

SEQ ID NO: 69000 - RNA, 2412 nt, Artificial Sequence
  derived and/or modified sequence opt5 from EXO1__Homo_sapiens__NP_003677
augggcauccaggggcugcuccaauucauuaaggaggccagcgaacccauccacgugagaaaauacaagggacaggucguugcuguggacaccuauugcuggcugcauaaaggcgccauugcgugugcugagaaacuugccaagggggaaccuacagaucgguacgugggauuuugcaugaaguucgucaacaugcugcucucccacggcaucaagccgauucugguguuugacggguguacgcuucccucuaaaaaggagguugaacgcagcagacgggagcgcagacaggccaaucugcucaaaggaaagcagcugcugcgggagggcaaaguguccgaagcucgcgagugcuucaccagaucuaucaacaucacacaugccauggcucacaaggucauuaaggccgcgcggagccaaggcguggauugucucguugccccuuaugaagcugacgcccagcuggcuuaccuuaauaaagccgggaucgugcaggcgauuaucaccgaggauuccgaccugcucgccuuuggaugcaagaaagucauucugaagauggaucaguucggcaacgggcuugagaucgaccaagcucgccugggaauguguagacagcucggcgauguguuuacagaagagaaauuccgguauaugugcauucugucugggugugacuaccugagcucccuccgcggaaucggccuggccaaggcuugcaaagugcuuagacuggccaauaaccccgauaucgucaagguuauuaagaaaaucggccauuaucucaagaugaauauuaccgugccugaagacuacaucaacggguuuauucgggccaauaacacauuccuguaccagcuuguguuugaucccaucaaacgcaagcugaucccucucaaugcuuaugaggacgacgucgauccggaaacccugagcuacgcgggacaguauguggacgauucuauugcccugcaaaucgcucucggcaacaaagacauuaauacguucgagcagaucgaugacuacaaccccgauaccgccaugccugcccacuccagaagccacucuugggacgauaagacaugucagaaguccgcuaauguuagcucuauuuggcaucggaacuauucccccagaccugagagcgggaccguguccgacgcgccccaacugaaagaaaacccgucuacagucggaguggagcgcguuaucagcaccaagggccuuaaucugccucggaaauccagcaucgugaagagaccccgcucugccgaacucuccgaggaugaccugcuuagccaguacucucugagcuuuacgaaaaagacaaagaaaaacuccucugaagggaauaagagccucuccuucagcgaggucuucgugccugaccuggucaacggacccaccaauaaaaagucuguguccacacccccucggaccagaaacaaauuugcuaccuuccugcagcgcaagaaugaggaaagcggcgccguuguggucccgggcacacggucuagauuuuucugcuccagcgauuccacggacugcgugucuaacaagguuagcauucagccccucgaugagaccgccgugacagacaaagaaaauaaccugcacgaguccgaauauggggaucaagagggaaagcgccuugucgacaccgauguggcucggaauagcagcgacgauaucccuaacaaucauauucccggcgaccacaucccugauaaagccacaguguuuaccgacgaggaauccuacagcuucgagucuuccaaguuuacgagaacaauuucucccccgacccuggggacccuccgcucuuguuucuccuggagcggaggccugggggauuuuucucggacaccuagccccuccccuagcaccgcucugcagcaguucagacggaaaucugacucccccacaagccuuccugaaaacaauauguccgacguuucucagcucaagagcgaggaguccucugaugacgaaagccacccccugcgcgaggaagccugcuccucucaaagccaggaguccggcgaauuuagccugcagucuuccaacgcgagcaaacucucucaguguuccagcaaggauucugacuccgaggagagcgauugcaacaucaagcugcuugacucccaaagcgaucagacgucuaaacugagacucagccauuucuccaagaaagacaccccgcugcggaauaaggucccuggacuguacaaaucuagcuccgccgauucucuuagcacaaccaagauuaagccccucggccccgcuagagccuccgggcugucuaaaaagccugcuagcauccagaaacgcaagcaccauaacgccgaaaauaaaccgggacugcagaucaagcucaacgagcuguggaagaauuuuggcuucaaaaaguucuga

SEQ ID NO: 69001 - RNA, 2685 nt, Artificial Sequence
  derived and/or modified sequence opt5 from EXOC1__Homo_sapiens__NP_001020095
augaccgccaucaagcacgcucugcagagagacauuuucacacccaacgaugagcggcuccugagcaucgugaaugucugcaaagccggcaagaaaaagaaaaacuguuuucuuugcgcgacgguuaccacagaacgcccugugcaagugaaggucgugaagguuaaaaaguccgacaaaggggauuucuacaagagacagauugcuugggcccugcgggaccucgccguggucgaugcuaaagacgccaucaaggagaauccggaauuugaucugcauuucgagaagauuuauaaauggguggcuucuagcaccgccgaaaagaacgcguuuaucuccuguaucuggaaacuuaaucagcgcuaccugagaaagaaaauugacuucguuaacgugucuagccagcuccuggaggaguccguccccucuggagaaaaucaaagcgugacaggcggggaugaggaaguggucgacgaguaucaggagcugaacgcccgggaagaacaggauaucgaaauuaugauggagggaugcgaauacgcuaucuccaaugccgaggcuuuugccgagaagcucagccgcgaacugcagguucuugacggcgcgaacauucaaucuaucauggccuccgagaaacaggugaauauucugaugaagcuccuggaugaagcucuuaaggagguggaccagaucgaacugaaacucagcucuuaugaggagaugcugcaguccgucaaggaacaaauggaccagaucagcgagucuaaccaccugauucaucucuccaauaccaacaaugugaaacugcuuagcgaaaucgaguuccugguuaaccacauggaucucgccaaggggcauauuaaagcucugcaggaaggagaccuugccuccucuagaggcaucgaggccuguacaaacgcugcggaugcccugcuccaaugcaugaauguggcucugcggccuggccacgaccugcuccuggccgucaagcagcagcagcaacgcuuuagcgaucuuagagagcuguucgcccggcgccucgcuucccaccugaacaauguguuuguucagcaggggcaugaccagagcucuacccuugcccaacacuccguggaacugacgcuccccaaccaucacccuuuccacagagaucugcugcgguacgcgaagcucauggaguggcugaaaagcaccgacuauggaaaguacgaaggccuuaccaaaaauuacauggauuaucugucucgccucuacgagagagagauuaaggacuuuuucgaagucgcuaaaaucaagaugacagggacaaccaaggagagcaaaaaguucgccacgcugccccggaaagaauccgccgugaagcaggagacagaaucucugcauggaagcuccggcaaacuuaccgggagcacaucuucccucaacaagcugagcguccagucuuccggaaauagacgcagccaguccucuagccugcucgauaugggcaacauguccgcuucugaccuggacguggccgaucggaccaaguuugacaaaaucuucgagcaaguucuuagcgagcuggaaccucucugucuggcugagcaggauuuuauuuccaaguucuuuaaacugcagcagcaccaaagcaugccgggcaccauggccgaagcggaggaccuugaugggggaacacucucuagacagcauaauugcggcacgccccugccuguguccagcgaaaaggacaugauccgccagaugaugauuaaaaucuuccgguguauugagcccgagcugaacaaucucaucgcccugggggauaagaucgacucuuuuaacucccuuuauaugcuggucaaaaugagccaccauguguggaccgcucaaaauguugauccugccucuuuccucagcacaacccugggaaacgugcuggucacagugaagagaaauuuugacaagugcauuuccaaccagauccgccagauggaagaggugaaaauuagcaagaaaucuaagguuggcauccuucccuucgucgcugaauuugaggaguucgccgggcucgcggaguccauuuuuaaaaacgccgagcggagaggagaucuggacaaggcuuacaccaagcugauccgcggcguguucgugaaugucgaaaaaguggccaacgagagccagaagacgccgcgggauguugugaugauggaaaauuuccaccacauuuuugcuacacucuccagacugaaaaucucuugucuugaggccgagaagaaagaagccaagcaaaaguauaccgaccaucugcagagcuacgucaucuauucccucggccagccucuggagaaacugaaccacuucuuugaagggguggaggcucgcguugcgcagggcauucgggaagaggaggugucuuaccaacuugccuucaauaagcaggaacucagaaaagucaucaaggaguaccccggaaaagaagugaagaaggggcuggacaaccuguauaaaaagguugauaaacaucucugcgaggaagagaaucugcuucagguggucuggcacagcaugcaggacgaguuuauucggcaauacaagcacuucgaaggacugaucgcucgcugcuauccuggcuccggggugaccauggaguuuacaauucaggauauccucgacuacuguucuagcaucgcccagucccauuga

SEQ ID NO: 69002 - RNA, 2775 nt, Artificial Sequence
  derived and/or modified sequence opt5 from EXOC2__Homo_sapiens__NP_060773
augagcagaucccggcagcccccucuggugaccggcaucucuccgaacgaggggauucccuggacaaaggucacgauccgcggagaaaaucucggcaccgggccuacagaccugauuggacuuaccaucugcggccacaacugucugcucacagccgaguggaugagcgcuuccaaaauuguuugcagaguggggcaagccaagaaugauaaaggagacaucaucgugaccacaaagucuggcggccgggggaccagcacggucuccuucaaacugcuuaagcccgaaaagauuggaauccuggaucagucugcgguguggguugacgagaugaacuacuaugauaugcgcaccgacagaaauaaaggcauuccuccccucagccugcggccugcuaacccgcuggggaucgaaauugagaaguccaaauuuagccagaaggaucucgagaugcuguuccauggaaugucugccgacuuuacauccgaaaauuucagcgccgcuugguaccuuaucgagaaccacucuaauaccuccuuugaacagcugaaaauggccgugacaaaccucaagcgccaagcuaauaagaaaagcgagggcucucuggccuaugucaaagggggacuuuccaccuucuuugaggcgcaggaugcccugagcgcuauucaucagaaacucgaagccgacggcacggagaagguggaaggcuccaugacacagaaacuggagaacguucugaauagagcuucuaacaccgccgauacacucuuccaagaagugcuggggcggaaggacaaagcggauagcacccgcaaugcccuuaacguccugcagagauuuaaguuccucuuuaaccugccccuuaauaucgagcggaacauccagaagggagacuacgacguggugauuaaugauuaugagaaagcuaagucccuguucggcaaaaccgaaguccagguuuuuaagaaauacuaugccgagguggaaacacgcaucgaggcucucagagaacugcugcucgacaagcugcuugagacgccuagcacccugcacgaucaaaagcgguacauucgcuaccucucugaccugcaugccuccggggaucccgccuggcaguguaucggagcucagcacaaauggauucuucaacugaugcacagcugcaaggagggcuaugugaaagaccucaaggggaacccuggacugcauucucccaugcuggaucucgacaaugauacaagaccgagcguccugggccaccuuucccagaccgcgucucugaaacggggcagcuccuuccagagcgggagagacgauacauggcgcuacaagaccccucaucggguggccuucguugaaaagcucacgaaacuggugcugucucagcuucccaacuuuuggaagcucuggaucuccuaugucaauggaagccuguucucugagacagcugaaaaauccggccaaaucgagagaagcaagaacgugcgccagcggcagaaugacuuuaaaaagaugauucaggaaguuaugcacucccuggugaagcucaccagaggggcccugcuuccucugucuauccgcgacggagaggccaaacaauacggcgggugggaggucaagugugaacucagcggccaguggcuggcucacgccauucagaccgugcggcugacacaugagucccuuaccgcgcucgaaauccccaacgaucugcugcagacaauucaagaccucauccuggaucuuagaguccgcugcgugauggcuacgcugcagcacaccgccgaggagaucaaacggcucgccgaaaaggaggacuggauuguugauaaugaaggacugacaucucugcccugucaguucgagcagugcaucguguguagccuucaaucccucaaaggcguccuggaaugcaagccuggggaggcuagcguguuucagcagccgaaaacccaagaggaaguuugucagcugucuauuaacaucaugcaaguguucauuuauugccucgagcagcuguccacaaagcccgacgccgauaucgacaccacgcaucuuagcgucgaugugucuuccccugaccuguuuggaagcauucacgaagauuucucucucaccagcgagcagagacugcugaucgugcuuuccaauugcuguuaccucgaacgccauacauuucugaacaucgcugagcacuucgagaagcacaauuuucagggcauugaaaagaucacccagguuagcauggccucucugaaggagcucgaccagcggcuguucgaaaacuauauugagcuuaaagcggaucccaucgucgggucccuggaaccuggaauuuacgccggcuacuuugacuggaaggacugccuucccccgacaggggugagaaacuaucugaaagaggcucuggugaauaucaucgccguccaugcugagguguucaccauuagcaaggaacuuguuccucgggugcuguccaaggucaucgaggccgugucugaagaacucagccgccugaugcaauguguuuccucuuucagcaaaaacggcgcgcuccaggccagacuggagauuugcgcucuccgggauacgguggccgucuaccugacacccgaauccaagucuagcuuuaaacaggcucucgaggcccugccucagcuguccagcggagccgacaagaaacuucuggaggagcuccugaauaaguucaagucuuccaugcaccuccaacugaccuguuuucaggcugcgagcucuacaaugaugaaaaccuga

SEQ ID NO: 69003 - RNA, 2241 nt, Artificial Sequence
  derived and/or modified sequence opt5 from EXOC3L1__Homo_sapiens__NP_848611
auggacagcgccgcuaaggaugagaugcagcccgcccuguccccuggcccggaauggcccgagcaagaaagagcggagcagcucgcucgcggggccgcccugaaaugggcuucuggaaucuucuaccggccugaacagcuugccagacugggccaguaucggagccgcgaggugcaaagaaccugcucccucgagucucggcuuaagagcgucaugcaguccuaccuugaagggguucagacaggaguguggcagcuggcucaagccauugaggugguccagggcacgcgcgaagcgcucucucaggccagagggcugcugcagggaaugagccaagcucuccagacccuggagccccuucgggagcgcguggcccagcacaaacaacugcaggcucucucccaucugcuuccuagacugcgggccguucccgcggccgugagccacacacagacccucaucgacggccagcaauuucuggaggcuuaugucucucugcgcgaacucgaacagcugagagaggauacaugggccccucuuggcgggcuggaacucccgguguuccagggacuggaccuucuguuugaggcucucggccaggccguugaggccgcugcgggggccgcuggaaagcuggcccgggaagaucccgcccugcucguggcugccguccgcguggcggagguggaaaccggcagaacaaccccucuggggcaagucccccgggacuggagacagcgcugucuucgggcucugcaggagggacucgaacaggcccauuucggcuccccucugcuucccgccccgggcgcucugccuggguggcucgaggcccugagaguugcucugcccguggagcucgccacggcggaagcccugguggcuccuugcuguccuccccaauacaacgucgugcagcuuugggcccacacccugcauagcggacuccgccggucucugcagaaucugcuugcuggccccgagcucgaagccgcggaugccuuugcucugcugcacugggcccuccacguuuaucuggggcaggagaugaugggaucccuugaacugggcccggaggcugacgugagccaacucgagccccugcugacacuugaaaacauugagcagcucgaagccaccuucgucgccaauauccaggcuucugugucccaauggcugcagaacgcgcuggauggggagguugccgaguggggaagagaacauggcccuaauacagaccccagcggcuccuacuauucuccuaugcccgcuauugugcuccagauccuggaggaaaacauccgcgucgccagccuuguguccgagagccugcagcaacggguccacgggauggcccucucugaacugggaaccuuucugagauccuucagcgaugcucuuauucgcuuuucucgggaccauuucagaggcaaaagcauggccccgcacuacgugccuuaccuccuggcggcucugaaucacaaguccgcccucucuagcuccguuagcgugcugcagcuugauggggcccccucuggagcucuggccccugucgaggcggcucucgacgagcugcagcgccggaucuauagacuggugcuugaagcccuccaggccgagcugcaaccccuguuugcugaccucccuucccggcaguggcugagcucucccgaacuucugcaguccguuugcgagcgcacgggcagauucugucgggauuuuuggagagugcgcaacccgacaguccagcuccugcuggccgaagcugagcgggccguggugcuucaauaccugagcgcgcucaugcaggggagacugguuugccgcggcgccgacgagagaacccaggcugccgaacggcuccgccaugaugcugcccaacugcagcagcuuuuccugucccucggacuggaggaaaaugcccacugugcuccuguccugcuugcgcugagagagcuccugaaccuccgggaccccgcccugcuuggccuggaaguggcugggcuccgccagcaauuccccgaugugucugaggaccaugucagcgcccugcugggacuuagaggcgaucugucccgggagcagcaccucgccgcucugucuagccuccaggccgcgcugccuccgagcccccgcgcuuccagacgggugcuguuuucucugguuccugcccccgcccuggcuccugccuccugccuccccagcgggucuugugcgcgcgcucugcuucuggccgaauga

SEQ ID NO: 69004 - RNA, 1230 nt, Artificial Sequence
  derived and/or modified sequence opt5 from EXOC3L2__Homo_sapiens__NP_612635
auggccgcucuggagaacggcgaacucgggccccugcuuagcccuggaacccugagaggccucgaggacgaaugcgugacagaugucaaggcccagacgcgggcggcucugcuucgcguucugcaagaggacgaggaacacugggggucccucgaggaucagccgucuagccuggcccaggacgugugugaacugcucgaggaacauaccgagagagcuccccggaucucccaggaguucggagaacgcauggcccacugcugucugggcgggcuugccgaguuucugcaaucuuuccagcagagaguggaacgguuucaugagaauccugcuguccgcgaaaugcuccccgauacauacauuagcaaaaccaucgcccuggugaacugcggaccuccccuuagagcgcuggccgagcggcucgcucgcguuggcccuccggaguccgaacccgccagagaggcuucugccagcgcgcuggaccacgugacacggcugugucaucgcgucguggccaaucuccuguuccaggaacuucaaccucacuuuaacaagcugaugagacggaaauggcucuccagccccgaggcucuggauggcauuguugggacccuuggagcccaggcucuggcccuccgcagaaugcaggacgaaccuuaucaggcccugguggcugagcugcaccggagagcgcucgucgaguacgugcgcccccugcuucggggcagacugcgcuguucuuccgcccggacaagaagccgcguggcugggcggcucagagaagaugccgcccaacugcagcgccuuuuccggagacuggagucucaggcuuccuggcucgacgccgucguuccgcaucuggcggaagugaugcaacuggaggauaccccuagcauccagguggaagucggagugcucguucgcgacuaucccgauauucggcagaagcacguggcugcccugcuugacaucagaggccugcggaauacggccgcucgccaggagauccucgccgucgcuagagaccuggagcugucugaagagggggcccuuuccccuccccgggauagagcguuuuucgccgacauucccgugccucgcccgagcuuuugccucucccugccccuguuccucggacggcugccucuuucuagacuggcucgccccagccucgccugccugccuagaccccggccgccuucccuggcucgccccagagcccaacgguga

SEQ ID NO: 69005 - RNA, 1422 nt, Artificial Sequence
  derived and/or modified sequence opt5 from EXOC4__Homo_sapiens__NP_001032203
auggccgcugaggccgcgggcgggaaguacagaagcaccguguccaaaucuaaggaccccagcggacugcucaucuccgucauucggacacugucuacgagcgaugacguugaagaucgcgagaacgaaaaaggcagacuugaggaggcuuaugaaaagugcgaccgggaucuggacgagcucaucgugcagcacuacaccgaacugacaaccgccauucgcacauaucaauccaucaccgagagaauuacaaauucucggaacaaaaucaaacaggugaaggaaaaucuucugagcuguaagaugcuccugcauugcaagcgcgaugagcugagaaaacucuggaucgaggggauugaacacaagcauguccugaaccuucuggacgagaucgaaaauauuaaacaggugccucagaagcucgagcaauguauggccuccaagcacuaccugagcgcuaccgauaugcuuguuucugccguggaaucccuggagggaccgcuccugcaggucgagggccugagcgaccuccggcuggaacuucauucuaaaaagaugaaccugcaccucgugcugaucgaugagcuucaccgccaucuguauauuaaauccacgagcagaguugugcagcggaauaaggaaaaagggaagaucucuucccucgucaaagacgcuagcgugccccugauugaugugaccaaccugccuacaccccgcaaguuccucgacaccucccacuacucuacagccggaagcuccagcgucagagagaucaaucugcaggacaucaaggaagaucuugagcuggacccugaggaaaacucuacccucuuuaugggcauucugaucaaaggccuugcgaagcugaaaaagauucccgagacgguuaaagccaucauugaacggcucgagcaagaacugaagcagaucgugaagcgcuccacaacccagguggcugauagcggguaucagagaggagagaaugucacaguggagaaccaaccucggcugcuccuggaacuucuggagcuccuguucgacaaauuuaaugccguugcugccgcgcauucugugguccugggcuaccuucaggauaccgugguuaccccgcucacacagcaagaagacaucaagcuguacgauauggccgacgugugggucaaaauucaggaugugcugcagaugcuccugacggaguaucuugacaugaagaacaccagaacagcuagcgagcccuccgcccagcugucuuacgcuagcaccgggcgcgaguucgccgccuuuuucgcuaaaaagaagccucaacggcccaaaaauucccucuuuaaguucgaaucuagcucccacgcgaucagcaugucugccuaucugagagaacagcgccgggagcuguacuccagaagcggagaacuucagggcuga

SEQ ID NO: 69006 - RNA, 2127 nt, Artificial Sequence
  derived and/or modified sequence opt5 from EXOC5__Homo_sapiens__NP_006535
auggccaccacagcugagcuguucgaagaacccuuuguggccgacgaauacaucgagagacucgucuggcggacgccuggcgggggaagccgcggcgggccggaagcguucgaucccaagagacugcuugaggaguuuguuaaccacauucaggaacugcaaaucauggacgagcggauucagcgcaaaguggaaaagcucgagcagcagugccaaaaagaggcuaaggaguucgccaaaaaggugcaggagcugcagaaguccaaucaggucgccuuucaacauuuccaggaacuugaugagcacaucucuuauguggcuaccaaaguuugucaucugggagaccagcucgaaggcgugaacacaccuagacagcgggccgucgaggcucaaaagcugaugaaauacuuuaaugaguuccuggauggggaacucaagagcgacguguuuaccaacuccgagaaaauuaaggaagccgcggauaucauccagaagcugcaccuuauugcccaggagcugcccuucgaccgcuuuucugaaguuaaaagcaagaucgcuuccaaauaucaugaucucgagugccaacugauucaggaguucacaucugcccagagacggggagaaaucagccgcaugagagagguggcugccguccuucugcacuuuaagggcuacucccacuguguggacguguauauuaaacagugccaagaaggcgcguaccuccggaaugauaucuucgaggacgccgggauucugugucagcgcgucaacaagcagguuggagauaucuucagcaauccugaaaccgugcuggcuaaacucauccagaacguguuugagauuaagcugcaaucuuucgucaaggagcagcuugaagagugcagaaaauccgacgccgaacaguaucugaagaaucucuacgaccuguacacacggaccacgaaccuuagcucuaaacugauggaguuuaaucucggcaccgauaagcagacauuccuguccaaacugaucaagagcauuuuuaucucuuaucucgagaacuacauugaaguggagaccggguaucugaagucccgcagcgcuaugauccuucaaagauacuaugacuccaaaaaucaucagaagcggucuaucggaacaggcgggauucaggaucugaaagaaagaauccgccagcggaccaaccucccccugggaccuagcauugacacgcacggcgagacauuccuuucccaagaaguuguggucaaucugcuccaggagaccaagcaggccuuugagagaugucaucgccugagcgauccgucugaccugccccggaacgccuucagaaucuuuacaauucucguggaguuccugugcaucgaacacaucgauuacgcucuugaaaccggccuggcggggauuccuuccagcgacucucgcaacgccaaucucuauuuucuggauguugugcaacaggcuaacaccaucuuccaccuguuugacaaacaguucaaugaucaucuuaugccccucauuagcuccucuccuaagcugagcgagugucugcagaagaaaaaggaaaucauugagcaaauggagaugaaacucgacacaggaaucgaccggacgcugaacugcaugauuggccagaugaagcacauccuugccgccgaacagaaaaagaccgauuucaagcccgaggacgaaaauaacguccugauccaguacacaaaugcuugugugaaagucugcgccuacgugagaaagcaaguugagaaaauuaagaacuccauggaugggaaaaauguggacaccguccucauggaacugggagugcgcuuucaucggcugaucuaugagcaccuucagcaguacagcuauucuugcaugggcgggaugcucgcgauuugugauguugcugaguacagaaagugcgccaaagacuucaagaucccgauggugcugcaucuguuugauacacuccacgcccuguguaaccuucuggucguggcuccugacaaucucaaacaggugugcuccggagaacaacuggccaaccuggauaagaauauucuucacagcuucguucagcuccgcgcugacuaucggucugccagacuggcgcggcauuuuuccuga

SEQ ID NO: 69007 - RNA, 2055 nt, Artificial Sequence
  derived and/or modified sequence opt5 from EXOC7__Homo_sapiens__NP_001013861
augauucccccucaggaggccagcgcuagacggcgcgaaaucgaggacaagcugaaacaagaagaggaaacccucuccuucaucagagauucucuggaaaagagcgaccagcuuacaaagaacaugguguccauucugucuagcuuugagucccggcucaugaagcuggaaaauucuaucauuccgguccacaaacagacggagaaccuucagcgccugcaagaaaauguugagaagacccucagcugccuggaucaugugaucuccuacuaucacguggccagcgacacagagaagaucauuagagaaggccccaccgggcggcuggaggaauaccucggaucuauggcgaaaauccagaaggcugucgaguauuuccaggauaacuccccugacagccccgaacugaauaaagugaaacuucuguuugagcgcggcaaagaggcccucgaaucugaguucagaucccugaugacacggcauagcaagguugugucuccuguccuuauucuggaucucaucuccggggacgaugaccuggaagcccaggaggaugugacccuggaacaccuccccgagagcguucugcaagacgugauucgcaucuccagauggcuugucgaguacggacggaaccaggauuuuaugaauguguauuaccagauucgcucuagccagcuggacagauccaucaagggccucaaagaacauuuccacaagucuagcuccagcucuggggugccuuauagcccggcuauccccaacaaacggaaggacacaccuaccaaaaagcccgucaaacgcccuggaacgauuagaaaggcccaaaaucugcuuaagcaguacucccagcacggccuggauggcaaaaagggagggucuaaccucaucccccuggagggccgggacgauaugcuggacguugaaaccgaugcuuacauucauugugugagcgccuuugugaaacucgcgcaauccgaguaucagcugcuugccgacaucauuccggaacaccaucagaagaaaacauucgauagccugauccaggacgcucucgaugggcugaugcuugagggagagaauaucgucucugccgcuagaaaggccauugugcgccacgacuuuuccaccguucugacaguguucccuauccuccggcaccugaagcaaaccaaacccgaauuugaucagguccugcagggcacggcggccagcacaaagaacaaacucccugggcugauuaccucuauggagacaaucggagcuaaggcccuugaagacuucgcugacaauauuaaaaacgaucccgacaaggaguacaauaugcccaaggauggcaccgugcaugagcugaccuccaacgccauccucuuucugcagcaacugcuugacuuccaggaaacagccggcgcuaugcucgcgagccaggagacguccucuagcgccaccuccuauucuagcgaguucuccaaaagacugcugagcacauacaucugcaagguucucgggaaccugcagcuuaaucugcucucuaaauccaagguguaugaggauccugcucugagcgccauuuuucugcacaacaauuacaacuauauccuuaaaucucucgaaaaguccgagcugauucaacuggucgccgugacccagaagacagcugagcgcagcuaccgggaacauaucgagcagcagauucaaaccuaccagagaucuuggcucaaagucacggacuauaucgccgaaaagaaucugccgguguuccagcccggaguuaaacuucgcgauaaggagcggcaaauuaucaaagaaagauuuaagggcuucaacgacgggcuggaggagcucuguaaaauccagaaggcgugggcuauuccugauacagaacagcgcgaccggaucagacaggcccaaaagaccauugugaaagagaccuacggagccuuucugcagaaguucggcagcguccccuuuaccaaaaauccugaaaaguauaucaaauacgggguggagcagguuggagauaugauugaccgccuguucgauacauccgcuuga

SEQ ID NO: 69008 - RNA, 957 nt, Artificial Sequence
  derived and/or modified sequence opt5 from EXOG__Homo_sapiens__NP_001138936
auggccaucaagagcauugcuuccagacugcggggcucucgcagauuccucagcggguuuguggccggagcggucguuggcgcugccggggccggacuggcugcccuucaguucuuucggucccaaggcgcugagggggcccugaccggaaaacagcccgacggcgaugcggaccgcaagcacugcaaauucaagccugauccgaacauucccccuacauuuucugccuucaaugaagacuacgugggcagcgggugguccagaggacauauggcucccgccggcaacaauaaauuuucuagcaaggcuauggccgagacguucuaucucuccaacaucgugccucaggauuuugacaauaacagcggguacuggaaucggaucgaaauguauugucgcgagcugaccgaaagauucgaggaugucugggugguuucuggaccccuuacacugccucagacccggggcgacgggaagaaaauuguguccuaccaagucaucggagaggauaacguggcgguuccgagccaccucuauaaggugauccuggcccgcagaucuuccgucagcacagaaccccuggcucucggcgccuuuguggugccuaaugaggcuauuggcuuccagccccagcugaccgaauuucaggucucucuucaagaccuggagaaacucuccgggcugguuuucuucccucaucuugaucggacaagcgacauccgcaacauuugcuccguggauaccuguaagcugcucgacuuucaggaguucacgcuguaccugucuaccagaaaaaucgaaggagcccggagcgugcuccgccuggagaagauuauggaaaaucuuaagaacgccgagaucgaacccgacgauuauuuuauguccagauacgagaaaaagcuggaggaacucaaagcuaaggagcagagcggcacacagauucggaaaccgucuuga

SEQ ID NO: 69009 - RNA, 588 nt, Artificial Sequence
  derived and/or modified sequence opt5 from EXOSC1__Homo_sapiens__NP_057130
auggcucccccugugagauacugcaucccgggcgagcggcuguguaaccucgaagaggggagccccggauccggcaccuauacacgccacggguacauuuucucuagccuggccggaugccuuaugaaguccucugaaaauggcgcccugccugucguuagcguggugagagagacggaaucccagcuccugcccgacgucggggcgaucgugaccuguaaaguuucuagcauuaacucccgguuugcuaaggugcauauccuuuaugucggaagcaugccucugaaaaauucuuuccgcggcacaauuagaaaggaggaugugcgggccaccgagaaagacaagguugaaaucuacaaguccuuucgccccggcgauaucgugcucgccaaagucauuagccugggggacgcucaaucuaacuaucugcucacaaccgccgagaaugaacugggagugguggucgcucacuccgagagcggcauccagaugguuccuauuucuuggugcgagaugcaguguccgaagacacauaccaaagaguucagaaagguggcccgggugcagcccgaauuucuucaaacguga

SEQ ID NO: 69010 - RNA, 804 nt, Artificial Sequence
  derived and/or modified sequence opt5 from EXOSC2__Homo_sapiens__NP_001269637
auggccauggagaugagacugcccguggcucggaagccucucagcgaacgccugggcagagacaccaaaaagcaccuugucguuccgggggauacaaucacgaccgacacaggauucaugcggggccaugggaccuacaugggagaggaaaaacugauugccuccguggcgggcucuguggagcgcgucaacaagcucaucugcgugaaagcucugaagacaagauauauuggggaaguuggagauaucguggucggccggauuaccgaggugcagcaaaagcgcuggaaaguugagacaaauagcagacuugacuccgugcugcuccugucuagcaugaaccugcccggcggggaacuccggcgcagauccgccgaggaugaacuggccaugcggggauuucuucaggagggcgaccugaucucugggguccucguccaggugagcccuucccuggugaagcgccagaaaacccacuuccaugaucuucccuguggagcuagcguuauccugggcaauaacggguuuauuuggaucuacccuacgcccgagcacaaggaagaggaagccggaggcuucauugcuaaucucgagccugugucucuggccgacagagaagugaucucccggcugcgcaacugcauuaucagccucgucacccaaagaaugaugcuguaugauacaucuauucuuuacuguuaugaggcgucccugccgcaucagaucaaagacauccucaagcccgagauuauggaagagaucgugauggaaacccggcagagacugcuugagcaggaaggcuga

SEQ ID NO: 69011 - RNA, 495 nt, Artificial Sequence
  derived and/or modified sequence opt5 from EXOSC3__Homo_sapiens__NP_001002269
auggccgagcccgcuagcguggccgcggaaucccuggcuggcucuagagcccgggccgcucgcaccguccucgggcagguugugcugccuggagaggaacuucugcucccggagcaagaagacgccgagggccccgggggagcuguggagagaccucugagccuuaacgcccgggcgugcucccgcgucagagugguuuguggccccgggcugcggcgcugcggagauagacuccuggugacaaaguguggccggcugcgccacaaagaaccuggcucugggagcggaggcggggucuacuggguggacucccagcagaagagauauguucccgugaaaggagaucaugucaucggcauugugacggccaagucuggggacaucuucaaaguggaugucggaggcagcgagccugcuucccucagcuaccugucuuuugaaggcgccaccaagcggaaucgcccgaacguucaggcuauuuccagcagacuuuga

SEQ ID NO: 69012 - RNA, 738 nt, Artificial Sequence
  derived and/or modified sequence opt5 from EXOSC4__Homo_sapiens__NP_061910
auggccggccuggagcuccugagcgaccagggguacagaguggauggacggcgcgcuggcgaacuuagaaagauccaagcccggaugggggucuucgcgcaggcugacggauccgccuauauugagcagggcaacaccaaagcccuggcuguuguguacgggccccacgaaauccgcggaucuagagcccgggcucucccugaucgcgcccuggugaauugccaguauagcuccgcgacauuuucuacgggcgagagaaagcggcgcccgcauggcgacagaaaaagcugugaaauggggcuucaacugcggcagaccuucgaggccgcuauucucacacagcugcacccccgcucccagaucgauauuuacguccaagugcugcaggccgacggaggcaccuaugcugccugcguuaacgcggccacacucgcugugcuggaugccgggaucccuaugagagacuuugucugugcuugcucugccggauucguggauggcaccgcccuugcugaccugagccauguugaggaagcggccgggggaccccagcucgcucuggcccuucugccugccuccggccagaucgcucuccuggagauggaugcccggcugcacgaagaccaucucgagcgcgugcuggaggcggcugcccaagccgcuagagauguccacacacuucuggaccggguggugagacagcacguccgcgaagccagcauucuccugggcgacuga

SEQ ID NO: 69013 - RNA, 708 nt, Artificial Sequence
  derived and/or modified sequence opt5 from EXOSC5__Homo_sapiens__NP_064543
auggaggaagagacccacacagacgccaagaucagagcugaaaacggcacggggagcucuccccggggaccuggcugcucccugcgccauuucgccugugagcagaaucuccugagcagaccggauggguccgcgucuuuucuucaaggagacaccagcgugcuggcuggcgucuacgggcccgccgaaguuaaaguguccaaggagauuuucaacaaagccacacucgaggugauccugcggccuaagauuggacuucccggcgucgcugaaaaaucucgcgagagacugauccggaauaccugcgaagccgugguucucggcacacugcacccucgcaccagcauuacagugguccuccaggugguuuccgaugcugggagccugcuggccuguugccuuaacgcggccuguauggcucugguggacgccggaguccccaugagagcucucuuuugcggcguggccugugcgcuggauucugacgggacccuugugcuggauccuacguccaagcaggagaaggaggcccgggcuguccucaccuucgcccuggacagcguugaacgcaaacugcucaugucuuccacaaagggacuguauagcgauaccgagcuucagcaaugccuggcugccgcccaggcugcgucucagcauguguuuagauucuaccgggaaucccuccagcgcagauauagcaaauccuga

SEQ ID NO: 69014 - RNA, 819 nt, Artificial Sequence
  derived and/or modified sequence opt5 from EXOSC6__Homo_sapiens__NP_478126
augcccggcgaccacagacggauccgcgggccugaggaaagccagccgccccaacuguacgccgcugaugaggaagaggccccuggaaccagagaccccacacggcuccgcccuguguaugcgagagcuggccugcuuucccaggccaaggggucugccuaccuggaagcuggaggcacgaaaguccucugcgccguuagcgggccccggcaggcugagggaggcgagcgcggcgggggaccugccggcgccgggggagaagcgccggcugcccugagaggccggcuucugugugauuuccgcagagcucccuuugccgggcggcgcagacgggcgccucccggaggcugcgaggaacgcgagcucgcccuggcucugcaggaggcccucgaaccugcugugagacugggccgguaucccagagcccaacuugagguguccgcccugcuccuggaagacgggggaucugcucuugcggccgcucugaccgccgccgcucucgcccuggcggaugcuggcgucgagauguacgaccuggugguuggguguggacucagccuggccccgggcccugcccccacauggcuucuggauccuacccgccucgaagaggagcgggcugccgcugggcugacaguggcccuuaugcccguccugaaccagguggcgggacuccugggcuccggcgaagggggacugaccgagucuugggccgaagcuguuagacucggccuggaggggugccagcgccuuuaucccgugcugcagcaaagccucguccgggccgcuagacgccggggagccgcggcccagccuuga

SEQ ID NO: 69015 - RNA, 876 nt, Artificial Sequence
  derived and/or modified sequence opt5 from EXOSC7__Homo_sapiens__NP_055819
auggccagcgugacccuguccgaggcugaaaaggucuacaucguucacggcgugcaggaggaccucagaguggaugggcggggaugcgaagacuaucgcugugucgagguggaaacagauguugugucuaacacgagcggcuccgccagagucaaacuggggcauaccgacauucuugugggaguuaaggcggagaugggcacacccaaacuggagaagccuaaugaaggguaccucgaguucuuuguggauugcucugcuagcgccaccccggaguucgaaggacggggcggcgacgaucuggggacagagaucgccaacacccuuuaucgcauuuuuaauaacaaauccucugucgaccugaagacacucuguaucagccccagagaacacugcugggugcuguacguggauguccugcuccuggaguguggaggcaaucuuuucgacgcuauuuccaucgccguuaaggcugcccuguuuaacacccggaucccucgcgugagagugcucgaagaugaggaagggagcaaagacauugagcugucugaugaccccuaugacugcauccggcuuuccgucgagaaugugccuuguauuguuacgcugugcaagaucggauaccgccauguggucgaugcgacccuccaagaagaggccuguagccuggcuucucugcucguguccguuacaagcaaaggcguggugaccugcaugagaaaggucgggaaaggaucucuggaccccgaauccauuuucgagaugauggaaacaggcaagcgggucggcaaggugcuucacgccagccugcaguccguugugcauaaagaggagucucucgggccuaagcgccagaaagucggauuucugggcuga

SEQ ID NO: 69016 - RNA, 831 nt, Artificial Sequence
  derived and/or modified sequence opt5 from EXOSC8__Homo_sapiens__NP_852480
auggccgcuggcuucaagaccguggagccccuggaauacuauagacgguuucucaaagagaacugccgcccugacgggagagaacugggagaguuccggacaacgaccgucaauaucggcagcauuuccacagccgaugggucugcgcuuguuaagcugggaaacaccacagugaucuguggcgugaaagcugaauuugccgccccgagcaccgacgcucccgauaagggguacgucgugccuaauguugaccugcccccucucugcuccucucgcuucagaagcggacccccuggcgaggaggcccagguggcuucccaauuuauugccgaugucaucgaaaacucucagauuauccagaaagaggaccuuuguaucagcccgggcaagcugguguggguucucuauugcgaucugauuugucuggacuacgaugggaauauccucgacgcgugcacauucgcccugcuugcugcccugaagaacgugcagcuccccgaagucaccauuaaugaggagacggcucuggccgaagugaaccuuaaaaagaaauccuaucugaauauccggacccacccuguggcgaccagcuuugccgucuucgaugacacacuccugauuguugaucccacaggagaggaggaacaucuggcuaccggcacgcucacaaucgugauggacgaagaggggaagcuguguugccuucacaaaccuggaggcucugggcugaccggagccaagcuccaagacuguaugucccgcgcugugacaagacauaaggaggucaaaaagcugauggaugaagugauuaaaagcaugaagcccaaauga

SEQ ID NO: 69017 - RNA, 5970 nt, Artificial Sequence
  derived and/or modified sequence opt5 from EXPH5__Homo_sapiens__NP_055880
augaccaaggugcccccugccuucgacuuuagcuuccugaacgaugaggaagcuagaaaaauccuccagguccuggagcggaacgaagaacuucagcgcgccgaaaaggacagaauuuccaaacugcagaagaccaaacgggauauccgcuggcuccagggcguuacgggggagugguuugaggaaauucagagaaagaaguucugcaacgagaccgacgugucucagaugcugaaacagccgcuuacauaccggcugagcaaggaaauggcgaaaaaugaucccaucgagcucccuaccucccgcucuaagaacgugaccaaucagaaaaagcccaccccuuuuagcuccagaaugucuuuccggagcuccuuugcuagccuguucucuuuucgcaaguccggaaaagagaccagcaagcugcccucucucggccagaaagggugugacggacacgccggcccucccaugcccgucagaggggccgcugugcaagccaagauuuauaacuccccucuggaaaaucaccuuguugauagcaccuucgugcccaaaccugcugucaugcgggaggaaucuggaaugcccccgccuugggacgccucccugcucgagaacgaauuuuuccaggugcuggaugaccuugauagcaagcuggcgcaggagcaguccgccucuagcguuaauacgcgcacaccccucaacuacggcuccagaacacaauuuggccacuucuauagcucugggaaucggcauggaaacaucaccgagcgccacaaaaagcauuacaaugaaacauccaacaugagcaucuaugacauucugagaccuggcacaccccgggagggguucaagacguuuucucccagaacaagcaccaucuacgauauguaucgcacacgggaaccuagaguguucaaagaggacuacguccagaagaauaccuuuggauccaccucucugugcuucgacagccgccagcgguccgcucucccggccacaggccacuuuacggcuagaagccugcacuuccccgccaccacacaaucuaaauccggguuuauuccuccccgccaucagcagagcccuaagcggacaccccuuucuuccaucauuuggaacagaagcgauuccucucgcgaccgggaaaaccaggaggaguuccugagagcgccgagcccuauggaaaucgaucccgccgacaaauacguguauccucgcggauuucaagagaauaagcgguacgaauccuaucacucucagaacguguaccagagagucagccucaaugcucccauggagaacgccauguccccugauacauucgaaaauagcgagaacaugcccuuuuaucaucagucuaauaccuucacgcgguccuuuuucagcaacacauucggccgcucuggcgagcaaagacgguuugggcagggaccguucuggggccaggaaaaggggcacuccuuuuggagcgacuuccacagaucucgcaaguccuuuuccagcucugaucgggacuucgagaugauuuccauggaagcuaauagcguuuccgccauccauggacacaacgugucuagcgagcauugggaguccuuuucuagcggcuacgggaccgauguguccagaggacaggaagaaccucaccccuggcaauucgacuuucagcgcucuacccuggauagcauggucgugucccauggcaaugaaacacagcuuacaccccacuucggcacaccuaacguuuguagcaugacggggucuuccuaucacgugaaguccucugagcuggucucccagcaagacagcucuccgguggaaguucauaucaauaaagaggccuccagcuuuggaauugcucagacccucgcguccagcuucaagacaucuuuuagccagaucuccgacgauagacggaacccccaaucuccuaaucugcagaaccccaccgugacacugcagaaaauuuucccuaacaagcccgccagccacccuaugcgcucccauaccgaggucacggugaccucuagcaauuccgucgacucucucccccuggcuaagagccagccgaacauccuugugacagaaguuaauaacgagaaagaucugaaugaauccauuagcgaggaagacaagcaacucucuaaaauggaucagaccaacaaggccggcgagaucccucagcccgugucccagacagggaucagcaauucucugccugacuuccaaaacccccuuucccaggauagcgccaaauccaauggauuuggcuucaacgcuucuaccauuaucagcuccaaaaagagcccgagagucuuuucucggaaagacacguccaagauguacauuccucacacagauaaaagcaaugacaucaagcaggauaaacgcuucaccgagaacagaaagcuggggucuacagccagccuccccuuuauucaggaacaccggaccccucccuccuucccccgcaccgaccaaggcugccaucaggagcugacagugaauaacgaagauaucucuagaaucauuacgaauaaccacuggagcuccgcgcugaccgacacacagaacgcucaauacucuaaauguaagcucaccccuggacauaagacaagcugcgacucccuggaucuuagcucugccgcccugccggacuccagccccuccaaaaauucuagccucgaugcuccuguugugcccuccaccacggucuuuucucggcgcagcccuuccgacaaggaucccagccugggcgagagagaagagaaagacaacgccgggaagaaucagaaaaaccaguucaucgugucucacuccgagaaucaggaacggaacgauagcccugugccgacacaugacgagguugucgaugugaagugucacucucacucccccuuuagaaaugaacgcggaaagggcaaaauucggcaucacaucagcugcauugagaagcugucuaaaaccgagagcaucuccgugccuaccucugaccauagaagccuuauugaagcuaaccaauccaauagcaaggucuccgagcucgauacaaucuauuguacccugccccgcaaaucuagcuccuuccugauccacgggcggcagucuggaagcaagauuauggccgcgucccucagaaacggcccucccccguuucagaucaagaauaacguggaagacgccauggggaauuacaugcugaacaaauucucuccuagcucccccgagagcgcuaaugaaugcucuaagguucuuuccgauagcgcccuggaggcucccgaggccacagaacgcaugacgaacgugaaaucuuccggcagcaccucuguccggaagggaccucuccccuuccugauuaacagagcgauguccuguccuagcggcgagccgcaugccuccacagggcgcgaaggacggaaaaagccccugaccagcggcauggacgcuucugagcuuacaccuagagccugggaacggaucauuagccccguggaguccgacucuagcguucgcgauugcucccucaccaagagacagcaccaaaaagagaauuuucaggaauauacggagaaggaagggaaaauggcugccucucggcgcagcguguucgcccuguccaacgaggacccucugcccuuuugcucugaucucagcggaaaggaaagaggcaaaacccugcacaaggucaaaacaaccuccacauucagcgugucuggggacgaggauaauguuaagugucuugagguggucuccaucuacuauacccugccgcggaagccuagcaaaaaguuuugcaaccuccugcagcaguacacacaaaauaccaaccugcuuaucgaaucuccccagguggagacggaaacauucccuaaugcucucgagaaagacaagcagaacuauuccaccagagagcagagcggcacccccuccugugaaaaucugaaaaugucugugaacagcgaucaaacacugaccacggagaauaugacagcguuucgccucuccaaccggggaccucuggcccccacccuucaggaaauggcuagcgucgaggccgccguuucucugccggaagaggaguccaaggcuagagaaauuuucagcgacaaucucgccaagacaccucugggcgauucugagaacaaaaaggaacgcgggaaaaagcugcagagcgagacccuucauacaucccucaugcugcaacggaaaaaugugucugaagaaaagagcgagaacugccagcaguccaucaauucuagcaacuccggacccagcucucugcccgcgcucuccgaagugaacauuggcaauagccagaccagacgcuccucuugggaguguacggggagcggacgggcuaucccuuuuaccggcuccgggaagugcccgcaaaaagaccacacaucuaccgccgucggcgauggaagcuccggcagccagcccagagaagggcgcggagacauuggcacaaacugucagaagaugaccaauaaaacgcugucucauuccgagagccagguguucgcccuuaccccugcucugcacaagcuccaacugggggaagagacccagucugacgagcccaaccuggaaucccuucagagcgagccuagagaacugccccagcggucucaagaggccaauaugacagagucccgcaaagcggaagaugagaugcaaaagagcgcuugggaccagccuucucucccggaaggaaacaagaauaaaaccaaccuggaugaccucguuaagggcgagaauagaagcuccgugaaacaccggcuggccgccaugagcaaggcuucccgcaaauuucccgccaaggaugucucuccuagacggcauguggcuaccaucuucccccaaagcggcuccagaucuggguuugaccaccuuagccugggaacaguugaaugcaacccucucuuccccgagccgacgccuaaguccgccgagucuaucggcgaaagccgccuguccgagaaugggaaacaugugaagaaaagcgaaaaccugcuucccauuaccguccugcccaaucgggagccuucuacacacguguccaaccaaaagagcaauucuaucucccagagacaucagaacgaguucaaaaacguuagcgagucucccuccaagcacgagaauagcaaagaugugaccgcggcccaaaaccucguccgcgaaucuggagcuccuuccccgauuacauuuaccagccugcgggaggccgaguucagcgacaaucagagacggcucagcccucccuuuccccuggagccugcucagaagucucgcgugagcagcccccuugccucuuuccugcagcaacagagaagcgccuccucucucgaaugggagccggagccucaccuguaccggagcaagucccugaaaagcaucaacgugcauggcgaucuucugcgcaagucucaucccccuaaagucagagaacggcauuuuuccgagagcacgucuauugacaaugcucucucccgccugacacucgggaacgaguucagcguuaauaacggauacuccagacgguuucgcucuuucagcgagcugcccuccugugauggcaaugagucuugggcguauagaagcggcaccaagaccgggccucgguccgccaucagcaucuacagacccauugacuauggaaucuuuggcaaagaacagcagcuugcuuuccuggagaacgugaagcgcucucugacacaagggcggcucuggaagccguccuuucugaaaaauccuggauuccuuaaggaugaccugagaaauccgcccaauccuagcgaaucucucagcuccaacucuccgagcucccaggugcccgaggacggccugagcccuucugaaccccucaauauuuacgaggaugacccugucgauuccgacugcgauaccgacacaacgaccgaugacgaguauuaccuggaugaaaacgacaaagagagcgaacuuuga

SEQ ID NO: 69018 - RNA, 2241 nt, Artificial Sequence
  derived and/or modified sequence opt5 from EXT1__Homo_sapiens__NP_000118
augcaggccaagaaaagauacuucauccugcucagcgcuggcuccugccuggcccuucuguuuuauuucgggggacuccaauuucgggcgucucgcagccacuccagacgggaggaacauucuggccgcaacgggcugcaccaucccagcccugaccacuucuggccgagauuucccgaugcccuucggccuuucgugcccugggaccagcuggagaaugaagauuccucuguccauauuagcccucgccagaagagagacgcuaacuccagcaucuacaaaggaaagaaaugucggauggagucuugcuuugauuucacccucuguaagaagaauggcuuuaaaguuuauguguacccccagcaaaagggggagaaaauugccgaauccuaucagaacauccuggcugccauugagggaagccgcuucuacacaucugacccuucccaggcuugccuguuugugcucagccuggauacgcuugacagagaucagcugucuccgcaauauguccacaaucuccgguccaaggugcagagccugcaccuuuggaacaauggccgcaaccaucugaucuucaaucucuacuccggcaccuggcccgacuacacagaagauguuggguuugacaucggacaggccaugcuggcgaaagccucuauuagcaccgagaacuucagaccuaauuucgauguguccaucccccuguuuagcaaggaccacccucggacaggcggggaacgcggauuccucaaguuuaacaccauucccccgcugagaaaauauaugcuugucuucaagggcaaacgguaccugacagggaucggaucugacaccagaaaugcucucuaucaugugcacaacggcgaggauguugugcugcuuacgaccuguaagcacggcaaagacuggcagaagcauaaagauucccgcugcgaccgggauaauacagaguacgaaaaguaugacuacagagagaugcugcacaacgccaccuuuugucucgucccucgcgggcggagacugggcagcuuccgcuuucuggaagcucuccaagccgcgugcgugcccgugaugcugucuaacggaugggagcuuccuuucagcgaagucauuaauuggaaccaggccgcuguuaucggggaugagcggcugcuccugcagauucccuccacaaucagaucuauccaucaagacaagauucuugcccugcgccagcagacccaguuucucugggaggcuuauuucagcuccguggagaaaaucgugcugacgacacuggaaauuauccaagaucggauuuuuaagcacaucagcagaaauucucucaucuggaacaaacaucccggaggccuguucguccuuccucaguacuccagcuaccugggggacuuuccguauuacuaugccaaucucggacugaagcccccuucuaaauucaccgccgugauucacgcuguuacaccccuggugucccagagccagccuguccuuaagcuccugguggcggccgcuaagucccaauacugugcccagaucauuguucuguggaacugcgauaaaccccucccggccaagcaccgcuggccugcuaccgccgugcccgucguggucaucgaaggcgagucuaaagugaugagcucccgguuccugccuuaugacaauauuaucaccgacgcgguucuuucucuggaugaagacacagugcucagcacgaccgaggucgauuuugcuuucacaguguggcaguccuuucccgagagaaucguuggcuacccugcccggagccauuucugggacaacucuaaggaacgcuggggguauaccuccaaauggacaaaugauuacagcauggugcugaccggagccgcuauuuaccacaaguauuaccauuaucuguacucucacuaucuucccgccucccucaagaacauggucgaccagcuggcuaauugugaggauauccugaugaacuuucucgugagcgccgugacgaaacugccgccuauuaagguuacacagaaaaagcaauacaaagaaaccaugaugggccagaccucuagagcgagccggugggccgaccccgaucacuucgcucagagacaauccugcaugaauacauuugccagcugguucggguauaugccccuuauccauucucagaugcgccuggacccuguccucuuuaaggaucagguguccauucugcggaagaaauacagagacaucgagcgccuguga

SEQ ID NO: 69019 - RNA, 2256 nt, Artificial Sequence
  derived and/or modified sequence opt5 from EXT2__Homo_sapiens__NP_000392
augagcugcgccuccggcucugggggaggccugagacacccccuccggugucagaagccuugggacgaggaaugcgaggaagaggcugugugugucaucaugugcgccagcguuaaauacaacauucgcgggccggcgcugauccccagaaugaagaccaaacaucggauuuauuacaucacacuuuucuccauugugcugcucggacugaucgcuacgggcauguuucaauucuggccucacucuaucgaaagcuccaaugauuggaacguggagaagcgcucuauuagagacguccccgugguucggcuuccugccgauagccccaucccugagcgcggggaccuguccuguagaaugcauaccugcuuugauguguaucgguguggauucaauccgaaaaacaagauuaaggucuacaucuaugcccucaaaaaguacguggacgauuuuggcguuagcgugucuaauacaauuucccgcgaauauaacgagcugcugauggcuaucagcgacucugauuacuacaccgacgauauuaauagagccugccucuucguccccuccaucgacgugcugaaccagaauacacuucggaucaaagaaaccgcucaggccauggcgcagcugagccgcugggauagaggcacaaaccaccuccuguuuaauaugcuuccugggggacccccugacuauaacaccgcccuggacgugccccgggaucgcgcucuccuggccggcgggggauucucuacguggaccuacagacaaggcuaugacgucuccauuccgguuuacagcccucuguccgcugagguggaucuccccgagaaggggccuggaccccggcaguauuuucugcuuucuagccaggugggccugcaucccgaauacagagaggaccucgaagcccugcaggucaaacacggcgaguccgugcuuguucuggauaaguguacaaaucucagcgaaggggugcugucuguccgcaagcggugccacaaacaucaaguguucgacuauccucagguucugcaggaggcgaccuuuugugugguccucagaggagcccgccugggccaggcugugcuuuccgauguccugcaagccgggugcgugccgguugugaucgcugacagcuacauucuccccuucucugagguccuggauuggaagcgggccagcgugguugugccugaagagaaaauguccgacgucuacucuauccuucagagcauuccccagagacaaaucgaagagaugcagcgccaggcccggugguuuugggaggcuuauuuccaguccaucaaggcgauugcccuggcuacacuccaaaucauuaacgauagaaucuacccuuaugccgccauuagcuacgaagaguggaaugaucccccggcugugaaauggggaucuguguccaacccucuguuccugccccucaucccuccccagagccagggcuuuaccgccaucguucugacguaugaccgcgucgaaucucuuuuccgggugauuacagagguguccaaggucccuagccuguccaaacuccuggugguuuggaacaaucagaacaagaaucccccggaagacucucuguggccuaagaucagagugccccuuaaagucgugcgcaccgcggagaacaagcucagcaaucgguuuuuccccuacgacgaaauugagacagaggcuguucuggccaucgaugacgauauuaucaugcugaccuccgacgaacuccaauuuggguaugagguguggagagaguucccugaucggcuggucggauacccgggccgccuucaccugugggaccaugaaaugaacaaauggaaguacgagucugaauggaccaaugaggugagcaugguucucacaggcgccgcuuuuuaucacaaauacuucaacuaucuguacacguauaagaugcccggggauauuaagaauuggguggacgcccacaugaacugcgaagauaucgcuaugaauuuucuggucgccaacgugaccggaaaagcggugaucaaggucacaccucggaaaaaguucaaaugucccgagugcaccgccauugacggccuuucccucgaucagacacauaugguugaaagaagcgaguguaucaauaaguuugcuucuguguucgggaccaugccucugaagguggucgagcacagagccgaccccgugcuguacaaagacgauuuuccugaaaagcucaaauccuuccccaacauuggaagccuguga

SEQ ID NO: 69020 - RNA, 1014 nt, Artificial Sequence
  derived and/or modified sequence opt5 from EXTL2__Homo_sapiens__XP_011539298
augagaaccuggaacagcggcgggacaaagugcugucacaucugcaaacugcccggacgggugaugggcauucgcguccucagacugucccuuguugugauccuggugcuccugcuugucgccggggcucugacggcccuccugccuucugugaaggaggacaaaaugcugaugcuccggcgcgaaauuaagagccagggaaaauccaccauggauucuuucacacugaucaugcaaaccuacaauagaacagaccuucugcucaagcugcuuaaccauuaucaggcgguuccgaaucugcacaaggugauugucguguggaacaauaucggcgagaaagcucccgaugaacucuggaacagccuggggccucaucccaucccuguuauuuuuaagcagcagaccgccaaucggaugcgcaacagacugcaaguguuccccgagcucgaaacaaauguccugaugguggacgaugacacccuuaucuccacgccugaucugguguuugccuucucugucuggcagcaguuuccggaccagauuguuggauucgugccccggaaacacgugagcaccuccagcggcaucuacucuuauggcuccuuugagaugcaagcuccugggagcggaaacggcgaucaguacucuaugguccucauuggggccuccuucuuuaauagcaaguaucuggagcuuuuccagcgccagcccgcugccgugcaugcgcugaucgacgauacacaaaacugugacgauauugccaugaauuuuaucaucgcuaaacacauuggaaagaccucuggcaucuucguuaagccugugaacauggacaaucucgaaaaagagacaaacuccggguacagcggaauguggcacagagccgaacaugcucugcagcgguccuauugcauuaacaagcuggucaauaucuacgacucuaugccccuccgcuacagcaacauuaugaucucccaguuuggcuucccguaugccaauuacaaaagaaagaucuga

SEQ ID NO: 69021 - RNA, 2760 nt, Artificial Sequence
  derived and/or modified sequence opt5 from EXTL3__Homo_sapiens__NP_001431
augaccggcuacacaaugcugagaaacgggggagccggcaaugggggacagacgugcaugcuccgguggagcaaccgcaucagacugaccuggcuuuccuucacacuguuugugauucucgucuucuuuccccugaucgcucacuauuaccuuaccacacuggacgaggccgaugaagcgggcaagcggauuuucgggccucgcguuggaaaugagcucugugaagugaaacaugugcuggaccugugcagaauccgggagucugucagcgaggaacuccugcaacuugaggcuaagcgccaggaacugaacuccgagauugccaaacucaaucugaagaucgaagccuguaaaaagucuaucgagaacgcuaagcaggaucuucugcagcucaaaaaugugauuagccaaaccgagcacuccuauaaggaacugauggcccagaaccagccgaaacugucucuccccaucagacugcuuccugagaaggacgaugcuggccugcccccucccaaagccacacggggcugccgccuccauaauuguuuugacuacagcagaugcccucugaccuccggguucccgguuuauguguacgauagcgaccaguuugucuucggaucuuaucuugauccccuggugaagcaagcguuucaggccacggcucgggccaacguuuacgugaccgaaaaugcugacauugccugucucuacgucauccuggugggcgagaugcaggaaccugugguccugcgccccgcggagcucgagaagcagcuguauucccuuccucacuggagaacagaugggcauaaccacguuauuaucaaucugagccggaaaucugacacccaaaaccuccuguacaauguguccacaggacgcgccaugguggcucagagcaccuucuauacgguccaguacagacccggcuuugaucuugugguuucuccgcuggugcacgccauguccgaaccuaacuucauggagauucccccucaaguccccgugaagcggaaauaucucuuuacauuccagggggaaaagaucgagagccugagauccucucugcaggaagcucgcagcuucgaggaggaaauggagggagaucccccugccgacuacgacgaccggaucauugccacccucaaagcuguucaggauuccaagcuggaccaagugcuugucgaauuuacaugcaaaaaccagccgaagcccagccugccuaccgagugggcgcucuguggcgaaagagaggaucgccuggagcugcuuaagcucucuaccuucgcccugaucauuacacccggcgacccucggcuggugaucuccagcgggugcgcuacgagacucuuugaagcccuggaggucggagccgugcccguugugcuuggcgaacagguccagcugccguaucaagauaugcuccaguggaaugaggcugcccuggugguuccuaaaccccgcgugaccgagguccauuuccugcuucggucucucagcgacuccgaucugcuggcgaugagacgccaggggcgguuucucugggaaacauacuucucuaccgcugacagcauuuuuaacacagugcuggccaugaucagaacccgcauccagauuccugccgcucccauccgggaggaagccgcugccgagauuccucacagauccggaaaggcggccggcacggaucccaauauggcugacaacggggaccuugaucugggaccgguggaaacagagccucccuacgccagcccccgguaucuccgcaauuucacccugaccguuacagacuuuuacagaucuuggaacugugcuccuggcccguuccaucuguuuccccacaccccuuucgaucccguccuuccuuccgaggccaaauuucucggcagcgggacaggauuccggcccaucggcgggggagcgggcgggucuggcaaggaauuucaagccgcucugggaggcaaugugccuagagagcaguuuacgguggucaugcugaccuaugaacgcgaggaagugcucaugaacucccuggagcggcuuaaugggcugcccuaccucaacaaaguuguggucguguggaauagcccgaagcugccuuccgaggaccugcuuuggcccgauauuggaguuccuaucaugguggucagaacagaaaagaacucucucaauaaccgcuuccugcccuggaaugagaucgaaaccgaggccauucugagcaucgacgaugacgcucaccucagacaugaugaaauuauguuuggcuuccggguguggcgcgaggccagagaccggaucguuggguuuccgggacgcuaucacgccugggauauuccucaucaguccuggcuguacaacucuaacuauagcugcgagcuuuccauggugcugacaggcgcugcguucuuucacaaauacuacgccuaucucuacagcuaugucaugccccaggcuaucagagacaugguggaugaauacauuaauugcgaggacaucgccaugaacuuccuggugucucauaucacccggaagccucccauuaaagucacgucccgcuggaccuuuagaugucccgggugcccucaagcccugagccacgacgauucucacuuccaugaacggcacaaguguaucaauuucuucguuaaaguguauggcuacaugccgcuucuguauacacaguuucgcguggacuccguccucuucaagaccagacugccccaugauaagacaaaaugcuucaaguuuauuuga

SEQ ID NO: 69022 - RNA, 1779 nt, Artificial Sequence
  derived and/or modified sequence opt5 from EYA1__Homo_sapiens__NP_000494
auggagaugcaggaccugaccagcccccacuccagacucucuggcagcuccgaaucuccuagcgggccgaagcugggaaacucccauaucaauucuaacagcaugacacccaauggcacggaggugaaaaccgaaccuauguccagcucugagacagccuccaccacagcugaugggagccuuaacaauuucucuggauccgccauuggcagcuccuccuuuagcccccggccuacccaccaauucucucccccucagaucuacccgucuaaccgccccuauccucauauucugcccacaccuagcucccagaccauggcggcuuacgggcagacgcaauuuaccacaggaaugcagcaggccaccgccuaugcuacauacccccagccgggccaaccuuauggcaucagcucuuacggggcccucugggcuggaauuaagaccgaaggcgggcugucccagagccagucucccggacagacgggcuuccuuagcuaugggacauccuuuucuaccccucaacccggacaggcccccuacagcuaccagaugcaaggcuccagcuucacaaccucuuccggcaucuauaccgggaauaacagccugacaaauucuuccggauuuaacagcucccagcaggacuacccuucuuauccgagcuucggccaggggcaauacgcgcaguauuacaauuccucucccuauccugcccacuacaugacgagcuccaacaccagccccacaaccccuucuacaaaugcuaccuaccagcuccaggagcccccguccggaaucacgagccaagccgucacagauccuaccgcugaguauucuaccauucauucccccagcacaccuaucaaagacucugauagcgacagacugcggcgcggcuccgauggaaagagcagagggcggggccgcagaaacaauaaccccucuccucccccggacuccgaucuggaacggguuuuuauuugggaccucgaugagaccaucauuguguuccacagccugcuuacaggcuccuacgccaaccgcuaugggagagacccucccacgucugugagccugggacuccggauggaagagaugaucuuuaaucuggcggauacccaccuuuucuuuaacgaccuggaggaaugcgaccagguccauauugaugacguguccucugaugacaauggccaggaucucagcacauacaacuucgggaccgacggauuccccgccgcugccacauccgcuaaucugugucuggccaccggcguucgcgggggcguggauuggaugagaaaacucgccuuucgguaucgcagagucaaggagaucuacaacacguauaagaauaacgugggaggccugcuugggccugcuaaacgggaagcguggcugcagcucagagccgagaucgaagcucugaccgacucuuggcuuacacuggcccucaaggcccugagccugauucacucccgcaccaauugcguuaacauccucgugacaaccacgcaacugauuccggcucuugccaaaguccugcucuacggacugggcaucguguuccccauugagaauaucuacagcgcgacaaagaucgggaaagagucuuguuuugaacggauuauccagagauucggacgcaagguggucuauguugugauuggcgaugggguggaggaggaacagggcgcuaagaaacaugccaugccuuuuuggcggaucuccagccacucugaccuuauggcccugcaccaugcucucgaacuggaguaccuguga

SEQ ID NO: 69023 - RNA, 1617 nt, Artificial Sequence
  derived and/or modified sequence opt5 from EYA2__Homo_sapiens__NP_005235
augguggagcuggucaucagccccucccucaccguuaacucugacugccuggauaaacuuaaguucaauagagccgacgcugccguguggacacugagcgaucggcagggcauuacgaaguccgcgccucuccgcgugucucaacuguuuagcagauccuguccgcggguccuuccccgccagccuucuaccgcuauggccgccuacgggcagacacaguauagcgcuggaauccaacaggccacccccuacacagcuuauccucccccugcccaggcguacggcauuccguccuauagcaucaaaaccgaagacucucugaaccacucccccgggcagagcggauuccucucuuacggcuccagcuuuucuacauccccuaccgggcaaagccccuauacguaccagaugcauggaaccacaggcuucuaccagggcgggaauggacugggcaacgccgcuggguuuggauccgugcaccaggauuauccuucuuaccccggcuucccgcaaagccaguauccucaguacuauggguccagcuacaaucccccuuauguucccgccucuuccauuugccccagcccucugucuaccagcacauacgugcuccaagaggcuucccauaacgucccgaaucagucuagcgaaucccuggccggagaguacaacacccacaauggccccagcacgccugcgaaggaaggcgacacagauagaccccaucgggccucugacgggaaacuucgcggaagauccaagcggagcucugauccuucccccgcuggcgacaacgagaucgagcgcguguuuguuugggaucuggacgaaaccaucauuaucuuccacagccuccugacagggaccuuugccuccagauauggaaaggauaccacaacgucugugcggauuggccuuaugauggaggaaaugaucuucaaucuggcugacacccaccucuuuuucaacgaccuggaggauugugaccagauucaugucgaugacgugagcuccgaugacaaugggcaggaucugucuacauacaacuuuagcgccgacggauuccacuccagcgccccgggcgcuaaucucugccugggcucuggggugcauggaggcgucgauuggaugcgcaaacuugcguucagauaucggcgcguuaaggagauguacaacaccuauaaaaacaaugucgggggacugaucggcacaccuaagagagaaaccuggcuccaacugcgggccgagcuugaagcucugacggaccucuggcugacacacucccugaaagcccucaaccugauuaauagcagacccaacugugugaaugugcuugugaccaccacacagcugaucccugcccucgcuaagguucugcuuuacgggcugggcucuguguuucccaucgagaacauuuauuccgccaccaagacaggaaaagaaagcugcuucgagcgcaucaugcagcgguuuggcagaaaggcggucuacgugguuauuggggauggaguggaggaggaacagggcgcuaaaaagcacaauaugccuuucuggcgcaucucuugucaugccgaccucgaagcccugcggcacgcucuggagcucgaauaccuguga

SEQ ID NO: 69024 - RNA, 1920 nt, Artificial Sequence
  derived and/or modified sequence opt5 from EYA4__Homo_sapiens__NP_004091
auggaggacagccaggaucugaacgaacaauccgugaagaaaaccugcacagagucugacgucagccagucccaaaauucuagaagcauggaaaugcaggaucucgccucuccccacacgcugguuggcgggggagacaccccuggcuccagcaagcuggagaaauccaaccugagcucuacauccgugaccacaaaugggaccggaggcgaaaacaugacagugcucaauaccgcugauuggcugcuuagcuguaacacgccgucuuccgccaccaugagccugcucgcggucaagacagagccccuuaauucuuccgagaccacagcuaccacgggggacggagcccuggauacauucaccggcagcgugaucacauccucuggcuacagcccucgguccgcccaucaguauagcccccagcucuacccuucuaaacccuauccucacauucuguccaccccggcugcccagaccaugagcgcuuacgccgggcagacacaauauucuggaaugcagcagcccgcgguuuacacggccuauagccagaccggccaaccuuacucccuucccacauacgaccugggggugaugcucccugcuaucaagaccgaaucuggacugagccagacacagagcccccuucaauccggcugccugucuuauuccccgggguuuagcaccccucagcccggacagacgccuuacucuuaucagaugcccggcuccagcuucgcccccuccucuacaauuuacgcuaacaauagcgucuccaacucuaccaauuuuagcggcucccaacaggauuauccuagcuacaccgccuucgggcagaaccaguaugcgcaauacuacucugccuccacauauggagcuuacaugaccagcaauaacacagccgacggcacgccgucuuccaccagcacauaucagcuccaggagucucugcccgggcugaccaaucagccuggagaauuugauacaaugcaaagccccuccaccccuaucaaggaccucgaugagcgcacguguagaagcucuggcuccaaaagccgggggcgcggaagaaagaacaaccccuccccgccucccgacucugaccuggagcggguguucguuugggaucuugacgaaaccauuaucguguuucauagccugcucacaggcuccuacgcucagaaauauggcaaggauccucccauggccgucacccuggggcuucgcauggaggaaaugaucuucaaucuggccgacacacaccucuuuuucaacgaucuggaggaaugcgaccaggugcauauugaugacgugucuagcgaugacaauggacaggaucuguccaccuacucuuuugcuacggacggcuuccacgcggccgcuagcuccgccaaccucugucugccuacaggggucagaggaggcguugacuggaugcggaaacuugccuuucgcuauagacgggugaaggagcuguacaauaccuacaagaacaaugucgggggccuccugggacccgcuaaacgcgaugccuggcuucaacugagagcggagaucgaaggccucacagacagcuggcugaccaacgcucugaagucucucuccauuaucagcacccggucuaauugcauuaacgugcuggugacaacgacccagcuuaucccggcccuggccaaaguucuccuguauucccuugggggagcuuucccuauugagaauaucuacagcgccacaaagaucggcaaagaaucuuguuucgagcgcauuaugcagagauuugggcggaagguggucuaugugguuaucggagauggcguggaagaggagcaagcugccaaaaagcacaacaugcccuucuggagaauuuccagccauuccgaccugcucgcgcugcaccaggcccuggaacucgaguaccuguga

SEQ ID NO: 69025 - RNA, 9435 nt, Artificial Sequence
  derived and/or modified sequence opt5 from EYS__Homo_sapiens__NP_001136272
augaccgacaagagcaucgugauucugagccugauggucuuccacucuagcuuuauuaacggcaaaacaugcagacggcagcugguugaagaauggcacccccaaccuuccucuuacguggugaauuggacgcuuaccgagaacauuugccuggauuucuaucgcgacugcugguuucucggggucaauacaaagaucgauaccagcggaaaccaggccgugccgcagauuuguccccugcagauccaacuuggcgacauccugguuauuuccucugaaccuagccuccaguuccccgagaucaaucugaugaacguguccgaaaccagcuuugucgggugcgugcagaauaccacaaccgaggaucagcugcuguucggauguagacugaaaggcaugcacacgguuaacucuaaguggcuuuccguggggacccacuacuuuauuacagucauggcuagcggaccuucucccugcccucugggccuccggcugaaugugaccgugaaacaacaguucugucaggagucccuuagcucugaauuuugcuccggccacgggaagugucugagcgaggccugguccaagacauauucuugccacugucagccgcccuucagcggaaaauacugccaagaacucgacgcgugcuccuuuaagccuuguaaaaacaauggcagcugcaucaacaagcgcgagaauugggaugagcaggcuuaugaaugugucugccaucccccuuucaccgggaaaaacuguucugagauuaucggacagugccaaccccacguuuguuuucauggcaauugcuccaacauuacgagcaacucuuucaucugugaaugcgacgagcaguucagcgggccguuuugugaaguguccgccaagccuugcgugucucugcuguucuggaagagaggaaucugccccaauagcuccagcgccuacacauaugaguguccuaaagggucuuccagccagaacggcgagaccgaugucucugaauuuucccucgugcccugccagaaugggacagacuguauuaagaucagcaacgauguuaugugcauuuguucccccaucuucaccgaccugcuuugcaaaucuauucaaaccagcugugaguccuuuccucugcggaauaacgcuacaugcaagaaaugugaaaaggauuacccgugcucuuguaucagcggauucacggagaaaaauugcgaaaaggccaucgaccacugcaagcuccuguccauuaacugucuuaaugaggaguggugcuuuaacaucauuggccgcuucaaauacguguguauccccgggugcaccaagaauccuuguugguuucugaaaaacgucuaucucauucaucagcaccugugcuacuguggagugacauuccacggcaucugccaggacaaggggcccgcucaguuugaauauguuuggcaacugggauucgccggcagcgagggcgaaaaaugucagggggugaucgaugcguacuuuuuccucgccgcuaauugcaccgaggacgccacauaugucaacgauccugaagacaauaacucuuccuguugguucccccaugagggaaccaaggagauuugcgcuaacggcugcagcugucugucugaagaggauucccaggaauacagauaucuuugcuuucugcggugggccgggaauauguaccucgagaacacgacagacgaucaggagaaugaaugucaacacgaggcggugugcaaggacgaaaucaaccgcccgagauguagcugcucucugagcuacauuggacggcuuugugucgugaauguugauuauugccugggcaaccauuccaucagcgugcacgggcucugucuggcccugucucauaauugcaacuguuccggccuccagcgcuacgagagaaauauuugcgaaaucgacaccgaggauugcaaaagcgcuuccuguaagaacggaaccacaucuacccaucugcggggcuauuucuuucgcaaaugcgucccuggguucaagggaacacagugugagauugacaucgacgaaugcgccagccaccccuguaaaaauggcgcuacgugcaucgaucagccugggaacuacuuuugucaaugcgugcccccuuucaagguuguggacggauuuuccugucuuugcaaucccggcuaugucgggauuagaugugagcaggauaucgacgauugcauucugaacgccugcgaacauaauucuaccuguaaggaccuccaccugagcuaccagugcgugugucuguccgauugggagggcaacuucugcgaacaagagucuaacgaguguaaaaugaauccgugcaagaacaauagcacauguaccgaccuuuauaaauccuaccggugcgaauguacaagcggauggaccggccagaacugcucugaggaaaucaaugagugugauuccgacccuugcaugaacgggggacucugucaugaaagcacgauucccggccaguuugugugccugugucccccucuguacaccgggcaguucugucaccaaagauauaaucucugcgaucugcuucacaacccgugucgcaauaacucuacaugccuggcccucguugacgcuaaucagcauuguaucugccgggaggaguuugaaggaaagaacugugagaucgaugucaaagacugccuguuccuguccugucaggacuacggcgauugcgaagacauggugaauaacuuuagauguauuugccgccccggguucagcggcucucuuugcgagaucgagauuaaugaauguuccagcgagccuugcaagaacaacggaaccuguguggaucucacaaaucgguucuuuugcaacugugaacccgaguaucacggcccuuucugcgaacuggacgucaauaaguguaaaaucucccccugccuggaugaggagaacuguguguacagaaccgacggguauaauugccucugugcgccuggauacacgggcauuaacugcgaaaucaaucuggaugagugccuuagcgaacccugucugcaugacgggguuugcaucgauggaauuaaccacuauacaugugacugcaagucuggcuuuuucgggacccauugugagacaaaugccaacgauugccucagcaauccgugucugcacggccgcugcaccgaacugaucaacgaguacccuuguuccugcgacgcugauggaaccucuacacaguguaaaauuaagaucaaugacugcacgagcauucccugcaugaacgagggcuuuugucaaaaauccgcccacggguucacaugcaucuguccucggggauacacaggcgccuauugcgaaaagucuaucgacaauugugcugagcccgaacuuaacagcgugauuugccucaaugggggaaucugugucgauggcccgggccauaccuuugacugcagaugucugccuggguucuccggacaguuuugcgagauuaacaucaacgaauguucuagcucccccugccugcacggcgccgauugcgaggaccauauuaauggguacguguguaaaugccagccuggauggagcggccaccauugugagaacgaacucgagugcauccccaauucuuguguucacgaacugugcauggagaacgagcccggguccacaugucuuugcaccccuggauucaugacguguagcauuggccugcucugcggcgaugaaauccgccggaucacaugucugaccccgauuuuucagagaaccgaccccaucucuacacaaaccuauacaauuccucccuccgagacgcuggugagcuccuucccuucuaucaaggcgacccgcauucccgcuaucauggauacauacccugucgaccaggggccgaagcagaccggaaucgugaaacacgauauucuucccacaaccggccucgccacgcugcggaucagcaccccucuggaauccuaucuccugcaagagcuuauuguuacaagagaacugagcgccaagcauucucuccuguccagcgcugacgugucuagcucccgguuccugaauuuugggauccgcgaucccgcccagauuguccaggacaaaaccucugugagccacaugccuaucagaacauccgcugccacccuuggauucuuuuuccccgaccggagagcgcgcacaccguuuaucaugucuagccugauguccgauuucauuuuuccuacccagagccuccuguucgagaacugccaaacgguggcccucucugcuacacccaccaccuccgucauccggagcauucccggcgccgacaucgagcugaauagacagucccuucugucucgcggguuucuccugauugcugccagcaucuccgcgacaccuguugugucuagaggagcccaggaagauauugaggaauacagcgcugacucccugaucagccggcgcgagcauuggagacuucugucucccuccaugagcccuaucuucccggccaaggugauuaucucuaaacaggucaccauucucaacuccagcgcucugcaccgguuuucuacgaaggccuucaaucccagcgaauaucaagccaucacagaggcuuccucuaaccagcgccucaccaauauuaagagccaggcggccgauucccugagagagcuuagccagacaugcgcuaccuguuccaugacagaaaucaaaucuagccgggaguuuuccgaccaagugcugcacucuaagcagagccauuucuacgaaaccuucuggaugaacuccgccauccucgccucuugguacgcucugaugggcgcccagacgauuaccagcggccacuccuuuagcucugcgacagagaucaccccuuccguugcuuucacagaagugcccagccuguuuccuucuaaaaaguccgccaaacgcaccauucuuuccucuagccuggaggagagcaucacgcucuccagcaaucuggaugucaaccucugccuggacaagacaugucuuucuauugugcccagccagaccaucuccucugaucugaugaauagcgaccugacauccaagaugaccaccgaugaacucucuguuagcgagaacauccugaaacuucugaagauuagacaauaugggaucacaaugggaccgacggaagugcucaaccaggagucccugcucgacauggagaaaucuaagggcagccauacccuguucaaacuucacccuuccgauagcucucuggacuuugaacugaaucuccagauuuaccccgacgucacacugaagaccuauuccgagaucacacaugccaacgauuucaagaauaaccuuccuccccugaccgggagcgugccugacuuuucugaaguuacgacaaauguggcuuucuacaccgucuccgccacccccgcgcucagcauucaaacauccucuagcauguccgugauccggccggauuggccuuauuuuaccgacuacaugacaagccugaaaaaggaggugaaaacgucuuccgaauggagcaagugggagcuccagcccucuguccaguaucaggaguuccccaccgcuagccgccaucugccuuuuacaagaucccuuacccugucuagccuggaauccauucucgccccgcaacggcugaugaucucugauuucagcugcguuagauacuacggagacuccuaucuugaguuucagaacguggcccugaauccccagaacaauaucagccucgaguuccagacauucucuuccuacggccugcuccuguaugugaaacaagauagcaaccuugucgacggguuuuucauucagcuguuuaucgagaauggaacccugaaguaccacuucuauuguccuggcgaagcuaaauuuaaguccauuaacacgaccgugcgcguugauaauggccagaaguacacacuccugauccggcaggagcuugaccccugcaacgccgagcugaccauucucgggagaaauacacaaaucugugaaucuaucaaccaugugcugggaaaaccucugcccaagagcggcuccgucuucauugggggauuuccugaucuccacggcaaaauccagaugccggugcccguuaagaacuucaccgggugcauugaggugaucgaaauuaauaacuggcgcucuuuuaucccuagcaaagcugucaagaauuaucauaucaacaauugucggucccagggauucaugcuuagccccacagccucuuuuguggacgcguccgaugucacgcaaggcguggacaccauguggacaagcguuucuccuuccguggccgcucccagcgucugccagcaggacgugugucacaacggcgggaccugccacgccauuuuccugucuuccggaaucguuagcuuucagugcgauuguccgcugcauuucaccggcagauucugcgagaaggacgcugggcucuuuuucccuucuuuuaauggaaacagcuaccuggaacuucccuuccugaaauuugugcucgagaaggagcacaaucgcacagucacgauuuaccugaccaucaaaacaaacucccugaauggcaccauucucuauagcaacgggaauaacuguggaaagcaauuccuucaucuguuucugguggaaggccggcccuccgugaaauacggcugcggaaauucucagaacauccucacaguuagcgccaacuauuccauuaauaccaacgccuucacgccuaucacaaucagauacaccacccccgucggaucuccuggcgugguguguaugauugagaugacagcugaugggaagccgcccguccagaagaaagacaccgaaaucagccacgcgucccaggccuauuuugagucuauguuccugggacauauuccugcuaaugugcaaauccacaagaaagccggccccguuuacggguuucgcggaugcauucuugaucuccaggugaacaauaaggaguucuuuaucaucgacgaagcccggcacggcaaaaacauugagaauugucaugucccuuggugcgcucaccaucucuguagaaacaauggcacaugcaucagcgauaacgaaaaucuguucugugagugcccccggcuguauuccgggaagcucugccaguucgccagcugugaaaacaauccgugcggaaacggcgcgaccugugugccuaagucugggacggacauuguuugccuuugucccuacggacgcuccggcccucugugcacagaugcuaucaauauuacccagcccagauuuagcgggacagacgccuucggcuacaccucuuuucuggccuauucccggaucagcgauaucucuuuccacuacgaguuucaccucaaauuccaacuggcuaacaaccauuccgcccuucagaauaaccugaucuuuuucacgggacagaagggccacgggcucaauggagacgacuuucuggcggugggccugcucaacgggagcgucguguauucuuacaaucuuggauccggcaucgcuagcauucgcagcgagccucugaaccugucccucgggguucauaccgugcaccugggcaaauucuuucaggaaggauggcuuaaggucgaugaccauaaaaauaagucuaucauugcccccggcagacugguggggcucaacguguucagccaauuuuaugucggaggcuacuccgaguauacaccggaucugcugccuaauggggccgacuucaagaacggauuccagggcuguaucuuuacccuccagguucggacagaaaaagaugggcacuucagaggccuuggaaaucccgagggccaccccaacgcugggcgcucugugggacaaugccaugccagcccuuguucccugaugaagugcggcaaugggggaaccuguauugaaucuggcacaagcguguacugcaacugcaccacgggcuggaaaggguccuuuuguacagagaccgucucuaccugcgacccggagcacgaucccccucaucacuguucccggggagcuacaugcaucucccugccccauggcuacaccuguuucugcccucucgggacaacgggaaucuauugugaacaggcccugagcauuucugaccccuccuuuagaagcaaugagcuuuccuggaugucuuucgcgagcuuucacgugcgcaagaaaacccacauccagcugcaguuccaaccucucgccgcugauggcauucuguuuuacgccgcucagcaucugaaggcccaguccggggacuuccucugcaucucucuuguuaacagcuccgugcagcugcgguauaaccugggagauagaacaauuauccucgaaacccugcaaaaagucacaaucaauggcagcaccuggcacauuaucaaggccggccgcgugggggcugagggauaccuugaccuggauggcauuaacguuacggaaaaggcgucuaccaaaauguccagccucgacacaaauaccgacuuuuauaucgggggagugucuagccugaaccuggucaaucccauggccauugagaacgagccggugggcuuccagggguguauccggcaggucaucauuaauaaccaggaacuccaacuuacagaguuuggagcuaagggcggcuccaaugugggggauugcgacggaaccgccuguggcuacaacacgugcagaaaugggggagaaugcacaguuaacggcaccacauucucuugucgcugccugccugauugggccgggaauaccuguaaccagagcguguccugccugaauaaccucugucugcaucagagccuuugcauccccgaccaaucuuucuccuauagcugucugugcacccucggaugggugggcagauacugugagaacaaaacauccuuuucuacggcuaaguucaugggcaauagcuacauuaaauauaucgauccuaacuaccggaugcgcaaucugcaguuuaccacaauuucccugaacuucucuaccacaaagaccgaggggcucaucgucuggaugggaaucgcccagaaugaagagaacgacuuucuugcgauuggccugcacaaucagacgcugaagaucgcuguuaaccucggggaaagaauuagcgugcccauguccuauaauaacggaacauucugcuguaauaaauggcaccauguggucgugauccaaaaccagacccugauuaaggccuacaucaauaacucucuuauucugagcgaggauaucgacccgcacaaaaauuuuguugcccucaacuaugauggcaucugcuaccucggcggguucgaauauggccggaaggugaacauugucacccaggagaucuuuaaaacaaauuucgugggcaagauuaaggacgucguguuuuuccaggagccuaaaaacaucgaacugauuaagcucgagggguacaauguuuacgauggagacgaacaaaacgaggugaccuga

SEQ ID NO: 69026 - RNA, 2244 nt, Artificial Sequence
  derived and/or modified sequence opt5 from EZH1__Homo_sapiens__NP_001982
auggagauccccaacccuccgaccagcaagugcauuacauacuggaaaagaaaggugaaauccgaauauaugcggcugcgccagcucaagagacugcaagccaauaugggcgcuaaagcccuuuacgucgcgaacuucgcuaagguucaggagaagacgcagauccugaaugaagaguggaaaaagcuccgggugcagcccgugcaaucuaugaaaccugucagcgggcaccccuuucugaagaaauguaccauugaauccaucuucccuggauuugccucucagcauaugcuuaugcgcagccugaacacaguggcccucguucccauuauguauuccuggucuccucugcagcagaauuucaugguggaggacgagaccguccugugcaacaucccguacaugggcgaugaagugaaggaggaagacgagacauuuaucgaggaacucauuaauaacuaugaugggaagguucacggagaggaagagaugauccccggcagcgugcugauuuccgacgcugucuuccuugaacugguggaugcccucaaucaauacagcgacgaggaggaagaggggcauaacgauaccucugacggaaaacaggaugacuccaaggaagaucugccugugacaagaaaacggaagcgccacgcuaucgagggcaauaaaaagagcucuaaaaagcaguuucccaacgacaugauuuucuccgccaucgcgagcauguuuccugaaaauggcguccccgaugacaugaaggagagauaucgggagcuuaccgaaaugucugacccgaacgcccugccuccccaguguacgccuaauauugaugggcccaacgcuaaauccguucaacgcgagcagagccuccauuccuuccacacccuguuuugcagacgguguuucaaguacgacugcuuucugcaccccuuccaugccacaccuaacguguacaaacgcaagaauaaagaaaucaagaucgagccggaacccuguggaaccgauugcuuccuccugcuugagggcgcuaaggaguaugccaugcugcacaacccuagaucuaaauguagcgggcggcgcagacggagacaucacauuguguccgcgagcugcucuaaugccuccgcuagcgccgucgcugaaacaaaggagggagacucugaucgcgacaccggcaacgauugggccagcuccucuagcgaagccaauucccggugucagacgcccacaaaacaaaaggcuagcccugcgcccccgcagcucugcgugguugaggccccuucugagcccguggaauggaccggggcugaggaaucccuguuuagagucuuccacggaacauacuuuaacaauuucugcagcaucgcccgccuucugggcaccaaaaccuguaaacagguguuucaguucgccguuaaggagucucucauucugaagcugccuacagacgaacucaugaaccccucccaaaagaaaaagcggaaacauagacugugggcugcccacugccgcaagauccagcuuaagaaagauaauagcuccacccagguguauaacuaccagccuugugaccaucccgaucggccgugcgacucuacguguccuugcauuaugacacaaaauuuuugugagaaguucugccaguguaaccccgacugccagaauagauuucccggcugucgcugcaaaacccagugcaacacaaagcaauguccuugcuaucuggcgguccgggagugugauccggaccucugccugaccuguggggcuagcgaacacugggauugcaaaguggucuccuguaagaauugcucuauccagagaggacuuaaaaagcaucugcuccuggcccccagcgacguggccggcugggggacguucaucaaggaguccguucagaaaaacgaauuuauuagcgaguacuguggagaacugaucucucaggaugaggcugaccgccggggcaagguguaugauaaauacauguccagcuuccucuuuaaccugaauaacgacuucgucguggaugccacaagaaaggggaauaaaauucgguucgcuaaccacucuguuaauccuaacugcuacgccaagguggucauggugaauggagaccaccgcaucggcauuuuugcgaagagagccauccaagcuggcgaggaacuuuucuuugauuaucgguacucccaggccgacgcucugaaauauguggggaucgagagagaaaccgauguucucuga

SEQ ID NO: 69027 - RNA, 2265 nt, Artificial Sequence
  derived and/or modified sequence opt5 from EZH2__Homo_sapiens__XP_005250019
augaucuacuucauuagaaucauuaugggccagaccgggaagaaaagcgagaagggacccgugugcuggcggaaacgcgucaaguccgaauauaugagacugcggcaacucaaacgcuuuagacgggccgacgagguuaagucuauguucagcuccaaccgccagaagauccuggaaagaacagagauucuuaaucaggaauggaaacagcggcgcauccaaccugugcacauccugacgucugugagcucccucagaggcacccgggaguguucugucacaagcgaucuggacuuuccgacccaggugauuccccuuaagacacugaacgcuguugccuccgugccuaucauguacagcuggucuccccuccagcagaauuucauggucgaggaugaaaccgugcugcauaacauuccuuauaugggggacgagguucuggaucaagacggaacauuuaucgaagaacucauuaaaaauuacgauggcaaggugcacggggaccgcgagugcggauucaucaacgaugaaauuuuugucgagcuggugaaugcgcuuggccaguauaacgacgaugacgaugacgacgauggcgacgaucccgaagagagagaagagaaacagaaggaccuggaggaucaucgggacgauaaggaaucccgcccuccgagaaaauuccccagcgacaagaucuuugaggcuaucucuuccauguucccugauaaagggaccgccgaggagcucaaggaaaaauacaaggagcugacggagcagcaacuucccggagcccugccucccgaauguaccccgaauauugacggcccuaacgcuaaaagcgugcagcgggagcagucucuccacuccuuucauacacuguucugcagacgcuguuuuaaguaugauugcuuccugcaccccuuccacgccaccccuaauacauacaagcggaaaaacaccgaaacggcucucgacaauaagcccugugggccccaaugcuaccagcaucuggagggagccaaagaauuugcggccgcucuuacagccgagagaaucaagaccccuccgaaacgccccggcgggcggagacgcggacggcugccuaacaauagcuccagacccucuacaccuaccauuaacguccucgagagcaaggacaccgauuccgaccgcgaagcuggcacagagacgggcggggaaaacaaugauaaggaggaggaagagaaaaaggacgaaaccucuagcuccagcgaggccaacucucggugucagacacccaucaaaaugaagccgaauauugaaccucccgagaacguugaguggagcggagcggaagccuccauguucagagugcugaucggcaccuauuacgauaauuuuugcgcuaucgcccgccuuauugggacaaaaaccuguagacagguguaugaguuccgggucaaggaaucuagcaucauugcuccugcccccgccgaggacguggauacgccuccccggaagaaaaagcgcaaacacagacugugggcugcgcauugccggaagauccaacucaaaaaggacggauccagcaaccacguuuacaauuaucagccgugcgaucacccuagacagcccugugacucuuccugccccugugugauugcccagaacuuuugcgaaaaguucugucaaugcagcucugagugucagaaucgcuuuccuggcugccgguguaaagcucagugcaacacaaagcaguguccgugcuaccuggccgucagagagugcgaucccgaccugugucugaccugcggggccgcugaucauugggacuccaaaaaugugagcuguaagaacugcuccauccaacgcggaucuaaaaagcaccuccuucuggccccuagcgacguugcgggcuggggcaucuucauuaaagaucccgugcagaagaaugaauuuaucuccgaguauuguggggaaauuaucucucaggacgaggcugauagacggggaaaggucuacgacaaauacaugugcagcuuccucuuuaaccugaauaacgauuucguggucgacgccacccgcaagggcaacaaaauuagauuugccaaucauuccgugaacccuaauuguuaugcuaagguuaugauggugaacggggaucaccggaucggaauuuucgccaaacgcgcuauccagacaggcgaggaacuuuucuuugacuacagauauagccaagccgaugcgcugaaguacgucgggaucgagcgggaaauggagauucccuga

SEQ ID NO: 69028 - RNA, 1761 nt, Artificial Sequence
  derived and/or modified sequence opt5 from EZR__Homo_sapiens__NP_001104547
augcccaagccuaucaacgugagagucaccacaauggacgccgagcuggaguucgcuauucagccgaauacgaccggcaaacaacucuuugaucagguugugaagacaaucgggcugcgggaggugugguacuucggacuucacuaugucgacaacaaaggcuuucccaccuggcugaagcucgauaaaaaggugagcgcccaggaaguucgcaaggagaauccucugcaguucaaauuuagagcgaaguucuaccccgaagacguggcugaggagcuuauucaagauaucacacagaaacuguuuuuccuccaggucaaggaagggauucuguccgacgagaucuauugcccucccgaaaccgccgugcugcucggaucuuacgccguucaggcuaaauuuggcgauuauaacaaggaggugcauaagagcggguaccuguccucugagcggcuuaucccucaacgcgucauggaccagcacaaacugacaagagaucagugggaagaccggauucagguguggcaugccgagcaccgcggaaugcucaaggauaaugcuaugcuggaauaucuuaaaaucgcccaagaccuggagauguacggcauuaacuacuucgaaaucaagaauaaaaagggcaccgaucucuggcuggggguggacgcgcugggacucaacauuuaugagaaagacgauaagcugacgccgaagaucggcuuucccuggagcgagauuagaaauaucuccuucaacgacaaaaaguuugucaucaaaccuauugauaagaaagcccccgacuucguuuucuacgcuccucggcuucgcaucaauaagcggauucugcagcucuguauggggaaccaugaacuguauaugagacgcagaaagcccgauaccaucgaggugcagcaaaugaaagcccaggcucgggaagagaagcaccagaaacagcuugaacgccaacagcuggagacagagaagaaaagacgggaaaccguggagagagaaaaggagcagaugaugcgcgaaaaggaggagcucaugcugcggcugcaggacuacgaagagaaaacaaagaaagccgaaagagagcucucugagcaaauucagcgcgcgcugcagcuugaagaggaacggaagagagcccaggaggaagcugagcgccuggaggccgaucggauggcugcccucagagccaaagaagaacuggaacgccaagcugucgaccagaucaagagccaggagcagcuugcggccgaacuggcugaguauaccgccaagaucgcccuccuggaggaagcucggagacgcaaagaggaugaaguggaggaauggcaacaccgggccaaggaggcgcaggacgaucugguuaaaacgaaggaggaacuccaucuggugaugacagcuccgccucccccucccccucccgucuacgagccgguguccuaucacguucaggaaagccuucaagacgagggagccgagcccaccggcuacucugccgaacuguccagcgaggggauuagagacgaucggaaugaagagaaacgcaucacagaagcugagaagaacgagagagugcagcggcagcuccugacccugucuuccgaacuuagccaggccagagacgagaauaaacgcacccauaacgauauuauccacaacgaaaauaugcggcaaggaagagacaaguacaagacacuccgccagauuagacagggcaacacgaaacagcggaucgaugaguuugaagcucuguga

SEQ ID NO: 69029 - RNA, 1467 nt, Artificial Sequence
  derived and/or modified sequence opt5 from F10__Homo_sapiens__NP_000495
augggcagaccccugcaccucgugcugcuuagcgccucccuggcugggcuccugcuucugggagagucucucuucauccggcgcgaacaggccaacaauauucuggcgagagucacccgggcuaacagcuuucuggaggaaaugaagaaaggccaucucgagcgcgaaugcauggaggagacauguuccuacgaagaggccagagaaguuuucgaggacucugauaagacgaaugaguuuuggaacaaauauaaggacggggaucaaugcgaaaccagcccuugucagaaucagggaaaaugcaaggacggccugggggaguacacauguaccugccuugaaggauucgagggcaagaacugugaacuguuuacacggaaacucugcucccuggauaauggcgacugugaucaguucugccacgaggagcaaaacucugugguguguagcugcgcccgcggguauacccuugcugacaauggaaaggccugcaucccgacaggccccuacccuugugggaaacagacccuggaaagacggaagcgcuccgucgcucaggccacgucuagcuccggagaggcgcccgauagcauuaccuggaaaccuuaugacgccgcugaucucgaccccacagaaaacccuuuugaucugcuggacuucaaucagacccaaccggagagaggcgacaacaaucucacacggaucguugggggacaggaaugcaaggauggcgagugucccuggcaggcccugcuuauuaacgaggaaaaugagggcuuuugcgggggaaccauccugucugaguucuacauccucacggcugcccauugucuguaucaggcgaagcgcuuuaaagugagagugggcgaccggaacacagagcaagaagaagggggagaggccguccacgaaguggagguugugauuaagcauaaccgcuucaccaaagaaacauacgauuuugacaucgcuguccuuagacugaagaccccuauuaccuuccggaugaauguggcccccgcuugccucccugagagagauugggccgaguccacacugaugacgcagaaaaccggcaucgugagcggguucggacgcacacacgaaaagggccggcagucuaccagacugaaaaugcucgagguccccuacguugaccgcaacuccuguaagcugagcuccucuuuuauuaucacacaaaauauguucugcgccggcuaugauaccaagcaggaagacgcuugucagggggauagcggaggcccgcacgugacgcgguuuaaagacacauacuucgugaccgggauugucuccuggggagagggcugcgcgagaaaggggaaauauggcaucuacaccaaggugacagccuuucuuaaauggaucgaucgcagcaugaagacccggggacugccuaaggcuaaaucucaugcccccgaaguuauuacauccagcccucucaaguga

SEQ ID NO: 69030 - RNA, 1878 nt, Artificial Sequence
  derived and/or modified sequence opt5 from F11__Homo_sapiens__NP_000119
augaucuuccuguaccaggugguccacuuuauucucuucaccagcguuuccggcgagugcgugacacaacugcuuaaggacacguguuuugaagggggagauaucaccacaguguucacccccucugccaaauauugccaggucguguguacauaccauccuagaugccugcucuuuaccuucacagcugagagcccguccgaagaccccacccggugguuuacguguguucugaaggauucugugaccgagacacuuccucgcgucaacagaaccgccgcgauuagcggcuauuccuucaaacagugcucucaccagaucagcgcuuguaauaaggacauuuacguggaucuggacaugaaagggaucaacuauaauuccagcguugccaagucugcccaagaaugccaggagcgguguacagaugacgugcauugccacuuuuucaccuacgcuacgcgccaguuucccucccucgagcauagaaacaucugucugcugaagcacacacagaccggaacaccuacccggauuaccaaacucgauaaggucgugagcggcuucucucugaaauccugcgcccuuagcaaucuggcuugcauccgcgacauuuuucccaacacaguguucgccgauucuaauaucgacuccgucauggcgccugaugccuucguuugugggagaauuugcacgcaccauccgggaugucucuuuuucaccuuuuucagccaagaauggcccaaggagucccagcggaaccugugccuucugaaaacaucugaaagcggccucccuuccacccgcaucaaaaagagcaaggcucugucuggcuuuucccugcagagcuguagacacucuauucccguguucugccauagcuccuuuuaucacgacacagacuuccucggggaggagcuggauaucguggccgcuaagucucacgaagccugucagaaacuuugcaccaaugcgguccggugucaauuuuucacguacaccccugcccaggcuagcugcaacgagggaaagggcaaauguuaccugaagcucuccagcaaugggucucccacaaaaauccugcauggacgcggcgggauuuccggauauacccuuagacugugcaagauggacaacgaaugcacaaccaagaucaaaccgcggauugugggcggcacagccagcguucgcggggaguggccuuggcaagugacgcuccacaccacaucucccacccagagacaucuguguggaggcuccaucauugggaaucaguggauccugacagcugcccacugcuuuuacggagucgaaagcccuaagauccuccggguguauuccggcauucugaaccagucugagaucaaagaggauaccagcuucuuugggguucaggaaauuaucauucaugaccaauacaagauggccgaguccggauaugauaucgcgcuucugaaacucgaaacgaccgugaauuacacagacucucagagacccaucugucugcccagcaagggcgaucgcaacgucauuuauaccgacugcugggugacaggcuggggguaccggaaacuuagagauaagauccagaacacccugcagaaggcuaaaauuccucucgucacgaaugaggaaugucaaaagcgcuaccggggacacaaaaucacacacaagaugauuugcgccggcuauagagaagggggaaaggacgcuuguaaaggcgauuccgggggcccgcugagcugcaagcauaacgagguguggcaccugguuggaaucaccucuuggggcgaggggugugcccagcgcgagcggcccggaguguacacaaaugucguggaauauguugacuggauucucgagaaaacccaggccguguga

SEQ ID NO: 69031 - RNA, 900 nt, Artificial Sequence
  derived and/or modified sequence opt5 from F11R__Homo_sapiens__NP_058642
augggcaccaaggcccagguggagagaaaacugcucugccuguucauccuugcuauucugcucuguagccuggcccuuggguccgucacaguucacucuagcgaacccgaggugcggaucccugaaaacaauccggugaagcuguccugcgcguacucuggauuuagcucuccccgcgucgaguggaaauucgaccaaggcgauacgaccagacucguguguuauaacaauaagauuacagcuuccuacgaagaccggguuaccuuucugccuacagggaucaccuucaaaagcgugacacgcgaggauaccggaacguauaccugcauggucuccgaggaaggcgggaacagcuacggagaggugaagguuaagcugauugugcucgugcccccuucuaaacccacagucaauaucccuuccagcgccaccaucggcaacagagccgugcugacauguucugaacaggacggcuccccgcccagcgaguauaccugguuuaaggaugggauugucaugccuacgaaucccaaaucuacacgggcuuucuccaacagcuccuacguucuuaauccuaccacaggagagcugguguuugacccccucucugccagcgauaccggcgaauauuccugcgaggcucgcaacggguacggaaccccgaugacaagcaaugccgugagaauggaagcggucgagcggaacgugggcguuaucguggccgcuguccuggugacgcuuauucugcucgggauccugguuuucggaauuugguuugccuacucucgcggccauuucgacagaaccaagaaaggcacauccagcaagaaggugaucuauucucagccuagcgcucgguccgaaggggaguuuaaacagaccucuagcuuccuggucuga

SEQ ID NO: 69032 - RNA, 1848 nt, Artificial Sequence
  derived and/or modified sequence opt5 from F12__Homo_sapiens__NP_000496
augagagcccugcuccugcuuggcuuccugcucgugagccuggaguccacccuuucuauucccccuugggaagcuccgaaggagcacaaauacaaggccgaggaacauacagucguucugacggugaccggggaacccugccacuuuccuuuccaguaucaucggcaacucuaccacaaauguacacauaagggacgccccggcccucagcccuggugcgcgaccacaccuaacuuugaccaggaucagagauggggguauugucuggagccgaaaaaggugaaggaccacugcagcaaacacucccccugucaaaagggagggaccugcgucaauaugccuucuggcccccauugucugugcccucagcaccucacaggaaaccauugucagaaagagaagugcuucgaaccccagcugcuucgguuuuuccacaaaaaugagaucugguaccgcaccgaacaagcugccguggccagaugucagugcaagggcccggaugcucacugccagcggcuggccagccaggcuugucgcacgaacccuugccuccauggcgggagaugucuggagguugagggacaccggcuuugccauugucccgugggcuauaccggggccuuuugcgacgucgauacaaaggcguccuguuacgacggacgcggccugucuuauagagggcucgcccggaccacacugagcggagcuccuugccaacccugggccuccgaagcuaccuaccgcaaugugacggccgagcaggcgagaaacuggggccugggcgggcacgccuucugucggaaucccgauaacgacauccgcccuuggugcuuuguucucaauagagaucggcugagcugggaauacugugaccuugcucagugccaaacaccgacccaggccgcucccccuacacccgugucuccuagacugcaugucccccucaugccggcccagccugcucccccuaaaccccagccuaccacccgcacacccccgcaaucccagacgccuggagcucugcccgcgaagcgggagcagcccccuagccuuaccagaaacggcccgcugucuugcgggcagcgccuccggaaaucccugagcucuaugacaagaguggugggaggccuggucgcccuccgcggggcucaccccuauauugccgcccuguacuggggacacuccuucugugcuggcagccuuaucgccccuugcuggguucugaccgcggcucauugucuccaagaucggcccgccccugaagaccugacaguggugcuuggccaggagagacgcaaucacuccugcgagcccugucagacccuggccguccggucuuauagacuccaugaagccuuuagcccuguguccuaccagcacgaucuggcccugcuccgccugcaagaggacgcugacgggagcugcgcccuucugucucccuauguucagccggugugucucccuuccggagcggcccggcccagcgaaacgacacugugccaggucgcuggcugggggcaccaguucgagggagccgaagaguacgcuucuuuucugcaagaggcccaggugccuuuccuuagccucgaaagauguuccgcgcccgauguucauggcucuagcauucugccggggaugcugugcgccggcuuccucgagggaggcaccgacgcuugucagggggauuccggaggcccucuggugugcgaagaccaagccgcugagcggcgccuuacccugcaggggaucaucagcuggggaucuggcugcggggauagaaacaagcccggcgucuauacagacguggccuacuaccucgccuggauucgggaacacaccgucuccuga

SEQ ID NO: 69033 - RNA, 2199 nt, Artificial Sequence
  derived and/or modified sequence opt5 from F13A1__Homo_sapiens__NP_000120
augagcgagaccuccagaacagccuucggcgggcggcgcgcugugcccccuaacaauucuaacgccgcggaagacgaucugccgacggucgagcuccagggaguugugcccagaggcgugaaucugcaagaauuucuuaacgucaccagcgugcaccuguucaaggagcggugggacacaaauaaaguugaucaucacaccgacaaguacgaaaacaauaaacucaucgugcgcagagggcaguccuuuuauguccagauugauuucucucggccuuacgacccccgcagagaucuguuucggguggaguauguuaucggacgcuacccucaggagaacaagggcacauauauucccgugccuaucgucagcgaacuucaauccgggaaauggggagcuaagauugugaugagagaggaccggucugugcgccugagcauccaguccagcccgaagugcaucgucggcaaauucagaauguacguugccguguggacccccuauggcgugcuccggacaucucgcaauccugaaaccgauacguacauucuguuuaaccccuggugugaggacgaugccgucuaccuggacaaugagaaggaaagagaggaauaugugcucaacgauaucgggguuauuuucuacggagaggugaaugacaucaaaacccgguccuggagcuauggccaguuugaagacgggauucuggauacaugccuuuacgucauggacagagcucagauggaucugucuggacgcggcaacccuaucaaggugucccggguugggagcgccauggugaaugcuaaagacgaugagggaguccucgugggcucuugggacaacauuuaugccuacggcgugcccccguccgcguggaccgggagcgucgauauccugcuugaguauagauccucugaaaacccuguucgcuacggacaauguuggguguucgccggcgucuuuaauacauuccugcggugccucgggauccccgcuagaauugugaccaacuacuuuagcgcccaugacaaugaugcuaaccugcagauggacaucuuccuggaggaagauggaaauguuaacuccaagcucacgaaggacagcguguggaauuaucacuguuggaacgaggccuggaugacacgcccugaccugcccgucggcuucgggggauggcaggcgguggauucuacaccccaggaaaauuccgacggcauguaccggugcggcccugccagcgugcaagcuauuaaacaugggcacguuuguuuucaguucgaugccccguuugucuucgcugaggugaacucugaccuuaucuauauuaccgccaagaaagauggaacccacguggucgagaauguggacgccacccauaucggcaagcugaucguuacaaaacagauugggggagauggcaugauggacaucacggauaccuacaaguuucaagaagggcaggaggaagagagacucgcucuggaaacagcgcuuauguauggcgccaaaaagccccugaacaccgagggagugaugaagucucgcuccaaugucgacauggauuucgagguggaaaacgcuguucucggcaaagacuuuaagcugucuauuacauuccggaauaacagccacaacagauacaccaucacggccuaucuguccgccaauauuacauuuuacaccggggugccuaaagcugaguucaagaaagaaaccuuugaugucacacucgagccccugagcuucaagaaggaggccgugcuuauccaggcgggagaauacaugggccagcugcucgagcaagcuagccugcauuucuucguuaccgcccgcaucaacgaaacacgggacgugcuugccaaacagaaguccacgguccugaccauuccugagaucauuaucaaagugagagggacacagguggucggaagcgacaugaccguuacaguggaauuuaccaauccccucaaggagacgcugcggaacguguggguccaccuggauggcccgggggugacccgcccuaugaaaaagauguuuagagagauucggcccaauucuacaguucagugggaagaggugugcagaccuugggucuccggccaccgcaagcucaucgcuagcauguccucugacagccugcggcauguguauggagaacuugauguucaaauucagagacgccccuccauguga

SEQ ID NO: 69034 - RNA, 1986 nt, Artificial Sequence
  derived and/or modified sequence opt5 from F13B__Homo_sapiens__NP_001985
augagacugaagaaccucaccuucaucauuauccugauuaucagcggcgagcuuuacgccgaagagaaacccugcggguuuccucacguggaaaauggacggauugcucaguauuacuauacauucaaguccuuuuacuucccgaugucuaucgacaaaaagcugagcuuuuucugucucgccggcuauacgaccgaguccgggcgccaagaagaacagacaaccugcacaaccgagggauggucucccgaaccuagauguuuuaaaaagugcacaaagcccgaucugagcaacggcuacaucuccgacgucaaacuucuguauaagauucaggagaauaugcgguacgggugugcgucuggauacaaaaccacgggcggcaaggaugaagagguugugcagugccucagcgacgggugguccagccaaccuaccugucgcaaagagcaugaaacaugccuggcucccgagcuguauaacggaaauuacucuaccacacagaagaccuucaaggugaaagauaagguccaguaugaaugugccacgggcuacuauacagccgggggaaagaagaccgaggaaguggagugccucacauacggcuggucccugaccccuaaauguaccaaacuuaaaugcagcucucugagacucaucgagaacggguauuuucacccgguuaagcagacauacgaagagggagacgugguccaauucuuuugccaugaaaauuacuaucuguccggcagcgaucuuauucaguguuacaacuucggcugguaucccgagucuccugugugcgaagggcggcgcaauagaugucccccucccccgcugccuaucaacuccaagauucagacgcacagcaccacauaccggcauggagagaucguucacauugagugcgaacucaauuuugagauccacggcuccgcugaaauccgcugugaggacgggaaauggaccgaacccccuaagugcauugagggacaggagaaaguggccugugaggagccucccuucaucgaaaacggcgcugccaaucugcauucuaagauuuauuacaacggggauaaagucacauaugcgugcaagagcggauaccugcuccacggcuccaaugagaucaccuguaacagaggcaaguggacgcugcccccggagugcguggaaaacaaugagaacuguaaacaucccccuguggucaugaauggggccguugcugacggcauucuugccagcuacgcuacaggaucuuccguggaauaucggugcaacgaguacuaucugcuccgcgggagcaagaucucuagaugcgaacaaggaaaauggagcucucccccugugugucuggagcccugcaccgucaauguggauuacaugaaccggaauaacaucgagaugaaguggaaauaugaaggcaagguucuucacggggaccugauugauuucguguguaagcagggcuacgaccucuccccgcugaccccucugagcgagcucuccguccagugcaaucgcggagaagugaaauauccccuguguacaagaaaggagagcaaaggcaugugcaccucuccuccccuuaucaagcacgggguuauuaucuccagcacaguggacacguacgaaaacggaucuuccgucgaguaccgguguuuugaucaucacuuccuggagggcagcagagaagccuauugccucgacgggauguggaccacaccuccccugugucuugagccgugcacccuguccuuuacagaaauggagaaaaauaaccuccugcugaagugggauuucgacaaucgcccucauauucuccacggagaauacaucgaguuuaucugucggggcgauaccuaucccgcggagcuguacauuacggggucuauccuuagaaugcaaugcgaccgcggccagcugaaguauccccggugcauuccuagacagagcacccucuccuaccaggaaccgcugcgcacauga

SEQ ID NO: 69035 - RNA, 1869 nt, Artificial Sequence
  derived and/or modified sequence opt5 from F2__Homo_sapiens__NP_000497
auggcccacgugagaggccugcagcuccccgggugccuggcucuugccgcgcuguguagccucguccauucccaacacguuuuccuggcuccucagcaggcccggucucuucugcagcgcgugagacgggccaacaccuuucucgaggaagugcgcaagggaaaucuggagagagaaugcgucgaggaaacauguagcuacgaggaggcuuucgaagcccuggaguccucuacggcuaccgacguguuuugggccaaauauacagcgugcgaaaccgcccggacaccgcgcgauaagcucgcugccugucuggagggcaacugcgcugaggggcuuggaaccaauuacagaggccauguuaacaucacacggagcgggauugaaugucaacuguggcgcuccagauauccccacaaaccugagaucaauucuaccacgcaucccggagccgaccuccaggaaaacuucugccggaauccugauagcuccaccacaggccccugguguuacaccacagacccuaccgugcgcagacaggagugcagcauuccggucuguggccaggaucaagugacgguugcgaugacaccccggucugaaggguccagcgugaaccugucuccuccccuugagcagugcgucccugaccgcggacagcaguaucaaggcagacuggccgugaccacacacgggcuccccugccuggcuugggccuccgcucaggccaaggcccugagcaaacaccaggauuuuaauucugcugugcaacucgucgagaacuucugucggaauccggacggagaugaagagggcguuuggugcuacguggcggggaagccuggagacuuuggcuauugugaucugaacuacugcgaagaggccguggaagaggagaccggcgacgggcuugaugaagacuccgacagagcuaucgagggacgcaccgccacaagcgaauaccagacguucuuuaauccccggaccuucggcuccggggaggccgauuguggacugagaccucucuuugaaaagaaaucucuggaggacaagacagagcgcgaacuucuggagagcuauauugauggccggaucgucgaaggguccgacgcugagaucggaaugagccccuggcaagugaugcuguucagaaaaucuccccaggagcugcugugcggcgccucccucauuagcgaucgcuggguucugaccgcggcucauugucuucuguacccuccgugggacaagaacuuuacagaaaaugaucuccuggugcggaucggcaaacacucuagaacccgcuaugagcggaacauugaaaagaucagcaugcuugagaagauuuacauccaucccagauauaacuggcgcgaaaaucuggaccgggauauugcccucaugaaacugaagaaaccugucgccuucuccgacuacauccaccccgugugccugccugauagagagacggcugccucucuccugcaggcuggguauaagggacggguuacaggcugggggaaccuuaaagagaccuggaccgccaaugugggaaagggccagcccagcguccuccagguggucaaccucccgaucguggaacgcccuguuuguaaagacuccacacggauuagaaucaccgacaauauguucugcgcgggguacaagcccgaugagggcaagagaggagacgccugugaaggcgauagcgggggaccuuuugugaugaaaucucccuucaacaaucgcugguaccagaugggcauugucuccuggggagaggggugcgaccgggauggcaaguauggguuuuacacacacguguucagacugaaaaaguggauccaaaaaguuauugaccaguuuggcgaauga

SEQ ID NO: 69036 - RNA, 1278 nt, Artificial Sequence
  derived and/or modified sequence opt5 from F2R__Homo_sapiens__NP_001983
augggccccagacggcugcuccugguggccgcuugcuucagccuuugcgggccucugcucuccgcccgcaccagagcgcggcgcccggagucuaaggcuacaaacgccacgcuggacccccggagcuuucuucugagaaauccuaacgauaaauacgaacccuucugggaggacgaagagaagaaugaauccggacucaccgaguaucgccuggucucuaucaacaaaagcuccccucugcagaagcaacuccccgccuuuauuucugaggaugcuagcggcuaccugacauccagcuggcuuacccuguucguuccuucuguguauacagggguguuugucgugucccucccgcugaauaucauggccauuguuguguucauccuuaaaaugaaggucaagaaacccgcugugguuuacaugcugcaccucgccaccgcggacgugcuguuugucagcgugcugccuuucaagauuucuuauuacuuuuccggaagcgauuggcaguucggcucugaacucugcagauuugugacagccgcuuucuauuguaacauguacgccuccauccugcuuaugaccgucaucagcauugaccgguuucuggcuguuguguaccccaugcagucccucucuuggcgcacgcuggggagagccagcuuuaccugccuugcgaucugggcccuggcuauugccggaguggucccucuccugcugaaagagcagacaauccaagugcccggccucaauauuaccacaugucaugauguucugaacgaaacccuucuggagggcuauuacgcuuauuacuucuccgccuucagcgccguguucuuuuucgucccgcucaucauuucuacggugugcuauguuuccaucauccggugucugagcucuagcgcuguggcgaaucgcuccaagaaaucuagagcccuuuuucugagcgcugccgucuucugcauuuuuaucauuuguuucgggccuacaaacgugcuccugaucgcccacuacuccuuucugagccauaccucuacaaccgaggcugccuauuucgcguaccuccugugcgucuguguguccagcauuucuugcugcaucgacccccuuaucuacuauuacgcuuccagcgaaugucagcgguauguuuacuccauucugugcuguaaggagucuagcgauccuuccucuuauaauagcuccggacagcucauggccagcaagauggacaccuguucuuccaaccugaauaacagcaucuacaaaaagcugcuuacauga

SEQ ID NO: 69037 - RNA, 1194 nt, Artificial Sequence
  derived and/or modified sequence opt5 from F2RL1__Homo_sapiens__NP_005233
augagaagccccuccgccgcuuggcugcucggcgccgcgauccugcuugcugccucucugagcugcuccgggaccauucagggaacaaaccggucuagcaagggccgcucccucaucgggaaaguggacggaacgucucacgucaccggcaaggggguuacaguggagaccguguucagcgucgaugaauuuuccgccagcgugcugacaggaaaacuuaccacaguuuuccugccuauuguguacaccaucgucuuugugguuggccucccgucuaauggcauggcucuguggguguuccuguuuagaacgaagaaaaagcaucccgccgucauuuauauggcuaaccucgcccuggcggaccuucuguccgugaucugguucccucucaagaucgccuaccacauucaugggaauaacuggaucuauggagaggcucuguguaaugugcuuauuggcuuuuucuacgggaacauguauugcagcauccuguuuaugaccugucucucuguccaacgguacuggguuauugugaaucccaugggacacucccgcaaaaaggccaacaucgcuauuggcaucagccuggccaucuggcugcucauucugcuugugacaaucccucuguaugucgugaaacagaccauuuucauccccgcgcucaauauuacaaccugccaugauguucugccugaacagcuucuggugggggacauguuuaacuacuuccucucucuggccaucggagucuuucuguucccggcuuuccucacggccuccgcuuacgugcugaugaucagaaugcuucggagcuccgccauggaugagaauagcgaaaagaaacgcaagagagccauuaagcugaucguuacagugcucgcuauguaucugauuuguuuuacccccagcaaccuucugcucgucgugcacuacuuccugaucaaaucccagggccaaagccacgucuaugcgcuguacauuguggcccucugccugucuacacuuaauuccuguaucgacccuuuuguuuauuacuucgugagccaugauuuucgggaccacgcuaagaacgcccugcucugccgcucugucagaaccgugaaacagaugcagguuagccugaccuccaagaaacauucucggaagucuuccagcuauucuuccagcucuacaacggugaaaaccuccuacuga

SEQ ID NO: 69038 - RNA, 1059 nt, Artificial Sequence
  derived and/or modified sequence opt5 from F2RL2__Homo_sapiens__NP_001243495
auggagaacgacaccaauaaccuggccaagcccacacucccuaucaaaacguucagaggcgcuccgcccaauagcuuugaagaguucccuuuuuccgcccuggaaggguggaccggagcgacaauuaccgugaagaucaaaugccccgaggaaucugcuagccaccuucaugucaagaacgccacaaugggcuaccugaccuccucucucagcacaaaacugauuccugccaucuaucuucugguuuucgugguggggguccccgcuaaugccgugacccucuggaugcuguuuuuccggacgcgcuccauuuguaccacaguguuuuacaccaaccuggcuaucgccgauuuccucuuuugcguuacacugccuuucaagaucgcguaucaccuuaauggaaacaauugggucuuuggcgaggugcuguguagagccaccacgguuauuuucuacgggaacauguauugcucuauccuccugcuugcuuguauuagcaucaaucgguaccuggccauugugcauccguuuacauaucgcggacuccccaagcacaccuacgcucuggucacaugcggccuggugugggccaccguguuccucuacaugcugccuuucuuuauccuuaaacaggaguauuaccugguccaacccgacauuaccacaugucaugauguucacaacacgugcgaauccagcucuccuuuccagcucuauuacuuuaucucccuggcguucuuuggcuuccuuauccccuuugugcugauuaucuauuguuacgccgcuauuaucagaacccucaaugccuaugaccaccgguggcugugguacgugaaggcuagccugcucauucuggucaucuucacaaucugcuuugccccgucuaacauuauccuuauuauccaucacgccaauuacuauuacaacaacaccgaugggcuguauuucauuuaccucaucgcucugugucuuggaucccugaauagcugccucgacccuuuucuguauuuccugaugucuaaaacacgcaaccauuccaccgcguaccucacgaaguga

SEQ ID NO: 69039 - RNA, 1158 nt, Artificial Sequence
  derived and/or modified sequence opt5 from F2RL3__Homo_sapiens__NP_003941
auguggggcagacugcuccuguggccccuugugcugggguucagccucuccggaggcacccagacaccuucugucuacgacgagagcggguccacgggaggcggggaugacucuaccccgagcauccugcccgccccucggggauaucccggccaaguuugcgcuaacgauuccgacacacuugaacugccugauucuagccgcgcccuccugcugggcugggugcccaccagacucgugccugcgcuguacgggcuuguccuggugguuggacucccggcuaauggccuggcccuuugggugcuggccacacaggcuccccggcucccuuccaccaugcugcugaugaaccucgccgcugccgaccugcuucuggcgcucgcccugcccccucgcauugcuuaucaccuuagagggcagcgguggcccuuuggagaggccgcuugucgccuggccacagcggcccucuacggccauauguaugggagcguccugcugcucgcugccgugucucuggauagauaccuugcucugguucacccgcuccgggcccgcgcccugagaggacggcgccuugcucugggccucugcauggcggccuggcugauggcugccgcccuggcucucccucugacccuucagagacaaacguuccggcuggcccgcuccgacagagugcucugucaugaugcgcugccccuggacgcucaggccagccacuggcagccugccuuuaccugccuugcucuccugggcuguuuccugccccuccuggccaugcuucugugcuauggggcuacacuccauacccuggccgcgucuggacggagauacggccacgcccugcgccuuacagcugucgugcucgccuccgcuguggccuuuuucguccccagcaaucugcugcuccugcuucacuacucugauccuuccccgagcgcgugggggaaccuguauggagccuacguucccucccucgcucugucuacccugaauagcuguguggacccuuuuaucuauuacuauguguccgccgaguuccgggauaaggucagagcuggccuuuuucagcgcagccccggggacacgguggccucuaaagccuccgcugaaggaggcagccggggcauggggacacauucuagccuccugcaauga

SEQ ID NO: 69040 - RNA, 6675 nt, Artificial Sequence
  derived and/or modified sequence opt5 from F5__Homo_sapiens__NP_000121
auguuccccggcugcccuagacugugggugcuggucguucuggggaccagcugggugggauggggcagccaggggacagaagccgcucaacuucggcaguuuuacguggccgcgcagggaauuucuuggagcuauagaccggaacccacgaacuccucucugaaucucagcgucaccuccuucaagaaaauuguguacagagaauaugaaccuuacuuuaagaaagaaaagccccagucuacaaucagcggccugcuugggccuacccuguaugcugaaguuggagacauuaucaaagugcacuucaagaacaaggccgacaaaccccucuccauucacccucaaggcauccgguacagcaagcugucugagggcgccuccuaucuggaccacacauuuccggcugagaaaauggaugacgccgucgcucccgggcgcgaauacaccuacgaguggagcaucucugaagauuccggaccuacacaugacgaucccccuugucucacccacauuuauuacagccaugagaaucugaucgaggacuucaacucuggccuuauugggccccugcucaucugcaagaaaggaacgcugaccgaaggcgggacacagaagaccuuugauaagcagauugugcuucuguucgccguuuuugacgaguccaaaagcuggucccagucuagcucccucauguauacagugaauggauacgucaacggcaccaugccggauaucacggugugugcgcacgaccacauuagcuggcaucugcugggcaugucuuccgggccugaacucuucagcauccacuuuaauggacaagugcuggagcagaaccaucacaaggucucugccaucacacuuguuagcgcuaccuccacaaccgccaauaugaccgugggccccgaagggaaauggauuaucucuagccugacaccuaagcaccuccaggcuggaaugcaggccuauauugauaucaaaaacugccccaagaaaacgagaaaucugaagaagauuacccgggagcaacgcagacauaugaaacggugggaguacuucaucgcggccgaagaggugaucugggacuaugcucccgucauuccugccaacauggacaagaaauaccgcucccagcaccuugauaauuuuagcaaccagaucggcaagcauuacaaaaaggugauguauacacaauacgaagacgagucuuucaccaagcacacaguuaauccgaacaugaaagaagaugggauucugggacccaucauuagagcucaggugcgggacacccucaagaucgucuucaaaaacauggccucccgcccuuauagcaucuacccccauggcgugacguuuucuccuuaugaggaugagguuaauuccagcuucacauccggcagaaacaauaccaugauucgggccgugcagcccggggaaaccuacacauauaaguggaacauccuggaguuugacgaaccgaccgagaaugaugcucagugucugacacgcccuuacuacucugacgucgauauuaugagagacaucgcgagcggacucauuggccugcuucugaucugcaaaucccggucucucgauagacgcgggauucaacgggccgcugacaucgaacagcaggccguguucgccgucuuugacgagaacaagagcugguaucuggaggauaauaucaacaaguucugugaaaaucccgacgaggugaaaagagaugacccuaaguuuuacgaauccaacauuaugagcacgaucaauggauauguucccgagucuauuaccacacuuggcuucugcuuugaugacaccgugcaguggcacuucuguuccgucgggacacaaaacgagauccugaccauucacuuuacgggccauagcuucaucuacggaaaacgccacgaagauacccucacacuguuuccuaugcggggcgagucugugaccguuacaauggacaauguggggaccuggaugcugacguccaugaacagcucucccagaagcaagaaacuccgccugaaguuccgggaugucaagugcaucccggacgaugacgaagauuccuaugagauuuucgaaccucccgagagcacagugauggcuaccagaaaaaugcaugaccgccuugagcccgaagacgaggaaucugaugccgacuacgauuaucagaaucggcuggcggcugcccucggaaucagauccuuucgcaacagcucccugaaccaggaggaagaggaguucaaucugacagcccuugcucucgaaaacggcaccgaguuugugucuagcaauaccgacauuaucguuggguccaacuacucuagcccuuccaauauuucuaaguucacagucaacaaucuggccgaaccgcagaaagcucccagccaccaacaggccacgaccgcgggauccccucugcggcaccucaucggcaagaacagcgugcucaauucuuccacagccgagcauagcucucccuacuccgaagauccuaucgaggacccccuucagccugaugugaccgggauuagacugcucagccugggcgcuggagaguuuaaaucucaggaacacgccaagcauaaaggccccaaggucgagcgggaccaagcugccaagcaccgcuucuccuggaugaaacugcuugcgcauaagguggggagacaccucagccaggauacaggauccccgagcggcaugcggccuugggaagaccugcccucucaggauaccgggagcccuuccagaaugcgccccuggaaagacccgccuucugaucugcuccugcuuaagcaaagcaacuccucuaaaauccugguuggacgguggcaccucgccagcgagaagggcuccuaugagauuauccaggacacggacgaagauacagcugugaauaacuggcugauuucuccccagaaugccagcagagcuuggggagaauccaccccucuggccaacaagcccggcaaacagagcggacaucccaaguuuccucgcgucagacacaaaucucuucaagugcggcaggacggcgggaagucccgccucaaaaagagccaguuccugaucaagacccgcaaaaagaaaaaggaaaaacauacacaccaugccccgcugucuccccggaccuuucacccucuccgcuccgaggcuuacaauacauucagcgaaagacggcugaagcacucccuuguucugcauaagucuaacgagacgagccuccccaccgaucugaaccagacacugccuuccauggacuuuggauggaucgcgagccuucccgaucacaaucaaaacucuuccaaugacaccggccaggccagcuguccuccggggcucuaucagacagugcccccugaggaacauuaccagaccuuccccauucaagauccugaccagaugcacucuacgagcgaucccucccaccgcucuagcuccccggagcugucugaaaugcuggaguaugacagaagccauaaauccuuuccuaccgauaucagccagaugucucccuccagcgaacacgaggucuggcaaacagugauuucccccgaccucucucagguuacccugagcccugagcuuucccagacaaaccugucucccgaccucagccauaccacacuguccccugaacugauccagcggaaucuuagcccggcucugggacaaaugcccauuucuccugaucucucccacaccacgcugagccccgaccucucucauacaacccugucccuugaucugagccagaccaaccucucuccugagcugagccagacaaaucugucccccgcccuuggccagaugccgcugucuccugaccucagccacaccacgcugucccucgauuucagccaaacaaaccugucccccgaacuuucucacaugacccugagcccugagcucucccagacaaaucugucucccgcccuggggcagaugccuaucagccccgaccuuucccauaccacacugucucucgauuucagccagaccaaccuguccccggaacucagccaaacgaaucugucuccugcucuuggccagaugccccugucccccgacccuagccacaccacacugucucucgaucugucccagaccaaccuuagcccggagcugucucagacaaaucucucccccgaccugagcgagaugccucucuuugccgaucugucccaaauuccccuuaccccugaccuggaucagaugacgcugagccccgaccucggagaaacagaccugucuccuaacuucggccagaugagccuuuccccggaucugucucaagugacccucagccccgacaucuccgauacaacccugcucccugaccugucucagaucucucccccucccgaucuugaccagaucuuuuacccguccgaguccagccagucccugcugcuccaagaguucaaugagagcuuuccuuaucccgaucuggggcagaugcccucuccuuccagccccacccuuaacgacacauuccugucuaaggaguuuaacccucucgucaucgugggacuguccaaagauggcacggacuacauugaaaucauuccgaaggaggaagugcagagcuccgaggaugacuacgcggaaaucgauuauguccccuacgacgacccuuauaaaaccgauguucgcacaaauaucaacucuagcagagaccccgauaauauugcugccugguaccuccgguccaacaaugggaacagacgcaauuauuacaucgccgcugaggagauuagcugggacuauucugaguucgugcagcgggagaccgauaucgaagacuccgaugacauuccugaggauacaaccuacaagaaaguggucuuuagaaaguaccuggacagcacguucacaaagcgcgauccccggggagaauaugaggagcaucuuggcauccugggcccgaucauuagagccgaaguggacgacguuauccaagugcgcuuuaaaaaccuggcgucucggccuuacagccuccacgcucacgggcuguccuaugagaagucuagcgaaggaaaaaccuacgaggaugacucccccgaaugguucaaggaggauaaugccguccagccuaacucuagcuauaccuacguguggcaugccacagagagauccggccccgaaagcccugggucugcuugccgcgccugggcuuauuacuccgccguuaaucccgagaaagacauucacagcggacuuaucggcccgcugcucauuugccagaaggggauccugcauaaggauuccaacaugccuauggacaugcgggaguucgugcugcucuuuaugaccuucgaugagaaaaagucuugguacuaugagaaaaagagcagauccucuuggcggcuuacaagcuccgaaaugaaaaagagccacgaguuucaugcgauuaauggaaugaucuacucucugcccggccugaagauguaugaacaggaguggguccgccuccaucugcuuaacaucggcgggucccaagacauucacgugguucauuuccacggacagacgcugcucgaaaauggcaacaaacagcaucaacuggggguguggccccugcucccugggagcuuuaagacccuugagaugaaagccucuaagccgggcugguggcugcugaauacagaggucggggaaaaccagagagcuggaaugcagacccccuuccucaucauggaucgggacugucgcaugccuaugggccuguccacaggcauuaucagcgauucucagauuaaagccuccgaguuucuuggguacugggaacccagacuggcucggcucaacaauggaggcagcuauaacgccuggucuguggagaagcuggccgcugaguucgcgagcaagccuuggauccaaguggacaugcagaaagaggucaucauuaccgggauccagacgcagggagccaagcacuaccugaaauccugcuauaccacagaguuuuacguugcuuacagcuccaaucaaauuaacuggcagaucuucaagggcaauucuaccagaaacgugauguauuuuaaugggaacagcgaugccuccacaauuaaagaaaaucaguucgaucccccuaucguggcccgcuacauccggauuucucccaccagagcuuauaaccgcccgacacuccggcuugagcugcagggaugugaagucaauggcugcagcacgccucugggcauggagaacgggaagaucgaaaauaagcaaauuaccgccuccucuuuuaaaaagagcugguggggagacuacugggagcccuucagagcgcgccucaacgcucagggccgggugaaugccuggcaggccaaagcuaacaacaauaagcaguggcuggagaucgaucuucugaaaauuaagaaaaucacagccauuaucacccaaggguguaagucccucagcucugaaauguauguuaaguccuacaccauccacuauagcgagcagggaguggaauggaaaccuuacagacugaagucuuccauggucgacaaaauuuucgagggcaacacaaauacgaaggggcaugugaaaaacuuuuucaaucccccgaucauuagccgcuuuaucagaguuauuccuaagaccuggaaccagucuaucgcgcugcggcucgagcuuuucggaugcgauaucuacuga

SEQ ID NO: 69041 - RNA, 1401 nt, Artificial Sequence
  derived and/or modified sequence opt5 from F7__Homo_sapiens__NP_000122
auggugagccaggcccugagacuccugugccuucugcucggccugcaagggugucuugcugccggaggcgucgcgaaggcuuccgggggagagacccgggacaugcccuggaaaccuggcccgcaccgcguuuucgugacacaggaagaggcccauggggugcugcacagacggcgcagagccaacgcuuuucucgaggaacugcggcccggaucucuggaacgcgagugcaaggaggaacaguguagcuucgaggaagccagagagaucuuuaaagaugcugagcggacgaaacucuucuggauuuccuacucugacggcgaucagugcgccagcuccccuugucaaaauggcgggucuugcaaggaccagcugcagagcuauaucuguuuuugccuucccgcguucgaaggacgcaacugugagacccauaaggaugaccagcugauuugcgucaaugaaaacggcgggugugagcaauacugcuccgaucacacaggaaccaagagaagcugccggugucaugaaggcuauucucuccuggccgacgggguguccugcacaccuaccguugaguaccccuguggaaaaaucccuauucuugagaagcgcaaugcuagcaaaccgcagggcagaaucgugggcgggaaggucugccccaaaggagaauguccuuggcaagugcugcuccugguuaacggcgcccagcugugcgggggaacacucaucaauaccauuuggguggucucugcugcccacuguuuugauaagaucaagaacuggcggaaucugauugcggugcuuggcgagcacgaccuguccgaacaugauggggacgagcagagccgcagaguggcccaggucaucauucccucuacguauguuccuggaaccacaaaccacgauaucgcucuccugcggcuucaucagcccguggugcugaccgaccacgucgugccgcucugccugccugaaagaacauucuccgagcgcacccuggccuuuguucgguucagccucguguccggcuggggccaacugcuugacagaggggcuacggcccuggagcucaugguccugaaugugccccgccuuaugacacaggauugucugcagcagucucggaaaguuggagacagcccuaacauuaccgaauacauguuuugcgccggcuauuccgaugggagcaaggacucuuguaaaggagauuccggcgggccccacgcuacacauuacagaggcaccugguaccucaccggaaucgugagcuggggccaagggugcgcgacagucggacacuucggcguguauacgcgcgucucucaguacaucgaguggcugcagaagcugaugcggagcgaacccagaccuggggugcuccugcgcgccccguuucccuga

SEQ ID NO: 69042 - RNA, 7056 nt, Artificial Sequence
  derived and/or modified sequence opt5 from F8__Homo_sapiens__NP_000123
augcagaucgaacugucuaccugcuucuuucucugucugcuuagauucugcuuuuccgccacacggcgcuacuaucugggagcuguggaacuguccugggacuacaugcagagcgaucugggggaacuucccguggacgccagauucccuccccggguucccaaguccuuuccuuucaauacgucugugguguauaaaaagacccuguuugucgaguucaccgaucaccucuuuaauauugcgaaacccagaccucccuggaugggacugcugggcccuaccauccaggcugaaguguacgacacaguugugauuacccucaagaacauggccagccacccggucucccugcacgccguggggguuucuuauuggaaagcuagcgaaggagccgaauacgaugaccagacaucccagagagaaaaggaagaugacaagguguuccccggcgggagccauaccuaugucuggcaagugcuuaaagaaaauggaccuauggcuucugauccccugugucucacguacuccuaccugagccacguggaccuugucaaggaucugaacucuggccucaucggcgcccugcugguuugccgggaagggucccucgcgaaagagaagacccagacacugcauaaauuuauucuucuguucgccguguuugacgagggaaagagcuggcacucugaaaccaagaacagccucaugcaggaucgcgacgcugccagcgcuagagccuggccuaaaaugcacacagugaacggcuaugucaaucggucccugcccgggcuuaucggaugucaucgcaagucuguguacuggcacguuaucggcauggggaccacgccggaggugcauagcauuuuccuggaaggacacacauuccucgucagaaaccaccggcaggcgucccuggagaucagcccuauuaccuuucugacagcccaaacccuccugauggaccuuggccaguuccugcucuuuugccauaucucuucccaccagcaugauggcauggaggcuuaugugaaaguugacagcugucccgaggagccucagcugcgcaugaagaauaacgaagaggccgaagauuacgacgaugaccuuaccgauucugagauggacguggucagauucgaugacgauaauagccccuccuuuauucaaauccggucuguggcuaaaaagcaccccaaaacauggguccauuauauugccgccgaagaggaggacugggacuacgcuccucuggugcucgcgccggaugaccgcagcuauaagucccaguaccugaacaaugggccccagagaaucggacggaaguacaaaaagguuagauucauggccuauacggaugaaaccuuuaaaacacgcgaggcuauccaacacgaaagcggcauucuggggccucuccuguacggagaggugggcgacacccuucugaucauuuucaagaaccaggccucucggcccuauaauaucuacccucacgggauuacagaugucagaccccucuauucccgccggcugccgaaaggagugaagcaucugaaggacuuuccuauccuucccggcgaaaucuucaaauacaaguggaccguuacgguggaggauggcccuacaaaaagcgaccccagaugccucacccgcuauuacucuuccuuugucaacauggagcgggaucuggccagcgggcugauuggaccucuccugaucuguuacaaggaauccguggaccagagaggcaaccagauuaugucugauaaacgcaaugugauccuuuucagcguuuuugacgagaaccgguccugguaucugaccgaaaauauucaaagauuccuccccaacccggcugggguccagcuggaggauccugaguuccaggccucuaauaucaugcacagcaucaacggauacguguuugacucccugcagcuuagcgugugccuccaugaagucgcguauugguacauucugucuaucggcgcucaaacagacuuccuguccguguuuuucagcggguauaccuuuaagcacaagaugguuuacgaggauacacucacgcuguuccccuuuucuggcgaaaccguguucauguccauggagaaucccggacuuuggauucugggcugucacaacagcgacuuucgcaaucgggggaugacagcccuccugaaagucucuagcugcgauaagaacaccggagacuauuacgaagauuccuacgaggacaucagcgccuaucugcuuucuaaaaauaacgcuauugagccuagauccuucagccaaaauucccggcauccgucuacacgccagaagcaguuuaacgccaccacgauccccgaaaaugauauugagaaaaccgacccuugguucgcucacagaacacccaugccuaagauccaaaacgugagcuccucugaucuccugaugcugcuccggcagagccccaccccucauggccugucccuuucugaccugcaggaagccaaguacgagacauuuagcgaugaccccuccccgggggcgaucgauagcaacaauucucucuccgaaaugacccacuucagaccucagcugcaucacagcggagacaugguuuucacgcccgagucuggccugcaacuucgccucaacgagaaacuggggacaaccgccgcuacagaacugaagaaacucgacuuuaagguguccagcaccucuaauaaccugauuuccaccaucccuagcgauaaucuugccgcuggcacagacaacacguccagccugggacccccgucuaugccuguccacuaugauagccagcucgacaccacacuguucggcaaaaaguccucuccccugaccgagagcgggggaccucuuucccugucugaagagaauaacgauagcaaacuccuggaauccggccucaugaacucucaggagagcuccugggggaagaacgugagcucuacagaguccggacggcuguuuaagggcaaaagagcccaugggcccgcgcuucugaccaaggacaaugcccucuucaaaguuagcauuucucugcugaagacgaacaaaacauccaauaacagcgcuaccaaucgcaagacccacaucgauggccccucccuucugauugaaaacucuccuagcguguggcaaaacauccucgaguccgacacagaauuuaagaaagucaccccgcugauccaugauagaaugcucauggacaagaaugccacagcucugcggcuuaaccacaugagcaauaaaacgaccucuuccaagaacauggagauggugcagcagaaaaaggagggacccauuccucccgaugcccagaauccugacaugagcuucuuuaagaugcuguuccuccccgaaucugcccgcuggauccaaagaacacauggcaaaaacagccucaauuccgggcagggaccuucuccgaagcagcuggugagccuuggccccgagaaauccgucgaagggcagaacuuucugucugagaagaauaaaguuguggugggaaagggcgaguucaccaaggacgucgggcucaaagagaugguguuuccuagcucccggaaccuguuccucacaaaucuggauaaccuucacgagaauaacacccacaaucaagaaaagaaaauucaggaggaaaucgagaagaaagaaacgcugauucaggagaacguugugcugccccagauccauaccgucacaggcaccaagaacuucaugaaaaaucucuuucugcuuagcacacgccaaaacguggagggaucuuacgacggcgcuuaugcgccuguucugcaggauuucagaucccucaaugacagcaccaaccggacaaagaagcacaccgcccauuuuuccaaaaagggggaagaggaaaaucuggagggacucggcaaccagacgaaacaaaucguggaaaaguacgcuugcacaacccgcauuucucccaauaccagccagcagaacuucgucacacagagauccaaacgggcccugaagcaauuucgccuuccgcuggaggagaccgaacuggagaagagaaucauuguggaugacacgucuacacaguggagcaaaaauaugaagcaccucaccccuuccacacugacccagaucgauuauaacgaaaaagagaagggggccauuacacagagcccccuuucugacugucugacccggucccacagcaucccccaagcuaauagaucuccucuccccaucgccaaaguuuccagcuucccuucuauucgcccgaucuaccugacgcgggugcucuuucaggauaacagcucccaucugcccgcggcuucuuacagaaagaaggacagcggaguccaggaguccagccacuuccuucagggcgccaaaaagaauaaccugucccuggccauucucacccuggaaaugacaggcgaucaacgcgagguggggucucuuggaaccagcgcuacaaauuccgugaccuauaaaaaggucgaaaacacgguucugccuaaacccgaccucccuaagacaucuggcaagguggagcugcuccccaaagugcauaucuaccagaaggaucuguuuccgaccgaaacaagcaauggguccccuggacaccuugaccuggucgagggcucucugcuccaggggaccgagggagccauuaaauggaacgaagcgaaccggcccggcaaggugccuuuccugagaguugcuaccgagagcuccgccaaaacacccagcaaacuucuggacccucucgccugggauaaucauuauggcacgcagauccccaaggaagaguggaaaucucaagaaaaguccccggagaaaaccgcuuuuaagaaaaaggacacaauucugagccugaacgccugcgagucuaaucacgcuaucgccgcgaucaacgaagggcagaauaaaccugagauugaagugaccugggccaagcagggacgcacagagcggcucuguucccaaaauccgcccguccuuaagagacaccagcgcgaaaucacccggacgacacugcagagcgaucaggaggagauugacuacgaugacaccaucucuguggaaaugaaaaaggaggauuucgacauuuaugaugaagacgagaaucaauccccucgcagcuuucagaaaaagacccggcauuacuucaucgcugccguugagcgccugugggauuauggcauguccagcucuccgcacgugcucagaaaccgggcucagagcggguccgucccccaguucaaaaagguggucuuucaagaguucacagacggaucuuuuacccagccucuguaccgcggcgagcuuaaugaacaucuggggcuccugggacccuacaucagagccgagguggaagauaacauuaugguuacauuccggaaucaggccagcagaccuuauuccuuuuacucuagccugaucuccuaugaggaggaccagcgccaaggcgcugaaccccggaagaacuucgugaaaccuaaugagacgaagaccuacuuuuggaaaguccagcaccacauggcgccgacaaaggacgaguucgauugcaaagccugggcuuauuuuucugacguggaucucgagaaggacguucauagcggccuuauugggccccugcuggugugucacaccaacacacucaauccugcccauggaagacaggucaccgugcaagaguucgcccuguuuuucacgaucuuugaugagaccaaguccugguacuucacagagaacauggaacgcaacugccgggcucccuguaauauucagauggaggacccuaccuucaaagaaaacuauagauuucacgccaucaauggcuacaucauggauacacuucccgggcuggugauggcgcaggaccagcgcauucggugguaccuccugagcaugggaucuaacgagaauauccauuccauucacuucagcggccacguuuuuaccgucagaaagaaagaagaguauaagauggcucuguacaaccucuauccggggguguucgagacaguggaaaugcuuccuucuaaagccggaaucuggcgcgucgagugccugauuggcgaacaucugcacgccggcauguccacgcucuuucugguguacagcaauaagugucaaacaccccuugggauggcuuccggacauaucagagauuuccagauuacagccucuggccaguaugggcagugggcgcccaagcuggcucggcuccacuacagcggauccaucaacgccuggagcaccaaagagccuuuuucuuggaucaagguugaccugcuggcccccaugauuauccacggcauuaaaacccaaggggcucgccagaaguucuccagccucuauaucucucaguuuauuaucauguacagccuugauggcaagaaguggcagacauacagaggcaauuccacgggcacccugaugguguucuuugggaacgucgacucuagcggaaucaaacauaauauuuucaacccuccgaucauugcccgguauauccgccugcaccccacacauuacuccauuagaucuacccuccggauggagcugaugggcugcgaccuuaauagcuguuccaugccucuggggauggaaagcaaggcuaucucugaugcccaaaucacagcguccagcuauuuuaccaacauguucgccacguggucccccucuaaggcuagacuccaucugcagggacgcagcaaugccuggcggccucaggugaacaaccccaaagaguggcugcagguugacuuccaaaagacaaugaaagugaccggcgucaccacacagggggugaagucccuccuuaccucuauguacguuaaagaauuucugauuagcuccagccaggauggacaucaauggacacuguucuuucagaauggcaaggugaaggucuuccagggcaaccaggacucuuuuaccccgguggucaauucccucgauccuccccugcuuacgagauaucugcgcauccacccucaaagcuggguccaccagauugcucuccggauggagguucuggggugcgaagcccaggaccuguacuga

SEQ ID NO: 69043 - RNA, 1386 nt, Artificial Sequence
  derived and/or modified sequence opt5 from F9__Homo_sapiens__NP_000124
augcagagagugaacaugaucauggccgagagccccggccugauuaccaucugccuccugggguaccuucuguccgcugaauguacagucuuccucgaccacgagaaugccaacaagauucugaaucggccuaaacgcuauaacucuggaaaacuugaagaguuuguucaaggcaaucuggaaagagagugcauggaggaaaaauguagcuucgaggaagcgcgggagguguuugagaacacggaacgcaccacagaguucuggaagcaguacguggauggggaccagugcgaauccaauccgugucucaacggaggcucuugcaaagaugacaucaauagcuaugaguguuggugccccuuuggguucgaaggaaagaacugugagcuggaugugaccugcaauauuaagaacggcagaugugagcaguuuugcaaaaauuccgcugacaacaaggucguuugcucuuguacagaaggcuaccggcuggccgagaaucaaaagagcugcgaaccugccgugcccuucccuugugggcgcgucuccgugagccagaccucuaagcucacaagagcugagaccguuuuucccgauguggacuaugucaacuccacggaagccgagaccauccuggauaacaucacacagagcacccagucuuucaaugacuuuacacggguggugggaggcgaggaugcuaaaccugggcaauucccguggcaggucguucuuaacggaaagguggacgccuuuugcggcggguccauugugaaugaaaaguggaucgucaccgcggcccauuguguggagacgggaguuaaaauuacaguggucgcuggcgaacacaacaucgaggaaaccgagcauacagagcagaagcgcaaugugauuagaaucauuccccaccauaacuacaaugccgcuaucaacaaauauaaucacgauaucgcccugcucgaacuggacgagccucuuguucugaacagcuacgugacccccauuugcaucgcggacaaggaauacaccaauauuuuccucaaauucggcucuggguaugucuccggauggggccggguguuucacaaggggcgcagcgcccugguccugcaguaccucagagugccucugguugaucgggcuacaugucuucgcuccacgaaauucaccaucuauaacaauauguuuugcgccggauuccaugagggcgggagagacucuugucaaggagauagcggcggcccccacgugacagaggucgaagggaccuccuuucugacaggaauuaucagcuggggcgaggaaugcgcuaugaaggggaaguacggaaucuauaccaaagugucucgguacguuaacuggauuaaggagaaaacgaagcucacauga

SEQ ID NO: 69044 - RNA, 1119 nt, Artificial Sequence
  derived and/or modified sequence opt5 from FA2H__Homo_sapiens__NP_077282
auggcccccgcuccuccgcccgccgcgagcuucuccccuucugaggugcagagacggcuggcugccggcgccugcuggguccgcagaggggcucggcucuacgaccugagcuccuuuguucgccaccaucccggaggcgaacaacuucugagagcccgggcugggcaggauaucucugccgaccucgauggaccuccccaccgccauagcgcgaacgccagacgguggcuggagcaguauuacgugggcgaacuucgcggggagcagcaaggauccauggaaaaugagccuguggcucuggaggaaacccagaagacagacccggccauggagcccagauucaaagucguggauugggacaaggaucucguugacuggcggaaaccucugcuguggcaagugggccaccucggcgaaaaguaugaugaguggguccaucagcccgugacgcgcccuauuagacuguuucacucugaccuuaucgaggggcugagcaaaaccguuugguacuccgugcccauuaucugggucccgcucgugcuguaucuuagcuggucuuacuaucggacauucgcucagggaaacgugcgccuguuuaccuccuucacaaccgaauacacagucgccguuccuaagagcauguuucccggccucuucaugcuggggaccuuucuguggucucucauugaguaccugauccacagauuccuuuuucauaugaagccucccuccgauagcuauuaccugaucaugcuccacuucgugaugcauggacagcaccacaaagcgcccuuugacggcucucggcugguguucccuccgguccccgccucccuugugauugggguuuucuaucuguguaugcagcucauccugccugaagcugugggaggcacggucuuugccggcgggcugcucggauacgugcuguaugauaugacccauuacuaucuucacuucggcagcccccauaagggguccuaccuguacucucucaaagcucaccauguuaagcaccacuuugcccaucagaaaagcggauucggcauuuccacaaagcugugggacuauugcuuucacacccuuacaccugagaagccccaucugaaaacccaauga

SEQ ID NO: 69045 - RNA, 1599 nt, Artificial Sequence
  derived and/or modified sequence opt5 from FAAH2__Homo_sapiens__NP_777572
auggcccccagcuucaccgcuagaauccagcuguuucuccugcgggcccuuggcuuccugauugggcucgugggacgcgcggcucugguccuuggcgggccuaaguuugccuccaaaacaccgagacccguuacggaaccucugcuccugcugucuggaaugcaacucgccaagcugauccggcagcgcaaagugaagugcauugacgugguccaggcuuacaucaacagaauuaaagaugugaaucccaugaucaacggcaucguuaaguaucgguucgaagaggccaugaaggaagcucacgccguggaccagaaacuugcggagaagcaagaagaugaggccacccuggagaauaaauggccuuuucucggggucccccugacagugaaggaggcuuuccagcuucagggaaugccuaacagcuccggccugaugaaucgcagagacgccauugcuaaaaccgaugccacaguuguggcgcuccugaagggcgccggggcuaucccgcugggaauuaccaacuguucugaacucugcaugugguacgaaagcuccaauaagaucuauggccggucuaacaaucccuacgaccugcagcauauugucgggggaagcuccggcggggagggauguacacuugccgcugccugcagcgugaucggcgugggcucugauauugggggauccauccgcaugccugccuuuuucaacggcaucuuugggcacaaacccagcccuggagucguucccaauaagggccaauucccgcuggcugugggggcgcaggagcucuuucuguguaccggaccuaugugcagauaugccgaagaccuugcucccaugcugaaagugauggccggcccuggcauuaagcggcucaaacuggauacgaagguccaucugaaagaccucaaguucuacuggauggagcacgaugggggaucuuuucugauguccaagguggaccaggaucuuaucaugacccagaaaaagguugugguccaucuggaaacaauucucggcgccagcgugcaacacguuaaacugaagaaaaugaaguauucuuuccagcuuuggaucgcuaugauguccgccaaggggcacgacggaaaagagcccgugaaguucgucgaccugcucggcgaucaugggaaacacgugagcccccugugggaacugauuaaguggugucucggccuguccgucuacaccaucccuucuaucggacuugcgcugcucgaggagaaacugcgcuacagcaacgaaaaguaucagaaguuuaaagcuguggaggaaucccugagaaaggagcuuguugacaugcucggcgaugacgggguguuccuguacccgagccaucccacagucgccccuaaacaccacgugccccugacccggccuuuuaauuucgccuauacgggaguguuuucugcucucggccugcccguuacacaaugcccgcuugggcugaacgccaagggacucccucugggcauucaggucguggcugggcccuucaaugaucaucugacccuugccguggcgcaguaccucgagaaaacauuuggcggauggguuuguccuggcaaguucuga

SEQ ID NO: 69046 - RNA, 384 nt, Artificial Sequence
  derived and/or modified sequence opt5 from FABP1__Homo_sapiens__NP_001434
augagcuucuccggcaaguaccagcugcaaucucaggagaacuuugaagccuucaugaaagcuaucgggcuccccgaggaacugauucagaagggaaaagacaucaagggcgugagcgagauuguccagaaugggaaacacuuuaaguucaccaucacagccggauccaagguuauucaaaacgaauuuacggugggcgaggagugcgaacuugagaccaugacaggggaaaaagugaagaccgucgugcagcuggagggagauaauaaacucguuacaaccuucaagaacaucaaaucugugacagagcugaauggcgacaucauuaccaacacgaugacccuuggcgauaucgucuuuaagagaauuagcaagcggaucuga

SEQ ID NO: 69047 - RNA, 399 nt, Artificial Sequence
  derived and/or modified sequence opt5 from FABP2__Homo_sapiens__NP_000125
auggccuucgacagcaccuggaagguggauagauccgagaacuacgacaaauuuauggaaaagaugggcgucaauaucguuaaacggaagcuggcugcccacgauaaccucaaacugacaauuacgcaggaggggaauaaguucaccgugaaggaaucuagcacauuucgcaacaucgagguggucuucgaacuuggagugaccuuuaauuauaaccuggcggacggcacagagcucagagggaccuggucccuggagggaaauaaacuuauuggcaaguucaaacggacagauaacgggaaugaacugaacaccguucgcgagaucauuggagacgaacucgugcaaacguacgucuaugagggcguggaggcuaagagaaucuuuaaaaaggauuga

SEQ ID NO: 69048 - RNA, 399 nt, Artificial Sequence
  derived and/or modified sequence opt5 from FABP4__Homo_sapiens__NP_001433
augugcgacgccuucgugggcaccuggaagcuggucagcuccgagaacuuugaugacuacaugaaagaaguuggggugggauucgcuacaagaaagguggccggcauggcgaaacccaauaugaucauuucugucaacggggaugugaucacgauuaagagcgaguccaccuuuaaaaauacagaaaucucuuucauucucggacaggaguuugacgaaguuaccgcugaugaccggaaggucaagagcacaaucacccuggauggcggggugcuugugcacguucaaaaaugggacggaaaguccacaaccaucaaacgcaagagagaggaugacaaacugguggucgagugugugaugaagggcgugacgucuacccgggucuaugaacgcgccuga

SEQ ID NO: 69049 - RNA, 408 nt, Artificial Sequence
  derived and/or modified sequence opt5 from FABP5__Homo_sapiens__NP_001435
auggccaccgugcagcaacuggagggcagauggcggcucgucgacagcaagggguucgaugaauacaugaaagagcugggaguuggcaucgcccuucgcaagaugggggcuauggcgaaacccgacugcauuaucacaugugauggaaagaaccugacgauuaaaaccgaauccacacucaagaccacacaguuuucuugcacccugggcgagaaguucgaagagacaaccgcugacgggagaaaaacgcagaccguguguaauuuuacagauggagcccuugugcagcaccaagagugggacggcaaggaaagcaccaucacacggaaacugaaggauggcaaacucgucguggagugcguuaugaacaaugugaccuguacgcgcauuuaugaaaaggucgaguga

SEQ ID NO: 69050 - RNA, 534 nt, Artificial Sequence
  derived and/or modified sequence opt5 from FABP6__Homo_sapiens__NP_001124430
augaagaccgugacaaugaugauggucguugagaugcaggcccugacgcaagugcucagagcugugcugagcgccugcaccugggucucccggaaaggcgaccuucagcgcaugaagcagacacacaaagggaagcccccuucuagcauggcguucaccggaaaauuugaaauggaguccgaaaagaacuacgaugaguucaugaagcugcucggcaucucuagcgacgugauugaaaaagcuagaaauuuuaagaucguuacagaggugcagcaagaugggcaggacuucaccuggucccagcauuauucuggaggccacacaaugaccaacaaauuuacggucgggaaggagagcaauauucagaccaugggaggcaaaacauucaaggccaccgugcaaauggaaggcgggaagcugguugugaacuuuccgaauuaccaucagacauccgagaucgucggagauaaacuuguggaagugagcaccauuggcggggucacguaugagcggguuucuaagcgccuggccuga

SEQ ID NO: 69051 - RNA, 399 nt, Artificial Sequence
  derived and/or modified sequence opt5 from FABP7__Homo_sapiens__NP_001437
augguggaggccuucugcgcuaccuggaagcugacaaacagccagaauuuugacgaauacaugaaagcccucggcgucggguucgcgacgagacaaguuggaaacgugaccaagcccacagugaucauuucccaggagggcgauaaagucgugauccggacccugucuacauuuaagaauaccgaaauuagcuuccagcuuggggaggaauuugacgagacaaccgcugaugaccgcaacuguaaauccguugugucucuggauggagacaagcucguccacauccagaagugggauggcaaagagacgaauuucgugagagaaauuaaggacgggaaaaugguuaugacccugacauuuggagauguggucgccgugcggcauuaugagaaggccuga

SEQ ID NO: 69052 - RNA, 399 nt, Artificial Sequence
  derived and/or modified sequence opt5 from FABP9__Homo_sapiens__NP_001073995
augguggagcccuuccugggcaccuggaagcucgucagcuccgaaaacuuugaggacuacaugaaagaacuggggguuaauuucgccgcuagaaacauggccggacuugugaagccuacagugacgaucucugucgauggcaaaaugaugaccauucggacagagagcuccuuucaggacaccaagaucucuuucaaacugggggaagaguuugaugagacaaccgcggacaaucgcaaggugaaaagcacaauuacccucgaaaacggauccaugauccacguucaaaaauggcugggcaaggagacgaccauuaaaagaaagaucguggaugaaaagauggucguggagugcaagaugaauaacaucguuucuacacggauuuaugagaagguguga

SEQ ID NO: 69053 - RNA, 627 nt, Artificial Sequence
  derived and/or modified sequence opt5 from FADD__Homo_sapiens__NP_003815
auggaccccuuccuggugcuccugcacagcgucuccucuagccuuuccucuagcgagcugaccgaacucaaguuucugugccuuggcagaguugggaaacggaagcuggagcgcgugcaguccggacucgaucuguucucuaugcugcucgaacaaaacgaccuggagccuggccauacagaacuucugagagagcuccuggccagccuucggcgccacgaucugcucagacggguggacgauuuugaggcuggggccgcggcuggagccgccccgggcgaagaggaccugugugcugccuucaaugucaucugcgauaacguggggaaagacuggcgcagacuggcucggcagcucaagguuuccgauacgaaaauugacagcaucgaagaucgcuaccccagaaaucugaccgagcgggugcgcgagucucuuagaauuuggaagaacacagaaaaggagaaugccaccgucgcgcaucuggugggagcccuccgguccugucagaugaaccugguugcugaccuugugcaggaaguccaacaggcccgcgaucugcagaauagaagcggcgcuaugucuccuauguccuggaacagcgacgccucuacauccgaggcgagcuga

SEQ ID NO: 69054 - RNA, 1506 nt, Artificial Sequence
  derived and/or modified sequence opt5 from FADS1__Homo_sapiens__NP_037534
augggcaccagagccgcucggcccgccgggcugccuugcggagcggagaacccggcucgcagacggcucgcccugggcgcccgccagcaaauccacagcuggucccccagaacaccuucuacgcggcuuaccgcucccgccgggccugcucgcggaguggccagacccgcgauggccccugacccggucgcugccgaaacagcugcccagggccccaccccucgguacuucacaugggaugagguugcgcagcgcagcgggugugaagagagauggcuggugauugaccggaagguguauaauaucuccgaauuuacccgcagacaucccggaggcucucgggucauuagccacuacgccggccaggaugcuacagacccuuucguggccuuucauaucaacaaagggcucguuaagaaauauaugaacucccugcuuauuggagagcugucucccgagcaaccgagcuucgaaccuaccaagaauaaagagcucacggaugaauuucgcgagcugagagcuaccguggagcggaugggccugaugaaggccaaucacgucuucuuucuccuguaccuucugcauauccuccugcuugacggggccgcuuggcugacacucuggguguucggaaccuccuuucugcccuuccugcucugcgcgguucugcuuagcgccgugcaggcucaggccggcuggcugcagcacgauuuugggcaccucucugucuucuccacaagcaaguggaaccaucugcuucaccauuuugugaucggacaccugaaaggcgccccugcuucuugguggaaucacaugcauuuccaacaccaugccaagcccaacuguuucagaaaagaccccgauauuaauaugcacccguuuuucuuugcgcucggcaagauccuguccguggaacuggggaaacagaagaagaaauauaugccuuacaaccaucagcacaaguauuucuuucucauuggacccccugcucugcuuccccuguacuuccagugguacaucuuuuauuucgucauucaacgcaaaaaguggguugaccucgccuggaugaucaccuuuuacgugcgguucuuucugacguaugugccucuucugggccucaaagccuuccuggggcuguuuuucauugucagauuccucgagagcaauugguuuguguggguuacacagaugaaccacauccccaugcauaucgaucacgaccgcaauauggauugggugucuacccagcugcaagcuacaugcaacguccauaaguccgccuucaaugacugguuuagcggacaccuuaacuuccagauugaacaccaucuguuuccgaccaugccucggcacaacuaccauaaaguggcuccccucguucagucccugugugccaagcacggcaucgaguaucagucuaagccucugcuuagcgcguucgccgacauuauccauucccucaaagaaagcgggcaacuguggcuggaugcuuaccuccaccaguga

SEQ ID NO: 69055 - RNA, 1269 nt, Artificial Sequence
  derived and/or modified sequence opt5 from FADS2__Homo_sapiens__NP_001268430
augcacggcagagaggccgggcccuucgugugcgucuguguucugcucgcuagcaucccuaccccgcagacaccccugcuucaagccucccugccucccuuucauccugcgucugcuggacaccccauuacgggccagcaggacgccuuccgggccuuucauccugaucucgaguucguggggaaguuucugaaaccgcuucugaucggagagcucgcucccgaagaaccuagccaggaccacggcaagaacuccaaaauuaccgaagauuuccgcgcccugagaaagacagcugaggacaugaaucuguuuaaaaccaaccauguguucuuucuccugcuucuggcccacaucauugcgcucgagucuaucgccugguucacagucuuuuacuucgggaauggauggauccccacccugauuacagcuuuugugcuugccaccagccaagcucaggccggcuggcugcagcacgauuauggccaucucuccguuuaccggaagccuaaguggaaccaccuggugcauaaauucgucaucgggcaccugaagggagcgucugccaauugguggaaccaccgccauuuccagcaccaugcuaaacccaauauuuuucacaaggacccggaugugaacaugcuccauguuuucgugcugggcgaauggcaaccuaucgaguaugggaaaaagaaacuuaaguaccugcccuauaaucaccagcacgaauacuuuuuccucauuggaccuccccugcuuauccccauguauuuucaguaccagauuaucaugacgaugaucguccauaagaacuggguggaccuggccugggcugugagcuacuauauuagauucuuuaucaccuacauuccuuucuauggcauccucggggcccugcuguuucucaauuucauucgguuucuggagucccacugguucgucuggguuacacaaaugaaccauaucgugauggagaucgaucaggaagccuaccgcgacugguuuagcucucagcuuaccgcuacaugcaauguggagcaauccuucuucaacgauugguuuagcggacaccugaauuuccagauugaacaccaucucuuuccgaccaugcccagacacaaccugcauaaaaucgcgccucuugucaagucucugugugccaaacacggcauugaguaucaggaaaagccccuccugcgggcucugcucgacaucauucgcucccugaaaaagagcggcaaacuuuggcuggaugccuaccuccauaaguga

SEQ ID NO: 69056 - RNA, 1338 nt, Artificial Sequence
  derived and/or modified sequence opt5 from FADS3__Homo_sapiens__NP_068373
augggcggggugggagagcccggcccuagagaagggccggcccagcccggagcuccucugcccaccuucugcugggagcaaauccgggcccacgaccagccuggcgauaaguggcucgucauugaacgcagaguuuacgacaucagccggugggcgcagcgccaucccgggggauccagacugauuggccaccauggcgcugaggaugccacagacgccuuucgggcuuuccaccaggaucuuaacuuugugcgcaaauuccugcaaccucuccugaucggggaacuugccccggaggagcccucucaggacggaccucugaaugcucagcucguggaagauuuuagagcccugcaucaggcggccgaggacaugaagcuguucgaugcuagccccacguuuuucgccuuucuccugggccacauucuugcuauggaaguccuggccuggcuccugaucuaucuucuggggccuggaugggugcccuccgcgcucgccgcuuucauccuggccauuucucaagcucagagcuggugucugcagcacgaccucggccaugccuccaucuuuaaaaagucuugguggaaccacguugcccagaaauucgugauggggcaacugaagggauuuagcgcucauugguggaauuuccggcacuuccagcaccaugcgaagccgaacauuuuucacaaagauccugacgucaccguggcccccguuuuccuucugggcgaguccagcguggaguacggcaagaaaaagcgcagauaucucccuuacaaucagcaacaucuguacuuuuuccuuaucgggccuccccugcucacacuggucaacuuugaaguggagaaucuggcuuauaugcucgugugcaugcagugggccgaucugcuuugggccgcuucuuucuaugcccgguuuuuccuguccuaccuccccuuuuacggagucccgggcguucugcuuuucuuuguggcggugcgcguccuggaaagccacugguucguguggauuacccagaugaaccauauccccaaagagauugggcacgaaaagcacagagacuggguuucuucccagcucgcugccacauguaauguggagccuagccuguuuaccaacugguucucuggacaucugaauuuccaaaucgagcaccaucucuuuccccggaugccucgccacaacuauuccagagucgcuccccugguuaagagccuuugcgccaaacacggccuguccuacgaagugaagccguuccucacagcccugguggacaucguccggucucugaaaaagagcggggauauuuggcuugacgcuuaucuccaucaguga

SEQ ID NO: 69057 - RNA, 1338 nt, Artificial Sequence
  derived and/or modified sequence opt5 from FAF2__Homo_sapiens__NP_055428
auggccgcucccgaggaaagagaccugacccaggagcaaacagaaaagcuccugcaguuccaggaucuuacgggcaucgagagcauggaccagugccggcacacccuggaacaacauaacuggaauauugaggccgcggugcaggaucgccucaacgagcaggaaggggucccuuccguuuuuaauccgcccccuucuagaccccuccaggugaacacagcugaccaccggaucuacagcuauguggucucccgcccucaacccagaggacuucugggcuggggguacuaucucauuaugcugccuuuccgguuuaccuacuauacaauccuggauauuuuccgcuuugcccucagauucauccggccggacccccgcucuagagugaccgauccuguuggagacaucgugagcuuuaugcauuccuucgaggaaaaauacggccgggcccaccccgucuuuuaucaggggacauacucucaggcucugaaugaugccaagcgcgagcuuagauuccugcucguguaccugcauggagacgaucaccaggacagcgaugaguuuugucggaacacccuuugcgcuccugaaguuauuucccugaucaauacgcgcaugcuguucugggccuguagcaccaacaaacccgagggcuauagagugucucaagcgcugcgggaaaauacauacccguuucuggccaugauuaugcucaaggacagacgcaugaccgucgugggccggcuggaggggcuuauccagccugacgaucugauuaaccagcucacauucaucauggacgcuaaucaaaccuaucugguguccgaaagacuugagcgcgaggaacggaaccagacgcagguccugagacagcaacaggaugaggccuaccucgcuagccugcgcgccgaccaggaaaaagagcggaagaagagagaggaacgcgagcggaaaagacgcaaggaagaggaaguucagcaacagaaacuggcggaggaacggagacggcagaaucuccaggaggagaaggaacgcaaacuggagugccuucccccugaacccucucccgaugacccugaguccgugaagauuaucuucaagcugccgaacgauagcagaguggagcggagauuucacuucucucaaucccucacagucauccaugacuuucuguucagccuuaaagaaucccccgagaaguuucagauugaagccaauuucccucgccgggugcugcccuguaucccuucugaggaauggcccaacccgccuacccuccaggaggcuggacugagccacacagagguucuguuugugcaggaucucaccgacgaauga

SEQ ID NO: 69058 - RNA, 945 nt, Artificial Sequence
  derived and/or modified sequence opt5 from FAHD2A__Homo_sapiens__NP_057128
augcuggugagcggcagacggcgccuccugaccguccuucugcaggcccaaaaguggcccuuccagccuuccagagacaugcggcucguucaguuucgcgcuccgcaccugguggggccccaucuuggacuggagacaggcaacgggggaggcgugaucaaucucaacgccuucgauccuacgcugcccaaaaccaugacacaguuucuggaacaaggggaggcgacccucucugucgcuagacgggcccuggccgcucagcuuccugugcugccccgcagcgaaguuacauuccucgccccugugaccagaccggacaaggucgugugcguuggaaugaauuacguggaucacuguaaagagcagaacguccccgugccuaaggaacccauuaucuuuuccaaauucgcuucuagcauugugggcccuuaugacgaggucguucugcccccgcagucccaagagguggauugggaaguggagcuugccgucgugaucggcaagaaggggaaacauauuaaggcgacagacgccauggcucacguugccggauuuaccguggcucaugaugucucugcccgggacuggcagaugcgcagaaauggcaaacaguggcugcucgggaagacguucgauaccuuuugcccucugggacccgcgcuggugacaaaagacagcguugccgauccucacaaccucaagaucuguugccgggugaauggcgaagucgugcaguccgggaacaccaaucaaauggucuucaagacagaggaccugaucgcuugggugagccaguuuguuaccuucuaccccggagaugugauucuuacgggcacacccccuggcgucgggguguuucgcaaaccgcccguuuuccugaagaaaggagacgaggugcagugugaaaucgaggaacucggcgucauuaucaacaaggugguguga

SEQ ID NO: 69059 - RNA, 1260 nt, Artificial Sequence
  derived and/or modified sequence opt5 from FAH__Homo_sapiens__NP_000128
augagcuucauccccguggccgaggacuccgauuuuccuauucacaaccugccguacggcgucuucucuaccagaggggacccccggccucgcaucggaguugcuauuggcgaucagauccucgaccugagcauuaucaagcaucuuuuuacagggcccgugcuguccaaacaccaagauguguucaaucagccuacgcucaacucuuuuaugggacugggccaggccgcguggaaggaagcuagagucuuccuucagaaucugcucagcgugucccaagcccggcugcgcgacgauaccgagcugagaaaaugcgccuuuaucucucaggcuagcgccacaaugcaucuccccgcuaccauuggggacuauacagauuucuacuccagccggcagcacgccaccaacguuggaaucauguuucgcgacaaggaaaaugcgcugaugccuaacuggcuucaucugccggugggcuaucacggcagagccucuuccgucgugguuagcgggacacccauucggcgcccuaugggacagaugaaacccgaugacucuaagccucccguguacggcgcuuguaagcuccuggauauggagcuugaaauggccuucuuugucgggccgggaaauagacugggcgagccuauccccauuuccaaagcucacgagcauaucuucgggauggugcucaugaacgacuggagcgcccgggacauucaaaagugggaauaugugccucugggacccuuucugggcaaaucuuucggcaccacggucucccccuggguugugccuauggaugcgcucaugccguucgccgugcccaauccuaagcaggacccccgcccucugcccuaccuuugccacgaugagccguauaccuuugacaucaaccugagcgucaaucucaaaggggaaggaaugucccaggcugccacaaucuguaagucuaacuucaaguacauguacuggaccaugcugcagcaacuuacacaucacagcgugaauggcugcaaccugagaccuggggaucuccuggcuuccggaaccauuagcggccccgagccugagaauuuugggucuaugcuggaacucuccuggaaaggaacgaagcccaucgaccugggcaacggccagacacggaaauuccuucuggauggggacgagguuauuaucaccggauauugucagggcgauggguaccgcauuggauuuggccaaugcgccgggaaggugcucccugcccugcuucccagcuga

SEQ ID NO: 69060 - RNA, 951 nt, Artificial Sequence
  derived and/or modified sequence opt5 from FAIM2__Homo_sapiens__NP_036438
augacccagggcaagcugagcguggccaacaaagcucccgggacagagggacaacagcagguccacggcgaaaagaaagaggccccugcgguuccguccgcucccccuucuuacgaagaggccacgagcggggaaggaaugaaggccggcgcuuuucccccugcccccaccgcugugccucuccauccguccugggccuauguggaccccucuagcuccucuagcuacgauaauggguuuccuacaggagaccacgagcuguucaccacauuuuccugggaugaccagaaagucagacggguguucguucgcaagguguauaccauccuucugauucaacuccuggucacacuugcggugguugcccuguuuaccuucugcgaucccgugaaggacuacguccaggcuaacccuggcugguauugggccagcuacgcuguguuuuucgccacguaucucacccuggcguguugcucuggccccagacggcauuuuccguggaaucugauccuccugacaguguucacccuuuccauggccuaccugacagggaugcucagcucuuacuauaacaccacguccguccugcuuugucugggaauuacagcucucguuugccugagcgugaccguguuuucuuuccagacaaaauuugauuucaccuccugucagggcguccuguucgugcuccugaugacccuuuucuucagcgggcugauccucgccauucugcuuccuuuucaauacguucccuggcugcacgcuguguaugccgcccucggagcuggcgucuucacacuguuucuggcgcucgacacgcagcugcuuauggggaaucgcagacauucccugucuccugaggaauacaucuucggagcccucaacaucuaucuggauauuaucuacauuuuuaccuucuuucuucagcuguucggcacaaaucgggaguga

SEQ ID NO: 69061 - RNA, 837 nt, Artificial Sequence
  derived and/or modified sequence opt5 from FAIM3__Homo_sapiens__NP_001135945
auggacuucuggcuguggccccucuacuuucugccugaguaugaaccgagcugggaggaacagcccaugccugagacccccaagugguuccaccuuccuuaccuguuucaaaugcccgccuaugcuuccucuagcaaauucgugacaagagucacgaccccugcccagcggggcaagguuccgcccgugcaucacuccucuccuacaacccagaucacacaucgccccagagugagccgggcguccucugucgcuggggauaaaccucgcaccuuucuccccagcacaaccgccuccaagauuagcgcccuggaaggacuucugaaaccgcagacgccuucuuacaaccaccauaccagacuccaccggcaacgcgcucuggacuauggcucccagagcgggagagagggacagggcuuccacauccugauucccacaauccucgggcuguuucuucuggcccuccugggacuugugguuaagcgggcuguggagcgcagaaaggcccugucucggcgcgcgagacggcucgccguccgcaugagagcucuggaauccagccagcggccuagaggcucuccccgcccccggucccaaaauaacauuuacagcgccugcccuagacgcgcucggggcgccgaugcggccgggaccggagaggcuccggugcccggcccuggggcuccccugccucccgccccgcuccagguuuccgaaucuccuuggcugcaugcccccagccuuaaaacauccugugaguaugugagccuguaccaccagccugccgcuaugauggaggacucugauuccgacgauuacaucaauguccccgcguga

SEQ ID NO: 69062 - RNA, 1155 nt, Artificial Sequence
  derived and/or modified sequence opt5 from FAM102A__Homo_sapiens__NP_001030331
auggccuuccugaugaagaaaaagaaauuuaaguuccagaccacauuuacgcucgaggaacugaccgcugugcccuucgucaacggcguucuguuuugcaaagugagacuucucgacgggggagauuucgugagccuguccucucgggaggaaguccaagagaauugugugcgcuggagaaagcgguuuacauucguuugcaagaugagcgccaacccugcgaccggccuucuggacccguguguguuucgcgucuccgugagaaaagaacucaaagggggaaaggcuuacucuaagcugggcuucgccgaucugaaucucgccgaguuugcugggagcggauccacaguucggugcugucugcuugagggcuaugacaccaaaaacacacgccaggauaauucuauccugaaggugaccauuggcauguuccuccugagcggggaccccugcuuuaagacgccucccuccaccgccaaaagcaucucuauuccuggacaggauuccagccuucagcugacauguaagggcgggggaaccucuuccggcgggagcucuacaaacucccucaccggaagcagacccccuaaagcucggccgacgauccuguccucuggccugcccgaggaaccugaccaaaaucucagcucccccgaagaggucuuccacagcggccauucucgcaacuccagcuacgccucucagcagagcaagauuuccggguauucuacagagcacagcagauccagcucucuguccgaucuuacccaucggcgcaauacaagcaccucuuccagcgcguccggaggccuggggaugaccguggaaggaccugagggcucugaaagagagcaccggcccccggaaaaaccuccccgcccucccagaccccuccaucugagcgaccgguccuucagacgcaagaaagauucuguggagagccacccuacaugggucgacgauacgcggaucgacgccgacgcuaucguugagaagauugugcagucccaagauuuuaccgacgggagcaacacagaagauucuaaucuuagacuguucgugucccgcgacggaagcgccacccucucuggcauccagcuggcuacacgggucuccagcggcguguacgagccgguugugauugaaucucacuga

SEQ ID NO: 69063 - RNA, 357 nt, Artificial Sequence
  derived and/or modified sequence opt5 from FAM103A1__Homo_sapiens__NP_113640
augaccgacacagccgaggcugugcccaaguucgaagagauguuugccagcagauucacggaaaacgauaaagaguaccaggaauaucugaagcggccuccggagucucccccuaucgucgaggaauggaacucccgcgcgggcgggaaucaaagaaaucggggaaaccgccuccaggacaauagacaguuucggggccgcgauaacagauggggguggcccagcgacaaucgguccaaccaguggcacggacgcucuuggggcaauaacuacccucaacauagacaggagcccuauuacccucagcaguaugggcacuacggauauaaucaacggccgcccuacggcuacuauuga

SEQ ID NO: 69064 - RNA, 1071 nt, Artificial Sequence
  derived and/or modified sequence opt5 from FAM105A__Homo_sapiens__NP_061891
auggccgcuaccagaagccccacacgggcccgcgagagagaacgguccggcgcgccugcugccgggucugaccaggugcacagcuggaugcuggccacgucccaagcucucgauaccgucuggcgcauggccaagggauucguuaugcuggcugugucuuuucuuguggccgcgaucugcuacuucagacggcugcaucucuauagcggccacaaacugaagugguggauuggguaccuucagcgcaaauuuaagagaaaccuguccgucgaggccgaaguggaccuccugucuuauugugcucgggaguggaaaggagaaacaccgcgcaauaagcugaugagaaaggccuacgaggagcuuuucuggcggcaucacaucaaaugcguucgccaggugagacgggauaacuaugacgcucugcgcagcguccuuuuucagauuuucucccaaggcaucagcuuucccucuuggaugaaggaaaaagauauugugaagcugccugagaaacuccuguucucccagggguguaauuggauccagcaguacagcuuuggacccgaaaaguauaccggcucuaacguuuucggcaagcucagaaaauacguggagcugcucaagacacaauggaccgaguuuaaugggauccgggacuaccauaaaagaggauccaugugcaacacacuguucagcgaugccauucuggaauauaagcucuacgaggcgcugaaauuuaucaugcuuuaucaggucaccgaaguguacgagcagaugaagacgaaaaaggugauuccuucucuguuccgccuccuguucucccgggaaaccagcuccgacccccuuucuuuuaugaugaaucaccugaacagcgucggcgauacaugugggcucgagcagaucgacauguucauucugggauauucccuggagguuaagaucaaaguguuuagacucuucaaguuuaauagccgcgauuucgaagugugcuacccugaggaaccgcugcgggacuggcccgagauuucucuucugaccgaaaacgauagacacuaucauaucccugucuuuuga

SEQ ID NO: 69065 - RNA, 519 nt, Artificial Sequence
  derived and/or modified sequence opt5 from FAM107A__Homo_sapiens__NP_001269642
auggcccagagacugggcgagugggcucgggggcccagcgacgccaccggacucuaccgcgcggugcugcuuagauccgcugccauguauucugaaauccaacgggagcgcgccgauauuggcgggcugauggcuagaccugaauaccgggaguggaacccggaacucaucaagcccaaaaagcugcuuaauccugucaaagccagccgcucccaccaggagcugcauagagagcuccugaugaaccaccggcgcggacugggcguugacucuaagcccgaacuccagagagugcuggagcaucggcgcagaaaucagcuuauuaaaaagaagaaagaggaacuggaggcuaagcggcuccaaugcccuuucgaacaggagcugcuucgcagacagcagcggcugaaccaacucgaaaaacccccugagaaggaagaggaucacgccccggaguuuaucaaagugagagaaaaucugcgccggauugcgacacugacgagcgaggaaagagagcucuga

SEQ ID NO: 69066 - RNA, 396 nt, Artificial Sequence
  derived and/or modified sequence opt5 from FAM107B__Homo_sapiens__NP_001269625
auggccgagcccgacuacaucgaagaugacaacccugagcugauuagaccgcagaagcucaucaaucccgugaaaaccagccggaaccaccaagaucugcaucgcgaacuucugaugaaucagaagagaggccucgcuccucagaacaaacccgagcugcagaaggucauggaaaaacggaagcgcgaccaaguuauuaagcagaaagaggaggaagcccagaagaaaaaguccgaucuugagaucgaacugcucaaaagacagcaaaagcuggagcagcuggagcucgaaaagcagaaacugcaggaggaacaagagaaugcgccugaguucgugaaggugaaagggaaccuucggcgcacaggacaggaagucgcucaggcccaagagucuuga

SEQ ID NO: 69067 - RNA, 789 nt, Artificial Sequence
  derived and/or modified sequence opt5 from FAM109A__Homo_sapiens__NP_001171467
auggcccccggcagcccuccggggcccgcuaucgccaccaugaagcugaacgagagaucccucgcguucuacgcuacaugcgacgccccuguggauaaugccggauuucuguauaaaaagggcgggcggcacgcugccuaccaucgcagaugguucguccuucggggaaacaugcuguuuuauuucgaagacgcugccucucgcgagcccguuggcgugauuauccucgaaggguguacgguggagcuggucgaagcggccgaggaguuugcuuucgccgugagauuugcuggaacccgggcccgcacauacguucuugcggccgaaagccaggaugcuauggagggcugggugaaagcccuguccagagcuucuuucgacuaucuccggcuggucgugcgcgaacuggagcaacagcucgccgccguuagaggcgggggaggcauggcucugccucagccccagccucaaagccuuccgcugcccccuucccuccccucugcgcuggccccugugcccagccuuccguccgcuccugcccccgucccugcccugccccucccccggcgcccuagcgcucugccgcccaaggagaaugggugcgccguguggucuaccgaagcgacauuuagaccuggacccgagccucccccgccucccccucggcgcagagcuuccgcuccccacggcccucuggauauggcccccuucgcccggcuccaugaauguuacgggcaggagauuagagcccugcgcggacaguggcuuagcucucgggugcagccguga

SEQ ID NO: 69068 - RNA, 888 nt, Artificial Sequence
  derived and/or modified sequence opt5 from FAM110A__Homo_sapiens__NP_001276075
augcccgugcacacccugagcccuggcgccccguccgcucccgcccucccuugcagacugcggacacgcguccccggguaccuucugagaggaccugcggacggcggggcucggaagcccucugccguugagcgccucgaagccgauaaagcuaaguaugugaaaagccugcauguggccaacacgagacaggagccuguccaaccgcuucuguccaagcagccccucuucucuccugaaacccggcgcacagugcugacccccagcagacgggcucugccuggacccugucgcagaccgcagcucgaccuggauauccuuuccucucugauugaccucugcgauagcccuguuucccccgccgaggcgagccggacaccuggccgcgccgaaggggcuggaagacccccucccgccaccccgccccggccucccccuucuacauccgcugugcgcagagucgacgugcggccccugccggccagcccugcgagacccuguccuucucccggcccugccgcugccuccagccccgcucgcccgccuggccuucagcggucuaaauccgaucugagcgagagauuuucccgcgccgccgcugaccucgagcgguucuuuaauuucugcgggcuggaucccgaagaggcgagaggacugggcguugcccaccucgcucgcgccucuagcgacaucgugucccuggccgggcccagcgcuggaccugggucuuccgaaggcggauguagccggagaucuagcgucaccguggaggagcgcgcccgggaaagagugccguacggcgucuccguuguggagcgcaacgcgcgggugauuaaguggcuuuauggccugagacaagcucgggaaucucccgccgccgagggguga

SEQ ID NO: 69069 - RNA, 1113 nt, Artificial Sequence
  derived and/or modified sequence opt5 from FAM110B__Homo_sapiens__NP_671722
augcccaccgagacacugcagacgggcagcauggugaagccugucuccccggccgggaccuucacaucugcuguuccccucagaauccugaacaaaggaccugacuacuuucggcgccaagccgaacccaauccuaagagacuuagcgcgguggagcggcuggaagcugauaaagccaaguaugugaaaucccaggaggucauuaacgccaagcaggaacccgugaagccugcuguucucgccaaaccgcccgugugcccugcugccaagcgcgcgcugggcucucccacccuuaaagucuucgggaaucacgccaagacagagagcggagugcagagagagaaccugaaacucgaaauccugaagaauauuaucaacuccucugagggcagcuccagcgggucuggacauaagcacuccagccggaauuggccuccccaucgcucugaagcuaccgaccugcacagacauuccuuugccgagagccucaaaguuuacccgacacaaggccggcgcucuccucaggagggcgggucccacgugggaagacggcugcuugaacagagcgcugaguccuuccugcacgucucucauagcuccagcgauauucgcaaggugaccucugugaaaccccucaaggccaucccuuguuccagcucugcgccuccccugcccccgaaacccaagaucgccgcuauugccagcaugaaauccccugaagcugaccccgucgagccugccugcggcguuucuagacggcccagccuucagcgcuccaagagcgaucugucugacagauauuuucggguggaugccgacguggaaagauucuuuaacuacugugggcucgauccggaggagcuggaaaaucugggaauggagaacuucgcucgcgccaauuccgacaucauuagccucaacuuucggucugcguccaugaucagcuccgauugcgaacaaucucaggacagcaauuccgaucugagaaacgacgacucugcuaaugaucgcgucccuuauggcauuagcgccaucgagcggaacgccagaauuaucaaguggcuuuacuccaucaaacaggcucgcgaaagccagaaggugucucacguuuga

SEQ ID NO: 69070 - RNA, 966 nt, Artificial Sequence
  derived and/or modified sequence opt5 from FAM110C__Homo_sapiens__NP_001071178
augagagcccuggcugcccucagcgcgcccccuaacgagcggcugcuuccgcgcgaccccgcugccaccagagauccugacgccgcucggcccgcccgcagauccgcuguggaacggcuggccgcggaucgcgccaaguacgucagaggccggccugggacaggacgcggcguugcuucugaggggagcggacccggcgccaucaaaugcccugggaaugacccgggacccccugcuagagcccccgcgccuguggcccggcgcgcuauugccagaaagccccuccggccggauucccugaucauuuaccgccagaaaugugaguucgugagaggcucuggcgcugacgggccucgggccagccuugucaagaaacuguuucaaggacccggcaaggauaaggccccugugcccagaacgggggacgaaggaaaagcuggcaaccccgaaaccguuccuacaaccccggggcccgcggccgauccugcuauccccgagacacccgcccccgccgcucgcuccgccgcgccgucuagcgugccugcugccccuccuggacccgagccucgggucgugagacgccggggccuccagagaucccagagcgaccugucuucccgcuacagcgccgcucuggccgaaucugauaccuucuuucaguauugcggccucgaccccgagguuguggaagcucuggggcgggagaauuucacagccggauccgauugugucacccuuaaggugagaagcgugucugucgcgacguccggcagcggguuuucccgccacucuggaggcgacgacgaggggcugcaagaagaggaacucauugagcagguuccgagcaccacauccgugaucgaacggaacgccagaaucauuaaauggcuguauaccugcaagaaagcuaaggagacaccuagccaggagcagucucgcacccggggauccaagcccagcagauga

SEQ ID NO: 69071 - RNA, 2115 nt, Artificial Sequence
  derived and/or modified sequence opt5 from FAM111B__Homo_sapiens__NP_001136176
augaagcagacccacgccgacacacccguggaucauugccugagcggcaucagaaaauguuccucuacguucaagcucaaaagcgaggucaacaagcacgaaaccgcucuggagaugcaaaauccuaaccuuaauaacaaagaaugcuguuuuacauucacccugaaugggaacucccggaagcucgaccgcucuguuuuuacagccuacggaaagccgagcgaguccauuuauucugcgcugagcgcuaaugauuacuucuccgaaagaaucaaaaaccaguuuaauaagaacauuaucguguaugaggagaaaaccauugacggccauaucaaucuugggaugccccugaagugccucccuagcgauucucacuucaaaaucacauuuggacagcggaaguccagcaaggaagacggccauauucugcgccagugugagaaccccaauauggaaugcauccuguuccacguggucgccauugggagaacccggaaaaagaucgugaaaauuaacgagcuccacgagaagggaucuaaacuguguaucuacgcccuuaagggcgaaacgauugagggcgcucugugcaaagaugggcgcuuuagauccgacaucggagaguucgaguggaagcucaaggaaggccauaaaaagaucuaugggaaacaaagcaugguugaugaggugucuggaaagguccuggagauggacauuuccaaaaagaaggcccuucagcagaaagauauccacaagaaaauuaagcagaaugaaagcgcuaccgacgagaucaaccaucaaucccugauucagucuaaaaagaaggugcacaaaccuaagaaagauggcgaaacaaaggacguugagcacagccgggaacagauccugcccccucaggaccucucccauuacaucaaagauaagacccgccaaacaauuccgagaauccggaacuauuacuuuuguagccugccccgcaaguacagacagauuaauucucaggugcggcgcagaccucaccucgggcggagauaugccaucaaccuggacguccaaaaagaggcgauuaaucuucugaagaacuaccagacccucaaugaggccaucaugcaucaguaucccaacuucaaagaagaggcucagugggugcgcaaguacuuucgggaagaacaaaagagaaugaaucuguccccugccaagcaguucaacaucuauaaaaaggauuucggaaagaugacggcuaauagcgugucugucgccacaugcgaacagcuuaccuacuauagcaaauccguuggcuuuaugcagugggacaacaauggcaacacagggaaugcgaccuguuucguguuuaacggaggcuacauuuuuaccugccgccacgugguccaucugaugguggggaagaauacacaccccucucucuggccggauaucauuagcaaaugcgccaagguuacguucaccuacacagaguucuguccuacccccgacaacugguuuuccaucgagccuuggcugaaagugagcaacgaaaaucuggauuaugcuauucucaagcugaaggagaacggaaaugccuucccucccggccuuuggcggcaaaucucuccccagccguccacagggcugauuuaccucaucggacaccccgaaggccagaucaaaaagauugacggcugcaccgucaucccucugaacgagagacuuaaaaaguaucccaaugauugucaggacgggcugguggaucucuacgacacgacaagcaacguuuauugcauguuuacccaacgcucuuuccuguccgagguguggaauacccauacacugagcuacgacaccuguuuuuccgauggaucuagcggcuccccugucuucaacgcuucugggaaacucguggcccugcacacauuuggacuuuucuaucagcggggcuucaauguccaugcccugauugaauuuggguacagcauggacuccauccucugcgauauuaagaagacgaacgagagccuguacaaaucucugaaugacgaaaaacuugagaccuaugaugaagagaaaggcaagcaggaguccagccuccaggaccaccaaaucgaacccauggaguguuga

SEQ ID NO: 69072 - RNA, 1692 nt, Artificial Sequence
  derived and/or modified sequence opt5 from FAM114A1__Homo_sapiens__NP_612398
augagcgacgaugccggcgacacccuggcuacaggggauaaggccgaggugacggaaaugcccaacuccgacucucucccugaggaugcggaaguccacugcgacagcgcugccguuucccaugagccgacccccgccgauccuagaggagaaggccacgagaaugcugccgugcagggggcuggagccgcggccaucgggcccccugugcaaccccaggacgcuaacgcccuggagccuccgcuuaauggcgaugucacagaagacacccuggcugaguguauugauucugugagccucgaagccgagccccgguccgagaucccucugcaggaacagaacuaccuugcgguugacucucccccuagcggaggcggcugggccggguggggauccuggggcaaaagccugcucucuuccgcuagcgccacaguggggcauggacugaccgcugucaaggagaaagccggcgccacacugcgcauucacgggguuaauucuggauccagcgaaggcgcucaacccaacaccgagaauggcgugccggaaaucacggaugcggccaccgaccaggggccugcugagucucccccuacaucccccagcuccgccucuagaggaaugcucagcgccauuaccaacgugguccagaauacaggcaaguccgugcugaccgggggacuugacgcucuggaguucaucggcaaaaagacgaugaacgugcucgccgaaagcgaucccggguuuaagcggacaaaaacccugauggagcgcacagucucucuuucccagaugcugagagaagcgaaggagaaagaaaagcaacggcucgcucagcagcugaccauggagcgcaccgcccauuauggaaugcuguucgacgaguaccagggccucagccaccuggaagcccuugagauccugucuaaugaaagcgaguccaaaguucaaucuuuucucgcuagccuggauggcgaaaaacuugagcugcucaagaacgaccugauuuccaucaaggauauuuucgccgcuaaggagcuggaaaaugaggaaaaccaggaggagcaggggcucgaagagaaaggagaagaguuugccagaaugcugacagaacuucuguucgagcuccacguggcggccacgccugacaagcugaauaaagcuaugaagcgggcccaugauuggguggaggaagaccaaaccgucgugagcguugauguggcuaaagucucugaggaagagacaaagaaggaagagaaagaggaaaagucccaggacccgcaggaggauaaaaaggaagagaaaaagaccaagacaaucgaagagguguauaugagcucuauugagucccuugccgaaguuaccgcgcgcugcaucgagcagcugcacaaaguggccgaacucauucugcauggccaagaggaggaaaagcccgcucaggaccaggccaaaguccugaucaagcucacgacagcuauguguaacgagguggccagccuguccaaaaaguuuaccaacucucuuaccacagucgggagcaauaagaaagccgaagugcugaacccuaugaucuccucuguucuccuggagggaugcaauagcaccacauacauucaggacgcuuuccaacugcuucuccccgugcugcaggucucccacauccagacgagcugucugaaggcgcagccuuga

SEQ ID NO: 69073 - RNA, 2769 nt, Artificial Sequence
  derived and/or modified sequence opt5 from FAM120B__Homo_sapiens__NP_001273308
auggacagacagaugauccugagccgguccucugugaugggcguccgcgggcuccaaggauucguuggcagcacaugcccccacauuuguaccguggugaacuuuaaggagcuggccgaacaucacagauccaaauacccugggugcacgccgaccaucgucguggaugcuauguguugccuucgguauugguacacacccgagucuuggauuuguggaggccaguggcgcgaauauuucagcgcccugagagacuuuguuaagaccuucacagcggcugggaucaaacucauuuucuucuuugauggaaugguggagcaggacaagcgggaugaaugggucaaacgcagacugaagaauaaccgggagaucucccgcaucuuccauuacauuaagucucacaaagagcagccuggcagaaauauguuuuucauccccagcggccuugccguguuuacccgguucgcccugaagacacucgggcaagaaacccugugcucccugcaggaggcugacuaugaaguugccagcuacggacuccagcauaacugucugggcauucuuggggaggauacggacuaucugaucuacgauaccugcccuuacuuuucuauuuccgagcucugucuggaaagccuugacacagugaugcugugccgcgagaaacucugugaaucucugggacugugcgucgcugaucucccccugcuugccugccugcucggcaaugacaucauuccugaggggauguucgaauccuucagauauaagugucugagcucuuacaccuccgugaaagagaacuuugauaagaagggaaauaucauccuugcggugagcgaccacauuuccaaaguccuguaucucuaccagggcgagaagaaacuggaagagauccugccgcucggccccaacaaggcccuguucuauaaagggauggcuucuuaccuucugccuggacaaaagagccccugguuuuuccagaaaccuaagggcguuauuacacucgacaaacaggugaucuccaccagcucugaugccgaaucccgggaggaagugcccaugugcagcgacgcugagucucgccaggaggucccgauguguacggggccugaaagcagacgggaggugcccguuuauacagauuccgaaccuagacaagaggugcccaugugcucugaccccgaaccucgccaggaggucccgaccuguacaggacccgagagccggagagaagugccuaugugcuccgaucccgagccucgccaggaaguucccauguguaccggcccggaggcccggcaagaggugccuauguacaccgacagcgaacccagacaggaggucccuauguacacagauucugaaccccgccaggaggugccuauguauacgggguccgaaccccggcaggaggucccgauguacaccggaccugagagcagacaagaagugcccauguauacaggccccgagucucgccaggaaguucugauucggaccgacccugaguccagacaggaaaucaugugcacaggccacgagagcaagcaggaggugccgaucuguaccgaucccauuuccaagcaagaagacucuaugugcacgcaugcggagaucaaucagaaacuuccugucgccacagauuuugaauuuaagcuggaggcucucauguguaccaaccccgaaauuaaacaggaggacccuaccaauguggggcccgagguuaagcagcaagugacaauggucagcgacaccgaaauccugaagguggcccgcacacaccaugugcaggcugaguccuaccugguuuauaacauuaugucuagcggagaaaucgagugcuccaauacgcucgaggaugaacuggaccaggcccuuccuagccaggccuuuaucuaccggcccauuagacaacgggucuauucucugcuccuggaggauugccaggacgugaccuccacaugucuggcugugaaagaaugguucgucuacccgggcaacccucuucgccaccccgaucucgugagaccucugcagaugaccauccccgggggaacaccgagccugaagauucucuggcugaaucaagagccugaaauccagguucggagacuugacacccugcucgcgugcuuuaaccugucuuccagccgcgaggagcugcaggccguggaaucucccuuccaggcucuuuguugccuccugauuuaccuguuuguccaaguggauacgcucugucuggaggaccuucacgccuucaucgcccaggcucugugccuccagggcaaaagcaccucccagcugguuaaccugcaaccugauuauauuaauccccgggccgugcagcuugggagccuccuggucagaggccugacaacccucgugcugguuaacucugcguguggauuucccuggaagacauccgacuucaugccuuggaauguguucgauggcaaacuuuuucaucagaaguaccugcagagcgaaaagggguaugcugucgaggugcuccuggaacaaaaccgcuccagacugaccaaauuccacaaucuuaaggccguggucugcaaagccuguaugaaggagaaccggcgcaucacgggcagagcucauuggggaucucaccaugccgggcgguggggacgccagggcagcuccuaccacagaacagggucuggcuauagccgguccucucagggacaaccguggcgcgaccagggccccgggagcagacaguacgagcacgaucaguggcggcgcuauuga

SEQ ID NO: 69074 - RNA, 3291 nt, Artificial Sequence
  derived and/or modified sequence opt5 from FAM120C__Homo_sapiens__NP_060318
augggcgugcagggguuccaagaguuucuggaaaagagaugccccggagccgucguuccuguggaccuccugaaacuugcucggaccgugagccgccagcagcagcaacagcaucugcacagacagcucccgcccacagccgcgcuggcuccuggcgcuccccgggccgcucgcggguccgucccucuucagcccccucugccgcccgccgcucucggagccuacucuggcggggcgggaccuacgagacaccaucaccccgcccaucacuuccaccaucacggccaagcucagccuggccugcaucccccgcugccucccccucccccuccccagcucccgggggcccgggugcugguugaugcuggaagcgcccuuccccgccuguauggcggguaccagaccgacuggguguguggaggccaauggaacgcgaugcucggguaucuguccgcccuuugccaggcuugugccuacccuggaggcgauggccuggagcucgucgugauguuucccgggggacugggcaaggacagacuggcugaaugggggcggcgcugccaggccgagagacaaacagcccagcucaucguuggacacgugggcaauaaagggaccccucccccgcgggcuugguuccugccucccgcgugucuuucucacugcguccgccuggcccucauuagauuucgggugaagguguuccagagccuggaagaucaucaccuugaggucguugccuuuuuccgcgagaacggauuucauggccugcucgcccacgacuccgaauaugcccuguacaauaucccuucuuauuacagcucccaugcucugaaacucagcuggaacggcaagaaucugacaaccaaccaguuccuuaugcaagagguggccaagcagcuggggcucaaaagaaugaauuuucccauuuucgcggcucugcuuggaaaccacauccugccugaugaagaccucgccgccuuucacuggucucugcugggccccgagcauccgcucgcuucccugaaggugcgggcccaccagcuuguccugccucccugugaugugguuauuaaagcugugagcgaguacgucucuuccaucaaggaccccagcaaucucgaugugguugggaaagacguguucaagcagucucaauccagaacagaagauaagaucgagcgcuucaaaaaggccgucgaauauuacagcgugaccacgaaacuguccucucugccugucggaccgagcuuucuuggcuuccggaacaauagacucgggaaucccccucugccccgcaaucaggugggcaccauuuccgcgggaaagccuauguuuagccaucagguuccccagaaagugaaguauccucccccguucccugucggccccaacucuucccugcucuuuagcucucacgcccugggggagagccacgcuuucuccgaagacccuaugcuucaaaauucucccuuugccaacugggcugugagcuacgacuccagcgccucucaguucccgaacuaucugccuuccaaagcgucucccccucucggacccgauagcucccauagcuccucuagcgacggcgaugagcccaauggggccuccucugaccacaucacagaggcuuuucaucaccagccugaauggggaaacccgaaucgggauagaggcagcugggcccagcccguugacaccgggguguccgaggcuagccugggcgauggagaaccucauauucccucucugcuuuccaugagcacacgcaaccacauggacaucaccauuccuccccucccuccggucgcccccgaggugcugcggguggccgaacacagacaucgccggggccugauguacccuuauaucuaccacguucucacgaagggggagauuaagauccccgucugcaucgaggaugaauguaauauggagcugccucccgcugcgcuucuguucagaucugcccgccaauacguguauggagugcucuuuucccuggcugaaacacagcggaaaauggagagacuggccaugcggcgcagacuuccggucgaagugccuagcguuauucucaaggaguggucugccuacaaaggcaagagcccccagacccccgagcugguguccgcucugacauuccgggaauggaccugcccuaaccucaaaaagcuguggcuugggaaggccgucgaggacaaaaauagacgcaugcgggcguuucuggcuuguaugaaaagcgauacccccucuaugcucaacccugccaaugugccgacacaucugcugcuuaugugcugcguucucagauauauggugcaauggcccggaggccgcauccugcacagacaugaacuggacacguuccucgcccaggcugucuccacccagcuguacgagccugaccggcuucaggagcugaagauugaaaagcucgaugcccgcgggauccaacuggcggcucuguucaugagcggcguggacacagcccuuuuugccaacgaugcuuguggacagcccguuccuugggagcacugcugucccuggauuuauuucgacggcaaacuguuucaguccaagcucaucaaggccgggagagaacgggugucucuggucgagcucugcgauggacaggcugaccuggccaccaaaguggaaaagaugcgccaaagcauccuugagggcgugaauaugaaccacccgccucccuccgcgcugcucccuucucccacauucgucccucccaugguuccgagccuguacccugugucccuguauucuagagccauggggagcaugccccuucccccucagggacggucccgcggcuuugcugggcugcauccgauucccccucagggcggaaaacucgagaucgccggcaugguggucgggcagugggcuggaagcagaucuucccggggccgcgggagcuucggaaugcaagugguuucugugggcggccccgggaagggacacggcaaagaacagaccgggagaggauccaagggccauaagaaagggaauaagcagggaagcucugauggcgucuccaaaagccuggagcuccaccaaggccgguccagaagccaggugaacgggaacucuggagcccugauuaaggaagagaaaagcgaccaccgccuuccugcccccucccagugugcucugucucgggauagcaacgaaugcaacaauggcaacagauaccucccuaugaauaaccgcgagaagaaucaucugcaggagcaaaaacuggaaacgguugcgcagcggaaggaggacuga

SEQ ID NO: 69075 - RNA, 1368 nt, Artificial Sequence
  derived and/or modified sequence opt5 from FAM124B__Homo_sapiens__NP_001116251
auggacgagacccagggcccccuggccaugacagugcaccuccuggcuaacagcgggcacggaucccuucugcagagaacgcucgaucagcugcuugacugcaucuguccugaaguccggcuguuccagguuucugagcgcgccagcccggugaaguacugcgaaaaaucccacucuaagagaagccgguuucccggcauguccgugcuccuguuccugcaugagucuccuggggaagaucgccucuuuagaguccuggacagccuucagcacucccccuggcaauguuauccuacccaggauacacggggacgccugugccccuacuucuuugcgaaucaggaguucuauagccucgacucucagcugccuauuuggggcgugagacaaguucauuguggguccgagauccuucgggugacccuguacugcagcuuugauaacuaugaagacgcuauucgccucuacgagaugauccugcagagagaagccacacugcagaaaucuaauuucugcuuuuucguccucuaugccuccaagagcuuugcucugcagcuuucucugaaacaacucccgcccggaauguccguggauccuaaggagagcuccguucugcaguucaaggugcaggagauuggccaacuugucccccugcucccuaaccccuguaugccgaucucuagcacccgguggcagacacaggacuacgauggcaauaaaauccugcuccaggugcaacugaacccugaacugggggugaagaauggcauucuuggagccgggaugcugccccucggaucccgccugaccagcgucucugcuaaaagaacguccgagccucggagccagcgcaaccagggcaagagaucucaggggcacagccuugaacugcccgagcccuccggaucuccuaccagcgaccggugugccggcacauccuggaaaagcccgggcagaucuuuucaaguuuccagccccgcgaugggggcccaccuccaucugucuucccaccaucuggaaagcggagcucgcaugaaggugcucaaucgggagaacuccuuccagaagcuggaggccgaaaccaauguggauacaggccuuaccaucauuaacucugagccuagacagacguacuucgggggauuuccccgcgaccugcagacaagccaaccucccuucugccucccggcuuccucucugggcgucgccaccagcaaaaauaacuccgugcugaaggaacggguuagcccucuuccccucgcggggcagagagaccugggaacacgcaaaaccaucucugagugucugcuccaucugcaagugcagggcgaagagaaggaggaagaugaggaagaguuuuucauuuga

SEQ ID NO: 69076 - RNA, 1566 nt, Artificial Sequence
  derived and/or modified sequence opt5 from FAM126A__Homo_sapiens__NP_115970
auguucaccagcgagaagggcguggucgaagaguggcuguccgaauuuaaaacacuccccgagacgucucugccuaacuacgccaccaaucuuaaggacaaaagcucccugguuucuagccucuauaaggugauccaggaaccgcaauccgagcugcuugagcccgugugccaccagcuguucgaauuuuacagaucuggggaggaacagcuccugcaguucacacugcaauuucucccugagcugauuugguguuaucuugcugucagcgccucccggaacgugcauagcucuggaugcaucgaggcgcugcuccugggcguuuacaaucuugaaauuguggauaaacaggggcacaccaagguccuguccuucacaauccccagccucucuaagccuuccguguaucaugagcccagcucuauuggauccauggcucugaccgaaagcgcccugucccagcacggccucucuaaaguuguguacagcgggccucauccgcagcgcgagaugcugacagcccaaaacagauuugaaguccuuaccuuccugcuccuguguuauaaugcugcccuuacguacaugcccuccgugagccugcagucucucugccagaucuguucccggaucugcguguguggauacccucgccagcacgucagaaaguauaaaggcauuagcucucggauccccguuagcuccggcuuuauggugcaaaugcugaccgggauuuacuucgcuuuuuauaacggagagugggaccuggcccagaaggcgcucgaugacaucauuuaccgcgcccagcuggagcuuuauccugaaccccugcucguggcuaaugccaucaaggcuucucugccgcacggcccuaugaaaagcaacaaggaggggacaagaugcauucaagucgaaaucacccccacauccagccggaucucucgcaaugccgugaccuccaugagcauuagaggacaucgguggaaacgccacggcaacacggagcuuacagggcaggaggaacugauggagaucucugaaguugaugagggauucuacuccagagcggccagcuccaccucucagagcggccucuccaauucuagccauaacuguuccaauaagccuagcauuggcaaaaaccaccggcgcucugggggauccaagacaggcgggaaagaaaaggagaccaccggagaaagcugcaaagaccacuuugcuagaaagcagacacaacgggcccagucugagaaucuggagcugcucucccugaagagacuuacgcugaccacaagccagucucuccccaaacccagcucccauggccuggcuaagaccgccgccacaguguucagcaaaucuuucgaacaggucuccggggugaccguuccucacaacccgagcuccgcugugggauguggcgcgggcacggaugccaaccgcuuuucugcuugcagccugcaagaggaaaaacuuaucuaugucuccgagcggacagagcuccccaugaagcaucagucugggcagcagagaccucccagcauuuccaucacccugucuaccgacuga

SEQ ID NO: 69077 - RNA, 2787 nt, Artificial Sequence
  derived and/or modified sequence opt5 from FAM129A__Homo_sapiens__NP_443198
augggcgggagcgccuccucucagcuggacgagggaaagugcgcuuacaucagaggcaaaaccgaagccgcgauuaagaacuucagccccuauuacucccggcaauauucuguggcuuuuuguaaucacguccgcacagagguugaacagcagagagaucucacgagccaguuccugaaaaccaagccuccgcuugcccccgggacaauccuguacgaggccgaacucucccaauuuucugaggacauuaaaaaguggaaggagcgguaugugguggucaaaaacgauuacgcuguggaaagcuaugagaauaaggaagccuaccagcgcggagcugccccuaaaugcagaauccugcccgcgggcgggaagguucuuaccuccgaggacgaguacaaccugcucagcgaucggcauuucccugacccccuggccucuuccgaaaaagagaauacacagccuuuugugguccugccgaaggaguuccccguguaucucuggcagcccuuuuuccgccacggauacuuuuguuuccaugaggcugccgaucaaaagagauuuagcgcucugcuuucugacugcguucggcaccugaaccaugauuauaugaaacagaugaccuucgaagcccaggcguuucucgaggccgugcaguucuuccgccaagagaagggccacuacggcuccugggaaaugauuacaggggacgagauccagauccugagcaaucuugucauggaggaacugcuccccacccugcagacggaucugcucccuaaaaugaagggaaagaagaacgacagaaaacggaccuggcugggccuucuggaagaggcuuauacacucgugcaacaccaggugucugaggggcuguccgcccuuaaggaagagugucgcgcucugaccaagggacucgaaggcacaauuagaagcgauauggaccagaucgucaauuccaaaaacuaccugauugggaagaucaaagccaugguugcccagcccgcugagaagucuugccuggaaagcgugcaaccguuucucgcguccauucuggaggagcuuaugggaccugugagcucuggcuucuccgaaguccgggugcuguuugagaaagaaguuaaugaggugagccagaacuuccagaccacgaaggacucuguccagcucaaggagcaucuggaucgccuuaugaaucugccccuccacagcgugaaaauggaaccuuguuauacaaagguuaaccugcugcaugagagacuccaagaccugaaaucccgguuuagauucccccacaucgaucuugugguccagcgcacccagaauuacaugcaggaacugauggagaacgccguguuuacauucgaacaacuccugucuccccaucugcagggcgaggcuagcaagaccgccgucgccauugagaaagugaaacuucggguucucaagcaguacgacuaugauuccagcaccauccgcaaaaagaucuuucaggaagcucuggugcaaauuacacugccuacgguccagaaagcccucgcgucuaccugcaagccggagcugcagaaauacgaacaauucaucuuugcugaccacacaaacaugauucacguggagaauguuuaugaagagauccuucaucagauucugcucgaugagacccugaaggugaucaaggaagccgccauccugaaaaagcacaaccuuuucgaggacaauauggcucuccccuccgaaagcgucucuucccugacagaucugaaaccucccaccgggagcaaccaggccuccccugcuagacgggccucugcgauucuccccggagugcugggcagcgagacgcuuuccaaugaaguguuucaggagucugaggaagagaagcaaccggaaguuccuagcucccuggccaaaggggagagccucucucugcccggaccuuccccuccucccgacggcacagagcaggucaucauuagcagaguggaugacccgguggucaacccuguggcuaccgaagacaccgccgggcugcccggaacauguucuuccgagcuugaguucggcggcacccucgaagaugaggaacccgcucaggaggaaccugagccgaucacagccagcgggucucugaaggcgcugcgcaaacuccugacggccagcguugaagugcccgucgacuccgcuccugugauggaggaagauaccaauggagagagccauguuccccaggagaacgaagaggaagaggaaaaggagccuucucaagccgcugccauucaccccgacaauugcgaggaauccgaggugagcgaacgggaggcccagccucccuguccggaggcucacggcgaggaacuugggggauucccugaagucggcucccccgcgucuccucccgccagcgggggccugacagaggaaccgcucggaccuauggagggcgagcugcccggggaggcuugcacccugacagcccaugaaggaagaggcgggaagugcaccgaagagggagaugccucccagcaggaaggcuguacgcuugggucugacccuaucugccucagcgagucccaagugucugaggaacaggaggaaaugggcggacagagcuccgcugcccaagcgaccgcuagcguuaacgccgaggaaaucaaaguggcccgcauucacgagugucagugggucguggaggaugcucccaaucccgacgugcugcugucucauaaggaugacgucaaagaaggcgaagggggacaggaauccuuuccugagcucccgagcgaggaauga

SEQ ID NO: 69078 - RNA, 2202 nt, Artificial Sequence
  derived and/or modified sequence opt5 from FAM129B__Homo_sapiens__NP_001030611
augggcuggaugggggagaagaccggaaaaauccugacagaguuccuccaguuuuacgaggaccaauauggcguggcccuguucaacagcaugagacacgaaauugaggggacgggacuuccccaggcucagcugcucuggcggaaggucccucuggaugaacgcaucgucuuuuccggcaaucuuuuccagcaucaagaggacucuaaaaaguggagaaaccgguuuagccuggugccgcacaauuacgggcucgugcuguaugagaacaaagccgcguacgaacgccagguucccccuagagcugugauuaauuccgccggauauaagauccugaccucuguugaucaguaccucgagcugauuggcaacagccuucccggcacaaccgccaaguccgggucugcuccuauccugaaaugccccacacaguucccucucauccuguggcauccguaugcccggcacuacuacuuuuguaugaugaccgaagcugagcaagacaaguggcaggccgugcuucaggauugcauucgccauuguaauaacggaauccccgaggacagcaaagucgaaggcccugcguucacagaugccauuagaauguaucggcaguccaaggagcuguacgggaccugggaaaugcucugcggaaaugaggugcaaauccugagcaaccugguuauggaagaacucggccccgagcugaaagcugaacuugggccucgccugaagggaaagccccaggagagacagcggcaauggauucagaucucugacgccguguaucacauggucuacgaacaggcuaaagcccgcuuugaggaagugcucuccaaggugcagcaaguccagccggcgaugcaggccguuauuagaacggauauggaccagaucaucaccagcaaagagcaccuggcuucuaagauucgggccuucauccuuccuaaagcugaggugugugugcgcaaucauguccaacccuauauuccuuccauccuggaagcccucauggugcccacaagccagggcuuuaccgagguuagagauguguucuuuaaggaagucacagacaugaaccugaaugugauuaacgagggcgggaucgauaaacugggagaauacauggagaagcucucucggcuggccuaucacccccuuaagaugcaguccugcuacgagaaaauggaaagccugagacucgacggccugcagcaacgcuucgacguuuccucuaccagcguguucaagcagcgggcucagauccauaugagagagcagauggauaaugcggucuacacguuugaaacacuucugcaccaagagcucgggaaaggaccuaccaaggaggaacuguguaaauccauucagcgcgugcuggagcggguccucaagaaguaugacuacgauagcagcuccgugagaaaacgcuucuuucgggaagcccugcuucagaucagcauuccguuccugcucaagaaacuggcucccacaugcaagucugagcugccuagauuucaagaacuuaucuucgaggacuuugcccgcuucauucucguugagaacaccuaugaagaggugguccugcagaccgugaugaaagauauccugcaggccguuaaggaagcugccgugcagcggaagcacaaccucuacagagacagcauggucaugcauaauuccgaucccaaccugcaccuucuggcggagggcgcuccuaucgacuggggagaagaguauucuaauagcgggggcggcgggucccccagcccgucuacaccugaguccgccacgcucagcgaaaaacgccggagagccaagcaaguggugucuguuguccaggaugaggaagugggacugcccuuugaggcuuccccugaaucucccccucccgccuccccggacggcgugaccgagauucgggggcugcuugcucagggacuccgcccugagucucccccucccgccggcccgcugcugaacggggcgcccgccggcgaaagcccucagcccaaagcugccccugaggcuuccucucccccugccagcccccuccaacaucugcuuccgggaaaggcggucgaucugggcccucccaaaccuuccgaccaggaaacaggggaacaggugagcucucccuccagccacccggcccuccauaccacaaccgaggacucugcuggaguucagacggaguucuga

SEQ ID NO: 69079 - RNA, 1494 nt, Artificial Sequence
  derived and/or modified sequence opt5 from FAM134B__Homo_sapiens__NP_001030022
auggccagccccgcuccuccggagcacgccgaagagggcugccccgcgccugcugccgaggaacaggcucccccuucucccccuccgccccaagccuccccugccgaaagacagcagcaggaggaggaagcucaagaggccggggcggccgaaggagcuggccuccagguggaggaggccgcugggcgggccgcggccgcugucaccuggcugcugggagaacccguucuuuggcugggcugucgcgccgacgagcuccugagcuggaagagaccucuucggucccugcucggguucguggcugccaaccugcuguuuugguuccucgcccugacacccuggcgcguguaccaucuuaucucugucaugauucugggaagagugaucaugcagauuaucaaagauaugguucucagccggacgcgcggcgcucagcuguggagaucccuuucugaaagcugggaggugauuaauuccaagccggacgaacggccucgccugagccacugcaucgcggagucuuggaugaacuuuuccaucuuccuccaagagaugagccuguuuaaacagcagucucccggcaaguucugucugcucgucugcuccguguguaccuuuuucacaauucuggggagcuauaucccuggaguuauucuuucuuaccugcuccugcuuugcgccuuucuguguccccucuucaaaugcaaugauaucggccagaagauuuauuccaagaucaaaagcgugcugcugaagcucgacuuugggauuggagaauacaucaaccagaaaaagagagagcgguccgaagcugauaaagagaagucucauaaggacgauagcgaacuggacuucuccgcccuuugucccaaaaucagccugaccgucgccgcuaaggagcucucuguguccgauacagacgugagcgaggucucuuggaccgauaauggcacauuuaaccugagcgaaggguauaccccucaaacggacaccuccgaugaccuugaccgcccgucugaggaaguuuucagcagagaucuguccgacuuccccagccucgagaauggaaugggcacaaacgaugaagacgagcugucucugggccucccuaccgagcugaaacggaagaaagaacagcuugauuccgggcaccgccccagcaaggagacacaaucugccgcgggacugacccucccucuuaauuccgaccagacguuucaucugaugagcaaccuggcuggcgaugugauuacagccgccgugaccgcugccaucaaagaccagcucgaagggguccagcaagcucugucccaggccgcgcccauuccggaggaggauacagacaccgaagagggagaugacuucgaacugcucgaccagucugagcuggaucagaucgaaagcgagcuuggccugacccaagaccaggaggccgaagcucagcagaauaagaaguccucuggguuucucagcaaccugcugggaggccacuga

SEQ ID NO: 69080 - RNA, 3960 nt, Artificial Sequence
  derived and/or modified sequence opt5 from FAM135A__Homo_sapiens__NP_001099001
augaccgaggugcaggccauggucgaguucagcguugaacugaacaaguuuuacaauguggaccucuuccaaagaggcuuuuaucagauccgggcuuccaugaaaauucccucucgcaucccucacagaguggaagccagccugcuucaugcgacagggaugacgcuggcuuucccggccuccguccacgauucucucauuugcagcaagaccuuucagauccuguacaaaaacgaggaagugguucuuaaugacgugaugauuuucaaggucaaaaugcugcucgaugagcggaagaucgaggaaacacuggaggaaaugaacuuucugcucucccuggaccuucauuucaccgauggagacuauucugccgaugaccugaaugcucuccagcugaucagcucccgcacacuuaagcugcacuuuagcccccauagaggccuccaccaccaugugaacguuauguucgauuacuuucaccugucuguggucuccgugaccgugcaugccagccuggucgcucuccaccaaccucugauuucuuucccccggccuguuaaaacaaccuggcuuaaucgcaacgcccccgcgcagaauaaggacuccgugaucccuacgcuggagagcguggucuuugggauuaacuauaccaaacagcucucuccggauggauguuccuucaucauugccgacagcuuccugcaccaugcuuacagauuucacuauacacuuugcgccacccugcuccuggcuuucaagggccugcauuccuacuuuaucacagugaccgaggaaauucccucuugucagaaacucgagcuggaagagauggauguugaagcccggcuuacggagcugugcgaggaagugaagaagaucgagaauccugacgaacucgcggagcugaucaacaugaaucuugcccaacuguguagccuccugauggcucugugggggcaguuccucgaagucauuacacugcacgaggagcuucgcauccugcucgcccaggaacaucacacccugagagugcggcgcuuuuccgaggcuuucuuuugcuucgaacaccccagagaggccgccauugcuuaccaggaacugcaugcgcaaagccaccuucagauguguacagccaucaaaaacaccucuuuuugcuccagccucccuccccugccgauugaguguucugagcuggacggagaucucaauagccugccuaucaucuucgaagaccgguaucuugauuccguuaccgagggcaagcuggacauuucucaggaugacagcgaaaucacacaaauggagcauaaccucgcuucccgcagaagcucugaugacugccacgaucaccagacgacccccucccugggcgugcggacaauugagaucaaaccuagcaacaaggaccccuuuucuggggaaaauauuaccgucaaacugggacccuggacagagcuuagacaggaagagauccucguggauaaccugcugccuaauuucgaaucccucgagagcaacggcaaguccaaaucuaucgagauuaccuuugaaaaggaggcccugcaggaagccaagugucuuagcaucggggagucccugacgaaacuccgcucuaaucugccggcucccagcacaaaggaauaccaugucgugguuuccggagacaccauuaaacugccugacaucagcgccaccuaugcgucuucccgguucagcgauucuggcguggaguccgagcccagcucuuucgcuacacacccuaacaccgaccuugucuuugaaacagugcaagggcagggacccugcaauagcgagagacucuucccgcagcugcugaugaagccugauuacaacguuaaauuuucccucggcaaucauugcacggaaagcaccucugccauuuccgagauccagagcucccugacaucuauuaacagccuucccuccgacgaugaacugucuccugacgagaauagcaagaaguccgugguccccgagugucaccucaacgauucuaaaaccgugcugaaucugggcacaaccgaccuuccuaagugcgaugacacgaaaaagagcuccaucacccuccaacagcagagcgugguuuucucugggaaccuggauaaugaaacagucgccauccauucccugaacagcucuauuaaagacccccuccaguuuguguucuccgaugaggaaaccagcucugacgugaaguccagcuguuccagcaagccgaaccuggacacaaugugcaaaggauuucaaucuccugauaagagcaauaacuccaccggcacggcuaucacacuuaauucuaaacugauuugucucgggacccccugcgucaucagcggauccauuucuagcaacacagacguguccgaggaucgcaccaugaagaaaaauucugacguucugaaccugacccagauguauagcgagauccccacaguggaauccgagacgcaccuuggcaccagcgauccuuucucugccuccacagacaucgucaagcaggggcugguggaaaauuacuuuggaagccagucuuccaccgauauuagcgacacaugugcuguuuccuauucuaacgcccucagcccgcaaaaggagaccuccgaaaaagagaucagcaaucugcagcaggagcaagauaaggaagacgaggaagaggaacaggaucagcagauggugcaaaacggcuacuacgaggagacggacuauucugcgcucgauggcacaauuaaugcccacuacaccucccgggacgaacugauggaggaaagacuuaccaaaagcgagaagaucaacucugacuaucugcgcgaugggauuaauaugcccacagucugcaccagcggaugucucuccuucccuucugcuccccgggaaagcccuugcaacgugaaauacuccucuaagagcaaauuugacgccaucacaaagcagcccuccagcacgucuuauaauuucaccuccagcaucuccugguacgagucuagcccuaagccccagauucaggcuuuucugcaagccaaagaggaacugaaacuucugaagcucccgggcuucauguauuccgagguuccucugcucgcgucuagcgugcccuacuucuccgucgaagaggaggaugggagcgaagacggagugcaucugaucguguguguccacggccuugaugggaacucugccgaccugagacucguuaagacauacauugagcugggccugccuggaggccgcaucgauuuucuuauguccgaacggaaccagaaugacaccuucgcugauuuugacagcaugacagauagacugcucgacgagauuauccaguauauccagauuuacucucugaccguguccaaaaucagcuucauugggcauucucucggaaaccugaucauucgcagcgugcuuacgcggcccagauuuaaguauuaccugaauaagcugcacaccuuccucucccugucuggcccgcaucuugggacacuguauaacagcuccgcccucgucaauaccggacugugguuuaugcaaaaauggaagaaaagcggcucccuccugcagcuuacaugccgggaccacucugauccucgccagaccuuccuguacaagcugagcaacaaagcugggcuccacuauuuuaagaaugugguucuggugggcucccuucaagacagauacguccccuaccauucugcccggaucgaaaugugcaagacagcccugaaagauaagcagagcggacagauuuauuccgagaugauccacaaccuccugagaccugugcuccagucuaaagacuguaaucugguucgcuacaacgugaucaaugcgcuucccaacaccgcugauagccugauuggccgggccgcucauaucgccguccuggacuccgagauuuuccucgaaaaguuuuuccugguggccgcucuuaaauauuuccaauga

SEQ ID NO: 69081 - RNA, 4221 nt, Artificial Sequence
  derived and/or modified sequence opt5 from FAM135B__Homo_sapiens__NP_056996
augagcgagauccagggcaccguggaguucuccgucgaacugcacaaguuuuacaacguugaccucuuccaaagaggguauuaccagauucgggugacacugaaagugucuagccgcaucccccauagacuuuccgccucuauugcuggacagacggaaagcuccucucugcacagcgccugcguccaugauuccaccgugcacagccggguuuuucagauccucuaucgcaaugaggaagugccuauuaacgacgcggucguguucagaguucaucugcuucugggcggggagcggauggaggaugcucucucugaaguggacuuucaacugaaggucgaucugcacuucacagacuccgagcagcagcuccgcgauguggccggagccccgauggugagcucuagaacccugggccuucacuuucauccccggaaugggcugcaccaucaggucccuguuauguucgacuacuuucaccucuccgugaucagcgugacaguccacgcugcccugguggcccuucaacagccccugaucucuuucacccgcccuggaagaggcuccuggcucggcaaagggggacccgauacaggccaggaacagagcauuaucucccuggagaaccugguuuuuggggccggauauuguaagccuaccucuagcgagggcuccuucuacauuacgagcgaaaauugcaugcaacaugcgcacaaauggcaucgggaccucugucugcuucugcuccacgccuaucgcgggcugagacuucauuuucuggugaucaugcgggauauuccggagcucccccacaccgaacuggaggcucuggccgucgaagagacacucucucagcugugcuccgagcuucagaugcugaacaauccugaaaagaucgcugagcaaauuagcaaggaccucgccuggcugaccucucacaugaugacacuuuggacccaguuccuggauacggugacacuccauagccagguuaccacauaccugacccaggaacaccauacccugcgcgugagacgguucuccgaggcguuuuucuacauggaacaccaaaaacucgccguccugacauuucaggagaaccuuauccagacgcacucucagcugagccucgacaucagaaauuccgaguaucugaccagcaugcccccucugcccgcugaaugucuugacauugauggagacuggaacacacucccggugaucuucgaggaucgcuacgucgacugcccugccaccggccauaaucugucuguguaucccaacuuugauguuccugugacaucccccaccauuaugaaucugaaggacaaagaagauaacuguauggucaauagcaaccucucuuuccgggaggaccuggugcuuuccacgaucaagcccagccaaauggauuccgacgaagagguuauuagaugcccugagccgggcgaaaacguggcuacacagaaucacauggauauguguucugagagccaggucuacaucuccaucggggaauuucagaacaaagccggagugcccgaggacgagugcuggaccggccaaaccucugacgccgggacauauccuguggcugauguugacaccagccgccggucccccggaccugaagauggccaggcgcccguccugacauacauugacgucaagagcucuaauaagaacccguccagagccgagccucucguggcuuucaaugcccagcaugaaagccggucuucccgcgauaaauaugggcuggacagaacgggacugagcaagguggugguuggcggcucucaccagaacgccaucagcuccgauaaaaccacacuucaugagcucagcacccuggggaagggaauugaccaagaaggcaaaauggugcugcucucucugaaacuuacacccuccgagccuugugauccccugagcuccacccuccgcgagccucuggacauccggucuagccugaaggauucccacacggaggaacaggaggaacuuucuguccucagcggggugauuaagagauccucuagcaucaucuccgacagcggaauugaaucugagcccuccagcguugcuuggucugaggcccgcucccgggcgcuggaacugccgagcgauagagaggugcuccacccuuuuguccggcgccaugcucugcacagaaauucucuugaaggcgggcauaccgaguccaacacaagccugcccuccggcauccaggccagccucaccucuauuagcucccugcccuucgaagaggacgagcgggaaguggcccugacaaaacuuaccaagucuguuagcgcuccucacaucuccucuccggaggaagccgcugaggacgccgauacgaagcaacaggacggaggcuuugcggagcccagcgauaugcauuccaaaucucaggggagcccuggauccugcagccagcucugcggcgacucugggacagaugccggagcugaccacccccugguggaaauuguccuggaugccgacaaucaacagggcccuggguacaucgauauucccaagggcaaaggaaagcaguucgacgcucagggccacugucucccugaugggagaaccgagaacacacccggaguggaaaccaagggccugaaucuuaaaaucccgcgcgugaucgcccuggagaacccucggaccagaucccuccaucgcgcgcuggaagagacacccaaggggaugccuaaagaccugaaugucggacaacaggcccuuagcaacucuggcauuuccgagguugaagggcugagccagcaccaggugcccgagcucuccugcacgucugcugccgaugcuaucaauagaaacagcaccggccaacagucccagagcggaucuccguguauuauggacgacacagccuuuaaccggggcgugaaugccuucccugaagcuaagcauaaagcggggaccgucugccccacagugacccacuccguucacagccaagugcugaagaaccaggagcucaaggccggaacgucuaucaugggcagccaucugacauccgcugaaaccuucacccuugauucucugaaagccgucgaggugguuaaucucagcguguccuguacagcuaccugccugccuuuuucuagcguccccaaggagacacccgcucgcgccggguucuccagcaaacagacgcuguuuccuauuacccaccagccgcuuggaucuuucggcgugguuuccacacauagcuccacccuggacgaagaggugucugaaagaauguuuagcuucuaccaagcgaaggagaaauuuaagaaggaacucaaaaucgagggguuccuguauuccgaucucacaguccuggcuucugacauccccuacuuuccucccgaggaagaggaagagaaccuugaggauggcauucaccuggugguguguguccauggacucgacggcaauagcgccgaucugcggcugguuaagaccuucaucgaacuugggcugccuggaggcaaacucgacuuucugauguccgagaagaaccagauggauacguucgccgacuuugauaccaugacagaccgccuccuggacgaaauuauccagcacauucagcuuuauaaucugagcaucucuagaaucuccuucauugggcacagccugggaaacaucauuauccggucugugcucacccgccccagauuccgguacuaucugaauaaacuucauacauuucugucccucagcggcccucaccugggcacccucuacaacaauucuacacuggugagcaccgggcuuuggcugaugcaaaagcugaaaaaguccggaucucuccugcagcuuacguuccgcgauaacgcugaccugagaaagugcuuucucuaucagcugagccagaaaacaggccuccaauacuucaagaaugucgugcugguugccuccccgcaggaucgguacgugcccuuucauagcgcgagaauugagauguguaaaaccgcucuuaaggaccgccacaccgggccugucuaugccgaaaugaucaacaaucugcugggaccccucguggaggccaaagauugcacacugauccggcacaacguuuuccaugcccuuccuaacaccgcuaauacgcugauuggcagagcugcccacaucgcggugcucgacuccgagcuguuucucgaaaaguucuuucuggucgccgggcuuaacuacuucaaguga

SEQ ID NO: 69082 - RNA, 417 nt, Artificial Sequence
  derived and/or modified sequence opt5 from FAM136A__Homo_sapiens__NP_116211
auggccgagcugcagcaacucagagugcaggaagcugucgagagcaugguuaagucccuggaacgggagaacauccgcaaaaugcagggccuuauguucagaugcucugccagcuguugcgaagacucccaggcgucuaugaagcaagugcaccaguguauugagcggugccaugugccccuggcucaggcccaggcccucgucaccagcgagcuggaaaaauuucaagaucgccuugcuagauguacaaugcacugcaaugacaaggccaaagauuccaucgacgcugggucuaaggagcuccaggugaagcagcagcuggauagcuguguuacgaaaugcguggacgaucauaugcaccugauuccuaccaugacaaagaaaaugaaggaagcccugcucuccaucggaaaauga

SEQ ID NO: 69083 - RNA, 2094 nt, Artificial Sequence
  derived and/or modified sequence opt5 from FAM13A__Homo_sapiens__NP_001015045
auggccugcgagaucaugccccugcagagcucccaagaagacgagagaccucucucuccguucuaccugagcgcucacgugccccaggucuccaacguuucugccaccggcgaacuucuggagcggacaauucgcagcgcgguggaacagcaucucuuugaugugaauaacuccgggggacagucuagcgaggacuccgagagcggcacgcugucugcuuccagcgccaccucugccagacaacggcgcagacaguccaaggaacaggaugagguccggcacgggcgcgacaaaggacuuaucaauaaggaaaacacaccuagcggcuucaaucaucuggaugacuguauucucaacacccaggagguggagaaaguucacaagaauacauuugggugcgcuggagaaagaucuaaacccaagcggcaaaaguccagcaccaaacuguccgagcugcaugauaaccaggacggccucgugaauauggaaucucugaacagcacacgcucccacgagagaaccggcccugaugacuucgaauggaugagcgaugagcggaaggggaaugagaaagacggaggccacacgcagcauuuugaaucucccaccaugaagauccaggagcacccuucccuuagcgauacaaaacaacagcgcaaccaggacgccggggaccaagaagagucuuucgucagcgaagugccgcaguccgaucugaccgcucucugugacgagaagaauugggaggaacccauuccugccuuuucuagcuggcagagagagaacuccgauagcgacgaagcgcaucugucuccccaggccggacggcuuauccgccaacugcucgaugaggacuccgauccuaugcugagccccagauucuaugcuuacggccagucucggcaguaucuggacgauacagaaguuccgccuuccccucccaauagccacuccuuuaugagacgccggucuagcucccucgggucuuacgacgaugagcaggaggaccugacccccgcccaacuuacgagacgcauccagagccugaagaaaaagauucggaaauucgaagacagauuugaggaagagaagaaauaucgccccucccacagcgauaaggcugccaacccugaggugcucaaauggacaaacgaccuggcgaaguuccggagacagcuuaaggaaucuaaacugaagaucuccgaggaagaucucaccccgcgcaugcggcagagaagcaauacacugcccaaaucuuuuggaucccaacuggagaaggaagacgagaaaaagcaggagcucgucgauaaggccauuaaaccuagcguggaagcuacccuggagucuauccagcgcaaacuucaggaaaaacgggccgagagcuccagacccgaagacauuaaggauaugaccaaagaccaaaucgcuaacgagaagguggcccugcagaaggcccuccuguacuaugagagcauucauggccggccugucacaaagaaugaacgccagguuaugaagccccuuuacgauagauaccggcuggugaaacaaauccucucuagagcuaacacgaucccgauuaucggcuccccuagcuccaagcgccggucuccccugcugcagccuauuaucgagggggaaaccgcgagcuucuucaaagagauuaaggaagaggaggaaggauccgaggacgauucuaaugugaagcccgacuuuauggucacacucaaaaccgauuucagcgccagaugcuuucuggaccaguucgaagacgaugcugacggcuuuaucuccccuauggaugacaagauccccucuaaauguagccaggauacagggcuuuccaaccugcacgccgccagcauuccggagcuccuggagcaucugcaagaaaugcgcgaggaaaagaaaagaauccggaagaaacuucgcgacuucgaggauaacuuuuucagacagaauggacggaaugugcagaaggaagaccgcaccccuauggcugaggaguauucugaauacaagcacauuaaagccaagcucagacugcuggagguucucaucuccaaacgggauacggacagcaagucuauguga

SEQ ID NO: 69084 - RNA, 1464 nt, Artificial Sequence
  derived and/or modified sequence opt5 from FAM13C__Homo_sapiens__NP_001001971
auguucagcugcuuuuguuucucccugcaggacaacucuuuuagcuccaccacagugacggagugcgaugaagaccccgucucucuccacgaggaucaaaccgacuguagcucccugagagaugaaaauaacaaggagaauuacccugacgccggcgcucuuguugaagaacaugccccgcccucuugggagccucagcagcagaacguggaagcgacagugcuggucgauagcgugcuccggcccuccauggggaauuucaaaagccgcaagccuaaaucuaucuuuaaggcugaguccggaagaagccacggcgaaucucaagagaccgagcauguuguguccagccagucugaaugccagguccgggccgggacacccgcccacgaguccccucagaacaaugcuuucaaaugucaagaaaccgugcgccugcagccgagaauugaccagcggacagccaucagccccaaggaugcuuuugagacccgccaggaccuuaacgaagaggaggccgcgcaaguucauggagugaaggauccugcccccgcuuccacgcagucuguccuggccgacggcaccgauagcgcugacccuucccccgugcacaaagacgggcagaaugaagccgauagcgcgccggaggaccuccacucugugggaacauccagacugcuguaucauauuaccgauggcgacaacccucuccugagcccccggugcucuaucuucagccaaucccagcgcuuuaaucuugauccugaaucugcccccucucccccuuccacacagcaguucaugaugccgagaagcagcucccgguguagcugcggcgacgggaaggagccccaaaccauuacgcagcugacaaaacacauccagucucucaagcgcaaaaucagaaaguuugaagagaaguucgagcaggagaaaaaguaccgggucaccaaacaagauaagaaccugauuaaaccucuuuaugaccgcuacagaaucauuaagcagauccuguccacacccagccucauuccuaccauccaggaggaagaggauuccgacgaagaucggccccagggaucucaacagccgagccuggcugacccugccucccaucugcccguuggcgaccaccucaccuauucuaaugagacagagccugugagagcucugcuucccgaugagaaaaaggaagugaagccucccgcccugagcauguccaaccuccacgaagccacgaugccgguccugcuugaccaucugcgcgagacccgggcugauaaaaagagacuccgcaaagcgcugcgggaguuugaggaacaguucuucaagcagacagggagaagcccucaaaaagaagaccgcauucccauggccgaugaguacuaugaauacaagcacaucaaggcuaaacugcggcuccuggaggugcuuaucucuaagcaggacguugccaaaaccauuuga

SEQ ID NO: 69085 - RNA, 1449 nt, Artificial Sequence
  derived and/or modified sequence opt5 from FAM149A__Homo_sapiens__NP_056213
augcuguucgagggcaaggugaacccccagacccaaagccuccuggccgaaugcggggaguggacaagacggucccuucaccuccgcguccucggaagacagcugauccuuccuacggacaaaggcguucagcauuuucaggggucuaccccggcuagcgccgugcaccggcccccucuguccgcguguggacauucuagcaauauucgcgaacucugcaucuccggcucucaaauugugcccgcugcccugagcgccuccgcucugccugggcccgaugacacaggagucgccgaucucaccgcuagaagcucucuggaggaagagguguaccacguugacggcaagaucgaggaauauuucgccuuugaucggaaagaggacgaugacgaaugucuugagcagaagccugcgcagccgggccgcaaauggagaaagcuggggcugcccccugugagcccccgggauugcgucaaggacgccguggcugccgagguuuucgaucauguguggacaaacauggucgaacugcuugaggaacugauucgcaaacacugggagaccacacucaccgaaggaaagaaacagagagagacgcugaagguggcuggcaaucgguuuccucacgugcuggucccccaugcccacgcggacggggccuccggaccgccuucuggccaugcugaggcccacgggaucucccucgcuagccgccugaaucccccucaaauccaccauuucucuuccagcuuuuacuccgauaugaacggaguuaugaccauucaggccaaaccccuucagagacggcccgccuauuucgcugaccgcacacagaacgaaaaggaggacaaggcgucuggcggcggggccggagcucugagcuccgccccucacagacucggccgggccagcgauacccaugggcugucuccguccgcuaaaaagacacccgugccuuggagacuucccagccuggccucugacagccaacgccucaaaaccccuaauaucuacuccgaugaagugcugcggggaacgaagcugcccacaggcgucgaccacauggcgucuccgcucgugcagaccagcagaucccgcuuuccuccccugguuacagagacccgggggcagaacaccgcugugccuggauguagacuugucagcuaucgcggccggcaucugcaaaauagagugcucucugccaugcccgauggcacagaacgcucccggcugagagagcgcacggccacccuugagcggcugagcagaccuucuacaacccacacauuccggcaguccgacacgccccgcaaaagcucccucacccagauggaauuugcugcccacacauggaccgggcagucuauucugaccggaagccaauacguuccgaaguccuuccagagaacaacccugacauuuaaacggagauuccaggugacgucuuga

SEQ ID NO: 69086 - RNA, 459 nt, Artificial Sequence
  derived and/or modified sequence opt5 from FAM150B__Homo_sapiens__NP_001002919
augagaggccccgggcacccucugcuccugggacuucugcucgugcugggcgccgcugggcggggacgcggcggggccgagccgagagaacccgcggacggacaggcccuucugcggcucgucguugagcuggugcaagaacugcgcaagcaucacagcgcugagcauaaaggccuccagcugcuuggcagagauugcgcccuggggcgggcugaagccgcuggacucggcccuucccccgagcagcgcguggagaucgucccuagagaccugcggaugaaggauaaauuccuuaagcaccugaccgggccccucuacuuuucuccuaaauguagcaagcauuuccaccgccuguaucacaacacaagagacugcacgauuccggccuacuauaagcggugugcgcgccugcucaccagacuggccgugucccccguuugcauggaagauaaacaguga

SEQ ID NO: 69087 - RNA, 1377 nt, Artificial Sequence
  derived and/or modified sequence opt5 from FAM155A__Homo_sapiens__NP_001073865
augaccagaggcgccuggaugugccggcaguacgacgaugggcugaagaucuggcucgcugcuccccgcgagaacgaaaaaccuuucauugacagcgagagagcgcaaaaguggcggcugucccuugcuucucugcucuuuuucacagugcugcuuagcgaucaccugugguuuugugccgaagccaaacucacgcgcgcuagagacaaggagcaucagcagcagcaacggcagcagcagcaacagcagcagcaacagcgccagagacaacagcagcagcaacagcggcgccagcaggaaccguccuggcccgcccugcuggcuucuaugggagagagcuccccugccgcgcaagcccacagacuccugucugcuagcuccagccccacccuuccucccucuccuggcgaugggggaggcgggggaggcaaaggcaaucgggggaaggacgaucgcggaaaggcccuguuccucggcaacuccgcuaaaccggucuggagacuggagacaugcuauccccagggggccagcucuggacaguguuuuaccguugaaaaugcggacgccgugugcgcucggaacuggucccgcggcgccgcugggggagauggccaggaggugagaagcaagcauccuacaccccuuuggaaucugucugacuucuaccucuccuuuuguaacagcuauacccugugggaacuguucuccggccucucuagcccuaauacacugaacugcucccuugaugucgugcugaaagaagggggagagaugaccacgugucggcaaugcguugaggccuaccaggacuaugaucaccaugcccaggagaaguacgaagaguuugaaagcgugcuccacaaauaucugcagucugaggaguacuccgucaagagcugucccgaagacugcaagaucguguacaaagccuggcuuuguucucaauauuucgagguuacccaguuuaauugcagaaagacaauuccgugcaaacaguacugucuggaagugcaaacccgcugcccuuucauccuccccgacaacgaugaggucauuuauggcgggcugagcuccuuuaucuguacaggacuguacgaaaccuuccucacgaaugacgagccugagugcugugaugugcggagagaagagaagucuaacaaucccagcaaaggcacaguggaaaaguccgggagcugccaccgcaccucucugacagucuccagcgcgacccggcuuuguaacucuagacugaaacucugcguucuggugcuuauccugcuccauaccgugcugacagccuccgcugcccagaauacggccggacugagcuucggcggcauuaacacccucgaggaaaacuccacaaaugaggaguga

SEQ ID NO: 69088 - RNA, 2217 nt, Artificial Sequence
  derived and/or modified sequence opt5 from FAM160B1__Homo_sapiens__NP_001128523
auguucagcaaguuuaccuccauccugcagcacgccguggaggcucucgcccccucucugccucuucaagaagacuucgucuaccauuggaaagcgauuacacacuauuacaucgagacgagcgaugacaaggcuccgguuaccgauacaaacauucccucccaucuggaacagaugcucgacauccuggugcaggaggaaaaugagagagagucuggcgaaaccgggccuugcauggaguaucuucugcaccauaaaauucucgaaacacuguacacccugggaaaggccgauugucccccuggcaugaaacagcaagugcucgucuuuuauacaaagcugcuugggcggauccgccagccccugcucccucacaucaacgugcacagaccgguucagaagcugauucggcuuugcggagaggugcuggccacccccacggagaaugaagagauccaguuccucuguauugucugcgcuaaacugaagcaagacccuuaccuggugaacuuuuuccucgaaaauaaaaugaaaagccuggccuccaagggcguucccaacgugaucucugaggauacccuuaaggggcaggacagccuguccacagauaccggacagagccgccagccugaagaacucucuggcgcuacaggcauggagcaaaccgaacuggaggacgaacccccgcaucagauggaucaccuuuccacgagccuggacaaucucucugucacaucccugccugaggccagcguggugugucccaaccaggauuauaaucuggucaacucucuccugaaucuuaccagauccccugacgggcggauugcgguuaaggccugcgaaggacugaugcuccuggugagccuucccgagcccgcugccgcuaaaugucugacacaaucuaccugccucugugagcugcugaccgaccgccucgccucccuguacaaggcgcuuccucagagcguggauccgcuggacaucgaaacagucgaggccauuaacuggggccucgauuccuacagccauaaagaagacgcuucugccuuucccgggaagagagcucugaucuccuuccugagcugguuugauuauugcgaccagcuuaucaaagaggcccagaagacggccgcuguggcgcucgccaaagcuguucacgaacgguucuuuauuggagugauggagccucaacugaugcagaccucugagaugggcauccugacaagcaccgcccuccugcaccgcauugucagacaggugacauccgauguucuucugcaggaaaugguguucuuuauccucggggagcaacgggaacccgagacccuggccgagauuucucgccauccucugagacaccggcuuaucgaacauugugaccacaucagcgaugagauuuccaucaugacgcuccgcauguucgaacaucugcugcagaagcccaaugagcacauucucuacaaccugguccuuagaaaucuggaggagcggaacuauacagaguacaagccgcucugcccugaagacaaagauguggucgagaacggacugaucgcuggcgccguggaccuggaagaggacccccuuuucaccgauauuagcccugaaaauacccuccccaaccaggaguggcugucuuccagcccucccgcgacaccggaccacccuaagaaugauggcaaaaccgagguucauaagaucgugaacucuuuucugugccucguccccgacgaugcuaaauccagcuaucacguggaagggacaggauacgacacguaucugagagaugcccaucgccaguuccgggacuacugugccaucugccuuagaugggaguggcccggcuccccuaaggcucuggaaaaguguaaucucgaggccgccuuuuucgaagggcacuuucugaaaguucuguucgaucgcaugggacggauucuugaccaaccguacgaugugaaccuccaggucaccucugugcugagcagacugucccucuuuccccacccucauauccacgaguaucugcuugaccccuacgugaaucuggcuccuggcugccgcucucucuucagcguuauuguccggguggugggggaucugaugcugagaauccagcgcauucaggacuuuacacccaaacuucugcucguccggaagagacugcucggacuggagccugaaggccccaugcaaacccuuccguccuggugguga

SEQ ID NO: 69089 - RNA, 2151 nt, Artificial Sequence
  derived and/or modified sequence opt5 from FAM161A__Homo_sapiens__NP_001188472
auggccaccagccacagaguggcuaagcuggucgccuccucucuccagacacccguuaacccuaucacgggcgcgcggguggcucaauacgagcgcgaagacccgcugaaagcccuugccgcugccgaggcuauucuggaagaugaggaagaggagaagguggcccagcccgcgggggccagcgcugaccucaauaccuccuucucuggagucgaugaacaugccccuaucagcuaugaggacuuugugaacuuccccgauauucaccauuccaaugaagaguacuuuaaaaagguugaggaacugaaagcugcccacaucgagacaauggcgaaacuugaaaagauguaucaggacaagcugcaucucaaggaggugcagccugucgugauuagagaagauucucugagcgacuccagccggucuguuuccgagaaaaacagcuaccaccccgugucucugaugaccuccuucagcgagccugaucucggccaaucuuccagccuguaugucuccucuagcgaagaggaacuuccgaaucuggagaaggaauacccccgcaaaaacagaaugaugacauaugccaaggagcucaucaauaacauguggaccgacuuuugcguggaggauuacauccgguguaaggacacaggguuccacgcugccgaaaaacgcagaaagaaacggaaggagugggugccuaccauuacgguccccgaaccuuuucagaugaugauccgcgagcagaaaaagaaagaagaguccaugaaguccaagucugauauugagaugguucauaaagcucugaagaaacaggaagaggaccccgaauacaagaaaaaguucagagccaauccggugccugccuccguguuucuuccccuguaucacgaccucgucaagcaaaaagaggagcggcgcagaagccugaaggaaaaaucuaaggaggcucugcucgcgagccagaaaccuuucaaguuuaucgcccgggaagaacagaagcgcgcugccagagaaaaacagcugcgggauuuccuuaaguacaaaaagaaaaccaacagauuuaaggcccgccccauuccccgguccacauauggaucuaccacaaaugacaagcugaaagaggaggaacucuacagaaaccugcgcacccaacuucgggcucaggagcaucugcagaauagcuccccucucccgugcagaagcgccuguggcugccgcaacccccgguguccugaacaagcggugaagcugaaaugcaagcacaaaguuagaugucccacgccugauuucgaggaccugcccgaacgcuaucagaagcaccucucugagcauaaauccccgaagcugcuuacagugugcaagccuuucgaucugcacgcuagcccccaugccucuaucaaacgggagaagauucucgccgacaucgaagcugaugaggaaaaucugaaagagaccagauggccuuaccuuagcccccgcagaaagagcccuguccggugugccggggugaaccccguuccgugcaacuguaauccucccgugcccacagucuccucucggggacgcgaacaggcugugagacggagccuggaggagaaaaagaugcucgaagaggaaagaaaccgcauccugaccaagcagaaacaacggaugaaggagcugcagaaacuccugaccacaagagccaaggcguaugacucccaccagucucuugcccagauuagcaaaucccgcgucaagugccugagaaagagcgagaaagaacggaugcgcgaguaccaaagagaacucgaggaacgggaggagaagcugaaaaagcgcccucugcuuuuugaaagaguggcucagaaaaaugcccggauggcugccgagaagcauuacucuaacacgcucaaggcgcugggcaucuccgaugaguucguuagcaaaaagggccagucugggaaagugcuggaguauuuuaauaaccaggaaaccaaguccgucacagaggacaaagagagcuucaaugaagaggaaaagauugaggaacgcgagaacggagaggaaaauuacuuuaucgauaccaacucucaagacagcuauaaagagaaggacgaagccaaugaggaguccgaagaggaaaagagcguggaggaaucucacuga

SEQ ID NO: 69090 - RNA, 504 nt, Artificial Sequence
  derived and/or modified sequence opt5 from FAM163A__Homo_sapiens__NP_775780
augaccgccggcacaguggucaucaccgggggcauucuggcuacgguuauccuccugugcauuaucgccgugcuuuguuacugcagacugcaguauuacuguugcaagaaaagcggcacagagguggcggacgaagaggaggaacgggaacacgaucuccccacccauccucgcgggccgacauguaacgcuugcuccucucaagcccuggacggaagaggcagccuugcuccccugaccuccgagccuuguucucagcccugcggggucgccgccagccacuguacaaccugcuccccuuauucuagccccuucuacauucggacggcugauauggugccuaauggaggcggcggggagcgccucuccuuugccccgaccuauuacaaggaaggaggacccccuagccugaaacuggcggcuccccagucuuauccuguuacauggcccggguccggaagagaggccuucaccaacccgcgggccaucagcacagacguguga

SEQ ID NO: 69091 - RNA, 501 nt, Artificial Sequence
  derived and/or modified sequence opt5 from FAM163B__Homo_sapiens__NP_001073984
augaccgccggcacaguggucaucacgggagggauucuggcuaccguuauccuccugugcauuaucgccgugcuuuguuacugcagacugcaguauuacuguugcaagaaagacgagagcgaagaggaugaagaggaacccgacuucgcggugcacucccaucucccuccgcugcacucuaaccggaaucuuguccugacaaacggccccgcucucuauccuaccgccagcacauccuuuucucaaaagagcccccaggcccgcgcucuguguagauccugcucucauugugagccucccaccuucuuucugcaggagccuccggaagaggaagaggaugugcucaaugggggagagcggguucuguacaaaagcgugucccaggaagacgucgagcuucccccuggcggguucggaggccugcaagcccucaaccccaaucgccugagcgcuaugagagaagccuuugcgcggucucgcuccauuagcacagauguguga

SEQ ID NO: 69092 - RNA, 645 nt, Artificial Sequence
  derived and/or modified sequence opt5 from FAM167A__Homo_sapiens__NP_444509
augagcgugccccagauccacgucgaggaaguuggcgccgaggaaggggcuggagccgcggcuccuccggacgaucaucugagaucccucaaggcccugaccgagaaacuucggcuggaaacacgcagacccucuuaccucgaguggcaagcccggcuggaggaacacacguggccuuucccccgcccugcugccgagccccaggcuagccuugaagagggcgagagagggggacaggaaccucugcucccgcugcgggaggccggccagcaucccccuuccgcgcgcucugccagccaaggggcuagaccccuguccaccggaaagcucgaaggcuuucagucuauugacgaggccaucgcuuggcugcggaaagaacuuacagagaugcgccugcaggaucagcaacucgccagacagcugaugcggcuucgcggcgacauuaacaagcugaaaaucgagcauaccugcagacuccaccggcgcaugcugaaugaugcgacauaugaacuggaggaaagagacgagcucgccgaucuguucugugacagcccucuugcuuccagcuuuucucuguccacaccccucaagcugauuggggugaccaagaugaacaucaauagccggagauucucucuuugcuga

SEQ ID NO: 69093 - RNA, 735 nt, Artificial Sequence
  derived and/or modified sequence opt5 from FAM168A__Homo_sapiens__NP_001272979
augaaccccguguacagcccuguccagccgggcgcccccuaugggaauccuaagaacauggcuuacaccggauaucccacagccuacccugcggcugcccccgccuauaauccuucccuguacccgacgaacucucccagcuaugcuccugaguuccaauuucuccacuccgccuacgcuacccugcuuaugaaacaggccuggccccaaaauucuagcuccugcggcacagaagggaccuuccaucugccuguugacacaggaaccgagaacagaacauaccaggcgucuagcgccgcuuuucgguauaccgccggcacgcccuacaaggugccgccuacccaguccaauacagcucccccucccuauagccccucuccuaacccguaccagaccgccauguaucccauccgcuccgcguacccucagcagaaucucuaugcccaaggggcuuacuacacacagcccguguaugccgcucagccucacgucauucaucacaccacggugguucagcccaacagcaucccgucugccauuuacccugcccccguggcugcgccuagaacaaauggagucgccaugggcaugguggcuggcaccacaauggccauguccgccgggacccugcuuaccacaccccaacauacggcuaucggagcccacccuguuagcaugcccaccuaucgggcgcagggcacaccggcuuacucuuaugugccuccccacugguga

SEQ ID NO: 69094 - RNA, 588 nt, Artificial Sequence
  derived and/or modified sequence opt5 from FAM168B__Homo_sapiens__NP_001009993
augaaccccguguacagcccuggcuccucuggggucccguaugccaaugcuaagggaaucggcuaccccgccggguucccuaugggauaugcggcugccgcccccgcuuacagcccuaacauguaucccggcgccaauccuaccuuucagacaggguacacgccgggaacccccuauaaaguuuccugcucuccuacaagcggcgcugugcccccuuacuccucuagccccaacccguaccaaaccgccguguauccugucagauccgcguacccccagcagagcccuuaugcccagcaaggcacauacuauacccagccccuguacgcugcucccccucacgugauucaucacacaaccguugugcagccgaaugggaugcccgccacggucuauccugcccccaucccucccccgcggggaaacggcgugaccauggggaugguugcgggaacaaccauggccaugucugcuggcacacuccugaccgcccauuccccuacgcccguggcuccucaccccgucacagugccuaccuaccgcgcccccgggacaccgaccuacagcuaugugccuccccagugguga

SEQ ID NO: 69095 - RNA, 579 nt, Artificial Sequence
  derived and/or modified sequence opt5 from FAM169B__Homo_sapiens__NP_872368
augaaggugcagagcuucggcgagagagucguucuguuuauccucaacgccauuaucuucgggcggcuggaacgcaaucuugacgaugacgauauguuuuuccugccccacuccgugaaagagcaagcuaagauucucuggagacggggagccgcggugggcuuuuacaccacaaaaaugaaggggcgccugugcggagacggcacgggggcuuguuaucuucugccugucuucgauaccguguuuaucagacggaaacauuggcaccgcggacucggcacagccaugcugagagacuucugcgaaaccuuuccggaggaugaagcccugggcguuucuuguagcaugucccccgcuauguaccaggcccauccugggaacucugaggacgugagccggcacgcucgcacaucccagaaugauagaccccggcagccugcccccggagacggcucuaaggagcgcaugugcggggaggaacucgaagauaccaaggacgauccugaguguggagucgaggaagaggacgcgggccuggccgggcaaccgcccggaaaacuuacaagaagcuccccuuga

SEQ ID NO: 69096 - RNA, 849 nt, Artificial Sequence
  derived and/or modified sequence opt5 from FAM170A__Homo_sapiens__NP_001157463
augaagagacggcagaaacgcaagcaccuggagaacgaagagagccaagaaaccgccgagaaaggcgggggaauccagcggauucauagagacucuccccagccucaguccccgcucgcucaagugcaggaacgcggcgagacacccccuagaagccagcacgucucccugucuagcuacuccucuuauaagacgugcguuagcucccuuugugugaauaaagaggaacgggggaugaagaucuacuauaugcaagugcagaugaacaagggagucgccgugagcugggagaccgaagagacacuggagucucucgaaaaacagccccgcauggaggaaguuacccuguccgagguggucagagugggcacaccucccagcgauguuucuacccggaaucuucuguccgacagcgaaccuucuggggaggagaaggaacaugaggaacgcacagaguccgauagccucccgggaucccccaccguggaagacacgccuagagcgaaaacccccgauuggcuggucacaauggagaacggcuuccggugcauggcuuguugccgcguguuuaccacaauggaggcccugcaggaacacgugcaguucggcauuagagagggguuuucuugucaugucuuccaccucaccauggcccaacugacgggaaauauggaaagcgaguccacacaggacgaacaggaggaggaaaacggcaaugagaaggaagaggaggaaaaaccugaggcuaaggaagaggaagggcaacccaccgaggaggaucuuggacugcggcgcagcuggucucagugcccgggcuguguuuuucacuccccuaaggacagaaacuga

SEQ ID NO: 69097 - RNA, 1113 nt, Artificial Sequence
  derived and/or modified sequence opt5 from FAM172A__Homo_sapiens__NP_001156889
augaagaaagacgagcccccucuggauuucccggacacccucgaaggcuuugaguacgccuucaacgaaaaggggcagcugagacacaucaaaacaggagagcccuuuguguucaauuaucgggaagaucuucaucgcuggaaccaaaagagauacgaggcucugggcgagauuaucacgaaauaugucuacgaacuccuggagaaggacugcaaucuuaagaaaguuagcauuccuguggaugccaccgaauccgagcccaagucuuuuaucuucaugagcgaggacgcgcugacaaacccucagaaacucauggugcugauucacggguccggagucgugcgggcuggccagugggcccgcagacugaucaucaaugaagaucucgacucugggacccagauucccuuuaucaagcgggccguugcugagggauauggcgugauuguccugaacccuaaugaaaacuacaucgagguggaaaaaccgaagauucauguucaaagcuccucugauagcuccgacgagcccgccgagaagcgcgaaagaaaagauaaggugagcaaagagacaaagaaacggcgcgacuucuaugaaaaguacagaaauccucagcgggagaaagaaaugaugcagcuuuacauccgcgagaacggcucucccgaggaacacgcuauuuaugucugggaucauuuuaucgcccaggcggccgcugagaauguguucuuuguggcccacuccuacgggggacuggcuuucgucgaacucaugauccaaagagaggccgacguuaagaacaaggugaccgcgguggcccugacagacagcguccacaauguguggcaucaggaagcuggcaaaaccauucgggaguggaugcgcgagaacuguugcaauuggguuucuuccagcgaaccucuugauacgucuguggaguccaugcugcccgacuguccgagagucagcgccgggaccgaucggcacgaacucacauccuggaagucuuuuccuagcaucuucaaauucuuuaccgaggcuuccgaggccaagacaagcucucugaaacccgccgugaccagacgcucccaucggauuaagcacgaggaacuguga

SEQ ID NO: 69098 - RNA, 702 nt, Artificial Sequence
  derived and/or modified sequence opt5 from FAM173B__Homo_sapiens__NP_954584
auggagggcgggggaggcaucccccuggaaacccucaaggaggaaagccaguccagacacgugcugccugccucuuucgaggucaacagccuucaaaaauccaauuggggguuucugcucacaggacugguuggcgggacgcuuguggcuguguacgccgucgcgaccccguucgugacacccgcucugcggaagguuugccucccuuuugugcccgccaccacaaaacagauugaaaacgucgugaagaugcugcgcuguagacggggaucucugguugacaucggcagcggcgaugggcgcauugugaucgccgcugccaaaaagggauucaccgcugucggcuaugagcucaauccuuggcuggugugguacuccagauaucgggccuggcgcgagggggugcauggaucugcgaaguuuuacauuagcgaccuuuggaaagucacauucucccaguauagcaacguugugaucuuuggcgugccccagaugaugcugcaacucgaaaagaaacuggagagagaacuugaggaugacgcccgggucaucgcuugccgcuucccuuuuccgcacuggacccccgaucaugugacgggggagggaauugacaccguuugggccuacgaugcuucuacauucagaggccgggaaaagcgcccuuguaccuccaugcacuuucagcugcccauccaggccuga

SEQ ID NO: 69099 - RNA, 573 nt, Artificial Sequence
  derived and/or modified sequence opt5 from FAM174A__Homo_sapiens__NP_940909
augaaggccagccagugcuguugcugucugucccaccuccuggcuucugugcuucugcuccugcuucugcccgagcucagcggcccucuggccguccugcuccaagcggcugaagccgccccggggcugggacccccugaccccagaccucggacccuucccccucugccgcccggcccuacacccgcucagcagccugggcgcggacucgccgaggcugccggccccagaggguccgaaggaggcaacggcucuaauccgguugcggggcuggagacggaugaccauggaggcaaagccggggaaggaagcgugggcgggggacuugcuguguccccuaaccccggcgauaagccuaugacccagcgggcccugacaguccucauggugguuucuggcgcugugcuggucuacuucgugguucgcaccgugagaaugcggcgcagaaaucggaaaacacgcagauaugggguccuggacaccaacaucgagaauauggagcucacaccccuggaacaagaugacgaggaugacgauaacacccuuuuugacgccaaucacccccggcgcuga

SEQ ID NO: 69100 - RNA, 1230 nt, Artificial Sequence
  derived and/or modified sequence opt5 from FAM175A__Homo_sapiens__NP_620775
auggagggcgaaagcaccuccgccgugcugucuggguucguccucggagcucuggccuuucagcaccuuaacacagacagcgauacggagggcuuccugcucggggaaguuaagggagaggcgaaaaauuccaucaccgacucucaaauggaugacguggaaguggucuacacaauugauauccagaaguauauucccugcuaccagcuguuuagcuucuauaacuccucuggcgaggugaaugagcaggcucuuaaaaagauccugagcaacguuaaaaagaauguggucgggugguacaaguuuagacggcauuccgaccaaauuaugaccuuccgcgaaagacuccugcacaaaaaccugcaggagcauuuuagcaaucaggaucucguguuccugcuucugacaccuucuaucaucaccgaauccuguagcacacaccggcucgagcauucucuguauaagccgcagaaaggacuuuuucaccgcguuccccugguggucgccaaccucggcauguccgagcaacugggcuacaagaccgugagcgggucuugcauguccacgggauucagcagagccgugcagacccacuccucuaaauuuuucgaagaggacggcagccugaaggaaguccauaagauuaaugagauguaugcuucccuccaggaggaacugaaaagcaucuguaagaaaguugaggauucugaacaggccguggacaaacuugugaaagaugucaaccggcugaagcgcgagauugaaaaacggagaggggcucaaauccaggccgcgcgcgagaagaauauucagaaggacccucaagaaaacaucuuucucugccaggcccugagaacauucuuccccaauuccgaguuucuucacagcugugugaugucucugaaaaaccggcauguuagcaaguccucuugcaauuacaaccaccaccucgauguggucgacaaccugacccugaugguggagcauacagacauuccugaagcuagccccgccuccaccccucagaucaucaaacacaaggcucucgaucuggacgaucgcuggcaguucaaaagaagccggcuucuggacacgcaagauaagcgcucuaaggccgacacaggauccagcaaucaggauaaagcgucuaagauguccagcccggagaccgacgaagagauugaaaagaugaagggcuuuggggaguacuccagaucucccacauucuga

SEQ ID NO: 69101 - RNA, 1248 nt, Artificial Sequence
  derived and/or modified sequence opt5 from FAM175B__Homo_sapiens__NP_115558
auggccgcuagcaucuccggcuacaccuucucugccgugugcuuucacagcgcgaacuccaaugcugaccaugagggguuccugcucggagaagucagacaggaggaaacauuuucuauuagcgauucccaaaucucuaacacggaguuccugcagguuauugaaauccacaaucaucagcccuguagcaaacuuuuuagcuucuaugacuacgccagcaaagugaacgaggagucucuggaucggauucucaaggaccgcagaaagaaggugaucggcugguaucgguuucgcagaaauacccagcaacagauguccuaccgggaacagguccugcacaaacagcuuacacgcauccugggggugccugaucucguuuuccugcuguuuagcuucauuucuaccgccaacaauuccacacaugcucucgaguaugugcuguuuagaccgaaccggcgcuacaaucaaagaaucagccuugccauucccaaccugggaaauaccucucagcaggaauauaaggucuccagcgugccuaacacaucccagucuuacgcuaagguuaucaaagagcacggcaccgacuucuuugauaaggacggggugaugaaagauauucgggccaucuaccaagucuauaaugcgcuccaggagaaggugcaggccgugugcgcugacgucgaaaaauccgagcgcguuguggaauccugucaagccgaggugaacaagcugagacggcagauuacgcagcgcaagaaugaaaaagagcaggagagacggcuucaacaggcuguccugagcagacagaugcccucugaaucccucgauccugccuucagcccccgcaugccuucuagcggauucgcggccgagggccgguccacccugggcgacgcugaagccucugauccgcccccucccuacagcgacuuucacccuaacaaccaggaguccacacugagccauucuagaauggaacgcuccguguucaugccccggccgcaagcuguugggagcucuaauuaugccuccaccagcgccggacucaaguacccuggcuccggggcugaccugcccccuccccagagagcggccggagauucuggcgaggacagcgaugacuccgauuaugagaaccuuaucgaccccacagaaccuucuaauagcgaguacucccacagcaaagauucucgcccgauggcucaucccgacgaagauccucggaacacccagacgucccagaucuga

SEQ ID NO: 69102 - RNA, 642 nt, Artificial Sequence
  derived and/or modified sequence opt5 from FAM177A1__Homo_sapiens__NP_001072987
auggaccaggagcccgugggcggggucgaaagaggagaggccguugcugccagcggcgcggcugccgccgcugccuucggggaauccgcuggacaaaugucuaacgagcggggcuuugaaaauguggagcugggggugaucggaaagaaaaagaaagucccucgcagagugauucacuucguuagcggcgagaccauggaagaguacuccacagaugaagacgagguggauggccucgagaagaaagacguccugccgacgguggaucccaccaaacuuacaugggggccuuaucugugguuuuacaugcuccgggccgcgaccucuacacugagcguuugcgacuuccuuggagaaaagaucgccuccgugcugggcauuucuacccccaaguaucaguacgcuaucgaugaguauuaccgcaugaagaaagaagaggaagaggaggaagaggaaaacagaaugagcgaggaagccgagaagcaguaucagcaaaauaaacuccagacagacuccauuguccagaccgaucagccugagacggugaucucuagcuccuuugugaacgucaauuucgaaauggagggggacagcgaaguuaucauggagucuaagcaaaaccccguguccgugccuccguga

SEQ ID NO: 69103 - RNA, 477 nt, Artificial Sequence
  derived and/or modified sequence opt5 from FAM177B__Homo_sapiens__NP_997351
auggagaucgacggcuuccagcaacuggaucucgaaaagagcgugcccuccaaaaagaccacaccuaaaagaauuauccacuuugucgacggggauauuauggaggaauacucuacggaggaagaggaggaagaggaaaaggaggagcagagcaccaacuccacacuggacccgucuaaacuuagcuggggacccuaucugcgguucugggccggccgcaucgcuuccaccucuuuuagcacaugcgaauuucucgggggaagauucgccguuuucuuuggccugacccagccuaaguaccaguaugugcuuaaugaguucuaccggauucaaaacaagaaauccgauaauaagagcgaacgcagagggucuaaagcgcaggcugccgaggugcccaacgaaaagugucaucuggaggccggaguccaggaguauggcacaauccagcaagacgugaccgaagcuaucccucaguga

SEQ ID NO: 69104 - RNA, 3561 nt, Artificial Sequence
  derived and/or modified sequence opt5 from FAM178A__Homo_sapiens__NP_001129595
augaccagacggugcaugcccgcccgcccuggcuucccgagcucccccgcuccugggucuagcccucccagaugucaucugcggcccggauccacagcccacgcggcugccggcaagcgcacggagucuccuggggacagaaaacagagcaucauugacuuuuucaagccggccuccaaacaagaucggcacaugcucgauucuccccaaaagagcaacaucaaauacggaggcucccgccugagcauuaccgggacagaacaguuugagagaaaacuuucuuccccuaaggaaagcaaacccaagcgggugccucccgagaaaucuccgaucauugaggcuuucaugaagggagucaaagaacaucacgaggaccauggcauccacgaaucccgcagaccuugccugagccucgccucuaaguaucuggcuaagggcaccaauaucuacguucccuccagcuaucaccuuccuaaagagaugaagucccugaaaaagaaacaucggucucccgaacgcagaaagagccucuuuauucacgagaacaaugagaaaaacgaucgggaccgcgggaagacaaaugccgauuccaagaaacagaccacaguggcggaagccgacaucuucaacaauagcucuagaucccugagcucucggagcucccugucuagacaucaccccgaggaaagcccucucggagcuaaguuucaacugucccuugccagcuacugucgcgagcgggaacugaaaagacuccgcaaggagcagauggagcagcggauuaacucugaaaauuccuucagcgaggcuucuucccugagccuuaaauccucuaucgaaagaaaguauaagccgcgccaggagcaacggaaacagaacgauauuauccccggcaagaauaaccugagcaauguggaaaacgggcaccucuccagaaaacgcucuagcuccgacagcugggagccuaccucugccggauccaagcagaauaaauuucccgagaagcggaagagaaacagcgucgauucugaccugaaauccacgcgcgaaagcaugauuccuaaggcgcgggagucuuuccuggaaaagagacccgauggcccgcaucagaaggagaaauuuaucaagcacaucgcccucaagaccccuggggacgugcugcggcuugaagacauuagcaaagagcccuccgaugagacagacggaagcucugcuggccuggccccuuccaacagcggcaauuccgggcaucacucuacccgcaacagcgaucaaauccagguugcuggaacaaaggaaaccaaaaugcagaagccccaucucccucugucccaagagaaaucugccauuaagaaagccagcaaucuucagaagaacaagacggcuuccucuacaaccaaagaaaaggagacaaaacugccccuccugagcagagugccguccgcgggcagcucucuggucccucucaaugccaagaacugcgcucugcccguguccaaaaaggacaaggagcggucuagcuccaaagaauguagcgggcacucuaccgaguccaccaagcacaaagaacauaaggccaaaacaaauaaggccgauagcaacguuuccagcggaaagaucucuggcgggccccuuagaagcgaguacggaacgccuaccaaauccccgcccgcugcccuggaaguggucccuugcauucccucuccugcggcucccagcgacaaggccccuuccgagggcgagucuagcggcaauuccaacgccgggucuagcgcucucaaacgcaagcugcggggagauuucgacuccgaugaagagagccuuggcuauaaucuggacucugaugaagaggaagagacacucaaaucccuggaggaaaucauggcccugaacuuuaaucagacccccgcugccacagggaagccgccugcgcucagcaagggacugagaucucaguccagcgacuacaccggccacgugcaucccgggacguacacaaacacccuugagcgccuggugaaagaaauggaggacacccaaagacucgaugaacugcagaagcagcugcaggaggacauccggcaaggccgcggaauuaaauccccuaucagaauuggcgaggaagauucuacagacgaugaggacgggcuucucgaggaacacaaggaguuccugaaaaaguucagcgucaccaucgaugccauucccgaccaccauccgggagaagagaucuuuaauuuccugaacuccggcaaaaucuuuaaccaguauacacucgaucugcgggacagcggguucauuggacagucugcuguugaaaaacuuauccugaaguccggcaagacggaucagauuuuucucaccacacaaggguuccugaccagcgccuaccacuaugugcaguguccugugcccguccugaaguggcuuuuucgcaugaugucugugcauacagacugcaucguuagcgugcagauucucuccacccugauggagaucacgauuagaaaugauaccuucucugacagcccugucuggcccuggauccccucccugucugacguggcugccguguuuuucaacaugggcaucgauuuucggagccucuucccucuggaaaaucuucagccggacuuuaacgaggauuaccugguuuccgagacacaaaccacaagccgcggaaaagaaucugaggacuccagcuauaagcccauuuucuccacccucccugaaacgaauauccugaacgucgugaaauuccugggccuuuguacaucuauucaccccgagggguaccaggauagagaaaucaugcuccugauucugaugcucuuuaagaugagccuggagaagcagcuuaaacaaaucccucuggucgacuuccagucccuccugaucaaucugaugaagaacauucgggauuggaauaccaaagugcccgagcuuugccucggaaucaacgaacugucuagccauccucacaaucugcucuggcugguucagcuugugccgaacuggacaucccgcggcagacagcugcggcaaugucucagccuggucauuaucucuaagcugcuugacgagaaacacgaagaugugcccaaugcguccaaccugcagguuagcgugcuccauagauaucugguccagaugaagccuucugaccuccugaagaaaauggugcuuaagaaaaaggccgagcagcccgaugggauuaucgacgauucccugcaccucgaacuggagaaacaggcuuacuaccugaccuauauccuucugcaucucgugggagagguuagcugcucucacagcuuuuccucuggccagcgcaagcauuucguccugcucugcggggcccuggaaaagcacgugaaaugugacauucgggaggacgcuagacuguuuuaccgcaccaaggugaaagaucuugucgcccggauccacggcaaguggcaggaaauuauccagaauugcagaccuacacaagugagcuucuguuauacgauuuccugcauccucaacagcuuugccgaguggcauuccucuuacugucugaaauga

SEQ ID NO: 69105 - RNA, 2040 nt, Artificial Sequence
  derived and/or modified sequence opt5 from FAM178B__Homo_sapiens__NP_001116118
auguggcccagacugccuggcgccgggcucgcuccgcagcugcggcgccaagaccagagacuucacuucaccggacagaugagccauggccugcagauggccgggccccaagagacagugcucgcgcugccucuucgggaaggaguccaggcugccgccacgguucccauccugcucuacaaccuggaggauggccuguccgaccacccucucgaucaggggccccgcugcccugcuagacggccguguucucccgccagcgcuccugcccccaccuccccuaagaaacccaagauucaggcgccgggagaaacauuuccuaccgacuggucucccccucccguggaguuccugaauccccgcgugcuucaagccagcagagaagcuccugcccagcggugggucggcgugguuggcccgcaggggcugcgcagacucgcuggagagcugcccgaggaacuugagcaggaacaucuggaucucgacccuaaacggggccuggcccugcccgagaagcucuuuuggaacacauccgggcugucucaacaggcggccgcuccugaguucagcuggggaggcuccgggagcuauuuuaauaaccuugauuaccugcuccaggaaaaacgcgagcaagcccuggaacaggagagagaacggcuucugcuccaggagugccugaaucugaacucucucgaccuggaugaggaagaggugccccuuaccccggaacaccgcaugcuggucgagaaguauuccgugagccuccagacaaucccucccguucauccuggagaaaccguguuccugcccagaugucacccucuucccugcauucuggacucuucccuccugaagccgcggagccaccuggagggccucuuucugucuuccccucccgcucaacagcuuagcuuccugagauccggccuccugaauauccuguaccuucauaugcccgauuguccugucucucuccugcaguggcuguuucagcuccugacguggccgcccgagaccagccuuggggccuucggacugcucugggaccugauuguggauggcaucuuucugcaaccugacgaagacaaacaccuuuggugccccucccuccaggaggugcgcgaagccuuccauagccugggggcucacucuccugcgcuguauccccucggaccuuuuuggcacggcgggcggguccugcccggagaggccggccuuaacgaaaaugaggagcaggaugcuccgcaggaaaucgcccuggacauuucccucggccauaucuacaaguuccuggcccugugugcucaagcccagccuggggcguauacagaugagaaccuuaugggacucauugaacugcugugcagaaccagccucgacguuggccugcgccuucugcccaaaguggaucuccagcagcugcugcuucuccugcuggagaauauccgggaguggccugggaagcuccaagaacuguguugcacacuuucuugggugagcgaccaccaucacaaccugcucgcucugguccaguucuuucccgauaugaccuccagaucucgccggcugagaagccagcuuucccuggugguuauugcccgcaugcucggacaacaggagaugcugccgcucuggcaggagaaaacgcagcugagcucucuuucccggcugcucggccugaugagaccuagcucucugcgccaauaccuugacuccgugccccugccucccugucaggaacagcagcccaaggccagcgcugaacucgaucauaaggccugcuaccugugccacucccuccugaugcuugcuggggucgugguuucuugucaagacaucacaccugaucaguggggcgagcugcagcuccugugcaugcagcuggaccggcacauuagcacccaaaucagagaguccccgcaggccaugcaucggacaaugcuuaaagaccuggcgacccagaccuauauccgcuggcaagaacuccugacacacugucagccccaggcccaguacuucucuccuuggaaggauauuuga

SEQ ID NO: 69106 - RNA, 5163 nt, Artificial Sequence
  derived and/or modified sequence opt5 from FAM179B__Homo_sapiens__NP_055906
auggccgcugcccccagcgcgcugcuccugcuuccuccguuccccgugcuguccaccuacagacuccagucucggagccgcccuuccgcucccgaaacagacgauucucgggucggcgggaucaugcggggagaaaagaacuauuacuuucgcggcgccgccggggaccacggaagcugcccuacgaccacaagcccccucgcuucugcccuucugaugccuagcgaggcuguuuccagcucuugguccgaaagcggcgggggacucucuggcggcgaugaggaagacaccagacugcugcagcuccugcggacagcccgcgauccguccgaggcguuccaggcccuucaggcugcccugcccagaagagggggacgccucggcuuuccuagacggaaagaggcucuguaucgcgcccuugggagagugcugguggaaggaggcagcgacgagaagcggcucugucugcagcugcucucugauguccugcgcgggcaaggagaagcgggccagcuugaggaggccuucucccuggcucuccugccccagcuugugguuagccugagagaagagaauccugcccuccggaaagacgcucugcagauucugcacaucugccucaagagaucccccggcgaagugcugcgcacccuuauucaacaggggcuggagucuacagaugcccggcucagagccagcaccgcucugcuucugccgauccuccugacgaccgaagaccugcuccugggacuugaucugacagaggucauuaucucccucgcgcgcaaacugggcgaccaggagaccgaagaggaaagcgagacagccuuuucugcucugcagcaaaucggggaacggcuuggacaggauagauuccaguccuacauuagccgccucccuucugcccugcggagacacuauaaccgccggcuggagagccaauuuggcucccaggugcccuacuaucucgagcuggaagccucuggguucccugaggacccccuucccugugcuguuacccugagcaauuccaaccucaaguuuggaaucauuccucaggaacugcauagcagacugcuugaccaggaggauuacaagaaucgcacgcaagccguggaggagcucaaacagguccugggcaaguucaacccgucuuccacaccccacagcucucuggugggcuuuaucucccuccuguacaaucuucuggacgauagcaacuucaaagugguccaugggacccucgagguucugcaucugcuugugauucggcucggagaacaggugcagcaauuucugggcccugucaucgcggcuuccgugaagguucuggccgacaauaaacucgugauuaagcaggaguauaugaagaucuuccugaaacuuaugaaggaagucgggccccagcagguccugugccuccugcuggagcaccuuaaacauaagcacucuagaguucgggaggaaguggucaacaucuguauuugcagccuccugacauacccuuccgaggauuucgaccugcccaaacucucuuuugaucuggccccggcucuuguggacagcaagcgcagaguccggcaagccgcucuggaagccuucgcggugcucgccuccagcaugggaucuggcaaaaccuccauccuguuuaaggcuguugauaccguggagcugcaggacaauggggauggcgucaugaacgccgugcaggcuagacuugcccgcaagacacugccucggcucacggaacagggauucguugaguaugcggugcugaugcccagcucugccggcgggagauccaaucaucucgcucacggagccgacaccgacuggcugcuugcuggcaaccgcacacaaagcgcccacugucauugcggggaucacgucagagacucuaugcauauuuacggaagcuauuccccuaccaucuguacacggcgcgugcugagcgccggcaaagggaagaauaaacuccccugggagaacgaacagccuggcauuaugggagagaaccagaccucuacguccaaggauaucgaacaauuuagcacauacgacuucauccccuccgcuaaacugaagcugucucagggcaugccggugaaugaugaccuuugcuuuagcagaaagcggguuucccgcaaccuguuccaaaauucuagagauuuuaacccugacugucucccccugugcgcggccgggaccaccggaacacaccagaccaaucucagcggcaaaugcgcucaacugggguucucccagauuuguggaaagacaggcucugucgggagcgaucuucaguuucugggcacgaccuccagccaucaggagaaaguguaugccucucucaacuucggauccaagacacaacagaccuuuggcagccagacagaaugcaccucuuccaaugggcagaaccccagcccuggagccuacauccugccgucuuaccccguguccagcccucggacgucccccaaacacaccagcccucugauuaucucucccaagaagucccaagacaauuccgucaacuucucuaauagcuggccucuuaaauccuucgagggccugucuaagcccagcccgcagaaaaagcucgugucccagaaaucuagcgauccuacagggcgcaaccacggagaaaauucccaagaaaagcccccuguucagcugacccccgcucucgugagaagcccgucuucccggcgcggccugaacgggacaaagccugugcccccuauucccagaggcaucagccuucugcccgacaaagccgaucugucuaccgugggacauaagaaaaaggagccugacgacaucuggaaaugugaaaaggauucccucccgauugaccugagcgagcuuaauuuuaaagauaaggaccuggaucaggaagagaugcacuccucucuccggagccugagaaacuccgcggcuaagaaacgcgccaagcucagcggcucuacguccgaccuggagagccccgauucugccaugaaacuugaccugacaauggauagcccuucccugucuagcucccccaacaucaauucuuauagcgaauccgggguuuacagccaggagucucucaccuccagccuguccacaaccccucaaggaaagcggauuaugucugacaucuuccccaccuuuggcagcaaaccuugcccgacaagacuuuccucugcuaagaagaaaauuagccauaucgccgaacagucccccagcgcggggucuuccagcaacccucagcagauuucuuccuucgauuuuacgaccacaaaggcucugagcgaggacucuguggucgugguuggaaaaggcguguucggcagccucuccucugcccccgccaccuguagccaauccgucaucagcuccguggagaauggggauacauuuucuaucaagcagagcauugaaccucccuccggaaucuauggccgcucugugcagcagaacauuagcuccuaccuggacgucgagaaugaaaaagacgcuaagguuucuaucagcaaguccaccuauaacaaaaugcggcaaaagagaaaagaggaaaaggaacucuuccacaauaaagauugcgagaagaaggagaaaaacagcugggagcgcaugcggcacacggggacagaaaagauggccucugaguccgaaaccccgaccggagcuauuagccaguacaaagagagaaugccuucugugacacauucccccgagaucauggaccugagcgaacuucgccccuuuucuaagccugagaucgcccugaccgaagcgcugcggcuccuggccgaugaggacugggagaaaaagauugagggccuuaauuucaucagaugucuggcugccuuucacuccgagauucucaacacaaaacugcaugaaacgaauuucgcugugguccaggaggugaagaaccuccggagcgggguuucccgcgccgccguggucugccugagcgaucuuuuuaccuaucugaagaaaucuauggaccaggaacuggauacaaccgugaagguucuccugcacaaagcuggagagagcaauacauucaucagagaggacguggauaaggcgcuucgggccauggucaacaaugugacccccgcucgcgccguugugucccugauuaacggcggccaaagauacuacgggcggaaaaugcuguucuuuaugaugugucauccuaacuucgaaaagaugcuggagaaguaugucccgucuaaagaccugcccuacaucaaggauagcgugagaaaucuccagcagaaaggacuuggcgaaaucccucuggacacgcccuccgccaaggggcgccggucucacaccggaagcgugggcaacacaagauccucuagcgucucccgcgacgcuuuuaauagcgccgagcgggcgguuaccgaagugagagaggugacacgcaaaucugucccucggaacucccuggagagcgcugaauaucucaagcugauuaccgggcuucugaaugccaaggauuucagagaccgcaucaacggaauuaaacaacuccugucugauacagagaauaaccaggaccuggugguuggcaauaucgugaagauuuuugaugccuucaaauccagacuccacgacagcaacuccaaggucaaucuuguggcucuggaaaccaugcauaaaaugaucccccugcuccgggaucaccugucuccgaucauuaacaugcuuaucccugccauuguugacaauaaccugaauagcaagaaccccggcaucuacgcggcugccacgaacgugguccaggcccucucccagcauguggauaauuaucugcugcuccaaccuuuuugcacaaaggcucaguuccuuaacgggaaagccaagcaggacaugaccgagaaacuggcugauauugucaccgaacuguaccagcgcaagccccacgccacagagcaaaaagugcucguugugcuguggcaucuucugggaaauaugaccaacagcggcucucucccuggggcgggaggcaauaucagaacggccacagcuaagcuguccaaggcccuguuugcucagauggggcagaaccuccuuaaucaggccgccagccaacccccgcacauuaaaaagucucuggaggaacugcucgacaugaccauccugaacgagcuuuga

SEQ ID NO: 69107 - RNA, 522 nt, Artificial Sequence
  derived and/or modified sequence opt5 from FAM180A__Homo_sapiens__NP_995327
augcacuggaagaugcugcuccugcuucugcucuacuauaacgccgaggcuagcaugugccaucgcuggucccgggccgugcuguuccccgcggcucaccgcccuaaaagaucuagcucccuuccgcugaaucccguccuccagaccucucuggaagagguugaacugcucuacgaguuucugcuugccgaacuggagaucagcccugaccuccaaauuuccaucaaggaugaggaacuggccucucuucggaaagcuagcgacuuccgcacaguguguaacaaugugauucccaaguccaucccugauauuagacggcugagcgccucucucuccagccaucccggcauccugaaaaaggaggacuuugaacgcacgguccugacccucgcuuauacagccuacagaaccgcgcugucucacgggcaucagaaggauaucugggcccagucccuugugagccuguuccaggcucuccggcacgaccugaugagaucuucccaaccuggaguuccgcccuga

SEQ ID NO: 69108 - RNA, 2916 nt, Artificial Sequence
  derived and/or modified sequence opt5 from FAM184A__Homo_sapiens__NP_001093881
augaagcagcaagcccugaccgaguucgaggcuuacaaacacagaguggaggacaugcagcucugcgccgaagcgcagcauguccagcggaucguuacaaugagccgcgagguggaagagauuagacggaaguuugaggaaaaacugcgcuccuucggccaacuucaggugcaguuugagaaggauaaaagacuggcucucgaagaccugcaggccgcccaccggcgcgagauccaagagcuucugaagucucagcaggaucauagcgcuuccgucaacaaggggcaggaaaaagccgaggaacuccacagaauggagguggaaucucugaauaagaugcuggaggagcuccggcuggaacgcaaaaagcugauugaggacuaugaaggaaaacugaacaaggcucagagcuucuacgagagagaacucgauacgcugaagcggucccaacuuuuuaccgccgagucucugcaggcgagcaaagagaaggaagccgaccuccgcaaagaguuccaaggccaggaagcuauccugagaaagacaauugggaaacugaagaccgagcuccagaugguucaggaugaagccggaucccugcuugacaaaugucaaaagcugcagacagcucucgccaucgcggagaauaacgugcagguccugcagaagcaacuugaugacgccaaagagggcgaaauggcucugcucagcaagcauaaagagguggaaucugagcuggccgcugcccgggagcgccugcagcagcaggccuccgaucucguucugaaggcuagccacaucgggaugcuucaagcgacccagaugacacaggaagugaccauuaaagaccuggagucugaaaaguccagagucaaugagcggcucagccagcuggaagaggagagagccuuucuucgcucuaagacgcaaucccuggaugaagaacagaaacagcaaauccucgaacuggagaagaaagugaacgaagcuaagcggacccagcaggaguauuacgagagagaacugaaaaaucuccagagccgccuggaggaagaggugacacaacuuaacgaagcccacuccaagacccuggaggagcucgccuggaagcaucacauggcuauugaagccguccauucuaaugcgauccgggacaaaaagaaacugcagauggaccuggaggaacagcacaacaaggauaaacuuaaucucgaggaggacaagaaccagcugcaacaggaacuggagaaucucaaggaaguucuggaggauaaacuuaacacagcuaaucaggaaauuggacaccuucaggacauggugagaaagagcgagcaaggccucggcuccgccgaggggcugaucgccagccugcaggauucucaggaacgccuucaaaacgagcucgaccugaccaaagauucccugaaggaaacgaaagacgcucuccugaacguggagggagaacuugagcaggagcggcagcagcaugaagagacaauugccgcuaugaaggaagaggaaaaacugaaggucgauaagauggcccacgaccucgagaucaaauggaccgagaaucugagacaagaaugcagcaagcugcgcgaggaacuucggcuccagcaugaggaggauaaaaagucugcgaugagccagcugcugcagcucaaagacagagaaaagaacgccgcucgcgacuccuggcaaaagaaaguggaggaucugcuuaaucagaucucucugcucaagcagaaccuggaaauucagcugagccaaucccagacaagccuucagcagcuccaagcccaguucacccaggagcggcaaagacugacccaggaacuggaggagcucgaagaacagcaccagcaacggcauaaaucucugaaggaagcucacguucuugccuuucagacaauggaggaagagaaagagaaggaacagcgcgcgcuggagaaucaccuccagcaaaagcauuccgccgaacugcagagccugaaagacgcucacagagagucuauggaaggcuuccggaucgagauggagcaggaacuucagacgcugagauuugagcucgaagaugaggggaaggccaugcuggcuucccuccgcagcgagcugaaccaucaacacgccgccgcuauugaccuucugcggcacaaucaucaccaggaacucgcggccgcuaaaauggagcuggaaagauccaucgauauuucucgcagacagagcaaggagcauaucugucggaucaccgaccugcaagaagaacuucgccacagagagcaucacauuuccgaacuggauaaagaggugcagcaccuccaugaaaacaucucugcccugacaaaggagcucgaguucaagggaaaagagauucugcggauccgcagcgaguccaaucagcagauuagacuugaagagauggaagagaaguaucugaugcgggaaagcaaacccgaggacauccaaaugaucaccgagcucaaggccaugcugacagaacgcgaucagauuaucaaaaagcugauugaggacaacaaauuuuaccagcuugaacuggucaauagagagaccaacuucaauaagguguucaacucuuccccuacgguuggcgugaucaauccgcucgcuaagcagaaaaagaaaaacgauaagagccccacaaaccgguuugucucugugccuaaucuguccgcccucgagagcgggggagucggcaacggccaccccaaucgccuggacccuauucccaacucuccugugcaugauaucgaguucaauagcuccaaaccgcuuccccaaccuguucccccuaaggggcccaagaccuuucugagcccggcgcagucugaggcuuccccuguggccagccccgacccucagagacaggaaugguucgcccgguauuuuaccuucuga

SEQ ID NO: 69109 - RNA, 3183 nt, Artificial Sequence
  derived and/or modified sequence opt5 from FAM184B__Homo_sapiens__NP_056503
auggccagcgcucugaacuccaagaucaaucccccugggaccugccagggcucuaaagccgacggaggcgcgggguggagaauggauugugacccgcaaaugcacgugaagaugugcaaaaagauugcucagcucacaaaagucaucuacgcccugaacacgcggcaggaugaggccgaagcuagcauggaggcccuucgcgaagcucaucaggaggaacugcaaaaugccguugcggagaccaaggccagacuccugcaggagcagggaugugcugaagaggaagcccuucugcagcggauucaagcucucgaguccgcccuggagcugcagaagcgccucacagaagaggcgcuggccgaaucugcuagcugcagacuugagaccaaagaacgggagcugcgcguggaggccgaacacgcugagagagugcucacacugucccgggaaaugcuugagcugaaggccgacuaugaacgcagacuccagcaucugaccucucacgaggccacaccccagggccggcugccucaagagagccccgaaaccaaauccgagccugggcagggacccgaaaugcaggagguccuccuggaagugcaacgccuuagaguugagaaccagcagcugagcaaggauuacgcucggaaagcggaggaacuccaggccacguaugagcgcgaaaaugaggcuaucagacaagccaugcagcagucugugucccaggcccuguggcaauggcaggagaaggaaagcgaccuucggaagaacuuccagguccaggagucugcucugcaagcccaggugagaaaacucgaaggcgaucuggagcaucgcggccggaagauuuccgaccugaaaaaguacgcgcagaaacucaaggaaagaauccaggaucuggacguucaacuuaaagaggcucgccaggagaauagcgaacugaaggggaccgccaagaaacucggagagaagcuggccguggcuaaagaucggaugaugcuucaggaauguagaggcacacaacagaccgacgccaugaagacagagcuggucucugaaaacaaagugcuccgcgaggagaaugaucuggaagcugggaaccugcacccucagcaggaccaauccugccucaaggaguguccgugcaugaagggaggcaccgacaugcagacgaaaaaggaagccagcgcggagacagaauauaugaaacagcaguacgaggaggaucugcggaagaucaaacaccaaaccgaagaggaaaagaagcaucuuaaagaccagcuggugaagagacucgaggaucuggucaaaaagcacacaguugagauuaaauccgugcgcucuagcguggaagccgagcggaagaagcugcagagagaagucgaggcucagcuugaagaggugcgcaaaaaguccgagaaagaaaucaagcaacucgaggaagagaaagccgcucugaauguuaagcugcagaacagccuccuggaagugcuucggcuggaggaguuuauucagcaaaauaaaaccagacccaccggggccgaagagucuccucaggaacucggacggcagcauuguuccauccuggagacacaggaccccugccugaaacuugaugaaacgagcccucgcggcgaggaguaucaagacaagcucgcggccgaagagggcaccucuagcgaugaagaggagagaacaaagguccugcugaaggaaggguccgacccccagccgccucucggaucucugcuuaaagagaagaccagcaaaauucagcggcuggaagaggauuggcagucccaaaaggcuaagcuccaggcccaggugagccagaugcaacaggcucuggaacaguguacaucuaacuacagagaggaccugcaggcccuuaaacaacucuccgaucuggagcgcgaaaagcugcagcgggagcuccaggaaaccacgcaacagaaucacgccaugaaagcucagcuggaggcgagccaccagagagcccuucgcaugcuggaaaaggcuagacaucaagagcucaaagccacagaggaacggcugaagaaggagucuucccacagccugcagauccagcaucagacccaccgccuugaacuccaagcccuggaggaaaaagcuagacaggagcugcaggaggaacgggagcgcaugcaggcccaacaggcgcuccugcuugaaucccugagacaggagcucucugagcaacaggcugccugcagcggccaucagaaggaccuggaagcccugcaggcugagcuucgggcccuggggcgccaacaggcguccucucagugccccggagacagcaaagaucacauuaucgcuaccgaagagagaggcgggccuggacaggccggcuccccucccggcgccgcugggcaaggaagcggcgaaggguguggacucugggaggagaacgcccagcugcaggacgcuguucggcgccucagagccgaaguggagcagcaccaacaggaagcgcagaagcugcgggaucagagacgcuuccuugaggaaacacaacaggcccagcgggcuagagaggucgagacccugcgccaagaacaucggaaagagaugcaggccaugguggcugacuuuucuuccgcccaggcccagcuccaagcuagacuggcggcccuggaagcugagcuuaaggauagcggcgaaaagcccgggaaaggcgccucucgcccggaggaccugcagcucaucggacggcugcagacaagacucaaggagcgcgaagauauuaucaaacagcugacggaggaacggagauuccacuacgccgcuuuucccuccgccaugagccaucggaaccgcucuuucagcuuuaauccucaccccggcuaucuuaccccuuccaugaagaaaaagaaagucgaggacgugcccagcagaguugugucugucccgaaccuggcguccuacgcuaagaauuuccucagcggggaucuguccucucggauuaacgccccucccaucacaaccagcccuucccuggaccccucuccuagcugcggacgcacauauaagcccaaucaauccaccgaugccaaaacggcuaccagaacaccggacggcgagaccgcccaggcgaaggaagugcagcagaaacaagggucuccucaccaggagugguuuacaaaguacuucagcuuuuga

SEQ ID NO: 69110 - RNA, 1110 nt, Artificial Sequence
  derived and/or modified sequence opt5 from FAM187B__Homo_sapiens__NP_689694
augcccccuaugcuguggcuccugcuucacuucgccgcuccggcccugggcuuuuacuucagcaucuccugccccucugggaagcagugucaacaggcgcuccugagcggaaacgacauucuucuguauugcaauuccucuggcgcucauugguacuaucucuuuacccaggggaaaaagggaagacugacaagccugacgaacaucuccaauauggagauuaugccugaaggcucucuccugaucaaagauccccuuccuagccagaccgggcuguaccacuguuggaacaagaauggacggcaagugguccaguaugagauugacuuccaggauguuacaacccuccauaucacacacaaagaccugggccagcgcccccuucaaaacgaaacccugcaucucggcuccaagcagcugaucuuuacauggugggagccuuggcaggauugcaauagaugugaagaaccgggggagugcaagcggcugggauaccgcuauauugaggagccccucgaagaggccaugccuuguuggcuguaccuuggcgaggugcugguguggagcucuagacuccggcccgaacugcaggucgaggccugccacgugcaauguaccaacaauacgcagcuucgcguugacuacgugaucuucgauaacuuuagacuggacgaaaagaccgaguucgucuggcucgauugcccucugggguccauguaucggcccgugaauuggcgcgcuaacgacacaccgcugaccugggaaagccagcucucuggacaagauuuuacaaccuuccuggacccuuccacgggcgggagacagcuucagguuuuucagcccgccguguacaaauguuucguccaacaggagcugguggcucaguuuaaaccugccgcgagccucgagacacuggaagcccaguggcgggagaaugaugcucaauggcgcgaagccagaaaggcccuucggggacgcgcugacucugugcugaaaggccucaagcugguccugcucguugugaccgugcuggcgcuucugggcgcccuccugaagugcauucaccccucccccgggagacggagcacacagguccuggugguuaaauga

SEQ ID NO: 69111 - RNA, 1338 nt, Artificial Sequence
  derived and/or modified sequence opt5 from FAM188A__Homo_sapiens__NP_079224
augagcgagcugaccaaggaacucauggagcugguguggggcacaaaauccucucccgggcuuagcgacacgaucuucugcagauggacccagggauuugucuucuccgaaucugagggcagcgcccuggaacaauuugagggaggaccuugugcuguuauugccccggugcaggcguuccuccugaagaaacuucuguuuuccucugaaaagagcuccuggcgggauugcagcgaagaggaacagaaagagcuccugugucacacacugugcgacauccucgagucugcuuguugcgaucauuccggcagcuacugucuggugucuuggcuucgcgggaagaccacagaagagaccgccuccauuagcggaucucccgccgaauccagcugccaggucgagcacuccucugcucuggccguggaggagcucggcuucgagagauuucaugcucugauccaaaagcggagcuuccgcucccuuccugaacugaaagacgccguucucgaucaguauagcauguggggcaacaaguuuggggugcugcuguuccucuacucuguccugcuuacaaaaggaauugagaauaucaagaacgaaaucgaggacgcguccgaaccccugauugauccuguguauggccacgggagccagucucucaucaaucugcuucugaccggacaugccguuagcaacgugugggacggcgauagagaguguuccgggaugaaacuccuggggauucacgagcaggcugccgucggcuuucugacgcucauggaagcucugcgguacugcaaggugggcucuuaucuuaagagccccaaauucccuaucuggauugugggguccgagacccaccugacagucuuuuucgccaaggacauggcgcucguugccccggaagcucccagcgagcaagcccgcagaguguuccagaccuacgauccugaagacaauggauuuauccccgauucucugcuugaggacgugaugaaagcucuggaccucgucuccgauccugaguauauuaaccugaugaagaauaaacuggaccccgaaggccucgggaucauccugcuuggaccguuccugcaggaguuuuucccugaucagggcagcucugggcccgaauccuuuacaguguaccauuacaacggacucaagcaaagcaauuauaacgagaaaguuauguacguggagggcaccgccgucgugaugggcuucgaagacccuaugcugcagacggaugacacacccauuaagcggugucugcagaccaaguggcccuauaucgagcuucucuggacaaccgaucgcuccccuucucugaauuga

SEQ ID NO: 69112 - RNA, 2274 nt, Artificial Sequence
  derived and/or modified sequence opt5 from FAM188B__Homo_sapiens__NP_115598
auggacagccuguucguggaggaagucgccgcuucccucguuagagaguuucugucucggaagggccuuaaaaagaccugcgugacaauggaucaggaacgccccagaagcgaccuguccaucaacaaucggaacgaucuccgcaaagugcugcaccuugaguuccuguacaaggaaaauaaagccaaggagaacccucucaagacgucucuggagcugauuaccagauauuuucucgaccauuucgggaauacagcgaacaauuuuacccaagauacaccgauccccgcucugagcgucccuaaaaagaacaauaaagugcccucccgguguucugaaaccacacuuguuaacauuuacgaccugagcgaugaggacgccggauggcgcaccucccucagcgaaacgucuaaggccagacacgauaaucuggacggcgaugugcuugggaacuucgucuccagcaaacggccuccccauaagucuaagccuaugcagaccgugccgggagagacacccguucugaccuccgcuugggagaaaaucgacaagcuccacagcgaaccuucucuggaugugaaacgcaugggcgaaaauuccagacccaagagcgggcugauuguccggggaaugauguccggcccuaucgccucuagcccccaggacuccuuucaucgccacuaucucagacggagcucuccguccagcucuagcacacagccucaagaggagucccgcaaagugcccgaacuguucgugugcacccagcaggacauccuugcuucuagcaacuccagcccuucuagaacgucccugggccagcucagcgagcugacagucgagcggcaaaagaccacagccucuuccccuccccaccuucccagcaaaagacugccgcccugggaucgcgcgcggccuagagaccccuccgaagauaccccugccguugacgggucuaccgauacagaccgcaugccccucaagcuguaccugccgggaggcaauagccggaugacgcaggagagacucgaacgcgcuuuuaagcggcaggggucccagccugcccccgugagaaagaaccaacugcuuccuucugauaagguggacggagagcugggcgcucuccgccuggaagaugucgaggacgagcuuauucgggaagaggugauccugagccccguuccuuccgugcucaaacugcagaccgccagcaagcccauugaucugucugucgcgaaagaaaucaagacacuccuguucggguccagcuuuuguugcuucaacgaggaauggaaacuucagucuuuuuccuucagcaauaccgccucucugaaauauggaauugugcaaaacaagggcggcccgugugggguucucgcugccgugcagggaugcguccugcagaaacugcuuuucgagggcgacagcaaggcugacugugcccaggggcuccaaccuuccgaugcccauagaacacgcugccuggugcuggcucucgcggacaucgucuggcgggccggaggcagagagcgggcugugguugcccuggccagccgcacccagcaguuuucucccacggggaaauacaaggcugauggagugcuugaaacacugacccuccacucccugaccuguuaugaggaccuggucacauuccuucagcaaagcauucaucaguuugaagugggccccuacggcugcauccuccugacccuguccgccauccucucuagaagcacagagcugauucggcaggauuucgacguuccuacgucccaccuuaucggggcgcacggauacuguacccaggagcuggugaaucuccugcugacaggcaaggcugucucuaacguguuuaaugaugugguugaacuugacagcggggauggaaacauuacccuccugagaggcaucgccgcccgcuccgacauuggguuccugucucucuuugagcauuauaauaugugccaagucggcugcuuccugaaaacaccgcgguuucccaucugggugguguguagcgaaucccacuucagcauccuguuuucucuucagccuggacuccugagagauuggcgcaccgagagacuguucgaccuuuacuauuacgauggccucgcuaaccagcaggaacaaauucggcugacgaucgacaccacacagaccauuuccgaggacacagauaaugaccuggugcccccucucgagcugugcauccgcaccaaguggaaaggggccagcgucaacuggaauggaucugaucccauucuuuga

SEQ ID NO: 69113 - RNA, 1953 nt, Artificial Sequence
  derived and/or modified sequence opt5 from FAM189B__Homo_sapiens__NP_001254537
augaugcccagcccuuccgacucuagcagaucccugaccucucggccgagcacacgcggccucacgcaccugagacuucaucggcccuggcugcaggcccuccugacccuugggcuggugcaaguccuccugggaauccugguugugacauucuccaugguggcuucuagcgucaccacaaccgaguccauuaagcgcagcugcccuucuugggccggcuuuuccaucagcuucuuuucucuccuguccgugcuuuguguuaugcugagcauggcggggucugugcucuccugcaagaacgcucagcuggccagagauuuccagcaguguagccuugaaggaaaggucugcguguguugccccuccguuccucugcuccggcccuguccugagucuggccaagaacugaaaguggccccgaauagcacaugcgacgaggcucgcggggcccugaagaaccuccuguuuuccgucuguggacuuaccauuugcgcugccaucauuuguacgcugagcgcgaucgugugcugcauccagauuuucucucucgaucuggugcacacccagcuugcccccgaaagauccgucagcggcccucugggcccccucggguguacaucuccucccccggcuccucugcugcauaccaugcucgaccuggaggaguuuguucccccugugcccccucccccguacuaucccccugaauacacaugcagcuccgagaccgaugcccagucuaucacguauaauggaagcauggacucccccgugccucuuuaccccacagauuguccgccuagcuaugaagcugucaugggccugcgcggggacucucaagccacccucuucgauccccagcugcacgacggauccugcauuugugagcggguggcgagcaucguugaugugucuauggacuccggcagccuuguccuguccgccauuggggaucucccuggaggcucuagccccuccgaggacucuugccugcuggaacuccagggcagcgugagauccguugacuacgugcuguuucggagcauccagcgcucuagagcuggguauugucuuucccuggauugcggacuccggggcccuuucgaggaaagcccccugccgcgcagaccuccccgggccgcuagaucuuacuccuguagcgcccccgaggccccuccgccccugggggcuccuacagcggcccgcucuugccaucggcuugaaggauggcccccuugggucggccccuguuuuccugagcucagacgccgggugcccagagggggaggccgcccggcugccgccccucccacccgggcuccuaccagacgcuucagcgacuccagcggcucucugacacccccggggcaccggccuccccacccugccuccccuccgccccugcuccugcccagaagccauuccgaucccggaauuacgaccucuagcgacacagcggauuuucgcgaccuuuacaccaaaguccuggaggaagaggcugccuccgugucuagcgccgauacaggccucugcuccgaggcuugccuguuccggcuggccagauguccuucucccaagcugcuccgggcucgcagcgccgaaaagagacggccuguucccaccuuccaaaaagugccucugccguccgggcccgcgccugcccacagccugggagaccucaagggcucuuggcccgggagaggccuggucacgcgcuuucuucagaucucccggaaagcuccugaucccagcggaacaggcgcccaugggcacaaacaggugccgagaucucuguggggacgcccuggcagagaaucccuccaccuucggagcugcggggaccugucuuccagcuccagccuucgcagacuccugucuggacggcgccuggagagaggcacccggccccauagccucucccugaacgggggcucucgcgagaccggacuuuga

SEQ ID NO: 69114 - RNA, 2469 nt, Artificial Sequence
  derived and/or modified sequence opt5 from FAM193B__Homo_sapiens__NP_001177875
augaccagacggcgcagcagacccuccggcggggccggacggcgcgagagagcucgggccgcgggcccucagaagccgcaagcucccgaaccucccccucccccuucucuggaggccggggccggagcuggcccgcccgaagccccugcugagcccgaccacgaugggccucgcgaagacgaugagcccaaccucgugccgggaccucagguucccccugccagcucccagcccguccagacaugcugucugcuuugccacagagagcggaaaggcugggaagagggccccucucaaaaugggcuggugcuccagggagaaaagcugccuccggacuucaugcccaaacuugugaagaaccugcucggcgagaugccucugugggucugucagagcugccgcaaauccauggaggaagaugagagacagacggggcgggaacacgcgguggccaucucucugagccauaccuccuguaagagccaaucuugcggagacgauucccacagcagcuccucuucuuccagcuccucuagcuccuccucuuccagcucuugucccggcaauagcggggacugggauccuuccucuuuucucagcgcucauaagcuguccggacuuuggaacagcccccacucuuccggcgccaugccgggcagcucucugggguccccucccacaauuccuggagaggcuuuccccguuagcgaacaccaucagcacuccgaccucaccgccccucccaauucuccgacaggccaucacccucagcccgcgagccugauccccucccacccuucuagcuuuggguccccgccccauccucaccuucugcccaccaccccugccgcucccuucccugcccaggcuagcgagugccccguggccgccgcuacagcgccgcauacgccuggacccugucaaucuucccaccucccuagcaccucuaugccccugcugaaaaugccgccucccuuuuccggcugcagccauccuuguucugggcacugcggaggccacugcagcggcccccuccugcccccuccguccagccagccccuuccuucuacacaucgcgaucccggguguaagggacacaaauucgcccauuccggccuggcuugccagcucccucaacccugugaggccgacgaagggcugggagaggaagaggauagcuccucugaaagaagcuccugcaccucuagcuccacacaccagcgggacggcaaguuuugugacugcuguuacugcgaguucuuugggcacaacgccgagaaagaaaaggcucagcuugccgcggaggcucugaagcaggccaaucgcgucucuggcagcagagaaccucggccggccagagagcgccuccuggaauggcccgaucgggagcuggacagagugaacuccuuccucagcucucgccugcaagagauuaaaaauaccguuaaggauuccauccgggcuagcuuuucugugugugaacuuuccauggacagcaacggauucucuaaagagggcgccgcugaaccugagccccagucccugccucccagcaaucucuccgggagcucugagcagcagccggauauuaaccuggaccuuagcccucugacgcucggaagcccccaaaaucauacacugcaggcccccggcgaaccugcgcccccuugggccgagaugagagggccgcaucccccuuggaccgaaguccgcggacccccucccggcaucgugccggagaacgggcuggugcggagacucaauacagucccuaaccugucucgcguuaucugggugaagacccccaaaccuggcuaucccagcuccgaggaaccuucuagcaaggaggugcccuccugcaaacaggaacuuccggagccugucucuagcggaggcaagccccagaaggggaaacggcaaggaucccaggcuaagaaaagcgaagccucucccgcuccuagaccgcccgccucccuggaggugccuagcgcgaagggccagguugccgggcccaaacagccuggacgcgugcucgaacugcccaaggucggcucuugugcugaggccggggagggcucccggggaagcagaccuggcccggggugggcuggaucccccaagaccgaaaaagagaagggcucuagcuggcggaacuggccuggggaagccaaagcccgcccccaagagcaggaauccgugcagccuagcggacccgcuagaccgcaaucucugccucagggcaaggggcgguccagacgcagccggaauaaacaggagaagcccgcgucuagccuugaugacguuuuucuccccaaggauauggacggcguggagauggaugaaacagacagagaggucgaauacuucaaacgcuucugccuggacuccgccaagcagacgagacaaaaaguggcugucaacuggaccaauuuuucucugaagaaaacaaccccuagcacagcccaguga

SEQ ID NO: 69115 - RNA, 1440 nt, Artificial Sequence
  derived and/or modified sequence opt5 from FAM196A__Homo_sapiens__NP_001034851
auggugagcaaggacaccggcaaaugcauccugacaacguccgagucugaagucgagcccgccgcuugucucgcccuggaaaugaaguacgcgcuugauccuaacagacagauuaaaaagcggaauaaagcucugcagguucgcuucaaggacaucugcgaggcccagaacgaacagagagauacccagcucagcuccgggcaacugggagagaagcgggaggccaaaccggugucuugucgcgcugccuauagaaaguacaugacagugcccgcucggcgcagcauuccuaaugucaccaaauccacaggcgugcagaccucucccgaccuuaagaaaugcuaucagacauuuccucuggauagaaagaaggggaaccucaaaagccugcccgccgcggacccuuucaagucccagaauaacggauuucugaccgaugccaaagaaaagaaugaggcuggcccgauggaagaggcccggcccuguggggcuggacgcguucacaaaacgaccgcccucguguuccauagcaaccaacacaugaauacagucgaccagccucugggcgugaacugcaccgagcccuguaagucuccugaaccccuuuccuacggcgaggcggcccugcagaauagcacaagaccgccuucugaagaacccgauuaucagcuccuggggcgggcuaaacaagaccgcggaagaccuaacuccgaggagcccgcucccccugcccuucggcgcguuuuuaagaccgagguggccacggucuacgccccggcucugagcgcgagagcccccgaaccuggccucucugauuccgcugccgccagccaguggucccugugccccgcugacgaugagcggagacgcgccacacaucugaaugggcuccaggcgccuucugaaaccgcucuggccuguagcccgcccaugcaaugccuuuccccugaguguagcgaacagcccucucagacacacaccccucccggacugggcaaccagccuucccccaccgccguggcugccggggaggagugccaacggaucgugccgcauacagaagucguugaccucaaggcucagcugcagaugauggagaaucuuauuagcucuagccaggaaacgaucaaagugcugcucggagugauccaagagcuggaaaagggcgaggcccacagagagggccuguccuaucgcaccgggcaggacacagcgaacugcgauaccugucggaacucugccugcauuaucuacagcgucgaacucgacuucaaacagcaggaggauaagcugcaaccugugcuuagaaaacugcaccccauugaagagacacagguuauccccuccccuuacagccaggagaccuauucuuccacgccgaagcaaaagagcaaaacagaaucuaagaaacauggacgcuggaagcucugguuucuguga

SEQ ID NO: 69116 - RNA, 1608 nt, Artificial Sequence
  derived and/or modified sequence opt5 from FAM196B__Homo_sapiens__NP_001123363
auggcccagcaaaacaugaaggugagacccguccugcucaaacggaauagccuggaguccguugaguucgugaagcagccucaccaucgcagaucuaaaagccaacaggugcgguuuaaggaagacggcaccaccaaaaacccgacggggcuugcugaagucgaugugcagacccccgaggacccugccguuaugggaaagacacaggcgacccgccaccaucugcccccuacauacucccucucuuuccccagaagccagaaggcuggcggguuucggaauaucgccauucagaccuccccuucucugcgcaaacacuucccgguguuuaagagaaaacggcuuacagccagcaagucccuggucgaaaugcccaccgcuagccaaucugccauccaggugaacggaaaucucuccgagcaggauauuguuagcucugaccuggcuuaucugcgccucgcccagcaucuggaggauggcccuagacgggugaaagucucccacgcguuccuuccccgcgugccuaaggugcaaagcaacgggcccgucucuaucugccuggaagccggaacguggagaucccucgagaaggcuaccgccgcuauucagguuccggacgauaucuaccacagcccuuccugggaagcccgggagucugcgcugagccccgaccgcuccgccgaggugagcaauucuauccauccucuugaugacacaagacccggcgauggccggagagugacaccccuggacuccgagaaaagcacaucuugucucaacgcuaccagcgucgccucccacacgccugggacagaagaacugaagccggagcugcuccugcccaaagauaauucugacgacaaggaucuuggaagccuguccagccagucuaaagaaaccugcgugccuuccagcccccgcacacauucuuccccuagccaaggcucccacucucagcccgcucacccggggcgggccagcgacuguccuuccucuagcaacaaucaucagaaccucguuucccugaagaccaauagcgccucuaaauccgcucccggaugccaggagcaaaccgcgaacaauccuacagagagcgauacgcuugaauuucccaacuguccuggcucuaaccaucugcccuccagccucucuagaagcgagaccaagcugcaguccaaucgcgaaauuagcgacaucaaccagauucaccuggccagaggggagcucugcgaucugcagggacggcuucaaucuguggaagagucccugcacagcaaucaggagaagaucaaaguccuccugaacgugauucaggaccuugaaaaggcucgcgcccugacagagggccggaauuucuauagaaccggccaggaucucaacaauuguuccacaugccaaaacaccgccuguaucauuuacucuguugaauaugacuuucgccagcaggaggggcgguuccaugaagugcugcagagccuggaggaggcugaaccggucgaggaagccuccccuccucccaaaucucccgcggagccgcccgcuccugagaagcaagaucucagacgcaaaacgaagaaggugaaaaagaaaugcuuuugguggaucuga

SEQ ID NO: 69117 - RNA, 1584 nt, Artificial Sequence
  derived and/or modified sequence opt5 from FAM198B__Homo_sapiens__NP_001026870
augaccugccccgacaagccuggccagcugaucaacugguucauuuguagccucugcgugccgagaguccggaaacugugguccucucgcagaccccggacacgcagaaaucuucugcucgggacggccugugcuaucuaccugggauuucuuguuagccaagugggccgggccucccugcagcacgggcaggcggcugagaagggaccucaucgcucuagagauaccgccgaacccagcuucccugagauuccccucgacggcacacuggccccuccggaaucccaggggaacggaucuacccugcaacccaauguggucuauaucacacuccggagcaaacgcuccaagccugcuaacauuagaggcaccgugaaacccaagcggcgcaagaaacacgccguugcuagcgccgcgccuggccaggaggcccugguggggcccucucuucagccgcaggaagcugccagagaggcugaugccgucgcgccuggauacgcccaaggcgcuaaucuggugaagaucggggagcggcccuggcgccucguuagaggaccuggcgugcgggccgggggacccgacuuucugcagcccuccagcagagaaucuaacauccgcauuuauuccgagagcgcuccuucuuggcuuuccaaagaugacauccggagaaugcgccugcucgccgauagcgccgucgcuggccugcggccgguguccucuagaagcggcgcgcgccugcucgugcuggaagggggagcccccggcgcuguccuucggugcgggccuucccccuguggacugcucaagcagccucuggacaugagcgagguuuucgccuuucaucuugaucgcauucugggccucaauagaacacugcccucugugucccggaaagccgaguucauccaggcugccgcggcugccugccugagcaugagacucgccuuuuucauuuuuccggcuugggaagacaugcgcgugccugggaaguguugcaucggacacgcccggcugaccuggggcacguaccaacagcuucugaagcagaaauguuggcaaaacggcagaguccccaagccugagucugggugcaccgaaauucaucaccacgaguggagcaaaauggcucucuucgauuuucugcuucagaucuauaaucggcuggacacaaacuguugcggauuccgccccagaaaggaagaugccugcgugcagaauggccuccggccuaaaugugacgaccagggguccgcggcccuggcucauaucauucaaagaaagcacgauccccgccaucugguuuuuaucgacaacaaaggauucuucgaucggucugaggacaaucucaacuuuaagcugcuugagggcauuaaggaguucccggccagcgcuguguccguccugaaaagccagcaccucagacagaagcugcugcagucucuuuuucucgauaaaguguacugggaaucccaagggggccgccagggaaucgaaaagcugauugacguuaucgagcacagagccaaaauccugauuaccuauaucaaugcgcauggcgugaagguccucccuaugaacgaauga

SEQ ID NO: 69118 - RNA, 402 nt, Artificial Sequence
  derived and/or modified sequence opt5 from FAM19A1__Homo_sapiens__NP_998774
auggccauggugagcgcuauguccuggguccuguaccucuggaucucugccugcgcgaugcugcuuugucacggcagccugcagcauaccuuccaacagcaccaucuccacagacccgaagggggaacaugcgagguuauugcugcccaucgguguugcaacaagaaucgcaucgaggaaagaucccagacggugaaauguucuugccugccuggcaagguggccgggaccacacggaaccgcccgagcugugucgacgcuuccauugugaucggaaaaugguggugcgagauggaacccugucuugagggcgaggaaugcaagacccugccugauaauucuggguggaugugugccacaggaaacaaaauuaagaccacaagaauccacccccggaccuga

SEQ ID NO: 69119 - RNA, 396 nt, Artificial Sequence
  derived and/or modified sequence opt5 from FAM19A2__Homo_sapiens__NP_848634
augagcaagagauaccugcagaaagccaccaagggcaaacuccugaucauuaucuucauugugacacuuugggggaaggucguuuccucugcuaaccaccauaaagcccaccaugugaagacgggaaccugcgagguggucgcgcugcaccgguguugcaauaagaacaaaaucgaggaacgcagccaaacagugaaguguuccugcuuucccggccagguugcugggaccacaagagccgccccuucuuguguggacgcuagcauugucgaacagaaaugguggugccauaugcagccgugucucgagggagaagagugcaaggugcugcccgaucggaaaggcugguccuguucuagcgggaauaagguuaagaccacacgcgugacccacuga

SEQ ID NO: 69120 - RNA, 423 nt, Artificial Sequence
  derived and/or modified sequence opt5 from FAM19A4__Homo_sapiens__NP_001005527
augagaagcccccggaugcgcgugugcgccaaguccguccugcucucucacuggcuguuccuugcuuacguucugauggugugcugcaaacucaugagcgccuccucucagcaucugagaggccacgcggggcaucaccaaaucaagcagggaaccugugagguggucgcugugcaucggugcuguaacaaaaaucgcauugaagagagaagccagacaguuaagugcuccuguuuuccuggccagguggccgggacgacccgggcccaaccgucuugcgucgaagcuagcaucgugauucagaaaugguggugucacaugaaccccugccuugagggagaagacuguaagguucugccugauuauuccggcuggagcuguucuuccgggaauaaggugaaaacaaccaaggucacacgcuga

SEQ ID NO: 69121 - RNA, 399 nt, Artificial Sequence
  derived and/or modified sequence opt5 from FAM19A5__Homo_sapiens__NP_001076436
auggcccccagcccuagaaccggcucccggcaggacgcuacagcccugccgucuaugagcuccacguucugggcguuuaugauccucgcuucucugcuuauugccuacugcagccaacuggccgcugggaccugugagaucgugacacucgaucgcgacuccucucagcccagacggaccauugcccgccagacagcuagaugcgccugucggaagggacagaucgcgggcaccacacgcgccagaccugcuugcgucgaugcccggauuaucaaaaccaagcaauggugugacaugcugcccugccuugaaggggagggaugugaucugcucaucaaccgcagcggcuggacgugcacccagccugggggaagaauuaaaacaaccacaguuuccuga

SEQ ID NO: 69122 - RNA, 702 nt, Artificial Sequence
  derived and/or modified sequence opt5 from FAM204A__Homo_sapiens__NP_071346
auguggagcggccugcugcccccugggcucaacgaguccgacgccgaaucuaauagcgaggaugaagcuacccuugagaacuccggacugaaucuccaggaagacaaggaggaugagucuaucagaaaaacagaaauuaucgacuucagcacggaugagccgaagaccgaaacagaguccaacgugaaugccuacgaggaaugccccucuggcauuccuaucgacauguggaacaaauuucaagagcugcacaagaaacauagcgaacagaaguccaccacaagccgguuccgcgggaagagacggaaacgcucuagaaaggauaaacuuaagaaugagaaagaacugcacuccgagcccagcucuaacgagacccaguggaaggaacucacacaguauuuuggagucaaugaccgguucgauccucccguuaagcgcaaaaagguggagaaauccggccuggaaaagagaauugaccaagcgguggaggaauggaacaucgagaaagcugaggaacugagcaaucagcucgccacccgggagcugggggucaagaucgccaaagcuguggccugucauaacuuuguuaaggcuaagaaagaaguggaaaauucucaggccgcgcgcaagaaaaagaaacuugccuggggauucgaggcuaagaagagaugggagacgaaauccaacaugggcuacauguga

SEQ ID NO: 69123 - RNA, 4008 nt, Artificial Sequence
  derived and/or modified sequence opt5 from FAM205A__Homo_sapiens__NP_001135389
augcugagccccaccuucgugcucugggaggucggcuacccucuguauaucuacggguccauuuuuaucguuauugugaucauuuggcaagugaagagaucucaccaugaacuuagcuccgagccgaaacggucuugcugucgcugccaccaaaaggucagacagcgggcccgcgacgcugccagcacagcgagacggcgcuccagagaagaggcugaaaaaccccagaagcugcucucuaucaucaaaagccagggauggcugccucuugagcgguccgugcgcagaauccugugugccgaucccugcugucaaaucugcaacagcguugcccucgagauucagcagcugcuggugggcgaaaauaaccagaucucucucacgcuguccgggccucuucaaggaagcucuugucuggagaugcucuccaccagcucuaugucccuggaccagagccuugaguuccauuccuggcacacacgggaacugucucucagcuccgucacccccacacugagccagcugaccgaucagaagucucucacacaauccgcugcccagagcaccuaugcugacggcauucaggauuacugggccgaccaucugcaacuugggcaggaguuucaggugccugauguucugcgcggaccgaauacgaucgcgucuagcagaauugaaaagccccgggccccucucaaccaggaggaaaugacccaauccaaucccucucuggugcagggcaaccagggccagcaccaccuuaauagccaagucucccugcucagccugaacccugagacacugaaucgcaugcaucccauggcucuccacauggugcugccggcccaucuuccuuuccugucucccgaagugcucagacugcuugagguccacguuaaaaaguggaugcacuuucagcggugggggcugccuagacgcguggaggaaucccuccggcagcugaugcccaaucccccucuguauuaccagccgggaaacgaccaacccgugagcuucaaccucaaaaauaccccucaggucucucugcauagauuugagacaaucucccuucagaccuggugcagcuguguggcuggccagcccauccaaacguucuggguuuccgaauggucuacaaugaacccugagcagcgccaccauugccagcaaacccccaauccgauggcccuggcgcucccuagccccgcccugaaggcucuguccgggccucacccccagucuggaggccaggauaacgacagcggguccgaucuucagcaaaaauauagccagcucuuuuguggacugccuucucugcauuccgaaagccucguggccacauucaugggcucucagggccugcccaagauugagaacgucccgaagccuccccuuaaagaccccuuucuguucaaugagcucuccuuuccucagcugcugccgaagaccagcccccaaucugcuccucccagcuccccucuuagccccaacuggaugucuccuuccgaucaccagcgggcccagaucaaugugcccuuccucacccuggccgaauacgaggcucuggaauggcaccuccugcagagacaacuucagcugcaguggggguggccggcggcccuccaacgcagccagcauacacagugccugaugcagcacgagccuugcggaaaagcucaaucccccgaaacgaccacagccucucagaccggcaagagcauuuccguucugacacgggagcuucucuucuuuccugagcaugccagaaaacugcuggaguuccacauccagaagcagcucauucgccaccggugggggcugccccaaaagauccagcagucuauccagcuucugcucaccagcacggaccaacagacaguguccucuagcuccaccgcucuggccaacgucagcauuccgcagccuguggcgcuggaagcuaauggagccugugacguccuuucucccaucgccgcuccuguguccauucccagaccccaucuccugacccagguuaaggccauccugcaaagccacauugauucuaagugcggccagauccaucaggggaaaaucccugcuugugugcaccgcuccugggacugccggauuagcggaguccucgccguggcgccguuucccuguaucccugaaucucaauuccuggagcuucagacagccuccgaucccgaccugcaucacaagguuaugccuuggaugcccaccgcucucgaucagcagcaacaggcccugccuggcacagugacggagcacccgaaacugcuuagaguccugagcguggaagcuauugagaagcucgaaaccacacugcggcauaaacaccucgccuuucuguccggccuucccgcgcuguacuauguggcccucccucgcgcucuggcccccgcuguuaccagccagucugucaucacagagauggaaccuagccccguggagauuccggccgagccucugauccagaugguguccuucgaggaacaaugcauuucucuugggcccuguccccagggaaacaaugaaagcugcaccgacgucgccaaggaguuucagccugcugugcccguuaagggcacgauggaaacccugccucucgagucccagacacauccgaccucuccccacagccugcaaacacauauccucaccaaacugaacuuccaccuuagaaagaaagugcuggagauccagugggggauuccuauccgggcgagaaagucccgcgaacagacggucgccgcucccgagaauauuucuacacagaaaagccucgaaucccugaaccaccagggagagacccugcuucaggaacugccuauucccccggauacacucccugcccccaauccugagggcgugcaucugaaggagcagcucgccaacgaccugaaggcuguucaacagaaucagaaacagagcaacucuaaggccgugccccaaggguccgcgcacagcgucucuaaaauuucccagccuagcggcgauaugaccgaagcucauaugcccugugugcagguugaggccaaugugaacaagccgucccuugaggaaccuugcggacccgagccccagucuccuagcaaauccaaggacccggcccacguccccaugcuggcuggcaaccgggaagauccugaggaaaccaaggccgcgagagaccaccgcgagggggacgcuggauuuggcagaagcucuacacgggaggaacgcagacccgccgaggaucaacggccugccgggaugcugcccaauaaaacgccucgcggauccuggagauggagccggucuuuccaucucgcugacccgugucagcacagcccccagcaucacccucagcugaaacuuccccaacugccuccccgcgugccgggcgaaaaagaguccgaaaaggaucuccaggacucucagaccaaacugacagugauccucgagccugccaccauccccgaaaacgcucaaacaguccugccccaggccagccaggggcagccuuuucuuucccaacccacccaggcgaagccucugcagggccagacgcugcaaggacagguucuccauggccuggugaugccggugcacgcccagaaaaagcccucucuuacagagagcuccuucagaaauaagauuaaaugcuuucugcagcacaucaacccuaagaccaaagggaagggacaugaggauagcauguucucugcugccgcuaaagucgccaagacccggaaggaaaauguggccaaaucccucgcucccgccaagagcccuguuggccgcuccaaaacagagaagcccaccgggugcucuaaagcgcaaagcagaccggcucagaagcuggugggaccugccuuccucgacggcccccagucccuggaugacaaacuucggcugcacucuagacaaccugggagcgccuccgcucugggcuacccccgccauuguccucggcacugccccagagaagccugugcgaacaagccgggacacccuacauga

SEQ ID NO: 69124 - RNA, 1212 nt, Artificial Sequence
  derived and/or modified sequence opt5 from FAM20A__Homo_sapiens__NP_001230675
auguacagagagcagaugaaccugaccagccucgaucccccucugcaacuucggcuggaagccuccugggugcaguuccaccucggcaucaaucgccaugggcuguauucuagaagcuccccggucguuucuaaacuucugcaggauaugcggcacuuucccacaauuagcgcugacuacucccaggaugagaaggcccuccugggagcgugcgacuguacgcaaaucgugaagccuucuggcgugcaucugaaacucguccugcgcuucagcgauuuugggaaggcuauguucaaacccaugagacagcagcgggacgaagagaccccuguggacuuuuucuauuuuauugacuuccagcgccacaacgccgaaaucgccgcuuuucaucuugaucggauucuggacuucagacgcguucccccuacagugggaagaaucgucaaugugaccaaggagauccucgagguuacaaagaacgaaauucugcaauccguguuuuucgucagcccggccucuaaugugugcuuuuucgcuaaaugucccuacaugugcaagaccgaguaugccguguguggcaacccucaccuucuggaagggucccucagcgcguuccugcccucucugaaucucgccccucggcuguccguccccaacccguggauccgcagcuacacacuugcuggaaaagaggagugggaaguuaauccucuguauugcgauaccgugaagcagauuuaccccuacaacaauucucagagacuccugaacgugaucgacauggccauuuuugauuuccuuaucggcaauauggaccggcaccauuaugagauguuuacgaaauucggcgacgauggguuucugauucaccucgacaacgcucgcggauucggcagacauucccacgaugaaaucagcauccuguccccucugucucaguguugcaugauuaagaagaaaacccuccugcaccuucaacugcucgcccaggcggacuaccggcugagcgaugucaugagagagucccuucuggaagaccagcucagccccgugcugacagagccccaucugcucgcccuggaucgccggcuucaaaccauccugagaacaguugagggguguauuguggcucacggacagcagucugucaucguggacggcccuguugaacagcucgccccggauuccgggcaagcuaaucugaccagcuga

SEQ ID NO: 69125 - RNA, 1230 nt, Artificial Sequence
  derived and/or modified sequence opt5 from FAM20B__Homo_sapiens__NP_055679
augaagcugaaacagagagugguccuccuggccauccuucugguuauuuucaucuuuaccaagguguuccucauugacaaccuggauacaagcgcugccaaucgggaggaccaacgcgcguuucacagaaugaugacgggccuucggguggaacuggcucccaaacucgaucauacccugcaguccccuugggagaucgccgcccagugggucgugccgcgcgaaguuuaccccgaggaaacaccugagcugggggcugugaugcacgccauggcuaccaagaaaauuaucaaggccgacgucggauauaagggcacacagcucaaagcgcugcuuauccuggaagggggacaaaaggugguuuucaaacccaagagauacucucgggaucauguggucgagggcgagccuuaugccggguacgaccgccacaacgcugaaguggccgcuuuucaucucgaucggauucugggauuccacagagcgccccuuguggucggccgcuuuguuaaucugagaaccgagaucaaaccuguggccacagagcagcuccugagcaccuuccugacggugggcaacaauaccugcuuuuaugggaaguguuacuauugccgggaaacagagccggccugugcugacggagauauuauggaaggcuccgucacccucuggcugcccgacguguggccucuucagaagcaccgccaucccugggggagaacauaccgggagggaaaacuggcccgcugggaauacgaugagucuuauugcgacgcuguuaagaaaaccagcccuuacgauuccggccccagacuccuggacaucauugacacggccguguucgauuaucuuaucgggaacgccgaccggcaccauuacgagucuuuucaggaugacgaaggagcuagcaugcugauucuccuggauaaugcgaaguccuucggcaacccgagccuggacgagagaucuauccucgccccucuguaucaauguugcaucauucgcgucuccacauggaaucggcuuaacuaccugaaaaauggcgugcucaagagcgcucugaaaucugccauggcccacgaucccaucuccccuguucuuagcgacccccaccuggaugcuguggaccagagacuccugucuguccuggccaccgugaagcaguguacagaucaguuugggauggacaccguccucguggaagaccgcaugccccugucccaucuuuga

SEQ ID NO: 69126 - RNA, 1755 nt, Artificial Sequence
  derived and/or modified sequence opt5 from FAM20C__Homo_sapiens__NP_064608
augaagaugaugcuggugagacgguuccgcguccucauccugaugguuuuucuuguggccugcgcucugcacauugcccucgaccugcuucccagacuggagcggcgcggcgcgagaccuagcggggaaccgggauguuccugcgcucagcccgccgccgagguggcugccccuggcugggcucaaguccgggggcgccccggagaaccucccgccgcgucuagcgccgcuggcgaugccggguggccuaacaaacauacccucagaauccugcaggacuucuccucugauccgagcuccaaucugucuagccacucccucgagaagcugcccccugcugccgaacccgcggagcgggcccuucgcggaagagacccuggcgcucugcggccccaugauccggcccaccgcccucuccugagagaccccggcccucggcgcagcgagucuccucccgggcccggaggcgaugcuucccuucuggccagacucuuugaacauccgcuguaccggguggccguucccccucugacagaggaagacguccucuucaacgugaauagcgauacgagacugucucccaaagcugcggagaacccugacuggccccacgccggggcugagggagccgaauuucuuuccccgggcgaggccgcuguggauagcuauccuaauuggcugaaguuccacauugggaucaaccgcuacgaacucuauucucggcauaaucccgccauugaggcgcugcuucacgaccuguccagccagagaaucaccuccguugcuaugaaaucuggaggcacacagcucaagcugaucaugaccuuucaaaacuacggccaggcccuguucaagccuaugaaacagacacgcgaacaggagacacccccugacuuuuucuauuuuagcgauuacgagcggcauaaugccgaaauugcugccuuccaccucgacagaauccuggauuuucgccgggugcccccggucgcugggagaauggugaacaugaccaaggagauucgcgacgugacccgggauaaaaagcuguggagaacguucuucaucuccccugccaauaacauuuguuuuuauggagaaugcagcuacuacuguucuaccgagcacgcgcuuugcggcaaacccgaccaaaucgaagggucccucgccgcuuuccugcccgaucuuagccuggccaagcgcaagacauggcggaauccuuggagacggucuuaucauaaacgcaagaaagcugagugggaggucgacccggauuacugugaagagguuaagcagacacccccuuaugacagcucccaccggauucucgaugugauggacaugaccaucuuugauuuccugaugggaaacauggacagacaucacuacgaaaccuuugagaaauucggcaaugaaacguuuaucauucaucuggacaacgggagaggauucggcaaguauucucacgaugagcucagcauccuggugccccuucagcagugcugucgcauucggaaauccacauaccugagacuccaacugcuggccaaggaggaauauaaacuuagccuccugauggcggagucucugcgcggcgaccaggucgccccugugcucuaccagccccaccuggaagcucuugauagacggcugcgcguugugcucaaggccgucagagacugcguggagcggaacgggcugcauuccguuguggaugacgaucuggacaccgagcaccgcgcugccagcgccagauga

SEQ ID NO: 69127 - RNA, 579 nt, Artificial Sequence
  derived and/or modified sequence opt5 from FAM210B__Homo_sapiens__NP_543011
auggccggccugcucgcucugcuugggcccgccggaagagugggcgcgcggguccgcccuagagcuaccuggcugcucggggccacagccccgugcgcucccccuccccuggcccuugcucugcucccuccccggcuggacgcccgccugcucagaacggcgcggggagauugucgcggccaccaggacccuagccaagccaccgggacaaccggauccucuguuagcugcacagaggaaaagaaacaguccaagucucagcagcugaaaaagaucuuccaagaguacggcaccgugggcgugagccuucauauugggaucucccugauuucucucggaaucuuuuauauggucgugagcuccggcguugauaugccggcuauucugcuuaaacugggguucaaggaaagccucgugcagucuaagauggccgcuggaacauccaccuuugucguggccuacgcgauccacaaacuguucgcccccguuagaaucagcauuacgcuggugucugucccucucaucgugcgguauuuucgcaaggugggcuucuuuaaacccccugcugccaagcccuga

SEQ ID NO: 69128 - RNA, 690 nt, Artificial Sequence
  derived and/or modified sequence opt5 from FAM213A__Homo_sapiens__NP_001230707
augagcuuccugcaggaccccuccuuuuucaccaugggcauguggucuaucggggccggagcucucggcgccgcggcucuggcccuucugcucgccaacacagauguguuucugagcaagccucaaaaagcugcccuugaguaccuggaagacauugaucucaagacgcuggagaaagaaccgagaaccuucaaggcuaaagagcugugggaaaagaauggggccgucaucauggcgguucggcgccccggaugcuuucucuguagagaggaggccgcugaccuguccucucuuaagagcaugcuggaucagcucggcgugccucuguaugccguggucaaagaacacauucggacagaggugaaggacuuccagcccuacuuuaaaggggaaaucuuccuugaugagaagaaaaaguuuuauggaccucagcgcagaaagaugauguucaugggcuuuauucggcugggcguuugguacaacuucuuucgcgcuuggaaugggggauucuccggcaaccucgagggggaaggauucauccugggcgggguguuugucgugggaucuggcaaacaaggcauccugcucgagcauagagaaaaggaguucggggacaaaguuaaucugcuuagcgugcuggaagccgcgaagaugauuaaaccccagacccucgccuccgagaagaaauga

SEQ ID NO: 69129 - RNA, 3252 nt, Artificial Sequence
  derived and/or modified sequence opt5 from FAM214A__Homo_sapiens__NP_001273424
augguguucagcggcaacaaggggcugcacagagaggacacccucgaugaauacuuugaguaugacgccgaagaguuccuggucucccuugcucugcucaucacagaaggacggacgcccgagugcucuguuaaaggccgcaccgagagcuuucauuguccuccggcccaguccugcuaccccgugacaaccaagcacgaauguucugauaaacuggcgcaaugcagacaggcucggcgcacaagaagcgaggugacccuucuguggaagaauaaccucccuauuauggucgaaaugaugcugcugcccgacuguugcuauuccgaugacgggccuacaaccgagggaaucgaucucaaugaccccgccauuaaacaggaugcccugcuucuggagcgguggauccucgaaccugugccgcgccagaacggcgacagauucauugaggaaaagacgcugcuucuggcuguucggucuuuuguguucuuuagccaacucuccgccuggcugagcgucucucauggggcuaucccccgcaauauccuguacagaauuuccgccgcggauguggaccuccaguggaacuucagccagaccccuaucgagcacguuuuucccgugccuaaugucucucauaacguggcccugaagguguccguccagagccuuccccggcaaucuaauuauccgguucugacauguuccauucacaccaacaucggacucuacgaaaaacgcauucagcagcacaagcugaaaacacaucagcaccauaauccuaacgaggcugagcaaugcggcaccaauagcucccagagacuuuguucuaagcagacguggacaauggcccccgaaagcgugcugcacgcuaaauccggcccuagccccgaguauaccgccgcggugaagaacaucaagcucuaccccgggacaggaucuaaauccgaucacggcaccagccaagccaauauucugggguucucuggaaucggcgacaucaagagccaggaaaccuccguccggacacugaaaucuuuuagcaugguggacuccagcauuucuaaccgccaguccuucuggcagagcgcuggggagacgaacccucucaucggaucucugauucaagaaagacaggagaucauugcccggaucgcucagcaucuuauccacugcgauccguccaccagccauguuuccggcagacccuuuaauacacaggagucuagcucccugcacucuaaacucuuccgcgugagccaagaaaacgagaaugucggcaaagggaaggaagccuucuccaugaccuuuggaagcccugaguucucuucccccgaagacacaaacgagggcaaaauucggcugaagccugagacccccagaagcgaaacguguaucucuaaugauuuuuacucccauaugccggugggggagacaaacccucuuauuggaagccugcuccaggaacgccaggacguuaucgcccggauugcucagcaccuggagcacaucgaucccaccgcgucucauaucccuagacagagcuucaauaugcacgacuccagcucuguggccuccaaggucuuucgcagcuccuaugaggauaaaaaccugcucaagaaaaauaaggacgaaucuagcguguccauuucucauaccaaaugcagccugcuuggcgauaucuccgacgggaagaaccugguccccaauaagugcuucacaucuuuuaaaaacaauagcaaggagaaauguucccucaagcaccaaacccggaaccagugccagaauaacccuagcgaaauuauccaaucuacauaccaggagacgcagaacaaauccagcucucuguccaccagcucuauucugucccaacacaaggaaaauaaccuugaucucacaagcagauucaaggagcaggagauguccaauggaaucgacaaacaguauagcaacuguaccacaauugacaagcagaucugcaccaauaaauacaaggaaaagaucauuaacgagaauuauaaccccaaguuuuucggcaaucugcaaucugaugacagcaagaaaaacgauuccaagaucaaagugacgguucuggaaaugucugaguaccucaauaaguaugaaagcauguccucuaacaaagacagcaagcgcccgaaaaccugugagcagaauacacagcugaacuccauugagaauuaccuuaacaaggauaacgaaggcuuuaagugcaaaaagucugaccagcugaaaaaugagcaagauaagcaggaagacccuaccaacgagaaaagccagaauuacucccagcggagaagcaucaaggauugucucucuacaugcgaacaacccaagaacaccgaggugcugcgcacgacacugaaacauuccaaugucuggcggaagcacaacuuccauagccuugacgggaccucuacaagagcuuuucacccccagaccggacucccucugcuguccagcccggugccccagcggaaaacccaauccggcuguuucgaucucgacucuagccugcuucaucugaaguccuucagcucucgcuccccuagacccugccucaauauugaggaugacccugacauccacgaaaaacccuuucugagcucuagcgccccucccaucacaucccugucucuucucgggaacuucgaggaaagcguucugaauuaucgguuugauccgcugggaauuguggacggcuucacggccgaggucggggcuuccggcgccuuuuguccuacccaccucacacugcccguggaggugucuuucuacagcguuuccgaugacaacgcgccuagccccuauaugggagucaucacccuugaaucucugggcaagagaggguaccgcgugccgccuuccggaacaauucaggugacccucuuuaaucccaacaagacggucgugaaaauguucguugugaucuaugaucugcgggacaugccugcuaaucaucagacauuucugagacagcgcaccuucagcguccccgugaagcaagagguuaaaagauccgugaacaaggaaaauauucggcacaccgaggaacgccuucucagauaccugauccaucugcgguuucagucuagcaaauccggcaagaucuaucuccaccgcgaugucagacugcuuuucucucgcaagagcauggagguggacuccggggccgccuacgagcugaaaagcuacacagaaucucccaccaacccucaguuuuccccgcggugcuga

SEQ ID NO: 69130 - RNA, 822 nt, Artificial Sequence
  derived and/or modified sequence opt5 from FAM216A__Homo_sapiens__NP_037432
augcugggccagcuccugccccacaccgccagagggcuuggagcugccgagaugccuggccaagggccgggaagcgacuggacagaacgguccucuagcgcggagcccccugcuguggccggcacggaagggggaggcggcggguccgccggauacucuugcuaucagaacagcaagggcuccgaucgcaucaaagacggguacaaggucaauucucauauugcuaaacugcaggagcucuggaagacaccccagaaccaaaccauccaccugagcaaauccaugauggaagccagcuucuuuaagcauccugaucuuaccacaggacagaagagauaucuguguucuauugcuaaaaucuacaaugccaacuaucucaagaugcugaugaaacggcaguacaugcacguucugcagcauuccagccaaaagcccggcgugcucacccaccaccgcucuagacuguccagccgguauucucagaaacagcauuacccuugcacaaccuggcgccaccagcuugagagagaggacuccgggagcuccgauauugcggccgcuucugccccggaaaugcugauccaacauagccucuggcggcccgugcgcaauaaggagggaaucaagacgggcuacgcuuccaaaaccagauguaagagccugaaaauuuuccggcgcccuagaaaacuuuuuaugcagacagucucuuccgacgauagcgaaucucacaugagcgaggagaagaaggaagaggaccugcucaacaauuucaugcaguccaugucuaucgaggaacaaggcgaacaccugaugcugaccuga

SEQ ID NO: 69131 - RNA, 780 nt, Artificial Sequence
  derived and/or modified sequence opt5 from FAM220A__Homo_sapiens__NP_001032240
augagagaccggcgcggcccccuggggaccugccucgcccaggugcaacaggcuggaggcggggauagcgacaagcuguccuguucucuuaaaaagagaaugccugagggaccguggcccgccgaugcgccuagcuggaugaacaaacccgucguugacggcaauucccagucugaagcucugagccucgagaugcggaaggauccuuccggggccggacuguggcuucacucuggcggccccgugcugccuuacgugcgcgaaagcgucagacggaacccggccuccgcugccacacccagcacggcuguggggcuguucccugcccccaccgagugcuuugcgcgcguuucuuguuccggaguggaagcccugggcagacgggacuggcucgggggaggcccucgcgcuacagaugggcauagaggacagugccccaaaggcgagccgcgggucagccgccucccuagacaccaaaaggugcccgagaugggcucuuuccaggacgauccucccuccgccuuucccaaggggcugggaagcgaacuugagccugcuugucugcauucuauccucuccgccacccugcacguuuauccggaagugcuucugagcgaggagacaaaacggauuuuccucgaccgccugaagcccauguuuuccaaacagaccaucgaguucaagaaaaugcugaagucuacaagcgauggccuccagauuacccuggggcuucuggcgcuccaaccuuuugaacuggccaauacgcuuugccauuccuga

SEQ ID NO: 69132 - RNA, 1527 nt, Artificial Sequence
  derived and/or modified sequence opt5 from FAM227B__Homo_sapiens__NP_689860
auggccggccagagaaccugccaacggcgcagcuccagagcugggcccggaaagaugcaggagccuccgaaaucuaucgaagaguuccugaaguuucagaacugggacuacuggccccgggaaauucacuuccgcgaugacgauaaauggagcuguacacucaagaaaaucaaggaggacuccucuuuugugagcauuuauacgcaucugugggaaaaugucccuagaaucuucgaggcccuucugauuauggaguccaagcucaaagaauacucucugauccuucagaaccacaccagcgagaucuuuaaguggaaauccaugauuagcgaaacaucuuccuaucggaagcuggagcgcuacggcgaguuccucaaaaaguaucauaagaaaaagaaaaucaugcugagcgaugaaauggagaccgaaaagaauauugaggggugcucuuuuacaggauucaaagcgaacgaacugacccaacuccccagacaccuggacgcugagcagaucuaccuuuuuauucugaaggcccauaauuucgaugagcggguuuuuaaaaucuggaagacacacuuccucuccgaagccagcauugcucugcuucacgacucuuuuugguggugguuccugcauaaguuccgcccugauagagagaaccaggacugucucuuugaucggaucuccgaaagcuaugugacccuguucauguccaucccccugucucgcaaagacgccuuuuuccagauuuacccugauugccucgcucaagccaucuacgcgacguuucacgaggccuucccggaaagcuccuaucuguuuaaugacgaguucaaggaggaccuuggcaacaauauuuuucugugguguagcgggcucaaaccccagaagggauucuggauccauuggaaacugaaggaacuuucuaccacaaccauucacggcuccaagaaagcuccugccaagagcgugaaagagagaaucgcugauucucaggaacacaucagcacauccauugacuuuaacaucauuaagauccugaauaacccccgggccuacacccucccuauuucuaaagaggaaagccgccuguccagacuggcgacaaagagccauuauucuuccacgggccccgaguucaaucggguccucuuuaacuucgggggacagagcccgcugauccuuuacuaucugaagaugcacgagcucgccggcaucucuaaagcuccuaagaaaaccaagauuaaacugacaaagaucuuccaagaaccccuuccugcccccaccuacagagaugugauuaaggaggcuaaacgccaguuugcccggaaucagaaggacuucagaauccugcaagccaaagcuaccaagaaaccccaugaaguuaagcaggauuuugagaaauuccuccacaagcugcgcuccgaggcggaaauugagcgggaaugcguggccagccuguccucuagcuccucuagcuccccuagcucuacagacaacuauaacuuugaggaagaggaguacuga

SEQ ID NO: 69133 - RNA, 339 nt, Artificial Sequence
  derived and/or modified sequence opt5 from FAM32A__Homo_sapiens__NP_054796
auggaggccuacgaacaggugcaaaagggcccccugaaacucaagggggucgcugagcugggaguuaccaaaagaaagaaaaagaagaaagacaaggauaaagccaaacuucuggaagcgaugggcacaagcaaaaagaacgaggaagagaagcggcgcgggcucgacaaaagaacgccugcucaggccgccuucgagaagaugcaggaaaaacggcagauggagcgcauccugaagaaggcuuccaagacccacaaacaaagaguggaagauuuuaaucggcaucuugacacacugaccgagcacuaugauauuccgaaggugucuuggacaaaguga

SEQ ID NO: 69134 - RNA, 579 nt, Artificial Sequence
  derived and/or modified sequence opt5 from FAM3A__Homo_sapiens__NP_001164604
augagacuggccggccccgagagcuccgugaccgcugccccucgggcgcgcaaguacaaaugcgggcucccgcagcccuguccugaggaacaccuggcuuucagagucguuucuggagccgccaacgugaucggccccaagauuugccuugaagacaaaaugcugaugagcuccgugaaggauaaugucgggcggggacucaacaucgcucuggugaauggcguuucuggggagcuuauugaagcccgcgcuuuugacaugugggccggagaugugaacgaccugcucaaauucaucagaccucugcaugagggcacacuggucuuuguggcgagcuaugaugaccccgccacgaagaugaaugaggaaacccggaaacucuucuccgagcugggcucucgcaacgcuaaggaacuugccuuuagagauagcuggguuuucgugggggcuaagggaguccaaaauaaauccccuuuugagcagcacgugaagaacagcaaacauucuaauaaguacgagggcuggccggaagcccuggagauggaaggguguauuccccggcgcuccacagcgagcuga

SEQ ID NO: 69135 - RNA, 708 nt, Artificial Sequence
  derived and/or modified sequence opt5 from FAM3B__Homo_sapiens__NP_478066
augagaccccuggccggcgggcuccugaagguggucuucguuguguuugcuagccuuugcgccugguacuccggauaucugcucgcggagcugaucccugacgcuccgcuuucuagcgccgccuacuccauucggucuaucggcgaacgccccgugcugaaagcuccuguccccaagagacagaaaugugaucacuggaccccuugccccagcgacacauaugccuaccggcuccuguccgggggaggccgcucuaaguaugcuaaaauuuguuucgaggauaaccugcucaugggggaacaacugggaaauguggccagaggcaucaacauugcgaucguuaauuacgugacgggcaacgucaccgccacacggugcuuugacauguaugagggggauaauagcggaccuaugaccaaguucauccaguccgcugcccccaagagccuucuguuuauggugacauacgacgauggcucuacccgccucaacaaugacgcuaaaaacgccauugaagcgcugggguccaaggagaucagaaauaugaaauuccggagcucuuggguuuuuauugccgcuaagggacuugagcugccguccgaaauccagcgcgagaaaauuaaccauagcgaugccaagaauaacagauacucuggcuggccugcugaaauccagauugagggguguauccccaaggagcgguccuga

SEQ ID NO: 69136 - RNA, 684 nt, Artificial Sequence
  derived and/or modified sequence opt5 from FAM3C__Homo_sapiens__NP_055703
augagaguggccggcgcugccaagcuggucguugcgguggcuguguuccuccugaccuuuuacgucaucagccagguguucgagauuaaaauggacgccucccuugggaaccuguuugcccggucugcucucgauacagccgcucgcagcacgaagcccccuagauauaaaugcggaaucuccaaggccuguccggaaaaacacuucgcguuuaagauggccucuggcgcugccaauguuguggggcccaagauuugccuggaggacaacguccuuaugagcggagugaaaaauaacguuggccgggggaucaauguggcucuggccaacggaaagaccggcgaaguccucgauacaaaauacuucgacauguggggcggggauguggcgccuuuuauugaguuccugaaggccauccaagacggaaccaucgugcugaugggcacauaugaugacggggcuaccaaacucaaugaugaagcccgcagacugauugcugaccuuggauccacaucuaucaccaaccugggcuuucgggauaauugggucuucugugggggaaagggcauuaagacgaaaagccccuuugagcagcauaucaagaacaauaaagacaccaacaaguacgagggcuggccugaaguuguggagauggaagggugcauuccccagaaacaggauuga

SEQ ID NO: 69137 - RNA, 675 nt, Artificial Sequence
  derived and/or modified sequence opt5 from FAM3D__Homo_sapiens__NP_620160
augagagugagcggcguccugcggcuccuggcccuuaucuucgcuauuguuaccacauggauguuuauccgcuccuacaugucuuucagcaugaagacgauuagacugccccgguggcucgccgcguccccuaccaaagagauccaggugaagaaauauaagugcgggcugauuaaaccgugucccgcuaacuacuuugccuucaagaucugcucuggagccgcuaauguggucggcccuacaauguguuuugaagaccgcaugaucaugagccccgugaagaacaauguugggagaggacuuaacauugcccuggugaauggcaccacaggggcuguccucggacaaaaagccuucgauauguauuccggcgacgugaugcaccugguuaaguuucugaaagagaucccuggcggggcgcucgugcuggucgccucuuacgaugaccccggaaccaagaugaacgaugaaagccggaaacuuuucuccgaccugggcagcucuuaugcuaagcagcucggguuucgcgauuccuggguguucauuggagccaaggaccugagaggcaaaagcccuuuugagcaguuccuuaaaaauucuccggauacaaacaaguacgaaggguggcccgagcugcucgagauggaaggaugcaugccucccaagccuuuuuga

SEQ ID NO: 69138 - RNA, 1329 nt, Artificial Sequence
  derived and/or modified sequence opt5 from FAM46A__Homo_sapiens__NP_060103
auggccgagggcgaaggguacuucgcuaugagcgaggacgaacuggccugcucccccuauaucccucucggaggcgauuuugggggaggcgacuucgggggaggcgauuuuggcgggggagacuucggcgggggaggcucuuuugggggacacugucuggauuacugcgagagcccgaccgcgcauuguaacgugcuuaauugggaacagguccaaagacuggacggcauucucuccgagacaauccccauucacggccgggggaacuucccuacgcuggagcuucagcccucucugaucguuaagguggugcgcagacggcucgcugaaaaacgcauuggagucagagaugugcggcugaauggcagcgccgccucccauguucugcaccaggacucugggcucggauauaaggaucuggaccuuaucuuuugcgcugaucugcgcggcgagggggaguuccagaccgugaaagacgucgugcucgauugucugcuugacuuucugccugaaggaguuaacaaggagaaaaucacaccccucacccugaaggaagccuacgugcaaaagauggucaaagugugcaaugacagcgauagauggucccugauuagccucucuaacaauuccggcaagaacguggagcugaaauucgucgacagccuucggcgccaguuugaguucucuguugauuccuuucagaucaagcuggacagccuccugcuuuucuaugaauguucugaaaauccuaugacagagaccuuccauccgacaauuaucggcgaguccguguacggggauuuucaggaggcuuucgaccaccugugcaacaaaauuaucgccaccagaaaucccgaagaaauucggggaggcgggcuccugaaguauuguaaccugcucgugcgcggauuuagaccugcgagcgaugagaucaagacgcugcaacgguacaugugcucccgcuucuuuaucgacuucucugauauuggcgaacagcagagaaaacuugagagcuaccugcagaaucacuuugucgggcucgaggaccggaaguaugaauaccugaugacccuucauggcgugguuaacgaguccacagugugucugaugggacacgaaagacgccaaacccucaaucugaucacaaugcuggccauucggguccucgcugaucagaacgugauccccaacguugccaaugugaccugcuauuaccagccugcucccuaugucgccgacgcgaacuucagcaauuacuauauugcccaagugcagccggucuuuacgugccagcagcaaacauacucuaccuggcugccuuguaacuga

SEQ ID NO: 69139 - RNA, 1170 nt, Artificial Sequence
  derived and/or modified sequence opt5 from FAM46D__Homo_sapiens__NP_689843
augagcgagaucagauucaccaaccugacaugggaccaggugauuacgcucgaucaaguccuggacgaaguuauccccauucacggcaaggggaauuuuccuaccauggaggugaaaccgaaggauaucauucauguggucaaagaccagcuuaucggacagggcaucauugugaaggaugcccggcugaacggguccguugcuucuuacauccucgccagccacaauggaauuuccuauaaagaccuggaugugaucuucggcgucgaacuucccgggaacgaggaauuucaggugguuaaggacgcggugcuggauugccuccuggacuuccugccuaaggaugucaaaaaggagaaacucucucccgacauuaugaaggaugcuuacgugcaaaaacuggugaaggucuguaauggacaugacugcuggagccuuaucucccugucuaacaauacaggcaagaaccucgagcugaaauuuguuagcucccuucgcagacaguucgaauuuagcguggacucuuuccagauugugcuggauccuaugcucgacuuuuauuccgauaagaaugccaaacugaccaaggagagcuaccccgucgugguugccgaaucuauguauggcgacuuccaggaggcuaugacacaucugcaacacaaacucaucuguacccggaagccugaggaaauccgcgggggaggccugcuuaaauacugcucccugcucgugcacggguuuaagccggccuguaugagcgagauuaagaaccuggaaagauauaugugcucucgguucuuuaucgauuucccccacauugaggaacagcagaaaaagaucgaguccuaccuucauaaucacuucauuggagagggcaugacaaaauacgacuaucugaugacccuccauggggucgugaacgaaagcacgguuugucugauguccuacgagcgcagacagauccugcaccucaucaccaugauggcucugaaggugcuuggagaacugaauauucucccuaacacacaaaaagugaccugcuuuuaucagcccgccccuuacuucgcggccgaggcucgguaucccaucuacgucauuccggaaccucccccugucucuuuucagcccuaucacccccugcauuuccgcggcagcaauggcauguccuga

SEQ ID NO: 69140 - RNA, 972 nt, Artificial Sequence
  derived and/or modified sequence opt5 from FAM49A__Homo_sapiens__NP_110424
augggcaaccugcucaaggugcugaccagagagaucgaaaauuacccccacuucuuucuugacuucgagaacgcccagccuacagaaggggagcgggaaauuuggaaucaaaucagcgcuguccugcaggauuccgagucuauucucgccgaccugcaggcguauaaaggagcuggcccggagauccgcgaugccauucagaaccccaaugacauccaacuucaggaaaaggccuggaacgcuguuugcccucugguggugagacucaaacgguuuuacgaguucagcauccgccuggaaaaggcccugcagucccuccuggagucucuuacgugucccccuuauacccccacacagcaucuggagagagaacaagcucucgccaaagaguuugcggaaauucugcacuucacccuucgguuugaugagcugaagaugcgcaauccugccauccagaacgacuucagcuacuauagacggacaauuucccgcaauagaaucaacaauaugcaucucgauauugaaaacgaggucaauaacgagauggcuaaucggaugucucuguuuuacgccgaagcuaccccgaugcugaagacacucagcaacgccaccaugcacuucguguccgagaacaaaacgcugcccaucgaaaauaccacagacugccuuagcaccaugacaucuguuuguaaggugaugcuggagaccccugaauaucgcuccagauuuacgagcgaggagacacucauguucugcaugcgggucaugguggggguuauuauccuguacgaucaugugcaccccgucggagcguuuuguaaaaccucuaagaucgacaugaaaggcugcauuaaggugcuuaaggaacaggccccugauuccguggaggggcugcucaacgcucugcgcuucacaaccaaacaccugaaugacgaaagcaccucuaagcagaucagagccaugcuccaauga

SEQ ID NO: 69141 - RNA, 975 nt, Artificial Sequence
  derived and/or modified sequence opt5 from FAM49B__Homo_sapiens__NP_001243692
augggcaaccugcucaaggugcugaccugcacagaccuugagcaggggcccaauuucuuucuggauuucgaaaacgcccaaccuacggagagcgaaaaagagaucuacaaucaggucaacguugugcucaaggacgcugaaggcauucuggaggaucuucaguccuauagaggagccgggcacgagauccgggaagcgauucagcauccggcugacgagaaacugcaagaaaaggccuggggagccguggucccccucgugggcaaacugaagaaguuuuacgaguucucucagcgccuggaggcugcccucagagggcugcuuggagcucugaccagcacaccuuauucccccacccagcaccucgaacgggagcaggcccuggcgaaacaauuugccgaaauccuucauuucacacugcgcuuugaugagcucaagaugaccaauccugcuauucagaacgacuucucuuacuauagacggacacugagccgcaugagaaucaauaacguucccgccgaaggcgagaaugaggugaacaaugaacuggcuaaccggaugucccucuuuuacgccgaggcgaccccuaugcugaaaacgcuuucugaugccaccacaaaguucgucagcgaaaauaaaaaccugccgaucgagaauaccacagacugucucuccaccauggcuagcgugugccgcguuaugcuggaaacgcccgaguauagaucucgguuuacaaacgaggaaaccguguccuucugucuucgcgucauggugggcgugauuauccuguacgaucacguccauccuguuggggccuuugcuaagacaagcaagauugacaugaaaggaugcaucaaggugcucaaagaucagcccccuaacucuguggagggccugcugaaugcccucagauacaccaccaagcaccugaacgacgaaacaacguccaaacagauuaagagcaugcuucaauga

SEQ ID NO: 69142 - RNA, 978 nt, Artificial Sequence
  derived and/or modified sequence opt5 from FAM50B__Homo_sapiens__NP_036267
auggcccaguacaagggcaccaugagagaggcugggcgggccaugcaucugcucaaaaagcgcgaaagacaacgggagcagauggaagugcugaaacagcgcaucgcggaggaaacaauucuuaagagccaggucgacaaaagauucuccgcucacuaugaugccguugaggccgagcugaagucuagcacggugggacucgugacccugaacgacaugaaggcucggcaagaagcccuuguccgcgagagagaacggcagcuggcuaaacgccagcaccucgaggagcagagacugcaacaggaacggcagcgcgagcaggaacaaagacgggagcgcaagagaaaaaucuccugccugucuuuugcccucgaugaccuggaugaccaggcggaugccgcugaagcccggagagcuggcaaucuugggaagaaccccgacguggauaccagcuuccugccugaccgcgaucgggaggaggaagagaauagacuccgcgaagaacugcggcaggaaugggaggcccaaagagagaaaguuaaggacgaagagauggaagugacauuuuccuacugggauggaucuggccaucgccggacagucagagugcgcaaggggaacaccguucagcaguuccuuaaaaaggcgcugcagggacuccggaaagacuuucuggagcugagaagcgccggcguggaacaacucauguucauuaaggaggaccugauccuuccgcacuaucauacauuuuacgauuucauuaucgcucgcgcccggggcaaauccgggccccuguuuagcuucgacguccacgaugacgugagacuccugucugaugcuaccauggagaaggacgaaucccacgccggaaaagugguccuucggagcugguaugagaagaauaagcauaucuuuccugccucucgcugggaggcuuacgaucccgagaaaaagugggacaaauauacgauuagauga

SEQ ID NO: 69143 - RNA, 1269 nt, Artificial Sequence
  derived and/or modified sequence opt5 from FAM53B__Homo_sapiens__NP_055476
auggugaugguccugagcgagucccucucuaccagaggcgccgacagcaucgcuugcgggacauucucccgggaacugcacacgcccaagaaaaugucucagggaccuacccuuuuuagcuguggcauuauggagaacgaucgcuggagagaccuggaucggaagugcccgcuccaaaucgaccagcccuccacaucuauuugggaaugucugccugagaaagauagcucccuuuggcaucgcgaagccguuaccgcgugcgcugugacaagccugaucaaggaccucucuauuuccgaucacaaugggaaccccagcgccccucccucuaaaagacagugucggucccugagcuucucugacgagauguccagcugccgcaccuccuggagaccucugggaucuaagguguggacaccggucgagaagcggcgcuguuacagcggcggguccgugcagagauauagcaauggauuuucuaccaugcaacgguccagcucuuucagccuccccucccgcgccaacguucugucuagcccuugcgaucaggcuggccuucaucacagauuuggcgggcagcccugucagggagugccuggcuccgcccccugcgggcaagcuggagacacguggagcccggaucugcauccugucggcgggggacggcucgaccugcagcgcucucuuuccuguagccacgaacaguucucuuuuguggaguacugucccccuuccgccaauagcacccccgcguccacacccgaacuggccagacggucuagcggccucuccagaucucgcagccagccuugcguucugaacgauaaaaaggugggcgucaaacggagacgcccggaggaggugcaagaacagcggcccucccuggaccucgcuaagauggcccagaauugccaaaccuucagcucucuguccugccuuagcgcugggacagaggacuguggaccucagucucccuuugccagacacguguccaacacccgcgcguggacggcccugcucagcgcuucuggcccugggggacggacacccgccggcaccccggucccugaaccccugccucccagcuucgaugaccaucuugcuugccaggaggaucuguccugugaagagagcgacucuugcgcccucgaugaggacugugggagacgcgccgaaccugcugcggccuggcgggauagaggagcucccggcaauucccugugcagccuggacggcgagcucgauaucgaacagaucgagaaaaacuga

SEQ ID NO: 69144 - RNA, 774 nt, Artificial Sequence
  derived and/or modified sequence opt5 from FAM57A__Homo_sapiens__NP_079068
augcugcucacccuggccggcggggcucuuuucuuucccggacuguucgcccucugcacaugggcgcugagacggagccagccuggcuggucccgcacggacugugugaugaucucuaccagacuugucagcuccguucacgcugugcuggccacagggucuggaauugugaucauucggagcugcgaugacgucaucaccggccgccauuggcucgccagagaguacgugugguuucugauuccguauaugaucuacgauuccuaugcuauguaccugugugaauggugccggacacgcgaccaaaacagagcccccucucucacccugcggaauuuccuuagccgcaacagacugaugaucacacaccaugcuguuauucucuuugugcuggucccuguggcccagcggcuucgcggggaucugggagacuucuuuguuggcuguaucuucaccgcggagcucuccacgcccuuugugagccugggcagaguccugauucagcucaagcagcaacacacccugcuuuauaaagugaaugggauccugacacucgccaccuuccugucuugccggauucuucuguuuccuuucauguacugguccuauggacgccagcagggccucagccugcuccaggugcccuuuucuaucccuuucuacuguaacgucgcuaaugccuuccugguugcuccgcaaauuuacugguuuugccugcuuuguagaaaggccgugcggcuguucgauacaccccaggcgaaaaaggacggguga

SEQ ID NO: 69145 - RNA, 687 nt, Artificial Sequence
  derived and/or modified sequence opt5 from FAM58A__Homo_sapiens__NP_001124469
auggaggcccccgaaggcgggggaggcgggccugcugccagaggaccggagggccagcccgcgccugaagcucgggugcacuuccgcgucgccagauuuaucauggaggccgggguuaagcugggaaugcggagcauucccaucgcuaccgccugcacaauuuaccauaaauucuuuugugaaacgaaccucgacgcuuaugauccuuaccugaucgccauguccucuauuuaucuugcgggcaagguggaggagcaacaucugcgcaccagagacaucaucaaugugagcaaccgguacuucaaucccuccggcgaaccucucgagcuggauucucgcuuuugggaacuuagagacagcauuguccagugcgagcugcucaugcugcgggugcugcgcuuccagguuuccuuucagcacccgcacaaauaucuccugcauuaccuugugucucugcaaaacuggcucaauagacacagcuggcagcggacacccgucgccgugaccgcuugggcccugcuucgcgauuccuaucacggggcucugugucucagauuccaggcccagcauaucgcgguugccgugcuguaccuggcucuccaagucuacggaguggaggugccugccgaagucgaggcugaaaagcccugguggcagauuuauacaauggacaccgagaucccuuga

SEQ ID NO: 69146 - RNA, 666 nt, Artificial Sequence
  derived and/or modified sequence opt5 from FAM60A__Homo_sapiens__NP_001129284
auguucggcuuucacaagcccaaaauguacagaagcaucgaggggugcuguauuugccgggccaaguccucuagcucccgcuucaccgacucuaaaagauaugaaaaggauuuucagagcuguuucggacugcaugagacacgguccggcgacaucugcaacgcuugugugcuccuggucaaacgcuggaagaaacuuccugccgggucuaagaagaauuggaaccacguuguggaugcgagagcuggaccgagccugaaaacgacccucaagcccaaaaaggugaagacacuguccggcaaucggauuaaaagcaaccaaaucucuaaacuucagaaggaauuuaagcgccauaauuccgacgcccacagcaccacaucuuccgccagcccugcucagucucccugcuacuccaaccagagcgaugacggguccgauaccgagauggccucuggaagcaauagaacaccugucuucuccuuucuggaccucaccuauuggaaacggcaaaagauuuguugcggcaucaucuacaaaggccgcuucggggaagugcugauugauacgcaucuguuuaagcccuguugcagcaacaagaaagcugccgcggagaagccugaggaacagggaccggagccccucccuaucucuacccaggaaugguga

SEQ ID NO: 69147 - RNA, 1866 nt, Artificial Sequence
  derived and/or modified sequence opt5 from FAM63B__Homo_sapiens__NP_001035540
auggagagcucccccgaaucucugcagccucucgagcacggcguggccgcugggccggccagcggaaccggcuccucucaagaagggcugcaggagacaagacuugcggcuggagacggccccggggucugggccgccgaaacgagcggaggcaacggccugggggcugccgcugcccggcgcucccucccugauucugcgagccccgccggauccccugagguucccggcccuugcagcagcuccgcugggcuggaccuuaaggauagcggacuggagucuccggccgcugccgaagcgccccucagaggccaguacaaagugaccgccuccccugagacagcuguggccggggucggacaugaacugggcaccgcuggcgacgccggggcccggcccgaucuggcuggaacaugucaggcggagcucaccgccgcuggcagcgaggaaccuucuuccgccgggggacugagcuccucuugcagcgaccccuccccgccuggcgagagccccucucuugauucccuggaaucuuucucuaaucuccacagcuuuccuuccucuugugaguucaacagcgaagagggggccgagaaucgcgugcccgaagaggaagagggagcugccguucugcccggcgcggugccucuuugcaaggaagaggagggcgaagagacagcucaaguccuggccgccuccaaagaaagauuuccggggcagagcguguaucauaucaaguggauucaguggaaagaggaaaacacccccaucauuacgcagaaugagaacggaccuuguccccuccuggcuauccugaauguucuccugcuugccuggaaggugaagcugccucccaugauggagauuaucaccgcugaacaacucauggaguaccugggcgacuauaugcuugaugccaaaccgaaggaaaucucugagauucagcggcugaacuacgagcagaauauguccgacgcgauggccauccuccacaaacugcagacagggcuggaugucaacgugcgcuucaccggagugagagucuuugaauauacaccugagugcauuguuuucgaccuccuggauaucccccuuuaccauggcuggcugguggacccucaaauugacgauaucgugaaggcugucgggaauuguagcuauaaccagcucguggagaaaauuaucucuugcaagcaguccgacaauagcgaacugguuuccgaaggcuuuguggccgagcaauuccuuaacaauaccgcuacgcagcugacauaccacggacucugugagcugaccucuacaguccaggaaggcgagcugugcguguuuuuccggaacaaccacuuuagcaccaugaccaaguacaaagggcagcucuaucugcuuguuacagaucaaggauuccugacggaagagaagguggucugggaaucccuccauaauguggacggcgaugggaacuuuugugacucugaguuccaccugagacccccuagcgaucccgagaccgucuacaaaggacagcaggaccagaucgaucaagacuaucugauggcccuuucccuccagcaggaacagcaaagccaggagauuaauugggaacagaucccggagggcauuucugaucuggaacuggcgaagaaacuccaggaggaggaagaccgccgggccucccaauacuaucaggagcaggaacaagcugccgcugccgccgcugcggccagcacacaggcucagcaggggcaaccugcccaggccucucccuccagcggccgccagucuggaaacagcgagagaaagcggaaagagccccgcgaaaaggacaaggagaaagaaaaggagaaaaauuccugcgugauccuguga

SEQ ID NO: 69148 - RNA, 747 nt, Artificial Sequence
  derived and/or modified sequence opt5 from FAM64A__Homo_sapiens__NP_001182157
auggccagcagauggcagaacaugggcaccuccgugcggcgcagaucucugcaacaccaggagcagcucgaagacagcaaggagcugcagcccgucguuucccaucaagaaacaucugugggggcucuuggaagccugugccggcaguuccagcgcagacucccucugcgggccgugaaucuuaaccugcgcgcgggcccguccuggaaaagacucgagacgcccgaaccugggcagcaaggacugcaggcugccgcccggucugcuaagagcgcccugggcgcugucucccagcgcauccaggagagcugucaaucugggaccaaauggcucguggagacacagguuaaggccagacggcgcaaaagaggagcgcagaagggcuccggcagccccacccacucucugucccaaaagagcacacggcuuucuggggccgcuccugcccauuccgcugccgaucccugggaaaaagagcaccaucgccugagcgugagaaugggaucccacgcgcacccucuccggagaucucgccgggaagccgcuuuuagaagcccguacuccagcaccgagccccugugcucuccuuccgagagcgacucugaucuugaacccgucggcgccgggauucagcaucugcagaagcucagccaggagcuggacgaagcuaucauggccgaggaacgcaaacaagcccuguccgaucggcagggauucauucucaaggacguguaugcuucuccuuga

SEQ ID NO: 69149 - RNA, 3144 nt, Artificial Sequence
  derived and/or modified sequence opt5 from FAM65B__Homo_sapiens__NP_001273374
augcaguucuuugacgccgaggaacugcucguggaugaggaagacgaugucuucggcgaggggcugcccaccagacuuccugaaaucaugcugguuggaagccaauccuuuucuccgggcgggcccaacggaauuauccggagccaguccuucgcuggcuuuucugggcuccaggagcgcagaagccggugcaauuccuucauugagaacucuagcgcccugaagaaaccucaggcgaaacuuaagaagaugcacaaucugggacauaaaaacaauaaucccccuaaggaaccccaaccuaagcgcguggaggaaguguacagagcucucaaaaacggccuggacgaguaucuggagguccaccagacagaacucgauaagcugacggcccagcuuaaagacaugaagcggaacucccgccugggcgugcucuacgaucuggacaaacagaucaagaccauugagagauauaugcggcgccuugaauuucauaucagcaagguugaugagcuguacgaagccuauuguauccaaagacggcuccaggacggggcuucuaaaaugaagcaggccuucgcuacauccccggccagcaaagcggcccgcgagucucugaccgagauuaauagauccuuuaaggaauacacagagaacaugugcaccaucgaaguggagcuggaaaaucuccugggagaguucagcauuaaaaugaagggccuugcuggguuugcccggcugugucccggagaucaguaugagaucuucaugaaauacggccgccaaagauggaagcucaaggggaaaauugaagucaacggaaagcagucuugggacggcgaggaaacaguguuucugccucuuaucguuggcuucauuuccaucaaagugaccgagcugaaggggcucgcuacgcacauccuggucggaagcgugaccugcgaaacaaaagagcuguucgccgcgcggccccagguggucgccguugauauuaaugaccucggcaccaucaagcugaaccuugagauuacaugguacccuuuugacguggaagauaugaccgcuuccucuggggccggaaauaaggcugccgcccugcaaagacgcaugagcauguauucccagggcacgcccgagacaccgaccuucaaagaccauagcuuuuucucuaaccucccugaugacaucuuugaaaacgggaaggcugcggaggagaaaaugccccugucccuuagcuucucugaucugccuaauggagacugugcccucacaagccacuccaccggcucucccagcaacuccaccaaucccgaaauuacaaucacgccugcugaguuuaaccugagcucucuggccucccagaaugaaggcauggaugacaccagcucugccuccagccggaacucccucggggagggacaggaaccgaagucucaccugaaagaggaggaucccgaggaaccuagaaagcccgcuagcgccccuuccgaagcgugccgccggcaaucuagcggcgcuggggccgagcaucuuuuccuggaaaaugacguggccgaggcucuccugcaggaguccgaagaggccagcgaacugaagcccgucgagcuugauacaucugaaggaaacaucaccaaacagcucgugaagagacugacauccgcugagguuccgauggccaccgaccgccugcucagcgagggcucugucgggggcgaauccgagggaugucggagcuuucuggacggcucucuugaagaugcguucaaugggcugcuccuggcccuggagccucacaaagagcaguacaaggaauuucaagaccuuaaccaggaggugaugaaucucgaugacauucugaaaugcaagcccgcugugagcagaucccgcuccucuucccugagccucacgguugaauccgcccuggagucuuucgauuuucuuaacacaagcgacuucgaugaagaggaggacggagaugaaguguguaaugucggcgggggagcugacuccguguucucugauaccgagaccgaaaagcauagcuaucgguccguccacccugaggccagaggccaccugucugaagcgcucacagaggacaccggggugggcacaagcguugccggaagcccccugccucugacgaccggcaacgagagccuugauaucacaauugugcgccaucuccaguacugcacccagcugguccaacagaucguguuuucuuccaaaacacccuucguugcucggagccugcucgaaaagcugucuagacagauucaggugauggagaaacuugccgcugucuccgacgaaaauaucgggaacaucagcucugugguggaggccauuccggaauuucacaagaaacugucccuccugagcuucuggaccaaguguugcuccccuguuggagucuaucauagccccgccgaccgggugaugaaacaacuggaggcuucuuuugcgcgcacggugaacaaggaguaccccggccuugccgauccugucuucagaacccucgugagccagauccuggaccgggcugaaccgcugcucuccucuagccuguccucugagguugugacagucuuucaguauuacagcuacuucaccucccacggggugucugaucuugaaagcuaucugucccaacucgccagacagguuagcauggugcagacacugcagucucugcgcgacgagaaacuucugcaaaccauguccgaucucgcccccagcaaucugcucgcucagcaggagguccugcggacgcuugcccugcuccugacaagagaagacaacgaggugucugaagcgguuacccuguaccuugcugccgccuccaagaaucagcauuuucgcgagaaggcucugcucuauuacugcgaagcccugacaaaaaccaaccuccaacugcagaaggcggcuugucuugcccugaaaauucucgaggccaccgagagcaucaagaugcuggugacacugugccaguccgauacggaagagauuagaaaugucgcuucugaaacccuucugagccucggagaggacggccggcuggccuaugaacagcucgauaaguucccucgcgacugugugaaagucgggggcagacacggaacagagguggcuaccgccuuuuga

SEQ ID NO: 69150 - RNA, 1260 nt, Artificial Sequence
  derived and/or modified sequence opt5 from FAM69C__Homo_sapiens__NP_001037834
auggccagagcugccggcgcgcgggggcccgcuggauggugccgcagacggggccgcugugggagaggaacccugcucgccuucgccgcuuggacagccggcugggugcuggcugccgcgcuucugcuccgggcccacccugggguccugagcgagcgcugcacggacgaaaaguccagacggauccuugcugcccugugucaggauuaccaaggaggcacccucgcuggcgaccugugcgaggaucuguguguugccggggaacuccuguuucagcgcugccuucauuauaacagaggcaaaaaggugcugcaggcggacuggcggggacgcccggugguccucaaaucuaaggaggaagccuucagcuccuuucccccucugucucuucuggaggaggaagcuggggagggaggccaggauaugcccgaagccgagcuccugcugaugguggcuggggagguuaaaagcgcccucggacuggaacuuuccaauucuagccugggcccuugguggcccggcagacgggggccucgcuggagaggacaacucgccucccugugggcgcuucugcagcaggaggaauacguguauuucagccuccugcaggaccugucuccgcacguccuccccgugcugggcuccugugggcauuuuuacgcuguugaguuccuugccgcuggaagcccucaccaucgggcccuguuuccccucgauagagccccuggcgcucccgggggaggccaagccaaggcgauuucugacaucgcucuguccuuccuugauauggugaaccacuuugacagcgauuucucucaccgccugcaucucugcgacauuaagccggaaaauuuugccauccgguccgauuucacagucguggccauugacguggacauggccuuuuucgagccuaaaaugagagagauccuggaacagaacuguaccggcgaugaggacugcaauuucuuugauuguuucagccgcugcgaccugcgggucaacaagugcggggcucagagaguuaauaacaaucuccaggugaucugugauaaaauuuuucgccacugguucuccgcuccccugaagucuagcgccguguccuuucaacuucagcugcagcuccaagaagcgguccaggagugcgccgacccuggagugcccagcggcaacacacggagagcugccucuuccguuuucuggaaacugcgccagcugcuucaggcuacccuccgggaacugcaagaggccgagaaguga

SEQ ID NO: 69151 - RNA, 1035 nt, Artificial Sequence
  derived and/or modified sequence opt5 from FAM71F1__Homo_sapiens__NP_115988
augcugagcuccuucccccacagaaagaccuggcggaaaucuaagaaaacagugaaggucacgcgcagcuacccuaccuuuccgucccucaacgccugggaggaguucagaggccugcuucccguugacggggaaccuaaucccggagccggccuggggguggaagagggacuccugugccgggugguccauucuccugaauuuaaccuuuuccuggauagcgugguuuuugaguccaauuucauccaggugaaacgcggcagaaacuggcgggacgucuauaaggccucuaauacaauggcgcucggggugaccagcuccguucccugucugccucugccgaacauucuccugauggcuagcgugaaguggcaccaaggacagaaucagacauggaaccgccccucuaucgccccuaauauuuuucuuaaaagaauccugccccuccgguucgucgagcugcaagugugcgaucauuaccaacgcauucuucagcugagaaccgugacagaaaagaucuauuaccucaaacugcacccugaccaucccgagaccgucuuucacuucuggauccggcugguucagauucuccagaagggccuguccaucacgaccaaagauccgcgcauucuugugacacacugucuggugccuaagaacugcagcucucccuccggcgacagcaagcucguccagaaaaagcugcaggccucucagccuuccgaaagccuuauccagcugaugaccaaaggggaguccgaggcucucucucaaauuuuugccgaucugcaucagcagaaucaacugagcuucagauccagccggaagguggaaacaaacaaaaauucuuccggaaaggacagcucucgcgaggauagcauccccuguaccugcgaccucagauggcgggcuuccuuuacguauggcgaaugggagagagaaaaccccucugggcugcagccucuuagccugcucuccacacuggccgcgagcaccggaccgcagcuugcucccccuauuggcaauucuaucuga

SEQ ID NO: 69152 - RNA, 930 nt, Artificial Sequence
  derived and/or modified sequence opt5 from FAM71F2__Homo_sapiens__NP_001012457
augagcaagaucagaggccugcccccugaggugcgggaaccggggcccggagucgagcucggcguugaaaacgggcugcuuugccagcugauucacuccccugaguucaaucucuuuucuaacagcgugguguucgaauccaauuuuauccaaacccauguccccgaggccgacuuccaggugacaaaaccuggaaacuggcgcgauguuugugagggcucugcuacggugauucugggggucaccagcuccgugcccucucuuccucugccgaauguucuccugauggccaacgugacauggccccagggaccuuuuaccacauggagcacccccggcgacgcgccugucaucaaucuguccagacuccugccccuuaaguacguggaacugcggauuuaugaucgccuccagagaauccugcgggugcgcacagucaccgagaaaaucuacuaucuuaagcugcacgaaaaacauccggagauuguuuuccaauuuugggugagacucgugaagauccugcagaagggccugagcauuacgaccaaagacccucggaucaaguucacacacugccucguccccaaaaugccuaccaacucuacagagaccacgcccgaaaauucccugcuuagcucuccccagccuuccgagccgcuggugcuccuggcugccgaacagacaagcgggucuuuuucccaacuuagcggaaagccccagcugaccgccgaucgcaacaaugacacagcuauugagaucgauaacuguuccucuuacaaaauuccuagccccguugccuccccuaucaaucucaacauccccaugagagcugcccugagccauucucugugggaacaggaggacuggaaugagcaccuccuucaggugcacauugcguccuaucugggcgaacauuuccugggggccuga

SEQ ID NO: 69153 - RNA, 330 nt, Artificial Sequence
  derived and/or modified sequence opt5 from FAM72B__Homo_sapiens__NP_001307078
augagcaccaacaucugcuccuucaaggacucugccguggauuuuacaggcagauguuacuucacgaaaauuugcaaguguaaacugaaggacaucgcuugccucaaaugugggaauauugucggauaucacguuaucgugcccugcagcuccugucugccuucuugcaacaauggccauuuuuggauguuccacagccaggccguguacgauauuaaccggcuugacuccaccggggucaauauccugcucuggggaaaccugccggagaucgaagagucuacagaugaagacgugcuuaauauuagcgcggaggaauguauccgcuga

SEQ ID NO: 69154 - RNA, 786 nt, Artificial Sequence
  derived and/or modified sequence opt5 from FAM78B__Homo_sapiens__NP_001017961
augggcugcauccagagcaucaccuguaaggccagaauccggcgcgagaacauuguggucuacgacguuugcgcuacaaucgaucaaugucccacgagaauugaagagaccuccccuaucgugcugcgguauaaaacaccguacuucaaggccucugcgcgcguggucaugcccccuauccccagacacgaaaccugggugguuggguggauucaggcuugcaaucagauggaguuuuucaacacauauagcgaccucggaauguccucuugggaacugccugaucuucgggagggccgcgugaaagccaucagcgacuccgauggggucucuuaccccugguauggaaauaccacagagaccgugacgcugguuggcccuaccaacaagauuagcagauuuuccgugagcaugaaugacaacuucuacccgucugucacaugggccgugcccguguccgauagcaaugucccucuccugacccggaucaaacgcgaccagucuuuuacaaccuggcuuguugcuaugaacacgacaaccaaggaaaagauuauccugcaaacaauuaaauggagaaugcggguggauaucgagguggacccccuccagcugcuggggcagcgcgccagacucgucggacggacccagcaagaacagccucgcauccuguccagaauggagcccauuccgccuaaugcucuugugaagcccaacgccaaugaugcgcagguucugauguggcggccuaaaagaggcccuccccucguggucauucccccgaaguga

SEQ ID NO: 69155 - RNA, 1359 nt, Artificial Sequence
  derived and/or modified sequence opt5 from FAM81B__Homo_sapiens__NP_689761
augcagcugcaauuccucggcacccuggccagcuccgagaagagaaagaagucucagcggcuuuucuucaaaaacaucaagagcacaaagaauaaggcugggaaggccuccauuaugucuagcgacacgaacgugaauaaauccgcgucucccaccgcuacagccgaggaacagccugucgaaccggauggaccccugccuggcagcgacaacaaucaggagaagaaaguucgccucucccccgccaagaugagcaccaaaaacucuacagaucugguggaauacguggacaagucccacgcuuuucuuccuaucauucccaauacccaaagagggcagcuggaggaucggcucaacaaucaggcccgcacaaucgcuuuccugcuggagcaggccuuuagaauuaaggaagacaucagcgcgugccuccaaggaacccauggcuuccggaaagaggaaucucuggcccgcaaacuucuggagucccacauccagacgauuaccagcaucgucaaaaagcucucucagaacauugagauccuggaagaucagauuagagcucgggaccaagccgcuacagggaccaauuuugccgugcaugagaucaacauuaaacaccuucagggaguuggcgaucugcgcggcagaguggcgcggugugacuccagcaucgucaagcucuccggggauauccaucuguuccgccaggaacacagacaaauugagaaagccauccaggaauuugugccugcucuggagacacucucuaagaaucuggacaugaagguuaugcagcuucugggaaaaauugagaccgccagcuccgaacagacgagcaaccucaagauggugcaaggcgauuaucggcacgagaugaaucugcuugaauuuaaauuucauucucuguccagcaaccucuacgaggaagucgagaacaauaagaaauggacagagaaccaguuccugaaguaucgcaaggaccaccuggggcauaucaaugaaugccucaaagugcugcaggagaaacuugaaaaaucugagaacaagauggaagagaaacugcuccagcugagcuccaagguggagaauuuuauuaacacccaaaagcaggaaacacagcuuucuaaagucaagcacauggagaauaaacugagcaagaaaauggaacagauggagaagcaaaucuggggagagcucgaaaccaugcagaacgaguaccaguccggcuucaagagcauccacgacucucuguccagccugcagcaaauucagaaaaccaagauggaucucgaaaaauauaagguucagaaagaccugaagaaacuucaaagaaagaucguggagcugcaggaaguguga

SEQ ID NO: 69156 - RNA, 885 nt, Artificial Sequence
  derived and/or modified sequence opt5 from FAM83A__Homo_sapiens__NP_001275516
augagcagaucccggcaccugggcaagauccgcaaaagacucgaggacgugaagucucaguggguccggcccgcccgcgcugauuucagcgacaacgaauccgccagacuggcgaccgaugcucugcuggacgggggaucugaggccuacuggcggguucucagccaagaaggcgagguggauuuucuguccucuguggaagcccaguauauucaggcucaggcccgcgagccuccgugucccccugacacacuugggggagcugaggccggccccaaagggcuggauagcuccagccuccaaucuggaacguacuucccugucgcguccgaaggcagcgagcccgcccugcugcauucuugggcuuccgccgaaaagccuuaucucaaagaaaagagcucugcuaccguguacuuucagacaguuaagcacaauaacaucagagaccuggugcggcgcugcauuaccagaacaucccagaauaucagcauucgguccgucgagggcgaaaucuauugcgccaaaucugggcgcaaguucgcgggacagaucagagagaaauuuauuaucagcgauuggcgguucgugcuuuccggcagcuacucuuuuaccuggcugugugggcauguucaccgcaacauucucuccaaguucacaggacaagccguggaacuguuugacgaggaguucagacaucuuuaugcuagcucuaaaccggucaugggccuuaagagcccccggcucguggccccugugcccccuggggcugcccccgccaauggaagacuguccucuagcuccggcagcgcuucugaucgcaccuccagcaacccguuuucuggccgguccgcggggagccacccuggaacgagaaccgacggcuga

SEQ ID NO: 69157 - RNA, 3036 nt, Artificial Sequence
  derived and/or modified sequence opt5 from FAM83B__Homo_sapiens__NP_001010872
auggagaccagcuccaugcugucuagccucaacgacgaaugcaaguccgauaauuacaucgagccccacuauaaagaaugguacagaguggccauugacauccugauugagcauggccuugaagccuaucaggaguuccugguccaagagcggguuucugauuuucucgccgaagaggaaaucaacuacauucugaagaaugugcagaaaguggcgcagagcacagcucacgggacggacgauuccugugacgauacccuuucuagcggaacauauuggccugucgaguccgacguggaggccccgaaccuggaucucggcuggcccuacguuaugccugggcugcugggaggcacccauaucgaccuccuguuccaucccccucgcgcccaccuucugacaaucaaggaaaccauuagaaaaaugaucaaggaggcucggaaggugauugcccucgucauggauaucuuuacagacguggauauuuucaaagaaaucguugaggcuagcacccgcggggugucugucuauauucugcuugacgaauccaauuuuaaccacuuccugaauaugacggagaagcagggaugcagcgugcaaagacuccggaacauccgcgugagaaccgucaaaggccaggacuaccugucuaagacaggcgccaaauuucacgggaagauggagcagaaguuccugcucguugauugucagaaagugauguacggauccuauagcuacauguggucuuuugaaaaggcgcaucuguccauggugcaaaucauuaccggccagcuugucgagagcuucgacgaagaguuucggacacuguaugcccgcuccugcgugcccucuagcuucgcucaggaagaguccgccagaguuaaacacgggaaggcucucugggagaauggaaccuaccagcauagcgugucuucccuggccagcgucucuagccaacggaaccuuuuuggccgccaggauaaaauccacaagcuggacuccucuuauuucaaaaauagagggauuuacacgcucaacgaacacgauaaguauaauauccggagccauggauacaagccucacuucgugccgaacuuuaauggccccaacgcgauucgccaguuccaaccuaaccagaucaaugagaacuggaaaagacauuccuacgccggcgaacagcccgagacaguuccuuaucugcugcucaaucgggcucugaacagaaccaauaaucccccggggaauuggaagaaaccuagcgacucucuuuccguggccagcagcucccgcgaaggauacgucagccaccauaacacacccgcucaguccuuugccaaucggcuggcccaaagaaagaccaccaaccucgcugaucgcaauucuaacgugcggagaucuuucaauggcacagacaaccacauccgcuuucugcagcagcggaugccuacgcuugagcacaccacaaaauccuuccugagaaauuggcgcauugagucuuaucucaacgaucauagcgaagcgacccccgacuccaacgggagcgcccugggagaucgguuugagggcuacgacaaucccgaaaaccugaaggcuaaugcccucuauacacacucuagacugcgcuccagccuugucuucaagccuacccugccggagcagaaagaggugaacucuuguacgacaggguccagcaauucuaccaucauuggaagccaaggcuccgaaacccccaaggagguuccugacacacccaccaacgugcagcaucucacagauaaaccucugcccgaaagcaucccgaagcugccucuucagucugaggcccccaaaaugcacacgcuccaggucccugaaaaucacuccguggcucugaaccaaaccacaaauggccauaccgagagcaacaauuacauuuauaagacacuggggguuaacaagcagaccgagaaucucaaaaaccagcagacggaaaaucugcuuaagcggagauccuuuccccuguucgacaacucuaaagccaaccucgauccuggaaauagcaagcacuacguguacuccacccugacacggaaccgcgucagacaacccgagaaaccgaaggaagaccugcuuaagucuagcaaauccaugcauaaugugacccacaaccucgaggaagaugaggaggaagugacaaagcggaacucuccuagcggcaccacgacaaaauccguuagcaucgcggcucugcuggacgucaacaaggaggaaucuaauaaagagcucgccuccaagaaagaagugaaggggagccccucuuuucugaagaaaggaucccagaaacuuagaagccugcucucucugacccccgauaagaaggagaaccuguccaaaaauaaggccccugcuuucuaucgccuuugcagcuccagcgacacacucgugucugagggcgaagagaaccagaagccgaaaaagagcgauaccaaagucgacuccucuccccggagaaagcauagcuccucuagcaauucccaagggucuauccacaaaagcaaggaagaugugaccguuuccccuagccaggagauuaacgcucccccugacgagaauaagcgcacacccucuccuggccccguggaauccaaauuucuggagagagcuggagaugccagcgcgccgcgguucaacacggaacagauccaguaccgcgacucuagagagauuaaugccgucgugaccccugaacggcgccccacauccagcccuagacccaccuccucugagcugcuccggagccacuccacagaccgcagaguuuauagccgguucgagccguuuuguaagaucgaaucuuccauucaaccuaccagcaacaugcccaacacgucuaucaaucgcccugagauuaaaagcgcuacaaugggcaacuccuacgggagaucuagcccccugcuuaauuauaacaccggaguguaccgguccuaucagcccaaugaaaacaaguucagaggcuuuaugcagaaauucgggaauuuuauccauaagaacaaguga

SEQ ID NO: 69158 - RNA, 1758 nt, Artificial Sequence
  derived and/or modified sequence opt5 from FAM83D__Homo_sapiens__NP_112181
auggcccugcucagcgagggccuggacgaagugcccgcugccugccuuuccccuugugggccgcccaacccuaccgagcuguucucugaaagcagacggcucgcgcuggaggaacuugucgcuggaggccccgaggccuuugccgcuuuccugcgcagagagcggcucgcccgcuuucugaauccugaugaaguucacgcuauccugagagccgcggagcggcccggggaagagggagccgcugccgcugccgcggccgaggacuccuucggcucuagccaugauugcuccucugggacauacuuuccugaacagagcgaccucgagccgccccugcuugaacugggauggccugcuuucuaucaaggcgccuaccgcggcgcuacgagaguggagacccacuuucagccccgcggggccggagaaggcgggccuuauggauguaaggaugcccuccggcagcagcugagauccgcucgggaggugauugcggucgugauggacguuuucacagauaucgacauuuuucgcgaucuucaagagaucugcagaaaacagggcguggccgucuacauucugcucgaccaggcucugcugagccaguuccucgauauguguauggaccugaaggugcaucccgaacaagagaaacuuaugaccguucggacaaucaccgggaacaucuauuacgcccgcucuggaacaaagauuaucggcaaagugcacgaaaaguuuacccugauugauggcaucagagucgccacgggguccuauagcuucaccuggacagacggaaagcucaauucuuccaaccuggugauucuuagcggccagguggucgagcauuuugaccuggaguuccggauccucuacgcucagucuaaaccgauuuccccuaagcugcugagccacuuccaguccucuaauaaauuugaucaccucaccaacagaaagccccaaagcaaagaacugacacuugggaaucugcuccgcaugcggcuggccagacuuuccagcaccccucgcaaggcggaccuggaucccgagaugcccgcugaaggaaaggccgagcggaaaccucaugacugcgaaucuuccacgguuagcgaggaagauuacuucucuagccacagagacgagcuccagucccgcaaggccaucgaugcugccacacagaccgagccgggcgaagagaugcccgggcugucugugagcgaagugggaacacaaaccuccaucaccacagcuugugccggcacgcagaccgcggucauuacacggaucgccagcucucagaccacaauuugguccagaagcaccacgacacagaccgacauggaugagaacauccuguuuccucgcggcacccaaucuacagaggggucccccgugagcaaaauguccguuucucggagcuccucucucaagagcuccagcucuguguccagccagggaucugucgcuuccagcaccggcucuccugccagcauuagaacaacggacuuccauaaucccggguauccgaaauaccugggaaccccucaccuugaacuguaucucuccgauagccugcgcaaccugaauaaggagcggcaguuucacuucgcuggcaucagaucucggcuuaaccauaugcucgccaugcugucccgcagaacacuguuuaccgaaaaucaccucgggcugcauagcggcaacuucucccgggugaaucuucuggcgguuagagacguggcccucuaccccucuuaucaguga

SEQ ID NO: 69159 - RNA, 3558 nt, Artificial Sequence
  derived and/or modified sequence opt5 from FAM83H__Homo_sapiens__XP_006725151
auggcccccggcccuaacauggcuagacggagccaguccucuagccaaggggacaauccgcuggcccccggauaccucccuccccacuauaaggaguacuaucgccuggcgguggaugcucuugccgaaggcggguccgaggccuacucuagauuccuggcuaccgaaggagccccugacuuucucugccccgaggaacuggagcaugucagccggcaccuucgcccuccgcaguauguuacaagagagcccccugaaggcucccugcucgauguggacauggaugggucuagcggaacguacuggcccgugaacuccgaccaggcugucccugagcuggaucugggcuggccccucaccuucggcuuucaggggacagaagugaccacacugguucaaccgccucccccugacagccccucuaucaaagaugaggcccggcgcaugauuagauccgcgcaacagguggucgccgugguuauggacauguucaccgauguggaccuucugagcgagguccucgaagcugccgcucggcgcgugcccguguauauccugcuugaugagaugaaugcccagcauuuucuggacauggcggacaaguguagagucaaccuccagcacguugauuuccugcgggugcgcacaguggccggaccuaccuacuacugcagaacgggcaaaucuuuuaaggggcaugucaaagaaaaguuccugcucguggacugugcuguugugauguccggaagcuauucuuuuaugugguccuucgagaagauucaccggagccuggcccacgucuuucagggcgaacuuguguccucuuucgaugaggaguuucgcauccuguucgcucagagcgaaccgcucguucccuccgccgccgcucuggcgagaauggacgccuacgcucuugccccuuaugccggggcuggaccccuggugggcgucccuggcgugggggcccccaccccguucagcuuuccuaaacgggcgcaucuccuguuucccccucccagagaggaaggacugggcuucccuucuuuccucgaucccgaccgccacuuucuguccgcuuuccggagagaggaaccgccucgcaugcccgggggagcccuugagccccaugccggccugcggccucucagcagacgccuggaggcugaagccgggccggcuggagagcuugccggcgcgcggggcuuuuuccaggccagacaccuggaaauggaugcuuuuaagcgccacucuuucgccacagagggggcuggagccgucgaaaauuuugcggccgcucggcaagugagcagacagaccuuccucucccauggcgacgauuuucgcuuccagacaucucacuuccaucgggaccaacuguaccagcagcaguaucaaugggauccccagcugaccccugccagaccccaggggcucuuugagaaacugcggggaggccgcgcuggguucgccgacccugacgauuuuacgcuuggcgccggacccagauucccugagcugggccccgacgggcaccagcggcucgauuacguuccgagcuccgcuagcagagaagugcgccauggaucugacccugcguuugcccccggcccucgggggcuggagcccuccggagcuccgagaccuaaccugacacaacgcuuccccugccaggccgccgcuagaccuggccccgaucccgccccugaagcggagccggagcggcgcgggggccccgaaggcagagcuggacuucggcgcuggagacucgccagcuaucugucugggugucacggagaggacggcggggaugacggacugccugcccccauggaagcugaggccuacgaagaugacguccucgcgccuggcgggcgggcucccgccggcgaucugcuuccuuccgccuuucgcgugccggcugccuuccccaccaagguuccugugcccggaccuggcagcgggggaaauggccccgagagagaggggccggaggaaccuggacuggcuaaacaggacuccuuucggucucgccucaacccccugguccagagaagcucccggcugagaucuagccuuauuuucuccacaagccaagccgaaggcgcggccggggcugccgcugccaccgagaaggugcagcuccugcacaaggaacagaccgugucugagacacugggccccggaggcgaggccguucgcuccgcugcgagcacgaaagucgccgaacuccuggagaaguacaaagggccugcucgggaucccggaggcggggccggagccaucaccguggcuucucauuccaaggccguggucagccaggcguggagagaagagguggcugccccuggcgccguuggcggggaacgccggucucuugagagcugccugcucgaccugagagacuccuuugcucaacagcugcaccaggaggccgaacgccaaccgggagcggcuagccuuacagccgcccagcuccuggauacccugggccggucuggguccgacagacuccccagccgcuuccuguccgcucagucucauagcacauccccucagggacuugauucuccccugccucucgagggcagcggggcccaccaagugcugcacaaugaauccaaaggaucucccaccagcgcuuauccggagcggaagggcuccccuacgcccggcuuuagcacaagacgggggucuccuaccaccggauucaucgagcagaaaggcucccccacaagcgccuacccugaacgcagagggucucccgucccgccugugcccgagcggcgcuccagccccguuccuccggugcccgaaagacggggaucucugacccuuacaauuuccggcgagagcccuaaggcggggcccgccgaagagggaccuuccggccccauggagguccucagaaagggcagccugcgccugcggcagcuccugucuccuaaaggggaaagacgcauggaggacgaaggaggcuucccggugccccaggagaacgggcaaccugaaagcccccggagacuuucccugggacagggcgauucuacggaggcugccaccgaggaacgcgggccucgggcuagacucagcuccgccacagccaaugcucuguauucuagcaaccugcgcgacgauaccaaggcgauccuugagcagauuuccgcccauggacagaaacacagagcuguucccgccccgucuccuggccccacacauaauagccccgaacugggccggccucccgccgcuggggugcucgccccugacauguccgauaaggacaaauguagcgcgaucuuucgcucugauucccugggaacccaaggcagacucagccggacgcugccggcuucugccgaggaacgcgacagacuucugcggagaauggaguccaugcgcaaggagaagcgggucuacagcagauucgaaguguuuugcaaaaaggaggaagccuccucucccggggcuggagagggcccugccgaggaagggacccgcgauagcaaagugggaaaguucguccccaaaauucucggcacauuuaaguccaagaaauga

SEQ ID NO: 69160 - RNA, 879 nt, Artificial Sequence
  derived and/or modified sequence opt5 from FAM84A__Homo_sapiens__NP_660158
augggcaaccagcuggacagaaucacccaccucaauuacagcgagcugcccacaggggaucccuccggaauugaaaaggacgagcuucgggugggcgucgccuauuucuuuucugaugacgaagaggaucuggacgaacgcgggcaaccggauaaauucggaguuaaggcucccccuggcugcacgcccuguccugagagccccuccagacaucaccaucaccuccugcaucagcuugugcugaacgagacccaguuuucugccuuccgggggcaggaaugcaucuuuagcaaaguguccggaggcccucaaggcgcggaccucucugucuacgcugugacagcccugccggcccugugugagcccggggaucuccuggaacuucuguggcuccagccugcucccgagccucccgccccggcuccucacugggccguuuaugugggaggcgggcagauuauccaucugcaccagggagagauucgccaagacagccuuuacgaagcgggcgccgcuaaugucgggagagugguuaacuccugguaucgguaccgcccccugguggccgagcucgucgugcagaaugcuugcggacaccugggccucaagagcgaagagaucuguuggaccaacucugaauccuucgccgcguggugcagauuuggcaaacgggaguucaaggccgggggagaggugccugcuggcacacagccuccccagcaacaguauuaccugaagguccaucugggggaaaauaaaguucacaccgcccgcuuucacagccuugaggaucugaucagagaaaagcggcgcauugacgcuucuggaagacuccgggugcugcaggagcuugccgaucugguggacgacaaagaauga

SEQ ID NO: 69161 - RNA, 933 nt, Artificial Sequence
  derived and/or modified sequence opt5 from FAM84B__Homo_sapiens__NP_777571
augggcaaccagguggagaagcugacccaccucagcuacaaagaaguccccacagccgacccuacggggguugaucgcgacgauggaccgcggaucggcguguccuauauuuucucuaaugacgaugaggacguggaaccccaaccucccccucaggggcccgauggaggcgggcugccugacggaggcgauggcccgcccccuccccagccucagcccuacgacccgcgccuucaugaggucgaaugcagcguguuuuauagagaugaguguaucuaccaaaaguccuucgcuccugggucugccgcgcugagcaccuauacacccgagaaccuccugaauaaaugcaagccuggagaccuuguugaauuugugucccaggcucaguacccccacugggccgucuaugugggcaacuuccagguugugcaucugcaccggcucgaggucauuaauucuuuucugaccgaugccagccaagggcgcagaggacggguggugaacgaccuguaccgcuacaaaccccucuccagcucugcugucguuagaaaugcccuggcucaugugggcgccaaggaacgggagcuuuccuggcgcaacagcgagucuuucgcggccugguguagauaugggaagcgggaauuuaaaaucggaggcgagcugcgcauuggcaagcagccuuacagacuccagauccagcuguccgcucaacggagccacacacuugaguuccagucucuggaagaccucaucauggaaaaacgcagaaaugaucagauugggcgggccgcugugcugcaagagcuggccacccaccuccauccggcggagcccgaagagggagacuccaacgucgccagaacaaccccucccccuggcagacccccggcuccuagcuccgaagaggaagauggggaggccguggcucacuga

SEQ ID NO: 69162 - RNA, 555 nt, Artificial Sequence
  derived and/or modified sequence opt5 from FAM89A__Homo_sapiens__NP_940954
augagcggcgccagagcugcccccggggcggcuggaaacggcgccgugcgggggcugcgcgucgacggacucccuccgcugcccaagucccuuucuggccugcuccacagcgccuccgggggaggcgcuucuggcggguggagacaucuggagcggcuuuacgcccagaaaagccgcauccaagaugaacuguccagaggaggcccugggggaggcggggcucgggccgcggcccuccccgcuaagccucccaaucuggacgccgcucuggcccuccugcgcaaagagaugguuggacuuagacagcuggauaugucucuccugugccagcuuuauagccuguacgaauccauucaggaguauaagggcgcgugucaagccgcuagcucuccugacugcaccuacgcccucgaaaacggcuucuuugaugaggaggaagaguauuuccaggaacagaauagccugcacgaccggcgcgauagagggccgccccgggaccugagccucccugugucuucccuguccucuuccgauuggauccuugagagcauuuga

SEQ ID NO: 69163 - RNA, 756 nt, Artificial Sequence
  derived and/or modified sequence opt5 from FAM92A1__Homo_sapiens__NP_001269963
augaugagacggacccuggagaaccgcaaugcccagacaaagcaacuccagacggcugugagcaacgucgaaaaacacuucggcgagcugugccagaucuuugccgcguacguuagaaagaccgcucggcuucgcgacaaagccgaucugcucgugaaugaaauuaacgccuaugcugccacagagacaccccaucugaaacuugggcugaugaauuucgcugacgaauuugccaagcuccaggauuacagacaagcggagguggagcggcuggaagccaaggucguggagccucugaagaccuauggaaccaucguuaaaaugaagcgcgacgaucucaaagcuacacugaccgccagaaaccgggaagcuaagcagcuuacgcagcuggagcgcaccagacagcggaauccguccgaccgccacgugauuucucaagccgagacagaacuccagagagcggccauggaugcuagccggaccucccgccaucuggaggaaacaaucaacaauuucgagagacagaaaaugaaggacauuaaggucuuucggaacucucuuuacgcccccgauuauagcuccagacuggacaucgugcgcgcuaauucuaaaagcccucuccagcggucccugagcgccaaguguguuucuggcaccgggcaaguguccacgugcagacugcgcaaagaucagcaggccgaagacgaugaggacgacgagcucgaugucacagaagaggaaaacuuccugaaguga

SEQ ID NO: 69164 - RNA, 915 nt, Artificial Sequence
  derived and/or modified sequence opt5 from FAM92B__Homo_sapiens__NP_940893
augaacaucguguucagcagagacucccagguccggguuauggagaauaccguggccaacacagaaaaguacuuuggccaauucugcucucugcucgcugccuauacgcgcaaaaccgcgagacugcgggauaaggcugaccagcuugugaaacagcugauugauuuugccaauagcgagaaccccgaacuccgcgccacaaugagaggguucgcugaggaccuggccaagguccaggauuaccggcaagcucagguggaacgccuugagaccaaaguugugaauccucugaagcucuauggagcccagaucaagcagacaagagcggagauuaaaaaguuuaaacacguccaaaaccaugaaaucaagcagcuggagaaacuggaaaagcuccggcagaaguccccgucugaccagcaaaugauuagccaggccgagacccgcgugcagagagcugccguugauuccucucggacaacccugcaacuugaggaaacgguggacggcuuccagcgccagaaacugaaggaucuccagaaauuuuucugugacuuugucaccaucgagaugguguuccacgcuaaggccguggaagucuacagcuccgcguuucaaacacuggagaaauaugaucuugaaagagaccugcucgauuuccgggccaagaugcaggggguuuacggacauuaugacacccgccugcuggcuaauacaucucccccucccagcgugcuccagucccuggccagccagggcacccuucaagugcagcugucuagagcuaacgaggacccugagcacccccaugccaaucacgggcgguuuucccucugcgaaugggucgugaaaggacagccugcccacuguguuugcggccagggcgggcaucugaugcuuccgggacacagccuguga

SEQ ID NO: 69165 - RNA, 561 nt, Artificial Sequence
  derived and/or modified sequence opt5 from FAM9B__Homo_sapiens__NP_995321
auggccgcuuggggcaagaaacacgccgggaaggaccccgugagagaugagugcgaagaacggaaccgcuucaccgaaacaagagaggaagacgucacggaugagcauggagagcgggaaccuuuugcggagaccgacgaacacacaggcgcuaauaccaaaaagccggaggauacagccgaggaccugaccgccaaacgcaagagaaugaagauggauaaaacauguagcaagaccaaaaacaaguccaaacaugcucuccggaagaagcagcugaaacgccaaaagagagacuacauccacucucuuaaacugcucaauguucuggaagaguauauuacggaugaacagaaggaggaagaggaggaagagggggaagaggaggagcuuauccggauuuuccaggagcagcagaaaaaguggcaacaguaccgcagcgugagacgggaacgccugaaagagaugaagcuccugagagaccaguuugugaaggcccuggaagauuucgaggaccucugcgaucgggucuuuuccgacgaagacucugagcuggauaacuga

SEQ ID NO: 69166 - RNA, 1602 nt, Artificial Sequence
  derived and/or modified sequence opt5 from FAN1__Homo_sapiens__NP_001139568
augaugagcgagggcaagcccccugacaaaaagagaccgcggcgcucccugucuaucagcaaaaacaagaaaaaggccuccaauucuauuaucagcugcuucaacaaugcucccccugccaagcucgcgugucccgugugcuccaaaauggucccuagauacgaucugaaccggcaccuugacgaaaugugugcuaauaacgauuuuguucagguggaccccgggcaagugggacugauuaauucuaacgucagcaugguggaucucaccuccguuacacuggaggacgugacgccuaagaaaagcccgcccccuaagaccaaucuuacacccggccagucugauuccgccaaacgcgaagucaagcagaagaucagcccuuauuucaaaucuaacgacgugguuugcaagaaucaggaugagcugagaaaccgguccgugaaagucauuugucucgggagccuggccucuaagcugucccgcaaauacgugaaggcuaaaaagagcaucgacaaggaugaagaguuugccggauccucuccccaaagcuccaaaagcaccguggucaagucucucaucgacaauuccagcgagauugaagaugaggaccagauccuggaaaacucuagccagaaagagaauguuuucaagugcgacucccuuaaagaggaauguauuccggagcauauggugagaggcucuaagaucauggaagcugagagccagaaggccacacgggaaugcgagaaauccgcgcugaccccuggguuuagcgauaacgccauuaugcuguucucucccgacuuuacacuccgcaacacccuuaaguccacgagcgaggauucucuggugaaacaagaauguaucaaggaggucguggaaaagagagaggcuugccacugugaagagguuaaaaugaccguggccuccgaggcuaagauucagcucagcgacuccgaagccaaaucucauagcuccgcggaugacgccucugcuuggagcaauauccaggaggccccucugcaggaugacuccugccugaacaaugauaucccccacagcauuccccucgaacaaggaucuuccugcaacggcccuggccagacaaccgggcauccguauuaccugcggagcuuccuugucgugcugaagacaguucucgagaaugaagacgauaugcugcuuuuugacgagcaggagaaaggaaucgugaccaaguucuaucaacugucugcuacgggccagaaacucuacguccgccuguuucagagaaagcuguccuggauuaagaugacaaaacucgaauaugaggaaaucgcccuggaccuuacccccgugauugaggagcugacaaacgccggguuccuccagaccgaaagcgagcugcaagaacuuucugagguccuggaacuccugagcgcuccugagcugaagucccucgcgaaaaccuuucaccuggugaaucccaacggacagaagcagcagcuuguugaugccuuccugaaacucgcuaagcaacggagcguguguacauggggcaaaaauaagccugggaucggagccgucauccugaagcgcuucugcuggcugcuucuccaguga

SEQ ID NO: 69167 - RNA, 4368 nt, Artificial Sequence
  derived and/or modified sequence opt5 from FANCA__Homo_sapiens__NP_000126
augagcgacuccugggugcccaacucugccagcggccaggauccugggggaagacggcgcgcuugggccgagcugcucgcgggcagagucaagcgggaaaaauacaauccggagcgcgcucaaaagcugaaagaauccgccguuagacuucugcggucucaccaggaccucaacgcccugcuucuggagguggaagggccccucugcaagaaacugagccuguccaaggugaucgauugugacucuagcgaggcuuaugccaaucauuccagcucuuucauuggauccgcucuccaggaucaggccagccgccugggcgucccuguggggauccuuucugcgggaaugguugccuccagcgugggccaaauuugcaccgcucccgccgagacaucucacccuguccugcucacgguggaacagagaaagaaacuguccagccuucuggaguuugcucaguaccuccuggcccauuccauguucucucggcugagcuuuugucaggaacucuggaagauccaauccagccugcuucuggaggcgguuuggcaccuccaugugcagggcauugucucucugcaggagcuucuggaaucccaccccgacaugcacgccguggggagcuggcuuuuccgcaaccugugcugucugugcgagcagauggaggcuucuugucaacaugccgauguggcuagagccaugcucagcgacuuuguccagauguucguucugcggggauuucagaaaaauuccgaucuucgcagaaccguggaaccugaaaagaugccgcaagugacagucgacgugcugcagcggaugcucaucuucgcccuggaugcucuugcggccggcguucaggaggagucuagcacccacaaaaucgugcgcugcugguuuggggucuucuccggacauacacugggcagcgugauuucuaccgacccccucaagagauuuuucucccacacacugacccagauccugacgcacagcccuguucucaaggcuucugaugccgugcaaaugcagcgggaaugguccuuugccagaacccauccccugcuuacaagccuguaucgcagacucuucgucaugcuguccgcugaggaacugguggggcaccuucaggagguccucgaaacccaggaggugcauuggcaacggguucugucuuucgugagcgcccuggucguguguuuuccugaggcgcagcagcuccuggaagacuggguugcucgccuuauggcccaggccuucgaguccugccaacuggacucuauggugacagcuuuucucgucgugcggcaggccgcucuggaaggacccagcgccuuccuguccuacgcggauugguuuaaagccagcuucggcucuaccagaggcuaucacggguguuccaagaaagcucuuguguuucucuucacguuucugagcgagcugguuccguucgaaucuccucgcuaccuccagguccauauucugcaucccccucuugugcccggaaaguaucggucccugcucacagacuacaucagccuggccaaaaccagacuggcugaucuuaaggugucuauugagaacaugggccucuacgaggaccugagcuccgccggggauaucacagaaccccacagccaggcgcugcaagacgucgagaaagccauuaugguguuugaacacaccggaaauaucccuguuaccgugauggaggcuucuaucuuccgccggccguauuacgucucccacuuucuccccgcccugcuuacaccuagagugcugcccaagguuccugauagccgcguggcuuucauugagucccucaagcgggccgacaaaauucccccgucucuguauagcacguacugccaggccugcuccgcugcggaagagaagccugaagaugccgcucugggcgucagagccgagcccaacucugccgaggaaccucuugggcagcucaccgcugcccugggagagcugcgggcgagcaugacagaccccucccaacgcgaugugaucucugcucagguugccgugaucagcgaaagacuccgggccguccugggccauaaugaggacgacuccagcguggaaauuucuaaaauccagcuuuccaucaacaccccuagacuggagccccgcgaacacauggcuguggaucuccugcugaccagcuucugucagaaucuuauggccgcgucuuccgucgcuccgccugagcggcaaggccccugggccgcccuguuuguuagaacaaugugcgggcgcgugcuccccgcugugcugacgagacucugucagcugcuucggcaccagggaccuagccugucugccccgcauguccucggccuggcugcccuggcggugcaccuuggggagucccgcagcgcccugcccgaaguugacgugggaccucccgcuccuggcgccgggcuccccgucccugcucuguucgauucccuccugacaugcagaacccgggacagccucuuuuucugucugaaguuuugcaccgccgccauuucuuauagccucuguaaauucuccucucagagccgcgauacacugugcuccugucugucucccggccuuaucaagaaguuucaauuccugauguuuagacucuucagcgaggcucggcagccgcuguccgaagaggacguggcgucucucagcuggcgcccucugcaucuucccuccgccgauuggcagagagcugcccugagccuguggacccaccggacauuucgcgaaguucucaaagaggaggacgugcaucugacguaccaggauuggcuucaccuggaacucgagauucaaccugaagccgacgcucugucugauaccgagagacaggacuuccaccagugggccauccaugagcacuuucuccccgaauccagcgcgucuggaggcugcgauggggaccugcaagcugccuguacaauucuugucaacgcccugauggacuuccaucaguccagccgguccuaugaucacucugagaauagcgaccugguguucggaggcagaaccgggaacgaagauaucaucucccgccuccaggagaugguugcugaccuggaacuucagcaagaucugauugugccgcucggacauacaccuagccaggagcacuuucuguucgagaucuuucggagacgccuccaggcccugaccucuggcugguccgucgcggcuagccuucagcggcaaagagaacugcugauguacaagcgcauucuccugcggcuucccucuagcgugcugugcggguccucuuuccaggccgagcagccuaucacggccagaugcgaacaguuuuuccaccucgugaauagcgagaugcgcaacuuuuguucccauggcggagcucugacccaagacauuacagcccacuucuuucggggccuccugaacgcuugccuuagaucucgggaucccagccugauggucgacuucauccuggccaaaugucagaccaagugcccccucauucugacauccgcgcuuguuugguggccuagccuggaaccggugcuccugugucgcuggagacggcauugccagucuccccugccucgcgagcuccagaaacuucaagaggggagacaguuugccuccgauuuccugagccccgaagcugccuccccugcucccaauccugacuggcugucugccgccgcucuccacuucgcgauccagcaagugcgggaggaaaacaucagaaagcagcugaagaaacuugauugugagcgcgaggaacugcucgucuuucuguucuuuuucagccugaugggacuccuuuccucucaccugaccagcaauuccacgacagaccugccgaaggccuuucaugugugcgcugccauucucgagugucuggaaaaacggaagaucagcuggcuugcccuguuccagcucaccgagucugaucugagacugggccgccuccuucugcggguugcucccgaccagcacacaagacugcucccuuuugccuucuacucccugcuuagcuauuuucaugaagacgcggcuauucgcgaggaggccuuccugcacguggccgucgauauguaccucaaacuggugcaacuguuuguugcuggggacaccucuaccguguccccucccgccggacggagccucgaacuuaagggccaggggaaccccgucgagcugaucacaaaggcgagacuguuccuccugcagcuuauuccgcgcugcccuaaaaagucuuuuagccauguggccgaacugcucgcugauagaggcgacugugaucccgaggucuccgccgcucugcagucucggcaacaggccgcucccgacgccgaucugagccaggaaccucaccucuucuga

SEQ ID NO: 69168 - RNA, 2580 nt, Artificial Sequence
  derived and/or modified sequence opt5 from FANCB__Homo_sapiens__NP_001018123
augaccagcaagcaggccauguccucuaacgagcaagaaagacugcucugcuacaauggcgaggugcuggucuuccagcuuagcaaggggaacuuugcugacaaggaacccacaaaaacgccuauccugcacguucggcgcaugguguucgauagaggaaccaagguguuuguccagaaauccacaggcuucuuuaccauuaaggaggaaaauucucaucucaagaucauguguugcaacugugugagcgacuuccggacagggauuaaucugccguauaucguuauugagaaaaacaagaaaaauaacguguuugaguacuuccuucugauccuccacuccaccaauaaguuugaaaugcgccugucuuucaaacugggauaugagaugaaggauggccucagaguccugaacgggccccuuauccuguggcggcaugugaaggccuuuuucuuuauuagcucccagacaggaaaaguugugagcgucucuggcaauuucuccagcauccaaugggcgggcgaaauugagaaccucgggauggugcugcuuggacugaaggagugcugucucucugaagaggaaugcacccaggagccuuccaaaagcgacuacgcuaucuggaauacgaaguucuguguguauucucuggaaucccaggagguccugagcgauauuuacaucauucccccugccuauuccucuguugugaccuacgugcacaucugcgccacagagaucauuaaaaaccagcuccgcaucagccugauugcucuuaccagaaagaaucaacugaucuccuuucagaacggcacacccaaaaacgucugucagcucccuuucggggacccgugcgccgugcagcugauggauagcggaggcgggaaucuguuuuucguugugucuuuuauuuccaacaaugcuugugccgucuggaaggagagcuuccaaguggcggccaagugggaaaaacuuucucucguucugaucgacgauuuuaucggaagcggcaccgaacaggugcugcuccuguucaaggacucccuuaacucugauugccugacgagcuuuaaaauuacagaccucggcaagaucaauuacuccagcgagcccucugauugcaacgaagacgaccuguucgaggauaaacaggagaaucgguaucuugucgugccuccccuggaaaccgggcucaaggucuguuuuuccagcuuccgcgagcugagacaacaucugcuccugaaggaaaagauuaucucuaaguccuacaaagcucuuauuaaccuggugcagggaaaggacgauaauacaagcuccgccgaggaaaaagagugccucguuccucuguguggcgaggaagagaacucugugcacauccuggacgaaaaacuuagcgauaauuuucaggacuccgagcagcucgucgagaagaucugguaucgggugauugaugacucucugguugugggggucaaaaccaccagcucccugaagcucagccugaacgaugugacacuuucucugcucauggaccaagcucacgauucccgcuucagacugcugaaaugccagaaucgggugaucaaacuuagcacgaaccccuucccggccccuuaccucaugcccugugaaauuggacuggaggcgaagcgcguuacccugacaccugacucuaagaaggaagaguccuuugucugcgaacaucccagcaaaaaggagugugugcagaucauuaccgccgugacaucucucagcccccugcuuaccuucuccaaauuuugcuguacgguccugcuccagaucauggagagagaaagcggcaauugcccuaaggaccgguaugugguuugugggagaguguuccugucucuggaggaucuuuccacaggaaaauaccuccugaccuuuccgaagaaaaagcccauugaacacauggaggaccuguucgcucuccuggccgcuuuucauaagagcugcuuccaaaucaccuccccuggcuaugcccuuaacucuaugaaagucuggcugcucgaacacaugaagugcgagaucauuaaagaguuucccgaaguguacuucugugagcgcccuggcagcuuuuacgggacacuguucaccuggaagcagcggacacccuuugaaggaauccugauuaucuauuccagaaaccagacgguuauguuccagugccuucacaaucucauucgcauccugccgaucaacuguuuccugaaaaaucucaagucuggcagcgagaacuuucugauugauaauauggccuucacccuugaaaaggagcuggugacacucuccucucugagcuccgcuaucgcgaaacaugagagcaacuuuaugcaacggugcgaagucucuaaggggaaauccagcgugguugccgcugcccugucugacagacgcgagaauauucacccuuaccggaaggaacuucagagagagaaaaagaagaugcugcagaccaaccucaaaguguccggagcccuguaucgcgagaucacacucaaggucgcugaagugcagcugaaaagcgauuucgccgcgcaaaaacuuucuaaucuguga

SEQ ID NO: 69169 - RNA, 1677 nt, Artificial Sequence
  derived and/or modified sequence opt5 from FANCC__Homo_sapiens__NP_001230672
auggcccaggacagcguggaucuguccugcgacuaccaauucuggaugcagaagcucucugucugggaucaggcuagcacccuggagacacagcaagacacgugucuucacguugcccaguuucaggaguuccugagaaaaauguaugaagcgcucaaggaaauggauuccaacaccgugaucgagcgguuucccacaauuggccagcugcuugcuaaagccugcuggaauccuuucauccuggccuacgacgaaucucaaaagauucucaucuggugucugugcugucugauuaacaaagagccgcagaauagcgggcaguccaagcucaacucuuggauccagggagugcugagccauauccuuuccgcucugcgcuuugauaaggaggucgcccucuucacccaaggccugggguaugcucccauugacuacuauccuggacuucugaaaaauauggugcucagccuggccucugaacugagagagaaccaccucaauggcuuuaacacacagcggcgcauggcgcccgaaagaguugccucccugagccgggugugcgucccucuuaucacccugacagauguggacccccucguugaggcucugcuuauuugucaugggcgcgagccucaggaaauccugcaaccggaguucuuugaagccgugaaugaggcuauucuccugaagaaaaucucucugcccauguccgccgucgugugccucuggcugagacaccuuccuagccuggaaaaggcgaugcuccaucuguucgagaaacuuauuucuuccgagcggaacugucugcgcagaaucgaaugcuuuaucaaggauagcucccucccccaggccgcuugucacccugccauuuuccggguggucgacgagauguuucgcugcgcucugcuggaaaccgauggagcccucgagaucauugccacgauccagguuuucacccagugcuucguggaagcucuggagaaggcgucuaaacaacuuagauuugcccugaagacauacuuccccuauaccagcccgucccucgcuauggugcugcugcaggacccucaggacauuccccggggccacuggcuucagacacucaaacauaucagcgagcugcugcgcgaagccgucgaggaucaaacccacggcucuugugggggaccuuuugaauccugguuccucuuuauccauuucggcgggugggccgagaugguggcugaacagcugcuuaugagcgccgcggagccucccacggcucugcucuggcugcuggccuuuuacuacggacccagagacggccggcagcagagagcccaaacaaugguucaggugaaggcuguccuugggcaccuccuggccaugucucgcagcuccucucugagcgcucaggaucuccagaccguggccggacaaggcacagacaccgaucugcgggcgccggcccagcagcuuauuagacaucugcuccugaauuuccugcuuugggcucccggcgggcacaccaucgccugggacguuauuacacucauggcucacacggccgagaucacccaugaaauuaucggauuucuggaucaaacacuguaucgcuggaaccggcucggcaucgaguccccuagaagcgaaaaacuggcgcgcgagcuucugaaggagcuccggacccagguguga

SEQ ID NO: 69170 - RNA, 4356 nt, Artificial Sequence
  derived and/or modified sequence opt5 from FANCD2__Homo_sapiens__NP_001018125
auggugagcaagagacggcuguccaaaucugaggacaaggaaagccucaccgaggaugccuccaaaacacgcaagcagccccugucuaaaaagacgaagaaaagccacaucgcuaacgaagucgaggaaaaugacuccauuuucguuaagcuccugaaaaucucuggcauuauccucaagaccggggagagccaaaaccagcuggccguggaucagauugcguuucagaaaaagcuguuccaaacacuuagacggcauccuuccuacccgaagaucaucgaggaauuugugagcggacucgagucuuauauugaagacgaggauuccuuccgcaauugccugcugagcugugagagacuccaggacgaagaggcuucuaugggcgccuccuacagcaaaucucugaucaaacuucugcucgggauugauauccugcagcccgccauuaucaaaacccuuuuugaaaagcugccugaguauuucuuugaaaacaaaaauuccgacgagauuaacaucccccggcucaucgucagccagcugaaguggcuggaucgcgugguugacggaaaagaucucacaaccaagauuaugcaacugaucuccauugcuccugagaaucuucagcacgacaucauuacaucucugcccgaaauccucggcgauagccagcaugccgacguggggaaggagcuguccgaccuucugaucgaaaacaccagccucacggucccuauucuggaugugcugucuucccucagacuggacccgaauuuccuucugaaaguucggcagcucgugauggauaagcugagcucuauccgccuugaggaccugcccgucauuaucaaauuuauucuccacagcgugaccgcuauggauacacuggaagugaucuccgagcugagagagaagcucgaccugcaacauugcguccuuccuucucggcugcaggccagccagguuaaacucaaguccaagggacgcgcgucuagcuccggcaaccaagaaagcucuggccaguccuguaucauucugcuguucgaugugaucaaaagcgccauuagauacgagaagaccaucuccgaggcuuggauuaaagccaucgaaaauacagcuucugugagcgaacacaaggucuuugaccuugugaugcuuuucauuaucuauuccaccaacacgcagaccaaaaaguacaucgaucggguucugcgcaauaagauuagaucugggugcauccaggagcaacugcuccagagcaccuuuuccgugcacuaucugguccuuaaagacauguguagcucuauucugucccucgcccagagccugcugcauucucuugaucaguccaucauuagcuucggaucucuccuguacaaguacgcguucaaauuuuucgacacauauugccaacaggaggugguuggcgcccuggugacccacaucuguagcgggaacgaagcugaggucgacaccgcccucgaugugcugcuugaacuggucgugcucaaucccuccgcuaugaugaugaacgccguuuuugugaagggaauccuggacuaccuggauaacauuagcccucagcagauccggaaacuuuucuauguccucucuacacuggccuuuuccaagcaaaaugaggcuagcucccauauucaggacgauaugcaccuggugaucagaaagcagcucucuagcacgguuuucaaauacaagcugauuggcaucaucggggcggugaccauggccggaauuauggcugccgaccgcuccgagucucccagccuuacacaggaacgggccaaccuguccgaugagcaaugcacccaggucacaucucuccugcagcuggugcacagcuguuccgaacaaagcccgcaggcuucugcccuuuauuacgacgaguuugcgaaucucauccagcaugaaaaacuggauccuaaggcucuggagugggugggccacaccauuugcaacgacuuccaggaugccuuuguugucgacuccuguguggugcccgagggcgauuucccuuuucccgucaaagcccucuaugggcuggaagaguacgacacgcaagacggaaucgcuauuaaucuucugccccuccuguucagccaggauuuugccaaggacggcgggccugugacaucucaggaauccggacagaaacugguuagcccgcuuugccuggcucccuacuucagacuccugcgccucugcguggagcggcaacauaacggcaaucuggaagagaucgaugggcuucuggacuguccuaucuuccucaccgaucuggagcccggagaaaagcuggagucuauguccgccaaggaacgcagcuuuaugugcucccuuauuuuccugacccucaacugguuuagagagaucgucaaugcguucugucaggaaacaagcccugagaugaaaggcaaggugcugacccggcucaaacacauuguugagcugcagaucauucuugaaaaguaucuggccgugacacccgacuacgucccgccucucggcaacuuugauguggagacgcuggacaucacaccccauacaguuaccgcuauuucugccaaaaucagaaagaaggggaaaaucgaacgcaagcagaaaacagauggaagcaagaccuccucuagcgacacgcuguccgaggagaaaaauucugaaugcgauccuacccccagccaccggggccaacuuaacaaggaguucacagggaaggaagagaaaaccucccugcuccugcacaauucucaugccuuuuucagagaacucgacauugagguguuuagcauccugcacuguggacuugucacaaaguucauucuggauaccgagaugcauacggaagcuacagagguggugcagcugggcccucccgaacuccuguuucuucuggaggaccucucccagaaacuggaaagcaugcucaccccgccuaucgcgcgccggguccccuuccugaagaacaaagggucuagaaauauuggcuuuucccaccuucaacagcggagcgcccaggagaucguucacugcguguuccagcugcugacacccauguguaaccaucucgagaacauccacaauuauuuccaaugccuggcugccgaaaaccauggaguggucgacggcccuggggugaagguucaggaguaccacauuaugucuuccuguuaucagcgccuucugcagaucuuucauggacucuucgcuuggagcggcuuuucccaaccggaaaaucagaaccugcucuacucugcccugcacgugcuuagcuccagacugaagcagggggagcacagccagccccuggaggaacuccugucucaauccguccauuaucuucagaauuuccaccagagcauuccuucuuuucagugcgcccuguaccucauccggcugcucauggugauucuggagaaaagcaccgcuuccgcgcaaaacaaggaaaagaucgccucucuugcuagacaguuccugugucgcguuuggcccagcggagauaaggagaaauccaauaucucuaacgaccagcugcaugcccuccugugcauuuaccuugaacacaccgagagcauccugaaggccauugaggaaaucgcuggcgugggggucccugagcucauuaauucccccaaagaugccucuagcuccacauuuccuacgcugacccggcauacauucgugguguuuuucagaguuaugauggcggaacuggagaagaccgucaagaaaaucgaacccggcacagcugccgacagccaacagauucacgaggagaagcuccuuuauuggaacauggccgugcgcgauuuuuccauccugaucaaucugauuaaaguguucgacucucacccgguccuccauguuugccugaaguacggaagacuuuucguggaggcuuuucugaaacaguguaugccucuccuggauuucagcuuucggaagcaccgcgaagacgugcugucccuccuugaaaccuuccagcuggauacgagacugcuccaucaccugugcggccacucuaagauccaucaagacacacggcuuacccagcacgucccccugcucaaaaagacccuggagcugcucgugugucgcguuaaagccaugcuuacacugaacaauugcagagaagcguuuuggcuggggaaccucaagaaucgggaucugcagggagaggagauuaaaagccagaacucccaagaaagcaccgcugacgagucugaagacgauauguccagccaggccucuaaguccaaggccacagaggacggcgaagaggaugaggugagcgcuggggaaaaagagcaggacucugaugaaagcuaugacgauuccgacuga

SEQ ID NO: 69171 - RNA, 1611 nt, Artificial Sequence
  derived and/or modified sequence opt5 from FANCE__Homo_sapiens__NP_068741
auggccacccccgacgcuggccugccuggggccgagggaguggaaccggcgcccugggcucagcucgaggccccugccagacugcuucugcaagcucuccaggccggccccgaaggggcucggcgcggacugggcguccuuagagcccuggggagccggggaugggagccuuucgauuggggccgccuccuggaagcgcugugcagagaggagcccguugugcagggcccugacgggcggcucgaacugaagccgcuucugcuccgccugcccagaaucugucagcggaaccuuaugucccugcucauggccgugcgcccuucucugcccgagagcggacugcucuccguccugcaaauugcucagcaggaucuugccccugaccccgaugcuuggcugagagcccucggcgaacugcuucggcgcgaccugggggugggaacaucuauggagggcgcgagcccgcucuccgagagaugccagcggcaacugcagucucugugucgcgggcucggacugggcggcagacggcuuaaaagcccucaggcccccgauccugaagaggaagagaauagagacucccagcaacccgggaagcgccggaaagauagcgaagaggaggcugccucucccgaaggaaagagaguuccuaaacgccugcggugcugggaggaagaggaagaccacgagaaggagagaccggaacauaagucccucgagagccuggcugauggcgggucugccucccccaucaaagaccagccugugauggccgucaagacgggagaagauggcagcaaccuugacgacgcuaaagggcuggcggagucucucgaacugcccaaggccauucaggaucaacugccucgccuccagcagcugcuuaaaacccuggaggagggacucgaaggccuggaggacgcucccccgguggaacugcagcuucuccacgaguguuccccuagccaaauggaucugcugugcgcccagcuccagcugccccagcuuuccgaccugggccuccugcggcuguguacauggcuucucgcccugucuccugaucugagccucuccaaugcuaccguucugacaagaagccuuuuucuggggcgcauccucucucugaccuccagcgccucucggcugcuuacaaccgcgcucacgagcuucugcgcuaaguacaccuaucccguguguuccgcccugcuggacccuguccuccaagcccccggaacaggcccggcucagaccgagcugcuuugcugucuggugaagauggaaucucucgagccugaugcccaggugcugaugcuggggcagauucuugaacuccccuggaaagaggaaacauuucugguccugcaaagccuccuggagagacagguugagaugacccccgaaaaguucuccgugcuuauggagaaacugugcaagaaaggacucgcugccacgacaagcauggcguacgccaagcugaugcugaccgugaugacaaaauaucaggcuaacaucaccgaaacccagcgccuuggccuggccauggcucucgagccuaauacaacguuucugcggaagucucucaaggccgcgcugaaacaucuugggccguga

SEQ ID NO: 69172 - RNA, 1125 nt, Artificial Sequence
  derived and/or modified sequence opt5 from FANCF__Homo_sapiens__NP_073562
auggagagccugcuccagcaccuggacagauucuccgaacuucuggccgugucuagcaccacauacgucuccacgugggaucccgcuaccguucggcgcgcccuccaaugggcgagauaucugcggcauauccaccgcagauuuggccggcaugggccuauucgcacagcucuugagagacggcugcacaaccaguggcgccaggaaggaggcuucgggagaggaccggugcccggccucgccaauuuucaggcccuggggcauugcgacgugcugcucucucugcggcuucuggagaaccgcgcucucggagaugccgcuagauaccaccugguccaacagcuuuucccuggccccggcgugcgggacgccgaugaagagacccugcaggagagccucgcgcgccuggccagacggagauccgcuguucacaugcugcgcuuuaauggguaucgggaaaacccuaaucuccaggaggacucucugaugaagacacaagccgaacuucugcucgagagacugcaggaggugggaaaagcugaagccgagcgccccgcgcgguuccuuagcucccugugggaaagacucccucagaacaauuuucugaaggucaucgccguggcucugcuccagccgccccugagccgccggccucaagaggaacuugagcccggcauucauaaaucuccuggggagggaucccagguucuggugcacuggcuccugggcaacagcgaagucuucgccgcuuuuuguagagcccuucccgccgggcugcucacccuggugacaucucgccauccggcucuguccccuguguaccucggacugcuuaccgauuggggccagcggcugcacuaugaccuccaaaagggcaucugggucgggacggagagccaggauguucccugggaggaacugcacaauagauuccagucucugugccaggcgccuccuccccuuaaagacaaggugcucaccgcccuggaaacauguaaggcucaagauggagacuuugaggugcccggccuguccauuuggaccgaucuccugcuugcccugcgcagcggggccuuccggaaaagacagguccucggacuguccgcuggccugucuagcguguga

SEQ ID NO: 69173 - RNA, 1869 nt, Artificial Sequence
  derived and/or modified sequence opt5 from FANCG__Homo_sapiens__NP_004620
augagcagacagaccacauccgugggcucuagcugccuggaccucuggcgggaaaagaacgaucgccuggucagacaagccaaaguugcucaaaauuccgggcuuacgcugcggcgccagcagcucgcccaggacgcgcuggaaggacuuagaggccugcuccacucucugcaggggcugcccgcugccgugccugugcucccgcuggagcuuaccgucacauguaacuucaucauucugcgggccagccucgcucagggauuuaccgaagaucaggcccaagacauccagcgcucccuggagagagugcuugaaacacaggagcagcaaggcccccggcuggagcaggggcuccgcgaacugugggauucuguucugagagcuagcugccuccugccugagcuucuguccgcccuccaucggcuggugggacuucaggcggcccuguggcucagcgcugaccgccugggcgaucuggcccuccugcuugaaacccugaauggcucucaauccggggcuagcaaggaccuccugcuucugcucaaaacauggucucccccugccgaggagcuggaugcgccccugacccuccaggacgcccagggacugaaggauguccuucugacggcuuucgccuacagacagggccuccaagaacugauuaccgggaacccugacaaagcucuguccagccuucacgaggccgccucuggacucuguccgcggcccgugcugguucagguguauacagcucugggcuccugccaucgcaagauggggaauccucagagagcgcuccuguaccuugucgccgcucugaaggaaggaagcgccuggggacccccucuccuggaggccucccggcuguaucagcaacuuggcgauaccacagcugaacucgagucucuggagcugcucguggaagcccugaacgugcccuguagcuccaaagcgccgcaguuucuuaucgaggucgaacugcuccugccucccccugaccuggcuagcccccuucacugcgggacccagucucagacgaagcauauucucgccuccagaugucugcaaacaggacgcgccggcgacgcugccgagcacuaccuggaucuccuggcccuucugcucgacagcucugaaccccgguucagcccuccgcccuccccucccgggccuugcaugcccgagguuuuucuggaggcugcgguggcccugauccaggcuggcagagcccaggaugcucuuacccucugugaagaacugcugucucgcacaagcucccuccugccgaaaaugagccggcuuugggaagacgccagaaagggcaccaaagagcugccuuauugcccccucugggugucugcgacccaucugcugcaggggcaagccuggguccagcuuggagcucagaagguggccaucuccgaguucagccgcugucuggagcuccuguuucgggcuacaccugaggaaaaggagcaaggcgccgccuucaauugcgaacagggcugcaaaucugaugcugcgcuccagcagcugagagccgcugcccuuauuucccgcgggcuggaguggguugccagcggacaagacacgaaggcucuccaggauuuucugcuguccgugcagaugugucccggcaaccgggacaccuacuuccaccuucugcagacacucaaaagacuggaucgccgggacgaggccaccgcgcucugguggagacuggaagcucaaacaaaggggucucacgaggaugcccuuuggagccugccucucuaucuggaauccuaccugucuuggauccggcccagcgaccgcgacgccuuucuugaggaguucagaaccucccugccgaaaagcugcgaucucuga

SEQ ID NO: 69174 - RNA, 3987 nt, Artificial Sequence
  derived and/or modified sequence opt5 from FANCI__Homo_sapiens__NP_001106849
auggaccagaagauccugagccucgccgcugagaaaaccgccgauaagcugcaagaguuccuucagacacugagagaaggcgaccucacgaaccugcuucagaaucaggcggugaaagggaaggucgcuggagcccugcuccgggccauuuuuaaaggcucccccugcucugaagaggcugggacccugcgcagacggaagaucuacacauguugcauucaacugguugaaagcggagaucuccagaaggagaucgccuccgagauuaucggccugcuuaugcuggaagcucaccauuucccugggccgcuccugguggagcuugccaacgaauuuaucucugcggugcgcgagggaagccuggucaauggcaaaucccucgagcugcugcccauuauccucaccgcccuggcuacaaagaaagaaaaccuugccuauggcaagggggugcugucuggagaggaauguaaaaagcagcucauuaauacccugugcagcggcagaugggaccagcaauacguuauccagcuuacauccauguucaaggaugugccucugaccgcugaggaagucgaguuugugguugagaaagcccucagcauguucucuaagaugaaccugcaggaaauucccccucugguguaucagcuccugguccuuuccagcaaagggucucggaaguccgugcuggagggaaucauugcguuuuucagcgcccucgacaaacaacacaaugaggaacagucuggcgaugaacugcuugacguggucacgguucccuccggggagcugcgccauguggagggaaccaucauccuccacauuguguuugcuaucaagcuggauuacgaacugggcagagagcucgucaaacaucugaaggugggccagcaaggggacagcaacaauaaccuuuccccuuucucuauugcccugcuccugagcguuacacggauccagcgcuuucaggaucaggugcuggaccuucucaagaccuccgucgugaaaucuuucaaggaucugcaacugcuccagggaucuaaauuucugcagaaucuuguuccgcacagauccuaugugagcacaaugauucuggaagucgugaagaacucuguccacagcugggaccaugugacccagggccucguugagcugggguucauccugauggacuccuacggacccaaaaaggugcuugauggcaagacgaucgaaacaucuccuagccucucccggaugcccaaucaacacgcuuguaaacugggggccaacauucugcucgagaccuucaagauccaugagaugauucgccaggaaauccuggagcagguccuuaauagagugguuacacgggccagcucuccuauuucccacuuucuggaccuccugagcaacaucgugauguaugcuccccugguccuucagucuugcuccagcaaagugaccgaagcguucgauuaccucuccuuucugccgcugcaaaccgugcagcgccuccugaaggccguucagccucuucugaaagucucuaugagcaugagagacugucucauccuggugcugcggaaggcuauguucgccaaccagcuugaugccagaaaguccgcuguggccggauuucuccugcugcucaaaaauuucaagguccugggcucucuuagcuccagccaaugcucucagucccugagcgugucucagguucacguggacguccauucccacuacaacagcguggcgaaugagacauuuugucucgagauuauggauucucugcgccggugccugagccaacaggcugacguuagacuuaugcuguaugaaggcuucuacgaugugcuccgccggaacucccagcuggccaauagcgucaugcagacgcuccugucucaacuuaaacaguuuuaugagcccaagccugaccugcucccuccccugaaacuggaagccuguauccuuacccagggggauaagauuucccugcaggagccccucgacuaccugcucugcugcauccaacauugucuggcuugguauaagaacacagugauuccgcuucagcagggagaagaggaggaagaggaagaggaagccuucuacgaggaccuggaugacauccucgagagcauuaccaauagaaugaucaaauccgaacuggaggauuuugaacuggacaagucugcugauuucagccaguccacaucuaucggcauuaaaaacaauaucugcgccuuucuuguuaugggggugugugagguccugauugaauauaacuucagcaucuccucuuucagcaagaaucgcuuugaggacauucucucccuguucaugugcuacaaaaagcucagcgauauccugaacgagaaagcgggaaaggccaagaccaaaauggcuaauaagacgucugacucccuucugagcaugaaauuugugucuucccugcucacagcccuguuccgggauagcauccaaucucaccaggaaucccuuagcgugcugagauccagcaacgaguuuaugcgcuacgcugucaauguugcccuccagaaggugcaacagcugaaagaaaccggccaugugucugggcccgacggccagaacccugagaagauuuuccagaaccucugugauaucacccggguccugcuuuggagauauacaagcauucccaccuccguggaggaaucuggaaagaaagagaagggcaaaagcaucucccugcugugccucgaagggcugcaaaagauuuuuagcgcgguucagcaguucuaccagccuaaaauccaacaguuucuucgcgcccuggacgugacagauaaggagggagaggaacgggaggacgcugacgucagcgugacgcagagaaccgccuuccagauccggcaauuucagcgcucccuccugaaucuccugucuagccaggaagaggauuucaacuccaaggaagcccuucugcugguuacagugcucaccagccugucuaaacuucuggagcccuccagcccgcaguuuguccaaaugcucucuuggacauccaagauuuguaaagaaaauagcagagaggacgcucuguucugcaagucccucaugaaccugcuuuucucucugcacgugagcuauaaauccccuguuauccugcuccgggaucugagccaggacauucacggccaucuuggggauaucgaccaggauguggaggucgaaaagaccaaucacuuugccauugugaaccugagaacggcugcgcccaccgugugucuccugguccugucucaagccgagaagguucucgaagagguggacuggcuuaucacaaaacugaagggacaggugucccaggaaacccugagcgaggaggcuucuagccaggccacacucccuaaucaacccgucgaaaaagccaucauuaugcagcugggcacccuucugacguucuuucaugagcucgugcagacagcucugccuuccgggucuugcguugauacccugcucaaggaccuuuguaaaauguacacaacccugaccgcccuggugcgcuauuaccuccaggucugccaaagcuccggcggaauccccaagaacauggaaaaacuggugaaacuuucuggcagccaccugacaccgcucugcuauuccuucauuagcuacguucagaauaagucuaagucccugaacuacacgggggagaagaaagagaagccugcggcuguggccaccgccauggcucggguccugagagaaacaaaacccauccccaaucucauuuuugccaucgagcaguaugaaaaguuccuuauucaccugagcaagaaauccaaggugaaccugaugcagcauaugaaacucucuaccagccgcgauuuuaagaucaaaggaaauauccuggacaugguccuuagagaggauggcgaagacgagaacgaggaagggacagcguccgagcacggaggccaaaauaaggaaccugcuaagaaaaagcggaaaaaguga

SEQ ID NO: 69175 - RNA, 1143 nt, Artificial Sequence
  derived and/or modified sequence opt5 from FANCL__Homo_sapiens__NP_001108108
auggccgugaccgaggcuagccugcucagacagugcccccugcuucugccucaaaaccgguccaagacagucuacgaaggcuucaucucugcccaggggcgcgacuuucaccucagaauuguucugccggaggaucuucagcugaaaaaugcgcggcuccuguguagcuggcagcugcgcacgauccucuccggauaucauagaauugugcaacagcggaugcagcacucucccgaccugaugagcuucaugauggaacuuaagaugcugcucgagguggcucugaaaaaccgccaggaacuuuacgcccugccucccccuccccaauuuuauuccucucucaucgaggagauuggcacccuggggugggauaagcuggucuacgccgacacaugcuucagcaccaucaaacucaaggcugaagaugccuccggaagagagcaucugaucacacuuaagcugaaagcuaaguauccugccgaaagcccggacuacuuuguggauuuccccguuccuuuuugugcgucuuggacaccccaggucaauuccccucagagcucucucauuuccaucuauagccaguuccuggccgcuauugagucucuuaaagccuuuugggacgugauggaugagaucgacgaaaagaccugggugcuggagcccgaaaaaccgccucgguccgcuaccgcccgcagaauugcgcucggcaacaauguuagcaucaacauugagguggauccccggcacccuacgaugcugcccgaaugcuucuuucugggggccgaccaugucgugaagccccucggaaucaagcugucccgcaauauccaccuuugggauccugagaacucugugcugcaaaaucucaaagacguccuggagauugacuucccggcuagagccauccuugaaaagagcgauuuuaccauggacuguggcauuugcuacgcuuaccagcuggauggcacaauccccgaccagguuugugauaacucccaaugcgggcagccuuuccaccagauuugucucuaugaguggcugcggggacugcucaccagccgccagucuuucaauaucaucuuuggcgaaugccccuacuguuccaaaccuauuacacugaagaugagcgggagaaaacauuga

SEQ ID NO: 69176 - RNA, 6147 nt, Artificial Sequence
  derived and/or modified sequence opt5 from FANCM__Homo_sapiens__NP_065988
auguccggaagacagcggacccuguuccaaaccuggggguccucuaucucucgcuccucuggaacgcccggcugcagcuccgggaccgagagaccucagucucccggaagcuccaaggcgccccugccugcugccgcggaagcucagcuggagagcgacgaugacgugcuucuggucgccgccuacgaagcugagcggcagcucugucuggaaaacggcggguuuugcacaucugccggagcucuuuggauuuaucccaccaauuguccuguucgcgauuaccaacugcacaucuccagagccgcccucuucugcaacacccuggugugucugcccaccggccucggcaaaacauuuauugccgcuguggucauguauaauuucuaccggugguuuccuagcgggaaggugguuuucauggccccgaccaaaccccuggugacgcagcagaucgaggcuugcuaucaggucaugggcauuccucaaucucauauggccgagaugaccggcuccacacaggcgagcacccgcaaggaaaucugguguucuaaaagagugcuuuuucugacaccccagguuauggugaacgaccucuccagaggggccugcccugcugccgagaucaagugucuggucauugaugaagcucacaaggcccuuggaaauuacgccuauugccagguggugcgcgagcuggucaaauacaccaaccauuucagaauccucgcucugagcgcgacgcccggcuccgacauuaaggccguucaacaggugaucacaaaucugcucauugggcagaucgagcugcggucugaagauagcccggacauucuuaccuacucccacgagcgcaaaguggaaaagcugaucgucccucucggagaggaacuggcugccauccagaaaacauauauucaaauccuugagagcuuugccagaucucugauucagcggaacgugcucaugcgcagagauauccccaaucugaccaaguaccagauuauccuggcucgggaccaauucagaaagaacccuucccccaauaucguuggcauucagcagggcaucauugagggggaauuugccaucuguauuagccucuaucauggauacgagcugcuucagcaaaugggcaugcgcucucuguauuucuuucucugcgggaucauggauggaaccaaaggcaugacacggagcaagaacgaacuggggagaaaugaggacuucaugaaacuuuacaaccaccuggaaugcauguucgcgcgcacgcgguccaccucugcuaauggaaucagcgccauucagcagggcgauaagaacaaaaaguuuguguauucccaccccaaacucaagaagcuggaggaggucgugaucgaacauuucaaaagcuggaacgccgagaauacaaccgaaaagaaaagagacgagacacgcguuaugauuuuuagcuccuuccgggacagcgugcaggaaaucgcugagaugcugucucaacaccagccuauuaucagagucaugaccuuugugggccaugccuccgggaaguccacgaaaggauucacacagaaggagcagcucgaagucgugaagcaauuucgcgauggcggguacaacacccugguuuccaccugugugggagaggaaggccuugacauuggggaggucgaucugaucaucugcuucgacucucagaaaagcccgauucggcucgugcagagaaugggccgcacaggacggaagagacaaggccggaucguuauuauccuguccgaggggcgcgaagagagaauuuacaaucagucucagagcaacaaacgguccaucuauaaggcuaucagcucuaauagacaggugcugcacuuuuaccaacgcagcccccggauggucccugauggaauuaaccccaaacuucacaagauguucaucacccauggcguguaugaaccugagaagcccagcagaaaucuccagcgcaaaucuuccauuuuuagcuacagagacgggaugcggcagucuagccugaagaaagauugguuccuguccgaagaggaguuuaagcucuggaaccgccuguauagacuucgggacagcgaugaaaucaaagagauuacacugccccaggugcaauucucuucccuccagaaugaagagaacaagccugcccaggaaagcacgaccggaauccaccagcugucccugucugaguggcgccuuuggcaagaccauccccucccuacacaccagguugaucauagcgacagaugucggcacuucaucggccugaugcagaugauugaggggaugcgccacgaagagggcgaaugcuccuacgagcuggaagucgagucuuaucuccaaauggaggacgugaccagcacauuuaucgcgcccagaaaugaauccaacaaucuggccucugauaccuucauuacgcauaagaaaagcuccuuuaucaagaacauuaaucagggauccucuuccagcgugaucgagucugacgaagagugugcugagaucgucaaacagacccacauuaagccuacaaaaaucgugucccuuaagaaaaagguuagcaaggaaauuaaaaaggaucagcugaaaaaggagaacaaccauggcaucauugacucuguggauaaugaccggaacuccaccgucgaaaauaucuuccaagaggaucuccccaacgacaaacgcacaagcgauaccgacgaaauugccgcuacgugcacaaucaaugagaacgugaucaaggagccguguguucugcugaccgaaugccaguuuacaaauaaguccaccagcucucuugccgggaacgugcucgauagcggauacaauuccuucaacgacgagaaaucugucagcuccaaucuguuucugccuuucgaagaggaacucuacauugugagaaccgaugaccaguuuuauaacugucacucucugacaaaggagguucuugcgaauguggagcgguuccugagcuacagcccgcccccucucucuggccugagcgaccuggaauaugagaucgccaaagggacggcucuugaaaaccuccuguuucugccgugcgccgagcaccucagauccgauaaguguaccugccugcuuagccauucugcugucaauucccagcaaaaccuggaacucaacagccugaaaugcauuaauuaccccucugagaaguccugucuguaugacaucccuaacgauaauauuagcgacgagcccucccuuugcgauugugacgugcacaagcauaaccagaaugaaaaccuggugccuaauaaccgcguccagauccaccggucucccgcccagaaucucguuggagagaacaaucaugauguggacaacagcgaucugccugugcucuccacagaccaagaugaaagccugcuucuguucgaggacgucaauaccgaguuugaugacgugucucucagcccccugaacagcaaaucugaaagccugccgguuuccgacaagacagccaucucugagaccccucuugugagccaguuccugauuuccgaugaacuccugcucgacaauaacucugagcugcaggaucagaucacgagagacgcuaacagcuucaaaucccgcgaucaacggggcguccaggaagagaaggugaaaaaucacgaggacauuuuugauugcagcagagaccuuuucucuguuacauuugaucugggguucuguucccccgacagcgaugacgaaauccucgagcacaccuccgacucuaaccgcccucuggaugaccuguacggccgguaucuugaaauuaaggagaucagcgaugcgaauuacguguccaaccaggcccugauccccagagaccauucuaagaauuuuaccagcggaacagucauuaucccguccaacgaagauaugcaaaauccuaacuacgugcaccucccccugagcgcugccaaaaaugaggagcuccugucuccuggcuauucccaguucagccuucccguucagaagaaagugaugucuacaccccuguccaagagcaacacacucaauucuuuuagcaaaauucgcaaggaaauccucaaaacgccugacuccucuaaggagaaggucaaccugcagcgguucaaagaagcccuuaauagcaccuuugauuacuccgaguucagccuggaaaaguccaaaucuagcgggccgauguaucuccauaaguccugccacucuguggaggacggacaacugcucacaagcaacgaguccgaagaugacgagauuuuuagacggaaagugaagcgcgcuaagggcaauguccugaacucucccgaagaucagaaaaauagcgagguugacuccccucuucaugccgugaagaaaagacgguuccccaucaaccgcagcgagcugucuuccagcgaugaaucugagaacuucccuaagcccuguucccagcuggaagacuuuaaagugugcaaugggaacgcgagacggggaauuaaggucccuaagagacagagccaccucaaacacguggcucgcaaguuccuggacgaugaggccgaacuuucugaggaggacgccgaauacguuuccagcgaugagaaugacgaauccgagaacgaacaagauagcucucugcucgacuuucugaaugaugagacccagcucagccaggcuaucaacgacuccgagaugcgggccaucuauaugaaaucucugagaagcccgaugaugaauaacaaguacaaaaugauucauaagacacacaagaauaucaacauuuucucccagauccccgaacaagaugagaccuaucuugaagacucuuuuuguguggaugaggaagagagcugcaaaggccaguccucugaggaagaggucuguguggacuucaaucugauuacggaugacugcuuugcgaacagcaagaaauacaagacccgccgggcuguuaugcugaaagaaaugauggagcagaauugcgcccauuccaagaagaaacucagcagaaucauccugccugacgauucuuccgaggaagagaacaaugugaacgacaagcgcgaaagcaacauugccgucaaucccucuacagugaaaaagaacaaacaacaggaucacugucuuaauuccgucccuagcggguccucugcucagagcaaggugcgguccacccccagaguuaacccgcuggccaaacagagcaagcaaacaucucucaaucugaaggacaccaucuccgaggugagcgauuucaaaccucagaaccacaaugaaguccagucuacaacaccgcccuuuacgacaguggacagccagaaggauugccgcaaauucccuguuccccaaaaggacggcuccgcucucgaggauucuagcaccuccggagccucuuguagcaaauccagaccucaucuggcgggcacccacacaagccuucggcugccgcaggaggggaagggaaccugcauucuggugggcgggcaugaaaucacgucuggacucgaggucauuuccagccugcgcgccauccacggccuucagguggaaguguguccccugaacggcugcgacuacaucguuuccaauagaauggucguggagcggcgcucucagagcgaaaugcucaacuccgugaauaagaacaaauuuauugagcaaauccagcaucugcagucuauguucgagagaauuugugucaucguggaaaaggaucgggagaaaacaggggacaccagcagaauguuucgccggacaaaguccuaugacagccugcucaccacacuuauuggagcuggcauccggauucuguucucuuccugccaggaagagaccgccgaucugcucaaagaacugagccuuguugagcaacgcaagaauguggggauccacgucccuacggugguuaacucuaauaaguccgaggcucugcaguucuaccucagcauccccaacauuucuuauaucaccgcccugaacaugugucaccaguuuuccagcgugaaacggauggccaauucuagccugcaagaaauuuccauguacgcucaggucacacaucagaaggcggaggaaaucuauagauacauucacuauguguucgacauccagaugcucccuaacgaucuuaaucaagaccggcugaaaagcgauaucuga

SEQ ID NO: 69177 - RNA, 1038 nt, Artificial Sequence
  derived and/or modified sequence opt5 from FANK1__Homo_sapiens__NP_660278
auggagccccagaagaucaugccuccgagcaaaccccacccucccguggucggcaagguuacccaucacuccauugaacuguacugggaccucgagaaaaaggccaaaagacaagggccucaggaacagugguuccgguuuucuaucgaggaagaggaucccaagaugcauacauauggaauuaucuacacgggcuaugcuaccaagcacgugguggaggggcuggaaccucgcacacuuuacagauuccggcugaaagucaccagcccguccggagagugcgaauauucuccccucgugagcguuuccacaacccgcgagccuauuucuagcgagcaucugcacagagccguguccgucaacgacgaagaucuucuggugcggauccuccagggcgggcgcguuaagguggacguccccaauaaauuuggauucacagcgcugaugguggcugcccaaaagggcuacaccagacuggugaaaauccucgucagcaacggcacggauguuaaucugaagaacgggucuggaaaggacucccuuaugcuggccuguuaugcuggccaccucgauguggugaaauaccugcggcgccauggggccagcuggcaggcuagagaccuuggaggcugcaccgcccugcacugggcggccgaugggggacauuguucugucauugaguggaugaucaaggacggcugcgaaguggauguuguggacacaggcuccggguggaccccucucaugcgggucagcgcugugucuggaaaucagcgcguugccucccugcugauugaugcuggcgccaacgugaaugucaaagacagaaacgggaagacaccccucaugguggcgguccugaauaaccacgaggaacuugugcagcugcuccuggacaaaggagccgaugcuagcguuaagaaugaguuuggcaaaggggugcuugagauggcccgggucuucgaccgccaauccgugguuucucugcucgaagagagaaagaagaaacagcggccgaagaaaagcugugugugcuga

SEQ ID NO: 69178 - RNA, 2208 nt, Artificial Sequence
  derived and/or modified sequence opt5 from FAP__Homo_sapiens__NP_001278736
augaagaccugggugaaaaucgucuucggcguugccacaagcgcugugcuggcccuccuggugaugugcauuguccuuagacccucccgggugcacaacucugaggaaaauacgaugcgcgcgcugacccucaaggacauccugaacgggacauuuagcuacaaaaccuucuuuccuaauuggauuuccggacaggaguaucuucaucaaucugcugauaacaauaucguucuguacaacauugaaacaggccagagcuauaccauccucuccaauagaacaaugcuguggcgguacucuuauaccgccacguacuauaucuacgaccugagcaacggggaguucgugcgcggaaaugaacucccgagacccauucaguaccuguguugguccccugucggcagcaaacuugccuauguguaccagaacaauaucuaucugaagcaacggcccggggauccucccuuucagauuaccuucaacggacgcgagaauaagaucuuuaacggcauuccugacuggguuuacgaggaagagaugcucgcuacaaaguaugcccugugguggucuccgaauggcaaauuccuugcuuacgccgaauuuaacgauaccgacauccccgugauugcguauuccuacuacggggaugagcaguauccuagaacaaucaacauccccuacccuaaggccggagcuaaaaaucccgucgugcggauuuucaucauugacaccacguauccggccuacgugggcccucaggagguccccguuccugcuaugaucgccagcucugauuauuacuuuuccuggcugacaugggugaccgacgaacgcgugugccuccaauggcugaagagaguccagaacgugagcguucugucuauuugugauuuccgggaggacuggcagacaugggauugccccaaaacccaggaacacaucgaggaaucccgcaccgggugggcgggaggcuuuuucgugagcacacccgucuucuccuaugacgccaucucuuacuacaagauuuuuagcgacaaggauggguauaaacauauccacuacauuaaggacacgguggagaaugcuauccaaauuaccuccggaaaaugggaggccaucaacaucuucagaguuacacaggauagccucuuuuauucuuccaaugaguucgaagaauacccuggccggcgcaacauuuauagaaucagcauuggcucuuacccgcccagcaagaaaugugugaccugccaucugcggaaggagagaugucaguauuacacagcuuccuuuucugacuacgccaaauauuacgcccuugucugcuaugggccuggaauccccauuagcacccugcacgauggccgcacggaccaagaaaucaagauucucgaggagaauaaggaacuggagaacgcucuuaaaaauauccagcugccuaaggaagagaucaaaaagcucgaaguggaugagauuacacugugguacaaaaugauccugcccccgcaguucgaccgguccaagaaguauccucuccugauucaggucuacgggggacccuguagccaaucugugagauccguuuuugcggugaacuggaucagcuaucuugccucuaaagagggcauggucauugcucugguggaugggcgcggaaccgccuuccagggcgacaagcuccuguacgccguuuaccggaaacuuggcguguaugaagucgaggaucagaucaccgcugugagaaaguuuaucgaaaugggguucauugacgagaaacgcaucgccauuuggggaugguccuacggcggguaugugagcucccuggcgcucgcuucuggaacaggccuguuuaagugcgggaucgccguugccccugucagcuccugggaguacuaugcuucuguguacaccgaacgguucaugggccugcccacaaaggacgauaaucucgagcacuauaaaaacagcacggugauggccagagcugaauacuuucgcaaugucgacuaccugcuuauucauggaaccgccgaugacaacgugcacuuccaaaauuccgcgcagaucgccaaggcucugguuaacgcccagguggauuuccaggcuaugugguauagcgaccagaaccauggccucucugggcuguccacaaaucaccuguacacccacaugacacauuuucuuaaacaauguuucagccucucugauuga

SEQ ID NO: 69179 - RNA, 1548 nt, Artificial Sequence
  derived and/or modified sequence opt5 from FAR1__Homo_sapiens__NP_115604
auggugagcauccccgaguacuaugaaggcaagaacguccugcucaccggggccacaggauuccugggcaaaguucuucuggagaagcuccugagauccugcccuaaagucaauucuguguacgugcuugugcggcagaaggcugggcaaacgccgcaggaacgcguugaggaagugcugagcggaaaacucuuugacagacugcgggaugagaaccccgacuuccgcgagaagauuaucgccauuaauuccgaacugacccagccuaagcucgcgcugucugaggaagauaaagaggucaucauugacagcacaaacaucaucuuucacugugcugccaccgugagauucaaugagaaccuucgggaugccguucagcugaaugugauugcuacacgccaacucauccugcuugcccagcagaugaagaaccuggaagucuuuaugcauguguccaccgcuuaugccuacugcaauagaaaacacauugacgagguggucuaucccccucccguugauccuaagaaacucaucgacucucuggaauggauggaugacggccuggugaacgauauuacaccgaagcucaucggggaccggcccaauaccuacauuuauacgaaggcgcuggccgaguacgugguccagcaagaaggagcuaaacuuaacguggccaucguucgcccuagcaucgugggcgcuuccuggaaggagcccuucccuggcuggauugauaauuuuaacgggcccagcggacuguucaucgccgcgggcaaagggauucucagaaccauccgggccucuaauaacgcucuggccgaccuugucccgguggacguuguggucaacaugucccuggcugccgccugguacagcggagugaaucgcccuagaaacauuauggucuauaauuguacaaccggcucuacaaaccccuuucauuggggagagguggaauaccacguuaucuccaccuucaagcggaauccucucgagcaggcuuuucgcagacccaacgugaaucugacgagcaaccaucugcucuaucacuacuggaucgcggucucucacaaagcccccgcuuuccuguaugauauuuaccuucggaugacagggagauccccucgcaugaugaagaccaucacacggcugcauaaagccaugguguuucucgaauauuucaccagcaauuccuggguuuggaacaccgagaaugugaacaugcugaugaaucagcuuaacccggaagacaagaagacauucaauauugaugucagacagcugcacugggccgaguacaucgagaacuacugccucggcacgaaaaaguaugugcugaacgaagagaugucuggccugcccgcugcccgcaaacaucucaauaagcugcggaacauuagauacggguuuaauaccauccuugugauccugauuuggcgcaucuucauugcgcggagccaaauggcuagaaacaucugguauuuuguugucucccucuguuacaaauuccugagcuauuuucgcgccucuuccacaaugcgguacuga

SEQ ID NO: 69180 - RNA, 390 nt, Artificial Sequence
  derived and/or modified sequence opt5 from FARP1__Homo_sapiens__NP_001001715
augggcgagaucgaacagagacccaccccugggagccggcugggagccccggagaacuccggcauuucuacacucgaacgcgggcaaaagcccccucccacgccuagcggaaaacugguguccaucaagauucagaugcuugacgauacccaggaggcuuucgaaguccccaugguuucuagcuccucuuuucugaaagccacaggcagcuccuggaccgggugggugcucagaugcagcaugaagccuaaacaccauucucaccugaucgagaaguucggagaggaccggauucuuacacaucugaccggcuccaucagcuacacaaauugggcgggcucucgcucccucgcugugaccgucacggaggaacugcugaaccucuuuuga

SEQ ID NO: 69181 - RNA, 1944 nt, Artificial Sequence
  derived and/or modified sequence opt5 from FARP2__Homo_sapiens__NP_001269912
augggcgagaucgaagggaccuacagagugcugcagacagccggaaugcggcucggcgcucaaacgcccgucgggguuagcacccuggagccuggacagacacuucugccgcgcaugcaggaaaagcaccuccaucugagagugaaacuucuggacaacaccauggagauuuucgauaucgaacccaagugcgacggccaggugcuccugacacaagucuggaaacggcugaaucucguggagugugauuauuuugggauggaguuccagaacacccaguccuacuggauuuggcuggaaccuaugaagcccaucauucgccagaucagacggccuaaaaauguugugcuucgccuggccgucaaguuuuucccuccugacccgggacaacuccaggaggaauauacaagauaccuguuugcgcuucagcugaagcgggaucuccuggaggagcgccugaccugcgcugacacgaccgccgcccuccugacaucucaccuucugcagagcgaaaucggcgauuaugacgagacccucgauagagaacaucugaaagugaacgaguaccuucccggccaacagcacugucuggaaaagauucucgaguuccaucagaaacacguugggcaaacacccgcugaguccgacuuucaggugcuggaaaucgcccggaagcuggagauguauggcauucgcuuccacauggcuucugauagagaaggaaccaaaauccagcucgccgucagccauaugggggugcugguguuucagggaacgacaaagauuaauaccuucaacugguccaagguccggaaacuuucuuuuaagcgcaaaagauuccugaucaagcuccaccccgagguucauggcccuuaccaagacacacuggaauuucuucuggggagccgggaugagugcaaaaauuucuggaagauuuguguggaguaccacaccuucuuuagacuccuggaccagcccaaaccgaaggcgaaggccguguucuuuucccgcggaagcucuuuccgguauuccggcagaacccagaaacagcuggucgacuacuuuaaggauagcggcaugaaacgcaucccuuaugaacggagacacucuaagacacauacguccgugcgcgcucucaccgccgaccugcccaaacaaagcaucucuuucccugaggggcuucggacacccgcuucccccagcuccgccaacgcguuuuacucucugagcccuuccacccucguuccgagcggacugcccgaguucaaggauucuuccagcucucugacagacccucaggugagcuaugucaagucccccgccgcugaaagacgcucuggcgccguggcugggggaccugauacccccagcgcccagccgcuuggcccucccgcccuccagccugggcccggacuguccacgaaaagcccucaacccucuccguccagccggaagucuccucugucccucagccccgcuuuucagguuccccugggcccugcggaacagggcuccucuccgcuucugagccccgugcucuccgacgccgggggagcuggcauggauugcgaggagccuagacacaaacgcguccccgccgacgaagccuacuucauugugaaggagauccuggcuacagaacggaccuaucugaaagaucuugaggucauuaccgugugguuuagaucugccguugugaaggaggacgcgaugccugcuacacucaugacccugcuguucagcaauaucgaucccauuuacgaauuucaucggggguuccuccgcgaggucgaacagagacuggcccuuugggagggaccuuccaaggcccacacaaaaggcagccaucaacggaucggggacauccugcucagaaacaugcgccagcugaagguguuccagcugcacgaaggccacguugcuggagugacgaaaauggaguga

SEQ ID NO: 69182 - RNA, 1356 nt, Artificial Sequence
  derived and/or modified sequence opt5 from FARS2__Homo_sapiens__NP_001305801
auggugggcagcgcccugagacgcggggcucacgccuacgucuaucucguuuccaaggcgucucauaucagccggggacaccagcaucaggcuuggggcuccagacccccugccgccgagugcgcuacccagcgggccccggggucugugguggaacugcuuggaaaaagcuacccccaggacgaucacuccaaccugacacgcaagguccucacgagagugggccggaaucugcauaaccagcaacaccacccucuuuggcugauuaaagagcgcguuaaggaacauuucuauaaacaguacguggggagauuuggaacaccccucuucucugucuaugacaaucugagcccugugguuaccaccuggcagaacuuugauucccugcucauccccgcugaccacccuagccggaagaagggcgauaauuacuaucugaaccgcacacauaugcuuagagcccacaccucugcgcaccagugggaccugcuccaugccggccuggaugcuuuccuuguggucggggacguguaccggcgcgaucaaauugacucccagcacuacccgaucuuucaucagcuggaggccgugagacucuucagcaaacacgaacuguuugcuggaauuaaggauggcgagucucugcaacucuucgagcaauccagccggucugcccauaaacaggaaacacacaccauggaggcggucaagcugguugaauuugaccuuaaacagacgcugacccgccucauggcccaccuguucggggaugagcuugagaucagauggguggacuguuauuuucccuucacacauccuuccuuugaaauggagaucaauuuccacggagaauggcuggaggugcucggcugcggggucauggaacaacagcuggugaacagcgcuggagcccaggaccggauuggcugggcuuucggccuggggcucgagagacuggccaugauccuuuacgauauucccgacauccgccuguuuuggugugaggaugaacgguuccucaagcaguuuugcguuuccaauauuaaccaaaaggugaaauuccagccucugucuaaguaucccgccgucaucaaugacauuagcuuuuggcuuccguccgagaacuacgcugaaaaugauuucuaugaccuggugagaaccaucggaggcgaucucguugagaaaguggaccugaucgauaaguuuguccauccuaaaacacacaagaccagccacuguuaccgcauuacguaucggcauauggaaagaacacugucucagcgcgaggugcggcacauccaucaggcgcuccaagaggccgcuguccagcugcuugggguggaaggaagauucuga

SEQ ID NO: 69183 - RNA, 1527 nt, Artificial Sequence
  derived and/or modified sequence opt5 from FARSA__Homo_sapiens__NP_004452
auggccgacggccagguggcugagcugcuccugagacggcuugaagccagcgaugggggacuggacuccgcggagcucgcugccgaacugggcauggagcaccaagccgucguuggggcugugaagucucuucaggcccugggagaagugaucgaggcugagcuccgcagcaccaaacauugggaacugacagccgagggcgaagagauugcgagagaggggucccacgaagcccgggucuuccgcucuauucccccugagggacuggcucagagcgaacucaugagacugccguccggcaaggugggcuuuucuaaagccaugagcaacaaguggauccggguugauaaauccgcugccgacgggccccgcguguucagagucguggauagcauggaggacgaaguucagcggcgccuucaacuggugagaggaggccaggcggagaagcucggggagaaggaacggucugagcugcgcaaaagaaagcugcuggccgaagucacgcucaaaaccuacuggguguccaagggaagcgcuuuuucuacauccaucagcaaacaggagaccgaacugucuccugagaugauuuccagcggcuccuggcgggaucgccccuucaagccuuauaauuuucuggcccauggggugcuccccgacucuggacaccuucauccucuucugaaggucagaagccaguuccggcaaaucuuucucgagaugggcuucacagaaaugccgaccgauaacuuuaucgaguccagcuucuggaauuuugacgcucuguuccagccccagcagcacccugccagagaucaacacgacacauuuuuccuucgcgaucccgccgaagcucugcagcucccuauggacuacguucagcgggugaaaagaacccauucucaaggcggguauggaucccagggcuacaaguauaacuggaaacuggacgaggcgcgcaagaaucugcuccggacgcacaccacaagcgccucugcuagagcccuguaccgccuugcccagaaaaagcccuucaccccggugaaauauuuuagcauugaucgggucuucagaaacgaaacacuggacgcuacccaucucgccgaguuucaccagaucgagggggugguugcggaucacggacugacgcuuggccaucugaugggggugcuccgcgaguucuuuacaaagcugggaauuacccaacugcgguucaagccugcuuacaaucccuacacagaaccuuccauggaagucuuuucuuaucaccagggccucaaaaaguggguggagguuggcaacagcgggguguucagacccgagaugcugcuucccaugggacugccugaaaaugucuccgugaucgccuggggccucagccuggagcgcccgaccaugauuaaauacgggaucaacaauauucgggaacuggucggacauaaggugaaccuucagaugguuuaugacucuccccucugcagacuggaugccgagccucggcccccucccacccaggaagcugccuga

SEQ ID NO: 69184 - RNA, 1008 nt, Artificial Sequence
  derived and/or modified sequence opt5 from FAS__Homo_sapiens__NP_000034
augcugggcaucuggacccuccugccccuugugcugacaagcgucgccagacucuccucuaagagcguuaacgcucaggugacggacauuaauuccaaagggcuggagcuucggaagaccgugacaaccgucgaaacacaaaaccuggagggacuccaccaugauggccaguucugccacaaaccuuguccgcccggggaacgcaaggccagagacugcaccgugaauggagaugagccugacuguguucccugccaggaaggcaaagaguacacagauaaggcgcauuuuucuagcaagugucggcgcugcagacugugugacgaggggcacggacuggaaguggagaucaacugcacccggacgcagaauaccaaaugucgcugcaagccuaacuucuuuuguaauuccacagucugcgaacauugcgaucccuguaccaaaugcgagcacggcauuaucaaggaguguacacucaccucuaacacgaaaugcaaggaagagggcagcagauccaaucugggguggcuuugucugcuccugcuuccuauuccgcugaucguguggguuaagcggaaagaagugcaaaagacaugccgcaaacacagaaaggagaaccagggaagccaugaaucucccacccucaauccugagacagucgcuaucaaccuguccgacguggaucugagcaaauauauuaccaccaucgccggcgugaugacacucucucaggucaagggguucguucggaaaaauggagugaacgaggccaagauugacgaaaucaagaaugauaacgugcaggacacggcugagcaaaaaguccagcugcuucgcaacuggcaccagcugcauggcaagaaagaagccuacgauacccucauuaaggaccugaaaaaggcuaaucuuuguacacuggccgagaagauccagaccauuauccucaaagacaucacauccgauagcgaaaacucuaauuuuagaaacgagauucaaucccugguguga

SEQ ID NO: 69185 - RNA, 846 nt, Artificial Sequence
  derived and/or modified sequence opt5 from FASLG__Homo_sapiens__NP_000630
augcagcaacccuucaacuacccuuauccgcagaucuacuggguggacagcuccgccucuagccccugggcuccucccggcaccguccugccuugccccacauccguuccuagacggccggggcagcgcagacccccucccccucccccgccucccccucugcccccucccccgcccccucccccucugcccccgcuuccucugcccccucucaagaaacggggaaaucacucuacgggccugugucuucuggugauguuuuucauggugcucgucgcccugguggggcucggacucggcauguuucagcuguuccaucuucaaaaggagcuggcggaacuccgcgagagcaccucccagaugcacacagcuucuagccuggaaaaacagauugggcaucccuccccucccccggagaagaaagaacuuagaaagguugcccaccugaccggaaagagcaacucucgguccaugccucucgagugggaggauacauauggcaucgugcugcugagcggcgucaaauacaagaaagggggacucgugauuaaugaaaccggccuguauuuuguuuacucuaagguguauuuccgcgggcaguccugcaacaaucuuccccugagccauaaagucuacaugagaaacucuaaguacccccaagaccucgugaugauggagggaaagaugauguccuauuguacaaccggccagaugugggcccggagcuccuaccugggggcuguguuuaaucuuacgucugccgaucaccuguaugucaacguuagcgaacucucccuggugaauuucgaggagagccagaccuuuuucggacuguacaaacucuga

SEQ ID NO: 69186 - RNA, 7536 nt, Artificial Sequence
  derived and/or modified sequence opt5 from FASN__Homo_sapiens__NP_004095
auggaagaaguggucaucgcuggaaugagcgggaagcugcccgaguccgaaaaccuccaggaguucugggacaaucugauuggaggcguugauauggugaccgacgaugacagacgguggaaagcugggcuuuacggacugccuagaagaucuggcaagcucaaagaucugagccgguuugacgccuccuucuuuggggugcacccgaagcaggcccacacgauggauccccagcuucgccugcuccuggaagucacguaugaggcuaucguggacggaggcauuaacccugauucucugagaggcacccacacagggguuugggugggagucagcggcuccgagaccucugaagcccucagccgggaccccgagacacuggugggguacuccaugguuggaugccagcgcgccaugauggcuaauagacuuagcuucuuuuucgauuuucggggcccuucuaucgcccuggacaccgcuuguuccagcucucucauggcccugcagaacgcguaucaagccauucauuccgggcagugccccgcugccaucgugggaggcaucaauguccuucugaaaccuaacacaagcgugcaguuccuccgccugggcaugcugucuccggaagggaccuguaaggcuuuugauacggccggaaauggcuacugcagauccgaggggguggucgcgguucuccugaccaagaaaagccuugcccggcgcguguaugcuacaauucugaacgccggaaccaauacagacggcuucaaggagcagggggugaccuuucccuccggagacauccaagaacagcucauuagaucucuguaccagagcgcuggcgucgccccugaguccuucgaauauaucgaggcccacggcacggggacaaaagugggagauccccaggaacuuaacggcauuacccgggcucugugugcgacacgccaagagccucuccugaucgggagcaccaagucuaauaugggacaucccgagccggccuccggccuggcugcccucgccaaaguucugcuuagccuggaacacgggcucugggcuccuaaccugcacuuucauucucccaauccugagauucccgcccuucuggacggcagacuccagguggucgaucagccccugccugugcggggaggcaacguugggaucaauagcuucggauucggcggguccaacgugcacaucauucugagaccgaacacccaacccccucccgcgccugcuccccaugccacacucccgcgccugcuucgggccucuggaagaacgccugaagcuguccagaagcugcucgagcagggccugcgccacagccaggaccuggccuuucuuuccaugcucaaugauaucgcugccgugcccgcgaccgccaugccuuuccggggguacgcuguccugggcggagaaagaggcgggcccgaggugcaacagguuccugccggagagcgcccccugugguuuauuugcagcggcauggggacacaguggcggggaaugggccucucucugaugagacuugaccgcuuccgggauuccauccugagaagcgacgaagcugugaagccguuugggcucaaagucucucagcugcugcuuuccaccgaugagagcacauucgacgauauugugcacuccuuuguuucucucaccgccauccaaaucggccugauugaccugcucagcuguaugggacugcgcccugacggcaucguggggcauucccuuggagaagucgcgugcggcuacgccgaugggugucugucucaggaggaagcugugcucgccgcuuauuggcggggacagugcauuaaggaggcccaucugccgcccggcgccauggcugcgguggggcugagcugggaggaauguaaacagagaugcccuccgggcguuguccccgccugccauaacuccaaggacacggugacaaucagcggaccucaagcucccguguucgaguuugucgaacagcuucggaaagagggcguguucgccaaggagguucgcaccgggggaauggccuuucacucuuacuucauggaagcuauugccccuccccuccugcaggagcugaaaaaggugaucagagaaccuaagccccgguccgcgagauggcucagcaccucuaucccggaggcucaguggcauuccagccuggcccgcacaucuagcgccgaauauaaugucaacaaucuuguguccccuguucuguuucaagaggcucucuggcacgugcccgagcacgccgucgugcuggaaauugcgccucaugcucugcuucaggccguucucaaacggggccugaagcccagcuguaccaucauuccgcugaugaaaaaggaucacagagacaaccucgaguucuuccuggccgggaucggacgccuucaucugucuggcauugaugcuaauccuaacgcccucuuucccccuguggaguuccccgcucccagaggcacaccucugaucuccccgcugauuaaaugggaccacagccuugccugggauguccccgcggccgaggacuuuccuaauggguccggaucucccagcgcugccaucuacaacaucgauacguccucugaaagcccugaccacuaucugguggaucauacccucgacggccgggugcuguuccccgcuacaggguaccucuccauugucuggaagacccuggcccgcgcccuuggacugggcguugagcagcucccugugguguuugaggaugucgugcugcaccaagcuacaauccugccgaagaccgggacgguuucucuugaagugagacugcucgaggcgagccgggccuucgaagucuccgagaauggaaaccuggugguuagcggcaaaguguaucagugggacgaccccgauccucgccucuuugaccaucccgaaucuccuacccccaauccgacagagccucuguuccuugcucaggccgaggucuacaaggaacugagacuccggggcuacgauuaugggccccacuuucagggcauucuggaggccucccuggaaggcgacagcgggcgccuucuguggaaagauaacugggugucuuucauggacaccaugcuccaaauguccauccugggaagcgcuaagcauggccucuaccugcccacaagaguuaccgccauucacaucgauccugcgacgcaccggcagaaacuuuauacacugcaggacaaggcucagguggccgaugucguggugucucgcuggcugagagucaccguugccgggggagugcauaucuccggccuccacacagagagcgcuccccggagacaacaggagcaacaggugccuauucuggaaaaguuuugcuucaccccgcauaccgaggaaggcugucuuuccgagcgcgccgcgcugcaagaagaacugcagcugugcaaagggcucguccaggcucugcaaacaaaggugacgcagcagggacuuaaaaugguugugcccggccuggacggggcccagaucccucgggaucccagccaacaggagcugccuagacuccugucugccgcuugucgccuucagcugaauggaaaccuccagcuggaacucgcccaaguccuggcucaggagcggcccaaacuuccggaagacccucugcugagcggccuccuggauucccccgcccuuaaagcgugccuggacaccgccguggagaacaugccuucucucaagaugaagguuguggaaguccuggcugggcacggacaucucuacagccgcauucccggccugcuuuccccucacccccugcugcagcucucuuauacagccaccgaccgccacccgcaggcucuggaggccgcccaagcugagcuucagcagcaugauguggcgcagggccaaugggacccugccgaucccgcucccagcgcccugggguccgccgaccuccuggucuguaauugcgcuguggccgcgcugggagauccugcuucugcccucagcaacaugguugccgcccuucgggaaggcggguuucugcugcuccacacacugcuuagaggacauccgcugggcgacaucguggccuuccucaccuccacggagccccaguacgggcagggcauucugagccaagaugcgugggaaucucuguucucccgcgucagccuccggcuugugggccugaaaaagucuuuuuauggcuccacacuguuccucuguagacggccuacaccccaggacagcccuaucuuucugcccguugaugacaccuccuuccgcuggguggagucucuuaaagggauccuggccgaugaagacagcuccagaccugucuggcucaaggcuauuaauugcgccacaagcggaguggugggccugguuaacugucugcggcgcgagcccgggggaaauagacuccggugcguccuucugucuaaccuguccagcaccucucacgugcccgagguggacccuggcagcgcugaacuccagaaaguccugcagggggaucuugugaugaauguuuacagagacggagccuggggcgcuuuucgccacuuccugcucgaggaagauaagcccgaggagccuacagcccaugcguuuguguccacgcugacccggggcgaccugucuagcaucagaugggucugcuccucucuccgccacgcccaacccacauguccgggggcucagcuuugcaccguguacuaugccagccugaacuuccgggauauuaugcuggcuacaggaaaacucuccccugacgccauccccggcaaguggaccagccaggauucucugcuugggauggaauuuuccggaagagacgccagcggcaagcgcguuauggggcuggugcccgcuaaaggacucgcgacguccguccugcugucuccugauuuccucugggacgugcccagcaauuggacccuugaggaagccgcuuccguuccuguggucuacucuacagccuauuacgcccugguggugcggggcagaguccgcccgggcgagacccugcucauucauagcggguccggaggcguugggcaggcugccaucgcgaucgcccugagccuuggauguagaguguuuacaaccgugggcucugcugaaaagcgggccuaucugcaagcucgcuucccccagcucgauuccaccagcuucgccaacucuagagacaccuccuuugagcagcacguccuguggcauacagggggaaaaggaguggaucugguucucaauagccuugcggaggaaaagcugcaggccucugugcggugccuggcuacacacggccgcuuccucgagauugggaaauuugaccugagccaaaaccacccucuuggaauggccaucuuccugaagaaugucaccuuucauggcgugcuccuggacgcuuucuuuaacgaauccucugccgauuggagagagguuugggcucuggugcaggccgggauucgggacggagucgugagaccccucaaguguaccgucuuccacggcgcccagguggaagaugcguuucgcuacauggcucaagggaaacauaucggcaagguuguggugcagguccuugccgaggagccugaagcuguucugaaaggagccaagcccaaacugaugagcgccauuuccaagacauucugcccggcgcacaagagcuauaucauugcuggcgggcucggaggcuuugggcuggagcuugcccaguggcugauccagcggggagugcaaaaacucgugcugaccuccagaucuggcauccgcacgggguaccaggcuaagcagguccggagauggcggcgccagggcgugcaaguucaggugagcacauccaauauuucuagccuggaaggagccagaggccucaucgccgaggcugcccagcuugggccugucggaggcguguucaaccuggcggucgugcugcgggacgggcuccuggaaaaccagacccccgaguuuuuccaagauguuuguaaaccuaaguacuccggaacacuuaaucuggaccgcgugaccagagaggccugccccgaacucgauuauuucgucguguuuucuagcguuuccuguggccggggcaacgcugggcagagcaauuacggauucgccaacucugcuauggagcgcauuugcgagaagagacggcacgagggccugccugggcuggccgugcaguggggagcgaucggcgacgucgggauucucguggagacaauguccaccaaugauacgaucgugagcggaacccuuccccagcgcauggccucuugucuggaaguucuggaccucuuucugaaccaaccgcauaugguccuuuccagcuucgugcuggcugagaaggccgcugccuauagagaucgggacucucagagagaucucguggaagcugucgcccacauccugggcauucgcgaccuggcggccguuaaucucgacuccagccuggcugaucuuggccuggacucccucaugagcguggaggugcggcagacacuggaaagagagcuuaaccugguccucucugugcgcgagguucggcaacugacccugagaaagcuccaggaacugagcuccaaagccgaugaggcuucugaacuugccugcccuacacccaaggaggacgggcuggcccagcagcaaacccagcucaaucugcgcagccuucuggugaaccccgaaggaccuacgcucaugcggcucaauuccguccagucuagcgagagaccgcuguuucucgugcaucccaucgagggcuccacaaccguuuuccacucucuggcgagccgccuuuccauuccuacauacgggcugcagugcacccgggcugcgccccucgauagcauccauucucuggccgcuuauuacauugacuguaucagacaagugcagccugaaggacccuaucgcgucgccggcuacuccuacggggcuugcguggccuuugagauguguagccagcuucaggcgcaacagucuccugcccccacccacaacucccuguuccucuuugauggaagcccgacauaugugcuggcuuacacgcaguccuaucgggccaaacugaccccuggcugcgaagcugaggccgaaacagaggcgaucuguuucuuuguccaacaguucaccgacauggagcacaauagaguucucgaagcccugcuuccccugaagggccucgaggaacgcguggcugccgcuguggaucugauuaucaaaucucaucaggggcuugacagacaggagcugagcuuugccgcucgguccuucuacuauaagcuccgcgccgcggagcaauacacaccuaaagccaaguaucacggaaacgucaugcugcugagagcuaagaccggcggggccuacggagaagaucucggcgccgacuacaaucugagccaggugugcgacgggaaaguuucugugcaugucauugagggagaucaccggacgcuucuggaaggcuccggccucgagagcaucauuucuaucauucacagcucccuggcugaacccagagugucuguucgggagggguga

SEQ ID NO: 69187 - RNA, 2133 nt, Artificial Sequence
  derived and/or modified sequence opt5 from FASTKD2__Homo_sapiens__NP_055744
augcugaccacacucaagcccuucggcagcguguccgucgagucuaaaaugaacaauaaggccgggagcuuuuucuggaaccugagacaguuuuccacgcuuguuucuaccagccggacaaugcgccugugcugucucggacugugcaaaccuaagaucgugcacuccaauuggaacauucuuaauaacuuccauaauagaaugcaaucuaccgacaucauucgguaccuguuucaggaugcuuucaucuuuaaaagcgacgugggcuuccagacaaaggggauuuccacccucacagcccugcgcaucgaaagacugcucuaugcgaagcggcuguuuuucgauagcaaacagucucuugucccgguggacaaguccgaugacgagcugaaaaagguuaaccucaaucacgaagugagcaacgaggauguccugaccaaagaaacgaagcccaaucgcaucucuuccagaaagcugagcgaggaguguaacucucuguccgacgugcucgaugcuuuuagcaaagccccuaccuuccccuccucuaauuacuuuacagccauguggaccauugcuaagcggcugagcgacgaucaaaaacgcuucgaaaagagacugauguucucccauccugccuuuaaccagcucugcgagcacaugaugcgggaagcuaaaaucaugcaguauaaguaccugcuuuucagccugcaugccauuguuaaacucggaaucccccagaauacaauucuggugcaaacccuucugcgcgucacgcaggagagaaucaacgagugugacgaaauuugccucucugugcuguccacagugcuggaggcgauggaaccuuguaagaacguccacguucuccggaccggcuuucgcauccugguggaucaacagguguggaagaucgaggacgucuucacacuucaggugguuaugaaaugcauugggaaggacgccccgaucgcucugaaaagaaagcucgaaaugaaagcccugcgggagcuugauagauuuagcgugcuuaauucucagcacauguucgagguccucgcugccaugaaccaucgcagccugauucugcucgacgaauguuccaaggugguucuggauaauauccacggaugcccccuucggauuaugaucaacauccugcagucuuguaaggaccuccaauaucauaaucuggaucuguuuaaaggccuugcggacuacguggccgcuaccuucgauauuuggaaguuuagaaaaguccucuucauccugauucuguuugagaaccucggcuuccgcccuguggggcugauggaccuuuuuaugaagcggaucgucgaagaucccgagagccugaauaugaaaaacauucucuccauccugcacaccuauagcucucugaaucacguguacaagugccagaacaaggaacaguucguugaggugauggccuccgcucuuacaggauaccuccauacgaucagcucugagaaucugcuggacgccgucuauuccuucugccucaugaacuacuuuccucuggcccccuucaaucagcuucugcaaaaagauauuaucagcgaacuccugaccuccgacgacaugaagaacgcuuauaaacugcacacacuugauaccugucucaagcuggacgauacaguguaccugagagacauugcgcucucucugccgcagcuuccucgcgagcugcccagcucccauaccaaugccaaaguugcugaagugcucucuagccugcugggcggggagggacacuuuuccaaggauguccaucuuccucacaacuaucacaucgacuucgaaauucggauggauacgaacagaaaucaggugcucccccugagcgacguggauacaaccucugccaccgacauccagcgcguugccguccugugcgugucccggagcgcuuacugucucgggucuucccaucccagaggcuuucuggccaugaagaugcgccaccuuaacgcgaugggauuccaugugauucuggucaauaacugggagauggauaaacucgagauggaagacgcugugacauuucugaagaccaaaaucuauagcguugaggcccugccuguggccgcugucaaugugcaaucuacacaguga

SEQ ID NO: 69188 - RNA, 1569 nt, Artificial Sequence
  derived and/or modified sequence opt5 from FASTK__Homo_sapiens__NP_001245390
augagacggccccgcggcgagccugggccgagagcuccccggccuaccgaaggagccacaugcgccggccccggggagagcugguccccuucucccaacagcaugcugcgcgugcuccuguccgcgcagacgucuccugcuagacuuagcggacugcuccugaucccgcccguccaaccuuguugccuuggccccuccaaguggggagaccggccuguugggggcggccccucugccgggccggugcagggacugcagcgccuccuggaacaggccaaaagcccuggcgagcugcucagauggcuggggcaaaaucccuccaaggugcgggcucaccauuacagcgucgcccuucgcagacugggacagcuccugggcucucggccucgcccuccgcccguggaacagguuacccuucaggaucugucccaacucauuaucagaaacugucccagcuucgacauucacacaauccaugugugccugcaccuggcuguccuccugggguuucccucugauggaccucuugugugugcccuggagcaggagcggcgccucagacugcccccuaaacccccgccuccccuucagccucugcuccgggaagcgagacccgaggaacugaccccucauguuauggugcugcucgcccagcaccuggcucgccaccggcuuagagagccccaacugcucgaggccauugcucauuuccuggucgugcaggaaacacagcuuuccagcaaggugguccaaaaacugguucucccguuuggccgccugaauuaucugccucucgagcagcaguucaugcccugccuggaacggauccuugccagagaggcgggcguggcuccccuggccaccgugaacauccucaugucucugugucagcugcgcugccuuccuuuucgggcccuccacuucgucuuuuccccgggguucauuaauuacaucagcggaacaccccaugcucugauugugagacgcuaucugucccuccuggacaccgccguugaacuugagcugccuggcuaccgggggcccagacucccucgccggcaacaggugcccaucuuuccucagccccugauuacggauagagcccgguguaaguauucucacaaggacaucgucgcugagggacugcgccagcuucucggcgaagagaaauacagacaagaucugaccgugccgccuggguauugcacagacuuccugcucugugcgagcuccagcggagccguucugcccgugcggacccaggauccuuuucuucccuacccgccuagaucuugcccccagggccaggcugccuccagcgccacaacccgcgacccugcucaacgggucgugcugguccucagagaacgcuggcacuucugcagagauggccgggugcugcuggggucucgcgcccuuagagagcggcaucucggacugaugggcuaccagcugcucccccugcccuuugaggaacuugagagccagcgcgggcugccucagcucaaguccuaucugagacaaaaacugcaggcgcuuggacuccgguggggcccggaagggggcuga

SEQ ID NO: 69189 - RNA, 13767 nt, Artificial Sequence
  derived and/or modified sequence opt5 from FAT1__Homo_sapiens__XP_006714202
augggcagacaccuggcccuucugcuucugcuucugcuucuguuccagcacuuuggggacagcgauggaucccaacggcucgagcagacaccccugcaguucacccaccuggaauacaacgucacgguccaggaaaauucugcugccaagaccuacguuggccauccugugaagauggggguguacaucacccaccccgcgugggaagucagauauaagauugugagcggagacuccgagaaccucuuuaaagcugaagaguacauccugggcgauuucugcuuucuuagaauccggaccaaagggggaaauaccgccauccugaaccgcgagguuaaggaccauuauacccucauugugaaggcccuggaaaagaauacaaacgucgaggcuagaaccaaagugcggguucaagugcuugauacgaaugaccugcgcccccucuucucuccuaccagcuacuccgucucucugcccgaaaacaccgccaucagaaccagcaucgcucggguguccgccacagaugcggacauuggcaccaauggcgaguuuuauuacagcuucaaggaucgcacggacauguuugccauccacccuacaucuggggugauuguccugaccggaagacucgauuaccuggagacaaaacuuuaugaaauggagauccuggcugccgaccggggcaugaagcucuacggguccagcggaauuucuuccauggcuaaacugaccguucacaucgaacaggccaacgagugugcgcccgugauuaccgccgugacacuuagcccuucugaacuggaucgcgacccggcuuaugccaucgucacgguggacgauugcgaccagggcgcuaauggggauaucgccucccucagcauuguugccggagaccugcugcagcaauucagaaccgugcgguccuuucccggcucuaaggaguacaaggucaaagcuaucggcgggauugauugggacagccauccuuucggauauaaccucacacugcaggcgaaggauaaaggcacacccccucaguuuuccagcgugaagguuauccacgugacaucuccccaguucaaagccgggccggucaaguucgagaaagacguguaccgcgcugaaauuuccgaguuugccccucccaauaccccugucgugaugguuaaggccauccccgcuuauagccaucuuagauacguguucaagucuacgcccggaaaagccaaguuuagccugaacuacaauacaggccucaucuccauucuggaaccugucaaacggcaacaggcggcucacuucgagcuugaagugaccaccucugauagaaaggccagcacaaaaguucuggugaagguccucggggccaacuccaacccgcccgaguuuacccagacagcuuauaaggccgcuuucgacgagaaugugccuaucggaacgaccgugaugagccugucugccguugaucccgacgaaggcgagaacggcuacgucacauauuccauugcgaaucugaaccacgugccuuuugccaucgaccauuucaccggggcugugagcacaucugaaaaucucgauuacgagcugaugccccgcgucuauacccuucggauuagagccuccgacuggggacugccguaccgccgggaaguggagguucucgcuacgaucacccugaacaaucugaacgauaauacaccucuuuuugagaaaaucaacugugaaggcaccauucccagagaccucggggugggagagcaaaucacaaccgucagcgccauugaugcggacgaacugcagcuggugcaguaucagaucgaggccggcaaugagcucgauuucuuuucccugaacccuaauucugggguucuuagccugaagcgcucccucauggacggccugggagcuaaagugucuuuccacagccugcggauuacggccacagauggcgaaaacuuugcuacaccccuuuacaucaauauuacagucgccgccucccauaagcucgugaaccugcaaugcgaggaaaccgggguugcuaaaaugcuggcggagaagcuccugcaggccaacaaacuucacaaucagggagaaguggaggacaucuucuucgauagccauucugucaacgcucacaucccucaguuuagauccacccugcccacaggcauucaagugaaagagaaucagccgguggggagcucugucaucuucaugaacuccacggaccucgauaccggauuuaauggcaagcugguuuacgccgugagcgggggcaacgaagacucuuguuucaugauugacauggagacaggaaugcugaaaauccuuagcccucucgaucgcgaaaccacagacaaguauacccugaauauuacgguguacgaucugggcaucccccagaaagccgcuuggcggcuccugcacgucgugguuguggacgccaacgauaaucccccugaguuucuucaggaauccuauuucgucgaggugagcgaggacaaggaaguucauucugagaucauucaaguggaagcgacagauaaggaccuggggccgaacggacacgucaccuacuccaucgugaccgauacagacaccuuuagcauugauuccguuacaggcguggucaauaucgcuagaccccucgaccgcgagcugcagcaugaacacucucugaaaauugaggcccgggaucaggccagagaggaaccucagcuuuucagcacggugguggucaagguuucccucgaggacgugaacgacaaucccccuaccuuuauucccccuaacuaucgggugaaaguccgcgaagaucugcccgaggggacagugaucauguggcuggaggcucacgacccggaucucggacaaucuggccagguuagauacagccugcuugaccauggggaaggcaauuucgauguggacaagcuguccggagccguccggauugugcagcaacucgauuuugagaaaaagcagguuuauaaccugaccgugagagcgaaagacaagggcaagccugucucucugagcuccacaugcuacguggaagucgaggugguugaugugaacgaaaaucuucaucccccugucuucagcucuuuuguggagaaagggaccguuaaggaggacgcucccgugggaucccuggucaugacggugagcgcccacgaugaagacgcccgccgggacggcgagaucagauacucuauucgcgauggguccggagugggcguuuucaaaaucggggaagagaccggcgucauugaaacaagcgacagacucgaucgggagucuaccucccacuauuggcugacaguguucgcuaccgaccagggaguggucccgcucagcuccuuuaucgagaucuacauugaaguggaggauguuaacgacaaugccccucagacaagcgaacccguguauuacccugagaucauggaaaacucucccaaggaugucagcgugguucaaauugaggcuuucgaccccgauuccucuagcaaugacaaacugauguauaagaucaccuccggcaacccucagggguuuuucucuauucauccgaagacgggacuuaucacaaccaccagccgcaaacuggauagagagcagcaggacgaacacauucucgaggugacagucaccgauaauggcagcccucccaagucuacgaucgcccgggugaucguuaaaauucuggacgaaaacgacaauaagccccaauuucugcagaaauucuacaagauccgccuuccugagagagagaagcccgaucgggaacgcaacgcgagacgggagccucuguaucacgugauugccacagacaaagaugaagggccgaaugcugagaucagcuacuccauugaagacggaaacgagcauggcaaguuuuucaucgagcccaaaaccggcgucgugagcucuaagcgcuuuuccgccgcuggggaauacgauauccucagcauuaaagccguggacaauggaagaccucagaagucuuccacaacccggcugcacaucgaguggauuagcaagcccaaaccuucccucgaacccaucucuuucgaggagagcuuuuucacauucaccgucauggaguccgauccgguugcccauaugauuggcgugaucagcguggagccucccgggaucccccugugguuugacauuacgggaggcaacuaugauucucacuucgacgucgauaaggggaccggaacaaucauuguggcuaaaccucuugacgcggaacagaaguccaauuacaaccugaccguugaggccacagauggcaccacgacaauccucacccaaguguuuauuaaagucaucgacacaaacgaccauagaccccaguucagcaccucuaaguaugaagugguuauuccugaggauaccgcuccggaaacagagauccugcagaucagcgccguggaccaagaugagaaaaauaagcugauuuacacgcuucaguccucucgcgacccccugagccucaagaaauuucggcuggauccugccaccggcucccucuauacaucugaaaagcuggaccacgaggcuguccaccagcauacccuuacagugauggucagagaucaggacgugcccguuaaacgcaacuucgcccggaucguggugaaugucagcgauaccaacgaccacgcgccuugguuuacggcuuccagcuacaaggggagaguuuaugaaucugccgccgugggauccgugguccugcaagugacagcucuggauaaagacaagggcaagaaugccgagguucucuacagcauugaguccgggaacaucggaaauucuuucaugauugaccccgugcugggcagcaucaaaaccgcgaaggaacuugaucgcuccaaccaggcugaguacgaccugauggucaaagccaccgauaaggggucuccgccuaugagcgaaaucacauccgugcggauuuuugucaccaucgccgacaaugcuagccccaaauucacaucuaaggaguauuccguggaacucagcgagacgguuucuauuggauccuuugugggcauggucaccgcccauagccagucuagcgugguuuacgagaucaaggauggcaacacaggggacgcuuucgauauuaauccucacuccggaaccaucaucacacagaaagcccuggacuuugaaacccuccccauuuauacgcugaucauucaaggcaccaacauggcggggcuuucuacaaauaccacagugcugguccaucugcaggaugagaacgacaaugccccuguguucaugcaggcugaauacaccggacucaucagcgaguccgccagcauuaacuccgugguucugacagauagaaaugucccccuugugauccgcgcugccgacgccgauaaggacucuaacgcucugcucguguaucauauugucgaaccgagcguucacacguacuucgcgaucgacuccucuaccggcgccauccauacagugcugagccucgauuaugaggagaccuccauuuuucacuucaccgugcagguccaugacauggggacaccucggcuguuugcugaauacgccgccaacgugacgguucacgugaucgauauuaaugacuguccgcccgucuucgcuaaaccucuuuacgaggccucucugcugcucccgaccuauaagggagugaaaguuaucacagugaacgcgaccgaugcugacagcuccgccuuuagccaacugauuuacucuaucacagaaggcaauaucggcgagaaguucuccauggauuauaagaccggggcccuuacgguccagaacacaacccagcugagaagccgguacgaacucaccgugcgcgcuucugacggaagauuugccggccugacauccgugaaaauuaaugucaaggagagcaaagagucucaccucaaguucacccaggauguuuauuccgcgguggugaaagaaaacagcacagaggccgaaacccuggcugucaucacggccauugggaaucccaucaacgagccucucuuuuaccauauucugaaucccgaccggcgcuucaagaucuccagaacaagcggagugcugucuaccacaggcaccccuuuugaucgggagcaacaggaggcuuucgacguuguggucgaggugacggaagaacacaagcccagcgccguugcucauguggucgugaaaguuaucguggaagaccagaacgauaaugccccugucuuugugaaccucccguauuacgcggucgugaagguugacaccgagguggggcacgucauuagauacgugacagccguggaucgcgacuccggacggaauggcgagguucacuauuaccugaaagaacaucacgagcauuuccaaaucggcccccuuggggaaauuucucugaagaaacaguucgagcucgauacccugaacaaggaauaucuggugacagucguggcuaaagacggaggcaauccugccuuuagcgcugagguuaucgugcccauuaccgucaugaacaaggccaugccuguguucgagaagcccuuuuacuccgccgaaaucgcugagucuauucagguccacagcccggugguucaugugcaggcgaacuccccugaagggcucaaagucuucuauucuaucacagauggagaccccuuuagccaauucaccaucaauuuuaacacgggcgugauuaauguuaucgcgccccuugauuucgaggcucacccugccuacaagcuguccauuagagccacagacagccugaccggggcucacgccgaaguguuugucgauaucauuguggacgauaucaacgacaaucccccuguguucgcgcagcagucuuaugccguuacccucuccgaggcuagcgucaucggaacaucuguggugcagguccgcgccaccgacuccgauagcgagccgaaccggggcauuuccuaccaaauguuuggcaaucauucuaaaagccacgaccauuuccacguggauuccagcacagggcugaucucucuucugagaacgcucgacuacgaacagucccgccagcacaccauuuuuguucgggcuguggauggaggcaugcccacacugagcucugacgucaucgugaccguugaugugacagaccugaacgauaauccuccccucuucgagcagcaaauuuaugaagccagaaucagcgagcaugcgccucacgggcauuucgugaccugcgugaaggccuacgacgcugauuccucugacaucgauaaacuucaguauagcauucuguccggaaacgaccacaagcauuuuguuaucgacucugccacgggcauuaucacccugagcaaucuccaccgccacgcucugaagcccuucuacucccuuaaccugagcgugucugauggggucuuuagauccagcacacaggugcaugugaccgucauuggaggcaaucuccacuccccggccuuccugcaaaacgaguaugaaguugagcuggcugaaaaugccccucuccauacacuugugauggaggugaaaaccacggacggcgauucugggaucuacggacacgucacauaucauauugugaacgacuuugcgaaggaucgguucuacaucaacgaacgcggccagaucuuuacccuggagaaacuggacagagagacacccgccgaaaagguuauuagcgugcggcucauggcuaaagaugccgggggaaaggucgcuuucuguaccgugaauguuauccugaccgacgauaacgacaaugccccucaguuucgcgccacaaaguacgaggugaacauuggcuccucugcggcuaaagggacgagcgucgugaagguccuugccuccgaugcugacgaaggcagcaaugccgacaucaccuaugccauugaggcugauucugaauccgugaaagagaaccuggagaucaauaagcucagcggaguuaucacaaccaaagaaucucugauuggccuggagaacgaguucuuuacauucuuugugagagccgucgacaaugggucccccagcaaggagucugugguucucguguacgucaagauccuuccucccgaaaugcagcugccgaaauucuccgagccuuucuauaccuuuacggugagcgaggaugugcccauuggaacagaaaucgaccugauucgggcggagcacucuggcaccguucucuacagccuggucaaggggaacacccccgaauccaauagagaugagagcuucgugaucgaccgccaauccggacggcuuaaacuggagaagucucucgaucacgaaacaaccaaaugguaucaguuuagcauccuggccagaugcacacaggacgaucaugagaugguggcuuccgucgacgugucuauucagguuaaggaugccaacgacaauagcccuguguucgaauccucuccguacgaggcuuuuaucgucgaaaaccugcccggcgggagccgcgugauucaaauccgggccuccgaugcggacagcggcacgaauggacagguuauguauucucucgaccagucccagagcguggaggucauugagucuuucgccaucaacauggaaaccggcuggaucacaacccuuaaagagcuggaucacgaaaagagagacaacuaccaaauuaaggugguggcuuccgaucauggggagaaaauccagcugagcucuacagccauuguugacgucaccgugacggaugugaaugacuccccuccccgguuuaccgcugaaaucuacaagggaacagucagcgaggaugacccucagggcgggguuauugccauccucucuaccacagaugcugacuccgaggaaauuaaccgccaggugaccuauuucaucacaggaggcgauccccuggggcaauuugccguggagaccauccagaaugaauggaaagucuacgugaagaaaccucuugacagagagaagcgggauaacuaucugcucacgauuacagcgaccgacggcaccuucagcagcaaggccaucguugaagugaaaguccuggacgcuaaugauaacucccccgugugugagaagacacuguacucugacacgauuccggaggauguucucccuggaaaacuuaucaugcagauuagcgccaccgacgcugauauccgcuccaaugccgaaaucacauauacccugcugggcucuggggccgagaaguuuaaacucaaccccgacacaggagaacugaagaccagcacaccucuugauagagaggagcaagcgguguaccaucugcucguccgggcuaccgacggcgggggacgcuucugccaggccuccauugugcugacgcuggaagaugugaaugacaacgcccccgaguuuucugcugauccguaugccaucaccgucuucgaaaauacagagccuggcacccuccuuacaagaguucaggcuaccgacgccgacgcgggccugaaccggaagauucuguacagccucaucgauuccgccgacgggcaguucagcauuaaugaacugucuggaaucauccaacuugagaaaccccuggaucgcgagcuccaggcuguguacacgcugucccugaaggccguggaccagggccuccccagacggcuuacagcuaccgggacagucauuguuagcgugcuggauaucaacgacaauccucccguguuugaauauagagaguacggagccaccgucucugaagauauucuggugggcacggagguucuccagguguaugcggccucccgcgacaucgaagcuaacgccgagauuaccuacagcaucauuuccgggaacgagcacggaaaauucucuaucgauagcaagacaggcgcugucuuuaucauugaaaaucuggacuaugaguccucucacgaauacuaucuuaccguggaggccacagauggcgggaccccuagccuguccgacguugcuacagugaacgucaaugugaccgauaucaacgacaauacgccggucuucagccaagacacauacaccaccgugauuucugaagaugccguucucgagcaguccgugaucacagucauggcggacgaugccgacggacccagcaacucucacauucauuacagcaucaucgauggcaaucagggguccucuuuuaccauugacccugugcggggagaggugaaaguuacaaagcugcuggauagagaaacgaucagcggcuauacccucacaguccaggcuuccgacaacgggucucccccucgcgugaauaccacaaccgugaacauugauguuuccgacgucaaugauaacgcccccguguucucccggggaaauuacagcgugaucauucaagagaacaagccugucggcuuuuccgugcuucagcugguugugacggacgaagauucuagccacaauggcccgcccuucuuuuucaccaucgucacagggaacgacgagaaagccuuugaggugaacccucagggaguucugcucaccuccucugcuaucaagagaaaagaaaaggaccauuaucugcuucaagugaaagucgccgauaauggcaagccccagcugagcucccucacauacauugacauccgcgugauugaggaaucuaucuauccucccgcgauucugccgcuggagaucuucauuaccagcuccggggaagaguacagcggaggcgugaucgggaaaauccacgcuacggaucaggacguuuaugauacacucaccuacucucuggacccucagauggauaaccucuuuagcgucagcucuacaggaggcaagcugauugcccacaagaaacucgacaucggccaauaccugcuuaauguguccgugaccgaugggaaguucaccacagucgccgacauuacggugcauauccggcagguuacccaggagaugcugaaccacacaauugcuaucagauucgccaaucucacccccgaagaguuugugggagauuauuggcgcaacuuccagcgggcucugagaaauauccugggcguccgccggaacgacauucaaaucgugagccuccagucuagcgaaccccauccucaccuggacguucuucuguuuguggagaaacccggguccgcccagauuagcacaaagcagcuccugcacaaaaucaauuccucugucaccgauauugaagagaucaucggagugcgcauucuuaacguuuuccaaaagcugugcgcgggccucgacuguccuuggaaguuuugcgaugagaaagugagcgucgacgaauccgugaugucuacgcauagcacagcccgccuguccuucgugaccccgagacaccaucgggcugccgucugucugugcaaggaggggcgcugucccccuguucaccauggaugcgaagaugaccccuguccugagggcucugaaugcgugagcgaucccugggaggagaaacacaccugugugugcccguccggcagauuugggcaguguccuggauccucuagcaugacacucaccggcaauagcuacgucaaguaucggcugacagaaaacgagaauaaacuugaaaugaagcugacgaugagacuccggaccuacucuacacacgcugugguuauguaugcccgcgggaccgacuacuccauccuggagauucaucacggaagacuucaguacaaguucgauugcggcagcgggcccggaaucgugucuguccaauccauucaggugaacgacggccaguggcaugcgguugcccuggaggugaauggcaacuaugcucggcucguccuggaucaggugcacacagccagcgggaccgcuccuggaacgcugaaaacccucaaccuggacaauuacgucuuuuucggcgggcauauccgccaacagggaacaagacacggccggucuccccagguggggaacggauuucgcggcugcauggauuccauuuaucuuaauggccaggaacugccgcucaacagcaagccuagauccuacgcccacaucgaggaaagcguugacgugucucccggguguuuccugaccgccacagaggacugcgcuagcaaucccugucaaaacggaggcgucugcaauccuucccccgccgggggauauuacuguaaaugcucugcccuuuauaucggcacccauugugaaauuagcgugaacccuugcuccucuaagccgugucuguacgggggcacaugcguuguggauaauggaggcuucgucugucagugccgggggcucuacaccggacagcgcugccagcugagccccuauuguaaagacgagccuugcaagaacggcgggacguguuuugauucccuggacggagcugugugccaaugugauagcggcuucagaggggagcggugccagucugacaucgaugaauguuccggcaaucccugccuccacggagcccugugugagaacacacauggcagcuaccacugcaauuguucucacgaauaucgcgggagacauugcgaggacgccgcuccuaaccaguacguguccacccccuggaauauuggacuugccgaaggcaucgggauuguugucuuuguggcgggaaucuuccugcucguggucguguuuguucugugccggaagaugaucagccgcaaaaagaaacaccaggcugagccuaaggauaaacaucuuggcccggccaccgccuuccugcaaagacccuauuuugacucuaagcucaacaagaacauuuacuccgauaucccuccccaggugccuguccggcccauuagcuauacaccguccaucccuucugacagcagaaauaaccuggaucgcaauuccuucgaggggagcgcuauucccgaacaccccgaguuuucuacguucaacccugaauccgugcauggccaccggaaagccguugcuguguguagcgucgcccccaaucugccuccgcccccucccucuaacagcccuuccgacucugacagcauccagaagcccuccugggauuuugacuacgauaccaaagugguugaccucgauccgugccugagcaagaaaccucuugaggaaaagcccucucaaccuuacuccgcgagagagagccugucugaggugcagucccucagcuccuuccagucugaaagcugugacgauaauggauaucacugggacacauccgauuggaugcccucugucccucugcccgacauccaggaguuuccgaacuacgaagugauugaugagcaaacaccccuuuauagcgccgacccuaaugcuaucgacacagauuacuaucccggcggguacgacauugaguccgauuucccuccgcccccugaagacuuccccgccgcugaugagcugccuccccucccucccgaauuuagcaaccaguucgagucuauccauccgccucgcgacaugcccgccgcgggaucccugggcuccucuucccggaauagacagcgcuuuaaccugaaucaguaucucccuaacuucuacccccuggauaugagcgaaccgcaaaccaaagggacaggagaaaauucuaccugccgggagccucacgcccccuaucccccuggcuaucagagacauuuugaagcucccgccguggaguccaugccuaugagcgucuacgcuagcacggccuccuguucugacguuagcgccugcugugaaguggaguccgaagugaugaugucugauuaugagagcggggacgauggccacuucgaggaagucaccauuccgccccuugacucccagcagcacacagagguguga

SEQ ID NO: 69190 - RNA, 13050 nt, Artificial Sequence
  derived and/or modified sequence opt5 from FAT2__Homo_sapiens__XP_011535905
augaccaucgcccugcucggcuucgcuaucuuucugcuucacugcgccacgugcgaaaagccccuggaagggauccucagcuccucugccuggcacuucacgcacagccauuacaaugcuaccaucuaugaaaauagcucuccuaaaacauacguggaauccuucgaaaagaugggaaucuaucuggccgaaccgcagugggccgugcgcuaccggauuaucuccggcgauguugcuaacguguucaaaaccgaggaguauguggucgggaauuuuugcuuccuucgcauccggacaaagucuagcaacaccgcccugcucaaucgggaagugcgcgauuccuacacacugauuauccaggcuaccgagaaaacgcuggaacucgaggcccugaccagaguugugguccacauucuugaccagaacgaucugaagccccucuuuagcccucccucuuaucgggugacaaucuccgaggacaugccucugaagucucccauuuguaaaguuaccgcgacagaugccgaccuuggacagaaugcugaguucuacuacgccuuuaacacccgcucugagauguucgcuauccauccuacguccggcguggucacaguggccgggaagcugaaugugaccuggagaggaaaacacgaacuccagguccuggcgguugaucggaugcgcaagauuagcgagggcaacggcuuugggucucuggccgcucucguggugcacgucgaaccggcccugagaaaacccccugcuaucgccuccgugguugugacacccccugacagcaaugauggaaccaccuaugccacaguccuuguggacgcuaacuccucuggcgcggagguugagagcguggaagucgucggaggggaucccggcaagcauuucaaggccaucaaauccuacgcucggagcaaugaguuuucucuggucuccgugaaggacauuaacuggauggaauaucuccacggguucaaucugagccuucaggcccgcucuggaagcggcccguacuucuauucccagaucagaggcuuucaucugccucccucuaaacucagcucccugaaguucgagaaagccguuuaccgggugcagcugagcgaauuuucuccucccgggucccgcgucgugaugguuagagugacgcccgcuuucccuaaccuccaguauguccugaagccgagcucugagaacgugggauuuaaacuuaaugcccggaccggccugauuacaaccacaaagcucauggauuuccacgacagagcgcacuaccaacugcauauccgcaccucccccgggcaggcuagcacggugguugucauugacaucguggauugcaacaaucacgccccucuuuuuaaccgguccucuuacgacggaacacuggaugagaauauuccgccuggcaccagcgugcucgccgucaccgcuacagacagagaucauggggaaaacggauaugugaccuacuccauugccggccccaaggcucugccguucucuaucgacccuuaucugggcauuaucagcacauccaaacccauggauuacgagcucaugaagcgcauuuauacguuucggguuagagccagcgacugggggucuccuuuccgccgggaaaaagagguguccaucuuucugcagcuuagaaaucugaacgauaaucagcccauguucgaagaggucaacuguaccggaagcauccgccaagacuggccugugggcaagucuauuaugacaauguccgcgaucgauguugacgagcuccagaaucugaaauacgaaauugugagcgggaacgagcuggaauauuuugaccuuaaucacuucucuggagucaucagccucaagcggcccuucauuaaccugaccgccggccagccgacauccuacagccugaagaucaccgcuucugaugggaaaaauuacgccuccccuacgacccucaacauuacagugguuaaggacccccauuuugaggugcccgugaccugcgauaaaacaggcgugcugacccaauucacgaagacaauccuucacuuuaucggacugcagaaccaggagagcuccgacgaagaguucaccucucucagcacauaucagauuaaucacuacaccccucaauuugaagaucauuucccgcaguccaucgacgugcuggagucuguccccauuaacaccccucuggcuagacuugccgcgacagaucccgacgccggcuuuaaugggaaacucguuuaugugaucgcugauggaaacgaagagggcuguuucgacauugagcuggaaacggggcugcucaccguggccgcuccucuggauuacgaggccacaaauuuuuauauccuuaacgucaccguguacgaccugggaacaccccaaaagagcuccuggaagcuccugaccguuaaugugaaagauuggaacgacaaugccccucgcuuucccccgggcggguaucagcugacgaucucugaagacacagaggucggcaccaccauugcugaacuuacaaccaaggaugcggacagcgaggauaacggacgggugagauacacacuccuguccccuacggagaaauuuagccugcacccccucaccggcgaacugguugugacagggcaucuugaccgggagucugaaccucgcuacauccugaaggucgaggccagagaucaacccuccaaaggacaccagcuguucagcgugaccgaccugauuaucacacuggaagauguuaaugacaacucuccgcagugcauuaccgagcacaaucggcuuaaggugccugaggaucugcccccuggcacgguccugaccuuucuggacgcuuccgaucccgaccucgggcccgccggagaagugagauaugugcugauggauggcgcccaugggacauuccgcgucgaccuuaugaccggcgcucugauccucgagcgggaacuggacuucgagagacgcgccggauacaaccugagccuuugggcgucugauggcgggagaccucuggcucggcgcacacucugucacguugaggugaucgugcuggacgucaaugaaaaccuccauccgccccacuuugccuccuucgugcaucagggacaaguucaggagaacagcccuuccggcacccaggugauugucguggccgcucaggaugacgauagcgggcuggacggagaacuucaauauuuucugagagccggcacagggcucgcggcuuucucuaucaaucaggauaccggcaugauucagacgcuggcuccccucgaccgggaguuugccagcuacuauuggcuuacaguucuggccguggaucgcggauccgucccucucucuagcgugaccgaagucuacaucgaggugaccgacgccaacgauaaucccccucaaaugucccaggcuguuuucuauccgucuauucaggaggacgcccccgugggcacaagcguccugcagcucgacgcgugggauccugacuccucuagcaaggggaaacugaccuuuaacaucacguccggaaauuacaugggcuucuuuaugauccaccccgugacagggcuucugagcaccgcccaacagcucgauagagaaaacaaggacgagcacauucuggaaguuacagugcuggauaauggagagccuucucuuaaauccaccagccgggucguggugggcauccuggacguuaacgauaaucccccgauuuucucucauaagcucuuuaacguccgccugccugaaagacucucccccgugagccccggcccuguguaccggcuggucgcuuccgaccuugaugaggggcugaauggacgcgugacauauucuaucgaggacagcgaugaagaggccuucuccauugaccugguuaccggcguggucuccucuuccagcacguucaccgcuggggaauacaacauccucacaauuaaagccaccgauucuggacagcccccucugagcgccuccgugagacuucacaucgaguggaucccguggccccggccuucuagcauuccccuggcuuuugacgaaacauauuacuccuucaccguuauggagacggacccugugaaucauauggucggcgugaucucuguugaggggagacccggacucuuuugguucaacauuagcggcggcgauaaggacauggauuuugacaucgagaaaacgaccggguccauugugaucgcgcgcccgcuggauacacggagacgcagcaauuauaaccucaccgucgaggugaccgacggaucucggacaaucgccacacaggugcacauuuucaugaucgcuaacauuaaucaucacagaccucaauuucuggaaacccgcuacgagguccggguuccccaggauacagugccuggcguggagcuucugagaguccaggccaucgaccaggauaaggggaagucccugauuuauaccauccacggaagccaagaccccggcuccgccucucucuuccagcuggauccuagcuccggggugcuuguuacagugggaaaacuggaccucggcucuggccccagccagcauacccugacggucauggugcgcgaucaagaaaucccgauuaagcggaacuuuguuugggugacaauccacgucgaggacgggaaucuccauccucccagauucacccagcugcacuacgaggcuuccgugcccgacaccauugccccuggaacagagcuucugcagguccgggcgauggaugcugaccgcggcgugaacgccgaaguucacuacagccugcucaaaggaaauucugagggauuuuucaacaucaaugcccugcuuggcauuaucacccuggcucagaagcucgaucaagccaaccaugcgccgcacacacugacggugaaagcugaggaccaggggagcccccaguggcaugaucucgccaccgugauuauccacgucuauccuagcgacagaucugcccccaucuuuuccaagagcgaauacuucguugagauuccugaaucuauccccgugggaagcccuauucugcuuguguccgcuaugucuccgagcgaggucacauaugaacugcgggagggcaauaaggauggcguguucuccaugaacagcuacuccgggcugaucucuacccagaaaaagcucgaccaugagaaaauuagcuccuaucaacugaagauccgcggaucuaauauggccggcgcuuuuacagauguuaugguggucguggacaucauugaugaaaacgacaaugcccccauguuccuuaaaagcaccuuugucgggcagaucuccgaggcggccccucuguacucuaugauuauggacaagaacaauaaccccuucgugauccacgcuagcgauuccgacaaggaagccaauagccuccugguuuauaaaauucuggagccugaagcucucaaguuuuucaaaaucgaucccucuaugggaacgcuuaccaucguguccgagauggacuacgagagcaugccgucuuuucaguucugcgucuacgugcacgaucagggcuccccuguucuguuugcccccagacccgcccaagugauuauccauguccgggacgugaacgauagcccucccagauucucugaacagauuuaugagguggcuaucguugggccuauucacccgggaauggaacugcucaugguccgcgcguccgacgaggauagcgaggugaacuacuccaucaagacaggcaaugccgacgaagcugugaccauucaucccgucacaggcagcaucucuguucugaacccugccuuucuugggcugagccggaaacucaccaucagagccuccgauggacuguaucaggacacagcucuggugaagauuucucucacacaggugcuugauaagagccugcaauucgaccaggacgucuacugggccgcggugaaagagaaucugcaggaucgcaaggcucucguuauccugggcgcccaagggaaccaccuuaaugacacccuguccuauuuucuccugaacggaacagauauguuccacauggugcagucugccggcguccugcagaccagagggguggcuuucgacagagaacagcaagauacccaugagcucgccguugaagugcgcgacaaucggacaccccagagagucgcgcagggacuugugcgcgugagcauugaggaugucaacgacaauccucccaaauuuaagcaccuccccuacuauacgaucauucaggauggcaccgagccuggcgacguucuguuccaaguguccgccacagaugaagaccucgggaccaacggagcugugacauacgaguuugccgaagacuacaccuauuucagaaucgaucccuaccugggcgacaucucucuuaaaaagccuuuugauuaucaggcucugaauaaauaccaucucaaggucauugcccgggacgggggaacgcccagccugcaguccgaggaagaggugcugguuacagugcgcaacaagagcaauccucucuuccagucucccuauuacaaagucagagugccggagaacaucacccuuuauaccccuauucugcacacacaagcucggucccccgaaggccugcgccucaucuacaauauuguugaggaagaaccccugaugcuuuuuaccacagauuucaagaccggggugcugacggucacaggaccucucgacuacgaaagcaaaaccaagcauguguuuacaguuagagccaccgauacggcgcugggcucuuucuccgaggccaccguggagguccugguggaagacgucaacgauaacccgcccacauuuagccagcucguguauaccacauccaucucugagggccuuccugcucagacccccguuauccaacugcuggccagcgaccaggauuccgggcggaauagagacgugagcuaccagauugucgaagauggaucugacguguccaaauucuuucagaucaacggcagcacaggggagaugucuaccgugcaagagcucgacuaugaagcucagcagcacuuccacguuaaggugcgcgccauggauaagggagacccuccccugacgggcgagacacuugucgugguuaaugugagcgauauuaacgacaauccucccgaguuccggcagccgcaauacgaggccaacgucuccgaacuggcuaccugugggcaucucgugcugaaaguccaggcgaucgauccugacucuagagauaccagccgccuggaguaucucauucuuuccggcaaucaggaccggcacuuuuucaucaacucuagcuccggaauuaucagcauguuuaaucugugcaagaaacaucuggauucuuccuacaaccucagagugggcgccagcgacgggguuuuccgggcuacagugcccgucuauaucaauaccacaaacgccaauaaguacuccccugaguuucagcaacaccuguacgaagccgagcuugcugaaaacgccauggugggaacgaaaguuauugaucugcucgcgaucgacaaggauucuggccccuaugggaccauugacuacacaaucauuaauaagcuggccagcgagaaauucuccaucaacccgaacggacagaucgcuacccugcagaagcucgaccgcgaaaauucuacagagagagugauugccaucaaagucauggcucgggauggcgggggccgcguggccuuuugcaccgugaagauuauccuuacggacgagaacgauaauccuccccaguucaaagcgagcgaauauaccguuuccauucaaagcaacgucucuaaggacucccccgugauccaggugcuggccuacgaugcugacgagggacagaaugccgaugucacauauagcgugaacccugaagaccugguuaaggaugugaucgagauuaaucccgucaccggcgugguuaaagugaaggacucucucgucgggcuggaaaaccaaacacuugacuuuuucaucaaagcucaggacggaggcccuccgcacuggaacucccuggugcccguuagacuccagguggucccuaagaaagugagccugcccaaguuuucugagccucuguacaccuucuccgcccccgaggaccucccugaagggagcgagauuggaaucgugaaggcugucgccgcgcaggauccgguuauuuauucucuugugcggggcacgacacccgaaagcaacaaagacgggguguuuucccuggauccugacaccggcgucaucaaggugcgcaaacccauggaucaugagagcacaaagcuguaccaaauugacguuauggcccacugucuccagaauaccgauguggucucccuggugucuguuaacauccaggugggagacgucaaugauaacagaccuguguucgaggcugaccccuacaaagccguccuuaccgaaaauaugccggugggcacaagcguuauccaggugacggcuauugauaaggacaccgggcgggauggacaagucuccuaucgccugucugccgacccuggcagcaacgugcaugaacucuucgccaucgacuccgaaucuggguggauuacaacccugcaggagcuggauugcgaaacaugucagaccuaccacuuucauguuguggcguaugaccacggacagacgauccaacucagcucccaggcucuuguccaggugagcauuacagaugagaacgacaaugcccccagauucgcuucugaggaauaccggggcuccgugguugagaacagcgaacccggcgagcuggucgccacccugaaaacccucgaugccgacaucucugaacaaaauagacaggugacaugcuauaucaccgagggggauccucugggacaguuuggcauuucccaggugggggacgaguggcgcaucagcucucggaagacacuugauagagaacacacggcuaaguaccugcuccgcgucaccgccuccgacggaaaauuccaagcgagcgugacaguugagauuuuugugcuggaugucaacgacaauucuccccaguguucccagcugcucuauaccggcaaggugcaugaagauguuuucccugggcacuuuauccugaaagugagcgccacagaccuugacaccgauacgaacgcucagauuaccuacagccugcauggaccgggcgcccacgaguucaagcucgacccccauacaggcgaacugaccacacuuaccgcucuggaucgggagagaaaagacgucuuuaaucucguggccaaggcgacagaugggggaggccgcuccugccaagccgacaucacccugcacguggaggauguuaacgacaaugcuccucgguucuuucccucucacugugccgucgcuguguucgauaacacgacagugaagaccccugucgccguuguguuugcuagagaccccgaucagggggccaaugcccagguggucuacagccugccggacuccgccgaaggacauuucucuaucgacgcuaccacaggcgugauucgccucgagaaaccucugcagguucggccccaagccccucuugaacugacggugagagcuagcgaucucgggacccccaucccgcuguccacacuuggaaccgucacagugucuguugugggccuggaggacuaucucccugucuuccugaacaccgagcacagcguccaggugcccgaagaugcgcccccuggcacagagguccugcagcucgccacccugacgcgccccggggcggaaaagaccggauaccggguuguguccggcaaugagcaagggagauuucgccuugacgcuagaacagggauucuguaugugaacgccagccucgauuucgaaaccucuccuaaauacuuucuguccaucgagugcagccggaagucuuccagcucccuuucugacgucacaaccguuauggugaauauuacggaugugaacgagcaucgcccgcaguucccccaggacccuuauagcacaagaguccuggaaaacgcccucgugggcgauguuauccugaccguguccgcuacagacgaggaugggccccucaauucugacaucaccuacagccucauuggaggcaaccagcugggccacuuuacgauccacccuaaaaagggggaacuucaagucgccaaggcucuggaucgggagcaggccuccagcuauucucucaaacugagagcgaccgacuccggacagcccccucuucaugaagacacagauauugccauccagguggcugacguuaaugauaacccgccccgguucuuucaacugaauuacagcaccacagugcaggagaacucuccuauuggcagcaagguccuccagcugauccuguccgaccccgauucuccugagaaugggcccccguacagcuuccgcauuaccaaaggaaacaauggcuccgccuuuagagugacaccugacggguggcucgucaccgcugaaggacugagccggcgcgcccaggagugguaucaacuucagauccaggcgucugauuccggcauuccgccccugagcucccucacgucugugagaguucacgugacagaacagagccauuacgccccuuccgcucugccccuugagauuuucaucaccgucggcgaagacgaguuucaagggggaauggugggcaagauucacgccaccgaucgggacccucaggauacacugaccuauucucucgcugaggaagagacacuggggcgccauuucagcgugggagccccggacggcaaaaucauugcugcccaggggcugcccagaggacacuacuccuuuaacguuacggucucugauggcaccuucacaaccacagcgggcgugcacguguauguuuggcaugucgggcaagaagcccuccagcaggcuauguggaugggauucuaccagcugaccccugaggagcuugugagcgaccacuggcggaaucugcaacgcuuucucucccauaagcuggacaucaagagagccaacauccaccuugccagccugcagcccgcugaagccguggcgggcgucgaugugcuccugguuuucgaggggcacucuggaacguuuuaugaguuccaggagcuggcuuccauuaucacccauagcgccaaagaaauggagcacucugugggcguccagaugcgguccgccaugccuauggugcccugucaagggccgacaugccagggacagauuugucauaauaccguucaccucgacccuaaggugggccccacauacagcaccgcucgccugucuauccuuacgccuagacaucaucugcagcggagcugcuccugcaacggcacagccacccgcuuuagcgggcaauccuacgucagauaucgggcucccgccgcgagaaauuggcacauucauuucuaccucaaaacacugcagccucaggccauccuucuguuuaccaacgagaccgcuucugugagccucaagcuggccuccggagugccccaacuggaauaucacugucuuggcggguucuacggaaaccugucuagccagcgccauguuaaugaucacgaguggcauuccauccucgucgaagagauggacgcuucuauucggcugaugguggauagcaugggcaacacaucccucguggucccggaaaauugcagagggcugcgccccgagcggcaccuucugcugggcggacucauccugcuucacagcagcuccaacgugagccagggcuuugaggggugucuggacgccguuguggucaaugaagaggcgcucgaucugcucgccccuggaaaaacgguggcuggccugcuggaaacccaggcccuuacacaaugcugucugcauucugacuauugcucccagaacaccugucucaaugggggaaagugcagcuggacacacggcgcuggguacguuuguaaaugucccccucaguucucuggcaagcauugugagcagggaagagaaaacugcaccuuugccccgugccuggagggcgggacguguauucuuucccccaagggagccagcugcaauuguccucaccccuacacaggcgaucgcugcgagauggaagcucggggguguucugagggacacugccuggugaccccugaaauccaaagaggcgacugggggcagcaggagcuccugauuaucaccgucgcgguggccuucauuaucaucuccacaguuggccuccuguucuauugucgccggugcaaaagccauaagcccguggcuauggaggauccugaccugcuugccagauccgucggaguggacacccaggccaugcccgcuauugaacugaacccgcucagcgccucuagcuguaauaaccugaaucaaccugagcccuccaaagcgucugugccuaacgaacuugucacauuuggccccaauagcaagcagcgcccgguugugugcuccgugccuccccggcugcccccugcugccguccccucucacagcgauaacgagccugugaucaaaagaacgugguccagcgaagagaugguuuaccccgggggagccaugguguggcccccuaccuauucucggaacgagagaugggaauacccccauuccgaggucacacagggcccucugcccccgagcgcucaccgccauucuaccccugugguuaugcccgaaccuaaugggcuguauggaggcuuccccuuuccucuggagauggaaaacaagcgggcgccccucccgcccagauacuccaaucagaaccuggaggaccuuaugccuagcagacccccuucucccagagagcggcugguggcuccuugucucaaugaauauacagccauuuccuacuaccacagccaauuccgccaagggggcggaggcccgugccuggcggaugggggauauaagggcgucgggaugagacuuucccgggccggacccucuuacgcugugugcgaggucgaaggcgccccucuggcuggccaggggcaaccccgcgugccucccaacuaugagggaagcgacaugguugaauccgauuacggcagcugugaggaggugauguuuuga

SEQ ID NO: 69191 - RNA, 13674 nt, Artificial Sequence
  derived and/or modified sequence opt5 from FAT3__Homo_sapiens__NP_001008781
auggacaucauuaugggacacugcguggggaccagacccccugccugcugccugauccuccugcuuuucaagcugcucgcuacggugagccagggacugccgggcacggggccccuuggauuucauuucacccacuccauuuacaacgccacaguuuacgaaaacucugccgcucggaccuacgugaacagccaguccagaaugggcaucacacugauugaucucucuugggacaucaaauauagaaucgugagcggggaugaagagggauuuuucaaggccgaagaggucauuaucgccgacuuuuguuuccugcggauuagaaccaaaggcggcaauuccgcuauccugaacagagaaauucaggauaauuaccuccugaucgugaaggggucuguucggggagaggaccuugaggccuggacaaaagugaacauucagguccuggauaugaaugaccuccgcccucuguuuagccccaccacguauuccgugaccaucgcugaaagcacaccucuuagaaccucuguugcccaggugacagcgaccgaugccgacaucggcuccaacggggaguucuacuauuacuuuaagaauaaggucgaucuguucagcgugcaucccacgucuggagugauuucccucagcggccggcugaacuacgacgagaagaauagauaugaucuggagauccucgcugucgacagagggaugaagcuguacggaaacaauggcguuucuuccacagccaaacuuuaugugcacauugagcggaucaacgaacaugcuccuaccauucacguggucacacacgugccguuuagccuggagaaggaacccaccuacgccguugugaccgucgacgaucucgacgauggcgcgaauggggagaucgaauccgugucuaucguugccggagacccucuggaucaauucuuucuugcuaaagagggcaaguggcugaacgaguauaagauuaaagaacgcaagcagaucgacugggagagcuuccccuacggguauaaccucacacugcaggccaaagauaagggauccccucagaaaugcagcgcucugaaggccguguacauuggcaaucccacgagagacaccgucccgauccgguucgaaaaagagguguacgaugucucuauuuccgaauuuagcccucccggggugguuguggccaucgucaagcucucuccugagcccaucgacguggaguauaagcugagccccggagaagaugcuguuuacuucaaaauuaacccucgcuccggccuuaucgugacagcgagaccgcugaauaccgucaagaaagagguguauaagcucgaagugacaaacaaagagggcgaccugaaggcccaaguuaccauuucuaucgaagacgcuaaugaucauacgcccgaguuucagcagccucuuuacgacgccuaugucaacgagagcgugcccguggggacauccguccugaccgugagcgccucugauaaggacaaaggagaaaauggcuacauuaccuauuccaucgcuagccucaaccugcugccuuucguuauuaaucaguuuacaggggugaucucuaccacagaggaacucgauuucgaguccagccccgagaucuaccgguuuauugucagagccuccgacuggggaucuccguaccgccacgaaagcgaggugaacguuacgauccggauuggcaaugugaacgauaauuccccucuguucgaaaaggucgcgugucaaggggugaucucuuaugacuuucccguuggcggacauauuaccgcugugagcgccaucgauaucgacgagcuugaacuggucaaauacaagauuaucuccggcaacgagcucggguucuuuuaucugaauccugauagcggagugcugcagcuuaaaaagucucucacaaacuccggcauuaagaacgggaauuucgcccugagaaucaccgcuacagacggagagaaccuggccgaucccaugagcauuaauaucucugugcuccacggcaaagucuccagcaagucuuuuagcugccgcgaaacccggguugcucagaaacuggccgagaaacuucugaucaaagcgaaggccaacgggaagcucaaucuggaagacggcuuccuggacuucuacuccauuaacagacaaggaccuuauuuugauaagagcuuccccucugacguggcugugaaggaggaucuuccggucggcgccaauauccucaaaauuaaggcuuacgacgccgauuccggguuuaacggaaaagugcuguucacgaucagcgacggcaauaccgauuccuguuuuaacauugacauggaaacagggcagcugaagguucucaugccuauggaucgcgagcacaccgaccuguaucuucugaauaucacaaucuacgaucucggaaacccccagaaaucuagcuggcggcugcugaccauuaauguggaggacgcgaacgauaauucccccgucuucauccaggacucuuacagcgugaacauucuugaauccucuggcaucgggacggagauuauccaaguugaagccagagacaaggaucucggcagcaacggagaggugacauauuccguccugaccgacacacagcaguuugcuauuaauagcucuaccggcaucguguacguugccgaucagcuggaccgcgaauccaaggcuaacuauagccucaaaaucgaggcccgggauaaggccgagucugggcaacagcuguucuccguggucacccuuaaaguguuucuggacgaugugaaugacugcagcccugcuuucauuccgucuuccuacagcgucaagguucucgaagaucugcccgugggaacagugaucgcguggcuggagacgcaugacccugaucuuggccucgggggacaggucagauauucccuggugaacgacuacaauggccgcuuugaaauugacaaagccagcggggcuauccggcugucuaaggagcucgauuaugagaagcagcaauucuacaaccugaccguuagagccaaagacaagggccggcccgugagccuuuccucugucagcuuuguggaaguugagguggucgaugugaaugaaaaccugcacacaccuuacuuccccgacuucgccgucgugggauccguuaaagaaaauucucgcauuggcaccagcgugcuccaggucacagcuagagaugaagacuccgggcgggauggagagauccaguauucuaucagagacggcagcgggcugggacgcuuuuccauugaugacgagagcggcgugaucaccgccgcggauauucuggaccgggaaacgaugggcucuuacuggcuuacaguuuaugcuaccgauagagggguggucccucuguacuccaccaucgagguguauauugaaguggaggacguuaacgacaaugcgccccucacaagcgaaccgaucuacuauccugucgugauggagaacucucccaaggauguguccgucauccagauucaagccgaggacccugauagcuccucuaaugaaaaacugaccuaccgcaucacaagcggaaacccccagaauuucuuugcuauuaacaucaagacgggccucauuaccacaaccuccagaaagcuggaccgggagcagcaagccgaacauuuccuugaggugacaguuaccgaugggggaccgagcccuaaacagucuacgaucuggguggucgugcagguucuggacgaaaacgauaauaagccccaguuuccugagaaaguguaccaaauuaagcuccccgagcgcgaccgcaagaaacggggcgaacccaucuaucgcgcguucgcuuuugauagagacgaggggccuaacgccgaaaucuccuacagcauugucgauggaaaugacgauggcaaguucuuuaucgacccgaaaaccggcauggugucuagccggaagcaguucacagccggguccuaugacauucugaccaucaaagcuguugauaacggacgcccccagaagucuagcacagccagacugcacauugaguggaucaaaaagccucccccuucccccaucccucuuaccuuugacgagccguucuacaauuucacagugauggaaucugaucgggucaccgagauugugggcguggucagcguucagcccgcuaacacgccucugugguuugacaucgucggcgggaauuucgauuccgccuuugacgcggaaaaagggguggggacaauugucaucgccaagccccucgaugcugagcaacgcagcauuuauaacaugucuguggaaguuaccgacggaaccaauguggccgucacacagguguucaucaagguucuggauaacaaugacaacggcccugaguuuucccagcccaauuacgaugugaccaucagcgaggacguccucccggacacggaaauucugcagaucgaggcuacagauagagacgaaaaacauaaacuuuccuauaccgugcacucuagcauugauuccaucucuaugcggaaauucagaauugacccuagcacaggcguccuguacaccgccgagcgccucgaucacgaagcccaagacaagcauauccugaacauuauggugcgggaucaggaguuucccuacagacgcaaucuggcucggguuaucgugaacguggaggacgcgaaugaucacucccccuauuucacaaacccucuuuacgaagccagcgucuuugagucugcugcccugggguccgccguucuccaggugaccgcucuggacaaagauaagggagaaaacgccgagcucaucuauacgauugaagcgggcaauaccgggaacauguucaagaucgagcccgugcugggaauuaucacaauuuguaaagagccugacaugaccacaaugggccaauuuguccuuagcaucaaggugaccgaucaggggucuccgcccauguccgcuacggccaucguuagaauuagcgugacaaugucugacaauagccauccuaaauucauccacaaggacuaccaggccgaagucaacgagaauguggauauuggaaccuccgucauccugauuucugcuaucagccaguccacacugaucuaugaagugaaagacggcgauauuaacggcaucuuuaccauuaaucccuacagcgggguuaucaccacacaaaaggcccucgacuaugagcgcacguccucuuaccagcugauuauccaggcgaccaacauggcuggaauggccagcaaugccacagugaacauucagaucgucgaugagaaugacaacgcuccuguguuccuuuucucccaauacucuggcagccuguccgaagccgcucccaucaauucuauuguucggagccucgauaacuccccgcuggugaucagagccaccgacgcggauagcaaucgcaacgcccuccuggucuaucagauuguggagucuacagcuaagaaauuuuucaccguggacuccagcacgggggccauccggacaauugcuaaccuugaucacgaaaccaucgcccauuuucacuuccauguucacgucagagacucuggauccccucagcugaccgccgagagccccguggaagugaauaucgaggucacagacguuaacgauaauccucccguguuuacccaggcuguguucgagacaauucugcuccugccuacguacgucggcguggaaguucuuaaggugucugcgaccgaccccgauuccgaggucccgccugaacugacauauagccucauggaggggucccuggaccauuuucucaucgauagcaacucuggagugcugaccauuaaaaauaacaaucuuagcaaggaccacuacaugcugaucguuaaaguguccgauggcaaguucuauucuacaagcauggucaccauuauggugaaggaagccauggacuccggccugcacuuuacgcaaucuuucuacagcaccuccaucucugagaacaauacaaacaucaccaaaguggcuauugucaaugccguugggaaccggcucaaugagccccugaaguauagcauccuuaaccccggaaauaaauuuaagauuaaauccacaagcggcgugauccagaccacaggggugccuuucgaucgcgaggagcaggaacuguacgagcucgucguggaagccucuagagagcuggaccaucuccggguugcucgcguggucgugagaguuaacauugaggauaucaacgacaauuccccgguguuugucggacugcccuacuaugccgcggugcagguugaugcugaaccuggcacgcuuauuuaccaagugaccgccaucgacaaggacaaggggcccaacggagaggucacauaugugcugcaggaugacuacggccacuucgaaaucaauccuaacagcggcaaugucauucugaaagaggccuucaacucugaucucuccaauaucgaguauggggugaccauucuggcuaaggacggaggcaaacccagccuuuccaccucuguugaacugccuaucacaauugugaacaaggccaugccggucuuugauaaacccuucuacacggcgagcgugaaugaggacauccggaugaacaccccuauccucuccauuaaugccacaagccccgaagggcagggaaucauuuauaucauuaucgauggcgacccuuuuaagcaauucaacaucgauuuugacaccggggugcugaaaguugugucuccccuggauuacgaggucacauccgcuuacaagcucaccauuagagccagcgacgcucuuacgggagcccgcgcugaagugacaguugaucugcuggugaaugacgucaacgacaauccgccuaucuucgaucagcccaccuauaacaccacacucucugaggccagccugauuggcacccccgugcuucaggucguguccaucgacgcggauucugagaacaauaagaugguucauuaccagauugugcaagacacauauaacagcaccgauuacuuucacaucgacuccucuagcggccugauccucacggcccggaugcuggaucaugaacugguccagcacugcacacucaaagugagauccauugacagcggguucccuucucuuuccagcgagguucuggugcacaucuauauuuccgaugucaaugacaaucccccuguguuuaaucagcugaucuacgaaucuuaugugagcgagcucgcuccgcgcggacauuucguuaccuguguccaggccuccgaugcugacucuagcgacuuugaucggcuggaauacuccauucuuagcggcaacgacagaacaucuuuccugauggauuccaagagcggggugaucacccucucuaaucaccgcaaacaacggauggagccccuguacucccugaacgugagcgucucugacggacucuuuacguccaccgcccaggugcauauuagaguucuuggcgccaaucuguauagcccugcuuucucucagagcacauacguggcggagguccgcgaaaacguggccgcugggaccaagguuauccacgugagagccacagauggcgaccccggaaccuauggccagaucuccuacgccauuaucaaugauuucgcuaaagaccgguuucugauugauagcaacgggcaagucaucacaaccgagcgccucgacagagaaaauccucuggagggagauguguccauuuucguucgggcccuugacggcgggggacgcacgacauuuugcaccgugagagucaucgugguggaugaaaacgacaaugcgccccaguucaugaccgucgaguaucgggccucuguuagagcugacgugggccgcgggcaccuggugacacagguccaagccaucgauccggacgauggcgcuaacagccggauuaccuacucccucuauucugaggccagcguguccguugcggaccugcuggaaaucgauccugacaacggauggauggugacaaagggcaauuuuaaccagcucaagaauacgguccuuucuuucuuugugaaagccguugaugggggcauucccgugaagcauagccugaucccugucuacauucacgugcugcccccugagaccuuccuccccuccuuuacacagagccaguacucuuucaccaucgcugaagacacagccaucggcuccaccgucgauacgcugcgcauucuuccgagccaaaacgugugguuuucuaccguuaauggggagcgcccugagaacaauaaaggaggcaucuucgugauugaacaggagacagggaccaucaagcuggacaaacggcucgauagagaaacaucccccgcuuuucauuucaaggucgccgcuaccauuccccuggacaagguggauaucguuuucacgguggacgucgacauuaaagugcuggaucucaacgacaauaagccuguguuugagacaagcucuuaugauaccaucaucauggaaggcaugccgguuggaacaaaacuuacccagguccgggccauugacauggauuggggcgcgaacggacaggugaccuacucccugcacagcgacucucaacccgagaaggugauggaggccuucaauaucgauuccaacacaggauggauuagcacgcugaaagaccucgaucaugaaaccgacccuacauuuaccuucagcgucguggcuuccgaucugggcgaggccuuuucucuuagcuccacagcucugguuucugugcgcgucaccgacaucaaugacaacgcccccguguucgcccaggaaguuuauagagggaaugugaaggagagcgauccucccggagaagucguggcggugcucuccacgugggaccgggauacaucugacguuaaccgccaggucagcuaccacauuaccggcggcaacccuagagggcgguuugcucugggacuggugcaguccgaguggaagguguaugucaaacgcccccucgauagagaggaacaagacaucuacuuccuuaauaucaccgccacagauggccuguuuguuacccaggcuaugguggaggugagcgucucugacgugaacgauaauuccccgguuugcgaccagguggccuauacagcccugcucccugaagauauucccagcaacaagaucauucugaaagucucugcuaaggacgccgauaucggguccaauggauacauucgguacagccuuuauggcuccgggaacucugaguucuuucuggacccugaaagcggagagcucaaaacgcuggcgcugcucgaccgcgagagaauccccguguacucccuuauggccaaggcuaccgauggcggcgggcgguucugucagucuaauauccaccugauucuggaagacguuaacgauaauccgccuguguuuagcuccgaccauuauaacacaugcgucuacgagaauaccgccacaaaagcucuccugaccagagugcaagccguggaucccgacaucggaauuaaccgcaaggucguuuauagccuugcggauucugccggcgggguguucuccaucgacagcucuagcggaauuaucauucuggaacagccccucgaucgggagcagcaauccucuuacaauaucagcgugagagcuacggaccaguccccuggccagagccugucuucccugaccacagucaccaucacaguucucgauauuaacgacaaucccccuguguucgagcgccgggauuaucuugugaccgucccggaagacacaagccccgggacccaggugcuggccguuuuugcuacguccaaggacaucggaacaaacgccgagauuaccuaccugaucagaucuggcaacgaacaaggcaaauucaagauuaauccuaaaaccgggggaaucagcguguccgagguccucgauuacgaacuguguaagcgcuuuuaucuugugguugaggcuaaagacggcgggacacccgcccugucugcgguggccacggucaacaucaaucucaccgaugugaacgacaauccucccaaguucagccaggaugucuacuccgcugugauuucugaggacgcccugguuggagauagcgugauccugcucauugcugaagacgucgauucccagccuaacggccagauccacuuuagcauugugaauggggaccgggauaacgaguucacaguggacccgguucuuggacuggucaaggugaaaaagaaacuggacagagaacgcgugucuggcuauucccuccugguucaagccgucgauagcggcauccccgccaugucuuccaccgcgacagugaauaucgacauuagcgaugugaacgacaauucuccugucuuuacccccgcuaacuacacagccgugauccaggagaauaagccuguugggaccagcauucuucagcugguggucacggaucgggacuccuuccauaacggacccccguuuagcuucuccauccucucuggcaaugaagaggaggaauuugugcuggauccucacgggauucugagaagcgccguuguguuccagcacaccgagucccucgaauauguccugugcgugcaagcuaaagacucuggaaagccccaacaggugagccauacauacauccgcguucgggucauugaggaauccacccacaagcccacagccaucccucuugagaucuuuauugugaccauggaggaugacuuccccggcggggugaucggaaaaauucaugcuacggaucaagacauguacgauguccugacauucgcccucaagucugaacagaaaagccuguuuaaggugaacucccacgacggcaaaaucauugcgcuuggcgggcuggacagcggaaaguauguucucaacgugucugucuccgauggcagauuccaggugccuaucgacguugugguccauguggagcagcugguucacgaaaugcugcaaaauaccgugacaauccgcuuugagaacgucagcccggaggauuucguggggcuccacaugcauggauuuagacggacccugcgcaaugccgugcuuacgcagaagcaggacucucugagaauuaucuccauucagcccgucgcuggcaccaaccaacucgauaugcuguucgccguugaaaugcacagcucugaguuuuacaaaccugcuuaucuuauccagaagcuguccaaugcccggagacaucucgaaaacauuaugcggaucagcgcgauccuggagaaaaauuguucugggcuggacugccaggaacagcacugugagcaaggacucucccuggauagccacgcccuuaugacauacuccaccgcucgcauuagcuucgugugccccagauuuuaucggaacgugcgcuguacaugcaauggcggccuguguccugggucuaacgaccccugcgucgagaagccgugcccuggagauaugcagugugugagcuacgaagccuccagacggcccuuccucugccaguguccucccggcaaacugggggagugcucuggacauaccagccuuuccuuugcuggcaauucuuauaucaaguaccgccugagcgaaaacuccaaagaggaagacuucaagcucgcccugagacugcggacacuccaaagcaaugggauuaucauguacacccgcgcuaacccguguauuauccugaagauuguugauggaaaacuuugguuccagcuggacugcggcucuggcccugggauccucggaaucuccggcagagccgugaaugaugggagcuggcacucugucuuucuggagcuuaaccggaauuucacgucccugagccucgacgacucuuauguggagcgcagacgggcgccccuguacuuucagacacuguccaccgaaagcuccauuuauuucggagcccucguucaggcugauaacauccgcucucugaccgacacaagagugacccaaguccuuagcggcuuucaggggugucuggauuccgugauucucaacaauaacgagcugccccuucagaauaagcggagcucuuucgccgaagucgugggccugacagagcucaaacugggaugcguucuguacccugacgccuguaagagaucccccugccagcauggcgggagcuguacgggacucccuucuggcggguaucaauguaccugccugagccaguuuacaggacgcaacugugaauccgagaucaccgcuugcuucccgaaucccugucggaacggcgggucuugcgauccuauuggcaauacauuuaucuguaacugcaaagccggacuuaccggcgugacgugugaggaagacaucaaugagugcgaaagagaggagugugaaaacgggggaagcugcgucaauguguucggcuccuuucuguguaacugcacccccggguacguuggacaguauugcggccuccgcccuguggucgugcccaauauucaggcggggcacagcuacgugggcaaggaggaacugaucggaauugcuguuguccuuuucgugaucuuuauucuggugguccucuucaucguguuccggaagaaaguuuuuagaaagaacuacucucgcaauaacaucacacuggugcaagauccugccaccgccgcucugcucaacaaauccaauggcauuccguuccggaaccugagagggagcggagacggccgcaaugucuaucaggagguggggcccccucagguucccgugcggccuauggccuacacacccuguuuucagucugauuccagaagcaaccuugacaagaucgucgauggacugggcggggaacaucaagagaugaccacguuccacccggaguccccucgcauucucacagcucggagaggcgugguugugugcucugucgcccccaaucugcccgcggugagcccuugucgguccgacugcgacucuauccgcaaaaacggaugggaugccggcaccgaaaauaaggggguggacgaucccggagaggucacauguuuugcuggcagcaacaagggguccaauagcgaaguucagucucuuuccagcuuccagucugacuccggagaugacaacgccuaucacugggauaccagcgacuggaugccuggcgcucgccugucugauauugaggaagugccgaauuacgagaaccaagacggcggguccgcccaucagggaagcacccgggagcucgaaagcgauuauuaccugggcggguaugacaucgauuccgaguaucccccuccccacgaagaggaauuucugucucaggaccagcuuccucccccgcugccugaggacuuccccgaucaauacgaggcgcucccucccagccagccugugucccuggccucuacacucagccccgacugcagacgcagaccgcaguuucaucccucccaguaucugccuccccacccuuucccgaaugaaacggaucuugucggacccccugcuucuugugaguuuagcaccuucgccguguccaugaaccaaggcacagaacccaccgggccugcugacucuguuagccugucccugcauaauagccggggaacaucuuccagcgaugugucugccaacugcggcuuugacgauuccgaggucgccaugagcgacuacgagucugugggcgaacucucccuggcuagccuucacauccccuucguugagacccagcaccagacacagguguga

SEQ ID NO: 69192 - RNA, 14946 nt, Artificial Sequence
  derived and/or modified sequence opt5 from FAT4__Homo_sapiens__NP_078858
auggaccuggcucccgauagagcuaccggccggccuuggcucccgcugcacacacuuagcgugucccagcugcuccgcguuuucuggcugcuuucucugcuccccgggcaagccuggguucauggcgccgagccuagacagguguuucaggugcuggaggaacagcccccuggcacgcuggucgggaccauccaaacacggcccggauucaccuaccgccucagcgaaucccacgcucuguuugccauuaacucuagcacaggcgcccuuuauaccacauccaccaucgacagagagucucugccuagcgaugugauuaaccucguugugcuguccagcgcuccgacguaccccaccgaaguccgggugcuuguucgcgaccugaacgauaacgccccuguguuccccgacccuucuaucgucgugacauuuaaggaggauuccagcucugggagacaggugauucucgacaccgcuacagauuccgacaucggaagcaacggcgucgaucaucggucuuaucgcaucauuagaggcaacgaggccgggcgguuccgccuggacaucacccugaaccccuccggagaaggcgcguuucuccaccugguuagcaaagggggacuugauagagaggugacgccgcaguaccagcugcucguggaagucgaggacaagggcgagccuaaacggcgcggguaucugcaagugaacguuacagugcaggacauuaacgauaaucccccugucuucggauccucucauuaccaggccggcgugcccgaagacgcuguugugggcagcuccguccuucagguggccgcugccgaugcggacgaggggaccaacgccgauaucagauaucggcugcaagacgaaggaacacccuuucagauggauccugagaccggccucauuaccgucagagaaccgcuggacuucgaggcucgccggcaguacagccugacagugcaagccauggauagagggguucccucucucacgggacgcgcugaggcccugauccagcuucuggacgugaaugauaacgacccugucgugaaguuucgguacuuccccgccaccuccagauaugcuagcguugacgaaaaugcccaggugggcacagucguggcccuccugaccgugacagaugcugacucuccugccgccaacgggaauauuagcguucagauccuuggaggcaacgagcaacgccacuuugaaguccaguccucuaaagugcccaaccugagccucaucaagguggcuuccgcccuggaucgggagcgcauuccgagcuacaaucugaccgucucuguguccgacaacuauggcgcgccucccggggcugccguucaggcccgcagcucuguggcuucccucgucaucuucgugaaugauauuaacgaccacccucccguuuucagccagcaaguguaccgggucaaucuguccgaagaggccccucccggaucuuaugugagcggcaucuccgcuacggauggggacucuggacuuaacgccaaucugagauacagcauuguuuccggcaacgggcucggcugguuucauaucagcgagcacucuggacuggugacaaccggcuccagcgggggacuggaucgcgaacuugcgucucagaucguccucaauauuuccgcccgggaccagggcgugcauccgaaggugagcuaugcucagcuggucguuacccugcucgaugugaacgacgagaaaccuguguucucucaacccgaaggguacgaugucagcgugguugagaaugcccccacaggaaccgaacugcuuaugcugagagcuacagacggcgaccucggggauaacggcacggugcgguuuucccugcaggaggccgagaccgaccgcagauccuuccggcuggauccugucucuggaagacuuuccacaaucagcucccucgaccgcgaagaacaggcguuuuacucucugcuggugcucgccaccgaucugggcagcccgccccaguccucuauggcucggauuaauguuagccuucuggacaucaacgauaauuccccuguguucuaucccguccaauacuuugcccacauuaaggaaaacgagccugggggaucuuauaucacaaccgugagcgcuacggaccccgaucucggcaccaacgggacaguuaaauacuccaucagcgccggagacagaucucgcuuccaggugaaugcccaguccggcgucauuagcaccagaauggcucuggaucgggaggaaaagacagcguaucaacugcagaucguggccaccgacgggggcaaccuucagucuccuaaucaggcuauugugacgaucacaguccucgauacccaagacaaucccccggucuuuucccagguggccuacagcuucguggucuuugagaauguggcccugggauaucacguuggcucuguguccgcuagcacaauggaccugaacuccaauauuagcuaccucaucaccaccggggaucagaaaggaauguucgccauuaaccaggucacaggccaacugacgaccgcgaaugugaucgaccgcgaagaacagucuuuuuaccagcuuaagguuguggcuagcgggggaacagucaccggcgauacaauggugaacaucaccgucaaggaccugaaugauaacuccccucauuuccuccaggccauugaaucugugaauguuguggagaacuggcaagccgggcacagcaucuuccaggcuaaagccgucgaccccgaugagggcgugaauggaaugguucuguauucccugaagcagaacccuaaaaaccuuuuugcgauuaaugaaaagaacggcacgaucucucuccuggggccccuggacgugcaugcuggaagcuaccaaauugagauccucgccuccgauaugggcgucccgcagcugucuagcuccgugauccuuacaguguauguucacgacgucaaugauaacagcccuguguucgaccagcugucuuacgaagugacccucuccgagagcgaacccgucaauucuagauuuuucaaagugcaggccuccgacaaggauagcggggcuaacggagagauugccuauaccaucgcugagggcaauacaggcgacgccuuugggauuuucccugauggacaacuguacaucaaauccgaacuggaccgggagcuucaggaucgcuauguucugaugguggucgcgucugacagagccguggaaccccucagcgcuaccguuaacgugacagucauucuggaggaugugaaugacaaccggccccucuuuaauuccacgaacuacaccuucuacuuugaagaggagcagcgcgccggcagcuucguugggaaggugucugcugucgauaaggacuuuggaccuaauggcgaagugagauauuccuucgagauggugcagccggauuuugaacugcaugccaucagcggggagaucacaaacacccaccaauucgaccgggagucucuuaugcgcagacggggaacagccgucuucagcuuuaccguuauugcuacggaucagggcaucccccagccucugaaagaccaggcgaccgugcacguguacaugaaggacauuaaugauaacgcccccaaauuccucaaggacuuuuaucaagcuacaaucuccgaaucugccgccaaccugacccagguccugagagugagcgcuuccgauguugacgagggcaauaacgggcuuauucauuacucuaucaucaaaggaaaugaagaaagacaguucgccauugauagcacauccggccaggugacccugaucgggaagcucgacuaugaagcgaccccugcuuacagccuggucauucaagccguggauucuggaaccaucccccucaacuccacgugcacacugaauauugacauccuugaugagaacgacaauaccccuagcuuuccgaaguccacccuguucguugaugugcucgagaacaugcggauuggcgaacuggucucuagcgugacagccaccgacuccgauucuggggacaaugcugaccuguauuacagcaucacgggaacaaacaaucacggcaccuuuuccaucagccccaacacaggcucuauuuuccuugccaaaaagcuggauuuugagacccagucccucuacaaacugaauaucacagcgaaggaccaggggagaccuccccgcagcucuaccauguccgucgugauucauguucgggauuucaacgacaauccucccagcuuuccgccuggagauaucuucaaaucuauuguggaaaacauccccaucggcacgagcgugauuuccgucaccgcucacgaccccgaugccgacaucaaugggcaacucucuuauacaauuauccagcagaugccuagaggaaaccacuucaccauugaugagguuaagggcacaaucuacaccaacgccgaaaucgaccgcgaguuugcuaaucuguucgagcuuacggugaaggccaacgaucaggcugugcccauugaaacacggagauaugcccugaaaaaugucaccauccuggugacagaccucaacgacaauguuccuauguuuauuagccaaaacgcgcuggccgcugauccguccgccgugaucgggagcguccuuaccaccauuauggcugccgaccccgaugagggagccaauggcgaaaucgaguacgaaauuaucaacggcgacacagauacguucaucguggaccgcuauuccggggaucugcgggucgcuucugcgcucgugccuagccagcugauuuacaaucucaucguuuccgccaccgaccugggacccgagagacggaagucuacaaccgagcuuacaauuauccugcagggccuggaugggccuguguuuacccagcccaaauauauuacgauccucaaggaaggagagccgaucggcacaaacgucauuagcaucgaagcugccuccccucgcgggucugaggcccccguggaguacuacauuguuagcgugagaugugaagagaaaaccgucggacggcuguucaccaucggccgccauacaggcauuauccaaaccgcugccauccuugacagagaacagggggcgugccuguaucucguggauguguacgcuauugagaaguccacagccuuuccucggacgcagagagccgaaguugagaucacccugcaggacauuaaugauaaucccccugucuuccccacagacaugcucgaccugaccguggaggaaaauaucggagauggcagcaagauuaugcaacuuacagcuauggacgccgaugagggggcgaacgcccuggugaccuauacgaucauuucuggagcugacgauuccuuucgcaucgacccggaaagcggcgaucugaucgccacccggagacucgaccgcgagcggagaucuaaauacucccugcuuguccgcgcugaugacgggcugcagagcucugauaugcggauuaauaucacaguuuccgacgugaacgaccacaccccuaaguucagcagacccguguauuccuuugauauucccgaagacacaaucccuggaagccucgucgccgcuauucuggccaccgaugacgauucuggcgugaacggcgagaucacauacaucguuaaugaggacgaugaagacgggauuuucuuucucaacccgaucacgggaguguucaaucugacccgccuucuggauuaugagguccagcaauacuacauucugacagugagagcggaagacggcgggggacaguucaccaccauccggguuuauuuuaacauucucgaugugaaugacaaucccccuaucuucagccuuaauuccuacucuacaagccugauggagaaccugcccgucggcuccacggugcucguguuuaaugucaccgaugccgacgacgggaucaacucucagcugacauauagcauugcuuccggagauucucugggccaguucaccguugacaaaaauggcgugcucaaggugcuuaaagcccuggaucgcgaaagccaauccuuuuacaaccuggucgugcagguucaugaccucccucagauccccgcuagcagauucacaucuaccgcccagguguccauuauccugcuugaugucaaugacaacccuccgacguuucugagccccaagcucacauauauuccugagaauacccccaucgauaccgugguuuucaaagcccaagcuacagacccugauucugggcccaacuccuacauugaguauacccugcugaacccgcucggaaauaaguuuagcaucggcacaaucgacggggaagugcggcuuaccggagagcuggaucgcgaagaggucuccaacuacacgcugacagugguugcgaccgacaagggccagccuucucucagcuccagcacagagguggucgugaugguccuggauauuaaugacaacaaucccaucuucgcccaggcucuuuacaaaguggaaauuaacgagaauacccugacggggaccgacaucauucagguuuuugccgccgauggcgacgaaggaacaaacggccaagugagauaugggaucgucaauggaaacaccaaucaggaguuccggaucgauucugugacaggcgcuauuaccguggccaagccccucgacagagagaagacaccuaccuaccaccugacgguucaggcgacagaucgcggguccacaccccggaccgacacaagcaccgugucuaucguccugcucgauauuaacgacuuugugccuguuuucgagcuuagcccguauuccgugaauguccccgagaaccugggaacacugccuagaacgauccuccagguggucgcccgcgaugacgaucggggcucuaauagcaagcuguccuacgugcuuuucgggggcaacgaagacaacgcuuuuacccugucugccagcggagagcucggcguuacacaaucccuggacagagaaaccaaagagcgguucgugcugaugauuacagcuaccgauagcgggucucccgcccucacgggaaccggcacaaucaaugucaucguggacgauguuaacgacaaugugccuaccuuugcguccaaggccuauuucacaaccauucccgaagaugcuccgacggggacagacguccuucuggugaacgccagcgaugcugacgccuccaagaaugcugugauccgcauuaucggaggcaacucucaguuuaccauuaauccuagcacagggcagaucauuaccuccgcccugcucgauagagagaccaaagacaacuacacacugguugucguguguucugaugcgggcagccccgagccucuuuccagcucuacguccgugcuggucaccgugacagacguuaaugauaaucccccucgguuccaacaucaccccuaugugacccacaucccgagcccuacacuccccggaucuuuugucuucgccgugaccguuacggacgcugacaucggccccaauuccgaacugcauuacagccugucugggcgcaacuccgagaaguuucacauugauccucucagaggagccaucauggcugccggcccgcuuaauggggccagcgaagugacauucucuguccaugugaaagacggaggcagcuuucccaagaccgauuccaccacaguuaccgugcgguucgucaacaaagcggacuuuccuaaggugcgcgcuaaggagcagacauucauguuccccgaaaaucagccugugagcucccuggucacgaccauuacaggcucuagccugagaggggagcccauguccuacuauaucgccucuggaaaccucggcaacaccuuucagauugaucaacugacagggcagguuagcaucucccagccucuugacuucgagaaaauccagaaguacgugguguggauugaagcucgggauggaggcuuucccccguucucuagcuaugagaaacuggacaucaccguccucgaugugaaugacaacgccccuauuuuuaaggaagaucccuucaucuccgagauucuggagaaucugagcccucgcaaaauccucacgguuucugccauggacaaggauuccgggcccaacggacaacuugacuacgaaaucgugaauggcaacauggagaauagcuuuucuauuaaccacgcuaccggcgaaaucagauccguccggccgcuggacagagagaaggugagccauuauguucugacaauuaaaucuuccgauaaggggagcccuucucaguccaccagcgugaaagucaugaucaauauucucgacgaaaacgauaaugcgccccgcuucagccagaucuuuuccgcgcacgugcccgagaacucuccucugggauacacagucacccgggugacaaccagcgacgaggauaucggcauuaaugccaucuccagauauucuauuauggacgcuagccuucccuucacgaucaacccuuccacaggggauauuguuaucucucgcccgcugaaucgggaagacaccgauagauaccgcauucgggugagcgcccacgacuccggauggaccgucagcacagaugugacgaucuuuguuaccgacaucaacgacaacgcucccagauucucucgcacauccuacuaucucgauugcccugagcugaccgaaauuggcagcaaggugacacaggucuuugccaccgaccccgaugaggggucuaauggacaaguguucuacuucaucaaaucccagagcgaauauuuucggauuaacgcgacaaccggcgagaucuucaauaagcagauucugaaauaccaaaacgugacgggcuuuuccaauguuaacaucaauagacauucuuucaucgucaccagcuccgaccgcgggaagccuucucucauuagcgagacaaccgugacaaucaacauuguggauuccaaugacaacgcgccccaguuucuuaagagcaaauauuucaccccugucacgaagaaugugaaaguuggaacaaagcugauccgggugaccgcuauugaugacaaagauuuuggccugaacucugaagucgaguacuucaucuccaaugacaaccaccucgggaaguuuaagcuggauaaugacacaggauggaucagcguggccucuagccuuauuuccgaucugaaccagaacuucuuuaucaccguuacggcuaaagacaagggcaauccgccccucucuagccaggccaccgugcauauuacagucaccgaagagaacuaucacacaccugaguucucccaaagccacaugucugcuaccauccccgagucccauagcauuggguccaucgugagaacagugucugcccgcgacagagaugcggccaugaauggacugauuaaauacagcaucuccucuggcaacgaggaaggcaucuuugcuauuaauagcuccaccgggauccugacgcucgccaaggcucuugacuacgagcugugucagaaacacgaaaugacaauuucugccaucgauggaggcuggguugcccggaccggguauugcagcgucaccgugaacgugauugacgucaaugauaacuccccuguuuuccugagcgacgauuacuuccccacagugcucgagaaugcgccgucuggaaccacagugauccaucugaacgcuacggacgccgauuccggcaccaaugccgucaucgcuuauacagugcagagcucugacuccgaucuuuuuguuauugacccuaacaccggggugaucacaacccagggauuccuggauuuugagacgaagcaaagcuaccaccucaccgucaaggccuucaaugugcccgacgaggagcgcuguucuuuugcuacaguuaacauucagcugaaaggcaccaaugaauaugugcccagauucgucagcaagcuguacuauuuugagaucuccgaagccgcgccuaaaggcacaauugugggggagguguucgccagcgaccgggaucucggaaccgacggcgagguccauuaccuuaucuuugggaacuccagaaagaaaggauuccagaucaacaagaagacgggccagauuuacguuucugggauccuggaucgggaaaaagaggaacgcgugagccugaaggugcucgcuaaaaauuuuggauccauuagaggcgccgacaucgaugaggucacaguuaacgugaccgugcuggacgcuaaugaucccccuauuuucacacuuaacaucuauucuguccaaauuagcgaaggcgugccgaucgggacccacguuaccuuuguguccgccuucgacucugauagcauccccuccuggagccgguucucuuacuuuauuggauccggcaaugagaacggggcguucagcaucaauccucagacaggacagauuacggucaccgccgagcuggaccgcgaaacacuccccaucuauaaccugucugugcuggcuguugauuccggcaccccuagcgccacagggucugcuucccuccuggugacccuugaggacauuaaugacaacggacccaugcugacggucagcgaaggcgaggugauggaaaauaagagaccgggcacacucgucaugacccugcaaucuaccgauccugaccuucccccuaaccaggggcccuuuacauacuaucugcucuccaccggaccggccacaagcuacuucucccugagcacggcuggcgugcugucuaccacacgggagaucgaucgcgagcagaucgccgacuuuuaucucagcguugugaccaaagauuccggggucccucagaugucuagcacaggaaccgugcacauuacggugaucgaccaaaaugauaaccccucccagucuagaaccguugaaauuuucgucaauuacuacggcaaccuguuucccgggggcauccuuggaagcgugaagccucaggaccccgaugugcuggacuccuuccauugcagccucacaucuggcguuaccucccuguuuagcauuccugggggaacaugugaucuuaauucucagccgcgguccaccgacggcacauucgaucugaccguccucagcaacgacggggugcacucuacggugacauccaacauccgcgucuuuuucgcgggauucagcaaugccaccguggacaacuccauccugcugagacucggcguucccaccgugaaggauuuucugacaaaucauuaucuucacuuccugcggauugcuucuagccaacucacggggcugggcaccgccguccagcuuuacuccgccuaugaggaaaacaaucgcacauuucugcucgcugccgugaaaagaaaccacaaucaguacguuaacccuagcggaguggcgaccuucuuugagucuaucaaggagauucugcugcggcaguccggcgucaaaguggaaagcguggaccaugauucuugcguucacgggcccugucaaaauggaggcagcugccuccgcagacuggcugucuccucugugcuuaagagccgggagucccugccugugaucauugucgccaacgaaccccuccagccuuuccugugcaaaugucuuccgggguaugccggaagcuggugcgagaucgacauugaugaaugucugcccucuccuugccauuccggcgggacaugucacaaucucgugggcggauuuagcugcucuugucccgacggcuucaccgggagagcuugcgagcgcgauaucaacgagugucugcaguccccuugcaagaauggagccaucugucagaacuuucccggcagcuucaauugcguuugcaaaacaggguacaccggaaagaugugugaauccucugugaacuauugcgaguguaacccgugcuuuaauggcgggagcugucaauccggcgucgacucuuacuacugccauuguccuuucggaguguuuggcaagcacugcgaacugaacagcuauggguucgaggaacucuccuacauggaguuccccagccuggaucccaauaacaauuauauuuacguuaaauuugcuacgaucaagucucacgcccuucugcucuauaacuacgacaaucagaccggagaucgggcggaguuccuggcccuugaaauugcugaggaaagacugcgcuuuuccuacaaccucggcagcgggacauauaaacugaccacaaugaagaaagugucugacggacauuuccacaccgucaucgcccggagagcuggcauggccgcgucccugacgguggauagcuguucugagaaucaggaaccuggcuacugcacaguuuccaacguggccgucagcgacgacuggacccucgaugugcaacccaaucgcgugacagucggcgggauucggagccuggagccuauccuucagagacgcgggcauguugagucccacgacuuugugggguguaucauggaguucgcugugaacggacggccgcuggagcccucucaggcccucgcugcccagggcauucuggaucaaugcccuagacuugaaggggccugcacccgcagccccugucagcacggaggaaccugcauggacuauugguccuggcagcagugucauugcaaggagggccugacagggaaguacugugagaaaucugucacgccugauaccgcucucagccuggaaggaaagggccggcuggacuaucacaugucccaaaaugagaaaagagaauaccuccugcggcagucucuuagaggggcgaugcuggagcccuuuggagugaacagccucgaaguuaaguuccgcacacgguccgagaauggcgugcugauccauauucaggagucuagcaacuauaccacagucaaaaucaagaacgggaagguguacuuuaccuccgaugccggaauugcuggcaaaguugaaagaaauaucccggagguguacgucgccgacggccacuggcauacguuccuuaucgggaagaacggaacagccaccgugcugagcgucgaucgcauuuauaauagagacaucauucacccuacccaggauuuuggcgggcucgacgugcugacaaucucucugggaggcauucccccuaaccaagcucaccgggacgcccagaccgcgggguucgauggaugcaucgcuuccaugugguacggcggcgaaagccuucccuuuucugggaaacauucccuggccagcauuucuaagacagacccuuccguuaaaaucggaugucgcggccccaauaucugcgccagcaacccguguuggggagaucuccugugcauuaaucagugguaugcuuacagaugugugcccccuggagacugcgccucccaccccugccaaaacggcgggagcugugagccuggacuccauucuggcuucacgugcagcuguccggauucccacaccggccggacaugcgaaauggucguggcuugucuggggguucuuugcccccagggaaagguguguaaggccggcucuccugcggggcaugucugcgugcugagccagggacccgaggagaucucccugccucucugggccgugcccgcuauuguuggcucuugugccaccguccuggcccuucuggugcucagccugauccucugcaaucagugucgcgggaaaaaggccaaaaacccuaaggaagagaaaaagcccaaagaaaagaagaaaaagggauccgagaauguggcguucgacgauccggacaacauuccucccuauggcgaugacaugacagucagaaaacaaccugaaggcaaucccaagccggauaucaucgagcgggagaacccuuaccugauuuaugacgaaaccgauaucccccacaauucugagacgauucccagcgccccucuggcuucccccgaacaggagaucgagcacuacgacauugacaacgccagcucuaucgcuccuuccgaugccgacaucauucagcauuacaaacaguuucgcagccacaccccgaaguucucuauccaaagacauagcccccuuggguuugcccggcagagcccuaugccccugggagcuuccucucucacauaucagccuagcuacggccaggggcugcgcaccuccagccuuucucacuccgcgugccccacaccgaacccucugagcagacacucucccgccccuuucuccaagagcucuaccuuuuaucggaauagccccgcucgcgaacuccaucugccuauuagagauggaaacacacucgagaugcacggcgacacgugccaacccgggaucuucaauuacgccacccggcugggaagacgcuccaaaucuccgcaggccauggcuagccauggcucccggcccggcagcagacugaagcagccuauugggcagaucccccuugaaucuuccccucccgugggacugagcaucgaggaaguugagcgccucaacacaccucggccgagaaaucccuccauuuguucugccgaucacggccgcagcuccucugaggaagacugccggagaccucugagccgcacccggaaccccgcggaugggaucccugcucccgaguccagcucugacuccgauagccaugaaucuuuuaccuguuccgagauggaauaugacagagagaaaccgaugguguacacaagccggaugccuaaacuuucucaagucaaugaguccgaugccgacgacgaagauaacuauggagcccgccugaaacccagacgguaccacggccgcagagcugaagggggcccugugggaacgcaggccgcugcccccggcaccgcggacaauacacucccgaugaagcuggggcagcaagccggaaccuucaacugggauaaucugcucaacuggggcccuggguuuggacacuacguugacguguucaaggaucuggcuagccuucccgaaaaagccgcugccaaugaggaaggcaaggcggggacaaccaaacccgucccuaaggacggcgaggccgagcaguauguguga

SEQ ID NO: 69193 - RNA, 552 nt, Artificial Sequence
  derived and/or modified sequence opt5 from FATE1__Homo_sapiens__NP_149076
auggccggcgggcccccuaacaccaaggcugagauggaaaugagccuggccgaggaacucaaucacggaagacagggcgagaaccaagaacaucuggugaucgcggagaugauggagcuugggucccggucucgcggagcuagccagaaaaagcagaaacuggaacagaaggccgccggcuccgcuucugccaaaagagucuggaauaugacagcuacgcggccgaagaagauggggagccaacuccccaaaccucgcaugcugagagaguccggacacggcgacgcccaucuucaggaauacgcgggcaacuuccaggggauucgguuucacuaugaucgcaaucccggaaccgacgccguugcucagacaucucuggaggaguucaacgugcucgaaauggaggugaugagacggcaacuguacgccgucaaucgcagacugcgggcucucgaggaacagggcgccaccuggcgccauagagaaacacugaucauugcggugcuuguuagcgccuccaucgcuaaccuguggcucuggaugaaucaguga

SEQ ID NO: 69194 - RNA, 402 nt, Artificial Sequence
  derived and/or modified sequence opt5 from FAU__Homo_sapiens__NP_001988
augcagcuguucgugagagcccaagagcuccacaccuuugaagucacaggccaggagacgguugcucagaucaaggcccauguggcgagccuggaagggauugcucccgaggaccaggugguccuucuggccggagccccucucgaagaugaggcuacccugggccaaugcgggguggaggcccuuacaacccuggaaguugcuggacggaugcucggcgggaaagugcacggaucccuggcccgcgcgggcaaggucagaggccagacaccgaaaguggccaagcaggagaaaaagaagaaaaagaccgggcgggcuaaacgcagaaugcaguacaaccggcgcuucguuaaugugguccccacauuuggaaagaaaaagggcccuaacgccaauucuuga

SEQ ID NO: 69195 - RNA, 3402 nt, Artificial Sequence
  derived and/or modified sequence opt5 from FBF1__Homo_sapiens__NP_001074011
auggcccccaagaccaaaaagggcugcaaagugacacugccugagaagccggucaaacucgcuagccacacgagagacaccacagggguuucccagauguuccccucuagcaaggcccggaccaagucccugcuuggagaugacguguuuucuacaauggcgggccuggaagaggcugaugccgaagugagcgggaucuccgaggccgacccucaagcucuccugcaggccaugaaagaucuugacggaauggaugcugacauucugggccucaagaaaucuaacagcgcccccuccaagaaagcggccaaggauccugggaagggagaacugcccaaucauccuaaaccggcuggcggcgccauccccaccaagaaaagccugccuucucccuccagcucugggcaccagaaccgcagauucuccagcgaggaccucgaggauccucugcggggacuucugucuuacgacgaaggcgggauuacaaagcagcccccggucacccaauccaaaacggcuagcgauaaguccccuucuaccgugcgcgaccagggacccagcaucccucucacacccggcgacacccccauucggaaaaaggaggaacugcuuuuugaugacggggaugacaucauggccacacugggauucggcgauuccccuaaggcggagaaaagacagaucggcgaccaggaggggccgcgccccgccagaagcacccucgaugaacugcugggacggggcauggcuacgaagcuccuggcccgcccugggacaggagagcauagagaauuuaaacuugacaagaaauaucaacggccccaggauucugaggacauguggggcgaugaagacuucaccuuuggggcuuaccagccuacaguuguguccagcgagggacgccagucuagacggcaaagcguccgcuucuuugccgacuccggcgccgaucccaagggcgagccggggucuaagcagagcccucccauggcuuccagcccuauucagcccagaaaaggaggcgcggacuggcuggggcucaaggaugaagaccuggaucuuuucccugccucucccacccgggaggcucacagagaauccagcgugccgguuaccccuucugugcccccucccgccucccaacauagcacaccggccggacugcccccuucccgcgcuaaacccccuacggagggcgccgggucucccgcgaaggcuagccaggccuccaaacuccgggccucuaaggaagagaaggaggacuggcugagccacgcucugucccgcaaaaagagccagggccucgccagagaacagcacgcuggaaccucugagggccugcaucuugccgggacagcgggacacccucccuccggcagccaaccgcugaccucuacacaggggcucgaacaugccgcugccggaggcuccagcgggaccacggcucgggagagaccuuguguccgccccggcgugucuggaagcccugugacacagaaucacgccgcguccgcccugcccaccggcagcccgaaacgggggaccgcuccuggagaucuuucugccacagaacccgcuaccugcuuuccuuccacacagaagcccacggagcccagcgucccuguucaaccgcugcuccccgagucccuggccagaucucugcucccuagcaccgaauaucagaaacagcugcuugccgcucaggugcaacugcaguguucccccgcggagcuccaggccgaacugcugcacucucaggcucgccuugccgagcucgaggcccaagugcggaagcuggaacuggagagagcucagcaugaacuccugcuuggcagccugcagcaacagcaccaggccgaccucgagcugaucgaauccgcgcaucgcucucggauuaagguccuggagacaagcuaccagcaaagagaggaacggcuucgcagagagaacgaagaacucuccgcucgguaucugagccagugccaggaagccgagcaggccagagcugagcugaccgcccaacaccagcgccggcucgcggcuaucgcccaggaaaaagaucaggagauggaaagacugcgcgagcuucaaagagccucuauucuggacaugcggcgcgaucaugaggagcagcuccagagacugaagcugcuuaaagaccgggagguggaugcugccacauccgcuaccagccacacgcgcucucucaauuccaucauucaccaaauggaaaaguucucuagcucccugcaugagcugagcuccagaguugaagccagccaccucaccacaucucaggagcgggagcuggggauccgccagagagacgaacagcuucgggcgcugcaagagcgccucggacagcagcagagagacauggaagaggaacggagcagacaacaggaggugaucggcaaaauggaggcccgccugaacgaacagucccggcugcuugagcaggaaagauggcgcgucaccgcugagcaaucuaaggccgaaagcaugcagcgggcucucgaggagcagagaaaagugacagcccagcaaauggccauggaacgcgcugagcuggaacgggcgaaguccgcccugcucgaggaacagaagucuguuaugcugaaauguggggaggagagacgccggcuugcugccgaaugggccgaguuuagcgcucagcaaaagcuguccaaagaaagagccgagcgggaggcggaacgcgcucuccagguggauacccagagagagggcacgcugauuucucuggccaaggaacaggccgagcuuaaaauccgggcuagcgaacugcgcgccgaggagaagcaacucgcggcugaaagagccgcccuggagcaggaacggcaggagcucagacuggaaaaggagcgcauuaaugcuacagcccuucgggucaaacugagagcugaggaaguggaguccaugagcaaggucgccucugaaaaauacgaggaaggagagcgcgcgcuccgggaggcccagcaagugcaggcugaacagcaggccagacugcaagcuguucagcagcaacaggagcgccugcggaagcaggaacagcauaugcaccaagagcaccuuucccuggcccagcagagacuccagcuggaccgcgccagacaagaucucccuagcucucuggugggccuuuucccccgggcucaggggccugcggccuccagccaguccgcucugaugccgcccgccccuaccacacgcuggugcucucagcccccuaccggacucgaccccagcccgcugcaucugcacgccagacuugcucugcuccggcauauggccgagcaagaucgcgacuuccuggaaaacgagcaguuuuuccucgaaacccugaaaaagggcuccuauaaucuuacaagccacucugcguga

SEQ ID NO: 69196 - RNA, 966 nt, Artificial Sequence
  derived and/or modified sequence opt5 from FBL__Homo_sapiens__NP_001427
augaagcccggcuucagcccuagagggggaggcuuugggggacggggcggguucggagaccgcggcggcagagggggacggggcggguuuggaggcgggcgcggaagaggcggcggguuccggggacgcggcagagggggaggcgggggaggcggcgggggaggcgggggaggccgcgggggcggaggcuuucacuccgggggaaaccggggcagagggcggggaggcaaacgcgggaaucagucuggcaagaacgugauggucgagccgcauagacacgaaggaguuuucaucugccggggcaaagaggaugcccuggugaccaagaaucucgugcccggggaaagcgucuacggagagaaacgcguguccauuucugaaggcgacgauaagaucgaguauagagcuuggaacccuuuucggagcaagcuggccgcggcuauucuugggggaguugaccaaauccauauuaaacccggcgccaaggugcuguaccucggggccgcuuccggcacaacggucucucacgugagcgauaucguuggaccugacggccugguguaugccgucgaguucucccauagaagcgggcgcgaucuuaucaaucuggcuaaaaagcggaccaacauuauccccgugauugaagacgccagacacccucacaaauaccgcaugcucaucgcgaugguggaugucauuuuugccgacguugcucagccggaucagacacggaucguggcccugaaugcucauaccuuccugagaaacggaggccacuuugugauuucuaucaaggccaauuguaucgacuccacagcgagcgccgaggcugucuucgccucugaagugaagaaaaugcagcaagagaacaugaagccccaggagcagcucacccuggaaccuuaugagcgcgaucaugcuguuguggucgggguguaccggcccccucccaaaguuaagaauuga

SEQ ID NO: 69197 - RNA, 945 nt, Artificial Sequence
  derived and/or modified sequence opt5 from FBLIM1__Homo_sapiens__XP_011539920
auggccagcaagcccgagaaaagaguggcuuccucugucuucaucacccuggccccuccgcggcgcgacguugcgguggcugaagaggugagacaggccgucugcgaagcccggcgcggcagacccugggaggcuccugcccccaugaagacaccugaagcugggcucgccggacggcccagcccuuggacgaccccgggccgcgcggccgcuacagugcccgccgcuccuaugcaacuguuuaacgggggaugucccccucccccgccuguucuugauggcgaggacgugcugcccgaucucgaccugcuuccucccccucccccgcccccucccguccugcucccuuccgaggaagaggcccccgcgccgaugggggccucucugauugcugaucuggaacagcuccaccugagcccucccccucccccuccccaggccccggcugagggaccuuccgugcagcccggcccccuuagaccuauggaggaggaacugccgcccccucccgccgaaccuguugagaaaggcgccucuaccgacaucugcgcuuucugucauaagacagugagcccccgggaacucgcggucgaggccaugaaacgccaauaccacgcucagugcuuuaccuguagaacaugccggcgccagcuggccgggcaguccuucuaucaaaaggauggaagaccucuuugugagcccugcuaccaggacacccuggaacgguguggcaagugcggggagguggugcgcgaucauauuaucagagcccucggacaggcuuuucacccgagcuguuucacgugcguuaccugcgcccgguguauuggcgacgaaucuuuugcgcuggggucccagaaugaggucuauugccuggaugacuucuacagaacagcuggaagcucuugucucuccagcccucgcaccaaagccgccacacccuga

SEQ ID NO: 69198 - RNA, 2052 nt, Artificial Sequence
  derived and/or modified sequence opt5 from FBLN1__Homo_sapiens__NP_001987
auggagagagccgcucccagccggcgcgugccucugccgcuccugcuucugggcgggcucgcccugcuugcggcuggagucgacgccgauguucugcucgaagccugcugugcugacggccacagaauggccacccaucagaaggauugcucccugcccuacgcuacagagucuaaagaaugucggauggugcaagagcagugcugucacagccagcuggaggaacuccauugcgccacggggaucucccuggcgaacgagcaggaccgcugugccaccccucacggagauaaugcuucucuugaagccacauucgugaagagaugcugucauugcugucugcucggccgggcugcccaagcgcaggggcagagcugcgaguauucccugauggucggauaccagugcggccaaguguuucgcgccuguugcguuaaaucucaggaaaccggcgaccuugaugugggaggacugcaggagacagacaagauuaucgaggucgaagaggaacaggaggaucccuaucucaacgacagaugucggggcgggggaccuugcaaacaacagugucgcgauaccggcgacgaagugguuugcagcuguuucgugggguaccagcugcuguccgauggagucagcugcgaggacgugaaugaguguauuacaggcucucacuccugcagacucggcgaaagcuguaucaacaccguggggucuuuucggugccaacgcgacuccagcugcggaacgggcuaugagcugaccgaagauaauucuuguaaggacauugaugagugcgaauccgggauccacaacugucuucccgacuucaucugccagaauacacuggggagcuuuagaugucggccuaagcuccagugcaaauccggcuucauucaggaugcucuggggaacuguaucgacauuaaugagugccuuucuaucagcgccccgugucccauuggacauaccugcaucaacacagagggcuccuacaccugucaaaagaaugucccuaacugcggccgcggguaucaccugaaugaagagggaacgagaugcguugauguggacgaaugugcucccccugccgagcccugcggcaaagggcaucggugugugaacagcccgggaucuuuuagaugcgaauguaagacaggcuacuacuucgaugggauuucccgcaugugcgucgacgugaaugagugucagcgguauccuggcagacucugcggacacaaaugugagaacacccugggcagcuaccugugcucuuguagcguuggguuucgccucuccguggauggacggucuugcgaagacaucaacgagugcagcuccagccccuguucucaggaaugcgccaaugucuauggcuccuaccaguguuauugcagacgcggguaccaacugagcgacguggauggaguuacaugugaggacaucgaugagugcgcgcuuccuaccggcgggcacauuuguucuuaucggugcaucaacauucccggcuccuuccaguguagcugccccuccucuggauacagacuggcuccuaauggccgcaacugucaggacaucgaugaaugcgugaccgggauucauaauugcagcaucaacgagacauguuuuaauauccagggaggcuuccggugccucgccuuugaauguccggagaacuacagacgcuccgcugccacgcggugcgaaagacugcccugucacgagaaucgggagugcucuaaacuuccucugcgcauuaccuauuaccaucucagcuuccccacaaacauccaagccccugcugucguguucagaauggggcccuccagcgccgucccgggagacucuaugcagcuggcgauuaccggcgggaaugaagagggcuuuuucacaacccggaagguguccccucacagcggaguuguggcucugacgaagcccgucccugaacccagagaucuccugcuuacagugaagauggaccugucucgccauggcaccguuuccagcuuuguggccaaacucuucaucuuugucucugccgagcuguga

SEQ ID NO: 69199 - RNA, 3696 nt, Artificial Sequence
  derived and/or modified sequence opt5 from FBLN2__Homo_sapiens__NP_001158507
auggugcugcucugggagcccgccggcgcuuggcuggcccuugggcuggcgcucgcucugggaccuagcgucgccgccgcugccccgagacaggacugcaccggcguugaaugucccccucuugagaacugcaucgaagaggcucuggaacccggggccuguugcgcgacaugugugcaacagggaugcgccugugagggcuaccaguauuacgauugccuccagggcggauucgugcggggccgcgucccugcuggccaauccuauuuuguggacuucgggucuacggaguguagcugucccccuggaggcgggaagauuuccugccaguuuaugcugugcccggaacugcccccuaauugcaucgaggccguuguggucgcugauucuuguccccagugcggacaggugggcuguguucacgccgggcauaaauacgcggccggacacaccgugcaucucccucccugcagagcuugucacugcccggacgccggcggcgaacugauuuguuaucaacuuccugggugccauggaaacuucagcgaugcugaggagggcgaccccgaacggcacuacgaggauccuuauuccuacgaccaggaagucgccgagguggaagccgcuacagcgcucgggggagaggugcaggccggcgcuguccaggccggggccggaggcccucccgcugcccugggcgggggaucucaaccccugagcaccauccaggcgccgcccuggccugcuguucuuccccgcccuacagccgccgcugcccuggggcccccggcuccugugcaggccaaggcgagacgggugaccgaggauuccgaagaggaagaggaagaggaggaggaacgcgaagagauggccgucacagaacaacucgcugccgggggacacagaggccuggacgggcugcccaccacggcuccugccggccccagccucccuauucaggaggagcgggcggaagccggagcucgcgccgaggcuggcgccagacccgaagagaaucugauccuugaugcccaggcuaccucucgguccacagggccggagggagugacccaugcgccuagccugggcaaagccgcucucguucccacacaggccgugcccgggucuccucgcgacccggucaagcccuccccucacaacauccugagcaccucucuucccgaugccgcuuggauuccucccacgagagaagugccucggaaaccccaaguucugccgcauucccacguggaggaagacacagacccuaauagcguccacuccaucccccgcucuagcccugagggauccaccaaggaucucauugaaacauguugcgccgcgggccagcagugggcuaucgacaacgaugagugucuggagauucccgaaagcgggaccgaggacaaugugugcagaaccgcccagcggcauugcugugucucuuaccugcaagaaaaguccugcauggccggcgugcucggagcuaaagagggcgaaacauguggggccgaggauaacgacagcugcggaaucucucuguauaagcaguguugcgauuguugcggccuugggcugagaguucgcgcggagggacagagcugugaauccaauccgaaccucggcuacccuugcaaucacgugaugcugucuuguugcgagggggaggaaccccuuauugucccugaagugcggagaccucccgagcccgcugccgccccgcgccggguuagcgaggcugaaauggccggcagagaggcucugucccucggaacggaagccgagcugcccaacagccugccuggcgacgaucaggacgagugccuccugcuucccggggaacugugucaacaucucugcaucaauaccgugggaucuuaucacugugcgugcuuuccuggcuucucccugcaggaugacgggcgcacaugucggcccgagggacauccuccgcagcccgaagccccucaggagcccgcucugaaaagcgaauuuucucaagucgccuccaacaccaucccucuuccccucccgcagccuaauacaugcaaggacaacggccccuguaaacaggugugcagcaccguugggggcuccgcuauuuguucuugcuuccccggauacgccaucauggccgauggcgugagcugugaggaccaagaugagugccugaugggggcucacgacugcuccagacgccaguuuugugucaacacgcugggaucuuucuauugcgugaaucacacagugcucugugcggauggcuacauucugaacgcccaucggaagugcgucgacaucaaugaaugugugaccgaucuucauaccugcagcagaggggagcacuguguuaacacacugggauccuuucacugcuauaaggcucucaccugugaaccuggcuacgcccugaaagacggcgagugcgaagauguggacgagugugccauggggacacacacgugccagcccggauuccugugccagaauaccaagggcagcuuuuacugucaagcucgccagcggugcauggauggguuccuucaggacccugagggaaacugugucgauauuaaugaaugcacaucucucuccgagccguguagacccggcuucagcugcaucaacaccguggggucuuauacaugucagcggaauccucugaucugcgcccgcggauaccaugcguccgacgacggcaccaaauguguugaugugaacgaaugcgagacgggcguccacagauguggggaaggacaagugugccauaaucugcccggcagcuaucggugcgacuguaaggcuggguuucagagagaugccuucggacgcggcugcauugacguuaacgaguguugggccucuccugggcggcucugccagcacaccugugagaauacacugggaagcuacagaugcuccugugcuagcggcuuucuucuggccgcggauggcaaacgcugcgaagacgugaacgagugugaagcucagagaugcucucaagagugugccaauaucuauggguccuaccagugcuauugucggcagggauaccaacucgccgaggauggccauaccugcacagacauugaugaaugcgcucagggggccggaauccuguguaccuuccgcugccugaacguccccggcagcuaccagugugcuugcccggagcagggguauacgaugacagccaacggaagauccuguaaggacguggaugaaugcgcgcuuggcacccacaauuguucugaggccgaaacaugccacaacauucaaggcagcuuucggugucuccgcuucgagugcccucccaauuacgugcaggucuccaaaaccaagugugagagaaccacaugccaugacuuucuggaaugccagaacucuccugcucggaucacgcacuaucagcugaauuuccaaaccgggcuccugguucccgcccauaucuuucgcauuggaccugcucccgccuucacaggcgauaccaucgcccuuaacauuaucaaggggaaugaggaaggauacuuuggcacaagacggcugaacgcuuauaccggggugguguaccuccagcgcgcgguccuggagccgagagacuucgcccuggacguggaaaugaaacuuuggcggcagggaagcguuacgacauuucucgcuaagaugcacauuuucuucaccaccuuugcccuguga

SEQ ID NO: 69200 - RNA, 1347 nt, Artificial Sequence
  derived and/or modified sequence opt5 from FBLN5__Homo_sapiens__NP_006320
augcccggcaucaagcggauucugaccgugacaauccucgcccugugccuuccuagcccggggaacgcucaggcccaauguacgaauggauucgaccuggauagacaguccggccagugccucgacauugaugagugucgcaccauccccgaagcgugcagaggggacaugaugugugucaaccagaauggaggcuaccugugcauuccucggacaaaccccguuuaucgcgggccuuacucuaaucccuauagcaccccuuacuccggaccguaucccgcugccgccccuccccuuucugcuccuaacuaccccacaaucagcagaccgcugaucugucgguuuggcuaucaaauggaugaguccaaucagugcguggacguggaugaaugugccaccgacucucaccagugcaacccuacacagauuuguaucaauaccgagggcggguacacgugcagcugcaccgauggauacuggcuccuggaaggccaaugucuggacauugaugagugccgcuauggguacugucagcagcucugcgcuaacguccccggauccuauagcuguacaugcaauccuggcuucacccugaacgaggacgggagaucuugucaggaugugaaugaaugcgccacagagaaccccuguguucaaaccugcgugaauacguacggauccuuuaucugucggugcgaccccggcuaugaacuugaggaggacggcguccacugcagcgauauggacgaauguucuuucuccgaguuucugugccagcacgaaugugugaaccagccugggacauacuucugcagcuguccgcccggauauauucuccuggaugacaaccgcucuugccaagauaucaaugagugugaacauagaaaccauaccugcaaucuucagcagacauguuacaaccugcagggcggguuuaaaugcauugacccuauccggugugaggagcccuaccuccgcaucuccgauaauagaugcaugugcccugcggaaaaccccggaugucgggaccaaccguucaccauucuguaucgcgauauggacguugugagcggcagauccgucccugccgauaucuuucagaugcaggcuaccacacgguaccccggggccuauuacauuuuccagaucaagucuggaaaugagggcagagaauuuuauaugcgccaaacgggcccuauuagcgcuacccuggugaugacacggcccaucaaagggccuagagagauccagcucgaccuggaaaugauuaccgugaacacagucaucaauuuccgcggauccagcguuauucggcuuagaaucuacgugucucaguaucccuuuuga

SEQ ID NO: 69201 - RNA, 8616 nt, Artificial Sequence
  derived and/or modified sequence opt5 from FBN1__Homo_sapiens__NP_000129
augagacggggccgccugcucgagaucgcccugggguucaccgugcuucuggcuagcuacacaucccacggagccgacgcgaaccucgaagcuggcaaugucaaggagacgagagccucucgggccaaacgcagagggggaggcgggcaugaugcucugaagggacccaacguuugcggcagccgguauaaugccuacuguugcccuggcuggaaaacccuuccggggggaaaccaguguauugugcccaucugccgccacuccuguggcgacggguuuugcucuagaccuaauauguguacaugccccagcggacaaauugcuccuuccuguggcucucggagcauccagcauugcaacauucgcuguaugaaugggggauccugcagcgaugaccacugccugugucagaagggcuauaucggcacccauugcgggcagcccgugugugaaucuggaugccucaacggcgggagaugugucgccccuaaucggugcgcguguacauacggauucaccggcccgcaaugcgagcgcgauuauagaacagggcccuguuuuaccgugaucuccaaccagaugugccagggacagcugagcggcauuguuuguacgaaaacccugugcugcgccacagugggccgggcuugggggcacccuugugaaaugugccccgcccaaccucaccccugucgcagaggauucaucccgaauauucggaccggcgcuugccaggacgucgaugagugucaggccaucccugggcucugccagggaggcaacuguauuaauacaguggggucuuuugagugcaagugucccgcgggccauaagcugaacgaaguuucccaaaaaugcgaggacaucgaugaauguagcaccauuccuggaaucugcgagggcggggagugcacgaauacagugucuuccuacuucuguaagugcccccccggauuuuauaccagcccugacggcacaagauguaucgauguccgcccgggguacugcuacaccgcccuuaccaacggacgguguuccaaccagcugccccagucuauuacaaaaaugcaaugcuguugcgacgcuggcagauguuggagcccuggggugacgguggcccccgaaaugugcccuauccgcgcuaccgaggauuucaauaagcucuguuccguccccaugguuauuccgggccggccugaauaucccccucccccucugggacccaucccgccugugcuucccgugcccccuggcuuuccgcccgggccucagauucccgucccuagacccccuguggaguaccuguaucccagccgcgaaccgccucggguucuccccgugaacgucacagacuacugccagcuggugagauaucugugccagaauggacgcuguaucccuacccccggcucuuaccggugcgaguguaacaaaggguuccaacucgaccugagaggagagugcaucgauguugacgaaugugagaagaauccgugcgccggcggggaauguauuaacaaucagggcuccuauacaugccagugucgcgccggauaccagagcacccuuacgcggacagagugcagagauaucgacgaaugucugcaaaacggccggauuugcaauaacgggcgcugcaucaauaccgauggaucuuuucacugugugugcaacgcuggcuuccaugucaccagagacgggaagaauugugaggauauggacgagugcagcauucggaacaugugucucaauggaaugugcaucaacgaagauggcuccuuuaaauguaucugcaagccuggguuccagcuggcgucugacggcagauacuguaaagauauuaacgagugcgaaacacccggaaucuguaugaauggccgcugcgugaacaccgacgggagcuaucggugcgaguguuucccuggacuugccgucggccuggacgggagagugugcguugauacacacaugcgcuccacguguuacggaggcuauaagagaggccagugcauuaaaccccucuuuggggcugugaccaagagcgaauguugcugugccucuacagaguacgccuucggagagcccugccagccuuguccggcucaaaauuccgccgaauaucaggcgcugugcagcucuggccccgggaugaccuccgcuggaagcgacaucaacgagugugcccuggauccugacauuugccccaauggcaucugugaaaaccuccgggggacauacaaaugcauuugcaauuccggauaugaggucgauucuaccggcaagaacuguguggacaucaaugagugcguucugaacagccuucugugugauaauggccagugccgcaacacgccuggguccuuuguguguaccugccccaagggauucaucuacaaaccugaccucaagacaugugaagauauugacgagugcgaaucuagcccguguaucaauggcgucugcaaaaacucccccgggagcuuuauuugugagugcucuuccgaaagcacccuggauccuacaaagaccaucugcauugagacgaucaaaggaacauguuggcagaccgugaucgacggcagaugcgagauuaauaucaacggggccacacuuaagucucaauguugcuccagccugggagcugccuggggcucucccuguacccucugccagguggauccuauuuguggcaagggguacagccggaucaaaggaacccagugcgaagacauugacgagugugaaguuuuccccggcgucugcaagaacgggcugugugugaauacacgcggauccuuuaaaugccaaugcccgagcggcaugacgcuggaugcuaccgggagaaucugucucgacauccggcuggagacaugcuuccuucgcuaugaagaugaggaguguacccugccuauugccggaagacaccggauggacgcgugcuguugcucugugggcgccgcuuggggcacagaagagugugaagagugccccaugcgcaacacccccgaauacgaggagcucuguccuagagggcccggauuugccacgaaggaaaucacaaauggcaaaccuuucuuuaaggauauuaacgagugcaagaugaucccgucccuguguacccaugggaaaugccggaauaccauuggaagcuucaagugcagaugugacuccggcuuugcucuggauucugaagagcgcaacugcacagacaucgaugagugucggaucagccccgaccuuugcgggagaggacagugugucaauaccccuggcgauuucgaaugcaaaugugacgagggcuaugaauccggguucaugaugaugaagaacugcauggauauugacgagugucagcgcgacccccuccugugccggggaggcgugugucacaauacagaagggucuuacagaugcgagugcccucccggacaucagcugagcccgaacaucuccgccuguauugauaucaaugagugcgaacucucugcgcaccuguguccuaacggccgcugcguuaaucuuauugggaaauaucaaugugccugcaaccccggauaccauagcacgccugaccggcuguuuuguguggauaucgacgagugcuccauuaugaauggcggcugugaaaccuucugcacaaacagcgaggggucuuaugaauguuccugccagcccggauuugcucucaugccugaucagagaagcugcaccgacaucgaugagugugaggacaaccccaauaucugcgauggcgggcaguguacaaacauuccgggagaauaccgcugccuguguuacgacggcuucauggccucugaggauaugaagaccugcgucgacgugaaugaaugugaccugaacccuaauaucugccuuuccgggacgugugagaacaccaagggaagcuuuauuugccacugugauaugggcuauucuggcaaaaaggggaaaacaggaugcaccgacaucaaugaaugcgagauuggcgcucacaacugugggaagcaugccguuugcacaaauaccgccggauccuucaaauguagcugcucccccggcuggaucggggauggcaucaaguguacagaccucgaugagugcagcaacggaacccacauguguucucaacaugcugacugcaaaaauacgaugggcagcuaccggugucugugcaaggaaggguauacaggagauggcuuuaccuguaccgaccuggaugagugcuccgaaaaccucaaucugugcgggaacggacagugucuuaaugcgcccggcggguacagaugcgagugugacaugggcuucgugccuucugccgauggaaaggcuugcgaggacauugaugaauguagccugccgaacaucugcgucuuuggcacaugucacaaucuccccgggcuguuccggugcgagugugaaauuggauaugagcuggaccgcuccggcgggaacugcaccgacgugaacgaaugucuugauccuacgacaugcaucucuggaaauugcguuaacacccccggcagcuacauuugugacugcccucccgauuuugagcucaauccuacaagaguggggugugucgacacccgguccggcaacugcuaucuggauauccgcccgagaggagacaauggcgauacagccuguucuaacgagaucggggugggagugagcaaagccuccugcuguugcagccugggcaaggcuugggggacccccugugaaaugugcccugccgucaauacgucugaguacaaaauucucugucccggaggcgaaggcuuccggccuaaccccaucaccguuauucuggaggacaucgaugaaugccaggagcuuccggggcugugccagggaggcaaguguauuaauacauuuggguccuuccaaugcagauguccuaccggauacuaucucaacgaggacacacgcgugugcgaugacgugaaugaaugugagacccccggcaucugcgggcccggaacguguuacaacacagucggcaauuauaccugcauuuguccucccgauuacaugcaggugaacggcgggaauaacugcauggacaugcggagaagccuguguuaucgcaacuacuaugcggacaaucagacaugcgauggagaacugcuuuucaacaugaccaaaaagaugugcuguugcucuuacaauaucggccgggcuuggaacaagccuugugagcaaugcccgauccccuccaccgacgaauuugccacacucugugggagccagagaccuggauucguuauugauaucuacacgggccugcccguggacauugaugagugccgcgagaucccuggggucugugaaaauggagugugcauuaacaugguuggcuccuuucggugugagugccccgugggcuucuuuuauaaugacaaacugcucgucugugaagauaucgacgagugccagaacgggccggugugccagagaaaugccgaguguaucaacaccgcuggaucuuaccgcugcgauuguaagccuggcuauagauucacaagcaccgggcaaugcaaugaccggaacgaaugucaggagauucccaauaucugcucccacggacaguguauugauacaguuggcagcuuuuacugccugugucauaccggguucaaaacgaacgacgaccagacaaugugccuugauaucaaugaaugugagcgcgacgccugcggaaacggcaccuguagaaacaccauuggcucuuuuaauugccggugcaaccacggguucauccugucccauaauaacgauuguaucgacguggaugaaugcgcgagcggaaauggcaaccucugucgcaaugggcaaugcauuaacacagucggaucuuuucagugucagugcaaugagggcuaugagguggcuccugacgggagaaccuguguggauaucaacgaaugccugcuggagccccggaagugugccccuggaacaugccagaaucuugacggcagcuacagauguauuugccccccgggcuauucccugcaaaacgaaaaaugcgaggauaucgacgaaugugucgaggagccugaaauuugcgcccucgggacguguucuaauaccgagggaagcuucaagugccugugucccgaaggcuucucccucucuagcuccgggcgccggugccaggaucugagaaugagcuacuguuacgcuaaguuugagggaggcaaaugcucuucccccaagagccgcaaccacuccaaacaggaauguugcugugcccuuaagggggagggauggggcgacccuugcgagcugugcccgacagaacccgaugaggcuuuccggcagaucuguccuuauggcucugggauuaucguuggacccgacgacagcgccguggauauggacgaaugcaaagagccugauguguguaagcauggccaaugcaucaauaccgacggguccuacagaugugagugccccuuuggauauauucucgcgggcaacgaaugugucgauacagacgagugcucuguggggaacccuuguggaaauggcaccugcaagaacguuaucggcggguucgaauguacgugcgaggaaggauuugagcccggcccgaugaugaccugcgaggauauuaaugaaugugcccagaacccucugcugugcgcuuuccggugugugaauacauacgggagcuaugagugcaaaugucccgucggauacgugcuucgcgaagacagacggaugugcaaggaugaggacgaaugugaggagggcaaacacgauugcaccgaaaagcagauggaguguaaaaaccugaucgggacauauaugugcauuuguggcccuggauaccaacgcagacccgacggcgaagggugcguugacgagaaugaaugccagaccaagccgggaaucugugagaacggccggugccucaauacacgcggguccuacacgugugagugcaacgauggauuuaccgccagcccuaaucaggacgaaugucuggauaacagagagggcuauugcuucacagaagugcuccagaauaugugucaaaucgggucuuccaaccggaaucccgucaccaaaagcgagugcuguugcgacggcggacgcggcugggggccccacugugagauuugcccuuuucagggaaccguggcuuucaagaagcugugcccccauggcagaggguuuaugacaaacggagccgauaucgacgaauguaaagucauucacgaugugugccggaacggcgaguguguuaaugacagagggucuuaccauugcaucuguaagacgggcuauaccccugauauuacaggaaccuccugcguggaccuuaacgaauguaaucaggccccgaaacccugcaacuucaucuguaagaauacagagggcagcuaccagugcucuuguccuaaaggguauauccugcaagaagauggacgcagcugcaaggaccucgaugagugcgcuaccaagcagcacaacugucaguuucugugcgucaauacgauuggcggguucacauguaaaugccccccuggauucacccagcaucacaccuccuguaucgacaacaaugagugcacaucugacauuaaccuguguggcagcaaggggaucugccaaaauacccccggcuccuuuacaugugaaugccagcggggauucagccuugaucagaccggcuccucuugugaggacguggaugaaugcgaggggaaccacagaugccaacauggaugucagaauauuaucggcggguaccgcugcagcuguccucagggauaucugcagcacuaccaauggaaccagugcguugacgaaaaugagugucucuccgcgcauauuugcggcggcgccucuugucacaacacgcuggggagcuacaaaugcauguguccggcuggauuucaguaugagcaguucuccggcgggugccaagauaucaacgaauguggaucugcccaggcccccugcagcuacggcugcuccaauacagaggggggauaucucuguggcugcccucccggcuacuuucggaucgggcagggacacugugugagcggcauggggaugggaagaggcaacccugaacccccggucucuggggagauggacgauaauucccugagcccugaagcuugcuaugaguguaagauuaacggauaccccaaacgcggccggaagagacgcucuaccaaugagacagacgccuccaacaucgaagaucagagcgagaccgaagcgaaugugucucuugcuuccugggacguggagaagacggccauuuucgccuuuaacaucagccauguuuccaauaaaguccggauucuggagcugcuccccgcucugaccacacuuaccaaccacaauagauaucugaucgaaagcggcaacgaggauggguucuuuaagaucaaucaaaaagaaggaauuucuuaccuccauuucacaaagaaaaagccuguggccggcaccuacagccugcagaucuccucuacaccccucuauaagaaaaaggagcugaaccagcuugaagacaaauacgauaaggacuaucugagcggggagcugggagacaaucucaaaaugaagauucaggugcugcuucacuga

SEQ ID NO: 69202 - RNA, 8739 nt, Artificial Sequence
  derived and/or modified sequence opt5 from FBN2__Homo_sapiens__NP_001990
augggaagacggcgcagacugugccuccagcuguacuuccuuuggcuggggugcgugguccucugggcccagggaaccgcuggacagccccagccuccgcccccuaaacccccucggccccagccuccgccccagcagguucgcagcgccacagcgggguccgaaggaggcuuucuggcuccugaauauagagaagaaggggccgccguggcuucucgggugcgcagacggggacagcaggacguccuucgcggccccaacgugugcggcagcagauuccacuccuacugcugcccuggguggaaaacgcugcccggaggcaaucaaugcaucguuccgauuugccggaacucuugcggggauggauuuugcagccgcccuaauauguguaccugcuccucuggccagaucagcuccacaugugggagcaagucuauucagcagugcuccgugagaugcaugaacggaggcaccugugccgacgaucauugccaaugucagaaaggcuauaucgggacauacugcggacagcccgucugugagaauggcugccaaaacgggggacgguguauuggcccuaaucgcugcgcuuguguguauggguucaccggaccccagugcgaaagagacuaccggacaggccccuguuuuacccagguuaacaaucagaugugccaaggccagcucacggggaucgugugcaccaagacacuguguugcgccaccaucgggagagcguggggccacccuugugagaugugcccggcccagccccagccuugucgccggggguucauucccaacaucagaacaggagcuugccaagaugucgacgagugucaggccauuccuggcaucugccaagggggaaauuguauuaacaccgugggcagcuuugaaugccgcugucccgcuggccauaaacagucugagacgacacaaaagugcgaagauaucgacgagugcuccauuaucccggggaucugugagaccggagaaugcagcaauacagugggcucuuauuucugugucugcccucggggguacguuaccuccaccgauggaagcagauguauugaccagcgcacaggcaugugcuuuuccgggcuggugaacggccggugugcccaggagcuccccggaagaaugacgaagaugcagugcuguugcgaaccuggccgcuguugggggaucggaaccauucccgaggcgugcccugugcggggcucugaagaguacagacgccugugcauggaugggcuucccaugggaggcaucccggggagcgccggcucccggccuggaggcacagggggaaauggcuucgcucccagcgggaacggaaacggcuaugggcccggcggaaccggcuuuauuccuauccccggcgggaauggguucucucccggggucggaggcgccggcgugggggcuggaggccaagggccuaucauuacaggacugaccauccucaaccagacgauugacaucuguaaacaccaugccaaucugugccuuaacggcagauguauucccacaguuuccagcuaccggugcgaguguaauaugggguauaagcaggaugccaacggagacugcaucgacguggaugaauguaccucuaauccuugcaccaacggcgacugugucaauacacccggcagcuacuauugcaaaugucacgcuggguuucaacgcaccccuacaaagcaggcgugcaucgauauugacgagugcauccagaacggagugcuguguaaaaauggcagaugcguuaacacggauggguccuuccaguguauuugcaaugccggauucgaacucaccacagacggcaagaacuguguggaucacgacgagugcaccacaaccaauaugugucugaacgggaugugcaucaacgaagauggaucuuuuaaguguauuugcaaacccggcuucguccuggcuccgaauggccgguacuguacggacguggaugagugccaaaccccugggaucugcaugaacggacauuguauuaauagcgagggcuccuuuagaugcgacugucccccugggcucgccgucggaauggacggccgcgugugcguugauacacacaugcggagcaccuguuaugggggaaucaagaaaggcgugugcgucagacccuucccgggcgccgugacaaagucugaauguugcugugcuaacccugacuacggguuuggagagcccugccagccuugucccgccaaaaauuccgcggaguuccauggccugugcagcucugggguuggaaucaccguggauggccgcgacauuaacgagugugcucuugaucccgacaucugcgccaaugggauuugcgaaaaccugagaggauccuaccgguguaauugcaacagcggcuaugagccugaugccuccggccgcaauuguaucgacauugaugagugccucgucaacagacugcuuugugacaaugggcugugccggaacacgccgggaucuuacagcuguacauguccgccuggcuauguguuucgcaccgaaacagagaccugugaagauaucaaugagugcgaguccaaccccugugugaacggggcuugcagaaauaaccucggaucuuucaauugcgaauguagcccuggcuccaagcugagcucuaccgggcugaucugcauugacucccucaaaggaacauguuggcugaacauccaggauagccggugcgagguuaauauuaacggcgccacgcuuaagucugaauguugcgcuacccugggcgccgcgugggggucccccugugagcgcugcgaacucgacacagccuguccuagaggacuggcucggaucaagggcgugaccugcgaggacgugaaugagugugaaguguuuccgggggucugccccaacggacgcugcgugaauagcaaaggcucuuuccacugugagugcccugaagggcuuacacuggauggaaccggcagaguuugucucgacauucggauggagcagugcuaccugaagugggaugaagacgaguguauccaccccgugccuggcaaauuuagaauggaugccugcuguugcgcugucggggccgcguggggaacggagugugaagagugccccaagccgggcacaaaagaauaugagacccuguguccucgcggggccggauucgcuaaccggggcgacgugcucaccgggagacccuuuuacaaggauaucaaugaaugcaaggccuuccccggcaugugcacauauggaaaaugucgcaacaccauuggcagcuucaagugccgguguaauuccggguuugcucuggacauggaggagagaaacugcacagauaucgacgaaugucgcauuagcccugaucuuugcggaucuggcaucuguguuaauacgcccggguccuucgagugcgaauguuuugagggauacgagagcggcuucaugaugaugaaaaacugcauggacauugaugaaugugagcggaacccucugcucugcagagggggaaccugcgugaauacagaaggauccuuucaaugugacugcccgcugggccaugagcugucucccagccgcgaagacugugucgauaucaacgagugcucccuuucugacaaucucugucggaacgggaagugcgugaauaugaucggaaccuaccaguguagcugcaacccuggcuaucaggccacacccgauagacagggguguaccgacauugaugagugcaugaucaugaauggaggcugugacacgcaaugcaccaacuccgaagggucuuacgagugcagcuguuccgaaggcuaugcccugaugccugauggacggagcugcgcugacauugaugagugugaaaauaaccccgacaucugcgauggcgggcaguguacaaauauuccgggagaguaccgcugccuguguuaugacggcuucauggcgucuauggacaugaaaaccugcaucgauguuaacgagugugaccucaauuccaacauuugcauguuuggggaaugugagaauacaaagggcagcuucaucugccacugccagcugggcuacucugugaagaaaggcaccacaggguguaccgaugucgacgaaugcgagaucggagcccauaacugugauaugcacgcuuccugccuuaauauuccuggcagcuuuaaguguucuugcagagaaggguggaucggaaacggcauuaaauguaucgaccuggaugagugcuccaacgggacgcaucaauguagcauuaaugcccagugcgugaacacacccggauccuaucggugugccugcagcgagggcuucaccggcgacggguuuaccugcucugauguggacgaaugugcugagaauaucaaccucugcgaaaauggacagugucugaacgucccuggcgccuaccgcugcgagugugagaugggguucacacccgcgagcgauuccagaucuugccaggacaucgaugaauguagcuuucaaaauauuugcguuuucggaaccuguaacaaucugccuggcauguuccacugcaucugugacgacggguacgagcuugaucggacgggaggcaacugcacagacauugaugaaugcgcugaccccaucaauugugugaacggccucugcgugaauaccccggggagauaugaguguaacugcccucccgauuuucagcugaaucccacaggagucggcuguguggacaaccgcguugggaacugcuaccugaaguucggaccucggggcgaugggucccucucuuguaauaccgaaauuggagugggcgucagcagauccucuugcuguugcagccugggcaaagccugggggaacccgugugagacaugucccccugucaauagcaccgaguauuacacgcuuugccccggaggcgaaggguuucgcccuaaccccaucaccaucauucuggaggacaucgaugaaugucaggagcucccuggacugugccagggcgggaauuguauuaacacauucggcagcuuucaaugcgaauguccgcagggcuauuaccugucugaggacacccggaucugcgaggauauugacgaauguuucgcccaccccggcguuugcgggccuggaacauguuauaauacccuuggcaacuacacgugcaucugucccccugaguacaugcaagugaaugggggacauaacugcauggauaugagaaaguccuuuugcuaucgcagcuacaauggcacaaccugugaaaacgagcuccccuucaaugucacaaagcggaugugcuguugcaccuauaacguggggaaggcuuggaauaagccgugugaaccuugccccacccccggaacagccgacuuuaaaacgauuuguggcaacaucccuggcuucaccuuugacauccacacagggaaggcgguugauauugacgagugcaaagagauccccggaauuugugcuaacggcgugugcaucaaucagauugggucuuucagaugugaaugcccuaccggauucuccuacaacgaucugcugcucgucugcgaggacaucgaugaauguagcaauggcgacaaccugugccaacgcaaugccgauuguaucaacuccccggggucuuauagaugcgagugugccgcuggauuuaaacuuagccccaauggcgccugcguggaccggaacgagugucuggaaauuccuaaugugugcucccauggccucugugucgaucugcaggggagcuaccagugcaucugucacaacggauucaaggcuucucaggaccaaacaaugugcauggauguugacgagugugaacgccaccccugcggcaaugggaccugcaagaacacggugggauccuauaauugucugugcuacccuggcuuugagcuuacacauaacaaugacugucucgauauugacgaaugcagcucuuucuuuggacagguguguagaaacggccggugcuucaacgagaucggcagcuuuaagugucugugcaaugagggcuacgaacugacccccgaugggaaaaacuguauugacaccaaugagugcgucgcccucccgggauccuguucuccuggcacaugccagaaccuggaagggagcuuccgcugcaucugucccccuggauaugaggugaaguccgaaaauugcaucgauauuaacgagugugacgaggaucccaauaucugccuuuuuggcucuuguaccaacacaccugggggcuuccaaugccugugucccccgggauuuguucucagcgacaauggcagacggugcuucgauacgagacaguccuuuuguuucaccaacuucgaaaaugggaaaugcagcgugccuaaggcguuuaacacaaccaaagccaaguguugcugcucuaagaugcccggagagggcuggggagaccccugugaacugugcccuaaagaugacgaggucgcuuuccaggaucuguguccguacggacacggcacagugcccucccuucaugacacccgcgaagacguuaaugagugccuggagagcccugggauuuguuccaacggccagugcaucaauacggauggaucuuuucggugugaaugccccaugggcuauaaccucgacuacaccggggugagaugugucgauacagacgagugcagcauuggaaacccuuguggcaaugggaccugcacaaacgugaucggauccuucgaaugcaauuguaacgagggcuuugagcccgggccuaugaugaauugcgaagauauuaacgagugugcccaaaauccccugcucugcgcuuuccgcuguaugaacaccuuuggcucuuaugaaugcacauguccgaucggauacgcccugcgggaggaccagaagaugugcaaagaucuugacgaaugugccgagggccugcacgauugcgagagcagagggaugauguguaagaaucucaucggaacguucaugugcauuugcccucccggcauggcucggcgcccugacggggaaggaugugucgaugagaacgaaugcagaaccaaacccggcaucugugagaauggccggugcgugaacauuaucggguccuaucgcugugaaugcaaugagggauuucaguccucuuccagcggcacagagugucuggacaacagacaggggcugugcuucgcggaaguucuucaaaccauuugucagauggccucuuccagccggaaucuggugaccaagucugagugcuguugcgacggaggccgcggguggggacaucagugcgaacucuguccgcugccuggcacagcucaguacaagaaaaucugcccccacggccccggguacacgaccgauggaagagacaucgaugaguguaaggucaugccuaaccucugcacaaacggccaauguauuaauaccauggggagcuuucggugcuucuguaaagugggauauacaaccgacaucuccggcacgucuugcauugaucuggacgaauguagccagucccccaagccuugcaacuacaucuguaaaaauacagaggggagcuaucagugcuccugcccgcgcggauacguucuucaagaggauggcaagaccuguaaggaccuggaugaaugccagaccaaacagcacaacugucaguuucucugcgugaauacacugggcggguucaccuguaagugucccccuggauucacacaacaucacaccgccuguauugacaacaaugagugcggcucucagcccagccuguguggggccaaaggaaucugccagaacacgccuggcuccuuuucuugugaaugccagagaggguucagccuugaugcuacaggacugaauugcgaggacgucgaugagugugacggcaaccaucggugccaacacggcugucagaauauccucgggggauauagaugcggcuguccccagggguacauucagcauuaucaauggaaccagugcguggacgaaaaugaguguuccaacccuaaugccugcggaucugcgagcuguuacaacacccugggcuccuacaagugcgcuuguccgagcggguuuucuuucgaucaguuuuccagcgccugccacgacgugaacgaauguucuuccagcaaaaaucccuguaacuauggaugcucuaauacagagggcggcuaccucugugggugcccucccggauauuaccgcguuggccaggggcacugugucuccggaaugggcuucaacaaggggcaauaucugagccuugauaccgaaguggacgaggagaaugcccuguccccugaggcuugcuacgaguguaaaaucaacggauauagcaagaaggauucucggcagaaaagaagcauucaugaacccgacccgacggccguggagcagaucucccuggaaucugucgauauggacagcccugugaauaugaaguuuaaccucucccaccugggcucuaaagagcauauucuugagcugcgccccgcgauccaaccccucaauaaccacauucgguacguuaucagccagggcaaugaugacuccguguucagaauccaccagcgcaacgggcugucuuaccuccauaccgcuaagaaaaagcugaugccuggaacauauacccuugaaauuacaagcaucccccuguacaagaaaaaggagcugaaaaagcucgaagaguccaaugaagaugacuaucugcuuggcgagcugggggaggcccuccggaugagacugcagauucaacucuacuga

SEQ ID NO: 69203 - RNA, 8430 nt, Artificial Sequence
  derived and/or modified sequence opt5 from FBN3__Homo_sapiens__NP_115823
augacccuggaaggccuguaccuggccagagggccccuugcucggcugcuccuggccuggagcgcgcuucugugcauggcuggaggccaggggcgcugggacggagcccucgaagccgcuggcccugggagagugcggcgcagaggauccccgggcauccugcaaggccccaacgucugcgggucucgguuccacgccuauugcugcccuggauggcgcacauuucccggcagaagccagugcguugugccuauuugucggcgcgcuugcggggagggauucuguucccagcccaaucugugcacgugugccgauggcacccucgcgccuucuugcggggugagcagaggauccggcuguucugucagcugcaugaacggcgggacaugccggggagccuccugucugugccagaaaggcuacaccgggacaguguguggacaaccgaucugcgaccgcggcugucauaaugggggaagaugcauuggccccaaccggugugcuugcguuuauggcuuuauggggccucagugugaacgcgauuacagaaccggacccugcuucggccagguggggccugagggaugucagcaccaacuuacaggccuggucugcaccaaagcccucugcugugcuacgguggggcgggccuggggccugcccugcgaacuuuguccggcgcagccucaucccugcagacgcggauuuaucccuaauauucacaccggcgccugucaggacguugaugagugccaggcugugcccgggcugugucaaggaggcagcugcgucaacaugguggggucuuuccauugucggugccccgugggacacagacucuccgacagcucugccgcuugugaggauuaucgcgccggcgccugcuuuuccguccuguucgggggccggugcgcuggagaccuggcgggccacuacacaagacgccaguguugcugugaucgggggagaugcugggccgcuggaccuguuccggaacucugucccccucgcggcagcaaugaguuucagcaacugugcgcccagcggcuuccccugcucccugggcaucccggacuguucccgggccuucugggguuuggcucuaacggaaugggcccuccccucgggccugccagacugaauccccacggauccgacgcucgcggcaucccuagccuggggcccggaaacuccaauaucggcaccgccacacucaaccagaccauugauaucugucggcauuucacgaaucugugccuuaacgggagaugucugccgacaccuucuagcuaucggugcgaauguaaugugggcuacacccaggacgugcgcggagagugcauugaugucgacgagugcacauccagccccugucaccacggcgacugcgugaacauccccgggaccuaccauuguagaugcuauccuggauuucaagcgaccccgacacggcaggcuuguguugauguggacgaaugcauugucucuggcgggcucugucaccugggaagaugcgugaacacggagggcuccuuccaguguguuugcaaugccggcuucgaacuuagccccgaugggaagaacuguguggaccauaaugagugcgccaccucuacaaugugcgucaacggagugugucugaaugaagauggcagcuuuuccugccucuguaaaccuggguuccugcuggcucccggaggccacuacugcauggacaucgaugagugucagaccccugggauuugcgucaacggacauuguacaaauaccgagggcucuuuucgcugccaaugucucggcgggcuggccgugggaacggacggccggguuugcguggauacacacgucagaagcaccuguuauggggcuaucgaaaagggauccugcgcccgccccuucccuggcaccgugacaaaaagcgagugcuguugcgcgaaccccgaccacggguuuggagaaccgugucagcuuugcccugccaaggauucugcugaguuccaggcccuguguuccagcggccucggcaucaccacagacgggagagacauuaaugaaugcgcucuggaucccgagguuugugccaacggagugugcgagaaucugcggggcucuuaccgcugugucugcaaccuuggguaugaagcgggagccuccggcaaggacuguacggauguggacgagugcgcucucaauagccugcugugugauaacggguggugccaaaauuccccuggaucuuacagcugcuccugucccccgggcuuucauuucuggcaagacaccgaaaucugcaaagauguggacgagugucucucuagcccuugcguuuccggcgucuguagaaaccuggccgggagcuauacaugcaaguguggacccggcucucggcuugauccuuccgggaccuuuugccuggacagcacaaaaggaaccuguuggcucaagauucaggaaucucgcugcgaggugaaccugcagggcgcuucccugagaagcgaguguugcgccacgcuuggggccgcuuggggaucucccugcgaacggugugagaucgaucccgcgugcgcccgcggcuucgcuagaaugaccggcgugacaugugacgaugucaaugaaugcgagagcuuuccugggguguguccgaacggacggugcguuaauaccgccggcuccuuccgcugugagugccccgaagggcucaugcuggacgccagcggaagacuguguguggacguccggcucgagccuugcuuucugagaugggaugaagacgaguguggcgugacacuucccgggaaauaccgcauggauguuugcugcuguucuauuggagcuguguggggcgucgaaugcgaggccuguccugaccccgagucccuggaguucgcgagccucugcccucggggccugggguucgcuuccagagauuuucugucuggacgcccguucuacaaggacgugaacgaguguaagguuuuucccggccuuugcacccacgggacgugucggaauacagugggcagcuuccauugcgccugugccggaggguuugcucucgaugcccaggaaagaaacugcaccgacaucgaugagugucgcaucuccccugaccugugcggacaaggcacaugcgucaauacccccggcucuuucgaaugugagugcuuuccuggguaugagagcggauucaugcugaugaaaaacuguauggauguggacgaaugcgcgcgggauccccuccuguguagaggcgggaccugcacaaauacggacggauccuacaagugucagugcccgccuggccacgagcuuaccgcuaaagggacagccugugaagacauugaugagugcucucugagcgacggccucuguccccacggacagugcgugaacgucaucggcgccuuucaaugcuccugucaugcuggguuccagagcacccccgaucgccagggaugcguugacauuaaugaaugucgggugcagaacggcgggugcgaugugcacuguaucaauacagagggaucuuauagaugcuccuguggccaaggguacagccugaugccugacggccgggccugcgcugaugucgacgagugugaagagaacccccgcgugugcgaucagggacauuguaccaauaugccuggcgggcacagaugccugugcuaugacggauuuauggccacgccggauaugcggacauguguugacguggacgaaugcgaucuuaacccccauauuugucuccacggcgacugcgagaacaccaaggggucuuucgucugucacugccagcugggauacauggugcgcaaaggcgcgaccggguguuccgauguugacgagugcgaagugggcggacauaauugugauagccacgccucuugccugaacaucccuggcuccuuuagcuguagaugccuccccgggugggucggagacggcuucgagugccaugaucuggacgaaugugugucccaggagcaccggugcagcccuagaggggauugucuuaauguucccggaucuuaucgcugcacaugucggcaaggcuucgcuggcgacggguuuuucugcgaagauagagacgagugugccgagaacguggaucugugcgacaauggacagugucucaacgcuccgggcggguaccgcugcgaaugugagaugggauuugacccuaccgaagaucaucgggccugccaggacgucgaugagugcgcccagggcaaucugugugcuuucgggagcugcgaaaaccugcccggaauguuuagauguaucugcaauggcggcuacgagcuugaccgcgggggaggcaacuguacagauauuaaugagugcgcggacccugugaacuguaucaauggggugugcauuaacacgcccggauccuaucuguguucuugcccucaagauuucgaacucaaucccagcggcgucggguguguugacacccgggccggaaacugcuuucuggagacacacgauagaggcgacuccggcaucucuugcagcgcugaaauuggggugggagugacccgcgccuccuguugcuguucucucggcagagccugggggaacccgugcgagcuguguccuauggcuaauacaaccgaauaccggacgcuuugccccggaggcgagggguuccagcccaaccgcaucaccgucauucuggaggauaucgacgaaugucaggagcucccuggacugugccaaggcggcgauugugugaauacauuugggagcuuccagugcgaauguccgcccggauaucaccuguccgagcauaccagaaucugcgaggacauugacgaaugcagcacacacucuggcaucugugggccuggaaccugcuacaacacacuuggcaauuauaccuguguuugccccgccgaguaccuccaggugaacgggggaaauaacuguauggauaugcggaaguccgucugcuuucgccauuauaauggcacgugucagaacgaacucgcguucaaugugacaagaaaaaugugcuguugcagcuacaacauuggccaggcuuggaaucggccuugugaggccugccccaccccuaucucuccggacuaccagauucugugcgggaaccaggcccccggauuccucaccgauauccacacaggcaagccucuggacaucgaugaauguggggagauucccgcuaucugcgccaauggaauuuguaucaaccagauuggcuccuuuagaugcgaguguccugcgggguucaauuauaacagcauccuucuggcuugcgaagacguugaugaguguggaucccgcgaaucucccugccaacagaacgccgacuguaucaauauuccgggcagcuaccggugcaaguguaccagaggcuauaaacucuccccugggggagccugcgugggccgcaacgagugccgggaaauccccaaugucuguagccacggggauugcauggacacggagggaucuuacaugugucugugccauagaggcuuucaggcuuccgccgaucagacacuguguauggacauugacgagugcgaucggcaacccugugggaacggaaccugcaagaauaucauuggcagcuauaacugucuuugcuucccuggcuuuguggucacacacaauggggacuguguggauuucgacgaaugcaccacacugguuggacaggugugucgcuuuggccauugccucaacaccgcugggucuuuccacugccugugucaggauggauuugagcucacggccgacggcaaaaauugcgucgauaccaacgaaugucugagccuugcggggacaugccugcccggcaccugucagaaucuggagggauccuucagaugcaucuguccuccgggcuuucaagugcagucugaccauugcaucgauauugacgaauguagcgaggagcccaaccucugccuguucgggacauguaccaauuccccuggaucuuuucagugccuuugucccccuggcuucguucugagcgauaacgggcaccgguguuucgacacgcgccaauccuuuugcuucacaagauuugaagccggaaaguguagcgugcccaaggcuuucaauaccacaaagacccggugcuguugcucuaagcgcccgggcgagggguggggcgauccuugugaacucugcccccaggagggauccgccgcuuuucaggagcuguguccuuucggccacggggccguccccggaccugacgacagcagagaagaugugaacgagugcgccgaaaaccccggcguguguaccaaugggguuugcgucaacacagacggauccuuucggugcgaguguccguucggcuacucucucgauuuuacggggaucaauugcguggacaccgaugaauguagcgugggccauccuugcggacagggcacauguaccaacgucauugggggauucgagugcgcuugugcggacggcuuugagcccgggcugaugaugacaugcgaagauaucgacgaguguucccuuaauccccugcugugcgccuuccgcugucacaacaccgaaggaucuuaucucugcacgugcccugcuggcuacacacugagagaggauggggccaugugucgggacguggaugaaugcgccgacggccaacaggacugucaugcuagaggaauggagugcaaaaaucuuauuggcaccuuugccuguguuugcccgcccgggaugcgcccucugcccggaagcggcgagggguguaccgaugacaacgaaugccacgcgcagccugaucucugugugaauggacggugcgucaacacagcuggcuccuucagaugugacugcgaugagggcuuccagcccagcccuacccugacagaaugccacgacauccgccaagggcccuguuuugccgaggugcuccagacgaugugccggucucuguccuccucuuccgaagccguuaccagagcugaguguugcuguggaggcgggcgcggauggggcccgcggugcgagcuuuguccucugcccgggacaagcgccuacagaaagcugugcccucauggaucuggcuauaccgcggaaggccgcgauguggacgagugucggaugcucgcccaccugugcgcucauggggaauguauuaauagccuuggauccuucagaugccacugccaggccggcuacacacccgaugcuaccgccacgaccugucuggacauggaugagugcucucaggucccgaaaccuuguacauuucucugcaagaacaccaaagggagcuuccuguguuccugcccccgcggauaucuccuggaggaagacggccggacauguaaggaucuugacgagugcaccagcagacaacauaauugucaguuucugugcgugaacacaguuggggcuuucacgugucgcugucccccuggauuuacccagcaccaccaagccugcuucgacaaugaugaauguuccgcgcagcccggcccuugcggcgcccaugggcacugucauaacacaccgggaucuuuuagaugcgagugucaccagggcuucacccuggugagcuccgggcacggaugcgaagacgucaacgagugugauggcccccaucggugccagcacgggugucaaaaucagcucggaggcuaccgcugcucuuguccucagggcuuuacccagcauagccaaugggcucagugcguggacgagaacgaaugcgcccugucucccccuacaugugggagcgcuagcugcagaaauacgcuuggaggcuuccggugugugugccccuccggguuugauuucgaccaggcccugggaggcugucaggaggucgaugaaugcgccgggagacggggaccuuguagcuauucuugcgcuaacaccccgggcggcuuccucugugggugcccccaaggauacuuucgcgcgggccaggggcacuguguuuccggacugggcuucagcccugggccccaggacacaccugauaaggaggaacugcucucuuccgaggccugcuaugagugcaaaaucaauggacuuagccccagagaccggccgcgcagaucugcucaucgggaucaccaggugaaccuggccacccuggacuccgaagcccuccugacacuuggccugaaucucagccaccugggccgcgcugagagaauccuggaacuccggccugcccuugaggggcuggaaggacgcauuagauacgugaucguccggggcaacgagcaaggguuuuuccgcaugcaucaccugagaggaguguccagccuccagcugggccggcgcagacccgggcccggaaccuaccggcuugagguugugucucauauggcgggcccuuggggcguccagcccgaagggcaaccuggaccguggggccaggcccugagacucaaggugcagcugcagcugcucuga

SEQ ID NO: 69204 - RNA, 1017 nt, Artificial Sequence
  derived and/or modified sequence opt5 from FBP1__Homo_sapiens__NP_000498
auggccgaccaggcucccuucgauaccgacgugaacacacugacgagauuugucauggaggaaggccggaaggcccgcgggaccggagagcucacacaacugcuuaauagccugugcaccgcgguuaaagcuaucuccucugccgugagaaaggccggcauugcucaccucuacgggaucgccggaagcacaaacgugaccggcgaucaggucaaaaagcuggacgugcuuuccaaugaucugguuaugaacaugcucaaaucuagcuucgcuacaugugugcuggucuccgaagaggacaagcaugccauuaucguggaaccugagaagcgggggaaauauguugugugcuuugauccgcuggacggaucuagcaauauugauugucucgucuccgugggcaccaucuucggcaucuaccgcaagaaaagcacggacgagcccucugaaaaggaugcgcugcagccugggagaaaccuuguggccgcuggauaugcccuguacggcuccgcuaccaugcucguccuggccauggacugcgggguuaauuguuuuaugcuugaucccgcgauuggagaguucauccugguggacaaagacgugaagauuaagaaaaagggcaaaaucuauagccucaacgaaggguacgcccgggauuuugacccugcugucacagaguauauucagcgcaagaaauuucccccugauaauucugccccguacggagcuagauacgugggcuccaugguugccgacgugcaccggacccuggucuauggcgggaucuuccuguaccccgccaacaagaaaagcccuaauggaaagcuccgccugcuuuaugagugcaaccccauggcuuacgugauggaaaaggcgggcgggauggccacaaccggaaaagaggcuguucuggaugugauuccuacggacauccaucaaagagcccccgucauccucggcucuccggaugacgugcuggaguuccuuaaggucuaugaaaaacacuccgcccaguga

SEQ ID NO: 69205 - RNA, 1020 nt, Artificial Sequence
  derived and/or modified sequence opt5 from FBP2__Homo_sapiens__NP_003828
augaccgacagaagccccuucgagacagauaugcugacgcucacccgguacgugauggaaaagggccgccaggccaaagggacaggagagcugacccaacuucugaacuccaugcucacagcuaucaaggccauuucuagcgcggucagaaaagcuggccuggcccaccuuuaugggaucgccggauccguuaaugugaccggcgacgaagugaagaaacuggauguccucucuaacagccuggugauuaauaugguucaguccucuuacagcacaugcgugcuggucuccgaggaaaacaaggacgcuaucauuaccgccaaggagaaacgggggaaguaugugguuuguuuugauccucucgacggaagcucuaauaucgauugccuggcuuccaucggcacgauuuucgccaucuaccgcaaaaccagcgaggacgaaccgucugagaaggaugcgcuucaguguggcagaaacauuguggccgcuggguaugcccuguacggauccgcuacacucgucgcccugagcaccggccaggggguggaccuuuuuaugcuggaucccgcgcucggagaguucgugcuggucgaaaaagacguuaagaucaagaaaaagggcaaaauuuauucucugaaugagggguacgccaaguacuuugaugcugccacaaccgaauaugugcagaaaaagaaauucccugaggacggauccgcucccuacggcgcccgguaugugggcagcauggucgccgacgugcaucgcacgcucguuuacgggggaaucuuucuguauccugcuaaccaaaagucccccaagggcaaacuuagacugcucuacgaaugcaauccuguggcguauauuaucgagcaggccgggggacuggcuacaaccggcacacagccgguccuugaugugaagcccgaagccauccaccaacggguuccucugauucucgggucucccgaggacgugcaggaguaccugaccuguguccagaaaaaccaggccggaagcuga

SEQ ID NO: 69206 - RNA, 2943 nt, Artificial Sequence
  derived and/or modified sequence opt5 from FBRS__Homo_sapiens__NP_001098549
auggagaccgccgcugccgcggcucccggcccugggugggccgccgaaggagagagacggcgcagacggugcagccgcagagaccgggaucgcgaacagagacggcgcagaggccccgggggagacgcuccccgggcccugcucgcugccccucgcggcuccucuagcuccucuucucccccucccccugcgagaccgugguccuccgccagcuccggggagcggcccggaggcccucgcagacggagaccccgcccucggcccagaccgccucgcccccgggcuagaaagcgcccugccggcagcgggucucggggagaagaggaggaagaggaagaggaggaaggcggggcugaugacggagaggccgaagaggaacccgaggaggaagaggaagaggaagaggaucugaucgacggcuucgcgauugccuccuuugcuacacuugaggcccugcaaaaagaugcuagccuccagcccccugaaagacuggagcaccgccuuaagcauucugggaaacggaagagaggaggcuccagcggcgccacgggggaaccgggagacucuuccgaucgcgagcccggccggccucccggggacagagcccggaaauggccuaacaagcgcagacggaaggaagcuagcuccagacacucucuggaggcgggauacaucugugaugccgagagcgaccucgaugaacgcguguccgacgacgaucuggaccccagcuucaccgucucuacauccaaagcuagcggcccgcauggggccuuuaauggaaacugcgaggccaagcugucuguugugccuaaagugagcggccucgaacggucccaggagcagcccccuggccccgauccucugcuuguccccuucccgccuaaggagcccccgcccccgcccgugccuagacccccuguuucucccccugcuccccugccggccaccccuagccugcccccucccccgcaaccucagcugcagcuucgcgugucccccuuugggcugagaacaagcccuuauggaucuucccucgaccugagcaccgggucuuccagccggcccccucccaaagcgccggcucccccugucgcccagcccccucccuccucuagcuccucuagcuccucuagcuccagcgccucuuccagcucugcucaacugacacaccgcccuccgacccccagccucccucugccccuuuccacgcauagcuucccucccccggggcugagaccuccucccccuccccaccacccuucucucuuuuccccgggacccacccugccucccccucccccgcuucuccaggugccuggccaucccggggccagcgcugccaaugcgcucuccgaacaggaucugauuggccaggaccugaacucucgguaccucaaugcccaaggaggcccugagguugugggggcuggaggcagcgcccgcccccuggcuuuccaguuucaccagcauaaccaccaacaccagcauacacaccagcauacccaccagcauuucacaccuuaucccccggggcuucugccuccccacggaccccacauguuugaaaaguacccuggcaagauggagggccucuucagacauaauccguauaccgccuuucccccugcgguccccggccugccucccggacuuccuccggccguguccuucggcucucugcaaggggcuuuccagcccaaaagcacgaacccugaacugcccccucggcucggacccgugccguccggccugucucagaaggggacacagaucccugaucacuuucgcccuccccucagaaaacccggaaaguggugugccaugcauguccggguugcuuacaugauucugcgccaccaagagaaaaugaagggcgacagccacaaacuugauuucagaaaugaccugcuccccugccugccugggccguauggcgcccugcccccuggacaggagcuuucccaucccgccagccucuuuaccgcuacaggcgcggugcacgccgcugccaacccuuucaccgccgcucccggggcccauggaccguuucugucuccuuccacccacaucgaucccuucggccggccuacgagcuuugcgucucuggcugcccucuccaauggggccuucggaggccuggggagccccacauuuaacucuggcgcuguguucgcccagaaggaauccccuggagcgcccccggcuuuugccagcccucccgaccccuggggcagacuucaucgcuccccucugaccuucccggccuggguccggcccccugaggcugccagaacacccgggagcgacaaggaacgcccuguggagcggagagaacccucuaucaccaaagaggagaaggaucgcgaccucccuuuuagccggccccagcugagaguuuccccggcuacaccuaaagcccgcgcgggagaagagggcccccggccuaccaaggaaucugugagagucaaagaggaacggaaggaggaggccgcugccgcugccgccgcugcggccgcugccgccgcugccgcggcugccgccgcuacggggccccaaggacugcaccuucucuucgaacgcccgagaccuccucccuuccugggccccuccccucccgaucggugugccggcuuucuggagccgacauggcucgcggcucccccucgccuggccagacccccucgguucuacgaagccggggaggagcuuaccggacccggcgcuguggccgcugccagacuguacgggcucgaaccugcgcacccgcugcuguauagccgccuugcucccccucccccucccgccgccgcuccgggaaccccucaucuccugucuaagacaccucccggcgcccugcucggggccccuccgccccugguucccgcuccccggccuagcagcccucccagaggacccggcccggcgcgcgccgaccgguga

SEQ ID NO: 69207 - RNA, 903 nt, Artificial Sequence
  derived and/or modified sequence opt5 from FBXL15__Homo_sapiens__NP_077302
auggagcccccuauggaaccgagcggcggggagcaggaacccggagccgugagauuccuggaccucccuugggaggauguccugcuuccccacguucugaaccgggugccucuccgccaacugcuuagacugcagcgggugucccgcgcuuuuagaucucucguccagcugcaucuggccggccuccggcgcuucgacgcggcucagguggggccccaaaucccuagagccgcccuggcucggcuucugcgcgaugccgaaggacuccaggagcuggcucuugccccgugccacgaguggcugagcgacgaagaucucguucccgugcuggcgagaaauccucagcugcgguccgucgcccucggcggguguggacagcugucucgcagagcucuuggcgcccuggcugagggcugcccccggcuccaacgccugagccuugcccauugugacuggguggaugggcuggcgcucagaggacuggccgaccggugcccugcucuggaggaacucgaucugaccgccuguagacagcuuaaggacgaggcuauuguuuaccuggcccagcgccggggcgccgggcucagaucccugucucuugcugugaacgcgaaugucggagaugccgcugugcaggaacuggcccgcaacugccccgagcuccaccaucuggaccugacaggcugucuccggguggggagcgauggagucagaacgcuggccgaauauugcccgguucuucgcucccugcgggugagacacugucaccauguggcugagagcucucucucccgccugcggaaaagaggcgucgacaucgacguggaaccuccccugcaccaagcccuuguucuccugcaggauauggcgggcuuugcuccuuucgugaaucugcaggucuga

SEQ ID NO: 69208 - RNA, 2106 nt, Artificial Sequence
  derived and/or modified sequence opt5 from FBXL17__Homo_sapiens__NP_001156787
augggccaccuucucagcaaggagcccagaaaccggccuucccagaaacgcccgagaugcuguucuuggugccggcgcagacggccccugcuucgccugccuagacggacccccgccaaggugccuccccaaccugcugccccgcgcagcagagacuguuucuuucgggggcccugcaugcucuguuucaucguccauuccccuggagcgcccgcuccugccggccccgaagaggaaccgccucugucucccccuccccgcgauggggccuacgcugccgcuagcuccucucagcaccuugccagacgguaugcggcccuggcugccgaggacugcgcugccgcggcccgcagauuucuccugagcuccgcugccgcugccgccgcugcggccgcuagcgccucuucccccgccagcuguugcaaagaacugggacucgcugccgcggcugccugggagcagcagggccggucucuguuccuugccucccuggggccuguuagauuucucggaccgcccgcugccgugcaacuguuccgcggcccuacacccagcccugcugagcuucccacgccgccugaaaugguguguaagcggaaaggcgccgggguccccgcgugcaccccuuguaagcagcccagaugcggaggcgggggaugcggcgggggaggcggcgggggaggcgggggaggcccugccgggggaggcgcuucucccccgcgcccucccgaugccggcuguugccaggcucccgagcagccuccgcaaccccuguguccucccccuuccagccccacauccgaaggggccccuaccgaggcgggaggcgacgccgugcgggcugggggaacagcuccccucucugcccagcagcagcaugagugcggcgaugccgacuguagagaaagcccggagaauccuugcgauugucaccgcgaacccccucccgagaccccggacauuaaccaacugccucccuccauccugcucaagauuuuuagcaaucugucucuugaugaacggugccuguccgccagccucguuuguaaauacuggagagaccugugccuugauuuccaguuuuggaagcagcuggaccucucuagccgccaacaggugacagaugagcugcuggagaaaaucgcuucccggucucagaacauuaucgaaaucaauauuagcgacuguagauccaugagcgacaacggggucugcgugcucgcguucaagugcccuggccugcuucgcuauaccgccuaccgguguaaacagcugucugauacguccaucauugcuguugccagccauugcccccuccugcaaaaggugcacgucggaaaucaggacaagcugaccgaugagggccugaaacagcucgggucuaaguguagagaacugaaagacauccacuuuggacagugcuauaagauuuccgaugagggcaugaucgugauugccaaagggugucugaagcuccaacggaucuacaugcaggaaaacaaacuggugacagaccagagcgucaaggcuuucgccgagcauugccccgagcuucaguauguuggauuuaugggcuguuccgugaccucuaagggggugauccaccugacaaaacuccgcaaucugagcucccuggaucuuagacauauuaccgaacucgacaacgagacggucauggaaaucgugaagcggugcaaaaaucugucuagccugaaccucugucugaauuggauuaucaacgauagaugcguugaggugauugcgaaggaaggccaaaaucuuaaagagcuguaccucgucuccuguaagaucacagacuacgcucugaucgccauuggacgcuauagcaugaccaucgagacaguggauguuggcuggugcaaggaaauuaccgaccagggggccacccugaucgcucagucuuccaaaagccuucgguaccucggacugaugagaugcgacaaggugaacgaggucacaguggaacagcugguccaacaguauccucacauuacguucucuaccgugcuccaggauuguaaacgcacacuggagagagccuaccaaaugggcuggaccccgaacauguccgcggcuagcucuuga

SEQ ID NO: 69209 - RNA, 2085 nt, Artificial Sequence
  derived and/or modified sequence opt5 from FBXL19__Homo_sapiens__NP_001093254
augggcaugaaggugcccgggaaaggagagagcggcccuuccgcccugcucaccccgcccaugucuagcuccucuagagggccuggagcuggcgcccggcgcagacggacacgcugcagacggugucgcgcgugcgucagaacggaauguggggacugccacuucugucgggauaugaagaaauuuggaggccccggccgcaugaagcagagcugccugcuuagacaauguaccgcuccuguucugccccauacagccgugugccuccuguguggggaggccggaaaagaagacaccguggagggcgaagaggagaaguucgggcuuucccugauggaaugcacaaucuguaacgagauuguccacccuggaugccucaagaugggcaaagcugaaggggugaucaaugccgagauuccgaacugcugggaguguccccggugcacccaggaaggacgcacaucuaaggauagcggcgagggcccugggagacggcgcgcugacaauggagaagagggcgccucccuggggagcggauggaaacugaccgaggaacccccucugcccccgccucccccuagacggaagggcccccuccccgcggggccuccgcccgaggauguuccuggacccccuaaaagaaaggaacgcgaggccggcaacgaacccccgacgccucggaagaaagugaagggcgggagagagcgccaucuuaaaaaggucggaggcgacgcuugucugcuccgggggucugaucccggaggcccugggcugcuucccccuagagugcugaaucccucccaggccuuuagcucuugccacccgggccucccucccgaaaacugggagaaacccaagccuccgcuggcuuccgccgagggacccgcgguuccuagccccucuccucagcgcgaaaaacuggagcgguucaagagaaugugucaacuccuggaacgcgugcccgacaccuccagcuccucuagcgauuccgacagcgauucugacuccagcggcacaucucuuagcgaggaugaagccccuggggaggcucggaauggaagacgccccgcccggggcuccucuggggagaaggaaaacagaggaggccggcgcgcugucagaccggggagcggcggaccucugcucuccuggccccugggcccugcucccccgccucggcccccucagcuugagagacauguggugcgcccuccgccccggagccccgaacccgacacccugccucucgccgccgggucugaccacccccugccuagagcggccuggcugcgcgucuuucagcaccucggacccagagagcugugcaucuguaugcggguuugccgcacaugguccagaugguguuacgauaaacggcuuuggccucgcauggaccugagcagacggaagucucucaccccgcccaugcuguccggcguggugcgcagacagccucgggcucuugaucugagcuggacgggggucuccaaaaagcaacucauguggcugcugaaucgccuccagggacugcaggagcuugugcugucuggcugcagcuggcucuccguuucugcccuggggagcgcuccccugccugcccuuagacuccuggaccugcgguggauugaagaugugaaagacucccagcucagagagcugcuucugcccccgccugauacaaagcccggccaaaccgaaagccgcggacggcuccagggcgucgccgagcugagacuggcggggcuugaacucacagacgcuucucugcgccugcuccugcggcaugcuccccagcuuuccgcccuggaucucagccacugugcccaugugggagacccuucuguucaucugcugaccgcccccaccuccccucuuagagagacacucgugcaccugaaccuggcuggcugccaccgccucacggaucacugccugccgcuuuuccggagauguccccgccugcggagacucgaccugcggagcugccgccaacugucuccugaggccugugcgagacuugccgcugccgggcccccuggacccuuucggugcccggaagagaagcuccugcugaaagacagcuga

SEQ ID NO: 69210 - RNA, 1215 nt, Artificial Sequence
  derived and/or modified sequence opt5 from FBXL20__Homo_sapiens__NP_001171835
augagacgggacgugaacggcgucaccaagagccgcuucgagauguuuuccaauucugaugaagccguuaucaacaaaaagcugcccaaagagcuccugcuuagaauuuucagcuuucuggacguggugacacucugccggugugcucaggucucccgcgccuggaaugugcuggcgcuugaugggucuaacuggcaaagaaucgaccuguucgauuuucagcgggacauugaaggacgcguuguggagaauaucagcaagagaugcggcggguuccuccggaaacugucccugcgcggaugucucggcgucggggauaacgcucugagaacguuugcccagaauugccggaacauugaagugcuuaaucugaacggauguaccaagacaaccgacgccgagggcugcccucuccuggagcagcuuaauaucucuuggugugaucaaguuacaaaggacggcauccaggcucuggugcgcgggugcggaggccucaaagcccuguuccugaagggguguacccagcucgaagaugaggcucugaaauacauuggagcccacugcccggaacuugucacacugaaccuccagaccugucugcaaaucacggacgagggccuuauuaccaucugcagagggugccauaagcugcagagccucugugcguccggaugcagcaauauuacagaugccauccugaacgcucugggccagaauuguccccggcuccgcauucuggagguggccagaugcucucagcuuaccgacgugggcuuuacaacccuggcucggaacugucacgaacucgagaaaauggaccuggaagagugcguccaaaucacggauuccacacuuauccagcugagcauucauuguccuagacuccagguucugucucugucccacugcgaacucaucaccgacgaugggauucgccaucugggaaacggcgccugugcgcacgaccaacuugaggugaucgagcuggauaauugcccccucauuacagacgccagccuggaacaccugaagucuugucauucccuugagcggaucgaacucuaugauugccagcagaucaccagagcugggauuaagcgccugcggacccaucugccuaacaucaaagugcacgccuacuucgcucccgucacaccuccgcccagcgugggaggcuccagacagcgcuuuugccgguguugcauuauccucuga

SEQ ID NO: 69211 - RNA, 1068 nt, Artificial Sequence
  derived and/or modified sequence opt5 from FBXL2__Homo_sapiens__NP_001165184
augguguucagcaacaaugacgagggccugaucaacaagaaacuccccaaggaacugcuucugagaaucuuuuccuuccucgauauugucacccugugccggugugcccagauuucuaaggcuuggaauauccuugcccuggacgggagcaacuggcaacgcauugaucucuuuaauuuccagacagacguugagggaagagugguggaaaacaucuccaaacggugcggcggguuucugcgcaaacugucucucagaggauguaucggcgucggggauagcucccugaagacguucgcgcagaauugccggaacauugagcaccuuaaucugaacggauguaccaagaucacagacucuaccugcuacagccucucccgcuuuuguagcaaacugaagcauauucagaauuauugccacgaacuugugucucugaaccuccaauccuguagcagaaucacagaugagggcguugugcagauuugccggggcugucaucgccugcaggcucugugccucucugggugcuccaaucugaccgacgccagccuuacagcccugggacucaacuguccuagacugcagauccuugaggcugcccggugcucucaccugaccgaugcuggcuucacgcuccuggcccgcaauugucaugaacuggagaaaauggaccucgaagagugcauucugaucaccgauuccacacuuauccaacugagcauucacuguccgaagcuccaggcgcugucccuuucucacugcgagcugaucaccgacgaugggauucuccaucugagcaacuccacauguggacacgaaagacugcggguccucgagcuggacaacugccuucugaucaccgacguggcccucgaacaucuggagaauugucgcggccuggaaagacuugagcucuacgauugccagcagguuacgcgggcugggauuaaaagaaugcgcgcccaacugccccacgugaagguccacgcuuauuuugccccugugacacccccuaccgcgguggccggaagcggccagcggcuguguagaugcugcgucauccucuga

SEQ ID NO: 69212 - RNA, 1287 nt, Artificial Sequence
  derived and/or modified sequence opt5 from FBXL3__Homo_sapiens__NP_036290
augaagagaggcgggcgggacagcgaucgcaacuccucugaggaaggaaccgccgagaaaagcaagaaacugagaacaacgaaugaacacucccagaccugcgacuggggcaaccuccugcaagauaucauucuucagguguucaaguaccugccccuccuggaccgggcucaugccucucaggucugucgcaauuggaaccagguuuuucacaugccugaucuuuggagaugcuucgaguuugaacugaaucaaccggcgacaagcuaucucaaagcuacccaucccgagcugaucaagcagauuaucaagcggcacuccaaccaucugcaguacgugucuuucaaaguggacagcuccaaggagagcgccgaagccgcuugugauauucucucucagcuggucaauugcucccuuaaaacacuggggcucaucagcaccgcccgcccuucuuuuauggaccugcccaagucccacuucaucagcgcucuuacagugguuuuugugaacucuaaaucccugagcucccucaagauugaugacaccccugucgaugaccccucucugaaggugcugguugccaauaacagcgauacgcucaaacugcuuaagauguccagcuguccucacgugucuccggcgggaauccugugcgucgccgaccaaugucauggccucagagagcuggcucuuaauuaucaucugcucuccgacgaacugcugcucgcccugagcucugagaaacacgugcggcuugagcaucugcgcauugauguggucagcgaaaaccccgggcagacccacuuccacacaauccagaaguccucuugggacgcuuuuauuagacacagcccuaaaguuaaucucgugauguacuucuuucuguaugaggaagaguucgaucccuuuuuccgguacgaaaucccugccacccaucuuuauuucggacgcuccgugagcaaggacguccugggcagagugggcaugacaugcccccggcucguugagcugguggucugugcgaacgggcugcgcccgcucgaugaggaacugauuagaaucgccgagcggugcaaaaaucuuucugcuaucggacugggcgaaugugagguguccugcagcgccuuuguugaguucgugaagaugugcgggggaagacucucucagcuguccauuauggaagagguccugaucccugaccaaaaguacagccuugaacagauucacugggagguguccaaacaucucggccgcgucugguuucccgauaugaugccuaccugguga

SEQ ID NO: 69213 - RNA, 1866 nt, Artificial Sequence
  derived and/or modified sequence opt5 from FBXL4__Homo_sapiens__NP_001265645
augagccccguguucccuaugcugaccguccucacaauguuuuacuauaucugccugagacggcgcgccagaacggcuacccggggcgagaugaugaacacacaccgcgccauugaauccaauucucagaccagcccgcuuaacgcggagguugugcaauacgcuaaggaaguggucgacuucuccucucauuaugggagcgaaaauuccaugucuuacacaauguggaaccuggccggagugcccaauguuuuuccuagcuccggcgauuucacccagacagccguguuuagaaccuaugggacguggugggaccagugucccagcgcuucucucccuuucaaacggacacccccuaacuuucagucccaagauuacgucgaacugaccuucgagcaacagguguauccgaccgccguucacgugcuugagacauaccaucccggagcugucauccgcauucuggccugcagcgcgaauccuuacucucccaacccucccgccgaagugagaugggagauccucugguccgaacggccgaccaaggugaaugcuagccaggcccgccaguuuaaaccuuguauuaagcagaucaacuuccccacgaaucugaucagacuggaggucaacucuucccuccuggaguauuacacagaacuugacgcuguugugcugcacggcgugaaagauaagccuguccucagccugaagaccucccuuauugacaugaaugauaucgaggacgaugccuaugcggaaaaagacgggugcggaauggauucucugaacaagaaauuuagcuccgccgugcucggcgagggccccaauaacggguacuucgacaagcugcccuaugaacugauucagcucauccugaaccaucuuacacugccugaucucugucggcuggcucagaccugcaaacuucugagccaacacuguugcgacccgcuccaguacauucaccugaaucugcagcccuauugggccaagcucgacgauaccucucuggaguuucuucaaucccgcuguacacugguucaguggcucaaccugagcuggacgggaaauagaggcuucaucucuguggcuggguucagccgguuucuuaaggucugcggauccgagcuggugcgccucgaacugucuuguagccauuuccugaacgagaccugccucgaaguuauuuccgagaugugcccuaaucugcaggcccuuaaccugagcucuugugacaaacugcccccucaggccuuuaaucacaucgcuaagcucugcucccugaaaagacuugugcucuaccggacaaaggucgaacaaaccgcgcugcugagcauccucaacuucuguucugagcugcagcaucuuucccugggcagcugcgugaugauugaggauuacgacgucaucgccuccaugauuggggcuaaauguaagaaacucagaacacuggaucuguggcgcugcaagaauaucaccgaaaacggaauugccgagcuugccucuggcuguccccuccuggaggagcuggaccucggcuggugcccgacgcugcagagcuccacaggguguuuuacccggcuugcucaccagcugccuaaucuccaaaagcuguuccugaccgccaacagaucugugugcgauacagacaucgaugaacuugcguguaauugcacccgccuccagcagcuggacauccugggaacacggaugguuagccccgcuucccucagaaaacugcuugagagcugcaaggaucugucucuccuggacguguccuuuuguagccagauugacaaccgcgccguccuggagcuuaaugccucuuucccuaaaguguuuaucaagaaauccuucacgcaauga

SEQ ID NO: 69214 - RNA, 2025 nt, Artificial Sequence
  derived and/or modified sequence opt5 from FBXL5__Homo_sapiens__NP_001180464
auggcccccuucccugaggaaguggacgucuuuaccgcuccgcacuggagaaugaagcagcugguuggccucuacugcgauaaaagccuguaugccacauucaaggaguuuaaaaugcaugaacaaaucgagaacgaauacauuaucgggcuucugcagcagcggucccagacgauuuauaaugugcacucugacaacaagcucagcgagaugcugucccuuuucgagaaaggacugaagaaugugaagaacgaauacgagcaacucaauuaugcgaaacagcugaaggaacgccuggaggcuuuuaccagagauuuccucccccauaugaaagaggaagaggaagucuuucagccuaugcugauggaguacuucacauaugaagaacuuaaggacaucaaaaagaaggugauugcccagcacuguucucaaaaagauaccgccgagcugcuccggggccugagccuuuggaaccaugcugaggagcgccagaaguuuuucaaauacuccguugacgaaaagucugauaaagaggccgaagugagcgagcacuccacagggaucacccaucugcccccugaggucaugcucagcaucuuuucuuaccugaauccccaggaacugugcagauguucccaggugagcaugaaguggucucaacucacaaaaaccggaucccuguggaagcaccuuuauccuguucacugggcucggggcgacugguacagcgggccggccacggagcuggauaccgaacccgacgaugagugggugaagaaccgcaaagacgaaucuagagcguuccaugagugggaugaggacgccgacauugaugaauccgaggaaagcgcugaggaguccaucgccauuucuaucgcucagauggaaaagcggcuccugcacggacuuauucacaauguccugccuuaugugggcacaagcgugaaaacccucguccuggccuacuccagcgcgguuucuuccaagauggugcgccagauccuggagcucugccccaaccuggaacaucuugaccugacacaaaccgauauuagcgacucugccuuugauagcugguccuggcucggcuguugccagucucugagacaccuugaccugagcgggugugagaaaaucacggauguggcucucgaaaagaucucccgggcccugggcauucugacaagccaucagucuggauuccucaagaccuccacaagcaaaaucaccucuaccgcuuggaagaauaaagacauuacaaugcaguccacgaagcaauaugccugccugcacgaucuuaccaacaaagggaucggagaggagauugacaaugaacauccuuggacaaagcccgucagcuccgagaacuucaccucuccguacguguggaugcuggaugccgaagaccucgcugacaucgaggauacaguugaauggcgccacagaaauguggagagccugugugucauggagaccgcguccaacuuuucuugcagcacguccggcuguuucagcaaggacaucguggggcugcggacaucuguuugcuggcagcagcacugcgccuccccugcuuuugccuauuguggacauagcuucugcuguaccggcaccgcccuucgcacaaugucuucccuccccgaaagcucugcuaugugcagaaaagccgcgcggaccagacugccucgcggcaaggaucugauuuacuuugggagcgagaaauccgaccaggaaacaggacgggugcuccuguuccuuagccugucuggcuguuaccaaaucacggaucacgggcucagaguccugacccugggaggcgggcuucccuaucucgagcaucugaaccuguccggaugccucacaauuaccggcgcuggccugcaggaccuugugagcgccugucccucccugaaugaugaauacuuuuauuacugcgacaacaucaaugggccucacgccgauacagcuucuggaugucagaaccuccagugcggcuuccgcgccuguugccggagcggggaguga

SEQ ID NO: 69215 - RNA, 1476 nt, Artificial Sequence
  derived and/or modified sequence opt5 from FBXL7__Homo_sapiens__NP_036436
augggcgccaacaaugggaagcaguacggaagcgagggcaaaggguccucuagcaucuccucugacgugagcuccucuaccgaucacacacccacgaaggcucagaaaaacgucgccaccagcgaagacuccgaucugagcaugagaacacucucuaccccuuccccggcgcugauuugucccccuaaucuucccggauuccaaaacggccgggggagcucuacauccuccucuuccaucaccggagagacaguugcuauggugcauagcccucccccuacccgccugacgcacccgcucauuagacuggccucccggccccagaaggaacaggccucuaucgaccgccuuccugaucauagcauggugcaaauuuuuagcuuccugcccaccaaucagcucugcagaugcgcucgggucugucgcagaugguauaaccuggccugggacccucggcuguggcgcacaaucagacucaccggcgagacaaucaauguggaucgggcucugaaaguucuuacccgcagacugugccaggacacgcccaacgugugucucaugcuggaaacagucaccgugagcggcugccggcgccuuacagauagagggcuguacaccauugcccaguguugcccggagcuccggagacuggagguuucuggauguuauaauaucuccaacgaagcgguguuugacgucgugagccugugcccuaaucucgagcaccuggaugugucuggcuguagcaagguuaccugcauuucccuuacacgcgaagccucuaucaagcugagcccccuccaugggaaacaaauuuccauccgguaccuggacaugacggauugcuucguccuugaggacgagggacugcacaccauugcugcccacuguacacagcucacccaucuguaucugagacgcugcgugcggcucacagacgaaggccugagauaccuugugaucuauugugcuagcaucaaggagcugucugucuccgauugccgcuuugugagcgacuucgggcuccgggaaauugccaaacuggagucuagacuucgcuaccuguccaucgcgcacuguggacggguuaccgaugugggcauuagauacgucgccaaguauugcagcaaacuccgcuaccugaacgcucggggcugugaagggaucacggaccauggaguggaguaucuggccaagaauugcacaaagcucaaaucccuggauauuggcaaguguccucuuguuucugacaccgggcuggagugccucgcucugaacuguuuuaaucugaaaagacuuagccucaaguccugcgaaucuaucaccggacagggccugcagaucguggccgccaacugcuucgaucugcaaacacucaacguccaggacugugaggugagcgucgaagcucugcgguuugugaaacgccacugcaagagauguguuauugagcacaccaaucccgcguucuuuuga

SEQ ID NO: 69216 - RNA, 1962 nt, Artificial Sequence
  derived and/or modified sequence opt5 from FBXO10__Homo_sapiens__XP_005251496
auggaggccggcgggcugccccucgaacuguggagaaugauccuugcuuaccugcaccucccugaccugggacggugcagccuugugugucgcgccugguaugagcugauucucucccuggauucuaccagauggcggcagcugugccucggcuguacagaaugccgccauccgaacuggcccaaucaaccugacgucgagcccgaaagcuggagagaggcguucaagcagcacuaccuggcuuccaaaacguggaccaagaacgcccuugaucuggagucuagcaucuguuuuucccucuuccggcgcagacgggaacgcagaacacugucuguugggccuggacgggaguuugacagccuuggcuccgcccuggcuauggccagccucuaugaucgcauugugcuguuccccgggguguacgaagaacagggagagaucauucugaaagucccuguggaaaucguuggccagggcaagcucggggagguggcucugcuugccucuaucgaccaacauugcuccaccacaagacuguguaaucucgucuuuaccccggcgugguucagccccauuauguauaaaacaaccucuggacacgugcaguuugauaacugcaauuucgaaaacggccauauccagguucacgggccuggaacgugucaggugaaguuuugcaccuucaagaauacacacauuuuucugcauaacgucccccuuugugugcuggagaauugcgaguucgugggcuccgagaacaauagcgucaccguugaggggcacccuucugccgacaaaaacugggcuuacaaguaucuccugggacugaucaaauccagccccacauuucucccgaccgaagauuccgacuuccugaugucucuugaucuggagagccgggaccaagccugguccccuaagacgugcgauauugugaucgaaggcagccagucucccacauccccugcuagcucuagccccaaacccggcuccaaggccgggucucaggaggcggaagugggaagcgacggcgagcgcgucgcccagaccccugacuccagcgaugggggacucucuccguccggcgaggacgaagaugaggaccaacugauguacagacuuagcuaccaggugcaggggccccggccuguucugggaggcucuuuccucggacccccucugcccggggcuuccauucaacugccgagcugucucgugcuuaauucccugcagcaggaacugcagaaggauaaagaggccauggcucucgccaacucuguccaaggaugccugaucagaaagugucuguuucgcgacggcaaagggggaguguucguuugcagccauggccgggccaagauggaagggaauaucuuuagaaaccuuacauaugcugugcgcuguauucacaacuccaaaaucauuaugcuccggaaugauaucuacagaugccgcgcgucuggcauuuuccugcggcuggagggaggcgggcucaucgccggaaacaauaucuaucacaacgcugaggccggcgucgacauuagaaagaaaagcaauccucugauccuuuguaaccagauucaucacgggcugcgcuccggaaucgugguccucggcaaugggaagggcauuauccggaacaaucagaucuuuagcaacaaggaagccggaauuuacauccuguaucauggcaaucccgugguuucugggaaccacauuuucaaaggcagagcugccggcaucgcggugaaugagaacgggaagggacugauuaccgaaaaugucauccgcgagaaccaguggggcgggguggauauucggagaggcggaaucccuguucuucgguccaaccucaucugcuuuggcuacagcgacgggguggucgugggagaugagggcaaagggcugauugaaggaaauaccaucuaugagaacggcaaguacaaugggaaaacacgcuga

SEQ ID NO: 69217 - RNA, 2784 nt, Artificial Sequence
  derived and/or modified sequence opt5 from FBXO11__Homo_sapiens__NP_001177203
augaacagcgugagagccgcuaaucggcgccccagacgggucucccgcccuagaccgguucagcaacagcagcagcaacccccucagcagcccccuccccagccuccgcaacagcagcccccucagcaacagcccccucccccgccucagcaacagcagcagcaacagcccccucccccucccccgcccccucccccucugccccaggagcggaacaaugugggcgaacgcgacgaugacgugccggccgauauggucgcggaggaaucugggccuggagcucagaacagccccuaccaacucagacggaagacccugcuuccuaaacgcacagccugccccacgaaaaauuccauggagggcgccucuaccagcacaaccgaaaacuucgggcacagagcuaagcgggcccgcguguccggaaagucucaggaccugagcgcugccccugcggagcaguaucuccaggagaaacugcccgaugaaguugugcuuaagaucuuuuccuaccugcucgagcaagaccuguguagagccgcuugcgucuguaagcgguucagcgaacuggccaaugauccgauucucuggaaacgccuguauauggagguguuugaguacacaagaccuaugaugcaucccgaacccggcaaguucuaucagaucaacccugaggaauacgagcacccgaaucccuggaaagaaucuuuucagcagcuuuauaagggggcucauguuaaaccuggauucgccgagcacuuuuacuccaaccccgcgcgguacaagggcagagagaauaugcuguauuacgacaccauugaagaugcccucggcggggugcaagaggcucauuucgacggacugaucuuuguccacagcggcauuuauacagaugaauggaucuacaucgagucuccuauuaccaugaucggggccgcucccggaaagguggccgacaaagugauuaucgaaaacacgcgcgauuccaccuucgucuuuauggagggcagcgaggacgccuauguuggguacaugacaauucgguucaauccugacgauaagucugcucagcaccauaacgcgcaccauugccuugaaaucaccgugaauuguucccccauuaucgaccacugcaucauuagaagcacauguaccgugggauccgccgucugcgugucuggccagggcgcuuguccgacgaucaaacacugcaacauuagcgauugugagaacguugggcuguauaucacagaccaugcccaaggaauuuacgaagauaaugagaucuccaacaaugcccucgcuggcaucugggugaagaaccacgggaauccuauuauccgccggaaccauauucaccauggaagagacgucggcguguuuaccuucgaucacgggaugggauacuucgaaagcugcaauauccaccgcaaccggauugccggcuuugagguuaaagcguaugcuaaucccacaguggucagaugcgagauccaucacggccagaccgggggaaucuacgugcaugaaaagggccgcgggcaguucauugagaacaaaaucuaugccaauaacuuugccggagucuggauuaccucuaauuccgacccuacaauccggggcaacagcauuuucaaugggaaccagggcggaguguacaucuuuggcgaugggagaggacugauugaaggcaacgacaucuaugggaaugcucuggccggaauccaaauucgcacgaacucuugucccaucguucggcacaauaagauucacgauggccagcaugggggcaucuacgugcacgagaagggacagggcgucauugaggaaaacgagguguauagcaauacccucgcugggguuugggugacaaccggauccacaccgguccugagacggaaccgcauccauucuggcaaacagguggggguguacuucuacgacaauggacacggcguucuugaagacaacgauaucuauaaucauauguacagcgggguccaaauuagaaccggcuccaacccuaagauccggagaaauaaaauuuggggaggccagaacgggggaauccugguguauaauagcggccucgggugcauugaggacaacgaaaucuuugauaaugccauggcgggaguguggaucaagacggacucuaaccccacacugcgccggaacaaaauucacgauggcagagacgggggcaucuguauuuucaauggaggccgcgggcuucuggaggagaacgauaucuuuagaaaugcccaggcuggaguccucauuuccaccaacagccacccuauccugcggaagaaucgcaucuucgacggcuuugccgcugggauugaaaucaccaaccaugccacagcgacccuggagggaaaucagauuuucaacaauagauuuggcggccucuuccuggccucuggggugaacguuacaaugaaggauaauaaaaucaugaacaaucaagacgcuauugaaaaggccgugucccggggacagugccuuuacaaaaucagcuccuauacgucuuaccccaugcacgauuucuaucgcugucauaccugcaacacaaccgacagaaaugcuauuugugucaacugcaucaagaaaugucaccagggccaugauguggaguuuauccggcacgaccgcuucuuuugcgacuguggggccggaacacugagcaaccccugcacccucgccggcgaaccuacgcacgauaccgacacacuguacgauuccgcuccgcccauugagucuaauacccuucaacauaacuga

SEQ ID NO: 69218 - RNA, 1533 nt, Artificial Sequence
  derived and/or modified sequence opt5 from FBXO15__Homo_sapiens__NP_001136430
auggccaccggcagagggcggauccugcagcaacacuggcucggacugcagacacuucgcggccccagcagagggggaggcgcugcccgggggcgcgcgagagcuuucggaugccggaagggcccuggcgugaaacuguccgccgggucugccgcucuccgcugucaugccggaggcgggcagcacugggagagcuccuuuucuugcuguagcggauuccuggacggcaugccguccgaaauucuucugaagaucuuuucuuaccucgaugcugucagccugcugugcacgggguguguuuccagacgguucuaucaucucgccaacgacaauuuuauuuggaucggaauuuacagcaccgcguucucucccgcccgcuccaacuggaaauuuaauagcguggagaagaucgcuaugucuauguccuuccugagcgugcaggauaaagaagccggcuauuggaagaaggaguacaucacaaaacaaauugcuucugucaaggccgcgcuugccgacauccugaaaccugugaaccccuauaccggccucccuguuaagacaaaagaagcucugagaauuuuugggcuuggaugggccaucauucugaaggagaagggcgggaaagaguacaucauggaacacguggaucucuccauuaaugacaccagcgucacagugaucugguauggaaagaaauggcccugccuggcuucccugucuacccucgaucuguguggcaugacgccuguuuucaccgacugguacaagacaccgaccaaacaucggcuucgcuggcacagccugaucgccaaguacaaccucucccaccugacaauuagcaccaugaucgggugcgauagacuuauucggaucuuuugucugcaucccggacuccuggugggcgucuggaaaaaggaggaggaacuggccuucgugauggcuaaucuccacuuucaucaccugguggagcgcucuacgcuuggcuccgcgacaauuccuuaugaacugcccccucacagccccuuccucgacgauucuccggaguacgggcugcauggauaucagcuucacgucgaccugcauagcggcgggguuuucuaccucugcggaaccuuuagaaaccuguucacaaagcggggcaauaucgaaaacgggcacgugaaacugaucgugauucaucucaagaauaacagagagcaucugccucuuaucggcaaagucggacuguccuggaagaccgauauuuuugacggcuguaucaaaucuugcagcaugauggacgugacccuccuggaugaacacgggaagcccuucuggugcuuuuccagcccuguuugucugcgcucucccgccacacccuccgacucuagcuccuuccuuggacagacguauaauguggauuacgucgacgcugagggccgggugcacguugagcucguguggauuagagaaaccgaggaauaucugaucgucaaccuggugcucuaccugagcaucgccaagauuaaucacugguuugggacagaguacuga

SEQ ID NO: 69219 - RNA, 837 nt, Artificial Sequence
  derived and/or modified sequence opt5 from FBXO17__Homo_sapiens__NP_079183
augggcgccagacugagccggcgcagacuccccgcugacccuucccuggcccuugaugcgcugccgcccgagcuccuggugcagguccuuucucacguuccuccccggagccuggugacccgcugcagaccugugugucgggcuuggcgcgacaucgucgaugggcccacaguguggcuccugcaacuggccagagaccgguccgccgaaggacgcgcucucuacgccguugcucagagaugccugccuucuaacgaggauaaggaagaguucccgcuuugugcccuggcgcgguauugccuccgcgcccccuuuggcagaaaucugauuuucaacagcuguggggaacagggauuucggggcugggagguggagcaugggggaaauggcugggcuaucgagaaaaaccuuacgccuguccccggcgccccuucccagaccugcuucgugacaucuuuugaaugguguagcaagcgccaacugguugaccucgugauggaaggggucuggcaggagcugcuggauuccgcucagauugagaucugcguggccgacugguggggagcgagagaaaauuguggcugcguguaccagcuccgggucagacugcuugauguuuaugagaaagaaguggugaaguucagcgccucucccgacccgguccugcaauggaccgagcgcggguguagacaggugucccacguuuuuacaaacuucggaaaaggcauucgguacgugagcuuugaacaguaugggcgcgaugucucuuccugggugggacauuacggcgcucucguuacccacagcucugugcgggucagaauccgccuguccuga

SEQ ID NO: 69220 - RNA, 2961 nt, Artificial Sequence
  derived and/or modified sequence opt5 from FBXO18__Homo_sapiens__NP_001245381
auggccaagagcaacuccgugggccaggacucuugccaagauagcgagggggacaugaucuuccccgcugaauccucuugugcccugccucaggagggaagcgcgggcccggggucccccggaucugcuccucccagcagaaaacgguccuggagcucugaagaggaauccaaucaggccaccggcacaagccgcugggauggggucucuaagaaagccccuagacaccaucucuccguucccugcacgcggccucgcgaggcuagacaggaggccgaagacagcaccucucggcuguccgcugagagcggagaaacagaucaagacgccggcgaugugggcccggaccccauuccugauuccuacuaugggcuucugggaacccuccccugucaggaggcgcugucucacaucugcagccuuccuuccgaggugcugcgccaugucuuugccuuccuccccguggaagaccuguacuggaaccugagccucguuugucaccuguggagagagauuaucucugauccgcuuuuuauuccuuggaagaaacuguaucaucgguaccucaugaaugaagaacaggcuguguccaaggucgacggcauccugagcaacugcgggaucgaaaaggagucugaucuuugugugcugaaucucauucgcuauacagccaccacaaaaugcagccccuccguugacccugagagagugcuguggucucugcgggaccacccccuccugcccgaagcugaggccuguguccgccagcaccuuccugaucuguacgcggccgcuggaggcgugaacaucugggcccucguggcugccgucguucugcuuagcuccagcgugaaugacauucaaagacuccuguucugccugcggcgcccgucuuccaccgugacgaugcccgaugucaccgaaacacuguauuguaucgccgugcuccuguacgcuaugagagagaaggggauuaacaucagcaaucggauucauuacaacaucuuuuauugccuuuaccugcaggaaaauucuugcacccaggcgacaaaaguuaaggaggagccuuccguguggcccggaaagaagaccauccagcucacgcacgaacaacagcugauucuuaaccauaagauggagccucugcaggucgugaaaaucauggccuucgcuggcacaggcaagaccagcacacucguuaaauaugccgaaaaguggucccaaucuagauuucuguacgugaccuucaauaaaagcauugccaagcaggcugagcgcgucuuucccuccaacgugaucuguaaaaccuuccacucuauggccuaugggcacauuggacggaaguaccagagcaagaaaaagcugaaucucuuuaaacugacaccguucauggucaacuccgugcuugcggaaggcaaagggggauuuaucagagcuaaacugguuugcaagacgcucgagaacuucuucgccagcgccgacgaggaacugaccaucgaucaugugccuauuugguguaagaauagccagggccaacgcgucaugguggagcaguccgaaaaacugaacgggguucuugaggcuagccggcucugggacaauaugagaaagcugggagagugcacagaagaggcccaccagaugacccaugauggcuaucugaaacucuggcagcugucuaagcccucccuugcuagcuuugacgccaucuucguggaugaagcgcaagacuguaccccugccauuaugaacaucguccugucucagcccugcggcaaaauuuuugugggggauccucaccagcagaucuacacauuccgcggagcugugaaugcccucuuuacgguuccccauacacacgucuucuaccugacccaaucuuuucgguucggcguggagaucgcuuaugugggggccaccauucuggacgucuguaagagagugcgcaagaaaacacuuguuggaggcaaccaccaguccgggauccggggcgacgcgaagggacagguggcccuccugagcagaaccaaugcuaacgucuuugaugaagccgugcgcguuacagagggcgaguucccgucucggauucaucugaucgggggaauuaaauccuuuggccucgacagaaucauugauaucuggauccugcuucagccugaagaggaacggcgcaagcaaaaucuggugauuaaagacaaguucaucagacgguggguccacaaggagggguuuagcggauucaaaagauacgugacggcugccgaagauaaggagcucgaggccaaaauugcuguuguggaaaaguauaacauccgcauucccgagcugguccagcggaucgaaaaaugccauaucgaggaccuggauuucgcggaaauggagucccaccacgugggccaggccgggcuugagcuccccaccucugaauacauucugggcacagugcauaaggcuaaaggacuggaguuugacaccguccacguucucgaugacuucgugaaggugccuugugccagacauaaucugccgcaacuuccccacuuucgcgucgagagcuucuccgaggaugaguggaaccugcucuauguggccguuacaagagcuaagaaacggcugaucaugaccaagucucuggaaaauauucuuacgcucgccggcgaguacuuucugcaggcggaacugaccagcaacgugcucaaaacaggggucgugcgcugcuguguuggacagugcaauaacgcuaucccuguggacaccguccugacaaugaagaaacuucccauuaccuauuccaacagaaaggagaauaagggcggguaccugugccauucuugugccgaacagcggaucggaccucucgccuuccugacggcuagccccgagcaagugcgcgccauggagagaacaguugaaaacaucgugcugccucggcacgaggcgcuucuguuucucgucuucuga

SEQ ID NO: 69221 - RNA, 540 nt, Artificial Sequence
  derived and/or modified sequence opt5 from FBXO28__Homo_sapiens__NP_001129587
auggccgcugccgcggaggaaagaauggcugaggaaggcgggggaggccagggggacggaggcagcucccuggccucugggagcacccaacggcagcccccuccgcccgccccucagcacccccagccuggaucccaagcucuccccgccccugcucuggccccggaucagcuuccccagaacaauacacugguggcgcucccuaucgucgccauugagaacauccugucuuucaugagcuacgacgaaauuucccagcuucgccugguuugcaagagaauggaucucgugugucaacggaugcugaaucagggcuuucugaaaguggagcgcuaucauaaccucugccagaagcaggucaaagcucaacugcccagacgggagucugaacgcagaaaucacagccuugcccggcaugcugacauccuggccgcgguggagacgcgccucucccugcuuaacaugaccuucaugaaguacguugauagcaaucuguguugcuuuauuccuggcaaauuccaggacagacuccagcccuga

SEQ ID NO: 69222 - RNA, 2238 nt, Artificial Sequence
  derived and/or modified sequence opt5 from FBXO30__Homo_sapiens__XP_005267216
auggaggaagaacugcagcacagccauugcgugaacugugucuccagacggugcaugacccgccccgaaccuggcaucucuugugaccucauugggugcccgcugguuuguggagccguguuccacagcugcaaggcugaugagcauagacuucugugucccuuugaacgggugccuugccucaauuccgacuucggcugucccuuuacaauggcccgcaacaaagucgcggagcaccuggagaugugcccugcuucugugguuuguugcacgauggaauggaauagauggcccgugagcuacgccgaucggaaguccuaugagaaccuuucucgcgacgucgaugaaguggcccaacuggacauggcucucgcccugcaggaucagagaaugcugcucgagagccugaaaguugcuaccaugauguccaaggccacagacaaagugagcaagccucgggagcagaucucugucaaguccagcgugccggaaauuccccaugcgaaugggcuugugucugucgaugaggaauccuacggagcccuguaucaagcuaccguugagacaacccgcagccucgccgcugcccuggacauccuuaacacagcgaccagagauauuggcaugcugaauacgucugugccuaacgacauggaugaacagcagaaugcccgggagucccucgaggaccagaaccugaaagaccaagaucaccuguacgaagaggaaaucggggcugugggaggcaucgacuauaaugauaccaaccagaaugcccagagcgagcagaacggcuccucugaccuccugugcgaucuuaauacaagcuccuacgacaccagcgcucuguguaacggguucccccucgaaaacauuugcacacaagucaucgaucagaaucagaaccugcacggagacucuaagcaauccaaucuuaccaacggcgauuguguggccagcucugacgggacgagcaaaccuuccucuagccuggccguugcugcgcagcuccgcgagauuauccccuccagcgcccugccgaauggaacagugcagcauauucugaugccugaugacgagggcgaaggggagcucugcuggaagaaagucgaccugggagaugugaagaacguugacgugcuuucuuuuucccacgcucccagcuucaauuuucugucuaacuccuguuggagcaagccuaaagaagauaaggccgucgacaccuccgaucucgagguggccgaagaccccaugggccugcagggcaucgaucuuauuacagcugcccugcuguucugccugggggacucucccggaggcagagggaucagcgauucccggauggcggacaucuaucauauugaugucggaacccaaaccuuuucucugccuagcgcuauccucgccacauccacgauggugggcgagauugccagcgcuucugccugugaccacgcuaauccgcagcuguccaaccccagcccuuuccagacccuugggcuggaucucguucuggagugcguggcccgcuaccagcccaaacaaagaucuauguuuacauucgucuguggacagcuguuucggagaaaggaguucuccagccacuucaaaaaugugcauggcgacauccacgcgggccuuaacggguggauggagcagcgcugcccucucgccuacuauggauguaccuacucucagcggagauuuugccccagcauucaaggcgcuaagaucauccaugaccgccaccuccgguccuucgggguucagccgugcgugagcacaguccugguggaaccugccagaaauugugugcucggacugcauaacgaucaccuuucuucccugcccuuugagguucuccagcacauugcuggcuuccuggacggguuuagccugugccagcuuuccugugucucuaaacucaugcgcgaugugugcggcagccugcugcaaucccggggaauggugauccuccaguggggcaagagaaaguauccugagggaaauucuagcuggcagauuaaagaaaaggucuggcgcuucuccaccgccuuuuguucugugaacgaguggaaauucgcggacauccugagcauggccgaucaucuuaagaaaugcuccuacaacguuguggaaaagcgggaggaagcuauuccccugccuuguaugugcgucacgagagagcucacaaaggaggggcgcagccugcggucugugcugaaacccguucuuuga

SEQ ID NO: 69223 - RNA, 1104 nt, Artificial Sequence
  derived and/or modified sequence opt5 from FBXO31__Homo_sapiens__NP_001269612
auguaccugcccccucacgacccgcauguggaugaccccaugagauucaagccucucuuucggauccaccugauggagcgcaaagccgcuaccgucgaaugcauguauggccauaaggggccccaccauggacacauucagaucguuaaaaaggaugaguucagcacaaaauguaaccaaacggaccaccauagaauguccggcgggcggcaggaagaguuucgcaccuggcuuagagaagaguggggacggacacuggaggauauuuuccacgaacauaugcaggagcucauccugaugaaguuuauuuacaccucucaguaugacaauugccuuacauaccgcagaaucuaucugccucccagccggccugaugaccucaucaagccgggccuguucaaagggaccuacggaucccacggccuggaaauugugaugcucucuuuucacggccgcagagcccgggggacaaagaucaccggagaucccaacauuccugcgggccaacagacgguggagaucgaccugcgccaucggauucagcuucccgaucuggagaaucagagaaacuucaaugaacucagccgcaucguccuggaggugagagaacggguuagacaagagcagcaggaagggggacacgaggcuggcgaggggcgcggacggcagggcccuagagaaucccaacccucuccggcccagccucgcgccgaggcucccagcaaaggcccugacgggacccccggagaagauggcggggagcccggagacgccguggcugccgcggaacagccugcccaauguggccaggggcagccguuuguccuucccgugggaguuuccagccggaacgaggacuauccuagaacaugccgcauguguuucuacggcaccggccugauugcugggcauggauuuacaucucccgagcggaccccuggcguguucauccucuuugaugaagacagauucggguucgucuggcuggagcugaaguccuuuagccucuacucucgcgugcaggccacguuccggaaugcugaugcccccuccccgcaagcguuugacgaaaugcugaaaaacauccagagccuuacaucuuga

SEQ ID NO: 69224 - RNA, 789 nt, Artificial Sequence
  derived and/or modified sequence opt5 from FBXO32__Homo_sapiens__NP_001229392
augcccuuccugggccaggacuggagaagcccugggcaaaacugggugaagaccgccgauggauggaaacgguuucucgacgagaaguccggcucuuucgucagcgaucuguccucuuacugcaauaaagaaguuuauaacaaggagaaucuuuuuaacagccugaauuacgacguggcugccaaaaagcgcaagaaagauaugcucaacuccaagacaaaaacgcaguauuuccaccaggaaaaguggaucuacgugcauaaagggucuaccaaggagagacacggauauuguacacugggcgaagcguuuaaucggcuugacuucagcaccgcuauucuggauucccgcagauuuaacuacgucgugcggccggccuucaaggggcucacauuuaccgaccugccccugugccuccagcugaauaucaugcaacgccuuagcgauggaagagaccugguuucucucggccaggccgcuccugaucugcaugugcuuuccgaggaccggcugcucuggaaaaagcugugucaguaucacuucagcgagcgccagauuagaaaacggcugauccucucugauaagggccaacuggacuggaaaaagauguacuuuaaacuuguccgcugcuaccccagaaaggaacaguauggggacacacugcagcucuguaagcauugccacauucuguccuggaaaggaaccgaucacccuuguacggccaacaaucccgagagcugcucugugucccuuagcccucaggacuucaucaaccuguuuaaguucuga

SEQ ID NO: 69225 - RNA, 1668 nt, Artificial Sequence
  derived and/or modified sequence opt5 from FBXO33__Homo_sapiens__NP_976046
augcuccuguuccugagcgugccccagccuagaccgcccggcgcccggacccgcgcuggggccgcgagagucgcucgguggcgcagacuucggcugcaacagcuccgcagacugcggggacuucugcgcguucucagaggccggccuggggccggaucccgcagacggggccgcauggcccugugcgggcaggcugccggagcugccucucugcccagcgagcucaucgugcacauuuucuccuuccugccugcgcccgacagacuucgggccucugcuagcuguucccauuggagagaaugccuguuuuacccugcccucuggccgcagcugcgcaucugucuucgggugucucccgcugagcaaccuagacuggaauuucucaugcgcaagugcggcugguuuguccgggagcugagaguggaguucgccgcggaaaacuaucugagcggcgggggacccggcgaugggggaggcgccgacacagggacgggaggcgaggaaguugaggcucuccagcuguccgcccgcuggcuugaagugcugcggaccuaccucgagcugguccuuugugugcugguuagcauuagaaauaaccgcaaucuccagaaauuuucucuguucggcgauaucuccgugcugcagcaacaggggagccucucuaacacauaucuguccaaggucgacccugauggcaaaaagauuaaacagauccagcaacuuuuugaggaaauccugagcaauucucggcagcucaaguggcuguccugcggauucaugcuugagauugugacccccacaagccuguccucucucagcaacgcuguggccaauaccauggaacaccugucccugcucgacaacaauaucccggggaacagcacacugauuaccgccgucgagcuugaaagauuuguuaaucugcauucucucgcucuggauuucugugacuuuacggcggagauggcccgcgugcugaccgauuccaaccacgugccucuucagcggcucagccugcugguccauaaugugucuguuaugcacaagagccucgacaacaugcccaaugaugagcacuggaaagcucuguccagaaagucuaccagcuuccggguguacaucauggccuucgacauuaaauccgaagauaugcuuaagauccugaaaccuagcauuccccucgagcgcauccauuuugacucuuauaucacaugcgucuccggagccauuguggaccugaucagcagacaauacgauaaguuccugacacacuuuauucuuaugaacgacguuaucgauaccucuggcuuccccgaccucuccgauaaccggaaugaagacccucuggugcugcucgcuuggagauguacgaagcugagccuucuggccauucauggguauacagucugggcgcacaaccucaucgcuaucgcccgccugcggggauccgaucugaaagugcuugaggucaccgaagagucuauugacuuugaucagggcgagcucgccgaccaggauguggacccgguucacaaucugaucgaacaggugagccugggccucgggcaacccuggcaugcugucauggacauugagucccugucuguguucacagaaccuaacagacacuuuuaccgcgagaugcagagcuucuccgaagauaucuga

SEQ ID NO: 69226 - RNA, 2832 nt, Artificial Sequence
  derived and/or modified sequence opt5 from FBXO38__Homo_sapiens__NP_001258652
augggccccagaaagaaaagcgugaagaccugcaucaugaacaaugagauuccugaagagaugacagccgacgaaacgaaagauuacaugaaccagcugucccacgagguccucugucauaucuuccgguaucugccgcuucaagacauuaugugcauggaaugucugucucgcaagcucaaagaggcuguuacccuguaccuuagaguggugcgggucguggaucugugcgccgggcgcuggugggaguauaugcccagcggauuuacagacgcguccuuccucacccugcugaagaagaugccugauguugaacagcucuacggccugcaccccagauaucuugagcggcgcagagugcgggggcaugaggcuuuuucuaucccuggaguccuggaggcccuccaggccugucccaaucuggugggcguugagacaagccaccuugaacugguggaguccauuuggaccuacaugccucauguccacauccucgggaaauuccgcaacagaaauggagcuuuuccgauucccccugaaaacaagcugaaaauccccaucggcgccaagauucagacacugcaccucgugggcgugaaugucccugagauccccugcauuccgaugcugcggcaucuuuauaugaaauggguucgccugaccaagccucaacccuucaaggacuuucucuguaucucucugagaacguucgugaugcggaacugcgcugggccuaccaauagccuuaaauacgugccccuggucacaggacucgccuccgcgcgcaaccuggaacaccuggagauggugagaguucccuuucucggcgggcugauucagcauguggucgaggauagcuggcggucuggaggcuucagaaaucuucacaccaucgugcugggggccuguaagaacgcucucgaaguugaccugggauaccuuaucauuacagccgcucgccggcugcacgaggugagaauccagccuucccucaccaaagauggcgucuuuagcgcccugaagauggcggaacuggaguucccgcaguuugaaacgcuccaucugggcuauguggacgaguuccuucugcaaucucgcauggccaaugcugaucucgucaaauacgggcuggccgacgugguugagaaccccggaauuaucacagauauuggcaugaaggcugugaaugaagucuucuccugcaucaaauaucuggccaucuacaacuguccucaccuucauaaccccuauaauuggauuagcgaccacucucgguggaccagacucguggacaucaaccugguucgcugccaugcccugaagcucgauuccuuugggcaguucauugagcugcuuccuagccuggaauuuaucucccucgaccagauguuccgggagcccccgaagggaugcgcuagagugggccugucugcggggacaggaauuggcgucagcuccgcccuggugagcaaucagaacucuaauaacgaugacaauaacgcucaaaauaacaaugccaacauccacgauaauaaccaccaucacccugacgauuccgacgaagagaaugauuuucgccaggaccuucagcccggcgagcaacaguucgccgcugaugcccucaacgaaauggaggacaucgugcaggaagacggggagguugucgcggagagcggaaacaauaccccugcucauucucaggccauuauccccguggauguggacgaagaacaagccggcccuagcgggcugcagcgggucgugaaacccaccuccauuacaguucacgauucugaaagcgacgaugaggaagacucccuggagcuccaggagguguggaucccgaagaacggaacgagacgcuacagcgaacgggaggagaaaaccggcgaaucuguccaguccagagaacugagcgagguggcuaagacaaaaccucggcacgccaugaagcgcaagagaaccgcugauaaaucuacauccaccagcgaccccguuauugaggaugaccaugugcaaguccuugugcugaaguccaaaaaucucguuggggugacgaugacaaacuguggcaucaccgaucugguccugaaggacugccccaaaaugauguuuauucacgccacccgguguagagugcuuaagcaucucaagguggaaaaugcgccuaucgucaaccgcuucgauuaugcccagugcaaaaagcugaauauggaccagguucuggaccagauccuccggaugccgcccgagagaaaccgcauuaucuaccugagaccuaugcaacagguggauacacuuacccuggaacagaaacucuuuucuggacccuacccuuaucacauuuguaucauucaugaguucagcaaucccccuaacgugcggaauaagguccgcaucagauccuggauggacacaaucgcuaacauuaaucaggaacugaucaaauacgaguuuuuccccgaggccacgcggucugaagaggaucugaagaaguauccgaaauacccuuggggccgcgaaauuuauacccuugagggggugguugacggagcucccuacagcaugaucuccgauuuuccuuggcucagaagccugcgggccgcggagcccaacucuuucgcccgcuaugacuucgaagaugacgaggaauccacaauuuacgcuccgagacggaagggccaacugagcgccgauaucugcauggagaccaucggggaagagauuucugagaugcgccagaugaaaaagggaguguuucagagagucguggcuaucuucauucacuacugugacguuaauggcgaaccuguggaggaugacuauaucuga

SEQ ID NO: 69227 - RNA, 1416 nt, Artificial Sequence
  derived and/or modified sequence opt5 from FBXO3__Homo_sapiens__NP_036307
auggccgcuauggagaccgaaacagcgccccuuacgcucgagagccugccuaccgacccgcuucugcucauccuguccuuccuugauuacagagaccugauuaacugcuguuaugugucucggcgccucagccagcuguccucucacgauccccuguggagacggcauugcaagaaauacuggcucaucagcgaagaggaaaagacacagaaaaaucaauguuggaagucccuguuuauugacaccuauucugaugucggccgcuacaucgaccacuaugccgcuauuaaaaaggccugggaugaccuuaagaaauaccuggagccuagaugcccccggaugguucucagccugaaggagggggcccgcgaagaggaucuugacgcuguggaagcccagaucggauguaaacugccugaugacuauagaugcuccuaccggauccauaacggccagaagcucgugguccccgggcugcugggaagcauggcucucucuaaucacuaccgcuccgaggaucugcuugacguggacacagccgcgggcggguuccaacagagacagggacugaaauauugucucccucugaccuuuugcauucauacaggccuuagccaguacaucgccguugaggcugccgaaggccggaacaagaaugagguguucuaucaauguccggaucagauggcucgcaaccccgccgcgauugacauguuuaucauuggggccaccuucacggauugguuuaccucuuacgucaagaaugugguuuccggaggcuucccuaucauuagagaccagaucuuucgguaugugcacgaucccgaaugcgucgcuacaaccggggacaucacagugagcgugucuaccuccuuccugccugagcucagcuccguccaucccccgcacuacuuuuucacguaucgcauuagaaucgaaaugucuaaagaugcccugccugagaaggcuugucagcuggacagccgguacuggagaauuacaaacgccaaaggagauguugaggaagugcaaggccccgggguggucggagaguuuccuaucauuucccccggccgcguguacgaauauaccagcugcacaaccuucucuaccacauccggcuacauggagggguauuacacguuccacuuucucuauuucaaggacaaaaucuuuaauguugccaucccccgguuccauauggcuugcccuaccuuuagagugagcauugcgcgccuggaaaugggaccggaugaguacgaggaaauggaggaagaggaagaggaggaagaggaagaggacgaggacgaugacucugccgauauggacgaaagcgaugaggacgaugaagaggaacggagacgccgggucuucgacgugcccaucagacgccggagauguucccgccuguuuuga

SEQ ID NO: 69228 - RNA, 2130 nt, Artificial Sequence
  derived and/or modified sequence opt5 from FBXO40__Homo_sapiens__NP_057382
augggcaaggccagacggagcccucccgggcaccaucgccacugcgagggauguuucaacagacauugccacaucccgguggaacccaauaccuccugucuggucauuucuugccaucuccuguguggcgcuacauuucacaugugcaaagaggccgaacaccagcuucuguguccucucgagcaaguucccugccugaacagcgaauacggguguccucuuuccaugucucggcauaagcuggcgaaacaccuccaggugugccccgcuagcguggucuguugcuccauggaguggaaucgcuggccuaacguggacucugagacgacccugcaugaaaauaucaugaaggagacaccgagcgaagagugccuggauaccgcccucgcccugcaggaccagaaaguucuuuucagaucccugaagaugguggagcucuuucccgaaacacgggaggcuaccgaagaggaaccuacaaugaacggagagaccagcgucgaggaaaugggcggggccgugggaggcguugauauuggccuggugccccacgggcuuucugcuacgaauggagagauggccgaacugucccaagaggaacgcgagguccucgcgaagaccaaagagggcauggaccuggugaaguucgggcagugggaaaacaucuuuagcaaagagcacgccgcuucugcccugacaaauuccagcgcuucuugugaauccaagaacaaaaaugauagcgagaaggaacagauuuccucuggacauaacaugguggagggcgagggggccccuaagaaaaaggaaccccaggagaaucaaaaacagcaggacgucagaaccgcgauggaaacaaccggacucgccccguggcaggauggcguucuggagcggcuuaagacggcuguggacgccaaagauuauaacauguaccuggugcacaauggccgcaugcucauccauuucgggcaaaugccugcuugcacacccaaggagagagacuuugucuauggaaaacuggaagcccaggaggugaagaccguuuacacauucaaggugccugucagcuauuguggcaaacgggcccgccuuggggaugcuaugcuguccugcaagcccagcgaacacaaagcgguggacaccucugaucucggaaucaccguugaggaccugcccaaguccgaccugauuaaaacaacgcuccagugugcccuggaaagagagcuuaagggccaugugaucagcgagucucggagcauugaugggcuguuuauggacuucgcuacccaaacauacaacuuugaaccugagcaguucuccucuggaaccguccucgccgaucugacagccgcuaccccgggcggccuucacguggaacugcacagcgagugcgucacgcgcagacauaacaaguccagcucugccuuuacauucaccuguaauaaauucuuucggagagacgaguucccccuccacuuuaagaacgugcauaccgauauccaguccugccugaaugggugguuccagcaccgcuguccucuggcguaucucggaugcacauuuguucaaaaccacuuccggcccccuggccagaaagcuaaggugauuuacagccaggaacugaaaaccuuugccaucaagcccgaggucgccccggaacuuucugaggggagaaagaauaaccaucugcucggacacggcgggaaaucccagaauagccugacaucccugccucuugaaauucucaaguacaucgcuggcuuccuggacucugugagccuggcccaacucucccagguuucugugcugaugcgcaacaucugugcuacgcuucugcaggagcggggaaugguccuccugcaguggaaaaagaaaagauauagccauggcgggaccuccuggcgcgugcaccgggaaauuuggcaauuuagcucucuguucuccaagaucaagagcugggaguuuaaugaggugacaucuauguccgaacaucuuaaaagcugccccuucaacauuguugagcacaagaccgauccuauccuccugacaucuaugugccagcccagagaacaggcccgcgagagccuggucuccaccuuucggauuagaccucgcggacgguacgugagcuga

SEQ ID NO: 69229 - RNA, 1359 nt, Artificial Sequence
  derived and/or modified sequence opt5 from FBXO47__Homo_sapiens__XP_011523166
auggccagcagaaucaacaccaauuucacacugauucccaaccagaagcuccggcgcuccaauagacaaacgucuugcuacagcaaaacccugggcuccggguuucagccuaucucuacauucggaaacuuuaaggcucugccgcuggagauuuuccagaucauucucaaauaucugagcgugaaggacaucuccaugcuuucuauggucagcaaaaccguuucccagcacaucauuaauuacaucagcacaucuuccggcagcaagcggcugcuccugcaagauuuucauaaccuggaacuccccgaccgcagacaggauucugccauucuggagcacuaucggucccuugggcuucucuucaagcgcuguacccugcuucugccuacaaaagaaagacucaaguacauccauaaaauucugaccgaggugagcugcuuuaaguucaauggaugugcggcucccaugcagugccugggccucacguguuaugggauguuucugcagacccuuacagccggaugggacgaacuggagugccaccggguguacaacuuccucugugagcugaccaaucuuugccgcaaaauccaaauggccgucuguucuaagccuggcuccgcucagaagcuggaacuccggauuagacuguuuugccgcaacgugcugcucgaucauuggacacacagaagcgacuccgccuucuggcugacccggauccuuaaacccuggccuaugguuaaucaggcucgccugcucuauaucauuuuuggcccgaucucuccccaggaugggcaaguggucuggcaggagaugauugaggaaccuacggacgaguucagccugaagggacuugccgaugcgaucaaacugcucuacgacgccuccacaaaggaauggaccgcugaugacgugauuagccugguugaugagcugucugugguccccagagaauggcuccuggagaacaaugcccggcuucugaugcucuccggcaacaauaucuguuucagcuuuauggcuucuaaagccgugaacgggagaacaaucgaacuggcgcgccugguggucuuccuugcccucguuugcgagaaggagcuguacugcauggacuggaccgugaaaaugaugcagaagguguguaaggucuuuagcaccccuguggaacggaaaaacuuccugcaaaauguugcuaacgccuuugcuugcgugauuauggagaugcuccaguccaucaugucuggagacagagaugaagacgaucgcagcuuccugaaucuuuuucaccugguccaugcccaggccaacuuccacaaggaggugcucuaucugacaaugaauacgccccuguccaccuga

SEQ ID NO: 69230 - RNA, 1164 nt, Artificial Sequence
  derived and/or modified sequence opt5 from FBXO4__Homo_sapiens__NP_036308
auggccggcagcgagcccagauccgggaccaacucuccuccgcccccuuucagcgacuggggacggcuggaagcugccauccucuccggcuggaagacauuuuggcagucugugagcaaagagcgcgucgcgagaacgaccucccgggaagagguugaugaagcugccucuacacugacccgccuucccauugacgugcaacuguacauccucagcuuccuguccccucacgaucuuugccagcuggggagcacaaaucauuauuggaacgagaccgugagagaccccauucucuggcgguacuuucugcugcgcgaucucccuucuugguccagcgucgacuggaagucucugccggaucuugagauccugaaaaagcccauuuccgaagugacagacggagccuucuuugauuauauggcuguuuacagaauguguugcccuuauacccggcgcgccagcaaaucuuccagacccauguacggcgcugugacgagcuuccuccacucccugaucauccagaaugagccucgguuugccauguucgggcccggacuugaagaacugaacaccucucucguccugagccugauguccagcgaggaacucuguccgacagcgggccugccucagcgccaaauugacggcaucgggucuggagugaauuuucagcuuaacaaucagcauaaguucaacauucugauccucuauuccaccacaagaaaggagcgggaucgcgccagagaggagcacaccagcgcuguuaauaaaauguuuucucggcauaacgaaggcgacgaucagcaagggagcagauacuccgugauuccccagauccagaaggucugcgaggugguggacggauucauuuacgucgccaaugcugaggcccacaaacgccacgaauggcaggacgaguuuucucauaucauggcgaugacggauccugccuucggcagcuccgggcggccccugcuuguucugagcuguaucucucaaggagacgugaagagaaugcccugcuucuaucucgcucacgaacugcaucugaaccuccugaaucacccuuggcuugugcaggauacagaggccgaaacccugacaggcuuucucaacggcauugaguggauccuggaggaagucgaguccaaacgcgcucgguga

SEQ ID NO: 69231 - RNA, 1206 nt, Artificial Sequence
  derived and/or modified sequence opt5 from FBXO5__Homo_sapiens__NP_001135994
augaagugcgacuucaacuguaaucacgugcauagcggccugaaacucgucaagcccgaugacaucgggagacugguuuccuacaccccugccuaucuugagggaucuugcaaagauuguauuaaggacuacgaacggcugagcugcaucggcuccccgauugugucuccccgcaucgugcagcucgagacagaaagcaaaagacugcacaacaaggagaaucaacauguccagcagacgcuuaacuccaccaaugaaauugaggcucuggagacaucucggcucuaugaagauagcggguacuccagcuuuucucugcaguccggacugagcgagcacgaagagggcucucuccuggaggaaaacuucggggacucccuucaaagcugucugcuccagauccagucuccugaucaguaucccaauaagaaccugcuuccugugcugcauuuugagaaaguugugugcuccacccucaagaaaaaugccaagcgcaaccccaaagucgacagagaaaugcugaaggagaucauugcgcggggaaauuuccgccugcaaaacaucauuggcagaaagaugggccucgaauguguggauauccugagcgagcuuuuucggcgcgggcugagacacguucucgcuacaauucuggcccagcuuuccgacauggaucugaucaaugugucuaaagucagcaccacauggaagaaaauucucgaggacgauaagggagccuuccagcuguacuccaaagcuauccagcgggugaccgaaaacaauaacaaguuuagcccucacgccucuacgcgcgaguaugugauguucagaaccccgcuggcuuccguccaaaagagcgccgcgcagacaucucucaagaaggacgcccagaccaaacugagcaaccaaggcgaccagaagggguccacauacucucggcauaaugaauuuagcgagguugcuaaaacccuuaagaaaaacgaaucccugaaggccugcauccgcuguaauagccccgcuaaguacgauugcuaucuccagagagccacguguaaacgggagggaugcggcuucgacuacugcacaaagugucugugcaacuaucacaccacaaaagauuguucugacgggaaacuucugaaagcguccugcaagauuggaccucuccccggcaccaagaaaagcaagaaaaaucugagacgccuguga

SEQ ID NO: 69232 - RNA, 1332 nt, Artificial Sequence
  derived and/or modified sequence opt5 from FBXO7__Homo_sapiens__NP_001028196
auggccagacccccuggcgggagcggaccgcugcucgacuccgagcacucuagccugcagaacaaugaacaacccucccuugcuaccucuagcaaccagacauccaugcaggaugagcagccuucugacagcuuccaaggccaggccgcgcaguccgggguguggaaugaugacagcaugcugggacccucucagaacuuugaagcugaguccauccaagauaaugcccauauggccgaaggcacgggguucuacccuagcgagcccaugcucugcucugaguccgucgaaggacagguuccucacagccuggagacccuuuaucagucugcugacuguuccgaugccaacgacgcucugauugugcucauccaucugcugaugcucgaaagcggcuacauuccgcagggcacagaggccaaggcgcuguccaugcccgagaaauggaaacuuucugggguguauaagcugcaauacaugcacccucucugcgaaggaagcuccgccacccugacaugugucccccuuggcaaucugaucgugguuaacgcuacccucaagauuaauaacgagauccggagcgugaaacgccugcagcugcucccugaaucuuuuaucugcaaggagaagcugggggaaaaugucgccaacauuuauaaagaucuucagaagcuguccagacucuucaaagaccaacugguguacccccuucuggcuuuuacacggcaggcccucaaucugccggauguuuucggacuggugguccucccucuggagcuuaagcugcgcaucuuuagacuccuggacgugcggagcgugcuuucucugagcgcggucugucgcgaucucuucaccgccuccaacgacccccugcuguggagauuucucuaucugcgggacuuccgcgauaauacgguuagagugcaggacaccgauuggaaagagcuuuaccggaagcgccauauucagagaaaggaaucuccuaaaggccgguuugugaugcugcuccccagcuccacacacaccauccccuucuacccuaacccgcugcacccccgcccuuuucccagcucuagacugccucccgggauuaucggaggcgaguaugaccaacggccgacacuuccuuacgucggcgaucccauuuccagccucaucccugggcccggagaaaccccuucucaguuucccccgcugagaccucgcuucgaccccgugggcccccugccugggccgaaccccauccucccuggacggggcgggcccaaugauagauucccuuuccgccccucccggggaagaccuacggacggccgccugagcuuuauguga

SEQ ID NO: 69233 - RNA, 960 nt, Artificial Sequence
  derived and/or modified sequence opt5 from FBXO8__Homo_sapiens__NP_036312
augggccaggggcuguggagagugguccggaaccaacagcuccagcaggagggauacagcgaacaaggcuaucugacccgcgagcaguccagacggauggccgcuucuaauaucagcaacacaaaucaccgcaagcagguucaagggggaauugacaucuaccaucuucugaaagccagaaaguccaaagaacaggagggcuucauuaaccucgaaaugcugcccccugagcuuucuuuuacgauccugagcuaucucaaugcgaccgaucugugccuggcuuccuguguguggcaggaccucgccaacgaugagcugcuuuggcaggggcugugcaagucuacauggggacacuguagcauuuacaauaaaaacccgccccucggcuucuccuuucggaagcuguauaugcagcuugacgaaggcagccugaccuucaaugccaacccugaugagggggugaauuacuuuaugucuaagggaauccucgacgauucccccaaagaaaucgcuaaguucaucuuuugcacacgcacccugaacuggaaaaagcugagaauuuaucucgacgagcggcgcgauguccuggacgaucuugugacacugcauaauuucagaaaccaauuucucccuaaugcccugcgggaguucuuucgccacauucaugcucccgaagagagaggcgaauaccuugagacccugaucacgaaauucagccaccgguuuugugccugcaacccugaccucaugcgcgaacuggggcugucuccggaugcgguuuacgugcucuguuauucccugauucuucugagcaucgaccucaccucuccccacgucaagaacaagauguccaaaagagaguucauucggaauacaagacgcgccgcucagaacaucagcgaggacuucgugggacaucuguacgauaauaucuaucuuauuggccacguugccgcuuga

SEQ ID NO: 69234 - RNA, 1344 nt, Artificial Sequence
  derived and/or modified sequence opt5 from FBXO9__Homo_sapiens__NP_036479
augcccgacaucauuuggguguucccuccgcaggccgaggcugaagaggauugccacagcgacaccgucagagccgaugacgaugaagagaacgaaucccccgcggagacagaccugcaagcucagcuccagauguuucgggcccaguggauguucgagcuggccccuggcguuucuagcuccaaucuugaaaaccgccccuguagagcugcccgggggucucugcaaaagacgagcgcugauaccaaaggaaagcaggagcaggccaaagaagagaaggcgcgcgagcucuuucugaaagccguggaagaggaacagaauggcgcucuuuacgaggccaucaaguucuauagacgggcuaugcaacuggugccugacauugaauuuaagaucacauacacccgcucccccgauggggacggagucggcaacucuuauauugaggauaaugacgaugacagcaaaauggccgaccuccuguccuacuuccagcagcagcugacauuucaagagagcgugcucaagcugugccagccugaacuugagucuucccagauccauaucagcguucugccgauggaagugcucauguauauuuucagaugggucgugucuuccgaucuggaccuucggagccuggagcaacucucucugguuugucgcggguuuuacaucugcgcgagagaucccgaaauuuggcggcuggccugucucaaaguguggggacgcuccugcaucaagcuggucccuuauaccagcuggagagagauguuccuugagcggccccgcgugagauuugacggcguguacauuuccaaaacaaccuacauccggcagggcgaacagucucuggauggguucuauagagcuuggcaccaggucgaguacuaucgcuacauucgguuuuucccugacggacauguuaugaugcucacgacccccgaggaaccgcaaagcaucgugccuagacugcgcacacggaacaccagaacagaugccauccuucugggccacuaucgccucucccaggacaccgauaaucagacgaagguguucgcugucauuacaaagaaaaaggaagagaaaccccuggacuacaaguaucgguacuuuagacgcgugccuguucaggaggccgaucagagcuuccauguggggcugcaacucuguucuuccggacaccagcgguuuaacaaacugaucuggauucaccauagcugccacaucaccuacaagucuacaggcgaaaccgccgucagcgcuuucgagauugacaaaauguauacaccccuguuuuucgcgagagugcgcuccuacaccgccuuuucugaacggccccuuuga

SEQ ID NO: 69235 - RNA, 1629 nt, Artificial Sequence
  derived and/or modified sequence opt5 from FBXW11__Homo_sapiens__NP_036432
auggagcccgacagcgugaucgaagauaagaccauugagcugaugugcuccgucccuagaucucucuggcugggcugugccaaccuuguugaaagcaugugcgcucuguccugucuccagucuaugccgagcgugcggugccugcaaaucuccaaugggacaucuagcgugauugucucccgcaaaagacccagcgagggaaacuaccagaaggaaaaagaccuuuguaucaaguauuucgaucaguggucugaguccgaccagguggaguuuguugaacaccugauuagccggaugugccauuaccaacacggccauaucaauucuuaucucaaaccuaugcugcagcgcgauuucaucacggcccugcccgagcaggggcucgaccacauugcggaaaacauccuguccuaccuugaugcuagaagccugugugccgccgagcucgugugcaaggaguggcagcgggucauuucugaaggaaugcuguggaagaaacuuaucgagcgcauggugagaaccgacccucuguggaagggccucuccgaacggcgcgggugggaucaauaucuguuuaaaaauagacccacagacggaccuccgaacagcuucuaccggucccuguaucccaagauuauccaggauauugagaccaucgaaucuaauuggcgcuguggcagacauaaccuccagcggauccagugccgcagcgaaaauuccaaaggcguuuacugucugcaauacgacgaugagaagauuaucagcgggcuuagagacaacucuauuaagaucugggacaaaacaucccuggaaugccucaaggugcugaccggacacacaggcagcguccuuugccugcaguaugaugagcgggugauugugaccgggucuagcgacuccacggucagaguuugggaugugaauaccggagaagugcucaacacacugauccaccauaaugaggcuguccugcaccuccgcuuuucuaacggccugauggugaccuguagcaaagaccgguccaucgccguuugggauauggcuagcgccacagacauuacccuuagacgcgugcuggucgggcaucgggcggccgugaauguuguggauuucgacgauaaguacaucgucucugcuuccggagacagaacgauuaaaguguggagcacaucuaccugcgaauuuguccgcacacucaacggccacaagcggggcaucgccugucugcaguauagagaucgccuugugguuuccgggagcuccgacaacaccauucggcugugggacaucgagugcggagcuugucucagagugcuggagggccacgaggagcugguccgcugcauccgguucgauaauaaaagaauugugucuggggccuacgacggaaagaucaagguuugggaucuccaagcggcccuggacccucgggcucccgccagcacccuuugucugcgcacacucguggaacauuccggcagagucuuucggcugcaguucgaugaguuucagauuaucucuagcucccacgacgauacgauucugaucugggacuuccuuaacgugccucccagcgcucagaaugaaaccagaucuccgucccgcacauauaccuacauuagccgguga

SEQ ID NO: 69236 - RNA, 1239 nt, Artificial Sequence
  derived and/or modified sequence opt5 from FBXW4__Homo_sapiens__NP_071322
auggccgcugccgcgggcgaggaagaggaagaggaagaggcugccagagagagcgccgcucggcccgccgcugggccugcccuguggcgccucccggaggaacugcuucugcucaucugcuccuaccuggacaugagagcgcuuggacggcuggcccaggugugucgcuggcucagacgguucaccucuugcgaucugcuguggcgcagaauugcucgggccagccucaacuccggcuuuacacgccuggggacggaccuuaugaccucuguccccguuaaggaaagagugaaagugagccaaaauuggcggcugggacgcuguagagagggcauccuccugaaguggcggugcucccagaugccuuggaugcagcuugaggaugacucucuguauauuagccaggcuaacuucauccucgccuaccaauuucgccccgauggggcgucccugaauagacggccucugggagucuucgccggccacgacgaagaugugugucauuuuguucucgcuaacagccacauugugucugccggcggggacggaaaaaucggcauccauaagauucacuccacauucaccgucaaauauagcgcucaugagcaggaagugaauugcguugauuguaaagggggaaucauugugucuggcuccagagaccgcacagccaaggucuggccccuggccagcgggcggcuuggacagugccugcacaccauccagacagaggauagaguguggucuauugcuaucuccccucuccugagcuccuuugugaccggcacggcguguugcggccacuucucuccgcuucgcauuugggaccugaacagcgggcaacucaugacccaucugggauccgauuuucccccuggcgccgggguccuggacguuauguacgaaagccccuucacacuccugucuuguggauaugacaccuacgugcgguauugggaucuuagaacauccgugcgcaagugcgucauggagugggaggaaccucacgacagcacccuguacugccuccagacggauggcaaucaucugcuugcuacagggucuagcuacuauggagugguucggcugugggacagacgccagcgggccugucuccacgccuuuccccugaccuccacaccgcugucuagcccuguguacugccucagacugaccaccaagcaccuuuaugcugcccuguccuacaaccuccauguccuggauuuccagaaucccuga

SEQ ID NO: 69237 - RNA, 1884 nt, Artificial Sequence
  derived and/or modified sequence opt5 from FBXW7__Homo_sapiens__NP_060785
augugcgugcccagaagcggccugauccucuccuguauuugccuguacugugggguccuucugccuguucuccugccgaaccuucccuuccugaccugccucucuaugagcacacuggaguccgugacguaucugccugaaaagggacucuacugucagcggcugcccucuagccgcacccacggcgggacagagucccuuaaaggaaagaauaccgaaaacaugggcuuuuaugggacacugaaaaugaucuucuacaagaugaaaagaaagcucgaccauggaucugaggugcggagcuuuucccugggcaagaaaccuugcaaggucagcgaauauaccucuacaaccggccuugugcccuguuccgccacgccuaccacauucggggaucugcgcgcugccaauggacaaggccagcagagacggcgcauuaccagcguucagccgcccacagggcuccaagaguggcugaaaauguuucagucuugguccggaccugagaagcugcucgcgcuggacgaacuuaucgauagcugcgagcccacccaggugaaacacaugaugcaggucauugaaccucaauuccagagagacuuuaucucucugcuccccaaggagcuggcucuuuacgugcuguccuuccucgagccgaaggaucugcugcaggccgcccagacgugucgguauuggcgcauccucgcugaagacaaccugcuuuggagagagaaaugcaaggaagagggcauugaugaaccucugcauaucaaacggcgcaagguuauuaaacccggguuuauccacagcccuuggaaguccgccuacauuagacaacaucggaucgacacaaauuggcgcagaggagagcucaaaucucccaaggugcugaagggccacgaugaccacgucauuaccugucuucaguucugcggcaaccggaucgugagcggguccgaugacaauacacugaaaguguggagcgcugucaccggaaagugccucagaacccugguuggccauacagggggaguguggucuucccagaugcgcgauaacaucauuaucagcggcucuacggaccggacccugaaaguguggaaugccgagacaggggaauguauucacacccucuacggacauacaagcaccgucagaugcaugcaucugcacgagaagcgcgugguuuccggcucucgggacgcgacgcuuagagugugggauaucgaaacaggccaaugucugcacguccucauggggcacguggccgcuguucgcugcgugcaguaugacggacggagagucgugagcggcgccuacgauuuuauggucaaagugugggaccccgagaccgaaaccugucugcauacacugcaggggcacaccaaccgcguuuauucccuucaguucgauggcauucauguggucagcggaucucucgacacauccauccgggugugggauguugagacggggaauugcauccacacccugacaggccaccaaagccugaccucuggaauggagcucaaggacaacauucugguguccggcaaugcugauagcacagucaagaucugggacauuaaaaccgggcagugucuucagacgcugcagggaccuaacaagcaucaauccgccgugaccugccuccaguuuaauaaaaacuucgugaucacaucuagcgaugacggcaccguuaagcugugggaccugaaaacaggggaguucauuagaaaccuugucacccucgaauccggaggcucugggggcgugguguggcgcauccgggcgagcaauacgaagcuggucugugccgugggauccagaaacggcacagaagagaccaagcugcucguucuggauuuugacguggauaugaaauga

SEQ ID NO: 69238 - RNA, 1599 nt, Artificial Sequence
  derived and/or modified sequence opt5 from FBXW8__Homo_sapiens__NP_036306
auggacgauuacagccuggacgaguucagacggcgcuggcaggaggaacucgcccaagcucaggcccccaagaaaagacggcgcccugaagcggcugagagacgggcccgcagaccggaaaacgagaugaaugaugugcccuuuuucgacauccagcugccuuaugagcuugccauuaacaucuuucaguaccuggaucggaaggaacucggccgcugcgcucaagucuccaaaaccuggaagguuauugccgaggacgaagugcugugguauagacuuugucagcaggaggggcaucugcccgauucuagcaucuccgacuacucuugcuggaaacucauuuuccaggagugucgggcuaaggaacacaugcugcgcacaaauuggaagaacagaaaaggagccgugagcgagcuggaacacgucccugauacggugcucugcgacguucauucccacgauggcguggucaucgcgggguauaccucuggagacgugcggguuugggauacacgcaccugggacuacguggcccccuuucuggagagcgaagacgaggaggaugaaccuggcaugcaaccgaaugucuccuucgugagaaucaacagcucucuugcuguggccgcuuaugaggacggguuucugaauauuugggaucuccggacaggaaaguaccccguccauagauucgaacacgacgcccgcauccaggcgcuggcccuuucccaggaugacgcuaccguugccacagcuagcgccuuugauguggugaugcugucuccuaacgaggaaggcuacuggcagauugccgcugaguucgagguccccaaacucgugcaauaucuggaaaucguuccugagacccggagauaccccguggcggucgccgcugccggcgaccugauguaucuccugaaggccgaagauuccgcucgcacgcuucuguacgcccacgggccgccugugaccugucucgacguuagcgcgaaucagguggcuuuuggaguccagggccugggguggguguaugagggaucuaaaauucuugucuacucccuggaagccggccggagacuccugaagcuggggaacgugcuccgcgauuucacaugcguuaaucugagcgacucucccccuaaccuuaugguguccggaaauauggacggccgggucagaauccaugaucugcgcagcggcaacauugcccucucccugagcgcucaccaacuucgggugucugccguucagauggacgauuggaagaucguguccgggggagaggagggccuggucagcgugugggacuauagaaugaaucagaaacucugggaaguguacucugggcaucccguucagcacaucagcuuuuccucucacagccugauuaccgcuaacguccccuaccaaacagugaugcgcaacgccgaucuggacuccuucaccacgcaucggagacaccggggacucauccgcgcguaugaguucgccguggaucagcuggcuuuucagagcccucuuccggucuguagaucuuccugcgacgccauggcuacacauuacuaugaucuggcccucgcguuccccuacaaucacguguga

SEQ ID NO: 69239 - RNA, 864 nt, Artificial Sequence
  derived and/or modified sequence opt5 from FCAR__Homo_sapiens__NP_001991
auggaccccaagcagaccacacugcucugccuggugcuuugucugggccaaagaauccaggcccaggagggggauuucccuaugccguuuauuagcgcuaaauccucucccgucaucccucucgacggaagcguuaagauucagugccaagccauccgggaagcguaccugacgcagcuuaugauuaucaaaaacuccaccuaucgcgagaucggcagacggcugaaguucuggaaugaaacagaucccgaguuugugauugaccacauggaugcuaacaaagccgggcgcuaccagugucaguauagaaucggacauuaccgguuccgcuauucugacacccucgaacugguggucacaggccuguacgggaagccuuuucucagcgccgauagaggacuggugcuuaugcccggcgagaauauuucccugaccugcucuagcgcucacaucccuuucgaccgguuuucccucgccaaggagggcgaacugagccuuccgcaacaucagucuggggagcaccccgcuaacuucucccugggaccuguugaucucaaugugagcggcauuuaucgcuguuacgggugguacaacagaucucccuaucugugguccuuuccuagcaaugcccuggaacucgucgugacagacucuauccaucaggauuacaccacgcagaaccugauucggauggcgguugccggacuugugcuggucgcucuccuggccauccuuguggagaauuggcacucccacaccgcucugaacaaagaggccagcgcggacguggccgaacccuccuggucucaacagaugugccagccgggccucacauucgcucgcaccccuagcgucuguaaguga

SEQ ID NO: 69240 - RNA, 774 nt, Artificial Sequence
  derived and/or modified sequence opt5 from FCER1A__Homo_sapiens__NP_001992
auggcccccgcuauggagagcccuacccugcucugcguggcccugcuuuucuuugcgccggacggcguccuggcuguuccccagaagccuaaagugucccucaaucccccuuggaauagaaucuucaagggggaaaacgugacacugacguguaauggaaacaacuuuuucgaggucucuagcaccaaaugguuucacaacggcucccuuucugaagagacaaauagcucccugaacauugugaaugccaaguucgaagauucuggggaguacaaaugccaacaucagcagguuaacgagagcgaacccguguaucucgaggucuuuuccgacuggcugcugcuccaggccagcgcugaagugguuauggagggacaaccucuguuccuucggugucacggcuggcgcaauugggauguguacaaggucaucuauuacaaggacggggaggcccugaaauauugguacgaaaaccauaauauuucuaucaccaacgcuacaguggaggauuccggaaccuauuacugcacaggcaagguguggcagcucgacuacgaaagcgagccgcugaauauuaccgucaucaaagcccccagagaaaaguauuggcuucaguuuuucaucccucugcucguugugauucuguuugcgguggauacgggccuguucaucucuacccagcaacaggucacauuucuccugaaaauuaagcggacccgcaagggguucagacuucugaacccccacccuaaacccaacccgaagaauaacuga

SEQ ID NO: 69241 - RNA, 261 nt, Artificial Sequence
  derived and/or modified sequence opt5 from FCER1G__Homo_sapiens__NP_004097
augauccccgccgugguccugcuccugcuucugcucguugagcaggcugccgcgcugggcgaaccucaacuuugcuacauucuggacgcuauccucuuccuguaugggauugugcugacccuccuguacuguagacuuaagauccaggugcggaaagccgccauuacaagcuaugagaaguccgauggagucuacacgggccugucuacccgcaaccaggaaacauaugagacccucaaacacgaaaagccgccccaguga

SEQ ID NO: 69242 - RNA, 963 nt, Artificial Sequence
  derived and/or modified sequence opt5 from FCER2__Homo_sapiens__NP_001193948
augaaucccccuagccaggagaucgaagaacugccgagacggcgcugcuguagacggggcacccaaauugugcuccuggggcuugucacagccgcccugugggccggacuccugacgcuucugcuccuguggcacugggacaccacacagucccugaagcagcucgaggagcgcgcggcuagaaacguuucucaggugagcaaaaaccuggaaucccaucacggcgaucaaauggcccagaagucucagagcacccagaucucccaagagcuugaggaacugcgggccgagcagcagcgccucaaaucucaggaccuggaacuuagcuggaaucugaacgggcuccaagcugaucuguccagcuucaagucucaggagcugaaugagagaaacgaagccuccgaccuccuggagcggcuucgcgaagaggugacaaaacugagaauggaacuccaggucagcucuggauuugugugcaauaccugucccgagaaguggauuaacuuccaacggaagugcuacuauuuuggcaaagggacaaagcaguggguucaugcucgcuacgccugugaugacauggagggacagcugguguccauccacagcccugaggaacaggauuuccuuaccaaacaugcgucucacacgggcuccuggauuggccugagaaaucucgaccugaagggggaauuuaucugggucgauggaagccacguggacuauuccaacugggcccccggcgagccuaccucucggagccaaggggaagauugcguuaugaugcgcggauccggcagauggaaugacgcuuucugugaucggaaacugggggccugggugugcgacagacucgcuacauguacacccccugccagcgagggaucugcggaguccaugggcccggacagccgccccgauccugacggccggcugcccaccccuucugcuccccuucauagcuga

SEQ ID NO: 69243 - RNA, 16218 nt, Artificial Sequence
  derived and/or modified sequence opt5 from FCGBP__Homo_sapiens__NP_003881
augggcgcccuguggagcugguggauccugugggcuggggccacccugcuuuggggccugacacaggaagccuccguggaccucaagaacacgggcagagaagaguuccugaccgcuuuucuucagaauuaccagcuggccuauucuaaagccuacccccggcuccugauuagcucccugucugaaagcccugcuuccgugucuauucucagccaggccgauaacacauccaagaaaguuaccgugcgcccgggggaaagcgugauggucaauauuucugcuaaggccgaaaugaucggcuccaaaauuuuccagcacgccgugguuauccacagcgacuaugccaucucugugcaggcucugaacgccaagcccgauacagcugaacuuacccugcucagaccuauucaggcccugggcacagaauacuuuguccuuacacccccugggacguccgcgcggaaugugaaggaguucgccguuguggcuggagccgcuggcgccagcgucucugugacccugaaaggcuccgugacauuuaacgggaaguucuaucccgccggagacguccuccgcguuacccugcagccuuacaauguggcucagcugcagagcuccguggaucucucuggcagcaaagucacagcguccagcccgguggccguucugucugggcacuccugcgcucagaagcauaccacgugcaaccacguggucgagcagcuucugcccacaagcgccuggggaacccauuaugugguuccuacacucgccucucagagcagauacgaccuggcuuuuguggucgccucccaagcgaccaaacuuaccuacaaucacggcgggaucacaggaucucggggccugcaggcuggcgauguggucgaguucgaggugcgccccagcuggccucucuaucuguccgccaacguugggauucaggugcugcucuuuggaacgggcgccaucagaaaugaggucaccuacgaccccuaucuggugcuuauuccggauguugcugccuacugcccugcuuauguggucaagagcgugcccgggugcgaaggaguggcccugguugucgcgcaaacaaaggccaucucuggccucaccauugacgggcacgcugugggagccaaacugacaugggaggcugugccuggcuccgaguucagcuacgccgaggucgaacuuggcaccgcggauaugauccauacggccgaggcuacaaccaaccuggggcuccugaccuuuggacuggccaaggcuaucggcuaugccacagccgcugacugcgggcggaccgugcucucucccguugagcccuccugugaaggaaugcagugcgcggccggccagcgcugccagguggucgggggcaaagcuggaugcguggccgagagcacagccguuuguagagcucaaggcgauccucacuacacgaccuucgacgggcggcgcuacgacaugaugggaacaugcuccuauaccaugguggaacugugcucugaggaugacacacuuccggccuuuagcgucgaagcgaagaaugagcauagaggcucccggcgcgugucuuacguugggcuggugaccgucagagcuuauagccacuccgugagccucacgcggggagaggugggcuucguccugguugauaaccagagaucucgccugcccgugucccuuagcgaagggcggcucagaguguaccagucuggcccucgcgccgucguggagcugguuuucggacugguggucaccuaugacugggauugccagcucgcccugucccuucccgcucgguuucaagaccaggugugcggccugugcgggaauuacaacggagauccugccgacgauuuccucacacccgacggcgcgcuggcuccggaugccguugaauuugccagcucuuggaaacuggacgacggggauuaucuuugcgaggacggaugccagaacaauugcccugcuugcacccccggccaggcccaacacuacgaaggggauagacucugcggcaugcugacaaagcuggacggaccuuucgcugugugccaugauacccucgacccccgcccuuuucuggagcagugcgucuacgaucuuugugugguuggcggggagcggcugagccucugcagaggacuguccgccuaugcgcaggccugucuggaacuuggcauuagcgugggggacuggcgcucucccgcuaacugcccgcucuccugcccugccaauagccgguacgagcuguguggacccgcuugccccacguccuguaacggcgccgccgcuccuucuaauugcagcgggagaccgugugucgaaggcugcgugugucugcccggauucguggcguccggcggggccugcgucccugcuucuagcuguggaugcacauuucagggccuccaacuggcccccgggcaggagguuugggccgaugagcuuugucagcgccgguguaccugcaacggagcuacacaccaagugaccuguagagacaaacaguccugcccugccggcgaacgguguucugugcagaauggccugcucgggugcuaucccgaucgcuucggaaccugucagggcagcggggacccucauuacgucuccuuugauggaagacgguucgacuuuaugggcacaugcacguaucugcugguggggagcuguggacaaaacgcggcccuucccgccuucagaguucucguggagaaugaacaccgcggcucucagaccgucuccuacacacgggccgugagaguugaggcucgcggcgugaaggucgccgugagacgggaauauccggggcagguccugguggacgauguucugcaguaccucccuuuucaagcggcugacggacaggugcaggucuuccgccagggcagagaugccgugguucggaccgacuucgggcugacagugaccuacgauuggaacgcccgcgucacggcuaaggugcccagcucuuaugccgaggcucuuugcggacuguguggcaauuuuaacggggacccugccgaugaccucgcgcugagaggaggcggccaagccgcuaaugcccuggcuuucgggaacuccuggcaggaggaaacacggcccggaugcggcgccaccgagccgggggauuguccuaaacuugacagccugguggcccagcaacuccagucuaagaaugaaugcggaauccuggcugaucccaaaggcccuuuucgcgagugccauuccaagcucgacccccagggggcgguuagagauugugucuacgaccggugccugcuucccggacagagcggcccucugugugacgcccucgcuaccuaugccgccgcuugccaagccgcgggcgcuacagugcacccguggcgcuccgaagaacucuguccccugagcugcccuccccacucucauuacgaggccuguagcuaugggugcccucuuuccuguggagaucugcccgugccuggcgggugcggaucugaaugucacgagggcugcgucugcgacgaaggguucgcccucagcggagaguccugucugccgcucgcuucuugcggcugugugcaucagggcaccuaccaucccccugggcagacauuuuaucccggaccuggcugcgauagccugugucacugccaggaagggggacuuguuuccugugagucuagcuccugcggcccccaugaggccugucaaccgagcgggggaucucugggcugcguggcggucggcuccagcacgugucaggccucuggggacccucacuacaccacauucgauggaagacgguuugacuucaugggaaccugcguguacguucucgcucagacaugcgggaccagacccggacugcaucgcuuugccgugcugcaggaaaacgucgcuuggggcaacgggcggguguccguuacgagagugauuaccguccaaguggccaauuucacacuucgccuggagcagcggcaguggaaagugaccgucaacggaguugauaugaagcuccccguggugcuggcuaauggccagaucagagccagccaacacggcuccgacgucgugauugaaacagauuuugggcuccgcguugcguaugaccugguguacuauguccgggugaccguuccuggaaacuacuaucagcagauguguggccuuugcgggaauuacaacggagaucccaaggacgacuuccaaaaaccuaauggcucucaggccgggaacgcuaaugaguuuggcaacagcugggaggaaguggucccggauucccccugucugccucccacaccuugucccccgggaagcgaggacuguaucccuucucauaagugucccccugaacuggagaaaaaguaucagaaagaagaguucuguggccuccuguccagccccaccgggccucuuucuagcugccacaagcugguggauccccagggaccgcucaaggacuguaucuucgaucugugccucggcgggggaaaucuguccauucuuuguucuaacauccacgccuacgucagcgcuugccaagccgccggcgggcauguggagccuuggagaacggaaacauuuugucccauggagugucccccuaauucccacuacgaacugugcgcugacaccuguucucugggcugcagcgcgcucuccgccccgccccagugucaggauggaugcgcugagggcugucagugcgacagcggguuccuguauaacggacaagccuguguuccuauucagcagugcggcuguuaccauaaugggguguauuacgaacccgagcagaccgugcuuaucgauaacugccgccaacaguguacaugccacgccggaaaaggcauggucugccaggagcauucuuguaagccugggcaaguuugccagcccuccggcggcauucugagcugugugaccaaagacccuugccacggcgugacgugucggccgcaggaaacaugcaaggagcaaggcgggcaaggcgucugucuccccaacuaugaagcuaccugcuggcuguggggagauccucacuaccauuccuuugacggaagaaaauucgauuuucagggcacauguaauuaugugcucgccaccacaggcugccccgggguuucuacccagggacugacgccuuucaccgugacaaccaagaaccagaaucggggcaaccccgcggucagcuacgugcgcgucgugacaguugccgcucuugggaccaauaucuccauccacaaggacgagauuggaaaagugagagucaacggcgugcugacggcccugccgguuucuguggcugacgggcggaucagcgucacacaaggagccuccaaggcgcuccugguggccgauuuuggccuucaggugagcuacgacuggaauuggcgcguugaugucacccugccuucuuccuaucauggcgcugugugugggcucugcggaaacauggacagaaaucccaacaaugaucagguguuccccaacggcacacuggccccuagcauucccaucuggggagggucuuggcgggcuccuggcugggacccgcucugcugggaugaauguagaggguccugccccaccuguccugaggaccgccuggagcaguacgaaggacccggcuuuugcggcccucuugcccccgggaccggaggcccguucacaacgugucacgcucacgucccucccgagagcuuuuucaaagggugcguucuggauguguguaugggaggcggggaccgggauauucugugcaaggcccucgcgucuuauguggccgcuugucaagccgcuggagucgugaucgaagacuggagagcccagguuggcugcgagauuaccuguccugagaauagccauuacgaagugugcggcucccccugcccugccucuugucccagcccggcgccucugacaacccccgcugucugcgaggggcccuguguggaaggaugccagugugaugccggcuucguucuuuccgcugaccgcugcgugccucugaacaauggguguggaugcugggccaacggcacauaucacgaggccgggagcgaauuuugggcugacggaaccuguucccaguggugccgguguggcccgggcgggggaucucucgucugcacgcccgccagcugcggccugggggagguguguggacugcucccuuccggccaacaugggugccagcccgugucuacagcggagugucaggccuggggagauccucacuacgucacccuugacggccauagauucaacuuucaaggaaccugcgaauaucugcugagcgcucccugucacgggccuccccucggagccgagaauuucacaguuaccguggcuaacgaacaccgcggcucccaggccgugucuuacacacggagcgucacgcugcagaucuacaaucauucccuuacccugagcgcgagauggccgcgcaaacuccagguggaugggguuuuugugacacugccuuuccaacuggacucucuccuucacgcccaucuguccggagcugaugucgugguuaccacaaccagcggccugucucucgccuuugacggggauuccuucgugagacugcggguccccgcugccuaugcuggaagccuuugcggccuguguggcaacuacaaucaggacccugccgaugaccucaaggcggugggcgggaaacccgccggguggcagguugggggagcucagggcugcggggagugugugucuaagccgugcccuucccccuguacgcccgaacaacaggagagcuuuggcggaccugaugccugcggcgucaucuccgcuaccgacgggccccuggccccuugccacggacuggugccgcccgcccaguauuuccagggcugucuccuugacgcgugccaaguccaggggcacccuggaggccugugucccgcuguggccacauacguugccgcuugccaggccgcuggggcccaacugcgcgaguggagacggccugauuuuugucccuuccagugcccugcgcauagccacuaugaacucuguggcgacucuugcccgggaagcugucccucccugucugccccugagggcugcgaaagcgcuugucgcgaggggugcgugugcgaugccggauuuguccuuuccggcgacaccugugugcccguggggcagugcggaugucugcaugaugacagauacuauccucucggccagacauucuaccccgggccgggcugcgauucucugugucggugcagagaaggaggcgagguuagcugugagccuuccucuugcgggccccacgaaaccugucgccccagcggaggcucccuggggugcguggcugucggaagcacaacgugucaagccucuggcgacccucauuacaccacauucgaugggcggagauuugacuucauggggaccugcguguauguucucgcgcagaccugcggaacacgccccggccuucaccgguuugccgugcugcaggagaacgucgcuugggggaauggaagaguguccgucacgcgggugauuaccguucagguggccaacuucacacugcgccucgaacaaagacaguggaaggucaccgugaauggcguugauaugaaacugccugugguccuugcuaacgggcagauccgggccagccagcacggaucugacguggugauugagacagauuuuggccugcgcguugcuuacgaccucgucuauuacgugagagugaccgucccgggcaauuauuaccaacugaugugugggcugugcggaaacuauaauggcgaccccaaggaugacuuccagaaaccuaacgggucccaggccggaaaugcgaacgaguuuggcaauagcugggaagaggugguucccgauuccccuugucugcccccgccuacgugucccccugggucugaaggauguauccccagcgaggaaugcccgccugagcuugagaagaaauaccaaaaggaagaguucuguggccugcuguccagccccacaggcccccucucuuccugccauaagcugguggacccucaggggccccuuaaagauuguauuuuugaccugugccucggaggcgggaaccugagcauccuguguucuaacauccacgccuacgucagcgcuugccaggccgccggaggccagguggaaccuuggcggaaugagaccuucugcccgauggaauguccccaaaacucccauuaugagcucugcgcugauaccuguucucuugggugcagcgcccuguccgcgccucugcagugucccgacggaugcgcugagggcugucagugcgauucuggcuuucucuacaaugggcaggccuguguuccuauucaacagugcggauguuaucacaacggcgccuacuaugaacccgagcagacagugcugaucgacaauugccgccagcaaugcaccugucacgucgggaaggugguugugugccaggaacauagcuguaaaccuggacaggucugccagccguccggcgggauucuuagcugugugaacaaggaucccugccacggagugacauguagaccucaagagaccugcaaagaacagggcggccagggggucugucugcccaauuacgaggcuacgugcuggcucuggggagacccucauuaucacucuuucgacggccggaaguuugauuuccaagggacauguaacuacguucuggccaccacaggaugccccggcguguccacccaggggcugacgccguucaccgugacaaccaagaaucagaaccgcggaaauccugcugucagcuacgugagaguugugacagucgccgcgcucggcaccaacaucuccauucauaaagacgagaucggcaaggugcggguuaauggggugcuuacagcccugcccgucucuguggcugauggaagaaucagcgucacccagggcgccuccaaagcucugcucguggccgacuuugggcugcaaguuucuuaugauuggaacuggcgcguggacgucacgcuucccagcuccuaccacggagcggugugcggccugugugggaauauggaucggaacccuaacaaugaccagguuuuccccaacggaacacucgccccuagcauuccgaucuggggcggcucuuggagagcucccgggugggauccucugugcugggacgaaugucgcggauccugccccaccuguccugaggaucggcuggaacaguaugagggccccggguuuugcggaccgcucgccccuggcaccgggggacccuucacaaccugucacgcucaugugccucccgagagcuuuuucaagggcugcguccuugacguguguaugggcgggggagauagagacauucugugcaaagcccuggccucuuacguggcugcgugucaggccgcuggcguugucaucgaagacuggcgcgcccaaguggggugcgagauuacaugcccugaaaauucccacuaugagguguguggacccccgugccccgccagcuguccuucucccgcuccucucacgaccccggccgucugcgaaggccccuguguggaggggugccagugugaugcgggcuuuguucuguccgcugaccggugcgugccucuuaacaauggauguggcugcugggccaacgggacauaccaugaggccggaagcgaguucugggcugauggcaccuguucucaguggugcagaugugggcccggaggcgggagccuggucugcaccccugcuuccugcggccucggagagguguguggccugcugcccagcgggcagcacggaugccaaccuguuuccacagcugaaugucaggccuggggcgacccccauuaugugacgcucgaugggcaccgcuuugacuuccagggaaccugcgaguaccuucugucugcgccgugucacggcccuccccugggggccgaaaauuuuacagucaccguggcuaacgagcaucggggcagccaagccguguccuacacaagaucuguuacccuccagaucuauaaucacagccugacgcuuuccgcucgcuggccucggaagcugcaggucgauggaguguucgugacacuccccuuucagcuggacucucugcuccaugcccaccugagcggcgcggaugucguugugaccacaaccuccgggcuuagccuggccuucgacggagauucuuucgugagacuccgcgucccggcugccuacgcuggcucccugugcgggcuuuguggaaacuauaaucaagacccugccgaugaccugaaggccgugggcgggaaacccgcuggcuggcagguuggaggcgcgcaggggugcggagagugugugagcaagcccugcccuucucccuguaccccugaacagcaagaguccuuuggcgggccggacgccugcggagucaucagcgcuacagauggcccccucgccccuugccacggccuggugcccccugcccaguacuuccaggggugucugcucgacgcuugccagguucaaggacaucccggcgggcuguguccggccguggcgacguaugucgcugccugccaggccgcuggagcccagcuuagagaauggcggcgcccugauuuuugucccuuccagugcccugcucacucucauuacgagcuguguggcgacuccugccccgggagcuguccuucucucuccgcccccgaaggaugcgagagcgcguguagagagggcugcgugugcgaugccggcuuugugcugagcggggacaccugugucccgguuggacaaugcggcugucuucacgaugaccgguauuacccccuggggcagacauucuacccuggacccggcugcgauucccucuguagaugccgggaagggggagaggugucuugugaaccuagcuccugcggcccccaugagaccugucgcccuucuggcgggagccugggaugcguggcugucggcuccacaaccugucaggccucuggggacccgcacuauacgacauuugauggacacagauucgacuuuaugggaaccugcguuuacgugcuggcucaaaccugcgggacacggcccggacuccaucgcuucgccgugcugcaggagaacgucgcguggggcaauggcagagugagcguuacccgggugauuacaguccagguggccaacuuuacgcuucgccuggaacagagacaauggaaaguuaccgugaauggggucgacaugaagcucccugugguccuggcuaacggacagauccgggccucccagcacggcagcgaugugguuauugagacagacuucgggcuucgcguggcuuaugaucuggucuacuaugugagagugaccguucccggaaacuacuaucagcucauguguggccugugcgggaauuacaacggagacccuaaagaugacuuucaaaagcccaauggcucucaggccggcaacgccaaugaguucgggaacuccugggaagaagucgugccggauagcccuugucugcccccucccacaugcccgccuggaucugcuggcuguauccccuccgacaaaugucccccugagcucgagaagaaguaccagaaagaagaguucugugggcugcuuagcucccccaccggaccucugucuagcugccauaagcucguggauccgcagggcccccugaaagacuguauuuuugaucuuugccucgggggcgggaaucucuccauccuguguucuaacauucacgcguauguuagcgccugccaagcugccggcgggcacgucgaaccuuggcggaaugagacguucugccccauggaauguccucagaacucccauuacgagcugugcgccgacaccuguagccucggaugcucugcucuguccgcgccccuucaguguccugauggcugcgcggaggggugucaaugcgacagcggauuucuguauaauggccaggcuugugugccgauccagcagugcggguguuaccacaacggaguguauuacgaacccgagcaaacaguccucaucgacaauugccgccagcagugcaccugucaugugggcaagguuguggucugccaggaacacucuuguaaaccuggccaagugugccagcccagcggcgggauucuguccuguguuacaaaggauccuugccauggggugaccuguagaccccaggagacaugcaaggaacaagggggccaaggcgucugucuuccgaacuacgaggcgaccugcuggcuguggggagacccccacuaucacucuuucgauggccggaaauuugacuuccagggaacguguaauuacgugcucgccacaaccggcugcccuggggugagcacccagggacugacacccuuuacgguuaccacaaagaaccaaaaccgcggcaauccugcugucuccuaugugagaguggucaccguggccgcucuggggacaaacaucagcauucauaaagaugagaucggaaagguucgggugaauggcguccucaccgcccugcccgugucuguugcggacgggagaauuuccguggcccagggcgcuagcaaagcccuucuggucgcugauuucggacuccagguguccuacgacuggaacuggcgcguugaugugacacugccuucuagcuaucacggcgccgucugcgggcuuuguggaaauauggaccggaacccgaauaacgaucagguguuucccaauggcacccuggcgccuuccauccccaucuggggaggcucuuggagagccccuggcugggacccccucugcugggaugaaugucgcgggagcugcccgacguguccugaggaccggcuggaacaauacgagggccccggauucugcggcccucuguccucugggaccggaggccccuuuacaaccugucaugcucacgugccucccgagagcuucuuuaaggggugcguccucgacguuuguaugggaggcggcgauagagacauucugugcaaggcccuugcuuccuauguggccgcgugucaggccgcugggguggucaucgaagauuggcgcgcccaggugggaugcgagauuacaugcccggaaaacagccauuacgagguuuguggacccccuugccccgcuucuuguccuucccccgccccgcugaccacgccugccgugugcgaagggcccugugucgagggaugccagugugacgcuggcuucgugcucagcgccgaucggugcguuccucugaauaacggguguggaugcugggcgaauggcacauaccacgaggcuggcucugaguucugggccgacgggaccuguucccaauggugcagaugcggacccggcgggggaagccuuguguguaccccugccucuugcggccugggggaggucuguggacuccugcccagcggccagcacggcugccagccgguguccaccgcugaaugucaggccuggggagauccucauuaugucacgcuggacggacaccgcuuugauuuccaaggaaccugcgaguaccuucugagcgcgcccugucaugggccuccccucggagcugaaaacuuuacagugaccguugccaaugagcaccggggcucccaggccgugucuuauacaagaagcgucacccugcagaucuacaaccacucccucacacugucugcucgcuggccgcggaaacuucagguggacgggguuuucguggcccugcccuuucaacuggauagccuccugcaugcucaccuuuccggagccgacgucguggugaccacgacaucuggccugagccucgcguucgacggcgauuccuuuguuagacugcgggucccugccgcuuaugccgcuagccucugcgggcuguguggaaacuacaaucaggaccccgccgaugaccugaaggcggugggcgggaaaccugccggauggcaagugggcggggcucaaggaugcggcgagugugucucuaagcccugcccuuccccgugcacccccgaacagcaggagagcuucggcgggccugaugccuguggagugauuucugcuaccgacggcccccuugccccuugccaugggcugguucccccggcccaguauuuucaaggaugucuccuggaugcuugccaggugcagggccacccugggggacuuugucccgccgucgcgacauacguggcugccugccaggccgcuggcgcccaacugggcgaauggagacgcccugacuucuguccccuccagugcccugcgcauucccacuacgagcuguguggggauagcugccccguuucuuguccgucccucagcgcucccgaaggaugcgagucugccugccgggagggcugugugugcgacgccggguuuguccuguccggagauaccugugugccuguuggccagugcgggugucugcacgacggaagauauuacccccuuggcgaaguguucuauccuggccccgagugcgaacgcagaugugagugcgggccuggaggccaugucacaugucaggagggggcugccugcggaccgcacgaagagugucggcuggaagauggcgugcaggcuugccaugccacggggugcggccgcugucucgcgaacggaggcauccacuacaucacccuggacgggagaguguaugaccuucacggaagcugcuccuacguccuggcccagguuugucaucccaaaccuggcgaugaggacuuuagcauugugcucgaaaagaaugcugccggggaucugcagcggcugcucgugacagucgcuggacaagugguuucucuggcccagggccaacaggugaccgucgacggggaggcgguggcccuucccguugcugugggccgcgucagagugacagccgagggacggaacauggugcugcaaaccacgaagggccuccgccugcuuuucgauggggacgcucaucugcucaugagcaucccuucccccuucagaggacggcugugcggccugugugggaauuuuaacggaaauuggucugaugacuucguccucccgaacggcagcgccgccuccucuguugaaaccuuuggggcugccuggcgcgcgccuggcagcuccaaaggaugcggcgagggguguggaccccagggcugcccugugugucuggcugaagagacagcccccuaugaaagcaaugaggccugcgggcagcuuagaaacccgcagggacccuucgcuaccugucaagccgugcugucuccuuccgaguacuuucggcagugcgucuacgaucucugcgcgcagaagggcgacaaggcuuuccugugucgcagccuugccgccuauacagcugccugccaggcugccgggguugcggugaagcccuggagaaccgauucuuuuuguccucugcacugccccgcccacucccauuacagcauuuguacgcggacaugccaaggcucuugugcugcccucuccggacugaccggcugcacaaccagauguuucgaagggugcgagugugacgaucgcuuucugcucagccagggagugugcaucccuguccaggacuguggcugcacccacaaugggcgguaucugccggugaacuccucucuucugacaagcgacugcuccgaaagauguagcuguucuuccagcucuggacucacgugucaggcugccggcugucccccuggccgcguuugugaggugaaagcggaagcccggaauugcugggcuaccagagggcuguguguccuuagcgugggagccaaccugacaaccuucgauggcgcucgcggggccacaaccucccccggaguuuacgagcucucuagccggugcccuggccugcaaaauacgauucccugguauagaguggucgccgaggugcagaucugucacgggaagacagaagcugucggacaggugcauaucuuuuuccaagacggcaugguuacccugaccccuaacaagggcgugugggucaacgggcuccgcguggaucugccggccgagaaacuugcguccgugagcguuucucggacacccgacggaucccugcucgucagacagaaggcuggcguccagguguggcugggggccaauggaaaaguugccgucaucgugagcaacgaucacgcuggcaaacuuugcggggccuguggaaauuucgacggcgaucagaccaacgacuggcaugauucucaagaaaaaccugcgauggagaaguggcgggcucaggacuuuucccccugcuacggcuga

SEQ ID NO: 69244 - RNA, 954 nt, Artificial Sequence
  derived and/or modified sequence opt5 from FCGR2A__Homo_sapiens__NP_001129691
augaccauggagacacagaugagccaaaacgugugccccagaaaucuguggcuccugcagccucuuacgguccugcuccugcuugccuccgcugacucucaggccgcggcuccgcccaaggccguucugaaacucgaaccucccuggaucaacgugcugcaggaggauagcgugacccugacaugucaaggcgcccgguccccugaaucugacagcauucagugguuccacaaugggaaccucauccccacccauacacagccuuccuaccgcuuuaaggcuaauaacaaugauucuggagaguauaccugccagacaggccaaaccagccuguccgacccgguccaccuuacggugcugagcgaauggcucguucugcagacaccccaucuugaguuccaggagggggaaaccauuaugcugagaugucacucuuggaaagauaagccucucgugaaagucaccuuuuuccagaacggaaagucccaaaaguuuagccaucuggaccccacauucucuaucccucaggccaaucacucccacagcggcgauuaccauugcaccgggaacauuggauauacgcuguuuucuuccaaacccgugacaaucaccguucaggugccgagcaugggcuccucuagcccuaugggcaucauugucgcuguggugaucgccacagcggucgccgcuauuguugccgcugugguggcccucaucuacugucggaagaaacgcauuuccgcgaauagcaccgaccccgucaaggccgcucaauucgagccucccgggagacagaugaucgccauucggaaacgccagcuggaagagaccaacaaugauuaugagacagcugacggaggcuacaugacgcuuaaccccagagccccuaccgaugacgauaagaauaucuaucugacacucccgcccaacgaccacgugaacucuaauaacuga

SEQ ID NO: 69245 - RNA, 873 nt, Artificial Sequence
  derived and/or modified sequence opt5 from FCGR2B__Homo_sapiens__NP_001002273
augggcauccugagcuuccuccccgugcuggccaccgaguccgacugggcugauugcaagucuccucagccgugggggcacaugcuucuguggacagccguccucuuucuggcgcccguugcuggaacgccugcucccccuaaagccgugcuuaagcuggaaccccaauggauuaacgugcuccaggaggacagcgucacccugacauguagaggcacccauuccccugaaucugauagcauccagugguuccacaaugggaaccugauuccgacacauacccagcccuccuaccgguuuaaagccaauaacaaugacucuggagaguauacaugccaaaccggccagacgagccucuccgauccugugcaccugaccguucuuagcgaauggcuggugcuccagacaccccaucuggaguuccaggagggggaaaccaucguccuucgcugucacucuuggaaggacaaaccucuggugaagguuacauuuuuccaaaacggaaaguccaaaaaguuuagcagaucugaucccaauuucuccauuccgcaggccaaccacagccauucuggcgacuaccacugcaccggcaauaucggguauacgcucuacuccagcaaaccugugacaaucaccguccaggcucccuccucuagcccuaugggaauuaucguggccguggucacaggcauugcgguugccgcuaucguggccgcuguggucgcccugauuuauugucggaagaaacgcaucuccgcgaaccccaccaaucccgaugaggccgacaaggugggggcugaaaacaccauuacauacagccugcucaugcauccugaugcccuggaggagccggacgaucagaauagaaucuga

SEQ ID NO: 69246 - RNA, 873 nt, Artificial Sequence
  derived and/or modified sequence opt5 from FCGR3A__Homo_sapiens__NP_000560
augggcgggggagccggcgagagacuguucaccagcuccugccucguggggcuggucccccuuggacugcggaucucucucguuacauguccucugcagugcggcauuauguggcaacuucugcucccgacggcucugcugcuccuggugagcgccgggaugcgcaccgaagaccuucccaaggcgguggucuuucuggagccucagugguacagagugcucgaaaaagauuccguuacacugaagugucagggagcuuauucucccgaggacaacagcacccagugguuccacaaugaaucccuuaucucuagccaagccuccagcuacuuuauugaugccgcuacaguggacgauucuggcgaguaucggugccagaccaaccuguccacacucagcgacccuguccagcuggaggugcauaucggcuggcugcuccugcaggcuccccgcuggguuuucaaagaagaggauccuauucaccuuagaugucauucuuggaagaauaccgcccugcacaaagugacguaccuccaaaacgggaagggacggaaguauuuucaucacaauuccgacuucuacaucccgaaagccacccugaaggauagcggcucuuauuuuugccgcgggcuuuucggauccaaaaacgucagcuccgaaacagugaauaucaccauuacacagggccuggcggugucuaccaucagcuccuuuuucccucccggguaccaggucagcuuuugucucguuauggugcugcuguucgccguggacacgggacucuacuuuucugucaagacaaacauuagauccagcacccgggauuggaaagaccacaaguucaaguggcgcaaagauccccaggacaaguga

SEQ ID NO: 69247 - RNA, 702 nt, Artificial Sequence
  derived and/or modified sequence opt5 from FCGR3B__Homo_sapiens__NP_000561
auguggcagcugcuccugcccaccgcccuucugcuccuggugagcgcuggcaugagaacagaggaccuuccuaaggccgucguuuuccuggaaccgcaaugguacuccgugcucgagaaagauucugugacgcugaagugccagggggcguauagccccgaagacaacuccacccagugguuucacaaugagaaccugaucucuagccaggcuuccucuuacuucauugaugccgccacagucaaugacagcggagaauaucggugucaaaccaaccucuccacacugagcgauccugugcagcuugagguucauaucggcuggcugcuccugcaggcuccccgcuggguguuuaaagaggaagacccuauucaccuuagaugccauucuuggaagaauaccgcccugcacaaagucacauaccuccagaacgggaaggaucggaaguauuuccaucacaauuccgacuuucacauccccaaagcuacccugaaggauagcggaucuuacuucugucgcggccuggugggguccaaaaacguuagcucugagacggugaauauuaccaucacacaaggacucgccgucuccaccaucagcuccuuuucuccuccgggcuaucaggugagcuucugccuggugaugguccuucuguuugcgguugacacaggccucuacuucuccgugaagaccaacauuuga

SEQ ID NO: 69248 - RNA, 1098 nt, Artificial Sequence
  derived and/or modified sequence opt5 from FCGRT__Homo_sapiens__NP_001129491
augggcgugcccagaccucagccgugggcccuggggcuccugcuuuuccugcuccccggaagccugggcgcugagucccaccuuucucugcucuaccaucugaccgccgucagcuccccugcgcccgggacgccugcuuuuuggguuucuggauggcugggcccccaacaguaucucagcuacaacucccugcgcggggaagccgagccuugcggagccugggugugggaaaaucaggugucuugguauugggagaaggaaacaaccgaccuucggaucaaagagaagcuguuccucgaggcuuuuaaagcccugggcggcaaggggccguacacacuucagggacugcucggcugugaacuggggcccgauaacaccagcgucccuacagcuaaauucgcccugaauggagaggaauuuaugaacuucgaccucaagcaaggcaccuggggaggggauuggcccgaggcgcuggccauuucccagagauggcagcagcaagacaaggcugccaauaaagagcuuacauuucuccuguucagcugcccucaccggcugcgcgaacaucuugagagaggccggggcaaccuggaauggaaggagcccccgucuaugcgccucaaagcuagaccuuccagccccggguuuucugugcugaccuguuccgccuucagcuuuuauccucccgaacugcagcuccgguuccugcgcaauggacuugcggccggcacggggcagggagauuuuggccccaacucugacggguccuuccacgcuagcuccucucugaccguuaagagcggagaugagcaucacuacugcuguaucgugcagcacgccggccucgcucaaccucugagagucgagcuugaauccccggccaaaagcucugugcugguugugggcauugucaucggggugcuccugcugacagccgcugcggugggaggcgcccuccuguggcggcgcaugagauccgggcuucccgcuccuuggauuagccugcggggagacgauaccggcguccuccugcccacaccuggggaggcccaggacgccgaucugaaggacguuaaugugauccccgcuaccgccuga

SEQ ID NO: 69249 - RNA, 2676 nt, Artificial Sequence
  derived and/or modified sequence opt5 from FCHO1__Homo_sapiens__NP_001154829
augagcuacuucggcgagcacuuuuggggagaaaagaaccauggauucgaggugcuguaucacuccgucaaacagggccccaucucuaccaaggaacucgccgacuuuauuagagagcgggcuacaaucgaagagacguacagcaaagccauggcgaagcuguccaaacuugcuucuaaugggacccccaugggaacauucgccccgcugugggagguuuuucgcgugagcuccgauaagcucgcccugugccaucuugaacugaccagaaagcuccaagaccugauuaaagaugugcugcgguauggcgaggaacagcucaagacacacaaaaaguguaaagaggaggucgugucuacccuggacgcuguucaggugcuuagcggggucucccagcugcuccccaagagccgcgaaaacuaccugaauagaugcauggaucaagagcggcuucgcagagaaucuacaucccagaaggagauggacaaagccgaaaccaagacgaaaaaggcugccgagagccugcggcgcucuguggagaaauauaacuccgcgagagccgauuucgaacagaagaugcucgacagcgcucugcgguuucaggccauggaggaaacccaucugcgccacaugaaagcucuccugggaucuuacgcccacuccguugaggauacacaugugcaaaucggccagguccacgaagaguucaagcagaauauugagaacgugagcguggaaaugcuucugagaaaguuugcggaguccaaaggcaccgggcgggaaaagccuggaccccucgacuucgaggccuauucugcugccgcucugcaggaagccaugaaacgccuuagaggcgccaaggcuuuucggcugccugggcucagcagacgcgagcgggagcccgaaccuccggcggccgucgauuuccuggagcccgacuccggaacauguccugaaguugaugaggagggcuuuaccgugagacccgacgugacgcaaaauagcacagcugaaccuucucgcuucuccagcucugacagcgauuucgacgaugaggaaccccggaaauuuuacguccauaucaagccggccccugccagagcucccgccugcuccccugaggcggcugccgcccagcugcgcgcuaccgccgggucucucauccugccgcccggaccuggcggcacaaugaagcggcacagcuccagagacgcugccgggaaaccgcagcgcccccggagcgcgccuagaaccucuuccugugccgaacgccuucaaagcgaggaacaggugucuaagaaccuguucggacccccucucgaguccgcuuuugaucacgaggacuucaccggcagcuccucucugggguuuacaagcucccccucuccguucagcuccagcucuccugaaaauguugaggauuccggacuugacagccccucucaugccgcuccuggccccuccccugauagcugggugccccggccggggacgccucagucuccgcccagcugcagagccccuccgcccgaagcgcgggggauucgcgccccuccccugccugacagcccccagccucucgcuuccucucccggcccguggggccuggaggcccuggcugggggagaucucaugccugcccccgccgacccuaccgcuagagagggccuggcggccccuccccggagacuucgcucccggaaagucagcuguccccugacaagauccaacggggaccucucucgcagccugucccccucuccucugggaagcuccgcugccucuaccgcccuugaaagacccagcuuucucucccaaacaggccacggggugagccggggccccucuccuguugugcugggaucccaggaugcucugccgaucgccaccgcguucacggaguacguccaugcuuauuuucgcggccacagccccucuugccucgccagagugacaggggaacugaccaugaccuucccugccggaauuguccggguguuuuccggcacacccccucccccuguucuuagcuuccgccuggugcauaccacagcuaucgagcacuuucagccgaaugccgaccuccuguucucugaucccucccagagcgacccugaaacgaaggauuucuggcugaacauggcggcucuuaccgaggcccuccaaagacaggccgagcagaaucccacagcuuccuacuauaacgucgugcugcugcgguaccaguuuagccgcccugggccccaaucuguuccgcuccagcugagcgcccacuggcaguguggagcuacccuuacacagguguccgucgaauauggcuacagaccuggggccaccgcggugcccacgccccugaccaaugugcaaauucuccugccuguuggcgagcccgucacaaacgugcggcugcagccugccgcuaccuggaaccuugaagagaaacgccucacauggagacugccggacgugucugaggccggaggcagcgggcggcuguccgcuucuugggaaccccucagcggaccuuccacccccucuccugucgccgcccaguucacgagcgagggcacaacccuguccgggguggaucuugaacugguuggaagcggcuauagaaugucucucgugaagcgccgguuugcuacagcggccccuccccaagggugcaccugguga

SEQ ID NO: 69250 - RNA, 2334 nt, Artificial Sequence
  derived and/or modified sequence opt5 from FCHO2__Homo_sapiens__NP_001139504
auggugauggccuacuucgucgagaacuuuuggggcgaaaagaauagcggguucgacguucuguaucacaacaugaaacauggacagaucuccaccaaggagcucgcugauuuugugagagaacgggccacaauugaggaagcguacucucgcagcaugacgaaacuggcuaaguccgccucuaauuauagccaacuuggcaccuucgcccccgugugggacgucuuuaaaacauccaccgagaagcuggcuaacugccaccucgaucuggugagaaaacuucaggagcugaucaaggaaguucagaaguacggggaggaacaggugaaaucucauaagaaaacaaaggaggaggucgccggaacccucgaagcugugcaaacaauucagagcaucacccaggcccugcagaaguccaaagagaauuauaacgcgaaguguguugaacaagagcggcugaaaaaggaaggcgccacgcagcgcgagauugagaaagcugccgucaagagcaaaaaggcuaccgacacauacaagcucuauguggaaaaauacgcccuggcgaaggccgauuucgagcagaaaaugaccgaaacagcucaggugcacgaggaauuuaucaauaacauggccaauaccacgguggagucucuuauccaaaaguucgcugaguccaaagggacaggaaaggaaagaccuggccugauugaguuugaagagugcgacaccgccagcgccgucgaaggcaucaagccgcggaaacgcaagacauucgcucuccccgggauuaucaaaaaggagaaagaugcggagucuguugaauguccugacgccgauucccugaacauucccgacguggaugaggaaggauacagcaucaagccugagaccaaucagaacgacaccaaggagaaucauuuuuauucuuccagcgauuccgacucugaagacgaggaacccaaaaaguacagaauugagaucaaaccuaugcacccgaacaauagccaccauacaauggcuucccuugaugaacugaaggugagcaucggcaacauuacgcucucucccgccaucucccggcacagcccuguccagaugaaccgcaaucugucuaacgaggagcugaccaaaagcaagcccuccgccccucccaaugaaaaggggacaucugaccuccuggcuugggauccgcuuuucggaccuagccuggacuccagcagcuccagcucucucaccuccagcuccucugccagacccacaaccccucugagcgugggcacgauuguucccccuccccggccggcgucccgccccaaacuuacaucugggaagcugagcggaaucaacgagauuccuagacccuuuuccccucccgugaccagcaauaccucuccgccucccgcugccccucucgcccgggcugaauccucuucuuccaucagcucuagcgccucccugagcgcugccaacacacccaccgucggcgugucucgcggcccuucccccguuagccuggggaaucaagauacacucccgguggcggucgcccugacggaguccgugaacgcuuauuucaaaggagccgacccuaccaagugcaucgucaaaauuacaggcgauaugaccaugucuuuccccagcgggaucauuaagguguuuacauccaaucccaccccugcuguucuuuguuucagagugaaaaacaucucucggcuggaacagauucucccgaaugcccagcuggucuuuagcgaccccucccagugcgauucuaacacgaaggacuucuggaugaauaugcaagcggugaccguuuaccuuaagaaacugagcgagcagaacccugccgcuuccuauuacaauguggauguccucaaguaucaggugagcucuaacggaauccaguccacaccccugaaccuggccaccuacuggaaauguagcgcuucuacaaccgaccucagaguggacuacaaguauaauccugaggccaugguugcccccuccguccugagcaacauccaagugguggucccuguggauggcgggguuacgaauaugcagucucuucccccggcuauuuggaacgcggaacagaugaaagccuuuuggaagcuguccagcaucuccgaaaagagcgagaauggaggcucuggcagccuccgcgcuaaauucgaccuguccgaggggccuucuaagcccacaacccuggccgugcaguuucuuagcgaaggauccacacucucuggcgucgauuucgagcugguggggaccggauaccggcugagccucauuaaaaagagauuugccaccggccgcuaucuggcugacugcuga

SEQ ID NO: 69251 - RNA, 2223 nt, Artificial Sequence
  derived and/or modified sequence opt5 from FCHSD2__Homo_sapiens__NP_055639
augcagcccccuccgagaaaggugaaagucacccaagagcugaagaacauccagguugaacagaugacaaaacuccaggccaagcaccaagcugagugcgaccugcuugaagauaugcggacguucagccagaaaaaggccgcgauugagcgcgaauacgcucagggcaugcagaagcuggccucccaauaucucaaaagagacuggcccggggugaaggccgaugaccggaaugauuaccgcucuauguauccuguguggaaaucuuuucuggagggaaccaugcaggucgcucaguccagaaugaacaucugugagaauuacaagaacuucauuucugaacccgcccggacagugcgcagccuuaaagagcagcaacugaagagaugcguugaccagcucaccaagauccagacagaacugcaagagaccgugaaagaucuggcuaagggcaaaaagaaauauuuugagacagaacagauggcccaugcgguccgggagaaggccgacauugaagcuaaauccaagcucucucuguuccagagccgcaucucccuucagaaggccagcgugaaacugaaggcuagacggucugaguguaauuccaaagccacccacgcgcgcaacgauuaccuccugacgcuugccgcugccaaugcucaucaagacagauauuaccagaccgaucugguuaacaucaugaaggcccucgacgggaauguguacgaucaccugaaagacuaucugauugccuuuagccggacagaacucgagaccugccaggcuguccagaacacauuccaauuucugcuugagaauagcuccaagguggugcgcgacuacaaccugcaacucuuccugcaggaaaaugcggucuuucauaagccucagcccuuccaguuucagccuugugauagcgacaccucuagacagcuugaguccgaaacgggaacaaccgaggaacacagccugaacaaagaggcccggaagugggcuacaagaguugcccgcgagcacaaaaauaucgugcaucagcaacgggugcucaacgaucuggaaugccacggcgccgcugucuccgagcagucuagagccgaacuggagcagaagauugacgaagcgcgcgagaacauccggaaagcugagauuaucaagcucaaggccgaagccagacuggaucuucugaaacaaauuggggugagcguugacaccuggcucaaguccgcuaugaaucaggugauggaggaacuggagaacgagcgcugggcccggccgcccgcugucaccagcaauggaacacuucauucucugaacgccgauacggaaagagaggaaggcgaggaguucgaggacaauauggauguguuugacgauuccagcucuagcccuuccggcacccuccgcaacuauccccugacauguaaaguuguguacucuuauaaggcgagccagccugacgagcugaccaucgaagaacacgaaguccucgaggugaucgaagacggggauauggaggacugggucaaagcccggaauaaggugggacagguuggcuacgugcccgagaaguaucugcaauucccgacauccaacagccuucugucuaugcuccagucccuggcugcccuggauagcagaucucacaccuccagcaauuccacggaagcugagcuugucucugggagccucaacggagacgccuccgugugcuucguuaaagcgcuguacgauuacgaaggccagacagacgaugagcugucuuuuccugaaggggccauuauccgcauucucaauaaggagaaccaggacgaugacggauucugggagggcgaauuuaauggccggaucgggguguuccccagcguccugguggaggaacuuuccgcuagcgagaacggagauaccccuuggaugagagagauucaaaucucucccucccccaaaccucaugccagccugccgccccucccucuguaugaccagcccccuucuucccccuacccgagcccugauaagcggucuagccuguauuuuccccgcuccccuagcgcuaaugaaaaaucucuucacgccgagucccccggcuucagccaggccuccagacauaccccugaaacaucuuacgggaagcuccggcccgugagagcugcgccgccuccucccacccagaaccaccgccggcccgccgagaaaaucgaagacguugagauuacacuggucuga

SEQ ID NO: 69252 - RNA, 981 nt, Artificial Sequence
  derived and/or modified sequence opt5 from FCN1__Homo_sapiens__NP_001994
auggagcugagcggcgccaccauggcuagagggcucgccgugcugcuuguccuguuccuccacaucaagaaccugcccgcgcaggcugccgacacaugcccugaaguuaaaguggugggacuugagggcuccgauaagcugacgauucuccggggguguccgggacugcccggcgccccugggcccaaaggagaagcuggcgucaucggcgagcgcggggaaagaggacugccuggcgcccccgggaaggcuggaccugugggcccgaaaggggaccggggagagaagggcaugcgcggcgagaagggggaugccggacaaucucagagcugcgcgaccggccccagaaauuguaaagaccuccuggaucggggguacuuucuuuccggauggcauacaauuuaucugccugacugccgcccccucaccguucugugugauauggacacagauggcgggggauggaccguguuccagagacggauggacggcucugucgauuuuuaccgcgacugggccgcuuauaagcagggcuucgggagccaacuuggagaauuuuggcugggcaacgauaauauccacgcccucacagcucagggguccucugagcugagaguggaccugguugacuucgaaggaaaccaucaguuugccaaauacaagagcuucaaaguggcggaugaggccgagaaguauaagcucguccugggcgcuuuugucgggggcuccgccggaaauagccuuaccggccacaacaauaacuucuuuucuacgaaagaccaggauaaugacguguccagcucuaacugcgcugaaaaguuccaaggggccuggugguacgccgauugucaugcuuccaaucugaacggacucuaucugaugggcccucacgagagcuacgcgaaugggauuaacuggucugccgcuaaaggauacaaguauuccuacaaagugagcgaaaugaagguucggcccgccuga

SEQ ID NO: 69253 - RNA, 942 nt, Artificial Sequence
  derived and/or modified sequence opt5 from FCN2__Homo_sapiens__NP_004099
auggagcuggacagagccgugggcguccucggggcugccacccugcuucugagcuuccucggaauggcgugggcucugcaggccgccgauacaugccccgaaguuaagauggugggccuugagggguccgacaaacugacgauccuccggggauguccuggccugccgggggcucccggaccuaagggcgaagccggcaccaacgggaaacgcggagagagaggcccucccgggcccccuggaaaggcuggcccgcccgggccuaauggagcccccggcgaaccucaacccugccugacaggcccgcggaccuguaaagaucuccuggaccgcgggcacuuucuuucuggauggcauacaauuuaccugccugauugcagaccccucaccgugcugugugacauggauacagacggcgggggauggaccgucuuccagcggcgcguggauggcagcguugacuuuuauagagauugggcgacguacaagcagggguucggaucccggcuuggcgaguuuuggcugggcaacgacaauauccacgcccucaccgcucaggggacaucugagcugcgcguggaucuggucgacuucgaagacaacuaucaauuugccaaguaccggagcuucaaaguggcugaugaggccgaaaaguauaaucucguucugggagcguuuguggagggcuccgccggggacucucuuaccuuccauaacaaucagagcuuuuccacaaaagaucaggacaacgaucugaauaccggaaacugcgcugucauguuccagggcgccuggugguacaagaauugucacgugagcaaccucaaugggagauaucugcgcggcacgcauggaucuuuugcuaacggcauuaauuggaaauccgggaagggauacaacuacagcuauaaggugucugagaugaaagucagaccugccuga

SEQ ID NO: 69254 - RNA, 1101 nt, Artificial Sequence
  derived and/or modified sequence opt5 from FCRL1__Homo_sapiens__NP_001152869
augcugcccagacuccugcuucugaucugcgccccucucugugagccggcugaacuguuccuuauugccagccccucccacccuaccgagggcucucccgugacacugacgugcaagaugccuuuucuccagagcuccgacgcgcaauuccaguuuuguuucuuucgggauacccgcgcucuggggcccggauggucuagcuccccuaaacugcagaucgccgccauguggaaggaagacacaggcucuuacuggugcgaggcucagaccauggccagcaaaguccucagaucccggcgcagccaaauuaacguucauagagugccgguggcugaugucucucuggaaacacagcccccugggggacaggugauggagggcgaccggcuuguucugaucuguuccguggccauggggaccggagauauuacauuccucugguauaagggcgcggucggccugaaucuucagagcaaaacccaacgcucucugacggccgaguacgaaauccccuccgugagagagagcgacgcugaacaguauuacugcguugccgagaacggguauggaccuucucccuccggccucgugagcaucaccguccggauuccggugucccgcccuauccugaugcugagagcuccccgggcccaggcggccguggaggauguccucgaacugcacugugaggcccuucgcgggucuccucccauucuguacugguuuuaucaugaagacaucacacucggaagcagauccgcucccagcggcgggggagcuucuuucaaucugucccuuaccgaggaacacagcggcaacuacucuugcgaggccaauaacggccugggggcccagcggagcgaggcuguuacacucaauuuuaccggacgcagauccgcgcgggauccucugagaucucugccgagcccccucccucaagaguucacguaccugaacucccccacaccuggccagcuucagcccauuuaugaaaaugaaccgcgcgagcaaagcguggccgugcaugggcggcagcagcacucuuccgaacagaaggcucaaaagccuuggggacacaucuggagaacccgcuuucccuga

SEQ ID NO: 69255 - RNA, 1335 nt, Artificial Sequence
  derived and/or modified sequence opt5 from FCRL2__Homo_sapiens__NP_001152960
augcugcucuggagccugcuugugaucuucgacgccgucaccgagcaggcugauucccugacacucguugcccccucuagcguguuugaaggcgacuccauugugcugaagugccaaggggagcagaacuggaaaauccagaagauggcguaccacaaagauaauaaggaacuuucugucuucaaaaaguuuagcgacuuccugauucaguccgcugugcucucugauagcggaaacuauuuuuguuccacgaagggccaacuguuccugugggacaaaaccagcaauaucguuaagauuaaagugcaggagcucuuucagagaccuguccugacagccucuuccuuccagccgaucgaagggggacccgugagccuuaagugcgagacccggcugucuccucaacgccucgauguucagcugcaguuuuguuucuuuagagagaaccaggugcuuggcuccggguggucuagcucccccgaacugcaaaucagcgccgucugguccgaggacacaggaucuuacuggugcaaagcugaaaccgugacacaucggauucgcaagcagagccuccagucccaaauccacgugcagcggauuccuaucagcaaugucucucuggagauuagagcccccggcggccagguuaccgaggggcagaagcugauccuccuguguuccguggcuggaggcacggggaacgugaccuucagcugguaucgcgaagccacaggaaccucuaugggcaaaaagacacaaagaagccuuuccgcggagcuggaaauuccugccgucaaagagucugaugcugggaaguacuauugccgggccgacaauggacaugugccgauccagagcaaaguugugaacauccccguccgcauuccuguguccagacccguucucacccugcggagcccuggcgcucaggccgcggugggcgaucuucuggaacuccacugugaggcccugcgcgggucucccccgauccuguaccaguuuuaucaugaggacgucacgcucggaaauuccagcgcuccuucuggcgggggagccuccuucaaccugagccuuacagcugaacacuccggcaauuacucuugcgaggccaacaaugggcugggagcccaauguagcgaagcugugcccgucuccauuucuggcccugauggcuacagacgggaccucaugaccgcgggggugcuguggggacuuuucggcguucugggguuuacaggaguggcccuccugcuguaugcucucuuccacaagaucagcggcgaguccagcgccaccaacgaaccccgcacccccaaaucuuccacacugcuuuga

SEQ ID NO: 69256 - RNA, 2205 nt, Artificial Sequence
  derived and/or modified sequence opt5 from FCRL3__Homo_sapiens__XP_006711208
augcugcucuggcugcuucugcucauccugacccccggcagagagcagagcgggguggccccuaaggcuguccuucugcucaacccgcccugguccacagccuucaaaggagaaaagguugcgcugauuugcucuagcaucucccacucucuggcucaaggcgacacguacugguaucaugaugagaaacuccugaagauuaaacacgacaagauccagauuaccgaaccugggaauuaccaguguaagacacggggaagcucccuuucugaugccgugcauguggaguuuagccccgacuggcugauccuccaggcccugcacccugucuucgaaggcgauaacgugauccuucgcugccaagggaaagacaauaagaacacccaucagaaaguuuauuacaaggauggaaaacagcugcccaauuccuauaaccucgagaagauuacagugaauagcgucucuagagacaacuccaaguaccacuguaccgcuuaucggaaauuuuacauccuggauauugaggugacaagcaagccucugaauauccagguucaagaacucuuccugcacccggugcuucgcgccucuuccagcacccccauugagggcucuccuaugacgcugaccugcgaaacacagcucagcccccagagaccugacguccagcugcaauuuucccuuuuccgggauucccagacccugggccucggguggucucgcagccccagacugcagaucccggcuauguggacagaggacuccggaagcuacuggugugagguggaaaccgugacgcauucuauuaaaaagcggucccugcgcagccaaaucagaguccagcggguuccugugucuaacgugaaucucgagauccgccccacaggcgggcagcugauugaaggagagaacaugguccuuaucugcagcguggcccagggcuccgggaccguuacauuuucuuggcacaaagaaggaagagugcggagccugggccgcaagacccaaagaucccuccuggcggagcuucauguccugaccgugaaagagagcgaugccggccgguauuacugugcugccgacaauguucacucuccuauucucuccacauggaucagagugacgguccgcauucccgugagccaccccguccugaccuuccgggcuccuagagcccauacagugguuggggaccugcucgaacugcacugcgagucucuucgcggauccccgcccauccuguaucgguuuuaccaugaagaugugacccucggcaacagcuccgcgccuucugggggaggcgccagcuucaaucugucccugacagcugagcacucugggaacuauagcugugacgccgauaacggacuuggcgcucagcauucccacggcgucagccucagagugaccguucccgugucucgcccuguccugacgcugcgggcccccggggcccaggcuguggugggagaccuccuggaacuucacugcgagucccugagaggcagcuuuccgauccucuacugguucuaucaugaggaugacacacuggggaauauuucugcgcacuccggaggcggggccagcuuuaaccugucucuuaccaccgaacauagcggcaauuacuccugugaggcugauaacggacucggcgcccagcacagcaagguugucacacugaaugugaccgggacaucucgcaaccggacgggacugaccgccgcuggcaucacagggcucgugcuguccauucuuguccuggccgcggcugccgcccuccugcacuacgcuagagcccgccggaagccuggaggccugagcgcuaccgggacauccucucauagccccuccgaaugccaagagccuucuagcuccagacccucucggaucgacccucaggaacccacccacagcaaaccgcuugccccuauggagcucgagcccauguauuccaaugugaaccccggcgauagcaauccuauuuacucucagaucugguccauccagcauacgaaggaaaacagcgcgaauugcccgaugaugcaccaagagcaugaggaacugaccguucuguauucugagcucaaaaagacacaccccgacgauuccgccggagaagcuagcucucgcggcagagcccacgaggaagacgacgaggaaaacuacgagaaugugccucggguccugcuugcuuccgaucauuga

SEQ ID NO: 69257 - RNA, 1548 nt, Artificial Sequence
  derived and/or modified sequence opt5 from FCRL4__Homo_sapiens__NP_112572
augcugcucugggccagccugcuugcuuucgcccccgugugcggccaguccgcggcugcccacaagccugucaucucuguucauccgcccuggaccacauuuuucaaaggggagagagugacgcugaccuguaacggauuucaauucuacgccacagaaaagaccacaugguaucaccggcauuacuggggcgagaaacucacccugacaccugggaauacccuugaagugcgcgagagcggacuguauagaugccaggcucggggcucuccccgcuccaacccugucagacuccuguuuagcuccgacucucugauucuccaggcccccuacagcguguucgaaggggauacgcugguucuucggugucaccgcagacggaaggagaaacugaccgcugugaaguauacauggaauggaaacauccucuccauuagcaauaagucuugggaccugcuuaucccucaggccuccagcaacaauaacggcaauuaccgcugcauuggcuauggggaugagaacgacgucuuuagaucuaauuucaaaaucaucaagauucaagaacuguuuccgcaucccgagcucaaagcgaccgauucccagccuacagaaggaaacagcgugaaucugucuugugagacccagcugcccccugagcgguccgacacgccccuccacuucaacuuuuuccgcgauggcgaaguuauccugagcgacugguccacauacccggagcuucagcugccuaccguguggagagaaaauucugggagcuacuggugcggagccgagacaguccggggcaacauucacaagcauucccccagccuccaaauccacgugcagcgcauuccugugucugggguccugcuugaaacccagcccuccggaggccaggcuguugagggcgagaugcuggugcucguguguagcgucgccgaagggaccggagauacaacguuuucuuggcauagagaggacaugcaagaaagccugggccggaaaacccagagaucccugcgcgcugagcucgaacugcccgccauccggcagucucacgccgggggauauuacugcacagcggauaacagcuauggcccugugcaauccaugguucuuaaugugaccgucagagagacaccggggaaccgcgacggacugguggcugccggcgcuaccggcgggcuccugagcgcccuucugcucgccguugcucugcuguuccacuguuggcggagacgcaagucuggagugggcuuccucggggaugagacgcggcugcccccugcgcccggaccuggcgaauccagccauucuauuugccccgcccaggucgagcuucagucccuguacguggacguccacccgaagaaaggggaccucguguauagcgaaauccagacaacccaacugggcgaggaagaggaggcuaauaccuccagaacacugcuugaagauaaggacguuucuguggucuacagcgaggugaaaacccagcauccugauaacuccgccggaaagaucucuagcaaagacgaagaguccuga

SEQ ID NO: 69258 - RNA, 2934 nt, Artificial Sequence
  derived and/or modified sequence opt5 from FCRL5__Homo_sapiens__NP_112571
augcugcucugggugauccugcuuguccuggcccccguuagcggccaguucgcuagaaccccucggccgauuaucuuucuccaacccccuuggacaacgguguuccagggggagcgcgugacccugacaugcaagggauuuagauucuacucuccccagaaaaccaagugguaucaccgguaccuuggcaaagaaauucugcgcgagacaccugacaacauccucgaaguccaggaguccggggaauauagaugucaagcccagggaagcccccuguccucuccugugcaucuggauuuuagcuccgcgucucucauucugcaggcuccgcuuagcguuuucgagggcgacuccgugguccugcggugccgcgccaaggccgaggugacccucaauaacacaaucuacaaaaaugauaacguucuggcuuuucuuaauaagagaaccgacuuccacaucccccaugccugucugaaggauaacggggcuuaucggugcacgggauacaaagaaagcuguugcccugugucuuccaauaccgucaagauucaggugcaagagcccuuuacacgcccugugcucagagccagcucuuuccagcccaucuccggcaacccggucacccugacaugugaaacccagcugagccucgagcggucugacguuccucugcgcuuuagauucuuucgggaugaccagacgcuuggccugggguggucccucagccccaauuuccaaauuacagcgaugugguccaaagauucuggauucuauuggugcaaggccgcuaccaugccuuacagcgugaucuccgacagcccccgcucuuggauucaggugcagauccccgccucccacccuguccugacacuuagcccggagaaagcucugaacuuugaaggcaccaaggugacccuccauugugagacacaagaagauucucugagaacgcuguaccgguucuaucacgaggggguuccccucagacacaagagcgugcgcugcgaacggggagccuccauuucuuuuagccugaccacagaaaauuccggcaacuacuauuguaccgcggacaaugggcuuggagccaaaccuagcaaggcugucucucuguccgugacaguucccgugagccauccuguccucaaccugucuucccccgaggaucuuaucuucgaaggcgccaaagugacccugcacugcgaggcucagagaggcagccucccgauccuguaccaguuucaucacgaaggggccgcccuggagcgccgguccgcuaauucugcgggaggcgucgccauuagcuucucccucacggcugaacacucugggaacuauuacugcacagccgacaacggauuuggcccucagagaagcaaggccgugucccugagcguuaccgugcccgucucucauccugugcuuacccuguccagcgcugaggcccucacauucgagggggcgaccguuacacugcacugugaagugcaacgcggaucuccccagauccuguaucaguuuuaccaugaggacaugccucuuugguccagcucuacgcccagcgucggccggguguccuucagcuuuucucucaccgaaggccacuccgggaauuacuauugcacagcugauaacggauucggcccgcagagaagcgaggugguuucccuguuugucaccgugccugugucucgccccauucugacacuccggguccccagagcccaagccgugguuggggaccugcuugaacugcauugugaggcuccucgcggaagcccgcccauccucuacugguucuaucacgaggaugugacccugggcuccucuagcgccccuuccgggggcgaggcuucuuucaaucugagccuuacggccgagcacuccggaaacuacagcugcgaagcgaauaacggccucgucgcccagcauucugacaccauuucccugagcgugaucguucccgugucucggccuauccugacauuuagagcuccccgggcccaggcugucgugggggaucuccuggagcuucacugugaggcccugcgcggauccagcccuauucucuauugguucuaccaugaagacguuacccugggcaaaaucucugcgcccuccgggggaggcgccagcuuuaaucugucccuuacaaccgagcacagcgggauuuauucuugcgaagcugauaacggccucgaggcccagagaagcgaaauggugacgcugaaggucgcugugccggugucccggccuguccugacacucagagcccccggaacccacgccgcuguuggcgaccugcuugagcugcauugugaggcgcuccgcgggucuccucugauccuguaccgguucuuucacgaagaugugacacuuggaaauagaagcucccccucuggcggggccagccucaaccugucccugaccgcugagcauucuggaaauuacagcugcgaagccgacaacggccucggggcccaacgcuccgagaccgugacacuguauauuacgggccuuaccgcuaauagaagcggaccguucgccacaggcgucgcugggggacugcucucuaucgcgggccuggccgccggggcucugcuucuguacuguuggcucucccggaaagccggacgcaagccugcgagcgaucccgcuagaucuccuuccgacagcgacucccaggaacccaccuaucacaacgugcccgccugggaggagcugcagccuguuuacacaaaugccaacccgcggggcgaaaacguggucuauucugaggugcgcaucauucaggaaaagaaaaagcaugcuguugccagcgaucccagacaccuccggaauaaaggguccccuaucauuuacagcgaggugaaggucgcuucuacccccguguccggcagccuguuucuugccucuagcgcgccucaccgcuga

SEQ ID NO: 69259 - RNA, 1242 nt, Artificial Sequence
  derived and/or modified sequence opt5 from FCRL6__Homo_sapiens__NP_001271146
augcugcccagccucggcccuaugcugcuuuggaccgccgugcuccuguucgucccgugcguugggaagacaguguggcuguaccuucaggcuuggcccaacccuguguuugagggagacgcccugacgcucagaugucaaggcuggaaaaauacaccccugucccaggucaaguucuaucgggaugggaaauuucugcacuucucuaaggaaaaccagacccucagcaugggagcggcuaccgugcagucccgcggccaauacucuugcagcgggcagguuauguauaucccucagacauuuacccagacauccgagaccgccauggugcaaguccaggaacuguuucccccuccggugcuuucugccauucccagcccugagcccagagaaggaucccugguuacgcuccggugucagaccaaacugcauccucuucgcagcgcucugagacuccuguucucuuuccacaaggacggccauacacugcaggaucggggcccccacccggagcucugcaucccuggggccaaggagggagacuccggccuguacuggugugaaguggcucccgaagggggacaaguccagaaacagagcccucaacuugaggugcgcgugcaggcccccgucucuagacccguucugacccuccaucacggcccugcggauccggccgugggggacauggugcagcugcuuugcgaggcucagcggggauccccucccauucuguauagcuuuuaccucgaugagaagaucgucggcaaucacucugcccccuguggcgggacaaccucccugcuguucccugugaaaagcgaacaagacgcuggaaacuauuccugcgaggccgaaaauucuguuagccgcgagagauccgaacccaagaaacucagccugaagggcucucaggugcuuuuuacgccggcguccaacuggcuggucccuuggcuccccgccagccugcuugggcugauggugauugcugccgcucuccugguuuacgugcggucuuggcgcaaggccggaccucugcccagccagaucccucccacagccccgggcggggagcaguguccucucuacgcuaauguccaucaccaaaaaggaaaggaugagggcguggucuauuccgugguucauagaaccucuaaacggagcgaagcgcgcuccgccgaguucacagugggcagaaaguuuuaccaccugugcgggggagaaaugcccgcugcccaguga

SEQ ID NO: 69260 - RNA, 1149 nt, Artificial Sequence
  derived and/or modified sequence opt5 from FCRLA__Homo_sapiens__NP_001171795
augcugaagaaaaucagcgugggcgucgccggggaccucaacaccguuacaaugaagcugggaugcgugcuuauggcuugggcccuguaccucucccugggcgugcuuugggucgcgcagaugcugcucgcugccgggugucacgccgcugccucuuucgagacgcugcaaugcgaaggacccguguguaccgaggaaagcuccugccauacagaggaugaccugaccgaugcuagagaagccggcuuucagguuaaagcguauacauucucugagccuuuucaccucauugugagcuacgacuggcugauccuucaggggccggccaagcccgucuucgagggagaucugcucgugcugcggugucaggcuuggcaagacuggccucuuacccagguuacauuuuaucgcgauggcuccgcccugggacccccugggcccaauagagaguucucuauuaccgugguccagaaagcugacagcggacauuaccacugcuccggcaucuuucagagcccugggccgggcauucccgaaacggccucugugguggcgaucaccguccaagaacucuucccugcccccauccugcgggcuguuccuuccgccgagccccaggcuggcagcccgaugacacugucuugucagaccaagcucccucugcagcgcuccgccgccagacuucuguuuagcuucuauaaggaugggcggauugugcaaucucgcggacucuccagcgaguuucagauccccacagcuuccgaagaccauucuggcagcuacuggugcgaggcggccaccgaagauaaccagguguggaaacaauccccucagcuggagauuagaguccagggcgcuucuagcuccgccgccccucccacgcuuaaucccgcuccgcaaaagagcgccgcgcccgggacagcuccugaagaggcccccggaccucugcccccgccucccaccccuucuagcgaggaccccggcuucuccucuccucucgggaugcccgauccgcaccuguaucaccagaugggacugcuccugaaacauaugcaggacgugcggguucuucugggccaccuccugauggaacuucgcgagcugagcgggcauagaaagccuggaacaaccaaagccaccgcugaauga

SEQ ID NO: 69261 - RNA, 957 nt, Artificial Sequence
  derived and/or modified sequence opt5 from FCRLB__Homo_sapiens__NP_001275758
auguggccccugaccgcccuccugcuucuggugccuagcuccggccaggcugccacccucgagaagccgauccugucucuucaucccccuuggacgaccauuuucaaaggggaaagagucacacugaagugcgacggauaccacccccuccugcuggagcuccaaccuaucagcacccugugguaucuuggccaucugcuccugcccucccacaaaaagucuauugaaguucagacaccugggguguaccggugucagacccgcggagcgccggugagcgaucccauccaccuuuccgucucuaacgacuggcugauucuccaggugccuuaugcucccguuuuugagggcgaaccucuggugcugagaugccgggggugguacgauaaagucguguauaagcuccauuacuaucacgacggacaagccguucgcuacuuccacagcuccgccaauuacacagugcugcaggcuagagccagcgauucuggccgguaucaguguuccggcaccaugcgcauccccgucgagagcgcuccgauguuuucugccaagguggcggugacgguccaggccgcuagaugcgccgcuuccaccggggccccuagcacacaaucucggagcccccgcuccagauccucuaaccggaccggagcgcgcagacuuccuccucccgccguuagcggcaaugcugugcggggguguuccagccgcggaagagugcugcccuggacacggccgcccccucccccucagcuccauggcccccagccguggcugcuugucaucgggagauucccuucugagagcccccgcugcccugaccgguccagauggucucccccuagcggaacacccccgccucccggcuguuccucucgccgggccgcucccagacugcgcggccacccuccggcccuccggagacgccccuggaacaaucggcuggaaccuuga

SEQ ID NO: 69262 - RNA, 1254 nt, Artificial Sequence
  derived and/or modified sequence opt5 from FDFT1__Homo_sapiens__NP_001274672
auggaguucgugaagugccugggccaccccgaagaguuuuacaaccucgucagauuccggaucgggggaaaacgcaagguuaugccuaaaauggaccaggauagccuguccucuagccuuaagaccuguuauaaauaccugaaucaaacauccagaucuuuugccgcugugauucaggcccucgacggcgaaaugcggaacgcggugugcaucuucuaucugguccuucgcgcucuggauacgcucgaggacgauaugaccauuagcguggaaaagaagguuccgcugcugcauaauuuucacuccuuccucuaccagcccgacuggagauuuauggagucuaaagagaaggaucgccaggugcuggaagacuucccuacaaucagccuugaguuucggaaccuggccgaaaaauaucaaaccgucauugccgauaucuguagacggauggggaucggaauggcugaguuccucgacaagcaugugacauccgagcaggaaugggauaaauacugccacuauguugccggccugguggggauuggacuuagccgccuguuuucugcuuccgaguucgaagacccccucgucggcgaggauaccgaaagagccaauagcaugggccuguuucugcagaagacaaacaucauucgggacuaccucgaggaccagcaagggggacgcgaguucuggccucaggaaguguggucuagauacgugaagaaacugggcgauuucgcgaagcccgagaauaucgaccuugccguccagugucugaacgaacucauuaccaaugcucugcaucacaucccugauguuauuacguaucuuucccggcugcgcaaccagagcguguuuaauuucugcgccaucccgcaagugauggcuaucgccacccucgcggccuguuacaacaaucagcaggucuuuaaaggggcugugaagauuagaaaaggacaagccguuacacugaugauggacgcuaccaacaugcccgccgugaaggccaucauuuaucaguacauggaggaaaucuaucaccggauuccugauucugaccccuccagcuccaaaacaagacagaucaucucuaccauucgcacgcagaaucugccuaacugccaacucaucagccggucccauuacagccccauuuaucugucuuucgucaugcuucuggcugcgcucuccuggcaguaccugacaacccuuagccaggugacagaggauuacguucagaccggcgagcacuga

SEQ ID NO: 69263 - RNA, 1260 nt, Artificial Sequence
  derived and/or modified sequence opt5 from FDPS__Homo_sapiens__NP_001129293
augccccugagcagauggcuccgguccgugggcgucuuccugcuuccugccccguacugggcuccccgcgagagauggcuggggucucuccggcgcccuagccugguucacggauaucccgugcuugccuggcauuccgcgagaugcuggugucaggcuuggaccgaagaaccucgggcccugugcucuagccuccgcaugaacggcgaccaaaauuccgauguguacgcccaggaaaagcaggacuuuguccagcacuucucucaaaucgugagaguucugacagaggaugaaauggggcaucccgagauuggagacgcuaucgcccggcugaaagaggugcucgaauauaacgcuauuggcgggaaguacaaucgcggacugacggucgugguugccuuuagagagcuuguggaaccucggaaacaggaugcggacagccugcagcgcgccuggaccgucggcugguguguggagcuccugcaggcuuucuuucuuguggccgaugacaucauggauuccagccugacaagacggggccaaauuugcugguaucagaagccgggggucggacucgacgcuaucaacgaugccaaucugcuggaggcguguaucuaccgccuccugaaacuuuauugcagagaacagcccuacuaccugaaccucauugagcuguuccuucagucuuccuaucaaaccgaaaucggccagacacuggaccuccugaccgccccucaggggaauguugaucuggugcgguuuacagagaagagauacaagagcauugugaaauauaagaccgcuuucuacucuuuuuaucuccccaucgccgcugccauguacauggccggaauugacggcgaaaaagagcacgcuaacgcgaagaaaauccugcuugagaugggggaguucuuucaaauucaggacgauuaucuggaccucuucggagauccuuccgucacgggcaagaucggcaccgacauccaggauaauaaguguagcuggcuggugguucagugccuucaacgcgccacacccgagcaguaccagauucugaaagaaaacuacgggcagaaggaggcugaaaaaguggcccgggucaaggcccucuaugaggagcuggaccugccggcuguguuucuccaauacgaagaggauucuuauucccauaucauggcccugauugaacaguacgcggcuccucuucccccugccguuuuccugggacucgccagaaaaaucuauaagcgccggaaauga

SEQ ID NO: 69264 - RNA, 555 nt, Artificial Sequence
  derived and/or modified sequence opt5 from FDX1__Homo_sapiens__NP_004100
auggccgcugccggcggggcgagacugcuccgggcugccagcgccgugcugggaggccccgcugggcgcuggcuucaccaugccggauccagagcuggcucuagcgggcugcuccggaaccgcggaccuggcggcuccgccgaggcgucuagaagccuguccgucucugcccgggcucgcagcuccagcgaagacaagaucaccguucacuucauuaauagagauggggagacacuuacgaccaaaggaaaggugggcgacucucugcucgauguggucguggaaaacaaucuggacaucgauggguuuggagccugcgagggcacacuggcuuguuccacaugccaucucauuuucgaagaccacaucuacgagaaacuggaugccauuaccgacgaggaaaacgauaugcuugaccuggcguaugggcucaccgaucggagccgccugggaugucagaucugccuuacaaagucuauggacaauaugaccguuagagugccggagacggucgccgaugcucggcaauccaucgacgugggcaaaaccagcuga

SEQ ID NO: 69265 - RNA, 561 nt, Artificial Sequence
  derived and/or modified sequence opt5 from FDX1L__Homo_sapiens__NP_001026904
augcacgugauggccgcuagcauggccagaggcggggucuccgcgcggguucugcuccaggcugcccgcggaaccugguggaacagacccggcgggacaucuggaagcggcgaagggguggcccugggaacgacccggaaguuccaagcuacaggcucccgcccugccggcgaagaggacgcugggggaccggaaagacccggcgauguggucaaugugguuuuuguggaccggucugggcagcgcaucccugucagcggaagagugggcgauaacguucuucaucuggcccagcggcacgggguggaccucgagggagcgugcgaagccucccuggcuuguucuaccugccaugucuacgugagcgaggaucaccuugaccugcugcccccucccgaggaacgcgaggaugacaugcucgauauggccccucugcuccaggaaaauuccagacugggcugucaaauugugcuuacaccggagcuggagggcgcugaguucacccuccccaaaaucacacggaacuuuuaugucgacgggcauguuccuaagccccacuga

SEQ ID NO: 69266 - RNA, 1605 nt, Artificial Sequence
  derived and/or modified sequence opt5 from FDXR__Homo_sapiens__NP_001244941
auggccagcagaugcuggcggugguggggcugguccgcuuggccccgcaccagacugccuccggccgggucuacacccagcuucugucaccauuuuuccacgcaggagaagaccccucaaaucugcguggucggaucuggccccgcgggguucuacacagcucagcaccuccugaaacggguugaagcccuuuguagccagccucgcgugcugaacucccccgcccucucuggagagggcgaagaccugggggcuagccagccucuuucccugggaccgaccagcugccaucccgugccucaacagcacccccaggcccaugucgauauuuaugagaagcagccugugcccuuuggccucguuagauucggcguggcuccggaccacccugaagucaaaaaugugaucaacacauuuacccaaacagcccacucugggcggugugcguucuggggaaauguugaggugggccgcgaugucaccgugcccgagcugcaggaagccuaccaugcugugguccuguccuauggggccgaggaccacagagcucucgaaauuccuggagaggagcugcccggcguuugcagcgcccgggcguuuguggggugguacaacggacuucccgaaaaucaggagcuggaaccugaucucucuugugacacggccgugauccugggccagggcaacgucgcucuugauguggcccgcauucugcucaccccgcccgagcaucuggaaagaacagacaucaccaaggcugcccuggggguucuccggcaaucccgcgugaaaacagucuggcuggugggaagacggggcccucuucagguugccuucaccaucaaggagcugcgcgagaugauucagcuccccggggcuagaccuauccuggaucccguggacuuucuuggacugcaagauaagauuaaagaagucccgcggccuagaaagcgccucacggagcugcugcuccggacagcgaccgaaaaacccggcccugccgaggcugccagacaggccagcgcuucucgcgccugggggcugcgguucuuuagaagcccccaacaggugcuuccuucccccgacggacgccgggcggcuggcgucagacuggccgugacacgccucgaaggcguugaugaggccacccgggcugugccgaccggggacauggaggaccugccuugcggacuuguccuguccucuaucggcuauaagagcagacccguggaucccuccguuccuuucgacagcaaacucggggugauuccgaaugucgaaggacgcgugauggaugugcccggccuguacuguucuggguggguuaagcggggcccuacaggagucaucgccacgaccaugacagacuccuuucugaccggccagaugcuccugcaggaucuuaaggcugggcugcuccccagcggaccuagacccggcuaugccgcgauucaggcccugcugucuagccgcggggugcggccuguguccuucucugacugggagaaacuugaugcugaagaggucgccagaggacagggcacagggaagccccgggaaaaacucguggacccgcaagagaugcugagacugcucggccacuga

SEQ ID NO: 69267 - RNA, 1272 nt, Artificial Sequence
  derived and/or modified sequence opt5 from FECH__Homo_sapiens__NP_000131
augagaagccugggcgccaacauggcugccgcgcuccgggcugccggggugcugcuucgcgacccccuggccuccucuagcuggagagucugccagccuuggcgguggaaguccggagcugccgcugccgcgguuaccacagagacggcccaacacgcucagggcgccaaaccccaggugcagccgcaaaagcgcaaaccuaagaccgggauccucaugcugaauaugggaggccccgaaacacuuggggaugugcaugacuuccugcucagacuguuucuggaucgggaccucaugacccugccuauucagaacaaacuugcucccuucaucgccaagcgcagaacaccuaagauucaggagcaguaccggcgcaucggaggcggcucuccgauuaaaaucuggaccagcaagcaaggggaaggaauggucaaacugcucgaugagcugucccccaauacagcgccucacaaguauuacaucggcuuuagauaugugcauccccuuaccgaagaggccauugaggaaauggagcgggacgggcuggaacgcgcuaucgccuucacgcaguacccucaguauucuuguagcaccacaggauccagccucaacgcuauuuacagauauuacaaucagguuggccggaaacccaccaugaaguggucuacaaucgaucgcuggccgacccaccaucugcugauucaaugcuuugccgaccacauccucaaggagcuggaucacuucccucuugagaaaagauccgaaguggucauucuguuuagcgcccauucucuccccauguccgugguuaacagaggggacccuuacccccaggaggugagcgcuacgguccagaaggugauggaaagacuggaguauuguaaucccuaccgccuuguguggcaaucuaaagucggaccuaugccguggcugggcccccagacagaugaauccaucaagggccucugcgagcgggggcggaaaaacauccugcugguuccuauugcguucaccagcgaccacaucgagacacucuaugaacuggauauugaguacucccaggugcuugccaaggaauguggaguggagaauauccgccgggcugaaucucugaacggcaauccccucuuuagcaaagcccuggccgaccuuguccauucccacauucagagcaacgagcugugcucuaagcaacucacccuguccuguccucugugcgugaaucccguuuguagagagaccaagagcuucuuuacaucucagcagcucuga

SEQ ID NO: 69268 - RNA, 2010 nt, Artificial Sequence
  derived and/or modified sequence opt5 from FEM1A__Homo_sapiens__NP_061178
auggaccugagaaccgccguguacaacgcugcccgggauggcaagcuccagcugcuucaaaaacugcucagcgggcgcuccagagaggaacuggacgagcuuacaggagaagucgcgggcgggggaacgccccugcucaucgcugcccgguauggccaccuggauguuguggaguaccugguggaccgcugcggggccucugucgaagcuggaggcagcgugcauuucgauggcgagaccauugagggggccccuccgcucugggcugccuccgcggccggacaccuggacguugugagaucucuucugcggcgcggcgcuagcgucaauagaacaacccggacaaacuccaccccucuccgcgccgcuuguuuugaugggcaucuggaagugguuagauaucuugugggagagcaccaggccgaccuggaagucgcgaaucggcauggccacacaugccucaugaucucuuguuacaaggggcaccgcgagauugccagauaucugcuggagcagggagcucaggugaaccggcgcagcgccaaaggcaauaccgcucuccaugauugcgccgaauccggcagccuggagauccuucaacugcuccugggguguaaggccagaauggaacgggacggauacggcaugacgccccuucuggcugcgucugugaccgggcacacaaacauugucgaguaucucauccaggaacagcccggacaggagcaaguugccggcggggaggcucagccuggacugccccaggaagauccuuccaccagccagggcugcgcccaaccgcagggcgcccccuguuguucuuccagcccugaggaaccccugaauggggagucuuacgaauccugcugcccuacaagcagagaggcugccguggaggcgcucgaacugcuuggagcuaccuacguggacaaaaagcgcgaucugcucggcgcccugaagcauuggcggagagccauggagcuucgccaccaagggggagaauaucugcccaaaccggagccuccccagcucguccuggcuuacgacuauucccgggaagugaacacgacagaggagcuggaagcccucaucaccgacccugaugagaugagaaugcaggcucugcuuauucgcgaacggauccugggccccucucaccccgacacaagcuacuauauuagauaccgcggggccguuuaugcggauuccggcaauuucgagcgguguaucagacucuggaaguacgcccuggacaugcagcagagcaaccuggagccucuuucuccgaugaccgcuuccagcuuucucucuuucgccgaacuguuuagcuacgugcugcaagaucgcgcugccaaaggaucccucggcacccagauuggguucgcggaccugaugggaguccuuacaaagggcgugcgggagguugaaagagcccugcagcucccccgggagccuggggauucugcucaguuuacgaaagcccuggcuaucauucugcaucuucucuaucugcuggaaaagguggagugcacccccagccaagagcaccucaagcaucagacagucuaccgccugcuuaaaugcgccccuagaggaaagaauggcuucacaccccugcacauggccguggacaaagauaccaccaacgucgggcgguauccggugggcagauuuccuucccuccauguugugaagguccugcuggacuguggagcugaucccgacagccgcgacuucgauaauaacacgccucuucacaucgcggcccagaauaacugccccgcuaucaugaacgcccucauugaagccggcgcucacauggacgccacaaaugcguuuaaaaagaccgcuuacgagcugcuggaugaaaaacuccuggcccgggggaccaugcagccuuucaacuaugugacacuucaaugucuggccgcuagagcccucgacaagaauaagauccccuacaaaggauuuauuccggaggaucuggaagcguucaucgagcugcauuga

SEQ ID NO: 69269 - RNA, 1884 nt, Artificial Sequence
  derived and/or modified sequence opt5 from FEM1B__Homo_sapiens__NP_056137
auggagggccuggccggguacguguauaaggcugccagcgaaggaaaaguccucacccuggcggcccuucugcucaacagauccgagucugacauccgguaccugcuuggcuauguuagccagcaagggggacagcgcuccacaccccugauuaucgcugccagaaauggccacgcuaagguggugcggcuccugcuggaacauuaccgcguccagacgcagcaaaccgggacagugagauucgauggauauguuauugacggcgccaccgcucucuggugcgccgcgggcgccgggcacuuugagguggucaaacugcuugugucucauggagcuaacguuaaucacacaaccgugacaaacagcaccccucugcgggccgcuuguuucgauggccgccucgacaucgucaaguaccugguggaaaauaacgccaauauuuccaucgcgaacaaauaugauaauacgugccuuaugaucgccgcuuacaaggggcauaccgacguggucagauaccugcucgagcagcgggccgauccgaacgcuaaggcccacuguggagccacagcucugcacuuugcggccgaggcuggccauauugacaucguuaaagaacugauuaaguggcgcgccgccaucguggugaaugggcacggaaugacaccccucaaagucgcugccgagucuugcaaggcggaugugguugaacugcuucugagccaugcugacugugauagacggucccgcauugaggcccucgagcugcuuggcgccagcuucgcuaacgacagagaaaauuaugauaucauuaaaaccuaccacuaucuguaccucgccaugcuggagcgguuucaggacggcgacaacauccuggaaaaggaggugcucccucccauccacgcuuaugggaaucgcaccgaaugcagaaacccucaggagcuggagucuauucggcaagauagagacgcccuucauauggaaggacugaucguccgcgagcggauucucggcgcggauaacaucgacgugucccaccccauuaucuacagaggggccguuuaugcugauaauauggaguucgaacaguguaucaagcuguggcuucaugcccugcaccuccgccagaaaggaaaccggaauacgcauaaggaccugcugagauuugcucagguguucagccaaaugauucaccucaacgaaacagucaaagccccugauaucgagugcgugcugcgcuguucuguccuugagauugaacaguccaugaaucgggugaagaacaucagcgacgcggauguucacaaugccauggacaacuacgagugcaaucuguacaccuuucucuaucugguguguauuucuacaaaaacccagugcuccgaagaggaucaaugcaagaucaacaaacagaucuacaaucugauucaucuugacccgagaacccgcgaaggcuucacacuccugcaccuggcugucaacagcaauacgcccguggacgauuuucauaccaacgacguuuguuccuucccuaaugcccucgugacaaagcugcuucuggauugcggggcugaggucaacgccguggacaacgagggaaauucugcccuccacaucauugugcaguauaaccggcccaucagcgauuuucugacccugcacuccauuaucauuagccuuguugaagcuggcgcgcauacagacaugaccaauaagcagaacaaaacgccucucgauaagucuacaaccggcgucuccgagauccugcugaaaacccaaaugaagaugagccucaaaugucuggccgcuagagccgugcgcgccaaugacaucaacuaccaggaucagauuccccggacacuugaagaguucgugggguuccacuga

SEQ ID NO: 69270 - RNA, 1854 nt, Artificial Sequence
  derived and/or modified sequence opt5 from FEM1C__Homo_sapiens__NP_064562
auggaccugaagaccgccguguucaacgcugccagagauggcaaacuccggcugcuuacaaagcugcucgcgagcaaauccaaggaggaagucucuagccugaucuccgagaaaacgaauggggcuacaccccuucugauggccgcccgcuacggacaccucgacaugguugaauuucugcuggagcagugcucugcuagcauugaagugggcggguccgugaacuucgauggagagaccaucgagggcgccccuccgcucugggcugccucugcggccgggcaucugaaggucgugcaaagccuucugaaucacggagcuuccguuaacaauaccacacucaccaacagcacaccccugagagccgcuuguuuugacggccaucuugaaauugugaaguaucuggucgagcacaaagccgaucucgaagugucuaaucggcauggccauaccugccugaugaucuccuguuacaaggggcacaaagagauugcgcaguaucugcucgagaagggagccgacguuaaccgcaaaagcgugaagggcaauacggcucugcacgauugcgccgaaucugggucccuugacaucaugaagaugcugcucauguacugugcuaaaauggagaaggauggauauggcaugaccccucugcuuagcgccucugucacagggcacaccaacaucguggacuuccugacacaucacgcccagaccuccaaaacggaaagaauuaaugcucucgagcugcugggagcgacauuuguggauaagaaacgggaccuccugggcgcccuuaaguacuggaaaaaggcuaugaacaugcgcuauagcgauagaaccaauaucauuuccaagcccgucccucagacacugaucauggccuacgacuacgccaaagaaguuaacucugcugaggagcucgaaggccugauugccgaccccgaugagaugcggaugcaagcgcuucugauccgcgaacggauucucgggccuagccacccggacaccuccuauuacaucagauaucgcggagcuguguacgccgauagcggcaauuucaagagaugcaucaaccuguggaaauaugcccuggacaugcagcagucuaaccucgauccccuguccccuaugaccgcuagcucucuucugagcuuugccgaacucuucuccuuuaugcugcaggaccgggcuaaggggcugcuuggaacaacggugaccuucgaugaccucaugggcauucuguguaaaucuguccuggagaucgagcgcgccauuaagcaaacacagugccccgcggauccucuccagcugaauaaggcccuuagcaucauucugcaucucaucugucugcuggagaaagugcccugcacccuugaacaggaccacuuuaagaaacaaacaaucuacagauuccucaagcugcauccgcgggggaaaaacaauuuuuccccucugcaccucgcuguugauaagaacaccacgugugugggaagauaucccgucugcaaguucccuagccuucaggugacagccauucuuaucgagugcggcgcugacguuaaugugcgcgacucugaugacaacagcccccugcauauugccgcgcucaauaaccaccccgauaucaugaaucugcugauuaaauccggcgcccacuucgacgcuaccaaccuucauaagcagaccgccucugaucuccuggacgaaaaagagaucgcuaagaaucugauccaaccuauuaaccacacaacccuccagugucuggccgcccgggucaucgugaaucauagaauuuacuacaaagggcacaucccggaaaagcuggagacauuugucucccugcaccgcuga

SEQ ID NO: 69271 - RNA, 1143 nt, Artificial Sequence
  derived and/or modified sequence opt5 from FEN1__Homo_sapiens__NP_004102
augggcauucaggggcuggccaagcucauugcugacguggcccccagcgcgaucagagagaacgauauuaaauccuacuucggacggaaggucgcuaucgacgccucuaugagcauuuaucaauuucugaucgccguucgccagggcggggaugugcuucagaaugaagagggagaaaccacaucccaccugaugggcauguucuacagaacgauccggaugauggagaacgggauuaaaccuguguaugucuuugacggaaagccgccccagcucaaaucuggcgaacuggcuaagcgcagcgagagacgggccgaggcugaaaagcaacuucagcaggcccaggcggccggcgcugagcaagaaguggagaaauucaccaagcgccugguuaaagugacaaagcagcauaaugaugagugcaaacaccuccugucccugauggggaucccuuaccucgacgcccccucugaagcugaggccagcugugcggcccuggucaaggcuggaaagguguaugccgcugccaccgaagauauggacugccuuacauuuggcuccccuguucugaugagacaucucaccgccagcgaggcuaaaaagcugcccauucaggaguuccaccuuucucggauccugcaggagcucgggcugaaccaagagcaguuuguggaucuguguauucuccugggauccgacuacugcgaaagcauccgcggcauugggccuaaaagagcggucgaucuuauccagaagcauaaaucuaucgaggaaauugugcggcgccuggacccgaauaaguaucccgugccugagaacuggcuccacaaagaagcccaccaacuguuccuugagcccgagguccuggauccugaauccguugagcucaaguggagcgaacccaaugaggaagaacugaucaaguuuauguguggagagaaacaguucucugaagagagaauccgguccggcgugaagcgccugagcaaauccagacagggcucuacacaggggcggcucgacgacuuuuucaaggugaccggaagccuguccagcgcuaaaagaaaggaaccggagccuaagggcucuacgaaaaagaaagccaagaccggggccgcuggaaaauuuaagcgcggcaaguga

SEQ ID NO: 69272 - RNA, 501 nt, Artificial Sequence
  derived and/or modified sequence opt5 from FERD3L__Homo_sapiens__NP_690862
auggccgcuuaccccgagagcugcguggacaccacaguccuggauuucguugccgaccucucccuggcgucuccuagacggccgcuucugugugauuuugcucccggcgugagccucggggacccugcccuggcccuucgcgaaggaagaccccggcgcauggcuagauucgaggaaggcgauccugaggaagaggagugcgaaguggaccagggggauggagaggaagaggaggaagaggaacggggccgcggggucucccugcucggaagacccaagcggaaacgcgugaucacguaugcccaaagacaggcugccaacauucgggagcgcaagagaauguuuaaucugaacgaagcguucgaccagcugcggcgcaaaguuccuaccuuugccuacgagaagagacucucucggaucgagacacugagacuugcuauuguguauaucagcuucaugaccgaacugcucgaguccugugagaaaaaggaaucuggcuga

SEQ ID NO: 69273 - RNA, 2469 nt, Artificial Sequence
  derived and/or modified sequence opt5 from FER__Homo_sapiens__NP_005237
augggcuucgggagcgaccugaagaacucccacgaggccgugcucaaacugcaggauugggaacuuagacugcucgagaccgucaagaaauuuauggcccugcggaucaagucugacaaagaauacgccagcacacuucaaaaucugugcaaccagguugauaaggaguccacggugcagaugaauuaugugucuaacgucagcaaguccuggcuccugaugauucagcaaaccgaacagcugucucgcaucaugaaaacacaugcggaggaccucaauagcggaccccugcacagacuuaccaugaugauuaaggauaaacaacaggugaagaaauccuacaucggcguucaucaacagauugaggcugaaaugaucaaggugacaaagaccgagcuggaaaaacucaaguguagcuaucggcagcugaucaaagagaugaacucugccaaggagaaauacaaggaagcccuugcuaaagggaaggagacagaaaaggccaaagagcgcuaugacaaggcuaccaugaaacugcacaugcuccauaaucaguacguccuggcccugaagggagcgcaacuccaccagaaccaguauuacgauauuacgcugccucuucugcucgacucccugcagaaaaugcaggaagagaugaucaaggcccuuaagggcauuuucgaugaguacagccagaucaccucucuggugacagaagagauuguuaaugugcacaaagaaauccagauguccgucgagcaaauugacccgagcaccgaauauaacaauuuuaucgaugugcauagaacaaccgcugccaaggagcaggagaucgaguucgacacgucucuccuggaggaaaacgagaaucugcaggcuaacgaaauuauguggaauaaccucacagccgagucccuucaggugaugcuuaaaacccuggcggaggaacucaugcaaacacagcagaugcugcuuaacaaggaggaagccguccuggagcucgagaaacggaucgaagagagcuccgaaaccugcgagaagaagucugauauuguucugcugcucagccagaaacaagcucuggaagaacuuaagcaguccgugcagcagcugcgcuguaccgaggccaaauuuagcgcucaaaaggaacuccuggagcagaaagugcaggaaaaugacgggaaggagcccccucccgucgugaacuacgaagaggacgccagaucuguuacauccauggagcggaaggaacgccugagcaaauucgagucuaucagacacagcauugccggaaucauccgguccccuaagucugcucuuggcagcuccgcgcucagcgauaugauuucuaucuccgaaaaaccccuggccgagcaagacugguaucauggcgcuauuccucgcaucgaagcccaggagcugcucaagaaacagggggauuuucuggugagagagagccacggaaagccgggcgaauacguccuuucuguguauuccgacgggcagcggcgccacuucauuauccaauacguugauaauauguauagauuugagggaacgggcuucagcaacaucccccagcugauugaccaucacuacaccacaaaacaggugaucaccaagaaguccggggucgugcuccugaauccuauucccaaagauaagaaauggauccugucucaugaagacgucauucuuggagagcuccugggcaagggcaacuuuggggagguguacaaaggaacacugaaggauaagaccagcguugccgugaaaacgugcaaggaagaccucccucaggagcugaaaaucaaguuccuucaagaagcuaaaauucugaagcaguaugaucaccccaauaucgucaagcucaucggcguguguacacagcggcagccgguuuacauuaucauggagcugguguccgggggagacuuucugaccuuccuuagacgcaaaaaggacgaacucaaacugaagcaacuggucaaauucucucucgaugccgcggcuggcaugcuguaucuugagagcaagaacugcauucaucgggaccuggccgccagaaauugucucgugggggagaacaaugugcugaagaucuccgauuuuggaaugagccgccaggaagacggcggcguuuacucuuccagcgggcugaaacagauuccuaucaaguggaccgcucccgaggcccuuaacuauggacgguacucuuccgaaagcgaugucuggucuuucggcauccuccugugggagacauuuagccugggggugugcccuuaucccggaaugaccaaucaacaggcuagagaacagguggagcgcggcuaccggauguccgcuccccagcacuguccugaggacauuagcaaaaucaugaugaagugcugggauuacaaaccggaaaacagacccaaguucucugagcuccaaaaagaacugacaauuaucaagcgcaagcugacguga

SEQ ID NO: 69274 - RNA, 2034 nt, Artificial Sequence
  derived and/or modified sequence opt5 from FERMT1__Homo_sapiens__NP_060141
augcugagcuccaccgacuucacauuugccucuugggagcucguggucagaguugaucaccccaacgaagaacagcaaaaggacgugacgcugcgggugagcggcgaucuucaugucgggggagugaugcugaaacucguugaacagaucaauauuucccaggacuggucugauuucgcucuguggugggagcagaagcacugcuggcuucugaaaacccauuggacacucgacaaguacggcgugcaagccgaugcgaaacugcuguuuaccccucagcacaagaugcuccgccugagacuuccgaaccugaagaugguccggcuccgcgugagcuucuccgcuguuguguuuaaagccgucucugacaucuguaagauucugaauaucagacggagcgaggagcuuucccugcucaaacccagcggggauuauuucaagaaaaagaagaaaaaggacaaaaacaauaaggagccuauuaucgaagauauccugaaccuggagucuucccccacagccagcggaucuuccgugagcccuggccucuacucuaaaaccaugacacccauuuaugacccuaucaaugggaccccggcuuccagcacgaugaccugguuuuccgauucuccccugacagaacagaacugcagcauucuugccuucucccagccuccccaaagcccugaggcucuggccgacauguaccagccccgcucucucguggacaaggcgaaacugaaugccggauggcuugauuccagcagaucucugauggagcagggcauccaggaagacgagcaacuccugcugcgguuuaaguauuacagcuucuuugaucucaacccgaaguaugacgcuguccgcauuaaucagcuguacgaacaggccagaugggcuauccuucuggaggaaauugauuguaccgaggaggaaaugcucaucuucgccgcgcugcaauaccauaucuccaaacuuucucugagcgccgagacacaggacuuugcuggcgaauccgagguugaugaaauugaggccgcucucagcaaccuggaggugacccuggaagggggaaaggccgacucucuccuggaggauaucacggacauuccuaaacuugccgauaaucugaaacucuuccggcccaagaagcugcugccuaaggcuuucaaacaguauugguuuaucuucaaggacacauccauugcguacuuuaaaaacaaggaacuugagcagggcgaaccccucgagaaacugaaucugcgcgggugcgaggugguccccgacgugaacguugccggaagaaaguucggcaucaagcuccugaucccuguggcugaugggaugaacgaaauguaucuucggugugaccacgagaaucaauacgcccaguggauggccgcuugcaugcuggccagcaaaggaaagaccauggcggauucuuccuaucagccggaaguccucaacauucugagcuuucugcgcaugaaaaauagaaacuccgcuucucagguggccagcucccuugagaauauggacaugaaccccgaguguuucguuucuccucggugcgccaagagacacaaaagcaagcaacucgcugcccgcauccuggaagcucaucagaauguggcccagaugccccuggucgaggcgaagcuccgguuuauucaggccuggcaaucccugccugaguucggccuuacauacuaucuggugagauuuaaaggcagcaagaaagaugacauccucggggucucuuacaaccgccugauuaagaucgaugcugccaccggaauccccgugaccacauggcgguucacgaauauuaaacaguggaacguuaauugggaaaccagacagguggucaucgaauuugaccagaacguguucacagcuuuuaccugucuguccgccgauugcaagauuguucacgaguacaucggcggguauauuuuccuuagcacacgcucuaaagaccaaaaugagacccucgaugaagaccuguuccauaagcugacgggaggccaggauuga

SEQ ID NO: 69275 - RNA, 2064 nt, Artificial Sequence
  derived and/or modified sequence opt5 from FERMT2__Homo_sapiens__NP_001128471
auggcccuggacggcaucagaaugcccgaugggugcuacgcugacggaaccugggagcucagcgugcacgucacagaucugaaccgggacguuacgcuucgcgugaccggcgaagugcauauugggggagucaugcugaagcucguggagaaacuggauguuaagaaagacugguccgaucacgcccuuuggugggaaaagaaaagaacauggcugcucaagacccauuggacacuggacaaguauggcauccaggcggaugcuaaacugcaguucaccccucagcacaagcuccugcggcuucagcugccgaauaugaaauacgugaaggucaaagugaacuuuucugaccgcguuuucaaggccgugagcgauauuuguaagacauuuaauaucagacaucccgaggaacucucccugcuuaaaaagccucgggaccccaccaaaaagaaaaagaaaaagcuggaugaccagucugaggacgaggcccucgaacuggaggggccucugauuacgcccggaagcggcuccaucuauucuagcccuggccucuacuccaagaccaugacaccgaccuaugaugcucacgacgggagcccccugucuccuacauccgccugguucggagauagcgcucuuucugaaggcaaccccgggauccuggccgucucccaaccuauuaccagccccgagauccucgcgaaaauguuuaagccgcaggcccugcuugacaaagcuaagauuaaucagggauggcuggauucuucccgcagccucauggagcaggacgugaaagaaaacgaggcccugcugcucagauucaaguacuauuccuuuuucgaucugaauccuaaguacgacgcuauccggauuaaccaacuuuacgaacaggccaaaugggcgauccugcucgaggaaauugagugcacggaggaagagaugaugauguuugccgcucugcaguaucacaucaauaaacuuucuaucaugacaagcgaaaaccaucugaauaacuccgauaaggagguggacgaagucgaugccgcucucagcgaccuggagauuacccuggagggcgggaagacaucuaccauccucggagacauuaccuccauccccgaacuggccgauuacauuaaaguuuucaagccuaagaaacuuacacugaagggcuauaaacaguacugguguacguuuaaggacaccagcaucucuugcuauaaaagcaaggaggaauccucuggcacacccgcccaccaaaugaaucuccgcgggugugaggugacccccgaugugaacaucagcggacagaaguucaauauuaaacugcugaucccugucgcugaaggcaugaacgagauuuggcuuagaugcgacaacgagaagcaguacgcgcauuggauggccgcuugucggcucgccuccaaagggaagacaauggccgauagcucuuauaaucuggaagugcaaaacauccuguccuuucucaaaaugcagcaccugaauccggacccccagcuuauuccugagcagaucaccacggauaucacacccgaaugccugguuagcccucgcuaccucaagaaauacaagaacaagcaacccggauauauuagagaccugaucaccgcucggauucuggaggcccaccagaauguggcgcagaugucucuuaucgaggcuaaaaugcgcuucauucaggccuggcaaucccucccggaguucggcaucacccauuuuauugccagauuccaagggggaaagaaagaagaacugaucggcaucgcuuacaaccggcugauuagaauggaugccagcacaggcgacgcuaucaagaccuggcgcuuuuccaauaugaaacaguggaacgucaauugggagauuaagauggugacaguugaguucgccgaugaagugcggcucucuuuuaucuguacggaggucgacugcaaggugguccacgaguucauugggggauauaucuuucugagcaccagagcgaaagaucagaacgaaucccuugacgaagagauguucuacaagcugacaucuggcuggguguga

SEQ ID NO: 69276 - RNA, 1992 nt, Artificial Sequence
  derived and/or modified sequence opt5 from FERMT3__Homo_sapiens__NP_113659
auggccggcaugaagaccgcuagcggggacuacaucgauuccucuugggagcugagaguguucgucggagaagaggaccccgaagccgagagcguuacacuccgggugacgggcgaaucccacauugggggagugcugcuuaaaaucgucgagcagauuaaccgcaagcaagauuggucugaccaugcgaucuggugggagcagaaaagacaguggcugcuccagacccacuggacacuggauaaguauggcauucuugcugacgcccggcuguuuuucgggccucaacaucgcccggugauccucagacugcccaaucggcgcgcccugagacuccgggcuagcuuuucccagccucuguuccaggccguugcugccaucugccgccuucugucuauuagacaccccgaagaacucagccugcuucgggcgccugagaaaaaggagaagaaaaagaaagagaaggaacccgaggaggaacuguacgaucucuccaaagugguccuggccggaggcguggcuccugcccuguuucgcggcaugccggcucauuucagcgacucugcccagaccgaagcguguuaucacaugcucuccagaccccaaccucccccugauccccugcuucugcagcggcucccgcgcccuagcucucuguccgacaagacacagcuucacagcagauggcuggauucuucccggugccucaugcagcaagggaucaaggccggagacgcucuguggcugagauuuaaauacuauagcuucuuugaucucgaccccaagaccgacccuguucgccugacacagcuuuacgagcaggcccggugggaucugcuccuggaggaaauugacuguaccgaggaagagaugaugguguucgcugcccuucaauaucauaucaacaaacugucccagucuggcgaagucggggagcccgccggaacggaucccggccucgacgaucuggacguggcucugagcaaucucgaggugaagcuggaaggguccgcgccuaccgauguccuugacagccugacaaccauuccggagcucaaagaucaccugagaaucuuucgcccccggaagcugacacuuaaaggauacagacagcauuggguuguguucaaggaaaccacgcucucuuacuauaagucccaggacgaggccccuggcgaucccauucaacagcugaaccugaaaggcugcgaaguggucccugacgugaauguuagcgggcagaaguuuuguaucaaacuccuggugcccucuccggagggaaugagcgagaucuaccuucgcugccaggacgaacaacaguaugcucgguggauggccggcuguagacuggccuccaaggggcgcacaauggcugauucuagcuacaccuccgagguccaggccauucucgcguuccugagccugcagcggacaggaucuggcgggccuggaaaccacccccacggcccugacgcuuccgccgaaggccuuaaucccuaugggcucguggccccuagauuccaacgcaaauuuaaggcuaagcagcugacaccccggauccuggaggcccaucagaacguugcucagcucagccuggccgaggcgcaacuuagauucauucaggccuggcagucucugccggauuuuggaaucuccuacgugaugguccgguucaaaggcagccgcaaggacgaaauucucgggaucgcuaauaacagacugauccggauugaucuggccgugggagacgucgugaaaaccuggagauuuuccaauaugcgccaauggaacguuaauugggauaucagacagguggcuauugaguucgacgaacacaucaacgucgccuuuucuugcgugagcgcguccugucggauuguucaugaguauaucggcggguacaucuuccuuucuacccgcgaaagagcccggggcgaggagcucgaugaagaccuguuucugcagcucacgggaggccacgaggcuuucuga

SEQ ID NO: 69277 - RNA, 2085 nt, Artificial Sequence
  derived and/or modified sequence opt5 from FES__Homo_sapiens__NP_001137257
augggcuucagcuccgagcugugcucuccccaggggcacggagugcuccaacagaugcaggaagccgagcugagacuucuggaaggcaugcggaaguggauggcucagcgcgucaaaagcgacagagaguacgccgggcuccugcaucacaugucccuucaagauucuggaggccagagccgggcgaucuccccugacucuccgauuagccagacccauucccaggauaucgaaaagcugaaaagccaauaucgcgcucucgccagagacucugcccaggcuaagcggaaauaccaggaggccuccaaggauaaggaccgcgauaaagcuaaggacaaauauguuagaagccuguggaagcuguuugcccaccauaaccgguacgugcucggggugcgcgcggcccagcugcaccaccaacaucaccaucagcuucugcuccccggacugcuuagaucucugcaggaucuccacgaggaaauggcuuguauucugaaagagauccugcaagaauaucucgagauuuccagccugguccaggacgaggugguugccauccaccgggaaauggcugccgcggccgcucgcauccagccugaggccgaauaccagggcuuccuuagacaauauggcucugcucccgaugugccucccugcgucacauuugacgagucccugcucgaagagggggagccucuggaaccgggagagcuucagcugaaugaacucacgguggagagcguucagcauacccugacauccgugaccgaugaacuggccgucgccacagagaugguguuccggcgccaggagauggugacccaacuccagcaggaacugagaaacgaggaagagaauacacacccccgggaaagaguccagcuucugggcaagcgccaaguucuccaggaggcucugcaggggcuucagguggcgcuguguucucaagccaagcuccaggcucagcaagagcugcugcagaccaaacucgaacaucugggaccuggcgagcccccucccgugcuucugcuccaggacgaccggcacagcacguccagcucugaacaggagagagagggaggacgcaccccgacacuggaaauucugaagucccauaucagcggcauuuuucggccuaaauucucuaaccuuuacagacucgagggcgaaggguuucccagcaucccucugcugauugaucaccuccuguccacccaacagccccuuacaaagaaaucuggagucgugcugcaccgcgccguucccaaggacaaaugggugcucaaucaugaggaucugguccugggcgaacagaucgggcggggaaacuucggcgagguguuuagcgggagacuucgcgccgacaauacccucguugcugugaaguccugccgggagacgcugccuccggaucugaaggccaaauuccuccaggaagcgcgcauucugaagcaauacagccaccccaacaucgucagacuuaucggaguguguacacagaaacagccuauuuauaucgucauggagcuggugcagggcggcgacuuucucaccuuccugcggacagaaggggcuagacugcggguuaagacccuucuccaaauggugggagaugccgccgcuggcauggaguaccuggaaucuaaaugcuguauucaucgcgaccuggccgcuagaaauugccucgucaccgagaagaacgugcugaagaucuccgauuuugggaugagccgggaggaagccgacggaguuuaugcggccucuggcgggcuuagacaggugcccgucaaauggacagcuccugaggcccugaauuacggccgcuauuccagcgaauccgauguguggucuuucgggauucuccugugggagacguucagccugggcgcuucccccuacccgaaccuuucuaaucagcaaacccgggaauuuguggagaaagggggaagacucccuugucccgagcugugcccugacgccguuuuccgccugauggaacaguguugggcguaugagcccggccagagaccuagcuuuuccacaaucuaccaggaacuccaaagcauccggaagcgccacagauga

SEQ ID NO: 69278 - RNA, 717 nt, Artificial Sequence
  derived and/or modified sequence opt5 from FEV__Homo_sapiens__NP_059991
augagacagagcggcgccucccaaccccugcucaucaacauguaccugccugacccggugggggauggacuuuucaaggacggcaaaaaucccucuugggggccucugagccccgcuguccagaagggauccggccagauucagcucuggcaauuucugcuugagcugcucgccgaucgggcgaacgcugggugcaucgccugggaaggaggccacggcgaguucaaacugaccgacccugaugaaguugcccgcagauggggagagcggaagucuaaacccaauaugaacuaugacaagcugagccgcgcucucagauacuauuacgauaagaauauuauguccaaagugcaugggaagcgguaugccuaccgcuuugacuuccagggccuggcucaggccugucagccuccgcccgcgcacgcccaugcugccgcugccgcggccgcugccgcugccgccgcucaagauggggcgcuuuauaaacugccugccggacucgcuccccugccuuuucccggccuuucuaagcugaaccucauggccgccagcgcugggguggccccggcgggauucuccuacuggccuggccccggcccugcugccacagccgcugccgcuacggccgcgcuguaccccagccccucucugcagccuccgcccgggccuuuuggagccgucgcugccgcuucccaccucggcgggcauuaucacuga

SEQ ID NO: 69279 - RNA, 1179 nt, Artificial Sequence
  derived and/or modified sequence opt5 from FEZ1__Homo_sapiens__NP_005094
auggaggcuccccuggugagccucgacgaagaguucgaagaucugagaccuuccugcucugaggacccggaagagaagccccaguguuuuuacggcagcuccccucaccaucuugaggaucccucucugagcgaacucgagaacuucuccucugaaaucauuagcuuuaaauccauggaggaccuggucaaugaguucgaugaaaaacuuaacguuugcuuucggaauuauaacgccaagaccgagaaucuggccccugugaagaaccaacuccagauccaggaagaggaagagacacugcaggacgaggaagugugggaugcgcugacggacaauuacauucccagccucucugaggauuggcgcgacccuaacaucgaagcucugaaugggaacuguuccgauaccgagauucacgaaaaagaggaggaagaguucaaugaaaagagcgagaacgacucuggaaucaaugaggaaccgcuucugacagccgaucaagucaucgaggaaauugaggaaaugaugcagaacucccccgacccugaggaggaagaggaagugcucgaggaagaggacggcggggagaccagcucucaggccgauuccguucugcuucaggaaaugcaagcucugacacagaccuuuaauaacaacuggagcuaugagggacucagacauauguccggcucugaacugacagagcugcucgaccagguggaaggggccauccgggauuucagcgaggagcugguccagcaacuugcucgcagagacgaacuggaguuugaaaaggaggugaaaaauuccuucauuaccguucucaucgaagugcagaacaagcagaaagagcaacgggagcugaugaagaaacgcagaaaggaaaagggacuuagccugcagucuucccggauugagaaaggcaaucagaugccccucaagcgcuuuagcauggaaggcaucucuaacauucugcagagcgggaucagacaaacguucggauccucuggcaccgauaaacaguaccugaauacagucaucccuuaugagaagaaagccagcccgcccuccguggaggaccuccagaugcugaccaacauucuuuuugcgaugaaggaagauaaugagaaagugccuacacugcucaccgacuacauccugaagguccuuugccccacguga

SEQ ID NO: 69280 - RNA, 1143 nt, Artificial Sequence
  derived and/or modified sequence opt5 from FEZ2__Homo_sapiens__NP_001036013
auggccgcugacggcgauuggcaggacuucuacgaguuucaagaacccgccagaagccugcucgaucaggagaacugcaaugcguccccugaaccgggggcugaggccggagccgaagcuggcgggggagccgacggcuuccccgcuccugccuguucucuggaggagaagcugagccuuugcuuucggcccuccgauccuggggcggaacccccucgcaccgccgugagaccgaucacagagcggucucuccugcagggagacgaaauuuggaacgcucuuacggauaauuauggcaacgucaugcccguugacuggaaaagcucccacacccgcacacugcaucuccugacccugaaucucucugagaagggcgugagcgauucccugcuuuucgacacaagcgaugacgaggaacugagagagcagcucgauaugcacucuaucauuguguccugugucaacgacgaaccucuguuuaccgccgaccaagugaucgaggaaauugaggagaugaugcaggaaagccccgauccugaggacgaugaaacacccacccagucugaccggcuuuccaugcugagccaggagauccaaacgcucaaacgcuccucuaccgggagcuacgaagagagaguuaagcggcuguccgugucugagcugaaugaaauccucgaggaaauugagacagcuaucaaagaauauagcgaggagcugguccagcagcuugcccugcgcgaugaacucgaguucgaaaaggaggugaagaacuccuuuauuagcguucugaucgaggugcagaauaaacaaaaggaacauaaagagaccgcgaagaaaaagaagaaacuuaagaacggaucuucccagaauggcaaaaacgaaagaagccacaugccggggacacgguucucuauggagggaauuagcaaugucauccagaacggccugcgccauaccuuuggcaauuccggaggcgaaaagcaauaccucacgacagugauuccuuaugagaaaaagaacgggcccccuucuguggaggaccugcagauccugaccaaaauccucagagccaugaaggaagauagcgagaagguccccucccugcuuacagacuacauucugaaaguucucugccccaccuga

SEQ ID NO: 69281 - RNA, 1428 nt, Artificial Sequence
  derived and/or modified sequence opt5 from FEZF1__Homo_sapiens__NP_001019784
auggacagcuccugccacaacgccaccacaaagaugcuggcuacggcccccgcgagaggcaauaugaugucuaccagcaaaccucucgcuuucuccaucgagcggauuauggcccgcacaccggaacccaaggcccugccugugccccauuuucuucagggggcucugccuaaaggagagcccaagcacucucuccaucugaacagcuccaucccuuguaugauuccguucguccccguugccuacgauaccucuccuaaagcuggcgugacagggagcgaacccagaaaggccucccuugaggcgccugccgcucccgccgcugugccgagcgccccugcguuuucuugcuccgaccugcucaauugugcccugagccugaagggagaucucgcucgggacgcccugccccuucaacaguauaaacugguccgcccuagagugguuaaccacucuuccuuccaugcuaugggcgcccucugcuaccugaauagaggggauggacccugucaccccgccgcuggcgugaacauccacccugucgcgagcuauuuucuuucuuccccgcugcauccccagccuaagaccuaccucgccgaacgcaauaaacuggugguucccgcuguggagaaguauccuagcggcgucgccuucaaagaccugucccaggcccaacuccagcacuacaugaaggagucugcucagcugcuuagcgaaaagauugccuuuaaaacauccgauuucagcagagggucucccaacgcgaagccgaaaguguuuaccugcgagguguguggaaaggucuucaaugcucauuauaaccugacgcggcacaugccuguucacaccggcgcccgccccuuugugugcaaagugugugggaagggauucagacaggccuccacacucugccggcauaaaaucauccacacccaagaaaagccucauaaguguaaucagugcggcaaggcuuuuaaccgcagcucuacacugaauacccacacgcggauucaugccggguacaagcccuucgucugcgaguucuguggaaaaggcuuucaccagaagggcaacuacaaaaaucacaaacuuacacauagcggggagaagcaguucaaaugcaacaucuguaacaaggcuuuucaccaaguguauaaucugaccuuccauaugcacacacacaacgacaaaaagccuuuuaccugccccaccuguggaaaaggcuucugccggaauuuugaucucaagaagcauguucgcaaacugcacgacuccucucuggggcucgccagaacaccggcgggagaaccuggcacggagcccccucccccgcugccccagcagccucccaugacccuuccuccccugcaaccuccccucccgacaccugggccccugcagccuggacuucaucagggccaccaguga

SEQ ID NO: 69282 - RNA, 1380 nt, Artificial Sequence
  derived and/or modified sequence opt5 from FEZF2__Homo_sapiens__NP_060478
auggccagcuccgcuucucuggagaccauggugcccccugccugcccgagagcgggcgcuagccccgccacauccaagacgcucgccuucucuaucgaacggauuauggcuaaaaccagcgagccucgcgcccccuuugaaccuagacccggggcucuggaggccgacggaucccagggcaagaaacuucugaaccucuguucuccucugccgugcaugaucccccuucaaccucugggguacgaaguccccagcaagacacuccuguccuauagcgagcuguggaaaucuucccuccgggcgggaggcgggggaggcggcgggggaggcgggggaggcgggggaggcggcgccccuguuuguggggcuagcggacugugcaagaccaauuguggcgugugcuguaaggccgagcuugggcuggcucccucugcccucccggcgggacgcgugauuaaaccucaggucaucaaccaggccgugggccugcccgcuuccgggagccuuuacuauuucaauuaccuggauucuacagccuauccucccuccgaacuccugagcggacaccuguuucccuccggccuccugaacgcucaggccccugccgcucuugcggcccauccgaagcuguuccuccuggagaaugcuaaacuugccggccuggccgcugacaaguuuccccacccugcccccuacccucauaaagaaagacuccccgcgccgcuggagcaaguucugaaggagaacucugcucucaccgccgaacgcgggggagugaagggccacagcaaacugccugggggauccgccgauggcaagcccaaaaauuucacaugcgaggucugugggaagguguuuaacgcucauuauaaucuuacccggcacaugccuguucacacgggcgccagacccuucgugugcaaagucuguggaaagggcuuucggcaggcuagcacccugugccgccauaaaauuauccacacacaggaaaagccucauaagugcaaccagugugggaaagccuucaauagaucuuccacccucaacacacacauccggauucacgcgggauacaagcccuuugugugcgaguucuguggcaaaggguuucaucaaaagggaaauuacaaaaaccacaagcugacccauagcggcgaaaagcaguauaaaugcacgaucuguaauaaggccuuccaccagguguacaaccuuacauuccauaugcacacccacaacgacaaaaagccguuuacaugcgcuaccugugggaaaggcuucugccgcaauuuugaucugaagaagcaugucagaaaacuccacgacucuguuggaccugccgcucccagcgccaaggaucugacccggacagugcaguccuga

SEQ ID NO: 69283 - RNA, 903 nt, Artificial Sequence
  derived and/or modified sequence opt5 from FFAR1__Homo_sapiens__NP_005294
auggaccugcccccucagcucagcuucggccuguacguggccgcuuuugcccuuggguucccgcugaacguccucgcgaucagaggagcuaccgcccacgcccggcugcgccuuacacccucccugguuuaugcucucaaucugggcugcucugaucugcuccugacggugagccuuccucugaaggccguggaggcucucgccuccggggcguggccccugccugccucucuuugucccgucuuugcuguggcccauuucuuuccucuguacgcuggaggcggguuccucgccgcgcugagcgccggaagauaucugggcgcugccuuuccgcucggcuaccaggcuuuccggcgccccugcuauuccuggggaguuugugccgccauuugggcucuggugcuuugccaccuggggcucgucuuuggccuggaagcgccugggggauggcuugaccauucuaacaccagccugggcaucaauacacccgugaacggguccccuguuugucucgaggccugggaucccgcuagcgccggaccggccagauucucucugucccugcuccuguuuuuccuuccucuggcuauuaccgccuuuugcuacgugggcugucuccgggcgcuggcucgcagcggccuuacacacagacggaaacugcgcgccgccugggucgcugggggagcccuccugacccugcuccugugcgugggccccuauaaugcuucuaacguggccuccuuccuuuacccuaaucucgggggaagcuggagaaagcugggccugaucacaggggcguggucugucguucugaacccccuugugaccggauaccucggccggggccccgggcugaaaacggugugugccgcucgcacccaaggaggcaagucccagaaauga

SEQ ID NO: 69284 - RNA, 993 nt, Artificial Sequence
  derived and/or modified sequence opt5 from FFAR2__Homo_sapiens__NP_005297
augcugcccgacuggaaaagcucccucauccugauggccuacauuaucauuuuccuuaccggccugccugcuaaccuccuggcccuuagagcguuuguggggcggauccgccagccgcaacccgcuccuguccacauucugcuccugucucugacacucgccgaucugcuucugcuccugcuucugcccuucaagaucaucgaggccgcuagcaauuuuagaugguaucucccuaagguugugugcgcccugacguccuucggauuuuacucuagcauuuauuguuccaccuggcugcucgcuggcaucucuauugaacgguaccuggggguggccuuccccguccaguauaaacuuagccgcagaccucuguacggagugaucgcggcccucguugcuugggugauguccuuuggccauugcacaauugucaucauugugcaguaucugaacaccacagagcagguucggagcgggaaugaaaucaccuguuacgagaacuucacagacaaucaacuugaugugguccugccggugcgccucgaacugugccuggugcucuuuuucauccccauggccgucaccaucuuuuguuacuggagauucguuuggauuaugcugucucagccucuugugggagcucagcggcgcagacgggccgugggccuggcggucgugacgcuccugaacuuucuuguuugcuucggccccuauaaugugucccaccuggucggguaccaucagcgcaagagcccuugguggagaucuauugccgugguuuucuccagccucaacgcuucucuggacccccugcucuuuuauuucuccagcuccgugguccggcgcgccuuuggaagaggccugcaagugcuucggaaucaggggucuagccugcucggaagacgcggcaaagauaccgcugaggggacaaacgaggaccggggagucggccagggcgaagggaugccguccagcgauuucaccacagaguga

SEQ ID NO: 69285 - RNA, 1041 nt, Artificial Sequence
  derived and/or modified sequence opt5 from FFAR3__Homo_sapiens__NP_005295
auggacaccggccccgaucagagcuacuucuccgggaaccacugguuuguguucucugucuaucugcucacauuucugguuggacuuccucugaaucuccuggcccuugugguguucgucggcaagcugcaaagacggccgguggcuguugacgugcuccugcugaaccucacggccagcgaucugcuucugcuccuguuucuucccuuccgcauggucgaggcggcuaaugggaugcauuggccucugcccuuuauccucugcccucuguccggauucauuuucuucaccacaaucuaccugaccgcccucuuucuggccgcugugucuauugaaagauuccuuagcguugcccacccccugugguauaaaacacggccucgccucggccaggcugggcugguguccgucgccuguuggcuucuggcgucugcccauugcagcgugguguacgucaucgaguuuuccggagacauuagccacucucagggcaccaacggcacauguuaucucgaauuuagaaaggaucagcuggcuauccugcucccgguucggcuggagauggccguggugcuuuucgucgugccccugaucauuaccuccuacugcuauagccgccucguuuggauccuggggagaggaggcucucaucggcgccaaagacggguggcugggcuucuggccgcgacgcuccugaauuuucuggucuguuucggaccuuacaacgugucccacguugugggcuacauuugcggggaaagccccgccuggcgcaucuaugucacccuccugucuacacuuaauuccuguguggacccuuuugucuacuauuucagcuccucuggauuucaggcugauuuccacgagcugcucagacggcugugcggccuguggggccaguggcagcaagagagcuccauggaacuuaaagagcagaaagggggagaggaacagcgcgccgacagacccgcugagcggaagaccagcgaacauucucagggcugugggacaggaggccaaguggccugcgccgaguccuga

SEQ ID NO: 69286 - RNA, 1086 nt, Artificial Sequence
  derived and/or modified sequence opt5 from FFAR4__Homo_sapiens__NP_001182684
augagccccgagugcgccagagcugccggcgacgcgccucugcggucccucgaacaggcuaaccgcaccagauucccguuuuucucugaugugaagggggaccaccggcugguccuugccgccguugagacaacggugcuggugcucaucuuugcugucagccugcuuggaaaugugugugcccugguucucguggcucgcagacggcgcagaggcgccaccgcgugccugguccugaaccucuucugugccgaucugcuuuuuauuuccgcuaucccccuggugcucgccguucgguggacagaggcuuggcugcuugggccuguggccugccaucuucucuucuacgucaugacccugucuggaagcgugacaauucugacccucgcggccgugucccuggaacgcauggucuguaucguucaccuucaaagaggcgugcgggggcccggacgcagagcucgggccgugcugcucgcucugauuuggggcuauucugccgucgccgcucugccucugugcguguuuuuccgcguugugccccagagacucccuggcgcggaccaggaaaucagcaucuguacacugauuuggccgaccauccccggggagauuuccugggaugucagcuuugugacgcugaauuuccucguuccuggacuggugaucgucauuucuuacuccaaaauccuucagauuaccaaggccagccggaaaagacugacagugucucucgcuuauuccgagagccaucaaauccgcgucucucagcaggacuuucggcuguucagaacccuuuuucugcucaugguguccuucuucaucauguggagccccauuaucauuacaauccugcugauucucauccagaacuuuaagcaagaucugguuaucuggccuucccuuuucuuuuggguggucgccuucaccuuugccaauucugcucugaaccccauucucuacaauaugacgcugugccgcaacgaauggaaaaagaucuucuguugcuuuugguucccggagaagggcgccauucugacagacaccagcgugaaacggaaugaucuuuccaucauuagcggguga

SEQ ID NO: 69287 - RNA, 2601 nt, Artificial Sequence
  derived and/or modified sequence opt5 from FGA__Homo_sapiens__NP_000499
auguucagcaugagaaucgugugccugguccucuccguugugggcaccgccuggacagcugacucuggggagggagauuuucuggccgaaggcgggggagugcggggcccccgcgucguggagagacaccagagcgcguguaaggacuccgauuggccuuucugcucugacgaagauuggaacuacaaauguccgagcgggugccggaugaagggacuuauugacgagguuaaucaagauuuuacgaaccgcaucaauaaacugaagaacucccucuucgaauaucagaaaaauaacaaggacucucauagccugaccacaaauauuauggagauccuuagaggcgauuuuuccagcgcuaacaaucgggacaacaccuacaaucgcgugucugaggaucugagaucccggauugaaguccucaagcgcaaagugaucgagaagguucagcacauccagcugcugcaaaagaacgugagagcccagcucgucgacaugaagcggcuggaaguggauauugacaucaaaauucgcagcuguagaggcucuugcucccgggcccuugcucgcgagguggaccugaaggauuaugaggaccagcagaagcaacucgaacaggucaucgccaaagaucugcuucccagcagagaccggcagcaucugccucucauuaagaugaaacccguuccugaucuggugcccgggaauuucaagucucagcugcaaaaagugccuccggaguggaaggcucucacagacaugccccagaugagaauggaacuggagcgcccuggaggcaacgaaaucaccagagggggauccacaagcuacggcaccggguccgagacggagucuccccggaauccuagcuccgccggaagcuggaacucuggcuccagcggccccgggucuaccggaaaccgcaauccgggcagcuccgggacaggaggcaccgcgacauggaaaccugggucuagcggacccggcuccaccggcagcuggaacucuggguccagcggaacgggcucuacagggaaucagaacccuggaagcccccggcccggcuccaccgggacauggaauccuggcuccucugaaagaggaagcgccggccacuggaccuccgagucuagcgucuccgggagcaccggacaauggcauucugaauccggcagcuuucgcccggauucucccggguccggaaacgcucggccuaauaaccccgacuggggcacauucgaggaagugagcgggaauguuucuccuggcacgagacgcgaguaucacaccgagaaacuugugacaagcaagggagauaaagaacugcggaccggcaaggagaaagucacauccgggagcaccacgacaaccagacgcucuuguuccaagaccgugacaaaaaccguuauuggacccgacggccacaaggaagugacaaaggaggucgugacgagcgaagauggguccgacugcccggaggccauggaccucggaacccugucuggcaucgggacacuugauggcuuucggcauagacacccugacgaggcugccuucuuugauaccgcgagcacaggaaaaaccuuccccggcuuuuucuccccuaugcugggggaguucgucucugaaacggaaagccggggauccgagucuggcaucuuuaccaacacaaaggagagcuccagccaucaccccgggauugccgaguucccuucucgcggaaaauccagcucuuacuccaagcaguuuaccagcucuacauccuauaauagaggcgacagcaccuucgaauccaaaagcuacaagauggcugaugaagccgggucugaggcugaccacgaaggcacgcauagcacaaagcggggacacgccaaauccagacccgugcgcgauugugacgauguucuccagacccauccgucuggcacacagagcgggaucuuuaacauuaagcugccuggauccucuaaaaucuucagcguguacugcgaccaagagaccucccugggcggguggcuccugauucagcagcggauggauggaucucuuaauuuuaacagaaccuggcaggacuauaagcgcggcuucggcagccugaaugaugagggggaaggagaguuuuggcucggcaacgacuaccugcaccuucugacacaaagaggguccguccuccggguggaacuggaggacugggccggaaacgaggcuuaugcggaauaccauuuccgcguuggcagcgaggccgaaggguaugcucuccaggugucuuccuacgagggaacggccggcgaugcccugaucgaaggcagcgucgaggaaggggcugaguauaccucucacaauaacaugcaguuuuccacauucgacagagaugccgaccagugggaggaaaauugugcggagguguacggaggcggguggugguacaacaauugccaagcugccaaccugaauggaaucuauuaccccggcgggagcuaugauccccggaacaauuccccuuacgaaauugagaacggagugguuugggucucuuuucgcggcgccgacuauagccuuagagcugugcggaugaaaauccgcccgcuggugacccaguga

SEQ ID NO: 69288 - RNA, 1476 nt, Artificial Sequence
  derived and/or modified sequence opt5 from FGB__Homo_sapiens__NP_005132
augaagagaauggugagcugguccuuccacaaacugaagaccaugaaacaucuccugcuucugcuccugugcgucuuucuuguuaagucucagggcgugaacgacaaugaggaaggguucuuuagcgcccggggacaccgcccccuggauaaaaagagagaggaagcuccuucccuccggccggcgcccccucccaucucuggcgggggauaccgcgccagaccugcuaaggccgccgcuacacagaaaaagguggagcggaaagcccccgacgcuggcgggugucugcaugccgauccugaccugggaguccucugcccgacgggcugucaacugcaggaagcgcuucugcagcaagagcgccccauuagaaacagcguggaugagcucaauaacaauguugaagccgugucccagaccucuagcuccagcuuccaguauauguaccugcuuaaggaccuguggcagaaacggcaaaagcaggucaaggauaacgagaaugugguuaacgaauauucuuccgagcucgagaaacaccagcuguacaucgacgaaacagugaauagcaacauuccuaccaaucugcgcguccucagaucuauccuggagaaccuucgguccaagauucagaaacuggaaagcgaugugucugcucaaauggaguauugccgcacacccuguaccguguccugcaauaucccugucguuagcggcaaggaaugugaggagaucauuagaaaagggggagaaacauccgagauguaccucauccagcccgacucuagcgugaagccguaucggguguacugcgauaugaacaccgaaaauggcggguggacggucauucagaaccgccaagacggauccguggauuuuggcagaaaaugggacccuuacaagcagggguucggaaacguugccaccaauacagacggcaagaacuauuguggccugcccggggaguacuggcuuggaaaugauaaaaucagccagcugacccggaugggcccuacagaacuccugauugagauggaggacuggaagggggauaaagugaaggcucauuauggaggcuuuaccguccagaacgaagccaauaaauaccaaaucucugugaacaaguauagagggacggcgggaaaugcccugauggacggcgcuucccagcucaugggcgagaaccgcacaaugaccauucacaaugggauguucuuuagcacauacgaucgggacaacgauggauggcugaccucugaccccagaaagcagugcagcaaagaagauggcgggggauggugguauaaucgcugucacgccgcuaaccccaauggccgguacuacuggggcgggcaguauaccugggacauggccaagcauggaacagaugacggcguuguguggaugaacuggaaaggguccugguacucuaugagaaagaugagcaugaaaauccgcccuuucuuuccgcaacaguga

SEQ ID NO: 69289 - RNA, 2886 nt, Artificial Sequence
  derived and/or modified sequence opt5 from FGD1__Homo_sapiens__NP_004454
augcacggccauagagcccccgggggagcuggcccuuccgagccggaacaccccgccaccaacccucccggggcggcuccucccgccugcgccgacuccgauccuggagcuucugagccgggccugcucgcccggcgcgggagcggauccgcucugggcggcccccuugacccucaguucguggggcccucugauacaagccugggagccgcgccuggccauagaguccuccccugugggccguccccucaacaccaucgggcccugcgcuuuucuuaccaccuugaaggaagccagcccagaccuggccugcaccaggggaaucggauccucguuaagucccugagccuggaccccggacagucucucgagccccauccugaaggcccgcaacgccugagauccgaucccggcccucccacggagaccccuagccagcggcccucuccgcuuaaacgcgcuccugggcccaagccucaggugcccccuaaacccuccuaucugcagaugccgagaaugccuccuccccucgagcccauuccgcccccucccagccggccucugcccgccgacccucgcguggcuaagggacuugcccccagagcggaagccucuccguccagcgcugccgucuccucucugaucgagaaauucgaacgggagccugugauuguugcuagcgaucgccccgugccuggccccuccccggggccucccgagccugucaugcucccccaacccacaagccagccuccggugccccagcugccugaaggagaggccucuagaugccuguuucuccuggcccccggcccucgggacggggaaaagguucccaacagagauuccggaaucgacagcauuucuagcccuuccaauucugaggaaaccuguuucgugagcgaugacggcccgcccucccacagccuuugcccugggcccccugcucuggcgucuguccccguggcccucgcugauccgcaucgcccugggucccaggagguggacagcgaccuggaggaagaggaugacgaagaggaagaggaggaaaaggaucgggagauccccgucccccuuauggaaagacaagagucuguugaacugacagugcagcagaaaguguuucacaucgccaacgagcuccugcaaaccgagaaggccuacgucucccgccugcaccuccuggaccagguguucugugcucggcuucuggaagaggccagaaaucgcagcuccuuuccugcggauguugugcauggaauuuucucuaacaucugcagcauuuauuguuuucaccagcaguuccuccugcccgaacuugagaaacggauggaggaaugggacagauacccucgcaucggcgauauucugcaaaagcucgcuccguuucugaaaauguauggggaguacgucaagaauuucgaccgggccguggaacugguuaacacauggaccgagagauccacgcaguuuaaggugaucauucaugaaguccagaaagaggaggccugcggaaaucucacccugcagcaccauaugcuugaacccgugcaacgcaucccucgguaugagcugcuccugaaggauuaccugcuuaaacucccccacggcucuccugacagcaaggaugcucagaaaucccuggaacugaucgccacagcugccgagcacagcaacgcggccauuagaaagauggaacggaugcauaaacuccugaaggucuacgagcuucugggcggcgaggaagacaucgugucucccaccaaggagcucauuaaagaaggacacauccugaagcuguccgcuaaaaauggcacaacccaggaccgcuaucuuauucucuucaacgauagacugcuguacuguguuccgcggcucagacugcuugggcagaaguucagcgugcgcgcccggaucgacgucgauggaauggagcugaaagaaucuuccaaucucaaccugccuagaacguuucuggugagcggcaagcaacgcucucuugagcuccaggcuagaacagaggaagagaagaaagacuggguucaggccaucaauagcacccugcugaagcaugaacagacacucgagaccuucaaacugcuuaacuccaccaaccgggaggaugaagacacacccccuaauagccccaacguggaucuggggaagcgcgcgccuacgcccauuagagagaaagaagucaccaugugcaugcggugucaagagccguuuaauucuaucacaaagcgcagacaccacugcaaggccugcggacaugugguguguggcaaaugcuccgaguuccgggcucgccucguuuaugacaacaauagaagcaaccgggucuguaccgauugcuacguggcccugcacggggugccuggcuccucucccgcuuguagccagcauacaccccagcgcagacgguccauucuggagaagcaagccucugucgccgcugagaauagcgugaucugcuccuuucuucacuauauggaaaaaggaggcaagggguggcauaaagcgugguucguugugccugagaacgaaccgcucguccuguacauuuauggagcuccccaggacgugaaggcccagagaucucugccucucaucggcuuugagguugggcccccugaagccggagagcgccccgaucggagacacguguucaagaucacccagagccaccuguccugguacuuuagcccugagacggaagaacuucaacgccgguggauggccguccugggcagagcugggcgcggcgacacauucuguccgggacccacccucucugaagaucgggagauggaagaggccccuguggcggcucugggcgccaccgccgagcccccugaaagcccccagacaagagacaaaaccuga

SEQ ID NO: 69290 - RNA, 1968 nt, Artificial Sequence
  derived and/or modified sequence opt5 from FGD2__Homo_sapiens__NP_775829
augaagggcgccagcgaggaaaaacuggcuuccgugucuaaccucgucaccguuuucgagaauagcagaacacccgaagccgcgccucgggggcagcgccuggaggacgugcaccauagaccggaaugccggcccccugagucccccggaccucgcgagaagacgaacgugggcgaagcugucgggucugagcccagaaccgugagccggcgcuaccuuaauucccugaaaaacaagcucucuagcgaagccuggagaaaauccugucaaccuguuacacugagcggaucuggcacccaggagccggagaagaagaucgugcaggaacuucuggagacagaacaggccuaugucgcucggcuccaucugcuggaucaaguguuuuuccaggagcuccugaaaaccgcccgcuccagcaaggcuuuucccgaagacguugugagagucauuuucucuaauaucuccagcauuuaccaguuucacucucaguucuuucuuccugagcugcaacggcgccucgaugacuggacagccaaccccagaaucggggaugugauucagaaacuggcgccuuuccuuaagauguauuccgaguacgugaaaaauuuugaacgggccgcugagcugcucgccaccuggacggacaagagcccccuguuccaggaaguccugacccgcauccaguccucugaggcuagcggaucccucacacugcaacaccauaugcuugaaccgguucagagaaucccucgguaugagcugcuccugaaggaguacauucagaaacuucccgcccaagcgccugaucaggccgacgcucagaaggcccuggauaugaucuuuagcgcugcccagcacucuaacgccgcuauuaccgaaauggagagacuccaagaccugugggaaguguaucagcgccugggccucgaggaugacaucguggaucccuccaauacacugcuucgggaaggccccguccugaaaauuagcuucagacgcaacgacccuauggagcgguaccucuuucuguucaauaacaugcuucuguacugcgugccgagaguuauccaggugggggcgcaguuccaaguccgcacccggauugacguggccggaaugaagguuagagagcucauggaugcugaauuuccccacucuuuccuggugagcggcaaacagcgcacgcuggagcuccaggcccggucccaggaagagaugaucucuuggaugcaagccuuucaggcugccaucgaccagauugagaagagaaaugaaacauucaaagcggcugcccaggggccugagggagauauccaagaacaggagcugcagagcgaggaacuuggccugcgcgcuccccaauggguccgggacaagauggugaccauguguaugagaugccaggagccuuuuaacgcccucacacggcgcagacaucacugucgggccugcggguaugucgugugugcuagaugcuccgauuaccgcgccgaacugaaguaugacgauaaucggcccaacagaguuugucugcauugcuacgcguuccuuaccggaaacgugcucccggaggccaaagaagacaagcgcagaggcauucuggagaaaggcagcucugcuaccccugaucagucccugauguguagcuuucuccagcugaucggggacaaguggggaaaaucuggcccccggggguggugcgucauuccucgcgaugacccccuugugcuguauguuuacgccgcuccucaagacaugagagcccacacauccaucccccuccugggauaucaggugacggucggcccgcagggggauccucggguguuccagcugcaacagagcggacagcuuuacaccuuuaaggcggaaacagaggagcucaagggccgcugggugaaagccauggaaagagcugccuccggcuggucucccagcuggcccaaugacggggaucuguccgacuga

SEQ ID NO: 69291 - RNA, 2178 nt, Artificial Sequence
  derived and/or modified sequence opt5 from FGD3__Homo_sapiens__NP_001077005
auggagagcggcagaggguccucuacacccccuggaccgaucgccgcucugggcaugcccgacaccgggccuggaagcuccucucugggcaagcugcaggcccuucccguggggccucgggcgcacugcggagaucccgucagccuggcugccgccggcgacggcuccccugauauugggccgacgggagaacucucuggcagccugaaaauccccaaccgcgacuccgggauugauagcccuucuuccagcguugcuggagagaauuuccccugugaagagggccuugaagccgggccuucucccaccgugcugggagcucaugccgagauggcgcucgacucccaagugccgaaggucacaccucaggaggaagccgauagcgacgugggcgaggaacccgauucugagaacaccccucagaaagcugacaaggaugccggccuggcucagcacuccgggccccaaaaacugcuccauaucgcccaggagcugcuucacacagaagagaccuacguuaagagacugcaucuccuggaccagguguuuugcacacggcuuaccgaugcgggcauucccccugaagucaucaugggaaucuucagcaauauuuccucuauccaccgcuuucacgggcaguuccugcucccggagcugaagacgagaauuaccgaagagugggacacaaacccccggcugggagacauccuccaaaaacuggccccuuuucuuaagauguauggcgaguacgugaaaaauuucgaucgcgcuguugggcuggugagcaccuggacacagagaagcccccucuuuaaggacgucgugcauuccauucagaaacaggaaguguguggaaaccugacccuucaacaccauaugcuggagccuguccagcggguuccccgcuaugaacuccugcugaaggauuaccucaagagacugccgcaggacgccccugaucggaaagacgcugagcgcucucuugaacugaucuccacggccgccaaucacagcaacgcugcgauuagaaagguggagaaaaugcacaagcuccuggagguguaugaacaacuuggcggcgaggaagauaucgucaaucccgccaacgagcugaucaaagaagggcagauucagaagcucucugcuaaaaauggaacaccucaggaccggcaucuguuccuguuuaacagcaugauccucuacugcgugcccaagcugcgccuuaugggccaaaaguucuccguuagagagaaaauggauauuucugggcuccaggugcaggacaucgucaagccuaauaccgcccacacauuuauuaucaccggacggaaaagaagccuggagcugcagacccgcacagaagaggaaaagaaagaguggauccaaauuauccaggccacgauugagaagcauaagcagaacuccgaaaccuucaaggcuuuuggcggggccuucagccaggaugaggaccccucucuguccccggacaugccuaucacaagcaccucucccguggaacccguugugacaaccgagggcuccagcggagcggcuggccuugaaccucggaaacucuccucuaaaacgagacgcgauaaggagaaacaaagcuguaaguccugcggggagacauucaauucuauuaccaagcggagacaccauuguaaacugugcggagccgucaucuguggcaagugcagcgaauuuaaagccgagaacucccgccagagccggguguguagagacugcuuccugacccagccggucgcucccgaaucuacagagaagaccccuacagccgauccccagccuucccuccugugcgggccccuucgccugagcgaaucuggagagacgugguccgaggugugggcugccaucccuaugagcgacccccaaguucuccaucugcagggcgggucucaggauggccggcugccgagaaccauuccucuucccagcuguaaacucuccgugccugaccccgaggaacgccuggauagcggacacgucuggaagcugcaaugggcgaagcagucuugguaucucuccgccagcuccgcugaacugcagcagcaauggcuugagacacugucuaccgccgcucacggcgacacagcccaggauagcccgggggcgcuccagcuccaggugccuaugggagccgcugcccccuga

SEQ ID NO: 69292 - RNA, 2637 nt, Artificial Sequence
  derived and/or modified sequence opt5 from FGD4__Homo_sapiens__NP_001291409
augaacuucaagagagugaaacccaauaucuuucugcucaaccagagccggcugauuaucuccauuugcgagaucaugucuaccgaccaaggcagcuccacauguccuaagauugcccuugucccgcccugcucuacgagcuccaccacaacccugguuggggaaaaugugucugaggaagaggcucagggaaucaacggcaaucgcccugccaaacacagcgcggcuucccccaagccucaggugcccccuaaaccgcuccaucugcagaacagccccucuuccaauauccaccaaacaccuagacauaaggcccuucccagcgccaagccucggauggaagagauuaaacccgcuucugccuccugugucagcaaggagaaaccgucuaagguguccgaucugaucagccgcuucgaagggggauccucucucagcaacuacuccgaccugaaaaaggagagcgcuguuaaucugaacgccccuagaacccccggccggcacgggcucacaaccacgccucagcagaagcugcuuucucagcaucugccccaacgccagggaaaugauaccgacaaaacacagggcgcgcagaccugcguggccaacggcgucauggcugcccaaaaucagauggaaugugaggaggaaaaggcugccacacucuccagcgauaccucuauucaggcgagcgagccccugcuugacacgcacaucgugaacggggaaagagaugagacagccaccgcuccugccuccccgacaaccgacucuugcgauggaaaugcuagcgacuccagcuaucggacccccggcauugggccuguucugccccucgaagaacgcggagccgagacagaaacgaaagugcaagagagagaaaacggcgagucuccucuggaacuggagcagcucgaucagcaccaugagaugaaggaaaccaacgagcagaaacugcacaagaucgccaaugaacuucugcucacagagcgggcuuacgucaaccgccuggaccuucuggaucaaguguuuuauuguaaacuccuggaagaggcgaauagaggguccuuccccgccgagauggugaacaagauuuuuagcaauaucucuuccaucaacgcuuuccauagcaaguuucugcucccggaacuggagaaacggaugcaggaaugggagaccacaccucgcauuggagacauccuucagaagcuggcccccuuccucaaaauguacggcgaguaugucaagggcuuugacaaugccauggaacugguuaaaaacaugaccgagcggauuccucaguucaaguccgugguggaagagauccaaaagcagaaaauuugcgggucucuuacgcugcagcaccacaugcucgaacccguccagagaaucccuagauacgagaugcugcugaaggauuaucuccgcaaacugcccccggacagccuugauuggaaugacgcuaagaaaucccuggagaucauuucuacagccgcgagccauuccaacagcgcuauccggaagauggaaaaucucaagaaacugcuggagauuuacgaaaugcuuggagaggaagaggauaucgugaacccuucuaaugagcucauuaaggaaggccaaauccugaaacuggccgccagaaacaccuccgcucaggagcgcuaccucuuucuguucaauaacaugcuucuguauuguguucccaaguuuagccucguggggucuaaauucaccguccggacaagagugggaaucgacggcaugaagauuguugaaacccagaacgaggaauacccccacacauuccagguguccgggaaggagcgcacgcuggagcugcaagccagcucugcucaggauaaagaagaguggaucaaggcccuucaggaaaccauugacgcguuucaucaacggcacgagacauucagaaaugccaucgcuaaagauaacgacauucauagcgaggucuccaccgccgaacucggaaagcgcgcuccucgguggaucagagauaaugaggugacaaugugcaugaaauguaaggaaccguuuaacgcccugacccgccggagacaccacugccgggcgugcggcuaugucguguguuggaaaugcagcgacuacaaggcccagcuggaguaugacggcgggaagcucucuaaaguuuguaaggauugcuaccagauuaucuccggauucacggacagcgaagagaaaaagcgcaaaggcauccuggagauugaauccgcugaggugucugggaauagcgucguguguuccuuucuucaguauauggaaaagucuaagcccuggcaaaaagccuggugcguuaucccuaagcaggauccccuggugcucuacauguacggagcuccucaggacgucagagcccaggccaccauuccccugcugggcuaugugguggaugagaugccucggagcgcugaccuuccccauuccuucaaacucacacaaucuaagagcguucacuccuuugcggccgauagcgaggagcugaaacagaaguggcugaaggucauccuccuggcugugaccggggagacaccgggcggaccuaacgaacaucccgccacccuugacgaucacccugagcccaaaaagaaaucugaauguuga

SEQ ID NO: 69293 - RNA, 4389 nt, Artificial Sequence
  derived and/or modified sequence opt5 from FGD5__Homo_sapiens__NP_689749
auguucagaggccccaagccuccgaucgcccccaaaccucggcugaccgcucccaacgaguggcgcgccagcguguaccucaaugacucccugaacaagugcucuaaugggagacuuccuugugucgaucggggacuggacgaaggcccccgcagcauuccuaaaugcuccgagucugaaacagaugaggacuauaucguugugccgagagugccccuccgggaagaugagccuaaggacgaggggagcgucggaaacaaagcgcuggugucccccgaaucuagcgcugaggaagaggaggaacgcgaggaaggcggggaggccuguggacuugaaggcacgggcgccggggaggauuccguugcuccugccgcucccggagccggcgcgcugagcagagagggggaagagggaaccgaccucgcccuggaagaugagggcgaagggugcgcugacgagccgggaacacuggaacaggugucucgguccgaagaggaagagaagcucguccaaccucaccgcgaauguagccuggaggauucuggccccugggccggcgaggggguguuucaguccgaccuucugcucccucauauucacggagaagaucaggagccucccgacacccccggcgaagcugaggaggacgaugaagaggggugcgccagcacagacccggcgggagccgaugaaggcucugggcccgacagaccuaccgaggauaugggacaggacgcugaagauacauccgaggagcccccugaaaaggaggaacuggccggcguucaagaggcugaaaccgccacggacugucccgaggugcuugaggaaggcugcgaggaagccaccggggucacaggaggcgaacagguggaucugagcgaaccgccugaccaugagaaaaagaccaaucaggagguggcugcggccacacucgaagaucacgcucaggacgaguccgccgaagagucuugucaaaucguccccuucgagaacgacugcauggaagauuuuguuaccagccugacgggguccccuuacgaguucuuucccacagaaagcaccucuuucuguuccgagagcugcucuccucugagcgaauccgccaaaggacucgagucugagcaggcucccaagcugggccuucgggccgaagagaauccgauggugggggcgcugugcggccaguguggaagccuccagggcggggcugccgaaggaccugccgcucccgacguggucgugguucuggaggaagaggcccuugaugacgcucuggccaaccccuaugugaugggcgucgggcucccuggacaagcggccccgggcgaagggggccaggcugccuccgaugcucugggaggcuacgggagcaaagaagaacugaauugcgaagccgagggaggccucgugcccgcggaccgcaagaacacaucuaccagaguucggccucauuccgggaagguggccggauauguccccgaaaccgugccugaggagacaggccccgaagcugggagcucugccccuggcauuggaggcgcugccgaggaagucgggaaaacgcugcuuucccuggagggaaagccccucgaggccagccgcgcucugccggcgaaaccuagagccuuuacccuuuacccccgguccuucucuguggaaggcagagagaucccuguuagcguguaucaggaacccgagggguccggacuggaugaccaccgcaucaagcggaaagaagauaaucucucucugagcugugucauuggcuccagcgggucuuuuucccaaagaaaccaucugccgagcucuggcacauccaccccuagcucuaugguggacauucccccucccuucgaucucgcuugcaucacaaagaaacccaucaccaagagcuccccuagccugcuuauugagucugacuccccggauaaguacaaaaagaaaaagagcuccuuuaaacgcuuccuggcccucacguuuaagaagaaaacagagaauaagcugcacguugacgugaacgucucuagcucccggucuagcuccgaaucuagcuaccacggacccuccagaauccuggagguggaccgccggagccuuucuaauuccccucagcucaaaagcagaaccggcaagcugcgcgccucugaaucccccagcucucugauuuucuaucgggaugggaaaagaaagggagugccuuucucccgcaccguuagccgggucgaguccuuugaagacagaagccggcccccuuuccucccgcugccccuuacaaagccucgcucuaucagcuuucccuccgcugauaccucugacuacgagaacaucccugccaugaacagcgauuaugagaauauucagauucccccgagacggccugcgagagcuggcgccuucacaaaacuguuugaagaccagucccgcgcccucucuacggcuaacgagaaugauggguacguggacaugagcuccuucaacgccuuugaaucuaagcaacagagcgcggaucaggacgcugaguccgccuauaccgaacccuacaaagugugucccaucagcucugccgcuccuaaggaggaucugacauccgacgaggaacagcggagcucugaggaagaggauuccgccagcagagaccccuccgucacccauaaaguggagggacaaucucgcgcucugguuaucgcccaggaacuucucagcuccgagaaggcguauguggaaaugcugcagcaccugaaucucgacuuccacggcgccgucaugagagcucuggaugacauggaucaugagggccgggacacacuugcccgcgaggagcugagacaggggcucagcgagcugccugcuauucacgaucugcaucaaggaauccuugaggagcucgaggagcggcugucuaacugggaaucccagcagaagguggccgacguuuuucuggcccgcgagcagggcuucgaucaccaugcuacccacauccuccaauuugacagauaccuggggcuucugagcgagaauugccuccacucuccgcggcuggcggccgcugugcgcgaguucgagcagagcguccagggaggcucccaaacggccaaacauagacugcuucgggugguucagcgccucuuucaguaccaggugcugcugaccgauuaucucaacaaucugugucccgacucugccgaauacgauaacacacaaggggcucuuagccugauuuccaaggucaccgacagagccaaugacucuauggagcagggagaaaaccuccagaaacuggugcacaucgagcauagcgugcggggccagggcgaucugcuucaaccugggagagaguuccugaaggaaggaacacucaugaaagucaccggcaagaaucgccggcccagacaccuguuccucaugaacgacguucugcuuuauacguacccucagaaagaugggaaguaucgccugaagaauacacucgcgguggcuaacaugaaagugucccggcccgucauggagaaggugccguacgcccugaaaauugaaaccagcgagucuugccugaugcuuuccgccagcuccugugcugagagagacgaaugguauggaugccugucucgcgcccucccugaggauuacaaggcgcaggcucuggccgccuuucaccauagcguugaaauccgggagagacucggcgugucccugggggaacggcccccuacacuuguccccgugacccacguuaugauguguaugaacugcggaugcgacuucucucugacccuccgcagacaucacugucaugcuugcggcaaaauugugugucggaauugcagccgcaacaaguacccucugaaguaucugaaagauagaauggccaaggucugugacggcugcuuuggggagcuuaaaaagcggggacgcgcugugcccggccugaugagagagcggccgguuuccaugagcuucccucucucuucccccagauuuagcgggucugccuucuccagcguguuucagucuaucaaucccagcacauucaaaaagcaaaagaaagucccuuccgcgcugacggaaguggccgcuucuggagagggcagcgccaucuccggguaccucagccgcuguaagcggggaaaaagacacuggaagaaacugugguuugugauuaagggcaagguccuuuauaccuacauggcuuccgaagauaaaguugcccuggagucuaugccgcugcucggcuucacaaucgcccccgaaaaggaggaggggagcuccgaagugggaccuauuuuucaccuguaucauaaaaagacccuuuucuacucuuuuaaagcugaggacacaaacagcgcgcagcgcuggaucgaagccauggaggaugcuuccgugcuguga

SEQ ID NO: 69294 - RNA, 4293 nt, Artificial Sequence
  derived and/or modified sequence opt5 from FGD6__Homo_sapiens__NP_060821
augaccagcgccgcugagaucaagaaacccccuguggccccgaagcccaaauucgucguugcgaacaauaagccugcucccccucccauugccccuaaaccggacaucgugauuuccucugugccccagagcacaaagaagaugaaaccugccaucgcucccaagccuaaaguccugaagacgucccccgugagagaaauuggccaaucuccgagccggaaaaucaugcucaaccuggaggggcacaagcaggaacuugccgaguccaccgauaauuuuaacugcaaguacgaaggaaaucagucuaacgacuauaucagcccuauguguuccugcagcucugaguguauucauaaacugggccaccgcgagaaucucugcguuaagcagcuggugcuugaaccccuggagaugaacgaaaaucucgagaacuccaaaaucgaugagacacugaccauuaagacaagaagcaaaugugaccuguacggggaaaaggcuaaaaaucaaggaggcgucgugcucaaggccucuguucuggaggaagaacuuaaggaugcgcugauccaucagaugccucccuucauuuccgcccagaaacaccggcccaccgacagcccugaaaugaacgggggaugcaauucuaacggccaguuucgcaucgaguucgcugaucucuccccgagccccuccucuuuugagaaggugccugaccaucacagcugucaucugcaacuucccuccgaugaaugcgagcacuucgaaacaugucaggacgauagcgagaaaucuaauaacugcuuucaguccagcgaacuggaggcccucgagaacggcaagagaucuacccugauuagcuccgacggggucucuaaaaagagcgaagugaaggaucugggaccucucgagauccaccuggugcccuauacgccgaaauucccuacccccaagccucggaaaacacgcaccgcuagacuucugcggcagaagugugucgacacacccuccgaaagcaccgaggaaccuggcaauucugacuccucuagcuccugccucacggagaacagccugaaaaucaauaagauuuccguucuucaucaaaacgugcugugcaagcaggaacagguggauaaaaugaagcucgggaauaaaucugaacugaacauggagagcaauuccgacgcccaagaucuggucaacucucagaaggcgauguguaaugaaacaaccagcuuugagaaaauggcccccuccuucgacaaggauagcaaccucucuuccgacagcacaaccguggauggaucuuccaugagccuggcuguugacgagggcaccggguuuauccgcugcacagugucuaugagccuuccgaagcagcugaaacucacguguaaugaacaucugcaguccggaagaaaccuuggcgucagcgccccucaaaugcagaaggagucugugauuaaagaagaaaauucccugcggaucguucccaagaaaccccagcgccacagccucccugcuaccggcgugcugaagaaagccgccuccgaggagcugcucgagaagucuagcuacccguccucugaagaaaagagcuccgaaaaaucucuggagagaaaccaccuucagcaccugugcgcucaaaauagaggggucagcuccagcuucgauaugcccaagcgcgcgucugaaaaaccuguguggaagcucccccauccuauucugcccuuuuccggaaacccugaguuccugaaaagcgucacagugucuuccaacagcgagcccucuaccgcccuuacaaagccgagagcuaagucccucagcgccauggacguugaaaaauguaccaagccuugcaaagauuccacgaagaaaaauagcuucaagaagcugcugucuaugaaacucagcaucuguuuuaugaaguccgacuuccagaaauuuuggucuaagagcucccagcugggcgacacaaccaccgggcaccuuucuagcggagagcagaaaggcaucgaauccgauuggcaagggcugcucgugggagaggaaaagcggucuaagcccauuaaagccuauagcacagagaacuacucccuggagagccagaagaaaagaaagaaaucucgcggccagaccuccgcugccaauggccugcgggcggaaagccuugacgaucagaugcucucuagagaguccagcucccaagcuccuuauaagucugucacaagccugugcgcccccgaauacgagaacauccgccauuacgaggaaauuccggaguaugaaaaucugccuuucaucauggccauucggaaaacgcaggagcucgaauggcagaacuccagcucuauggaggacgcugaugccaauguguacgagguugaggagcccuaugaagcuccugacgggcaacugcagcuuggacccagacaccagcacuccagcucuggcgccagccaggaggaacaaaacgaucuggggcucggagaccugcccuccgaugaggaggaaaucaucaauucuagcgacgaggaugacguguccucugaaagcuccaagggcgagccugauccgcuggaagacaagcaggacgaggauaacgggaugaaaagcaagguccaucacauugcgaaagagaucaugucuuccgaaaagguguuuguggacguucuuaaacuccugcauauugauuuccgcgacgccgucgcucacgccagccggcagcugggcaagcccgugaucgaggaucggauucucaaucagauccuguacuaucuuccucaacuguacgaacucaaccgcgaccugcugaaggagcuugaggaacggaugcuccacuggaccgagcagcagagaauugcugauaucuuugugaaaaagggacccuaucugaaaauguacuccacauacaucaaggaguucgacaaaaauauugcccugcucgaugagcaguguaagaagaacccuggcuuugcggccgucgugcgcgaguucgagaugucuccccggugcgcuaaucuggcccuuaaacauuaucugcucaagccuguucaaagaaucccgcaguaccggcugcugcuuaccgacuaucugaaaaaccucauugaggaugcuggggacuaccgcgauacacaggacgcccuggccguggucaucgaaguggcuaaccacgcgaaugacaccaugaagcaaggagauaacuuucagaaacucaugcagauucaguauagccugaauggccaucacgagaucguucaacccgggagaguguuccuuaaggaaggaauccugaugaagcucucccggaaagucaugcagccuagaauguuuuuccuguucaacgacgcccugcuuuacacgacccccgugcagucuggcauguauaagcugaauaacaugcucagccuggcugggaugaaaguucgcaagccuacacaggaggccuaccaaaaugaacucaaaauugaguccguggagcggagcuuuauccugucugccuccagcgcuaccgaaagagaugaguggcuugaagccauuucucgcgcgaucgaggaauacgcuaagaagagaauuacauucugucccucccggagccuggacgaggccgauucugagaacaaagaagaggucagcccgcucggcuccaaggccccuaucuggauccccgacacccgcgcuacgaugugcaugauuugcacaucugaauuuacccugacauggagacggcaucacugucgcgccugcggaaaaaucgugugucaggcgugcagcuccaauaaguauggccuggauuaccuuaaaaaccagcccgcuagagugugugagcacugcuuccaggagcugcaaaagcucgaccaucagcacagcccucggauugggucccccggaaaucauaaaucuccuagcuccgcccugucuagcguccuccacuccaucccgucuggccgcaagcagaagaaaauucccgccgcucugaaggaaguuagcgccaacaccgaggauuccagcaugucuggguaucuuuacagauccaaaggaaauaagaaaccuuggaagcauuuuugguucgugaucaagaacaaagugcuguauaccuacgcugccagcgaagacgucgcggcccuggagucucagccccuccugggcuuuacagugauccaaguuaaggaugaaaauuccgagagcaaaguguuccagcuucugcacaagaacaugcucuuuuaugucuucaaagcugaggacgcccacucugcucagaaguggauugaagccuuucaagaggggacgauccuguga

SEQ ID NO: 69295 - RNA, 627 nt, Artificial Sequence
  derived and/or modified sequence opt5 from FGF10__Homo_sapiens__XP_005248321
auguggaaguggauccugacccacugcgccagcgcuuucccccaucucccuggcuguugcuguugcuguuuucugcuucuguuccucguguccucugucccgguuacaugccaggcccuggggcaagacauggugagccccgaggcgacgaacuccucuagcuccucuuuuagcuccccuagcucugcuggaagacacgugagauccuacaaucaucuucagggcgauguccgcuggagaaaacuguucagcuuuaccaaguauuuccucaaaauugaaaagaacgggaaagugucuggaacaaagaaggagaauugucccuacuccauccuggaaauuaccagcguugagaucggcguggucgccgugaaagccauuaacucuaauuauuaccuggcuaugaacaagaaagggaagcucuauggauccaaagaauuuaauaacgacugcaagcugaaggagcggaucgaggaaaauggcuacaacacauaugccagcuucaauuggcagcacaacggccgccagauguacguugcucuuaaugggaaaggagccccuagacggggccaaaagacccgccggaaaaacacauccgcgcauuuucugcccauggugguccacucuuga

SEQ ID NO: 69296 - RNA, 678 nt, Artificial Sequence
  derived and/or modified sequence opt5 from FGF11__Homo_sapiens__NP_004103
auggccgcucuggccagcucccucaucagacagaagcgggaggugcgcgaacccggcgggucuagaccugucagcgcgcaacggcgcguuugcccgagaggaaccaaaucccugugucagaagcagcuucugauucuccugucuaaagugcggcuuugcggcgggcgccccgcuagaccugaccggggacccgagccucagcugaagggcaucgugacaaaacucuucugucgccaaggguuuuaccugcaggccaaccccgauggaagcauucagggcacgccugaagacaccuccucuuucacacacuuuaaucugaucccggucggccucagagugguuaccauucagagcgccaagcuggggcauuauauggcuaugaacgccgagggacuucuguacuccagcccccacuucacagcugaaugccgguuuaaggaguguguguucgagaauuauuacguccucuaugccucugcgcuguaccgccaaagacgguccggccgcgccugguaucuugggcuggauaaagaaggacaggugaugaagggcaacagaguuaaaaagaccaaagcugccgcucauuuucucccuaagcugcuggagguggccauguaccaggaacccagccuccacucugucccugaggcgucccccagcucuccgccugcccccuga

SEQ ID NO: 69297 - RNA, 546 nt, Artificial Sequence
  derived and/or modified sequence opt5 from FGF12__Homo_sapiens__NP_004104
auggagagcaaggaaccccagcugaaaggcaucgugaccagacucuucucccaacagggguacuuucugcagaugcacccugacggaacaauugauggcacgaaggacgagaacucugauuauacccuuuucaaucugaucccggucgggcuccggguuguggccauucagggagugaaagcuagccuguacgucgccaugaacggcgaaggguaucuuuacuccucugacguguuuacacccgagugcaaguucaaagaaagcguuuuugagaauuauuacgugaucuauuccucuacccuguaccgccaacaggagagcggacgggcgugguuccucggccugaacaaggaaggccagauuaugaaggggaaucgggucaaaaagacaaaaccuuccagccauuuugugcccaagccuaucgagguuuguauguaccgcgaacccucucugcacgagaucggagagaaacagggcagauccagaaagagcucugggaccccuacaaugaacggaggcaagguggucaaucaagauuccaccuga

SEQ ID NO: 69298 - RNA, 600 nt, Artificial Sequence
  derived and/or modified sequence opt5 from FGF13__Homo_sapiens__NP_001132970
augagcggcaaggugaccaaacccaaggaggaaaaagacgccuccaaggagccucagcugaaagggaucgucacaaagcucuacucuagacaaggauaucaucugcagcuucaggcugauggcacgauugacgggaccaaggaugaagacagcacauacacccuguucaaccucaucccgguuggacugcgggugguggccauucagggcguccaaacaaaacuuuaucuggcgaugaauagcgagggguaccucuauaccucugaacuguuuacacccgagugcaaguucaaagagagcguguuugaaaacuacuauguuaccuacuccucuaugaucuaccgccagcagcagagcggaagaggcugguaucugggccucaauaaggagggggaaauuaugaaaggaaaccacgugaagaagaauaaaccugcugcccacuuccugcccaagccucuuaaagucgccauguacaaggagcccucccugcaugaucucacggaguuuagccggucuggcuccgggaccccuacaaaaagccgcucuguguccggaguucugaacggcgggaaguccaugucucacaaugaauccaccuga

SEQ ID NO: 69299 - RNA, 744 nt, Artificial Sequence
  derived and/or modified sequence opt5 from FGF14__Homo_sapiens__NP_004106
auggccgcugccaucgcgagcggccugauuagacagaagcggcaagcucgcgagcagcacugggacagacccuccgccucucggcgcagaagcuccccuucuaaaaaccgggggcucugcaauggaaaccugguggauaucuucagcaagguccgcauuuuuggccuuaaaaagagacggcugcgcagacaggacccgcagcucaaagggaucguuacccggcuguacugucgccaaggauauuaccuucagaugcaucccgauggcgcccuggacgggacaaaggaugacuccacgaacucuacccucuucaaucugauuccugugggacugagaguggucgcuauccagggcgugaagacaggccucuauaucgccaugaauggggaaggauaccuguaucccagcgagcuuuuuaccccugaaugcaaauucaaggaguccguuuuugaaaacuacuaugugauuuacagcucuaugcuguaccggcagcaagaguccggccgcgcuugguuccucgggcugaauaaagagggacaggccaugaagggcaacagagucaaaaagacaaagcccgcggcccacuuucuuccuaaaccgcuggaaguggcuauguaucgggagcccagccuccaugauguuggggaaaccgugccuaagcccggagucacaccuucuaaauccaccagcgccucugcuaucaugaauggcggcaagcccgugaacaaauccaagacgaccuga

SEQ ID NO: 69300 - RNA, 624 nt, Artificial Sequence
  derived and/or modified sequence opt5 from FGF16__Homo_sapiens__NP_003859
auggccgaggugggcggggucuucgcuagccuggacugggaucuccacggauuuuccucuagccugggcaacguuccccuugccgacuccccuggguuccugaaugaaagacucggacagaucgagggcaagcugcaacgggggucuccgaccgauuuugcgcaucuuaaaggcauucugcgcagacggcagcucuacugccgcacaggauuccaccuggaaaucuuucccaacggcacggugcaugggaccagacacgaccauagccgguucggcauucuggaguuuaucucccucgcugugggacugauuucuauccgcggggucgauagcggacuuuaucugggcaugaaugaaagaggggagcucuacggauccaagaaacugacacgggaguguguguuccgcgaacaguuugaggaaaacugguauaauaccuacgccagcacacuuuauaagcacucugacuccgagagacaguacuauguugcccugaacaaagauggcagcccucgggagggcuaccgcaccaagagacaccaaaaguucacacauuuucucccccggccuguggaccccucuaaacugccuuccaugagccgcgaucuguuccacuacagauga

SEQ ID NO: 69301 - RNA, 618 nt, Artificial Sequence
  derived and/or modified sequence opt5 from FGF17__Homo_sapiens__NP_001291407
augggcgccgcuagacugcuccccaaccugacccuuugccugcagcuccugauccuuuguugccaaacacaguacgugcgggaccagggggccaugacggaucagcugagccgcagacaaauucgggaguaucagcucuacucccgcaccucuggaaagcacguccagguuacaggcagacggaucagcgcgaccgcugaagacgggaauaaauucgccaagcugauuguggagacagauaccuuuggaucccgcgugagaaucaaaggcgccgaaucugagaaguauauuuguaugaacaaacgggggaagcugaucggaaagccuagcggcaaauccaaggacugcgucuucacagaaaucgugcucgagaauaacuacaccgcuuuucagaaugcccgccaugagggcugguucauggcuuuuacgagacaagggcggccgcgccaggccucuagaagccggcagaaccagcgcgaagcgcacuucauuaaaagacuguaucaaggacagcuucccuuuccuaaucaugccgagaagcagaaacaauucgaauuuguuggcuccgcucccacccggagaacaaagcgcacccggagaccucagccccugacauga

SEQ ID NO: 69302 - RNA, 624 nt, Artificial Sequence
  derived and/or modified sequence opt5 from FGF18__Homo_sapiens__NP_003853
auguacagcgcccccuccgcuugcaccugucugugccuccacuuccugcuucuguguuuucaggugcaaguccucguugccgaggaaaacguggacuucagaauccauguggagaaucagacacgggcgcgcgaugacgucucuagaaagcagcugcggcuuuaucagcuguacagccgcacguccggcaaacacauucaagugcucgggagacggaucucugcucgcggagaagauggcgacaaguaugcccagcugcugguugagaccgauacauuugggagccaggugagaauuaaaggaaaggaaaccgaguucuaccucugcaugaaccggaaaggcaagcuggucgggaagccugacggaacauccaaagaguguguguuuaucgaaaagguucuugagaauaacuauaccgcccugaugucugcuaaauacagcggcugguaugugggcuucacaaagaaagggcgcccgagaaagggacccaagacccgggaaaaucagcaagauguccauuuuaugaaacgcuacccuaagggccagcccgagcuccagaaaccuuucaaguacacgaccgugacaaaaagaucccggcgcauuagacccacccacccugccuga

SEQ ID NO: 69303 - RNA, 651 nt, Artificial Sequence
  derived and/or modified sequence opt5 from FGF19__Homo_sapiens__NP_005108
augagaagcggcugcguggucguucacguguggauccuggccgggcucuggcuggcuguggccggacggccccuugcguucuccgacgcuggcccucauguccacuacggguggggagauccgauucgccugagacaucucuauaccucuggcccccacgggcugagcuccuguuuucuucggauccgcgccgacggagugguugauugcgccagaggccagucugcucauagccugcucgagauuaaggccguggcucugcggacagucgccaucaaaggcgugcacuccguucgcuaccuguguaugggggcggacggaaagaugcaaggccuccugcaguauucugaagaggauugcgccuucgaagaggaaauuagaccugacggguacaacguguaucggagcgagaaacaccgccuucccgucucccugagcucugcuaagcagagacagcucuacaaaaaucggggauuucugccucuuucccauuuccugcccaugcucccuauggugccggaggaacccgaggaucugcgcggccaccuggaaagcgacauguuuucuuccccucucgagacggauagcauggaccccuucgggcuggugaccggacuugaggccgucagaucuccuuccuuugaaaaguga

SEQ ID NO: 69304 - RNA, 468 nt, Artificial Sequence
  derived and/or modified sequence opt5 from FGF1__Homo_sapiens__NP_001244139
auggccgagggcgaaaucaccacauucacggcucugaccgagaaguuuaaccugcccccugggaauuacaaaaagccgaaacuccuuuauugcagcaacggaggccacuuccugcggauucuccccgacgggacaguggauggaaccagagaccgcuccgaucagcauauccaacugcagcuuucugccgaaagcgucggcgagguuuacauuaaguccacagaaaccgggcaguaucuggcgauggacacagauggacuccuguacggcucucagaccccuaaugaggagugucuguuucucgaaagacuggaggaaaaccacuauaauacguacaucagcaaaaagcaugcugagaagaacugguucgugggccuuaaaaagaauggguccugcaaacggggaccccgcacccacuauggccaaaaggccauucuguuucucccucugcccgugucuagcgacuga

SEQ ID NO: 69305 - RNA, 636 nt, Artificial Sequence
  derived and/or modified sequence opt5 from FGF20__Homo_sapiens__NP_062825
auggcuccccuggccgaggugggcggguuccucggaggccuggaagggcuuggacagcaagucggcagccacuuucugcucccuccggccggggagagacccccucugcuuggagaacggcgcuccgcggcugagagaucugcccggggcggccccggggccgcucagcuggcccaucuccacggaauccugcgcagacggcagcuguacugccgcaccggcuuccaucuccagauucugccugacgggagcguucaaggaacaagacaggaucacucccuuuuuggcauccuggaguucauuucuguggcuguggggcucgucagcauccggggaguggacuccggccuguaucuuggcaugaacgauaagggggaacuguacggaucugagaaacucacgagcgaauguauuuuucgcgagcaguucgaagagaauugguauaacaccuacuccagcaauaucuauaagcauggcgacacagggagacgguacuuuguugcccugaacaaagauggaacaccccgcgacggcgcgagaucuaagcggcaccagaaauucacccacuuucugccucgcccgguggaucccgagagagucccugaacucuauaaggaccugcuuauguacaccuga

SEQ ID NO: 69306 - RNA, 630 nt, Artificial Sequence
  derived and/or modified sequence opt5 from FGF21__Homo_sapiens__XP_005258788
auggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuuga

SEQ ID NO: 69307 - RNA, 756 nt, Artificial Sequence
  derived and/or modified sequence opt5 from FGF23__Homo_sapiens__NP_065689
augcugggcgccagacuccggcugugggugugcgcucuuuguagcgucugcuccaugucuguucugcgcgccuaccccaacgcgagcccucuccugggguccucuuggggaggccuuauccaccuguauaccgcuacagccagaaauagcuaccaucuccagauucacaagaacgggcauguggacggagccccgcaccaaacgaucuauuccgcucugaugauucggucugaggaugccggcuucguggucaucaccggggugaugagccgcagauaccuguguauggacuuucggggaaauauuuucggcucccauuauuuugaucccgaaaacugccgcuuccagcaccagacacucgagaauggcuacgacguuuaucacagcccucaguaccauuuucuggugucucuugggagagcuaaacgggccuuccugcccggaaugaacccucccccuuacucccaauuucucagccgcagaaaugaaaucccgcugauccacuucaacacccccauuccucggcgccauacaagaucugcggaggaugacuccgaacgggauccccuuaauguccugaagccucgcgccagaaugacccccgcuccggccagcuguucucaggagcucccuuccgcugaggacaacagccccauggccuccgauccucugggcgugguuagagggggacgggugaauacacacgcgggcgggaccggacccgaaggcugccgccccuuugccaaauucaucuga

SEQ ID NO: 69308 - RNA, 867 nt, Artificial Sequence
  derived and/or modified sequence opt5 from FGF2__Homo_sapiens__NP_001997
auggugggcgucgggggaggcgacguugaggaugugacccccagaccugggggaugccagaucagcggccgcggggcccggggauguaacggcauuccgggcgcugccgcgugggaagcugcccugcccagacggcgcccuagacggcaccccuccgugaauccucgcucuagagccgcugggagcccccggacacgcggaagacggacggaggaacgcccuuccggcucuagacucggggaccggggacgcggcagagcccugcccgggggacggcuuggcggcagagggcgcggacgggcucccgagagagucggcgggcgcggacggggcagagggaccgccgcgccucgcgccgcucccgccgcucggggaagcagaccuggccccgccggcacaauggcggccggguccaucaccacacugccggcucucccugaagauggaggcucuggggccuucccgccuggacauuuuaaggaccccaaacgccuguacugcaagaacggcggguucuuucuucggauucaccccgauggcagaguggacggaguucgcgagaaaagcgauccucauaucaagcugcaacuccaggcugaggaacggggcguggucuccauuaaaggggugugugccaauagauaucuggccaugaaggaggacggacggcugcucgcuagcaagugcguuaccgaugaauguuucuuuuucgagcgccuggagucuaacaauuacaacacauauagaucccggaaauacaccagcugguauguggcgcuuaagagaacgggccaguacaaacuggggucuaagaccggaccgggccagaaagccauccucuuucugcccauguccgcuaagagcuga

SEQ ID NO: 69309 - RNA, 720 nt, Artificial Sequence
  derived and/or modified sequence opt5 from FGF3__Homo_sapiens__NP_005238
augggccugaucuggcuccugcuucugagccuccuggagcccggguggccugccgcuggaccgggcgccagacuucggcgcgacgcugggggaagaggcgggguguacgaacaccugggaggcgcgccccggcgcagaaagcucuauugcgccaccaaauaccaucugcagcugcacccuuccggccgggucaacgggucucucgagaauagcgccuauuccauucuggaaaucacagcuguugaggugggaauuguggccauccgcggccuuuucucugggagauaccuggcuaugaacaagcggggacgccucuaugccagcgaacauuacuccgcggagugugaguuugucgaacggauucacgagcugggcuauaauacguacgccucuagacuuuaccgcaccgugagcuccacacccggggcuagacggcaaccuagcgccgaacgccugugguauguuucugugaacggaaaaggcagaccccggagaggcuucaagacccgccggacacagaaauccagccucuuucugccuagaguccuggaucaucgcgaccacgagauggugcggcagcuccagucugggcugccgagacccccuggaaagggcguucaaccccgccggagacgccagaagcaguccccugauaaucuugagcccagccacgugcaggcuucucggcuggggucccaacucgaagccagcgcgcauuga

SEQ ID NO: 69310 - RNA, 621 nt, Artificial Sequence
  derived and/or modified sequence opt5 from FGF4__Homo_sapiens__XP_006718538
augagcggccccgggaccgccgcuguggcccugcucccugcgguccugcuugcucugcucgccccgugggccggaagaggcggggcugccgcucccacagccccuaacggaacgcuggaggcggaacuugagcggcgcugggaaucccugguugcccucucucuggcuagacugcccguggccgcucagccuaaggaggccgcggugcaaagcggcgccggggacuaccuccugggaaucaaacggcuucgcagacuguauugcaaugucggcauuggcuuccaccuccaggcucugcccgaugggcggaucggaggcgcccaugcugacacccgcgauucccuucuggaacucucuccuguggagagagggguugugagcauuuuuggagucgccucccgguucuuuguggccaugucuagcaagggcaaacuguacggguccccguucuuuacagacgaguguaccuucaaggaaauccugcuccccaacaauuauaacgcuuacgagagcuauaaauacccuggaauguuuauugcgcugucuaagaauggcaagaccaaaaagggcaaccgcguuucccccacaaugaaagugacacacuuccuuccuagacuguga

SEQ ID NO: 69311 - RNA, 807 nt, Artificial Sequence
  derived and/or modified sequence opt5 from FGF5__Homo_sapiens__NP_004455
augagccuguccuuccuccugcuucuguuuuucucucaccucauccugagcgccugggcccauggcgaaaagagacuugcccccaaagggcagccuggaccggcggcuaccgaccggaacccccgcggcuccucuagcagacaauccucuagcuccgccauguccucuuccagcgccucuuccagcccugcugccucucuggggucccagggaagcggccucgaacaguccucuuuucaguggagccccuccgggcggcgcacaggaagccuguacugcagagugggcauuggcuuccaucugcaaaucuauccugaugggaaggucaauggaucucacgaggcuaacaugcucuccguucuggaaauuuuugccgugagccagggcaucguggggauucggggagucuucucuaauaaauuucuugcgaugagcaagaaaggcaagcugcacgccuccgcuaaguucacggacgauuguaaauuucgcgagagauuccaggaaaacucuuacaauaccuaugccagcgcuauccaucggacagagaagaccgggcgcgagugguacguggcccucaacaaaagaggaaaggcgaaacggggcugcagcccccgcguuaagccucagcacaucagcacacacuuucugccgagauucaagcaaucugaacagcccgagcuuuccuuuaccgugacagucccugagaaaaagaaacccccuagccccauuaagccgaaaaucccucugucugcuccccggaagaauaccaacuccgugaaauaucgccucaaguucagauucggcuga

SEQ ID NO: 69312 - RNA, 627 nt, Artificial Sequence
  derived and/or modified sequence opt5 from FGF6__Homo_sapiens__NP_066276
auggcccugggccagaaacucuucaucaccaugagcagaggggcuggacggcugcaaggcacacuuugggcccugguguuucucgggauucuggucggaaugguugugcccuccccugcgggcacgcgcgcuaacaauacccuucuggacucuagaggguggggaacacuccugagccggucccgcgccggccuggccggcgagaucgcuggggugaacugggaaucuggauaccucgucggcauuaagagacagcggcgccuguauugcaauguggggaucggauuccaccuucagguucugccggauggcagaauuagcgggacccaugaggaaaaccccuacucccuccuggagaucucuacaguggaacggggagucgugagccuuuuuggcguucgcuccgcccuguucguggcuaugaauagcaagggcagacucuaugccaccccuucuuuucaggaggaguguaaauuccgggaaacacugcugcccaacaauuacaacgcguaugaguccgaccucuaccaagggaccuauaucgcccugagcaaguacggacgcgucaaaagaggcucuaagguguccccuauuaugacggugacccacuuucuuccccggaucuga

SEQ ID NO: 69313 - RNA, 585 nt, Artificial Sequence
  derived and/or modified sequence opt5 from FGF7__Homo_sapiens__NP_002000
augcacaaguggauccugaccuggauucuccccacacugcuuuacagaagcugcuuccauaucauuugucuggugggcacgaucucccucgccugcaacgacaugaccccugagcagauggcuacaaaugucaacuguucuagcccggaacggcacacccgcuccuaugauuacauggaagggggagacauuagaguucggcgccuguuuugcagaacacaaugguaucuucggaucgauaaacgcggcaaggugaaagggacccaggagaugaagaauaacuacaauaucauggagauuagaacaguggccgucggaaucguggcgauuaaaggcguugaaucugaguucuaucuggcuaugaacaaggaggggaagcucuacgccaaaaaggaauguaaugaggacugcaacuuuaaagaacugauccuggagaaucauuauaacaccuacgccagcgcuaaguggacgcacaauggaggcgagauguucguggcccucaaccagaaaggcauucccguccgggggaagaagaccaaaaaggaacagaaaacagcucauuuucugccuauggccaucaccuga

SEQ ID NO: 69314 - RNA, 648 nt, Artificial Sequence
  derived and/or modified sequence opt5 from FGF8__Homo_sapiens__NP_006110
augggcagccccagauccgcccugucuugccuccugcuucaucugcucgugcugugucuucaggcucaagucaccguucagagcuccccuaacuucacacagcacgugcgggagcagucucuggugacggaccaacucagccgcagacugauccggaccuaccagcuguacucccgcacaucugggaagcacguccaggugcucgccaauaaaagaauuaacgcgauggcugaagauggagacccguuugccaagcugaucguugagaccgauacauucggcagccgggugcgcgucagaggggccgaaaccggacuuuacauuugcaugaauaaaaagggcaaacugaucgcuaaguccaacgggaagggaaaagacuguguguuuacagagauuguucucgaaaauaacuauaccgcccugcagaaugcuaaguacgagggcugguauauggccuucacgcggaaaggccgccccagaaaggggagcaaaacccggcaacaucagcgcgaggugcacuuuaugaagagacuuccucggggacaucacacaaccgaacagucucugcgcuucgaguuucucaacuaucccccuuucacaagaucccugcggggcagccagagaaccugggcgcccgaaccucgcuga

SEQ ID NO: 69315 - RNA, 627 nt, Artificial Sequence
  derived and/or modified sequence opt5 from FGF9__Homo_sapiens__NP_002001
auggcuccccugggcgagguggggaacuacuucggaguccaggacgccguuccuuuuggcaaugugccggugcuccccgucgauagcccugugcugcuuuccgaccaccuggggcaaucugaagccggaggccuccccagagggccugcgguuaccgaucuggaccaucuuaagggaauccugcggcgcagacagcucuauugccggacaggcuuccaccuggagauuuuucccaacggcacgauccaggggacccgcaaagaucauagcagauucgggauucuggaauuuaucuccauugcugugggccucgucucuauccggggaguggacagcggacuguaccuuggcaugaaugagaagggggaacuguauggauccgagaaacucacacaggaguguguuuuccgcgaacaauuugaggaaaacugguacaauaccuauucuagcaaccuguacaagcacguggauacaggcagacgguauuacgucgcccuuaauaaagacggcaccccucgcgaggggacaagaaccaagcggcaucagaaguucacgcacuuucugccgcgccccguggauccugacaaagugcccgagcucuacaaggauauccugucccagagcuga

SEQ ID NO: 69316 - RNA, 705 nt, Artificial Sequence
  derived and/or modified sequence opt5 from FGFBP1__Homo_sapiens__NP_005121
augaagaucugcagccugacccuccuguccuuccuucugcucgccgcucaggugcugcuugucgagggcaaaaagaaaguuaagaacgggcugcacucuaaaguggugagcgaacaaaaggacacacucggaaauacgcagauuaagcagaaauccagacccggcaacaaggggaaauuugucaccaaggaucaggccaauugucggugggcggcuacagagcaagaagagggaaucucucugaaaguggaaugcacccagcuggaccaugaguucagcuguguuuuugccggcaacccuacauccugccucaagcugaaggaugagcgcguguacuggaaacaggucgccagaaaucuucggucucagaaggacauuugucgcuauagcaaaaccgcugugaagacaagaguuugccggaaagauuucccggaauccagccugaagcucgugucuuccacccuguuugggaacacgaaaccccgcaaggagaagaccgaaaugagcccuagagagcacaucaaaggaaaggagacaacccccucuucccuugccgucacacaaaccauggcuacgaaagccccugaauguguggaggaccccgauauggcgaaucagcggaagacagcccuggaguucugcggcgaaaccuggagcucucucuguacauuuuuccuguccauugugcaggacaccagcugcuga

SEQ ID NO: 69317 - RNA, 672 nt, Artificial Sequence
  derived and/or modified sequence opt5 from FGFBP2__Homo_sapiens__NP_114156
augaaguucgugcccugccugcuccuggucacccuuagcugucugggcacacucgggcaggccccuagacaaaaacagggauccacgggcgaggaauuucacuuccagaccgggggacgggacucuugcacaaugcgcccgagcucccugggccagggggcuggagagguuuggcuuagaguggauugucggaacaccgaccaaacauacuggugcgaauaucgcggccagcccucuaugugucaggccuuugcggcugauccuaagcccuacuggaaucaggcccugcaagagcucagacggcugcaucacgccugccagggcgcuccugugcugcgccccagcgucuguagagaagccgggccucaggcucauaugcagcaagugaccuccucucucaaaggaagcccggagcccaaccagcagccugaggccggcacacccucccugcggccuaaggcgaccguuaaacuuacggaagccacccaacuggggaaggacagcauggaggaacucggaaaggcuaaacccacaacccgcccgacagccaagccuacccagcccggcccuagacccgggggaaaugaggaggcuaaaaagaaagccugggaacacugcuggaagcccuuccaggcgcugugugccuuucuuaucucuuucuuucggggcuga

SEQ ID NO: 69318 - RNA, 777 nt, Artificial Sequence
  derived and/or modified sequence opt5 from FGFBP3__Homo_sapiens__NP_689642
augacacccccuaagcugagagccagccucuccccgucucugcuucugcuccugagcggcugccuucuggcugccgcgcggcgcgagaaaggggcugccuccaacguggccgaacccgucccuggacccaccggcgggucuagcggaagauuccucuccccugagcagcacgcuuguucuuggcaacugcugcuccccgccccugaagcugccgcgggcagcgagcuggcccuucggugccaguccccggacggggcucgccaucagugugccuacagaggacaccccgaacggugcgcugccuaugcggcccgcagagcucauuuuuggaagcagguucugggcggccuccggaaaaagcgcagaccuugucacgaucccgccccucugcaagcucggcuuugcgccgggaaaaagggacauggcgccgagcugcgccucgugcccagagcuagcccgccugcgcggcccacgguggccggguucgcuggagagucuaagccucgcgccagaaaucggggcagaacccgcgaacgggccuccgggcccgcugccggaacacccccuccgcagagcgcgcccccuaaagagaaccccucugaaagaaagaccaaugagggcaaacgcaaggcugcccuggucccuaacgaggaacggcccaugggcacagggccggacccugauggacuggacggcaaugccgagcucaccgaaacauacugugcugagaaauggcacucccugugcaacuuuuucgugaauuuuuggaacggguga

SEQ ID NO: 69319 - RNA, 2439 nt, Artificial Sequence
  derived and/or modified sequence opt5 from FGFR1__Homo_sapiens__NP_001167535
auggccgcugugaccagagacuucggcgagaugcugcuccacagcgggcggguccugcccgccgaagcgcagccuuggggagcuccgguugagguggaauccuuucuugugcaucccggcgaucugcuccaacugcgcugcagacuucgggacgauguccagucuaucaacuggcugcgcgacggggugcagcucgccgagagcaauagaacccggauuacgggagaagagguugaggugcaggauuccgucccugccgacucuggccuguacgcuugugugaccagcucccccucugggagcgauacaaccuauuucuccguuaacgugagcgacgcccugccuucuuccgaagaugacgaugacgaugacgacuccucuuccgaggaaaaggagacagauaauaccaaacccaaccgcaugccugucgcuccguacuggacaagccccgagaagauggaaaagaagcuccacgccgugccugcggccaaaaccgugaaguuuaagugccccucuuccggaacgccuaaucccacccugagauggcuuaaaaacggcaaggaguucaaaccggaccaucggaucggcggguauaagguccgcuacgcuacauggagcauuaucauggauuccguugugccuucugacaaaggaaauuauaccuguauuguggaaaacgaguacggcagcaucaaucacacauaucaacuggaugucguggaaagaagcccccaucggccuauccuccaggccgggcugcccgcuaacaagaccguugcccuuggaagcaauguggaguuuaugugcaaggucuacucugacccccagccucacauucaguggcugaaacacaucgaggugaacggcuccaagauugggccggauaaucuccccuacguucaaauccugaaaacggcgggagugaacacaaccgacaaggaaauggagguccugcaucuccgcaaugugagcuucgaagaugccggcgaguauacaugucuggcuggcaacucuauugggcuuagccaccauuccgccuggcugaccguccucgaagcucuggaggagagaccugccgugaugaccucuccccuuuaccuggaaaucauuaucuauugcacaggagccuuucucaucagcuguaugguuggcuccgugauugucuacaaaaugaaaagcgggacgaaaaagucugacuuccacucccagauggcugugcacaagcuggcgaaaagcaucccucugcggcgccagguuucugccgauuccagcgcuuccaugaacucuggagugcuccuggucagacccagccggcuuuccucuagcggcaccccgaugcuggccgggguguccgaguaugaacucccugaggaccccagaugggaacugccucgcgaccggcuugugcugggaaagccccucggcgagggcugcuuugggcagguuguccuggccgaggcuauuggacuggauaaagacaagccuaauagagugacaaaaguggccgucaagaugcucaagagcgaugcgaccgaaaaagaccugucugaucuuaucuccgagauggaaaugaugaagaugauuggcaaacauaagaacaucaucaaucugcucggggcuuguacacaagacggaccccuguacgugauuguugaguaugccagcaaaggcaaccugcgcgaguaccuucaggcccggagaccgccugggcucgaauacugcuauaaucccucucacaaccccgaggaacagcuguccagcaaggaucuggugucuugugcuuaccaagucgcccgcggcauggaguaucucgcuagcaagaaaugcauccaucgggaccuggccgcgagaaaugugcuuguuaccgaagauaacgugaugaagauugccgacuucggacuggcucgcgauauccaccauauugacuacuauaaaaagacgacaaauggccggcucccugucaaauggauggccccggaggcucuguuugauagaaucuacacccaccaguccgacguguggagcuucgggguucugcuuugggagaucuuuacccucggaggcucucccuauccuggggugcccgucgaggaacuguucaagcugcucaaggaaggacaccgcauggacaaaccuuccaacugcacaaaugagcuguacaugaugaugcgggauuguuggcaugccgugcccagccagagaccuaccuucaagcagcuuguggaagaccuggaucggauugucgcgcucacauccaaccaagaguaccuggaccugucuaugccccuugaucaguauagcccguccuuuccugacacgcgcucuagcacaugcuccucuggcgaggauagcguuuucucccacgaaccccucccugaggaacccugucugccgagacauccugcccagcuggcuaaugggggccucaaacggagauga

SEQ ID NO: 69320 - RNA, 648 nt, Artificial Sequence
  derived and/or modified sequence opt5 from FGFR1OP2__Homo_sapiens__NP_001165358
augagcugcaccaucgagaaggcccuggcugacgccaaagcgcucguggaaagacugcgggaucacgacgaugcugccgagucccuuauugaacagacaacggcccugaacaagcgcgucgaggcuaugaaacaauaccaggaagagauccaggagcucaaugaaguugccagacaucggccccgcucuacccuggugaugggcauucagcaagagaacagacagauccgggaacuucagcaggagaauaaggagcugcgcacaagccucgaggaacaccaauccgcucuggaacugauuaugucuaaauauagagagcagauguuccggcuccugauggccagcaagaaggacgauccugggaucaucaugaaacuuaaggaacagcauuccaaagagcugcaggcgcacguggaccaaauuaccgagauggccgcugucaugcgcaaggccaucgaaauugaugagcagcagggauguaaagaacaagagagaaucuuucagcucgaacaggagaacaagggccugcgggagauucuucagaucacacgcgaaucuuuccugaaucucagaaaggacgaugcuagcgaguccaccagccugucugcccuggugacaaacuccgaccucagccugcggaaaucuuga

SEQ ID NO: 69321 - RNA, 1056 nt, Artificial Sequence
  derived and/or modified sequence opt5 from FGFR1OP__Homo_sapiens__NP_001265619
auggccgcuaccgccgcggcuguggucgccgaggaagacacagagcugagagaucuccugguucagacgcuugaaaacagcggcgugcugaaucggaucaaggccgagcuccgcgcugccguguuccuggcucuugaagaacaagagaaagucgaaaacaagacaccccuggugaaugagucccucaaaaaguuucugaacaccaaagacgggagacugguugccucucucguggcggaguuccugcaguuuuucaaucuugauuuuacccuggccgucuuccagccugagacaagcacccuccagggacuggagggccgggaaaaccuugcucgcgaccuggggauuaucgaggccgaaggaacagugggcgggccgcuccugcuggagguuauuagacggugccaacagaaggaaaagggacccaccacgggcgagaaagcuaaugaugaggccaaccaguccgacaccucugugagccucuccgaaccuaagucuaaaagcucccugcaccuucugagccaugagacaaagaucggcucuuuucucuccaaucgcacccuggaugggaaagacaaggcgggacuuugucccgaugaagacgauauggagggcgacagcuucuuugaugacccuauucccaagccugagaaaacauacgggcugagaaaggaaccgcggaaacaggccggaucucucgcuucccugagcgacgcucccccucugaagucuggccucuccagccuggccggggcccccucccuuaaagauucugagagcaagcgcggaaacaccguccugaaagaccucaagcugaucuccgauaagaucggcagccuuggccuggggacgggagaagacgaugacuauguggaugacuucaauucuacaucccacagaagcgagaaaucugaaauuagcaucggcgaggaaauugaggaggaucucuccguggaaaucgacgauauuaacaccucugacaagacaaucacccaacuggagugccugcucagcauuggggcccugcauuuuaaaaauaccgcugacaucuucuga

SEQ ID NO: 69322 - RNA, 2466 nt, Artificial Sequence
  derived and/or modified sequence opt5 from FGFR2__Homo_sapiens__NP_000132
auggugagcuggggcagauucaucugccuggucguugugaccauggccacacucucccuggcucggcccucuuuuagccuuguggaggacacgacccuggaaccugaggaaccgcccacaaaguaccagauuucccaaccugaggucuauguggccgcgcccggggaaucucucgagguucgcugucugcuuaaagaugcugccgugaucagcuggaccaaggacggaguccaccugggcccuaacaauagaacagugcucauuggggaguaccugcagaucaaaggagccacaccccgggauuccggccuguaugcuugcaccgccucucgcaccguugacagcgaaacgugguacuucauggugaacgucaccgaugcuauuuccagcggggacgaugaggacgauacagacggagccgaagauuuugugucugaaaauuccaacaauaagagagcgccuuauuggaccaacacagagaaaauggaaaagcggcuccaugccgugccggcugccaauaccgucaaguuccgcugucccgcuggcggcaacccuaugcccacgaugagauggcugaaaaaugggaaggaguuuaaacaggaacaccggaucggaggcuacaagguucgcaaccagcauuggagccuuaucauggagucuguggugccuuccgacaaagggaauuauacaugcgucguggaaaacgaguacggaagcauuaaucacaccuaccaucuggauguuguggagagaucuccccaccggccgauccuccaagccggccugccugcgaacgccuccacagucguugggggagacguggaguucguguguaaggucuauagcgacgcucagccccacauucaguggaucaagcauguggagaaaaauggcuccaaguacggcccugaugggcuucccuaucugaaaguccucaaggccgcuggagugaacaccaccgacaaagaaauugagguucuguacauccgcaacgugacauuugaagaugccggcgaguauacgugccuggccggaaauucuauuggaaucagcuuccacuccgcuuggcucaccguccugcccgcgccuggcagagagaaggaaaucacagccagcccggacuaccuugagauugcuaucuauuguauugggguguuucugaucgccugcaugguugugaccgucauucucugucggaugaaaaacacaaccaagaagcccgauuucucuucccagccugccgugcauaaacugacgaagcgcaucccccuuagacggcaagugacaguuagcgcugaaucuagcuccucuaugaauagcaacaccccucuggucagaaucaccacacgccucuccagcaccgccgacacacccaugcuggcgggagugucugaguacgaacugccggaggauccuaaaugggaguuuccccgggacaagcucacgcugggcaaaccucuuggcgaagggugcuucggacagguggucauggcugaggccgugggcauugauaaggacaagcccaaagaagccguuaccguggcugucaagaugcugaaagaugacgccacagagaaggaccucuccgaucuggugagcgagauggaaaugaugaaaaugaucgggaagcacaagaauauuaucaaccuucugggagcuuguacccaggacggcccucucuacguuauuguggaguaugccucuaaagggaaucugagagaauaccugcgcgcgcggagacccccgggcauggaguauuccuacgauaucaaccgcgucccugaggaacagaugacauuuaaggaccucgugagcugcaccuaucaacuggcccggggaauggaguaccuugcuucccagaaaugcauccacagagaucuggccgcucgcaauguucucgugacggaaaacaaugucaugaagauugccgacuucggccuggcgcgggauaucaacaauauugacuauuacaaaaagaccacaaacgggagacugcccgugaaguggauggcccccgaggcucuuuucgaucgcguguacacccaucagucugacgucuggagcuuuggaguucucaugugggaaaucuucacacugggcggguccccuuauccggggauucccguggaggaacuguuuaaacuccugaaggagggccaccggauggauaaaccugccaauuguaccaacgagcuuuacaugaugaugagagacugcuggcaugcugugcccucucaacggccuacguucaagcagcuggucgaagaucucgaccgcauccugacacugaccacaaacgaggaauaucuugaccucagccagccccuggagcaguacuccccuagcuaucccgauaccagaucuuccuguagcucuggggacgauuccguguuuagcccggacccuaugcccuacgaaccuugccugccccaauauccgcacauuaauggcucuguuaaaaccuga

SEQ ID NO: 69323 - RNA, 2421 nt, Artificial Sequence
  derived and/or modified sequence opt5 from FGFR3__Homo_sapiens__NP_000133
augggcgcccccgcuugcgcccuggcgcucuguguggcugucgccaucguugccggggcuagcuccgagucucugggaaccgaacagagaguggugggccgggccgcugaggucccugggccggaacccggacaacaggagcagcuuguguucggcagcggggacgccguugaacuguccugcccucccccuggaggcggccccauggggccuacagugugggucaaggauggaacgggccucgugccgucugagcgcguucugguggggccccagagacuucaaguccugaacgcgagccacgaggacuccggagccuacucuugucggcagcgccucacccagagagugcugugccauuuuagcgugcgggucacagaugcuccuuccagcggcgacgaugaagacggggaggaugaagccgaggacaccggaguugauacaggcgcucccuauuggacccgcccugagagaauggacaaaaagcugcucgccgugcccgcggccaauacagugcgguuccgcuguccggcugccggcaacccuacccccucuauuuccuggcugaaaaaugggagagaauuucggggagagcaccgcaucggcgggauuaaacuuagacaucagcaauggagccuggucauggaaucugugguuccuuccgaucggggaaacuacacgugcguggucgagaauaaguucggcagcauccgccagaccuauacacucgacgugcuggaaagaucuccccaccggcccauucuucaggcugggcugccugccaaccagaccgccguucucggauccgauguggaguuucauuguaaggucuacagcgacgcucaaccgcacauccaguggcugaagcacguggaggucaauggcuccaaagugggccccgacgggacaccuuauguuaccgugcugaagacggcgggagccaacacaaccgauaaagaacucgagguccugucucuucauaaugugacauucgaagacgcuggcgaguauaccugccuggccgggaacagcaucggauuuucccaccauagcgccuggcucguugugcugcccgcugaagaggagcuugucgaagccgaugaggcgggcucuguguacgcugggauucuguccuacggcgugggauucuuucucuucauccugguugucgccgccgugacccuguguagacuccgcagcccucccaagaaaggccuggggucuccgacagugcacaagauuagccgguuuccucuuaagagacaggucucccuggaaucuaaugcuagcauguccagcaacacgccccucgugcgcaucgcccggcugucuuccggagagggcccuacccuugcuaauguuagcgaacuggagcuccccgccgacccuaaaugggagcugucuagagcgcgccugacacucgggaagccccugggagaaggcugcuucgggcaaguggucauggccgaggcuauuggcaucgauaaagaccgggccgcuaagccggugaccguugccgugaaaaugcuuaaggaugacgcgacagauaaagaccuguccgaucucgucagcgaaauggagaugaugaagaugauuggaaagcacaaaaacaucaucaaucugcugggcgccuguacccaagggggaccucuuuacgugcucguugaguaugcugccaagggcaaccugagagaauuucugcgcgcucggagaccucccgggcucgacuacuccuucgacacgugcaaacccccggaggaacagcugacauucaaggaucuugugucuugcgccuaucaggucgcccgcggaauggaguaccuggcuagccagaaauguauucaucgggaccucgcggccagaaacgugcuggugaccgaagauaaugucaugaagaucgcugacuuuggccuggcccgggauguucacaaccuugacuauuacaagaaaaccacaaaugggcgccuccccgugaaguggauggccccugaggcucuguucgauagaguguauacccaucaguccgacgucuggucuuuuggcgugcugcucugggagauuuucacacugggaggcagccccuacccugggauccccguugaggaacuuuuuaaacugcucaaggaaggacaccggauggauaaaccugccaacugcacgcaugaccuguacaugauuaugagagaguguuggcacgcggcucccucccagcgcccgaccuucaagcagcugguggaagaucuugaccggguccucacagugaccagcacagaugaguaucuggaccugucugccccuuuugagcaauacucccccggcgggcaggacaccccuucuagcuccagcucuggagaugacagcguuuucgcccacgaucuccugcccccggcuccucccuccagcggcgggucuagaacguga

SEQ ID NO: 69324 - RNA, 2205 nt, Artificial Sequence
  derived and/or modified sequence opt5 from FGFR4__Homo_sapiens__NP_001278909
augagacugcuccuggcccuucugggcgugcuccugagcguccccgggccuccgguucuuucccuggaggcuucugaagagguggaacucgagcccugccuggccccuagccuggaacagcaagagcaggagcucaccguggcgcugggacagcccguccggcuuuguugcggccgcgcugaaagagggggacacugguacaaggagggcucccggcuggccccugccgggcgcgugagaggauggcggggccgccucgaaaucgcuucuuuccugcccgaggacgccggcagauaucuuugucuggcucgggggagcaugauuguucuccagaaccugacacugaucacgggagauucccucaccucuagcaaugacgaugaggacccuaaaucccaucgcgauccgagcaacagacacucuuacccccaacaggccccuuauuggacacauccccagcggauggaaaagaaacugcacgcggugccugccggcaauaccgucaaguuucgcugccccgcugccgggaacccgacaccuaccauuagauggcuuaaagacggacaggcuuuccauggcgagaaucggaucgggggcauucgccugagacaccaacacuggucccucgugauggaaagcguugugcccucugaucggggaacauacaccugucuggucgagaacgccgugggcuccaucagauauaauuaccuucuggacgugcucgaacgcagcccucaucggcccauccugcaggcggggcugcccgccaacacgaccgcugucguuggaucugauguggagcuccugugcaagguguauuccgacgcccagccucacauucaguggcuuaagcauaucgucauuaauggcagcuccuuuggggcugauggauucccguacgugcaaguucugaaaacagccgacaucaacucuagcgagguggaaguccucuaccugagaaauguguccgccgaggaugcuggcgaauauaccugucuugcggggaacagcauuggacugucuuaccaguccgccuggcucacaguucugcccgaggaagacccuaccuggacggcugccgcccccgaggcuagcucuccuuggagccaggcccugcccgcgucccaagcucacccgugguaugaggccugcgugucuccucccgccgcuccucccuguagcccugccucccucguccugggcaagccccuuggcgaagggugcuuuggacaggugguccgcgcugaggccuucggcauggacccggcgcggccugaucaggccagcacaguggcuguuaaaaugcugaaggacaaugccucugauaaagaccucgcugaucugguguccgaaauggaggucaugaagcugaucgggagacacaagaacauuaucaaucuucucggaguguguacccaggaaggcccccuguacguuaucguggagugcgccgcgaaagggaaccugcgcgaguuucuccgggccagacgcccucccggcccggaccugagccccgauggaccucggucuuccgaaggcccccuuagcuucccuguccugguguccugcgcuuaucaaguggccagagggaugcaguaccucgagucucgcaaguguauucaucgggaccuggcugccagaaacguucuggucacagaagauaaugugaugaaaaucgccgacuuuggacuugcucggggcgugcaccauauugauuauuacaagaaaaccagcaacgggcgccuccccgucaaguggauggcgccugaggcccuguucgacagaguguacacccaccaguccgacguuuggucuuuuggaauccugcucugggagauuuucacacugggcgggagccccuauccgggcaucccuguggaggaacuguuuucccuucuccgggaaggacauagaauggaucggcccccucacugucccccggagcuguacggccugaugcgcgaaugcuggcacgcugccccuagccagagacccacguucaaacaacuugucgaggcccucgacaaggugcugcuggcuguuucugaggaauaucucgaucugcgccuuaccuucgggccuuacucccccagcggaggcgacgccucuuccacaugcagcucuagcgauuccguguuuagccaugacccccugccucucgggucuuccagcuucccguuuggauccggcguccagaccuga

SEQ ID NO: 69325 - RNA, 1515 nt, Artificial Sequence
  derived and/or modified sequence opt5 from FGFRL1__Homo_sapiens__NP_001004358
augacccccagcccucugcuccugcuucugcucccgccccugcuucugggcgccuucccucccgcugccgcggcuagagggccucccaagauggccgacaaaguggucccucggcagguugcccgccucggaagaacagugcggcugcaaugcccgguggagggcgaucccccuccccugacgauguggaccaaggacgggcgcacaauccacuccggauggucuagauuucggguccucccucagggccugaaagugaagcagguugaacgcgaggaugcugggguguacgucuguaaagccaccaacggauucggcagccuuuccgugaauuauacacugguugugcucgacgauauuucucccggcaaggaaagccuggggccggacuccucuagcggaggccaggaggauccugcuucccaacagugggccagaccccgguuuacccagccuagcaagaugcgcagacgggucaucgcgcgccccguggggucuuccgugagacuuaaaugcgucgccagcggacauccccggccugacauuacauggaugaaggaugaccaggcucugacccgcccggaagccgcugagccccggaaaaagaaauggacgcucucucugaagaaccugagaccugaggauuccggcaaguacaccuguagaguuagcaaucgcgccggggcgaucaacgccacauauaaaguggacgugauucaacggaccagaucuaagcccguccucacaggaacccacccugugaauacgacaguugauuucggcggcaccacauccuuucagugcaaagugcgcagcgacgucaagcccgugauccaguggcugaaacggguugaauacggggcugagggaagacauaacuccaccaucgacgugggcgggcagaaguucgucgugcuuccgaccggagaugucuggucucgcccugacggcagcuaucugaauaaacuccugauuacacgggccagacaagaugacgcugggauguacaucugucuuggagccaacacgaugggcuauuccuuucgcagcgccuuccugaccgugcuccccgauccuaagcccccugggcccccgguugcuucuuccagcucugcgacaagccugccuuggcccguggucauuggcauccccgccggagcuguguuuauucugggcacccuccugcuuuggcugugccaggcccagaagaaaccuuguacaccggcccccgcuccuccccucccugggcaccggcccccuggaaccgccagagaccgcuccggcgauaaggaccugcccucucuugcggcucugagcgccgggccgggcguuggacucugcgaggaacauggcuccccugccgcuccccaacaucugcuggggccuggacccguggccggcccgaaacucuacccuaagcuguacacggauauccacacacacacccacacccauagccacacacacucucaugucgaggggaaagugcaccagcauauucacuaucaguguuga

SEQ ID NO: 69326 - RNA, 1314 nt, Artificial Sequence
  derived and/or modified sequence opt5 from FGG__Homo_sapiens__NP_000500
augagcuggucccugcaccccagaaaccucauccuguacuucuaugcccuucuguuucucucuagcacaugcguggcuuacgucgccacccgggacaauuguugcauucuggaugagcgcuucggcuccuauuguccuacgaccugcgggaucgcggacuuucuuucuacauaccagaccaagguugauaaagaccugcaaagccucgaagauauucugcaucagguggagaacaagacauccgaagugaaacagcugaucaaggcuauucagcucaccuauaauccggacgagucuagcaaacccaacaugaucgaugccgccacacugaaguccagaaagaugcuugaagagaucaugaaauacgaggcuagcauucugacccacgacucuuccauccgguaucuccaagaaauuuacaauagcaacaaucagaagaucgucaaccugaaagagaagguggcccagcuugaagcucagugucaagagccuugcaaagauacgguucagauucaugacaucaccggaaaggauugucaggacauugccaauaagggcgcgaaacagucugggcuguacuucaucaagccccucaaagccaaccaacaguuucugguguauugcgagaucgauggauccggcaauggguggacagucuuccagaagcgccuggacggaagcguggacuuuaaaaagaacuggauucaauacaaagaaggcuucggccaccucucuccuaccgggacaaccgaguuuuggcugggaaaugaaaagauccaucuuauuuccacgcagagcgcuauccccuaugcccugagaguugagcucgaagauuggaacggccggacauccaccgcugacuacgccauguucaagguggggccugaggcggauaaauaucgccugacauacgccuauuuugcuggaggcgacgccggggaugcuuucgacggauuugauuucggcgacgauccgucugacaaguucuuuaccagccacaauggcaugcaguucuccaccugggauaacgacaacgacaaauuugaggggaauugugccgaacaggauggaagcggcugguggaugaacaagugccacgccgggcaucuuaauggagucuacuaccaaggcgggacauauucuaaggcuuccacgcccaacggauacgacaauggcauuaucugggcgaccuggaaaacaagaugguauagcaugaagaaaaccacaaugaagaucauuccuuucaaccggcugaccaucggcgaggggcagcagcaccaucucggaggcgccaaacaggcuggggauguguga

SEQ ID NO: 69327 - RNA, 1086 nt, Artificial Sequence
  derived and/or modified sequence opt5 from FGGY__Homo_sapiens__XP_011540039
augagcggcggggagcagaagcccgaaagauacuaugugggagucgacguuggcaccggguccgugcgggccgcucugguggaucaaucuggaguccuccuggccuucgcggaccagccuaucaaaaacugggagccgcaguuuaaucaccaugaacagagcuccgaggauauuugggcugccugcugugugguuacaaagaaagugguccaaggcaucgaccuuaaccagauucgcgggcugggauucgaugccacgugcucucucgugguucuggacaagcaguuucacccccuuccugugaaucaggaaggcgauagccauagaaacgucaucauguggcuggaccaccgggcugugucccaagugaaucgcauuaacgagaccaaacauucuguccuccaguacguuggcggggugaugagcguggagaugcaggcccccaagcugcuguggcucaaggaaaaucugagagagaucuguugggauaaagcuggacacuucuuugaccuuccugauuuccuguccuggaaggccacaggcgucaccgcgcggagccucugcucucugguguguaaauggacauauuccgccgaaaaggggugggacgauagcuuuuggaaaaugaucggacuugaggacuucguugcugacaacuacucuaagauuggcaaucaggugcugcccccuggggccucccucggaaacggccugaccccggaggcugcccgcgaucugggccuccugcccgggaucgcggucgccgcuagccuuauugacgcccacgcuggaggccugggggugaucggagccgauguuagaggccaugggcucauuugcgaaggacaaccugugacaucucggcuggccgucaucuguggcaccuccagcugccacaugggcauuuccaaggaccccaucuuugugccuggggucuggggacccuauuucucugcuauggugccgggcuuuuggcuuaaugaagggggacagagcguuacgggcaaacugaucgaucauauggugcaggggcacgcggccuucccugagcuccaagucaaggcuaccgcccgcucccccgacuga

SEQ ID NO: 69328 - RNA, 939 nt, Artificial Sequence
  derived and/or modified sequence opt5 from FGL1__Homo_sapiens__NP_004458
auggccaagguguucagcuuuauccuggucaccacagcucucacgaugggcagagagauuuccgcccuggaagacugcgcgcaggagcaaaugcggcuucgcgcucagguuagacugcucgaaacccgggugaaacagcagcaagugaagaucaaacagcugcuucaggagaacgaaguccaguuccuggauaagggggacgagaauacagugauugaucucggaucuaaacgccaauacgccgacuguagcgagaucuuuaacgauggcuauaagcuguccggguucuacaagauuaaaccccugcagucuccugccgaauuuagcguuuauugcgacauguccgauggaggcggguggaccgugauccagagacggucugacggaagcgagaauuucaaccgcggcuggaaggauuacgaaaauggcuuugggaacuucguccagaaacacggagaguauuggcucggcaauaagaaccugcauuuucuuacaacccaagaggacuacacacugaaaaucgaucucgcugacuucgaaaagaacuccagauaugcccaguacaagaauuuuaaagugggggaugagaagaauuucuacgaacugaacauuggagaguauagcggcaccgcuggggacucucuugccggaaauuuucacccggaaguucaguggugggcgucccaucaacggaugaaauucagcacgugggaccgcgaucacgacaacuacgagggcaauugugccgaggaagaucagucuggcuggugguucaacagaugccauuccgcuaaccugaaugggguguauuacagcggacccuauaccgccaagacagacaacggcaucgucugguacaccuggcacggguggugguauucucucaaauccguggugaugaagauucggccuaaugauuuuauccccaacgucauuuga

SEQ ID NO: 69329 - RNA, 1320 nt, Artificial Sequence
  derived and/or modified sequence opt5 from FGL2__Homo_sapiens__NP_006673
augaagcuggccaacugguacuggcucagcuccgcugugcuggccaccuauggcuuccuugucguugcgaauaacgagacagaagagaucaaagacgaaagagcuaaggaugugugccccgugcggcuggagucucgcgggaaaugugaagaggccggagagugcccuuaccaggucagccucccgccccugacgauucaacuuccuaagcaguuuuccagaaucgaagagguguucaaagaaguucagaaucugaaggagauugugaacucucucaagaaaagcugucaggacugcaagcugcaagccgaugacaauggcgaucccgggcggaacggacugcuccugccuuccaccggcgcucccggggaggucggagacaaucgcgugagagaacuugagucugaaguuaacaaacugagcuccgagcucaagaaugccaaagaagagaucaacgugcugcacggccggcuugagaagcugaaucucgucaacaugaauaacauugaaaauuauguggauagcaagguggcuaaccugacauuugucguuaacucucuggacggcaaauguuccaagugcccuagccaggagcagauccagucucgcccggugcaacaucucaucuacaaagauuguuccgacuauuacgccauugggaagagaagcucugaaaccuaucgggugacacccgauccuaaaaauuccagcuucgaggucuacugcgacauggaaaccaugggaggcggguggacagugcugcaggcgcgccuugauggauccaccaacuuuacgagaaccuggcaggacuacaaggccggcuucgggaaucugcggcgcgaguuuuggcucggaaacgacaaaauccaucugcuuacaaagucuaaggagaugauucugagaaucgaucucgaagacuucaauggcguugagcuguaugcucuguacgaucaguuuuauguggccaacgaguuccucaaauaccggcugcacgucggcaauuauaacgggaccgcuggagacgcccuucgcuuuaauaagcacuacaaccaugaucugaaauucuuuacaacccccgacaaggauaaugacagauauccuagcggcaacugugggcucuacuacuccagcggauggugguucgaugcgugccugucugccaaucuuaacggcaaauauuaccaccaaaaguauagaggggugcggaauggaauuuucuggggcacguggcccggcguuuccgaagcucacccugggggauacaagagcucuuuuaaagaagccaagaugaugauccgcccgaaacauuucaagcccuga

SEQ ID NO: 69330 - RNA, 1383 nt, Artificial Sequence
  derived and/or modified sequence opt5 from FGR__Homo_sapiens__XP_011539313
augggcugcguguucuguaagaaacuggagcccgucgccaccgcuaaggaagacgccgggcucgagggagauuuuagaagcuacggcgcggcugaccacuaugggccugauccgacaaaagcccggcccgccuccucuuucgcucauaucccuaacuacagcaauuuuuccucucaggccauuaaccccggauuccuggacagcggcacgauccgcgggguuuccgugaaggugaccggaggcagacuuggccugucugcuccugaaaaacucgccgcguuucccgccacaaccuggccucugcuuacacaaagcaagcugaaguccgcuuauagccucucuauucgggauugggaccagacccgcggggaucacgucaaacauuacaagaucagaaaacuggacaugggaggcuauuacauuacaacccgggugcaguucaauuccguucaggagcuggugcaacacuauauggaagucaacgaugggcucugcaaucugcuuaucgccccguguacgaucaugaagccccagacccugggacucgcuaaagacgccugggagauuagccgcagcuccaucacacuggagagacggcuuggcaccgggugcuuuggagauguguggcugggcacauggaacggcagcaccaagguugcggugaagacgcucaaaccugggacaaugucucccaaggccuuccuggaagaggcucaggucaugaaacugcuccgccaugacaagcuggugcagcuuuacgccguggucuccgaggaaccuauuuacaucguuaccgaguuuaugugucacggaagccugcucgauuuccugaaaaaucccgaaggccaagaccuuagacugccgcagcucguggacauggcugcccagguggccgaggggauggcuuauauggaacggaugaacuacauucaccgcgaucugagagcggccaauauccuggucggagagcggcucgcuugcaagauugccgacuuuggccuggcccgccuuaucaaagaugacgaauauaacccuugucagggguccaaguuccccaucaaguggacagcuccugaggccgcgcuguuuggaagauucaccauuaaaucugauguguggagcuucggcauccuccugaccgagcuuauuacaaagggccggauccccuaccccgggaugaauaaaagagaaguucuggagcaaguggaacagggauaucauaugccuugcccgcccggcuguccugcuucccucuacgaggccauggaacagacguggcgccuggaccccgaggagcggccuaccuuugaauaucugcaaucuuuccucgaggauuacuuuacaucugccgaaccccaguaccagccgggggaccagaccuga

SEQ ID NO: 69331 - RNA, 3432 nt, Artificial Sequence
  derived and/or modified sequence opt5 from FHDC1__Homo_sapiens__NP_203751
augcacgugaugaacugcgucagccugguuuccgacaaggagaauggcaacaucgccaccgcucccggguucaugauuggacagacaccuccgcccgccccucccccucccccuccgcccccucccccuucucccccguguagcugcuccagagaagaguguccuucuucucccccucccccucccccgcccccucuccccggcgaaccucccaucccgccucccccucccgggcugccucccacgacccauaugaauggauacucccaccuuggcaaaaagaaacggaugcgcagcuuuuucuggaagacaauuccggaggaacaagugagagggaaaaccaacaucuggacacuggcggcucggcaggagcaucacuaucagauugauaccaagacaaucgaggaacucuuuggacagcaagaggacaccaccaagagcucccugccucgcagaggccggacgcuuaauagcucuuuccgcgaagccagagaggagaucacaauucuggaugccaaacgguccaugaacaucggcauuuuucucaagcaguucaaaaagagcccccgcucuaucguggaagacauucaucaggggaaauccgagcacuacggaagcgaaacccugagagaguuucugaaguuccuccccgaaucugaggaggucaagaaacugaaggcuuuuuccggcgaugugagcaaacuuucccuggccgacucuuuccucuaugggcugauccagguuccuaauuacagccuucggauugaagcuauggugcugaagaaagaguuucucccguccugcagcucucuguauacagauaucaccguccugcgcacggccaucaaggaacucauguccugugaggaacugcacagcauucuucaucuggugcuccaagcgggaaacaucaugaaugccggcggguacgcuggaaacgccguuggcuucaaacugucuagccuucugaagcucgcugacacaaaggccaauaaacccggcaugaaccugcugcacuuuguggcgcaggaggcccagaagaaagauaccauucuccugaauuucuccgagaaacuucaucacguccagaagacagcuagacugucucucgaaaacaccgaggccgaacugcaccuucuguucgugcggaccaagagccucaaggagaauauccaacgcgacggggaacugugccagcagauggaggauuuucugcaauucgcuauugagaaacucagagaacuggaguguuggaagcaggaacuucaggacgaggccuauacacugaucgacuuuuucugcgaggauaaaaagacgaugaaacucgacgaauguuuucagaucuuccgggauuuuugcaccaaguucaacaaggccgugaaagacaaccaugauagagaggcucaagaacugcgccagcugcagcggcuuaaggagcaggaacaaaaacagagauccugggcgacaggagagcucggcgccuuugggcgcucuagcuccgagaaugacgucgaacugcugaccaagaaaggagcugagggccuccugccuuuccuucacccccggccuauuagccccucuuccccuagcuacagacccccgaacacacgccgguccagacugucucucgggccuagcgccgaucgcgaacugcugaccuuucuugaguccucuacgggaagccccgaggaaccuaauaaguuccauucccucccccggagcucuccgagacaggcccgcccuacaaucgcuugucuggagcccgccgaaguucggcaccaggacuccagcuuugcgcauaagccucaggcuucuggcggccaagaggaagcccccaaucccccuuccgcccaggcucaccagcuggccgcugcccaaccggagaaccacgcgagcgccuuccccagagcucggcgccagggggugucugugcucagaaaacgguacagcgaaccugucucccugggaagcgcccagucucccccucuuuccccucuggcucucggcauuaaggagcaugagcuggugaccgggcuggcccaauucaaccuucagggaagccagggcauggaagagaccucccagcucacacugucugauuuuagccccauggaacuggaguccguugggcacagaggcccgcaaucucucagcgcguccucuagcucccugacccccaugggacgcgacgcccuuggcagccugucuccugcucucgaggaugggaaagccgcucccgacgaaccuggauccgccgcccugggcagcguggggucuuccgaucccgagaauaaggacccgcggccucuguucugcaucagcgacacaacggauugcucucuuacccucgacuguuccgaaggaacagauagcagaccccgcggcggggaccccgaggaaggcggagagggcgauggguccaugagcucuggagucggcgagaugggggacagccagguguccucuaacccuaccagcuccccucccggagaagcuccggcgcccguuucuguggauagcgagccuuccugcaaaggcgggcugcccagagacaagccuacaaaacggaaggaugucguggcccccaagcgcggcucucugaaagaagcuagcccgggagccuccaagccuggcagcgccagacggucucagggggcugucgccaaauccgugcgcacccucacggcgagcgagaaugaaucuaugagaaagguuaugcccauuaccaaauccagccggggagcuggcuggcgcagaccugagcuguccucucgggggcccagccagaacccucccuccagcacagacaccguguggucucgccaaaauuccgucagacgggccagcacaggagccgaggaacagagacuuccgcgcggcucuagcggguccucuagcacccggccuggcagagaugugccccugcagccccgcggauccuuuaagaagccuucugcuaaaccgcuccggaaccugcccagacagaagccugaggaaaauaaaacgugucgcgcccauagcgagggccccgaauccccuaaggaggagcccaaaacaccuagcguuccgucugugccccacgaacugccucggguccccuccuucgcgagaaacaccguggcuagcuccucucgcagcaugcggacagaccuuccucccguggccaaggccccggggaucaccagaaccguuucccaacggcagcugcgcgucaagggagauccugaggacgcugcccccaaagacucuagcacacucagacgggcuuccagcgcccgcgcgcccaagaaaagaccugaaucugccgagggccccuccgcuaauacggaggccccucugaaggcuagaggggccggagaacgggccagccuccgccggaaagauucuuccagaaccacacugggccgcauccuuaacccgcugcggaaguga

SEQ ID NO: 69332 - RNA, 1533 nt, Artificial Sequence
  derived and/or modified sequence opt5 from FH__Homo_sapiens__NP_000134
auguacagagcccugcggcuccuggcucgcagcagaccccuugugcgggccccugcggcugcccuggccuccgcuccgggccucgggggagccgcuguccccucuuucuggccucccaacgccgcgcgcauggccagccaaaauuccuuuagaaucgaguaugacaccuucggcgaacugaagguuccuaacgauaaauacuauggggcucagacagugcggucuacgaugaauuuuaagauuggaggcgugaccgagcgcaugcccacaccugucaucaaagccuucgggauucuuaagagagcugccgcggaagugaaccaggacuacggacuggauccgaaaaucgccaaugcuauuaugaaggccgcugacgagguugccgaaggcaagcucaacgaucacuuuccccugguggucuggcagaccggcagcgggacacagaccaauaugaacgugaaugagguuaucuccaaccgggccaucgagaugcugggaggcgaacucgggucuaaaauuccugugcaucccaaugaccacgucaacaagagccaauccagcaaugauacauucccuaccgcuaugcauaucgcggccgcuauugaggugcacgaagugcugcuucccggacugcagaaacuccaugacgcccuggaugccaagucuaaagaguuugcucagaucauuaagaucggccgcacgcacacccaggacgccgucccgcuuacacuggggcaagaguucuccggauauguucaacaggugaaguacgcgaugaccagaauuaaagcugccaugccucggaucuaugaacucgccgcuggcggcacagccguggggaccggacugaacacgcgcaucggcuuugcugagaaggucgccgcgaaaguggccgcucugacagggcuccccuucguuaccgccccuaauaaguuugaagcucuggccgcgcacgaugcccuuguggagcugagcggagcuaugaacacaaccgccugcucucucaugaaaauugcuaacgacaucagauuccugggcuccgggccccggagcggacuuggcgaacugauucuccccgagaaugagccugggucuuccaucaugccgggcaaggucaaccccacccagugugaagccaugacaaugguggccgcucagguuaugggaaaucauguggcggucacggugggcgggagcaacggacacuuugagcugaaugucuucaaaccuaugaugauuaagaacgugcugcauuccgcccgccuccugggcgaugcuucuguuagcuucaccgaaaauugcguggucgggauccaggccaacacagagagaaucaauaaacuuaugaacgaaucccugaugcucgugaccgcccugaauccccacauuggcuacgacaaggcugccaagaucgcgaaaacagcucacaagaacggaagcacccuuaaagagacggccauugagcugggcuaccucacagccgaacaguuugacgaguggguuaagccuaaggauaugcuggggcccaaauga

SEQ ID NO: 69333 - RNA, 444 nt, Artificial Sequence
  derived and/or modified sequence opt5 from FHIT__Homo_sapiens__NP_002003
augagcuucagauuuggccagcaccugaucaagcccuccguggucuuccucaaaaccgagcugucuuuugcccuuguuaaccggaagccuguggugccggggcauguccuggugugcccccuccgcccuguugaaagauuccacgaccugcggcccgaugagguggcugaccuuuuucaaacaacgcagcgcgucggaaccgugguugaaaaacauuuccacggcacaagccugaccuuuuccaugcaggaugggccugaggccggacagacagugaagcauguccacgugcacgugcuccccagaaaagcgggcgacuuccaucggaaugauucuauuuacgaggaacugcaaaagcacgacaaggaggauuuuccugcuagcuggcgcuccgaagaggaaauggccgccgaggcugccgcucugagagucuauuuccaguga

SEQ ID NO: 69334 - RNA, 891 nt, Artificial Sequence
  derived and/or modified sequence opt5 from FHL1__Homo_sapiens__NP_001153171
auggccagccacagacauuccggccccucuagcuacaagguggggaccauggcugagaaauucgacugccacuauugucgggauccucuucagggaaagaaauacguccaaaaggacggccaucacugcugucucaaaugcuuugauaaguucugugccaacacaugcguugaaugucgcaagccgaucggggcggacuccaaagaggugcauuauaagaauagauuuuggcacgauacgugcuuccggugugcuaaaugccugcacccccuugccaacgaaaccuuuguggccaaggacaauaaaauucuguguaacaagugcacaacccgcgaggauucuccuaagugcaaaggauguuucaaggcuaucgucgccggcgaccagaauguggaauacaaagggacaguuuggcauaaggauugcuuuaccuguagcaacugcaaacaggugauuggaacaggcuccuucuuucccaagggcgaggacuucuauugugugaccugccacgagacgaaauuugcuaagcauugugucaagugcaauaaagccaucaccucugggggaauuacauaccaggaucaaccuuggcacgcggacuguuucguuugcgugaccuguagcaagaaacucgccggccagagauuuacagcugucgaagaucaguauuacugcguggacugcuacaagaacuucguggccaaaaagugugcugggugcaagaaucccaucaccggauucggcaaaggguccagcgucguugccuaugagggacagucuuggcacgacuacuguuuucauugcaagaaauguuccgugaaccuggcgaauaagcgguucguguuucaccaagaacaggucuauugcccugauugugccaaaaagcuguga

SEQ ID NO: 69335 - RNA, 1170 nt, Artificial Sequence
  derived and/or modified sequence opt5 from FHL2__Homo_sapiens__XP_005263959
augaccagacggggcuucagccgcgccggggcugcccagagauccacacggcccgcggcugagccucaaccgcccgccgcccgcgcucugcagccuagacccggagugccuggcccccuccggugccgcgaauaccugcagccuccggcccccagacgggaggcugaagggcuuucucaccagggaagcgaggucggcgccgaauccggggcgcgcccuaaggagagaggagccgagcccgaacugggccggcucuggcugcgcacgguuucuagcuggagacuuggcuggcauuuugacuucgggguggcugagaaaccuggagugaagaugaccgaacgguuugauugucaccauugcaacgagucccuguucggcaaaaaguauauccuccgcgaggaaucucccuacugugucgugugcuuugagacacuguucgccaauaccugugaagagugcgggaaaccgauuggaugugacugcaaggaucugagcuauaaggacagacacuggcaugaggcuuguuuucacugcucccaaugucggaacagccucguugauaaaccuuucgccgcgaaggaagaccagcugcuuugcacagauugcuacucuaaugaguauuccagcaaaugucaggaaugcaagaaaaccaucaugcccggcacaagaaagauggaguacaaggggucuuccuggcacgaaaccuguuuuauuugccaucgcugucagcaaccuaucggaacgaaaucuuucauucccaaggacaaccagaauuuuugcgugcccuguuaugagaaacagcacgccaugcagugcguccaauguaagaaaccuaucaccacaggcggcgugaccuaccgggaacagccguggcauaaggagugcuucguuuguacagcuugcagaaaacagcugagcgggcaacgcuuuaccgcccgggaugacuucgcuuacugccucaacuguuucugcgaucuguaugccaagaagugugccggaugcacgaaucccaucuccggccuugggggaacaaaauacauuagcuuugaggaaagacaguggcacaacgacuguuucaauugcaagaaauguucccugucucucgugggccgcggguuucugaccgagcgggaugacauccugugcccugacuguggaaaggauauuuga

SEQ ID NO: 69336 - RNA, 855 nt, Artificial Sequence
  derived and/or modified sequence opt5 from FHL5__Homo_sapiens__XP_006715676
augaccacagcccacuucuacugccaguauuguacggcuagccugcucggcaagaaauacgugcugaaggacgauucccccuauugcgucaccuguuacgacagaguuuucucuaacuauugcgaggaauguaaaaagccuaucgagagcgauuccaaagaccuuugcuacaaggaucggcauuggcacgaaggguguuucaagugcacaaaauguaaucauucucugguggagaagccguuugccgcgaaagacgaacgccuccugugcaccgaguguuauagcaacgagugcuccucuaagugcuuccacuguaaaagaacaauuaugcccggaagccggaagauggaauuuaagggcaauuacuggcaugagaccugcuucgugugugaaaacugccgccaaccuaucgggacaaaaccccuuauuuccaaggagagcggaaauuacugugucccuugcuuugagaaagaauuugcucacuauuguaacuuuugcaagaaagugaucaccucuggcgggauuacguucugugaucagcuguggcacaaggagugcuuucucuguuccggaugcagaaaagaccugugcgaggaacaguucaugagccgggaugacuaccccuuuuguguugauugcuauaaucaucuguacgccaacaaguguguggccugcucuaagccuaucuccggccucaccggcgcuaaauucaucuguuuccaggacagccaauggcacucugaaugcuuuaauugugggaagugcuccgucagccuggugggaaaaggcuuccuuacacagaacaaggagaucuuuugucagaaaugcggguccggaauggauaccgacauuuga

SEQ ID NO: 69337 - RNA, 3495 nt, Artificial Sequence
  derived and/or modified sequence opt5 from FHOD1__Homo_sapiens__NP_037373
auggccggcggggaggacagaggagauggcgaacccgugagcgucguuaccgugcgggugcaguaccuggaggacacagauccuuucgcuugcgccaacuuuccggaaccccgcagagcgccuacguguucccucgacggggcucugccccuuggagcccaaaucccugccguccaccggcugcucggcgcuccccugaaacuugaggauugcgcccuccaggugucuccuagcggguauuaccucgacaccgaacugucccuggaggagcagcgcgaaaugcucgagggauucuaugaagagauuucuaaaggcagaaagccgacacugauccuucggacccagcugagcguucgcgugaaugcuauucucgagaaacuguacuccucuagcggccccgaacuuagacggucccuguuuagccucaagcaaaucuuccaggaggauaaagaccuggucccugaauuugugcauucugaggggcuguccugucucauucgcguuggagccgcggccgaucacaacuaucagagcuacauccugagagcucuuggccagcugaugcuguucguggacgggaugcugggagucguggcccauucugauacaauccaauggcuuuauacccugugcgcuucccucagccggcugguggucaagacagcccugaagcuccugcuuguuuuuguggaauacucugagaauaacgcgccccuguucauucgcgccgucaauuccguggcuagcaccacgggcgccccucccugggcuaaccucguguccauccuggaggaaaagaauggggccgacccggagcuucugguuuacaccgugacacucauuaacaagacccuggccgcucugccugaucaggacucuuuuuaugacgucacagaugcgcucgaacagcagggaauggaggcccuggugcaaagacaccuuggcaccgcuggcacggacguugaucugcggacacagcucgugcuguacgaaaaugcccugaaacuugaggacggggauaucgaggaagcccccggagcuggcgggcgcagagagcggagaaagccuagcuccgaagagggaaaacgcagccggagaucucucgaaggcgggggaugucccgcccgcgcgcccgagccuggcccgaccggccccgcuuccccugucgggcccacaagcucuaccggaccugcccugcugaccggccccgccagcuccccgguggggccucccucuggacuccaggcuagcgucaaccuguucccuacaauuuccguggcccccagcgcugacacgucuuccgagcggagcaucuauaaggccagauuucuugaaaauguugcggccgcugagaccgaaaagcaaguggcccuggcucagggccgcgccgagacacucgcgggggccaugccuaacgaggcuggcggacaucccgaugcccggcagcugugggacucuccggaaaccgcuccugccgccagaacaccccagucccccgcuccuugcguccugcuucgcgcgcaacggagccucgccccggagcccaaagaaccucugauucccgcuuccccuaaggccgagcccaucugggaacugccuaccagagcuccccgccucucuaucggcgaucuggacuucagcgaucuuggggaggacgaggaccaggauaugcugaauguggaauccguugaggccggaaaagacauuccggccccuucucccccucucccccugcugagcggcgugccgccucccccuccccuucccccuccgcccccuaucaaggggcccuuuccucccccuccgccccucccucuggcggcuccccugccucacuccguccccgauagcucugcccucccgacgaaacggaagacagugaaacuguucuggagagaacuuaagcuggccggaggccacgggguguccgcuagccgguucggcccuugugccacccucugggcgucucuggaccccguuuccgucgauaccgcucgccuggagcaucuuuuugaaagcagagccaaggaggugcuccccucuaaaaaggccggagagggccggagaacaaugaccacagugcuggacccuaaacgcagcaacgcuauuaauaucgggcugacgacccugcccccuguccacgugauuaaggccgcucuccuuaacuucgaugaauuugccguuuccaaagacggaaucgagaagcugcucacaaugaugccgaccgaagaggaacggcagaagaucgaggaggcgcagcuggccaaccccgauauuccucugggccccgcugaaaauuuccuuaugacacuggccagcaucgggggacucgcugccagacugcaacucugggccuuuaaacuggacuacgauucuauggagcgcgaaauugcugagccucuuuucgaccugaaggugggcauggagcagcucguccagaacgcgaccuuuagaugcauccuggccacgcugcuugcuguggggaauuuccugaacggcucccagagcuccggauuugaacucucuuaucuggagaaaguuagcgaagugaaggauaccguccggcgccaaucccuccugcaucaccuuuguucucuggugcuccagacaagacccgagagcuccgaccuguacucugaaauuccggcccugacccggugcgccaaaguugacuucgagcagcuuacagagaaucugggccagcucgaacgcagaagccgggcugccgaggaaucccugcgcagccucgcgaagcacgagcuggcuccugcccuuagagcccggcugacccauuuucuggaucaaugugcucgcagaguggccaugcuccggaucguccacagacgcgugugcaaccgguuccaugcguuucugcuuuaucugggguacacgccccaggcugccagagaagugcgcaucaugcaguucugccacacacuccgggaguucgcccuggaguacagaaccugucgcgaacggguccuccaacagcagcagaagcaagcuacauauagagagcgcaauaaaacccggggaagaaugauuaccgaaacagagaaguuuucuggcguugccggggaagcuccuuccaaccccagcgugccuguggccgucucuuccggacccggccgcggggacgcggauagccaugccucuaugaaaucccugcuuacgagccggccggaggacaccacacacaauagacggucccgcggcauggugcagagcucuagcccuaucaugcccaccguuggacccuccacagcuucuccugaggaaccgcccggcagcucccugccuucugauaccagcgacgagauuauggaucugcucgugcaguccgucacgaagucuagccccagagcccuggcugcccgggaaagaaaacgcucccgggggaacagaaagagccuucgccggacacugaagucuggacucggcgacgaucuggugcaggcccucgggcuguccaaaggaccuggccuugagguuuga

SEQ ID NO: 69338 - RNA, 4269 nt, Artificial Sequence
  derived and/or modified sequence opt5 from FHOD3__Homo_sapiens__NP_001268668
auggccacccuggcuugcagagugcaguuccucgacgauacagaccccuuuaacagcacgaauuucccugagccgucccggcccccucuguuuaccuuccgcgaagaucuugcccugggcacacaacucgcggggguccacagacugcuucaggcuccccauaagcuggacgauuguacccuccagcugucucacaacggagccuaccuggaccucgaggccacacuggcugaacagcgggaugagcuugaaggcuuucaagacgaugccgggcgcggcaaaaagcauagcaucauucugagaacccagcucuccguucgggugcacgcuugcaucgagaaacuguauaauucuagcggacgcgaccuuagacgggcccuguucucccucaagcagauuuuucaggaugacaaagaucuggugcaugaguucgucguggcggaagggcugacaugucucaucaagguuggagccgaggcugaccaaaacuaccagaauuauauucugcgcgcccuuggccagaucaugcuguacguggacggcaugaacggggucaucaauagaaacgaaaccauucaguggcucuauacgcugaucggaucuaaguuucggcuugugguuaaaaccgcucugaagcuccugcugguguucgucgaguacagcgaguccaaugccccucuccugauucaagcggugacagccguggauaccaaacgcggcgucaagcccuggagcaacaucauggaaauucuugaggaaaaagacgggguugauacagagcugcucguguaugcuaugacccuggugaauaagacgcuuucuggacugccugaccaggauacauuuuacgacgucguggauugccucgaggaacugggcaucgccgcuguuucccagagacaccugaacaagaaagggaccgaccucgaucugguggagcaacuuaauauuuacgaagucgcccugcggcacgaggacggagaugaaacaaccgagccgcccccuagcggcugucgcgacagacggagagccucugugugcuccagcggcgggggagaacaucgcggccucgaccggagacgcucucggagacacuccguucagagcaucaaguccacccugucugcucccacaagcccuuguucccagagcgcgcccucuuucaaaccgaaccaggugcgcgaucugcgggagaaguauuccaauuuugggaacaacagcuaccauucuagcagaccuuccucuggaagcuccguccccacgaccccuacaagcucuguguccccuccccaagaggcccgccuugaacggagcucucccuccggccuccugaccagcuccuucagacagcaccaggagucucuggcugccgaacgcgagcggagacggcaggaacgcgaggagagacuccaacggaucgaaagagaggaacgcaauaaauuccgguauaaguaccuggagcagcuugccgcugaggaacacgagaaagaacugagaagccgcuccgucucuagagggcgggccgaccucagccuggaucugacauccccggcggcucccgccugccuugccccucucagccauucucccuccagcucugacucccaggaggcucugaccgugagcgccucuagcccuggaacgccccaccauccgcaggcuuccgccggcgauccugaacccgagagcgaggcggaaccugaggccgaagcuggcgccgggcaaguugcugacgaggccggacaggauauugcgucugcccacgaaggcgcugagacagagguggaacaggcccuggagcaggaacccgaggaacgcgcuucccucagcgagaaggagagacaaaacgaaggggucaaugagcgggacaacuguuccgccucuagcguguccucuagcuccucuacccuggaacgcgaggagaaggaagauaaacuuagcagagaccggaccacaggacuguggccugccggcguucaggaugcuggggugaauggccagugcggagacauccucaccaacaagcgcuuuaugcuggauaugcuguaugcgcauaauagaaaaucccccgacgacgaggaaaagggcgauggggaggccggacggacacaacaggaagcugaggccgucgccagccuugcuacgcgcauuucuacccuccaggccaacucccagacacaagacgagagcgugagacggguggauguuggcugucuggacaauagagggucugucaaagcguucgcugaaaaguuuaacuccggagaucugggccgcgggagcaucucuccggacgccgagccuaaugauaaggugcccgaaaccgcccccgugcagccuaaaacagaguccgacuacauuugggaucagcucauggcuaacccgcgggaacugagaauccaggacauggauuucaccgaccuuggcgaggaggaugacaucgacguccuggauguggaccucggacaccgcgaagcccccggcccucccccucccccucccccgacguuucuggggcugccucccccucccccgccuccccuucucgauagcauuccucccccucccguuccgggaaaucugcuggugcccccucccccugucuucaacgcgccccaaggccucggguggucccaggugccucggggacagccgaccuuuacaaagaaaaagaaaaccaucagacuguucuggaaugagguucgccccuuugacuggccuugcaagaacaaccggagaugccgcgaguuccuuuggagcaagcuggaacccauuaaaguggauacaucucggcucgaacaccuguuugagagcaaguccaaagagcugucugucagcaagaaaaccgcugccgacggcaagagacaggaaaucauugugcuugauuccaagcggucuaaugccaucaacaucgggcugacgguucucccucccccgcgcacaauuaaaaucgcuauucugaauuucgacgaguaugcccucaacaaggaaggcaucgagaaaauucugaccaugaucccuacagaugaggaaaagcagaaaauucaagaggcucagcuugccaaucccgaaaucccccugggaagcgcggagcaauuucuccugacccuguccucuaucagcgaacuuuccgccagacugcaucucugggcuuucaagauggacuacgagaccacagagaaagaaguggccgagccucugcucgaucugaaggaaggcauugaccagcuugagaacaauaagacgcugggguucauccucagcacccugcuggcuauuggaaacuuucuuaauggcacaaacgccaaagccuucgaacugucuuaccucgagaagguccccgaggugaaagacaccgugcacaagcagucccugcuccaucacgucuguacaaugguuguggaaaauuuuccugauagcucugaccuguauuccgagaucggggcuauuacccggagcgcgaaaguggauuucgaccagcuucaagauaaccugugccagauggaacgcagauguaaggccuccugggaccaccugaaggcuaucgccaaacaugagaugaagccgguccucaaacagcggaugucugaauuucugaaggauugcgccgagagaaucauuauccuuaaaauugugcaccgccggaucauuaauagauuccauagcuuucuccuguucaugggacaucccccuuacgcuauccgcgagguuaacaucaauaaguuuugucggauuaucuccgaguucgcccuggaauauagaacgacacgcgaacgggugcuccagcaaaagcagaaaagagcgaaccaccgcgagagaaacaagacccggggcaaaaugauuaccgacagcgggaaguuuucuggcuccagccccgcuccucccucucagccgcagggacugagcuacgccgaggaugccgcugaacacgagaauaugaaagccguccuuaagacauccucuccuagcguggaagacgcgacccccgcucugggcguucgcacaagaucccgggccucucgcgggagcacguccagcuggaccaugggaacagaugacucuccuaacgugaccgaugacgccgcugacgagaucauggauagaauugucaaguccgccacacaagugcccagccagcggguugugccuagagaacgcaaacgguccagagcuaaucgcaagucucugcggagaacccucaaaagcggccugacgcccgaggaggcccgggcgcuugggcuggucggaaccuccgaacuccagcuguga

SEQ ID NO: 69339 - RNA, 1074 nt, Artificial Sequence
  derived and/or modified sequence opt5 from FIBP__Homo_sapiens__NP_004205
augaccagcgagcuggacaucuucgugggcaacacaacgcucauugaugaagacgucuacagacuguggcuugauggguauuccguuaccgacgccguggcucugcgggugcgcucuggaauccucgagcagacaggcgccaccgcggcuguccugcaaagcgauacaauggaccacuacagaaccuuucauaugcuugaacggcugcuccacgcucccccuaagcugcugcaucagcucauuuuccagaucccgcccucccgccaggcccugcuuauugagagauauuacgccuuugaugaagccuucgugcgggagguucuggggaaaaagcucucuaaaggaacaaagaaagaccuggaugacaucagcaccaagacgggcaucacccuuaaguccugccgcagacaauuugauaauuucaaacggguguuuaaggucguggaggaaaugcgcgggucucugguugacaacauucagcagcacuuccuccugagcgauagacuggcucgggacuaugccgcgaucguguuuuucgccaauaaccgcuuugagacaggaaagaagaaacuccaguaccuguccuucggcgacuuugcuuucugugccgaacuuaugauucaaaauuggacccugggcgcugucgauagccagauggacgauauggacauggaucucgacaaggaguuccugcaggaucuuaaggagcugaaagugcucguggccgacaaggaucugcuggaccuccauaaaucucuggucugcacagcgcuuagagggaagcugggaguguuuuccgaaauggaggccaacuucaaaaaucucagccggggccugguuaacguggcugccaaacuuacccacaauaaagauguccgcgaccuguuuguggaccucguugaaaaguucguggagccuuguagaucugaucacuggccccuguccgacguccgguuuuuccugaaccaguauagcgcuucugugcauucccucgauggguuuagacaccaagcccugugggaccgcuacaugggaacgcuucggggcugccugcucagacuguaccaugauuga

SEQ ID NO: 69340 - RNA, 2724 nt, Artificial Sequence
  derived and/or modified sequence opt5 from FIG4__Homo_sapiens__NP_055660
augcccaccgccgcugccccuaucauuagcuccgugcagaagcugguccucuacgagacaagagcgcgguauuuccugguuggcucuaacaaugcugaaacgaaauaccgcgugcuuaagaucgacagaaccgagccgaaagaucuggugauuaucgacgaucggcacgucuauacacaacaggaagugcgcgagcuccuggggagacuugaccugggaaaccggaccaagaugggccagaaagggagcuccggacucuuucgcgccguuucugccuucggcguggucggguuugugagauuccuggaaggauacuauauuguucugaucacaaagcggcgcaagauggcugauaucggcggccaugccauuuacaaaguggaggacaccaauaugaucuauauucccaacgauagcgucagagugacacacccugacgaggcucgguaccuccgcaucuuucagaauguggaucuguccucuaacuucuacuuuagcuauuccuacgaccuuagccauucucugcaauauaaucucaccguccugagaaugccccuugaaaugcugaaguccgagaugacgcagaaccggcaggagagcuucgauauuuuugaggacgaggggcucaucacccagggaggcucugggguuuucggaauuugcuccgaaccuuacaugaaauauguguggaauggcgagcugcuggauaucaucaagagcacagugcaccgcgacuggcuccuguacauuauccauggguuuuguggacaaucuaaacuucugauuuauggcagacccgucuacgugacccucaucgcccggagauccagcaaguucgcgggcacacgcuuucugaagagaggggccaacugcgaaggagacguugcuaaugagguggaaaccgagcagauucuuugugaugccuccgucaugucuuucacggcuggcagcuacuccagcuaugugcagguuagagggucugugccucuguacuggucccaggacaucagcacaaugaugccgaaacccccuaucacccucgaucaagccgaccccuucgcgcacgucgccgcucugcacuuugaucagauguuccagcgcuuuggaucuccuauuaucauucugaaccucgugaaggagcgggaaaaacggaagcaugagcgcauccugagcgaagaacuugucgccgcugugacauaucugaaucaauuccugcccccggaacacaccauuguuuacaucccuugggacauggccaaauauaccaaguccaaacugugcaacgugcuugaucggcugaaugucaucgccgagucugugguuaagaagacaggcuuuuucgugaacagacccgacagcuacuguuccauucuccgcccugaugagaaauggaacgaacucgggggaugcgucauccccacgggccggcugcagaccggcauucucagaacaaauuguguggacugccuggaucgcaccaacacagcucaguuuaugguggggaagugugcgcuugccuaucagcuguacagccucggacugaucgacaaacccaaucugcaauucgacaccgaugcuguucggcuuuuugaggaacucuacgaggaccauggcgauacgcugucucugcaguaugggggaucccagcucguccacagagugaagacauaccggaaaauugccccuuggacccagcacagcaaggacaucaugcaaacccugucucgcuauuacuccaacgccuucagcgaugcugacagacaggauuccauuaaucuuuuucugggcguguuccauccgacagaagggaagccccaccucugggagcugccuaccgacuuuuaucugcaucacaaaaacacaaugcggcuucuccccacgagacgcucuuacaccuauugguggacaccugaggucaucaagcaucugccccugccguacgaugaagugaucugcgccguuaaucucaaaaagcugauugugaaaaaguuccacaaguacgaggaagagaucgacauucacaacgaguucuuucggccuuaugaacuuagcuccuucgaugacaccuuuugucuggcgaugacaucuagcgcuagagauuucaugcccaaaaccgucggcaucgacccuucccccuuuacggugcgcaagccugacgagaccggaaaaagcguucucggcaauaagucuaacagagaagaggccgugcugcagcggaaaacagccgcuuccgcucccccgccucccagcgaagaggccgucucuuccagcucugaggaugacagcgggaccgaucgcgaagaggaaggauccgugagccagagaucuacacccguuaagaugaccgacgccggcgauuccgcgaaggugacggagaaugucgugcaaccuaugaaagaacuguacgggauuaaccuuagcgacggacucuccgaggaggauuucucuaucuauagccgguuugugcagcugggccagucccagcauaagcaagacaaaaauucucagcagccgugcagccgcugcuccgauggggucaucaagcugacacccauuucugccuucagccaagacaacaucuacgaaguucagccucccagaguggaucggaaauccaccgagauuuuucaggcucacauccaggccagccaaggcauuaugcagccucucggaaaggaagacucuuccauguaucgcgaguacaucagaaaucgguaucuguga

SEQ ID NO: 69341 - RNA, 1065 nt, Artificial Sequence
  derived and/or modified sequence opt5 from FIGF__Homo_sapiens__NP_004460
auguacagagaguggguggucguuaacguguucaugaugcuguaugugcagcucguccaaggcagcuccaaugaacacgggcccgugaagcggucuagccaguccacccuggagcgcucugaacagcagaucagagccgcuagcucccuugaggaacugcuccggauuacacauucugaggacuggaaacuguggcgcugcagacuucggcucaagagcuuuacguccauggauagccgcucugccucccacagaagcacccgguucgcggcuacauuuuacgacaucgagacccugaaaguuauugaugaagaguggcaacgcacacaguguucuccuagagaaaccugcguggaggucgccuccgagcugggaaagagcacaaacaccuucuuuaaaccgcccugugugaauguuuuccggugcggcggguguugcaacgaagagucucugaucuguaugaauacguccaccagcuauauuuccaagcagcucuuugaaaucucugugccucugacaagcguccccgagcuugugccugugaaggucgccaaccauaccggaugcaaaugucugcccacagcuccucgccacccguacuccaucauuagacggagcauccagauucccgaagaggaccgcugcucucauuccaagaaacucuguccuaucgauaugcugugggacagcaauaagugcaaaugcguucuucaagaggaaaacccccuggccggcaccgaggaucacucucaccuccaggaaccugcucugugugggccccauaugauguucgacgaggauagaugcgaaugugugugcaagacgccguguccuaaggaccugauucagcaccccaaaaauugcagcuguuuugagugcaaggagucccucgaaacauguugccagaaacauaagcuguuccacccugauaccuguucuugcgaggaccggugccccuuucacacaagacccugugccagcggaaaaaccgcgugcgccaagcauugucgcuucccuaaagaaaagcgggcugcccaaggcccgcacuccagaaagaaccccuga

SEQ ID NO: 69342 - RNA, 660 nt, Artificial Sequence
  derived and/or modified sequence opt5 from FIGLA__Homo_sapiens__NP_001004311
auggaccccgccccuggcgugcuggauccgagagcugcgcccccugcccuccuggggacaccccaggcugagguccuugaagacguucugcgggagcaauucggaccucucccccagcuggccgccgugugccgccuuaagagacugccuagcggcggguacuccucuaccgaaaaccuccagcuggugcuggagcggcgcagagucgcuaaugccaaagaacgggagcgcaucaagaaccucaauagaggauuugcucggcugaaagcccuugugccguuccugccccagagccgcaagccuuccaaaguugauauucucaagggcgcgacggaguauauccaagugcugucugaccuucuggaaggggccaaggauagcaaaaagcaggaccccgaugagcaguccuacucuaacaauagcuccgaaagccacaccucuuccgcuagacagcucagccggaacauuacacaacauaucucuugugccuuuggacugaaaaaugaggaggaaggcccuugggcugacggcggguccggagagcccgcccacgcgugccgccauagcgucaugucuaccacagaaauuaucuccccgaccagaagccuggaucgguucccugagguggaacuccugucccaccgccuuccccagguuuga

SEQ ID NO: 69343 - RNA, 2280 nt, Artificial Sequence
  derived and/or modified sequence opt5 from FIGN__Homo_sapiens__NP_060556
augaucagcuccaccucuguguacggccugaagaugcaguggacacccgagcacgcccaauggccugaacagcauuucgacauuacgagcaccacaagauccccggcucacaaagucgaggccuaucgggggcaucuccagcgcaccuaccaguaugcgugggcuaacgaugacaucucugcccugacagccagcaaucuucugaagaaauacgcugaaaaguauuccggcauucucgagggacccguugauagaccugugcugucuaacuacagcgacacccccuccgggcuugugaauggacggaaaaacgaaagcgagccuuggcaacccucucucaauuccgaggccgucuauccuaugaacugcgugccggauguuaucacagcuagcaaggccggcgugucuuccgcgcugcccccugccgacgucagcgcuucuauuggguccagccccggaguggccuccaaucugaccgaaccuucuuacagcuccagcacguguggcucucacaccguucccucccugcaugcuggccucccgagccaggaguacgccccuggguauaacggaucuuaccugcacagcacauauuccucucagcccgcgccugcccuucccagcccccacccuuccccgcugcauagcucuggccuccugcagcccccucccccucccccgccucccccugcucuugugcccggguacaauggaaccuccaaccugagcucuuauuccuacccuagcgccuccuaucccccgcaaacagcugucggcucuggguacagcccuggaggcgcucccccucccccguccgccuaccuccccucuggcaucccugcccccaccccucugcccccuacgacagugcccggguauaccuaccagggacacggccugacaccgaucgcgccuagcgcccucaccaauuccagcgcuucuucccugaagcgcaaagccuuuuauauggccgggcagggagauauggacagcucuuacggcaacuauuccuacgggcagcaaagaagcacccagucucccauguaucggaugccugauaauagcauuuccaacacaaaucgcggaaacggcuucgacagaagcgcugaaacgucuucccuugccuuuaagcccaccaaacagcugaugagcuccgagcaacagcggaaguucucuagccaguccucucgcgcgcucacaccgccuagcuacuccaccgcuaaaaacucucugggcagcagauccagcgagucuuuugggaaguacacaucccccgugaugagcgaacauggagaugagcaccggcagcuucugucucacccuaugcaaggccccgggcuccgcgccgccaccuccagcaaucauucugucgacgaacagcugaagaacacggauacacaccugaucgaccucguuaccaaugagauuaucacccagggacccccuguggacuggaacgauauugcuggccuggaccuugugaaagccgucaucaaggaagaggugcuguggccgguucucagauccgaugcuuucagcgggcugacagcccuuccccgguccauucugcucuuuggcccucgcggaaccggcaaaacacugcuggggagaugcaucgcgagccagcucggagccacguucuuuaagaucgcuggcucugggcugguggccaaauggcuuggagaggcugaaaagauuauccaugccagcuuccuggucgcgcgguguagacaacccuccgugauuuuuguuucugacaucgauaugcuccugagcucccaggugaaugaggaacacucuccugucagccgcaugcggaccgaguuccugaugcagcuugacacagugcucaccuccgccgaagaucagauugucgugaucugcgcuacaucuaaacccgaggagaucgacgaaagccugagacgcuauuuuaugaagcggcugcucauuccucugccggauuccaccgccagacaucaaaucauuguucagcuucugagccagcacaacuacugucucaaugacaaggaguucgcucugcuggugcagcgcacggaaggcuucucugggcuugaugucgcccaccucugccaagaggccgugguuggcccccugcaugcuaugccugcgaccgaccuguccgccaucaugcccagccagcuccggccugugacauaucaggacuuugaaaacgcuuucuguaaaauucaacccucuaucucccagaaggagcuggauauguacgucgaguggaauaaaauguuuggaugcagccaguga

SEQ ID NO: 69344 - RNA, 3651 nt, Artificial Sequence
  derived and/or modified sequence opt5 from FILIP1__Homo_sapiens__NP_001276916
auggugggcaugagaagccggaaccaagggggagaguccgccucugacggccacaucagcugccccaagccuuccauuaucgggaaugcuggagaaaaaucucugagcgaggaugccaagaaaaagaaaaaguccaaccgcaaggaagacgaugucauggcgucuggcaccguuaaaagacaucucaagacaagcggggagugugaacggaaaacgaagaaaucccuggagcuuagcaaggaggaccugauucagcuccugucuaucauggaaggagagcuucaggcucgcgaagaugugauucacaugcugaagaccgagaaaacaaagccggaggugcucgaagcccauuacggcuccgccgagcccgaaaaaguccugagagugcugcaccgggacgcuauccucgcccaggaaaagagcaucggcgaagauguuuaugagaaaccuauuucugagcuggaccgccuugaagagaagcagaaagaaaccuacagacggaugcuggagcaacuccugcuugcugaaaagugccaucgcagaacaguguaugagcuggagaaugaaaagcacaaacacaccgauuacaugaacaaguccgacgauuucacaaaucuccuggagcaggaacgggagcgccugaaaaagcuccuggaacaggagaaagccuaucaggcgagaaaggagaaggaaaacgccaaacggcuuaauaagcugcgcgacgagcucgucaaacuuaagagcuuugcucuuaugcugguggaugaaagacaaaugcauaucgagcagcucgggcugcagucucagaaaguucaagaccugacccagaagcuccgggaggaagaggaaaagcugaaagccauuacguccaagagcaaagaggacagacagaagcugcugaaacucgaaguggauuucgagcacaaggcuucccgcuuuucucaagagcaugaagagaugaacgccaagcuggcgaaucaggaaagccacaaccggcagcuuagacugaaacucgucggacugacccagcgcaucgaggaacuggaggagacaaauaagaaccuccaaaaagccgaagaggaacugcaggagcuucgggacaagauugcuaaaggcgaauguggaaauuccagccugauggccgagguggagaaccucagaaagcgcgugcuggaaauggaggggaaagaugaagagaucaccaagacagagucucagugccgggaacugagaaagaaacuucaggaggaggagcaccauuccaaggaacuccgccuggaggucgagaaacugcaaaagcggaugagcgaacucgagaaacuggaagaggcuuucucuaagagcaaguccgaauguacccagcuucaccugaaucucgagaaagagaagaaccugacgaaagaccugcuuaacgaacucgagguugugaagucuagagugaaagaacuggagugcagcgaaucccgccuggagaaggccgagcucagccugaaggaugaccuuacaaaacugaagucuuuuaccgucaugcucguggaugaacggaaaaauaugauggagaagauuaaacaggaagagagaaagguugacggccugaacaagaauuucaaaguggagcaggggaaggucauggaugugacagaaaaacugaucgaggaauccaagaaacuucucaagcugaaaagcgagauggaagagaagguuuacaaccugacccgggagcgcgacgaacucaucggaaagcugaaaucugaggaagagaaguccagcgaacuuuccuguucuguggaucugcucaaaaagagacuggacggcauugaggaggucgaacgggagaucaccagaggccgcagccggaaaggguccgaacugacaugccccgaggacaauaagauuaaggaacuuacgcucgagaucgagagacugaaaaagcgccugcaacagcucgaaguggucgagggagaucugaugaaaaccgaagacgaguaugaucagcuugagcagaaguuuagaacagaacaagacaaagccaacuuccugucucagcagcucgaggaaauuaagcaucaaaucgcuaagaauaaagcgaucgagaagggcgaagugguuagccaggaggccgagcugcggcaccgcuuuagacuggaagaggcuaaaucccgggaucuuaaggccgaagugcaggcccugaaagagaagauucaugaacucaugaacaaggaggaccagcugagccaacuccaggucgauuacucugugcugcagcagcgcuucauggaggaagagaauaaaaacaagaauauggggcaagaaguucuuaaccugaccaaagagcucgaacuguccaagagauacagccgggcucugcgcccuucugugaauggaagacggauggucgacgugcccgugacauccaccggcguucagacggaugccgucagcggggaggcggcugaggaagagaccccugccguguuuauccgcaaaucuuuccaggaagagaaccacauuaugagcaaucuuagacaggugggacugaagaagccggucgagcgguccagcgugcucgacagauaucccccugccgcuaacgaacugacaaugcgcaaaucuuggauccccuggaugcggaagagagagaacggcccuuccauuacccaagaaaaaggcccccgcacaaauagcuccccggggcacccuggagagguugugcucucucccaagcagggccagccucugcauauccgggucacccccgaucacgaaaacagcacagccacgcuugagaucaccucccccacaucugaggaauuuuucagcuccaccacagugauuccuacccuggggaaucaaaaaccgagaaucacgauuauccccucuccuaacguuaugccccagaagcagaaaagcggagacaccacacucggcccugagcgcgcuaugucccccgugaccauuacaaccuucagccgggaaaagacgccggagucugggagaggcgccuuugcggaucgcccuacaucccccauccagauuaugaccgucagcacaucugccgcuccugccgaaaucgcugugucccccgagagccaagagaugccuaugggacggaccauccugaagguuacccccgaaaaacagacagugccgacgccugucagaaaguacaauucuaacgccaauauuaucaccacagaggacaacaaaauucauauccaccugggcucccaguucaagcggagccccgggaccuccggagaaggcgugagccccgugauuacaguccgcccuguuaaugugaccgcggagaaagaagugucuacggggacaguccuuagaagcccgcggaaccaccuguccucucgccccggagccagcaaggugaccuccaccaucacaaucaccccuguuacaacgucuagcgcuagaggcacccaguccgugucugggcaagacggcagcucccagcggcccacaccuacccgcauucccaugagcaagggaaugaaagccggcaagccugucguggcugcccccggggccggaaaucucacaaaauuugagccgagagcugagacccagucuaugaagaucgaacugaaaaaguccgcggccagcucuacgaccucccucggcgggggaaagggcuga

SEQ ID NO: 69345 - RNA, 3402 nt, Artificial Sequence
  derived and/or modified sequence opt5 from FILIP1L__Homo_sapiens__NP_001035924
augagaagccggggcuccgacaccgaggggucugcccagaagaaauucccccgccacacaaagggacauagcuuucaaggcccuaaaaacaugaagcacagacagcaggauaaagacuccccgucugaaagcgaugugauccugcccugcccuaaggcugagaagccccauuccgggaauggacaccaggccgaagaccucucucgggaugaccugcuuuuccugcucagcauucuggagggcgaacuucaagcgcgcgaugaggucaucgggauucugaaagcugagaagauggaccucgcccugcuggaagcccaguacggauuuguuacgccuaaaaaggugcucgaggcucugcagagagaugccuuccaggcuaaauccacccccuggcaagaagacaucuaugagaagccuaugaacgagcuugauaagguggucgaaaaacauaaggagagcuaccggcgcauucugggccagcuccugguggccgaaaaaucuagacggcagacaauccuugagcuggaagaggagaagcgcaaacacaaggaauauauggagaaauccgacgaauuuaucugucuccuggagcaggaaugcgagagacugaagaagcucauugaucaagagaucaaaagccaggaagagaaggaacaggagaaagaaaagcggguuaccacacugaaagaggagcuuaccaagcugaagucuuucgcgcucaugguggucgacgaacaacagcgccugacagcccagcuuacccugcagagacaaaagauucaggagcucacgaccaaugcuaaggaaacacacaccaaacuggcccuggcugaggcccgggugcaggaggaagaacagaaggcgacacgccucgaaaaagagcugcaaacccagacgacaaaguuucaucaggaccaggauaccaucauggccaaacuuacaaacgaagacucccaaaauagacagcugcagcagaaacucgcugcccugagccggcaaauugaugagcuugaggaaaccaacagaucucugcgcaaggcugaggaagaacuccaggacaucaaagaaaagauuuccaaaggcgaguacgggaaugccggaaucauggccgagguugaggagcugcggaagagagugcuggauauggaaggcaaggacgaggaacucaucaaaauggaggagcagugucgcgaucugaacaagcggcuugaaagagagacccugcaaagcaaagacuucaagcucgaagucgagaaacuguccaagcgcauuauggcucuggagaaacuugaagaugcguuuaauaagucuaagcaggagugcuauagccucaaauguaaccuggaaaaggagcggaugacaacgaaacagcugucccaggaacucgagagccugaaggugagaaucaaagagcuugaagccauugagucucgccuggaaaagaccgaguucacacucaaggaagaccugaccaaacugaagacacuuaccgugauguuugucgaugagcggaaaacgauguccgagaagcucaaaaagacagaagacaagcugcaagcugccagcucucagcugcagguugagcagaauaaagugaccaccgugacagaaaagcucaucgaggaaaccaaaagagcccucaagagcaaaacagacgucgaggagaagauguacuccgugacgaaggaacgcgaugaccuuaaaaacaagcugaaagcugaggaagagaaggggaaugaucuccugucucggguuaacaugcugaaaaauagacuucaaagccucgaggccauugaaaaggacuuccugaaaaacaagcugaaccaggauuccggaaagagcaccacagcgcuccaccaggagaauaacaaaaucaaggaacugucucaggagguggaacggcuuaaacugaagcucaaagacaugaaggcuaucgaggaugaccugaugaagaccgaggaugaauaugagacacuggaacgcagauacgccaaugagcgggacaaagcccaauuucuuuccaaggaacucgagcaugucaaaauggagcuggcuaaguacaaacuggccgaaaagaccgagacgagccacgaacaguggcuguucaagagacugcaggaggaagaggcuaaaucuggccaccuuucccgcgagguggaugcccugaaggagaaaauucaugaguauauggcgaccgaagaccucaucugccaucugcaaggggaucacagcguucugcagaagaaacuuaaccagcaggagaaucggaacagagaccugggacgcgagauugaaaaucucacaaaggagcuggaaagauaccggcacuucuccaagucucuccgcccgagccugaacggcagacggaucuccgacccccaaguguuuucuaaagagguccagaccgaagccguggauaaugagccucccgacuauaagagccuuauuccucuggagcgcgcugucaucaacggccagcucuacgaagaguccgaaaaucaggaugaggaccccaacgaugaagggagcgugcugucuuucaaauguucccaaagcacaccgugcccuguuaauagaaagcuguggauccccuggaugaaaucuaaggagggacaucuucagaacggcaagaugcagaccaaaccuaaugccaacuuugugcagcccggggaccugguccucucccacacgcccggacaaccucugcacauuaaggugacaccggaucauguucagaacaccgcuacacucgagaucaccagccccaccacagaaucuccucacagcuauacguccaccgccgugauucccaauuguggcacaccuaaacagcggaucaccauucugcagaacgcgagcaucacacccgucaagucuaaaaccuccacggaggaccuuaugaaucuggaacaagggaugagcccgauuacaauggccaccuucgcucgcgcccagaccccugaguccugcggaucucucacacccgaaagaaccaugagcccuauccaggugcuggcugugacaggcuccgccucuagccccgagcaaggccgguccccugagcccacggaaaucucugccaagcaugcuauuuuucgcguuagcccggauagacaguccagcuggcaguuccagcggucuaacuccaauucuagcuccgucaucaccacagaggacaacaaaauucacauccaccuggggagcccuuacaugcaagcgguggccucucccgugagacccgcuuccccuagcgccccgcuucaggauaaucgcacccagggacugauuaacggcgcccucaauaagacaaccaacaaggucacguccagcaucaccaucacacccaccgcuacaccucugccccggcagucucaaauuaccgugagcaauaucuauaacuga

SEQ ID NO: 69346 - RNA, 1767 nt, Artificial Sequence
  derived and/or modified sequence opt5 from FIP1L1__Homo_sapiens__NP_001128409
augagcgccggcgagguggaaagacuggucuccgagcucucugggggaaccggcggggacgaagaggaagaguggcuguacggagaugagaacgaaguugagcggcccgaagaggagaaugcuagcgccaacccuccguccggcaucgaagacgagacagcggaaaauggggugcccaagccuaaagugacggagaccgaagaugacucugauagcgacuccgaugacgaugaggacgauguccacgugacaauuggagacaucaagaccggcgcuccccaguauggcucuuacgggacagccccuguuaaccuuaauauuaaaaccggaggccgcguguaugggacaaccggaacgaaggucaaaggcguggaucuggacgcccccgggagcaucaacggaguuccucuccuggagguggaccuugauuccuucgaagacaagccguggagaaagcccggcgcugaucugagcgacuacuuuaauuauggcuucaacgaggauaccuggaaagccuacugcgaaaagcaaaaacggauucgcauggggcucgaggucaucccugugacaucuaccacaaauaagaucaccgcugaagacuguacgauggaggugacacccggagccgagauucaggauggcagauuuaaccuguucaaaguccagcaggggcggaccggaaauuccgaaaaggagacagcgcugccuagcaccaaggccgaauuuaccucucccccgucccucuucaaaacaggccugccucccagccgcaacucuacguccagccaaucccagaccucuacagcuagcagaaaggccaauuccagcguugggaaauggcaggaccgguauggacgcgcugagucuccugaucuuagacggcugcccggcgccaucgacgugauuggccagaccaucacaauuucccgcguggaagggagacggcgcgcgaacgagaauagcaacauccaaguccucucugagagaagcgccaccgaaguggauaacaauuuuuccaagcccccuccguucuuucccccuggagcucccccuacgcaucugcccccgccucccuuccuuccucccccucccacaguuucuaccgccccgccucugauucccccucccggcaucccgaucaccgugcccccucccggguuuccucccccucccggagcuccgccucccagccucauuccuacaaucgaguccggccacagcucuggguacgacucccggagcgccagagccuuccccuacggcaacgucgcuuuuccgcaucugccuggaucugcgcccuccuggccuagccugguggacaccuccaaacagugggauuauuacgcccgccgggaaaaggacagagaucgcgagcgggacagagaucgcgagcgggacagagaucgcgaccgggaaagagagcgcacacgggaaagagagcgggaacgcgaucacucucccacgcccagcguuuucaauuccgacgaggagagauaucgguacagagaauaugcugagcgcggcuacgaacggcauagagccucucgcgagaaagaagagagacaccgggagcgcagacaccgggaaaaggaggaaacccgccauaagagcuccagaagcaacucucggcgcagacacgaguccgaagagggggauagccaucggcgccacaaacacaagaaaucuaagagauccaaagagggaaaggaagccggcagcgagccugcuccggaacaggagucuacagaggccacccccgcggaauga

SEQ ID NO: 69347 - RNA, 459 nt, Artificial Sequence
  derived and/or modified sequence opt5 from FIS1__Homo_sapiens__NP_057152
auggaggccgugcugaacgaacucgucagcguugaggaccugcuuaaguucgagaaaaaguuucaguccgagaaagcugccggcucugugagcaaguccacccaauucgaauacgcguggugccuggugagaucuaaauauaaugaugacauccggaaggggauuguccuccuggaggagcuucugcccaagggaagcaaagaagaacagcgcgauuacguguuuuaucucgcuguuggcaacuacagacugaaggaauaugagaaagcccugaaguacgugcgggggcuccugcagacagagccucagaauaaccaagccaaagaacuugagcgccugaucgacaaggcuaugaagaaagauggacucgucggcauggccauuguugggggaauggcucugggcguggccggccuugcggggcugaucggacucgccguguccaagucuaaaagcuga

SEQ ID NO: 69348 - RNA, 879 nt, Artificial Sequence
  derived and/or modified sequence opt5 from FITM1__Homo_sapiens__NP_981947
auggagagaggccccguggucggggccggacugggcgcuggggcccggauccaggcgcuccugggaugccuucugaagguucuccuguggguggcuagcgcccuucuguacuucggcuccgaacaagccgcucgccuccuggggucuccuugucugagacggcucuaucacgccuggcuggcugccguggucauuuuuggaccgcuucugcaguuccaugugaacccccgcaccaucuuugcgagccacggcaauuucuuuaacauuaaauucguuaauuccgccuggggcuggacaugcacguuucucgggggauucgugcugcuugucguguuucuggcuaccagacggguugccgugacagcucgccaucucucuagacuggucgugggcgccgcgguguggcgcggggccggacgggcuuuccugcucaucgaggaccugaccggcagcuguuuugaaccucuuccccaggggcugcuccugcacgagcuuccugauagacgguccugccuggccgcuggacaucaguggcgcggcuacacagucucuagccacaccuuccuccugacauuuuguugccugcucauggccgaagaggccgcuguuuucgcgaaguaucuggcccacggccuucccgcuggggccccucugagacucguguuccugcuuaacgugcugcuccugggacuguggaauuuucuccugcuuuguaccgucauuuacuuccaucaauauacgcacaaagugguuggcgccgcuguggggaccuuugccugguaccugacauauggauccugguaccaucagccguggagccccggcucuccugggcacggacucuucccccggccucacuccagccgcaagcauaacuga

SEQ ID NO: 69349 - RNA, 789 nt, Artificial Sequence
  derived and/or modified sequence opt5 from FITM2__Homo_sapiens__NP_001073941
auggagcaccuggaaagaugcgaguggcuccugcggggcacccuugugcgcgccgcugucagacgguaccugcccugggcccucguugcgagcaugcuggcugggucccuucugaaggaacucucuccucugccggagagcuaucuguccaacaaacgcaaugugcucaacguguacuucgucaagguggccugggccuggacauuuugucugcuucugcccuucaucgcucucacgaauuaucaucugaccggaaaagccggccuuguucugagacggcucucuacacugcugguggggaccgcuauuugguacaucugcacaagcaucuuuuccaacauugaacacuauaccggaucuuguuaccagagcccugcccucgagggcguccgcaaggagcaucaauccaaacagcagugccaccaggaagggggauucuggcauggcuuugacauuagcggccacucuuuccugcuuacauuuugugcgcugaugaucguggaggaaauguccguucuccacgaggugaagaccgauagaagccauugccugcacacggccaucaccacacuugucguggcucuggggauucucaccuucaucugggugcugauguuucuguguacagccgucuauuuccauaaucucucucaaaagguuuuuggaacccuguucggccuucuguccugguacgggacguacggauuuugguaucccaaggcuuucagcccuggccugcccccucagucuugcucccucaaccuuaaacaggacagcuacaaaaaguga

SEQ ID NO: 69350 - RNA, 1314 nt, Artificial Sequence
  derived and/or modified sequence opt5 from FJX1__Homo_sapiens__NP_055159
augggcagacggaugcgcggggccgcugccaccgcgggacuguggcuccuggcucuuggcagccugcucgcccuguggggagggcuucugcccccuagaacagagcucccggccucccggcccccugaagaccgccugcccagacggccugcucgcucuggcgggcccgccccugcuccgagauucccccugccucccccucucgccugggaugcgcggggaggcagccugaagacguuucgcgcccuucugacccucgcugccggcgcugacgggcccccgagacagucccggucugagccucgcuggcacgugagcgccagacaaccccggccugaagaguccgcggccguccauggaggcguuuucuggucucgcgggcuggaagaacaggugccucccggauuuagcgaggcucaggccgcugccuggcuugaagccgcuagaggcgcgcggaugguggcccuggagagagggggaugcggccgcuccagcaaccggcucgcuagauucgccgauggcacacgcgccuguguccgguacgggaucaaucccgaacagauucaaggagaggcucugucuuauuaccuggccagacuccugggccuucagcgccacgugccgccccuggcgcucgcucggguugaggccagaggggcccagugggcucaggugcaagaggagcugcgcgccgcucauuggaccgaaggauccgucgugagccuuacacgguggcugccuaaccucaccgacguugugguccccgccccuuggagaucugaggauggccgccugcggccccugagagacgccgggggagaacucgcgaaucugucccaggcugagcuuguggaucuggugcaguggacagaccucauccuguuugauuaucuuaccgccaacuucgaccggcuggucagcaaucucuuuucucugcagugggauccgcgcguuaugcaaagagcuacguccaaccugcaccggggcccuggcggggcccucguguuccuggacaaugaggcgggacuugugcauggcuacagagucgccgggaugugggauaaauauaacgaaccccugcuccagagcgugugcguuuuucgcgagcggaccgcuagacgcgugcuggaacugcacagaggacaggacgccgcugcccggcuucuccgccuguacagacggcacgagccucgcuuccccgaacuggccgcucucgcggacccucaugcccaacugcuucagagacggcuggauuuucucgcuaagcacauucugcauuguaaagccaaguauggccgcagauccgggacauga

SEQ ID NO: 69351 - RNA, 1749 nt, Artificial Sequence
  derived and/or modified sequence opt5 from FKBP10__Homo_sapiens__NP_068758
auguuccccgccggcccuccgagccacucccugcucagacugccccuucugcagcuccugcuucuggugguccaagcuguugggcggggacucggccgcgccucuccugcugggggaccccuggaggacguggugaucgaaagauaccauauuccucgggcgugcccccgcgagguccagaugggcgauuuugugagauaucacuacaacgggaccuucgaagacggaaagaaauuugauagcuccuaugaccggaauacacugguugccaucguggucggcgugggccgccucauuacggggauggauagaggacugaugggcauguguguuaacgagcggcgcagacuuaucgugccuccgcaucugggguacggaucuauuggccucgccgggcugauucccccugacgcuacccuuuauuucgaugucgugcugcucgacguguggaauaaggaagauacaguccagguuagcacccugcugcggcccccucacugcccccgcauggugcaggacggagauuuugugagauaccauuauaacggcacacuccuggacggcaccuccuucgauacaucuuacagcaaagggggaaccuacgacacguaugucggcuccggguggcuuaucaagggaauggaccaaggccugcucgggauguguccgggagagcggcgcaaaaucaucauuccucccuuucuggccuacggcgagaagggcuaugggaccgugaucccuccccaggcuagccuuguuuuccacgugcugcucauugauguccacaaucccaaggacgccgugcagcuggaaacacuggagcucccuccgggaugcguuagacgggcgggcgccggggauuuuaugagauaccauuauaacggaucucugauggacggcacccuuuucgauuccagcuacucucgcaaucacacauauaacaccuacaucgggcagggcuacauuauccccggaauggaccaaggccugcagggggcuuguaugggagaacggagacgcaucacgauuccuccccaucucgccuauggcgagaaugggacaggagauaaaaucccuggcuccgcugugcugauuuuuaacguccacgugaucgacuuccacaaucccgccgaugucguggagauucggacccuuagcagaccgucugaaacaugcaacgagaccaccaagcugggggacuuuguucgcuaccauuauaauuguucccuccuggauggcacacagcuguucacgagccacgacuacggagcgccucaggaagccacccucggcgcuaacaaagugaucgaggggcuggacacaggacuucaaggcaugugcgucggggaacggagacagcugaucgugcccccucaucucgcccacggagaguccggcgcucgcgggguucccggcucugccgugcugcuguucgaggucgaacuugugagccgggaggauggacucccuaccggcuaucuguuuguguggcauaaggaucccccggccaaucuguucgaagacauggaccucaacaaagauggggagguuccucccgaagaguuuuccacauucauuaaggcucaggucagcgagggaaagggcagacugaugcccgggcaagacccugagaaaaccaucggagauauguuucagaaccaggaccgcaaucaggauggcaagauuacgguggacgaacuuaaacugaagucugaugaagacgaggaacgggugcacgaggagcucuga

SEQ ID NO: 69352 - RNA, 300 nt, Artificial Sequence
  derived and/or modified sequence opt5 from FKBP11__Homo_sapiens__NP_001137253
augugcgugggcgaaaagagacgggccaucauucccagccaccuggcuuacgggaaacgcggauucccuccguccguccccgccgacgcgguugugcaguaugauguggaacucaucgcucugauuagagccaacuacuggcuuaagcuggucaaaggcauccucccucugguggggauggccaugguucccgcccuucugggacucauuggcuaucaucuguaccggaaggcuaaucgcccuaaagugucuaagaagaaacugaaggaggagaaaagaaacaagagcaaaaagaaguga

SEQ ID NO: 69353 - RNA, 636 nt, Artificial Sequence
  derived and/or modified sequence opt5 from FKBP14__Homo_sapiens__NP_060416
augagacuguuccucuggaacgccgugcugacccuuuuugucacaagccugaucggcgcucucauucccgagccugaaguuaagaucgaggugcugcagaaaccguucauuugccaccggaagacgaaagggggagaccuuaugcuggugcauuacgaaggcuaucucgagaaggaugggucccuguuucacucuacccauaaacacaauaacggacaacccaucugguucacacugggcauucucgaagcccugaaggggugggaccagggacuuaagggcaugugugucggcgagaaacgcaagcugaucaucccucccgcgcucggguacggaaaagagggcaaggggaaaauuccucccgaaagcacccugaucuuuaauauugaucuucuggagaucagaaacggaccucggucccaugaaucuuuccaggagauggaccucaaugaugacuggaagcugagcaaggaugaggugaaagccuaucugaagaaagaauuugagaagcacggcgcuguugugaacgaaucccaccaugacgcccucgucgaggauauuuucgacaaagaagaugaggacaaggauggguuuaucucugcucgcgaguucacauacaaacacgacgaacuguga

SEQ ID NO: 69354 - RNA, 3660 nt, Artificial Sequence
  derived and/or modified sequence opt5 from FKBP15__Homo_sapiens__NP_056073
auguucggcgccggggacgaggaugacaccgauuuucugagccccuccggaggcgcuagacucgccucucuguucgggcuugaccaggcggcugccggacacggcaacgaauuuuuccaauacaccgccccuaagcagccgaaaaaggggcagggaacggcugccaccggcaaucaggcuacacccaaaaccgccccugcgacaaugagcacccccacaauccugguggccaccgcuguccaugccuaucgguacacgaacggccaauauguuaagcaggggaaauuuggagcugccgugcucggcaaucacaccgcgcgcgaguaccgcauucugcuuuauaucucccagcagcaaccugugacagucgcccggauucaugugaacuucgaacugaugguucgccccaauaacuacucuaccuuuuaugaugaccagagacagaauuggagcaucauguucgaguccgaaaaggcugccguggaguuuaacaagcaggucugcauugcuaaauguaauucuacaagcucccucgaugccgugcugagccaagaccugaucguugccgaugggccugcuguggaggucggagacucucucgaaguggcguacaccggcuggcuguuccagaaccacgugcuugggcaggucuuugauuccacggccaauaaggacaaacugcuccggcugaagcugggaagcggcaaaguuaucaagggcugggaggaugggaugcugggaaugaagaaaggcgggaagcgccuccugauugugccgcccgcuugcgccgugggaucugaaggcgucaucggguggacacaagccaccgacuccauucugguguucgagguugaggugagacgggucaaauuugcucgcgacagcggaucugauggccauuccgugagcuccagagacucugccgcgccuagccccaucccuggcgcugauaaccucuccgccgaccccguugugagcccgccuacaucuauucccuucaaguccggggaaccugcccugcggaccaaaagcaauucucuuagcgagcagcuggcuaucaacaccucccccgaugccgucaaggcuaaacucauuucucgcauggccaagaugggacagcccaugcugccuauccuuccgccccagcuggacagcaaugauuccgaaaucgaggacgugaacacacuccaaggcgggggacagccugucgugacgcccagcguucagccuucucugcaccccgcgcacccggcccugccucagaugaccucccaagcuccccagccuagcgugacaggccuccaggcccccucugcugcccugaugcaggucuccagccuugauucccauucugcggugagcgggaacgcccaauccuuccagccuuacgcuggcaugcaggccuaugcuuacccccaggccucugccguuaccagccaacugcagccggugagaccucucuaucccgcuccccugucccagccuccgcacuuucaaggaagcggcgacauggcgucuuuccuuaugacagaagcccggcagcauaauaccgagauucgcauggcugucuccaagguggccgauaaaauggaccaccugaugacgaagguggaggaacuccagaaacacagcgccgggaacucuaugcugauccccuccaugagcguuacaauggagaccucuaugauuaugagcaauauccagagaauuauccaagaaaacgagcggcugaagcaggaaauccucgagaaauccaauagaauugaggaacagaacgacaagaucagcgagcugauugaacgcaaucagcgguacgucgagcaaucuaaccuuaugauggaaaagagaaauaacucccugcagaccgcuacagagaauacccaggcccgcgugcuccaugcggagcaggaaaaagcuaaggugacagaggaacuggccgccgcuacggcccaagucagccaccuucagcuuaaaaugaccgcgcaucagaagaaagagacagagcuccaaaugcagcugaccgaaucccugaaggagacagaucuccugcggggacagcuuaccaaggugcaggcuaaacugucugaacuccaagagacgagcgaacaggcccaguccaaguuuaaaucugagaagcagaacagaaaacaacuggagcugaagguuaccagccuugaagaggaacucacagaccugcgcguggagaaggaaucccuggagaaaaaucucucugagcggaagaaaaagagcgcccaggaaagaucccaggcugaggaagagaucgaugaaauucgcaaaagcuaucaggaggagcuggacaaacuucggcaacugcucaagaagaccagagucucuacagaucaggccgcugccgaacagcugucccuggugcaggcggagcuucaaacccagugggaagccaagugugagcaccuccuggcuagcgccaaagacgagcaucugcagcaauaccaggaaguuugcgcucagcgcgaugccuaucagcaaaagcucgugcagcugcaggagaaaugucuugcccugcaggcucaaaucacggcgcucacaaagcagaacgaacagcacaucaaagagcuggaaaagaauaagucucagauguccggcgucgaggccgcugccagcgacccuucugagaaagugaagaaaauuaugaaccaaguuuuccagucccugcggagagaauuugagcuugaagagagcuacaacgggcggaccauccucggaacaauuaugaauaccaucaagauggugacccugcagcugcucaaccaacaggaacaggagaaagaggaauccagcucugaggaagaggaagagaaggccgaggaacgccccagacggccuagccaggagcaauccgcuucugccagcuccggccagccccaggcgccucugaauagagaacgccccgagucuccgauggucccuagcgaacaggugguggaggaggcugucccccuuccuccccaagcccugacaacgucccaggaugggcaccggagaaagggcgacucugaagccgaggcucucagcgaaauuaaagauggaucccugccgccugagcugagcugcauccccucucaucgcguucuuggcccucccaccuccauucccccugagccgcuggggcccgugagcauggacucugaaugugaggaaucccucgccgcgagcccuauggcugccaagcccgauaacccuuccggaaaagugugcgucagagagguggcccccgacggcccucugcaggaaucuagcacacggcucucccugaccagcgacccggaggagggggauccccuugcucugggaccugaaucucccggcgagccucagcccccgcaacucaagaaagacgauguuacauccagcaccgggccucacaaggaacugucuagcacggaggccggcuccacaguggcuggagccgcgcugcgccccucucaucacagccagagauccucucuuagcggcgacgaagaggaugagcuguucaagggggccacccucaaagcucugcggcccaaggcccagccugaagaggaagacgaggaugaggucuccaugaaaggaagacccccuccgacaccccucuuuggcgacgaugacgaugacgaugacaucgacuggcugggguga

SEQ ID NO: 69355 - RNA, 327 nt, Artificial Sequence
  derived and/or modified sequence opt5 from FKBP1A__Homo_sapiens__NP_000792
augggcgugcaggucgagaccaucagccccggggacggaagaacauucccuaagcggggccaaacgugcguugugcacuacaccgggaugcuggaagauggcaaaaaguuugacuccucucgcgauagaaacaaaccguucaaguuuaugcucggaaaacaggaggugauccgggggugggaagagggagucgcccagaugagcgugggccagcgcgcuaagcugacaaucucccccgacuaugccuacggcgcgaccgggcauccuggaauuauucccccucacgcuacacuuguuuucgauguggaacugcucaagcuggaguga

SEQ ID NO: 69356 - RNA, 327 nt, Artificial Sequence
  derived and/or modified sequence opt5 from FKBP1B__Homo_sapiens__NP_004107
augggcguggagaucgaaaccauuagccccggggacggaagaacauucccuaagaaaggccagacgugcgucguucacuacaccgggaugcugcaaaacggaaagaaauuugauuccucucgggaccgcaauaagccguucaaauuuagaaucggcaagcaggaggugauuaagggguucgaagagggagccgcucagaugagccucggccagcgggccaaacugacauguacccccgauguggcguauggcgcuacagggcauccuggagucauucccccuaacgccacccuuaucuuugacguggaacugcucaaucuggaguga

SEQ ID NO: 69357 - RNA, 429 nt, Artificial Sequence
  derived and/or modified sequence opt5 from FKBP2__Homo_sapiens__NP_004461
augagacugagcugguuccgggugcucaccguccuguccaucugccuuucugccguugcuacagccacgggcgcggaggggaagcgcaaacugcagauuggagugaagaaaagaguggaccacugucccaucaagagccggaaaggcgauguccuccauaugcacuacaccgggaagcuggaagacggaacagaguuugauuccucucuuccucaaaaccagccguucguguuuagccugggcaccgggcagguuauuaagggaugggaccagggccuccugggcaugugcgaaggggagaaacgcaagcuggugauccccuccgaacucggauauggcgagagaggggcuccucccaaaauuccuggaggcgccacacuggucuucgagguggaacuucugaagaucgagcggcgcaccgaacucuga

SEQ ID NO: 69358 - RNA, 675 nt, Artificial Sequence
  derived and/or modified sequence opt5 from FKBP3__Homo_sapiens__NP_002004
auggccgcugccgugccccagagagcguggaccgucgagcaacugcggagcgaacagcucccuaagaaagacaucauuaaguuccugcaggagcacggcuccgauucuuuucuugcugaacauaaacugcucgggaacaucaagaauguugccaaaacagccaacaaggaccaccuggugacggcuuacaaucaucuuuucgagaccaagcgcuuuaaaggaacagaaagcauuuccaaggugucugagcaggucaaaaacgugaagcugaaugaggauaaaccgaaggaaaccaagagcgaggaaacacucgacgagggacccccuaaauauaccaaguccguucugaaaaagggggauaaaacaaacuuccccaagaaaggagacgugguccacugcugguacaccggcacgcugcaagaugggaccguguuugacacaaauauccagaccucugccaagaagaaaaagaacgcuaaaccucucagcuucaagguuggagugggcaaagucauuagaggcugggaugaggcccugcuuacaauguccaagggggaaaaggcgcggcuggagaucgaacccgagugggccuauggcaaaaagggccagccugacgcuaaaaucccgcccaaugccaagcucaccuuugaaguggagcugguggauauugacuga

SEQ ID NO: 69359 - RNA, 1380 nt, Artificial Sequence
  derived and/or modified sequence opt5 from FKBP4__Homo_sapiens__NP_002005
augaccgccgaggaaaugaaggcuacagagagcggcgcccaguccgcgccccugccuauggaagggguggacaucucuccgaaacaagaugagggaguccucaagguuauuaaaagagaaggcacggggaccgagaugcccaugaucggagaccggguguucgugcacuacacaggcuggcugcuugaugggaccaaguuugacagcucccuggaucgcaaagacaaguucucuuuugaucucggaaagggcgaggucauuaaggcuugggacaucgccauugccacaaugaaagugggcgaaguuugccauaucaccuguaaaccugaguaugcuuacgggagcgccggaucucccccuaagauucccccuaacgcuacacugguguucgaagucgagcuuuuugaguucaaaggcgaagaucugaccgaggaagaggacgggggaaucaucagacggauucagacgcgcggcgaaggguaugccaagccgaaugagggagcgaucguggagguugcccucgaaggcuacuauaaggauaaacuguuugaccagagagagcugcgguucgaaauuggcgagggggaaaaccucgaucugcccuacggacuugagcgcgcuauccagagaauggagaagggcgaacacuccauuguguaucugaaaccuagcuacgccuuuggguccgucggaaaggagaaauuccaaauucccccuaaugcugaacucaaguacgagcugcaucuuaagagcuuugaaaaagccaaggagucuugggagaugaacuccgaagagaaacuggaacagagcaccaucgugaaggagcggggcacaguguauuucaaagaggggaaguacaaacaggcgcuccugcaguauaagaagaucgucucuuggcuggaauacgaguccagcuuuucuaaugaagaggcccaaaaagcucaggcccuccgccuggcuucccaccuuaaccuggccaugugccaucucaagcugcaggccuucagcgcugcgaucgaauccuguaauaaagcccuugagcuggacucuaacaaugagaagggacucuucagacggggcgaagcucaccuggccguuaacgacuuugagcuggcccgcgcugauuuccagaaagugcuccaacuguaucccaauaacaaggccgcgaagacccagcuugcugugugccagcaacggauuagacgccagcuggccagagagaaaaagcucuacgccaauauguuugaacggcuggcugaagaggagaacaaagccaaggcugaagccagcuccggcgaccacccgacagauaccgagaugaaagaggaacaaaagagcaauacggcggggucucagucccaggucgaaacagaggccuga

SEQ ID NO: 69360 - RNA, 1374 nt, Artificial Sequence
  derived and/or modified sequence opt5 from FKBP5__Homo_sapiens__NP_001139247
augaccacagacgagggcgccaagaacaaugaagagagccccacggcuaccguggccgaacagggggaggauaucacauccaaaaaggacagaggaguccugaaaauuguuaagcgggugggcaacggggaagagaccccuaugaucggagauaaaguguacguccacuauaagggcaagcucucuaaugggaaaaaguucgacagcucccaugaucgcaacgagccguuuguguucucucugggaaaaggccaaguuauuaaggcgugggacaucggcguggcuacaaugaaaaagggggaaauuugccaccuucuguguaagcccgaguacgccuauggaagcgccggcucccucccuaaaauccccucuaaugcuacccuguuuuucgaaaucgagcuucuggauuuuaagggggaggaccucuucgaagauggaggcauuaucagacggacaaaacgcaagggggagggauacagcaacccuaaugaaggcgccaccgucgagauucaucuggaaggcagaugcgggggacggauguuugacugucgcgauguggcuuucacgguuggcgagggggaggaccacgauauccccauuggaaucgacaaagcccuggaaaagaugcagagagaggaacagugcauucucuaucugggcccucgguacggguuuggagaggcgggcaaaccgaaguucggcaucgaacccaacgccgagcuuaucuaugaggugacccugaaguccuuugaaaaagcuaaggagagcugggaaauggacacaaaagagaagcucgaacaggccgcuauugucaaagagaaggggaccguguacuucaagggaggcaaauacaugcaagccgugauccaguaugggaagauugucucuuggcuggagauggaauacggacuuuccgagaaagaaagcaaggcgucugaguccuuucugcucgccgcuuuccugaaucuggccauguguuaucucaaacugcgcgaguacacaaaggcuguugaaugcugugauaaggcccuuggccuggacagcgccaacgagaaagggcucuauagacggggcgaagcucagcugcuuaugaaugaguucgaaucugcgaagggagauuuugagaaagugcuggaggugaacccucagaauaaggccgcucgccuccaaaucuccaugugccagaaaaaggccaaggaacauaacgagagagaccggcgcauuuacgccaauauguucaaaaaguuugcugaacaggaugccaaagaggaagcgaacaaggcuaugggcaaaaagaccagcgagggggucacgaacgagaaaggaacagacucccaggccauggaagaggaaaagcccgagggccacguguga

SEQ ID NO: 69361 - RNA, 969 nt, Artificial Sequence
  derived and/or modified sequence opt5 from FKBP6__Homo_sapiens__NP_001128683
augagcgccuccucuuggccccagaacggcaugccuccgagcucccuguacgagagacucucucaacggaugcuggacaucagcggggaucgcggagugcuuaaggacgucauuagagaaggcgcuggggaucugguugcccccgacgcguccgugcucgugaaauauucuggauaccuggagcacauggaucggccuuucgacagcaauuauuuucgcaagacccccagacuuaugaaacugggcgaagauaucacacucugggggauggagcugggacugcucuccaugcggcgcggcgaacuggcuagauuccuuuuuaagccuaacuacgccuauggcacgcuggggugucccccucucauuccgcccaauaccacaguccuguucgagaucgagcuucuggacuuucucgauugcgccgaaagcgacaaauucugcgcucugucugccgagcagcaggaucaguuuccucugcaaaaggugcucaagguugcugccaccgaacgggaguucggaaacuaccuguuucgccagaauagauucuaugacgcgaaagugcgguacaagcgcgcccuucugcuccugagacggcgcuccgcucccccugaggaacagcaucuugucgaggccgcuaaacugcccgugcuccugaaccugagcuuuacauaccucaagcuggauagaccgaccauugcccuuuguuauggcgaacaggcgcugaucaucgaccagaaaaaugccaaggcucucuuccggugcgggcaagccugucugcuucugacagaguaccagaaggcuagagacuuucucguucgcgcccagaaagaacaaccuuucaaccacgauauuaauaacgagcugaagaaacuggccucuugcuaucgggacuacguggauaaggagaaagaaauguggcauagaauguucgcucccuguggagacggcuccaccgcgggggagagcuga

SEQ ID NO: 69362 - RNA, 666 nt, Artificial Sequence
  derived and/or modified sequence opt5 from FKBP7__Homo_sapiens__NP_001128684
augcccaagaccaugcacuuccuguuuagauucaucguguuuuucuaccucuggggccuguuuacagcccagcggcagaaaaaggaggaaagcacggaggaagucaaaauugagguucuucaucgcccugaaaacugcuccaagaccucuaaaaagggggaccugcucaaugcucacuaugauggauaccuggccaaggacggcagcaaauucuauuguuccagaacacaaaacgaggggcauccgaagugguuugugcuuggagugggccaggucaucaaagggcuggauauugcgaugaccgacaugugccccggagagaagcggaaagugguuaucccucccucuuucgcuuacggcaaggaaggcuaugaggggaagauuccucccgaugccacacucaucuuugaaaucgagcuguacgccgugaccaaaggaccucgcagcauugagacauucaagcagaucgacauggauaaugacagacaacuguccaaagcugaaauuaaccucuaucugcagcgggaguuugaaaaggaugagaaaccgcgcgacaagucuuaccaggaugccguccuugaagacaucuucaaaaagaaugaucacgacggcgacggguuuauuagccccaaggaguacaacguguaucagcaugaugagcuguga

SEQ ID NO: 69363 - RNA, 1242 nt, Artificial Sequence
  derived and/or modified sequence opt5 from FKBP8__Homo_sapiens__NP_036313
auggccagcugcgcugagcccuccgaaccuucugccccgcugcccgcgggcgugccuccccucgaggacuucgaaguccuggaugggguugaggacgcugaaggagaggaggaagaggaagaggaggaagaggaagaggaugaccuuagcgaacugccuccccucgaggauaugggccagccuccggccgaggaagccgagcaacccggggcucuggccagagaauuucuugcugccauggagccugaacccgcgccugcccccgcuccggaggaguggcuggacauccucggaaacggccugcugcggaagaaaacccucgugccugggcccccuggauccucucgccccgugaagggccaggucgugacaguucaucugcagacgagccuugaaaauggcaccagagugcaggaggaacccgagcuggucuucacacucggggauugugacgugauucaagcccuggaucuuuccguuccucugauggacgugggagaaaccgcuauggucacagccgauucuaaauacugcuauggcccgcaggggagccggucccccuacaucccuccccacgcggcccucugucuggaggugacccugaagacagcuguggacggaccugaucucgagaugcugaccggccaggaacgcgucgcccuugcuaacagaaaacgggagugcgggaaugcccacuaucagcgcgccgacuuuguucuggcugcgaacagcuacgaccucgccauuaaggcuaucacgucuuccgccaagguggauaugaccuucgaagaggaggcccaacugcuucagcugaaagugaagugucucaauaaccuggcugccagccagcugaaacucgaccauuauagagcggcucugcggucuugcucccuuguccuggaacaccagcccgauaauauuaaggcccucuuucgcaaaggaaaggugcuggcccaacagggcgaguacagcgaagcuaucccgauccuuagagccgcucugaagcucgagccuucuaacaaaacaauucaugccgaacuguccaagcugguuaaaaagcacgcggcccagcggagcaccgagacagcucucuaucgcaaaaugcugggcaaucccuccagacuuccugccaagugucccgggaaaggagcuuggucuaucccuuggaaguggcuguucggcgccaccgcgguggcccucgggggagucgcucugagcgugguuauugccgcucggaacuga

SEQ ID NO: 69364 - RNA, 1872 nt, Artificial Sequence
  derived and/or modified sequence opt5 from FKBP9__Homo_sapiens__NP_001271270
auggccuucagaggcuggcggcccccuccgcccccucugcuccugcuucugcucugggugaccgggcaggcugcccccgucgcgggacugggcagcgacgcugagcuucaaaucgaacgcagauuuguuccugaugagugcccccggacagugcgcuccggggacuucgugagauaccacuaugucggaacguuuccugauggccagaaguucgacucucgguacugggauaccgccgaagacaaagccgauaagagcccguguccccaggugcgcguuggggugaacacauccccuucuugcagacugaaacagaagggagucggcauuuauuggaaagaccuccaauuucuggugcggguucagaaucauggccugagcuacgaucgcgacuccaccuucaacguguuugucgggaagggacagcucaucacaggcauggaucaggcucugguggggaugugugugaaugagagacgguucgucaagauucccccuaaacuugccuauggaaacgaaggcguuucuggggugauucccccgaauagcgugcugcacuuugacguccuccugauggauaucuggaacuccgaggaccaagugcagauccauaccuacuucaagccucccagcugcccucgcacaauccagguuucugacuuugugagauaucacuacaauggaaccuuccuugauggcacgcuguuugacuccagccauaaccggaugaaaaccuacgauacauaugucggcauuggguggcucauccccggaauggacaagggccugcuggggaugugugugggagagaaacgcauuaucaccauucccccuuuccucgcuuacggcgaagauggggacggaaaggauaucccgggccaggccucucugguuuucgacguggcgcuucuggaucuccacaaucccaaggacuccauuagcaucgagaacaaagucgugccugaaaauugcgagagaaucucucaauccggcgauuuucugcgguaucacuacaacgggacacuucuggacggaacccucuucgacagcuccuauucuagaaaucgcacguuugauacauacauuggccagggguaugucauccccggaauggacgagggccugcuggggguguguauuggcgaaaagcggagaaucguugugccuccccaucucggauacggcgaggaagggcgcggaaacauuccgggcagcgccguccugguguucgauauccacguuaucgacuuucauaauccuuccgauagcauuucuaucaccucccacuacaaacccccugacugcagcgugcuuucuaagaaaggggauuaucugaaguaccacuauaacgcuagccuccuggacggaacacuucuggauuccaccuggaaccucggcaaaaccuacaauauuguccuggggucuggccagguggugcugggaauggacaugggccuccgggagauguguguuggggaaaagagaacagucaucauucccccucaucugggauauggcgaggccgggguggauggagaggugcccggcagcgcuguccuuguguucgacaucgaacugcucgagcugguugccgggcugccggaaggcuacauguuuaucuggaacggagagguguccccuaaucuuuucgaagagauugauaaggacggcaacggggagguccuccuggaagaguuuagcgaauauauccacgcgcaaguggccucuggaaaaggcaagcuggcucccggguucgacgccgagcucauuguuaaaaauauguuuacgaaccaggaucgcaauggagacggcaaggugaccgcugaagaguucaaacugaaggaucaggaggccaagcaugacgaacuuuga

SEQ ID NO: 69365 - RNA, 1050 nt, Artificial Sequence
  derived and/or modified sequence opt5 from FKBPL__Homo_sapiens__NP_071393
auggagacacccccugugaacaccaucggcgaaaaggacacgagccagccgcaacaggagugggagaaaaaucugagagaaaaccucgauuccgucauucagauccggcagcaaccccgcgacccucccaccgaaacacuggagcuugagguuucuccugaucccgccagccagauucuggaacacacccagggggcugagaagcucguggccgaacuggagggagacucccauaaaucucacggcagcacaucccagaugccugaggcgcuucaggcuucugaucugugguacugcccggacgggagcuucgugaagaaaaucgucauuagaggacauggccucgauaagcccaagcugggguccuguugccgggugcuggcccucggauuuccuuucggcagcgggcccccugaaggguggaccgagcugacaaugggaguuggccccuggcgcgaagagaccuggggcgaacuuaucgagaaaugucuggagucuaugugccaaggagaagaggccgaacuccagcugccgggccacuccgggccucccgugagacuuacgcuggcuagcuuuacccagggacgggacucuugggagcucgaaacauccgagaaggaggcccuggcucgcgaagagagagcccggggcaccgaacuguuccgcgcgggcaauccugagggggccgcuagauguuauggacgggcccuccgccugcuucugacacugcccccucccggcccgcccgaaagaaccguccuccaugcuaaccuugccgcgugccaacugcuccuggggcagccucagcuggccgcucaaagcugugaucgggugcucgagcgcgagcccggacaccugaaagcccuuuacagacggggcguugcucaggccgcccuggggaaucucgaaaaggcuacggcggaccugaaaaaggugcuugccaucgauccuaagaacagagcugcccaggaggaacugggaaaagucgugauucagggcaagaaucaagacgccggccucgcucaggggcugcgcaaaauguuuggauga

SEQ ID NO: 69366 - RNA, 1488 nt, Artificial Sequence
  derived and/or modified sequence opt5 from FKRP__Homo_sapiens__XP_011525609
augagacugacccggugccaggccgcucucgccgcggcuaucacacugaaccuucuggugcucuuuuacgucagcuggcugcaacaccagccccgcaauuccagagcccggggcccucgcagagccucugcugccgggccgcggguuacggugcuugugcgcgaguuugaggcuuucgacaacgccguccccgagcugguggauagcuuucuccagcaggacccugcgcaacccguuguggucgccgcugauacccugccuuaucccccucuggcccucccgcggauucccaaugugagacuggcccuucugcagccugcucucgaccgccccgcggccgcuuccagaccugaaacauacguugccaccgaguucguggcucugguccccgauggagcccgggccgaagcuccgggccuucuggagcgcaugguggaggcgcucagagccgggucugcucggcugguggccgccccugucgcuacagccaaccccgcgcgcugucuggcucucaauguuagccugagagaauggaccgcccgguauggagccgcuccugccgcucccagaugcgacgcccuugauggcgacgcgguggugcugcuccgcgcccgggaucuguuuaaccuuuccgcuccccuggccagaccugucgggacaucucucuuccugcagaccgcucugcgcggaugggccgugcagcuccuggaccuuacguuugcggccgcucggcaaccgccccuggccaccgcucaugccagauggaaggccgagcgcgaaggccgggcuagacgcgcggcccuccugcgggcucuuggcaucagacugguuagcugggaagggggacgccucgagugguucggcuguaauaaagaaacaacccggugcuuugggacaguggucggagauaccccugccuaccuguaugaggaaagauggacgcccccuuguugccugcgggcccuccgcgagacagcuagauacgugguuggcgugcuggaagccgcggggguccgguauuggcuugagggaggcucccugcucggcgcugccagacacggggacauuauccccugggauuacgacguggaccugggaauuuaccuggaggaugucggcaacugugaacagcuucgcggggccgaggcuggaagcgugguugacgaacggggcuucgugugggagaaggccgucgaaggggauuucuucagagugcaguauucugaguccaaucaucuccacguugaccuguggccguuuuacccucgcaacggagugaugaccaaagauacauggcuggaccauagacaggaugucgaguuccccgaacacuuccuccaaccucuggugccccuuccuuuugcgggcuucguggcucaggcccccaauaacuaucggcgcuuucuggagcucaaguucggcccggggguuaucgaaaauccucaguaccccaaccccgcccugcugagccuuaccggaucuggcuga

SEQ ID NO: 69367 - RNA, 1386 nt, Artificial Sequence
  derived and/or modified sequence opt5 from FKTN__Homo_sapiens__NP_001073270
augagcagaaucaacaagaaugugguccuggcccuccugacccuuacauccucugcuuuccugcucuuucagcuguacuauuacaaacacuaucuuagcacgaagaacggcgccgggcuguccaaaucuaagggaagccggauuggcuucgacuccacccaauggcgcgcgguuaaaaaguuuaucaugcucacaucuaaucagaacgugcccguguuccugauugauccucugauccucgagcugauuaauaagaacuuugaacaggucaaaaauaccagccauggguccacaagccagugcaaguucuuuugugugccgagagacuucaccgcuuuugcccuucaauaccaccuguggaaaaacgaggaaggaugguuccggaucgccgagaauaugggcuuucagugccucaagaucgaaucuaaagauccccgccuggacgggauugauucccuuagcggaacagagaucccucugcauuauauuuguaagcucgcuacccacgccauccaucugguuguguuccacgagagaucuggcaacuaccuguggcacggccaucuccggcugaaggaacacauugaccgcaaauuuguccccuucagaaaacuucaguucgggcgguauccuggagcuuuugaucgccccgagcugcagcaagugacgguugacggccucgaagugcugaucccuaaggauccgaugcauuucgucgaggaggugccccacuccagauuuauugaaugccgguacaaggaggcccgcgcguucuuucagcaguaccuugacgauaauaccguggaagccgucgcuuucagaaaaagcgccaaggagcugcuccagcuggcugccaaaacacugaacaagcucgggguuccuuuuuggcugucuuccggaaccugucuuggcugguaucggcaaugcaauaucauccccuacagcaaggacguggaucuggggauuuucauccaggacuauaaauccgacauuauccucgcguuucaggaugccggacugccucuuaagcacaaauucggcaagguggaagacucucuggagcucagcuuucaaggcaaagaugacgucaagcuggauguguucuuuuucuacgaggaaacagaccauauguggaacgggggaacccaggcuaagacgggcaaaaaguucaaauaucuguuucccaaguucacacucuguuggaccgaguuuguugauaugaaagugcacgucccgugcgaaacacuggaguacauugaagccaauuaugggaagaccuggaagaucccugugaaaaccugggacuggaagcgcuccccucccaacguucagcccaacggaaucuggcccauuagcgagugggaugaggugauccagcuuuacuga

SEQ ID NO: 69368 - RNA, 1341 nt, Artificial Sequence
  derived and/or modified sequence opt5 from FLAD1__Homo_sapiens__NP_001171820
augaccagcagagccuccgagcugucucccggccggagcgugacagcugggaucauuaucgucggagacgaaauucucaagggccacacgcaggauaccaacacauucuuucugugccgcacccuuagaucccuggggguucaagugugucgggugucugucgugccugacgagguugccacaaucgcggcugaagugaccagcuucuccaaucgcuuuacacauguccucaccgccggaggcauugggccgacgcacgaugacgugaccuucgaggccguugcucaggccuuuggagaugaacugaaaccccauccuaaacuugaggcugccacaaaggcgcugggcggcgaggggugggaaaagcucucucuggugcccagcuccgccagacugcacuacggaaccgacccuugcacaggccagcccuuccgguuuccucucgucagcgugcgcaacguguaucuguucccggggauccccgagcuucugagacggguccucgaaggaaugaaaggccuguuucagaauccugcuguucaauuccauucuaaggagcuuuacguggccgcugaugaggccuccaucgcgcccauucuggccgaagcucaggcccacuuugggcgcagacucggacugggcagcuauccugacuggggcucuaacuacuaucaggugaagcugacccucgauuccgaggaagaggggccccuggaagagugucuugcuuaccugacggcccggcucccgcagggaagccuggucccuuauaugcccaaugccguggagcaggcuucugaagcgguuuacaaacuugccgaguccggcagcucccuggggaagaaaguggcuggagcccuccagacaaucgaaaccucucuggcccaguacagccugacacagcucugcgucggcuucaacgggggaaaggacuguaccgcucugcuucaccuguuucaugccgcggugcaacgcaaacucccugauguucccaauccccugcagauucuuuauaucagauccauuagcccuuucccggagcuggaacaguuccuccaagacaccaucaagcgguacaaccugcagaugcuggaggcugagggcucuaugaagcaggcccucggcgaacugcaggcccgccacccccaacuugaggcugugcugauggggacaagacggacggauccuuauuccugcagccucugucccuuuucuccuaccgaccccggauggccggccuucaugagaauuaauccucugcuggacuggacauaccgcgauaucugggacuuucuucggcaacucuucguccccuauugcauccuguacgauagaggcuga

SEQ ID NO: 69369 - RNA, 1029 nt, Artificial Sequence
  derived and/or modified sequence opt5 from FLCN__Homo_sapiens__NP_653207
augaacgccaucguggcucugugccacuucugugagcuccauggccccagaacccuguuuugcacagaaguccuucacgccccucugccgcagggggacggaaaugaggauagccccggccaaggggaacaggcggaggaagaggagggaggcauucagaugaacucccggaugcgcgcucauucuccugccgaaggggccagcguugaguccucuagccccggaccuaagaaauccgacaugugugaaggcugcagaucucucgcugccggccaccccggguacaucagccaugauaaggagacguccauuaaauaugugagccaccagcacccuucucauccgcaacuguucuccaucgugcggcaggcuuguguccgcagccuuucuugcgaggugugucccggaagagaaggcccuaucuuuuucggggacgagcagcacggauuuguuuucucccauaccuuuuucauuaaggauagccuggcccggggcuuucagcgcugguacucuaucauuacaaucaugauggacagaauuuaucucaucaauuccuggcccuuccugcuggggaaagugcggggaauuaucgaugaacuccaaggcaaggcgcugaaggucuuugaggccgaacaguucggcugcccucagcgcgcucagagaaugaacaccgccuuuacacccuuccuucaccaacggaaugggaacgcugcccgcagccugaccucccucacaucugacgauaaucugugggcgugucuucacaccagcuucgccuggcugcucaaggcuugcggauccagacugacggagaaacugcucgagggcgccccgaccgaagacacacuggugcagauggagaaacuugcuggggaagccggaguucugcucccuggccccuggccuggguggcccuggggaggcaccagcugucugcuuucuuggcaggagucccugcgggaaggcaacgccgcucucaaucaaccccgcacaagccugagagaggcgcauccuccgauuucuguguga

SEQ ID NO: 69370 - RNA, 7176 nt, Artificial Sequence
  derived and/or modified sequence opt5 from FLG2__Homo_sapiens__NP_001014364
augaccgaccugcucagaagcguggucacaguuaucgauguguucuacaaguauacgaaacaggacggcgagugcgggacccuguccaagggagaacuuaaagagcugcucgaaaaggagcugcaccccgugcuuaaaaacccugaugacccggauacagucgacgugauuaugcauaugcuggaucgggaccacgaucgcagacucgacuuuaccgaauuccugcugaugaucuuuaagcucacaauggccuguaauaagguucugucuaaagaguacugcaaggcuagcggcuccaaaaagcaucggcgcgggcacagacaucaagaggaagagucugaaaccgaggaggaugaagaggacacacccggacacaaaagcggcuaucggcacuccucuuggagcgaaggggaggaacauggauacuccagcggccacucucgcggcaccgugaaguguagacauggguccaacagccggcgccuuggaagacagggcaaucugucuuccagcgggaaccaggagggaucucagaagcgguaucaccgcuccagcugcggccacuccuggucugggggaaaagauagacauggcagcuccagcgucgagcuccgggaacgcauuaauaagucucacaucuccccuagcagagagucuggcgaagaguacgaaagcggguccggaucuaacagcugggagcggaaaggccaugggggacuguccuguggccuugagacgagcgggcacgaaucuaauuccacccaaagcagaauucgcgagcagaagcugggaucuuccugcagcggcuccggcgacucugggcggagaagccaugccuguggauauuccaacucuagcggcugcgggcgcccccagaaugcguccagcucuugucagucccaccgguucggaggccaagggaaccaguuuagcuacauccagucuggcugccaguccggaaucaaaggcgggcaaggacacggcugugugagcgggggacagccuucuggcugcgggcagcccgaaagcaauccuugcucccaaagcuacucucagagaggcuauggagcucgcgagaacggccagccgcagaauugugggggacaauggcggacaggcuccagccaguccucuugcugugggcaguacggaagcggcgggucccagucuugcagcaacggccaacaugaauauggauccuguggcagauucucuaauagcuccagcucuaacgaguuuuccaagugcgaccaguacgggagcggaucuucccagagcaccucuuucgagcagcacggcacagggcucucccaaagcuccggauuugaacagcauguuuguggcagcgggcagaccugcggccagcacgagucuacgagcucccaaucucugggauaugaucagcacggcagcuccucugggaaaacaagcggauucggccagcauggguccggaucuggccaaagcuccggcuuugggcaguguggaagcggcucugggcaguccagcggauucggccagcacgggucuguguccggacaaagcuccggcuuuggccagcaugggucugucagcggacaguccagcggcuucgggcagcacgaaucucgcucccggcaaagcucuuacggacagcauggcagcggguccucucagagcuccggauauggccaguacggcucuagagagaccagcggguucggacaacacggccugggguccggacagagcacaggcuuugggcaguacggaucuggcuccggccaaagcuccggguucggacagcacggcucugggagcggacaguccucuggcuuugggcagcaugagagccgcuccggacaaagcucuuauggccagcacuccagcggcucuucccagagcucuggguacggacagcauggcagccggcaaaccuccggguucggacagcacggcucugggagcucccagagcaccggauuuggccaguauggcuccgggucuggacaaagcuccggcuucgggcagcaugugucuggaagcggccaguccucuggguuuggacagcacgaaagcagauccggccacagcucuuacggccaacauggguucggauccagccagucuuccggcuaugggcagcacggaagcucuuccggccaaacaagcggguuuggccagcaugagcucuccagcggacagucuagcuccuucggccagcacgggucuggaagcggccaauccucuggguuuggacagcacggcagcggguccggccagucuagcggauucggccagcaugaaucccggagcgggcaaucuuccuacggacagcacagcucuggcuccagccaguccucuggguauggacagcauggcagccgccaaacguccggguuuggccagcacggaagcggcucuucccagagcaccggguucggacaauacggcucugggagcggacaguccgccggcuucggccagcaugggucuggaagcggccaguccucuggguuuggacaacacgagagcagaucccaccagagcucuuacggccagcauggguccggaagcucccagucuagcggcuauggccaacacggguccucuagcggacagacauccggcuucgggcagcaucggagcucuuccggacaguacagcggcuuugggcaacacggaucuggcuccggccagagcucuggguucggacagcacggcaccggguccggacaguauagcggcuuugggcaacaugaaucuagaagccaccaguccagcuacggacagcauggcuccggcucuagccaauccucuggguauggacagcacggcagcuccucugggcagacauucggauuuggccagcaucgcagcggguccggacaaagcucuggcuucggccagcacggguccggaagcggccagucuuccggguuuggacagcacgagagcggcucugggaaguccagcggauucggccaacaugagucucgguccagccagagcaacuacggccagcacggguccggaucuagccaguccucuggcuaugggcaacauggaagcuccucuggccagaccacgggguuuggacagcacagaagcuccagcggccaauacucuggcuucgggcagcacggauccggcagcgaccagucuuccggguuuggacagcauggcacagggagcggccaauccucuggauucggccaguacgaaagccgcuccagacagucuagcuaugggcagcacggauccggcagcucucaauccagcggguacggacagcauggcucuaauagcgggcagaccuccggcuucggacagcaccggcccggcucugggcaaagcuccggauuuggccaguaugggagcggaucuggccaguccagcggguucggccaacauggauccggcaccgggaagucuagcggauuugcccagcacgaguaccgcuccggccagucuagcuaugggcagcacggaacaggcuccucucaaagcuccgggugcggccagcaugaaagcggaucuggcccuaccacauccuucgggcagcacgugagcggaucugauaacuuuuccagcucuggccagcauauuagcgacuccgggcaaagcacgggauucggccaguacggcuccgggucuggacagagcaccggccuggggcagggagagucccaacaggucgaaucuggcagcacaguucacgggagacaggagaccacacauggacagaccaucaauacgacccggcacucccaaucuggccagggccagagcacacaaaccgggucccgcgugacaagacggcgcagaagcucucaguccgagaacagcgauucugaagugcacuccaaagucagccaucggcacucugagcauauucacacccaggcuggaucccacuaucccaagagcggcucuacggugcgcagacggcaggggacaacccauggacaaagaggcgacacaacccgccacgggcauuccggacacggccagagcacccagacaggcucccggacgagcgggagacagcgcuuuucucauagcgaugccaccgacuccgaaguucacucuggagugagccaccggccucauucccaagagcagacacacucucaggcuggcagccagcauggggaauccgagagcaccguccacgagagacacgaaacaaccuacggacaaacgggcgaggccacagggcauggacacucuggccauggccaguccacccagcgcgggagccggaccacaggaagacgcggcucugggcacuccgaaagcucugauuccgaggugcauagcggaggcucccaccggccccaaucucaggagcagacccacgggcaggcgggaagccaacauggcgaauccggcagcacaguucacgggagacauggaacgacccacggccagacaggggacaccacacggcaugcccacuaccaccauggaaaaucuacccagcgcggcuccagcacgaccgggagacggggaucuggccacagcgaguccucugauagcgaagugcauuccggcgggagccacacacacucuggacauacccacggccaguccgggagccaacauggagagucugaauccaucauucacgaccgccauagaaucacacacggccagaccggggacacaacccggcacagcuauuccggacaugagcagacgacacagaccggcucuagaaccacaggccgccaacggaccagccacuccgagucuacggauagcgaaguccauuccgggggaagccacagaccgcacucucgcgagcauacauacggccaggcugggucccagcacgaagagccugaauucaccgugcaugagcggcacggaacaacccauggccagauuggggacacaaccggccacagccacucuggacauggccaauccacgcagagagggagccgcaccacaggacggcagagaucuucccacagcgagagcuccgauucugaaguccauagcggcgugucccacacccacacagggcauacccacggacaagccggcucucagcaugggcagagcgaguccaucguucccgaacgccacggcacgacacauggacagaccggcgacacaaccagacacgcucacuaucaucacgggcuuaccacacaaacgggaucucggaccacaggccgcagagggagcggacauuccgaguacucugauagcgaaggcuauuccggggugagccacacccauucuggccacacacacggacaggcccggucccagcauggcgagagcgagucuaucguccacgaacgccaugggaccauucacggacagacgggcgacacaaccagacacgcgcauuccgggcacggacaaagcacccagacaggcucucggaccacagggagacgcuccagcggccauuccgaguacagcgauucugaaggacacagcggcuuuucccagcggccucauucuagagggcacacgcacggacaggccggcagccaacauggggaguccgagucuaucguggacgaacgccacggaaccacacauggccagaccggcgauacaagcgggcacucccagucuggacacggccaaagcacccaguccgggagcucuacgaccggacggagacgguccggccauagcgagucuuccgacagcgaaguucacuccgggggaucucauacacacagcggccauacccacucccaggcucgcagccagcacggcgagucugaauccacagugcauaagagacaccaaaccacacaugggcagacgggagauaccacagagcacggccaucccagccacgggcagaccauucagaccggaucucggacaacgggccgcagaggguccggacacagcgaguauucugacagcgaaggccccuccggcgucucucauacccacagcgggcauacacacggacaagccggcucccacuacccugagagcgggucuuccgugcaugaacggcacggaaccacacauggccagaccgcugauacgacacgccacgggcauagcggacacggccaguccacccagagaggcucucggaccacagggcgcagagccagcggacacuccgaguacucugacagcgaaggccauuccggggugagccacacccauucuggacacgcccacggccaagcugggucccagcauggagagagcggcucuuccguucacgagcggcauggcacaacccacgggcagacgggagacacaaccagacaugcgcacagcggccacgggcaaucuacacagcgcggaucccggaccgccggcagacgcgggagcggacauucugaaagcuccgauagcgagguccacuccggcgugucucauacgcacagcggccauaccuaugggcaggcucggucccagcacggagaaucuggcagcgccauccacgggagacaaggaacaauucauggccagaccggggacacaacccgccacggacaguccggccauggccagucuacacaaaccgggagccggacgacaggaagacagcgcuccagccacucugaguccagcgauucugaagugcacuccgaggccagcccgacccauucuggccacacccauucccaggcugggagccggcacggacaguccggcagcucugggcauggcagacaaggaacaacccacggccagacaggggacacgacccgccacgcccauuacggauauggccaguccacacagcgggggagcagaaccacaggacgcagaggcucugggcacagcgaguccucugauagcgaaguccauuccuggggcucucacacccacagcggacauauccaaggccaggcggggucccagcaacggcagcccggaagcacggugcacggccgccuggagaccacacaugggcagaccggagacacaaccagacacggccauucuggguacggccaguccacgcaaacaggaagccggucuuccagagcuagccacuuccagucccacucuagcgaacggcagcgccauggcuccagccagguuuggaaacacgggucuuauggaccugccgaguacgauuauggccauaccggguacggacccuccggcggcagcagaaagucuaucuccaauagccaccucucuuggagcacagacuccaccgccaacaagcaacugucucggcacuga

SEQ ID NO: 69371 - RNA, 12186 nt, Artificial Sequence
  derived and/or modified sequence opt5 from FLG__Homo_sapiens__NP_002007
augagcacccugcucgagaacaucuucgccauuaucaaucuguuuaagcaguacuccaaaaaggacaaaaacacagauacgcuuucuaagaaagaacugaaggagcuccuggaaaaggaguucagacaaauucuuaaaaaucccgacgauccugacaugguggaugucuuuauggaccaccuggauaucgaccauaacaagaaaauugauuucaccgaauuucuccugaugguuuucaagcuggcucaggccuauuacgagagcacacggaaagagaaucucccgaucuccggccacaagcaucgcaagcacucucaucacgacaaacacgaagauaacaagcaggaggaaaauaaagagaacagaaagcggcccagcucccuggagcgcagaaauaaccggaaagggaauaagggacgcucuaaaagcccuagagaaaccggcgggaagcggcaugaguccagcucugaaaagaaagagcgcaagggauauucccccacacacagagaagaggaguacggcaaaaaccaucacaauagcucuaagaaagaaaagaacaagaccgagaauacacggcuuggggacaaccgcaaaagacuguccgaacggcucgaggaaaaggaggauaacgaggaaggaguguaugacuacgagaauaccggccgcaugacgcagaaauggauccaaagcggccacauugcgaccuauuacacaauccaggacgaagcuuacgauaccacagacucucugcuugaggaaaacaagauuuaugagagaucccggagcuccgaugggaaaucuagcucccaggugaauagaagccgccaugagaacaccucucaggucccucugcaagaaucccggacgagaaagcgccggggaagcagagugucucaggaccgcgauagcgagggccacuccgaagacucugagcggcauagcggguccgccagcagaaaucaccauggaucugccugggagcagucccgcgauggcagccggcaccccagaucucacgacgaagaucgcgcuucccaugggcacagcgccgacuccucucggcagagcggaacaagacaugcugagaccuccucucggggccaaacagccagcucccacgaacaggcgcgcagcucuccuggcgagagacacggguccggacaucagcaaagcgccgauucuucccggcacagcgcuaccggcagagggcaggccucuagcgcuguuuccgaccgcggacaucggggcagcucugggucccaggccagcgacuccgaaggacacucugagaacagcgauacccaguccgugucuggccauggcaaggcggggcucagacaacagagccaccaggaguccacacgcggaagaucuggcgaacggagcgggcgcuccggaagcucucuguaccaggucuccacgcacgagcaaccggacagcgcccauggcagaaccgggacaucuaccggcggacggcagggcucccaccaugaacaggcucgcgauagcucuagacacuccgccagccaggaggggcaagacacaauccggggacaucccggcuccagccgcgggggaagacagggcucucaccacgaacagagcgugaaucgguccgggcauucuggcagccaccauucccacaccacgucucagggacgcagcgaugcuucccacggccaaucugggagcagauccgccagccggcagacaagaaacgaggagcagucuggagacggcacccgccauuccgggagccggcaccaugaagccucuucccaagcugauagcuccagacacucucagguuggacagggccagagcuccgggccucgcaccagccggaaucaaggcucuuccgugagccaggacucugauagccagggacauuccgaggacucugaaagauggagcggcuccgcgucucgcaaccaccacgggagcgcccaggagcaaucccgggauggaagcagacauccccgcucucaccaugaagaccgggcuggccacgggcacuccgccgauagcuccagaaaaucuggaacacggcauacccagaauagcuccucuggccaggccgcuagcucccacgagcaggcccgcagcucugcgggggagagacauggcucccggcaccaacugcagagcgcugacucuucccgccauagcggaacaggccacgggcaggccucuagcgccgucagagacuccggacaccggggcucuagcgggucccaagcuacggauagcgaaggacauuccgaggacucugauacccagagcguguccggccacggccaggccgggcaucaccagcaaucucaccaggaaagcgcuagagaccgcuccggagagcggucuagacgcagcggcuccuuucucuaucaggugagcacacauaagcagucugaguccagccacggguggaccggaccuucuacaggcguccggcaagggucccaucacgaacaggccagagauaacagccgccauucugcgucccaggacggacaggauaccauucggggccaccccggcagcuccagacgcgggagacaaggaagccaccaugagcagucuguugaccggagcggccacuccgggucucaucacagccauacgaccucccagggacgcucugaugccagcagaggccaguccgggucucggagcgcuucccgcacaaccagaaaugaagagcaaagccgggacggaucuagacacuccggcagccgccaccaugaagccucuucccacgcugauaucagccggcauucccaggccggccaggggcaaucugagggaagcagaacaucccgccggcagggcagcucugugucccaggacagcgauucugaggggcacagcgaagacuccgagagauggucuggaagcgcgucccggaaccaccgcggcucugcccaggaacaaagcagacaugggucccggcacccgcgcagccaucacgaggacagagcuggacauggccacucugccgauuccagccggcaguccggcaccccucacgcugaaacgucuagcgggggacaggccgccuccucucaugagcaggcucgcagcucccccggcgagagacacgggagccggcaucaacagucugcggacuccagccgccacucuggaauuccuagacggcaggccuccagcgcugugagagauucuggccacuggggguccagcggaucucaggccagcgacuccgaaggccauagcgaggaauccgauacacaaucugucagcggccacgggcaggacggaccccaucagcaaucccaccaggagucugcccgcgauuggagcggcgggcgguccggaagaucuggcagcuucaucuaccagguguccacccaugaacagagcgagucugcucacgggcgcacacggaccuccaccggaagacgccaaggcagccaccaugagcaggcccgggacucuuccagacacagcgcgucucaggaaggccaggauacaauccgcgcucaucccgggucccggagaggaggccgccaagggagccaccaugagcagucuguugaccgguccggacacagcggcagccaccauucccacacgaccucucaggggagaagcgaugccucccauggacagucuggcagccgcuccgccucuagacaaacacggaaagacaagcagagcggcgacgggucccgccacagcggaucuagacaccaugaagcugccuccugggcggauagcucucggcacucccaggugggccaggagcaaagcuccgggucuagaaccagccggcaucagggauccucugucagccaggacuccgauagcgagcgccacucugacgauuccgaaagacugagcggcucugcuagccggaaucaucacggguccucucgcgagcaaagcagagacggcucccggcacccuggauuucaucaggaagaucgcgccagccacggccauucugccgacuccagcagacaguccgggacacaccacaccgagucuagcucccauggacaggcugugucuagccacgaacaagcccgguccucuccgggcgagcgccaugggagcagacaccagcaguccgcugauagcucucggcauuccggaauuggccaccgccaggccagcucugcgguuagagacuccgggcaccggggcagcucuggaagccaagugacgaacuccgagggccauagcgaagauuccgacacacagucugucagcgcccacgggcaggcuggaccccaucagcaaucccacaaagagucugcccgcggccagagcggggaauccucuggaagaagccgguccuuccuuuaucaggugagcucucacgagcaauccgaaagcacccauggccagaccgcuccuucuacagggggcagacagggaucccgccacgagcaggcccggaacagcucuagacauuccgccagccaagauggccaggacaccauccgcgggcaccccggaucuucccggggcgggagacagggaagcuaccaugagcaguccgucgaccgcagcggccacucuggcuaucaccauagccacacaacgccucaagggcgguccgaugcuucucauggacagagcggccccagauccgcgucucgccagacccggaaugaagagcagagcggggacggauccagacacagcggcucucgccaucacgaaccguccacacgggccgggagcucuagacacucccaagugggacagggcgagagcgcuggcucuaagaccucccggagacaggggagcuccguuucucaagaucgcgacagcgaaggacauuccgaggauagcgagcggagaucugaauccgccagccgcaaccacuacggcucugccagagagcagagccggcaugggucccgcaauccuagaucucaccaggaagaccgggcuagccacggacauuccgccgagagcucucgccaguccggcacaagacacgcggagaccagcucugggggacaagcugccuccagccaggaacaggcccgguccucucccggcgagcgccauggcagcagacaccagcaauccgcugauucuagcacggacuccgggaccggacggcgccaggauagcucuguggucggcgacuccgggaacagaggaagcucuggcucccaggccagcgauucugaagggcauuccgaggaaagcgacacacagagcguguccgcgcacggacaagcuggcccucaccagcagucucaucaggagagcacccggggccaauccggggagcgcucuggaagaagcggcuccuuucuguaccagguuucuacacacgaacagagcgaguccgcccaugggcggaccggacccucuacaggcgggagacaacgcagccggcacgaacaggccagagauuccagccgccacucugcuucccaggagggacaggacaccauucggggccauccuggcagcucuagagggggacgccaaggcucccacuaugaacagagcguggacucuuccgggcauagcggaucccaccauagccacacgacaucucaggagcggagcgaugucuccagaggccagucugggagccgcuccgugucucggcaaaccagaaaugagaagcagagcggagacggcucccggcacucuggcagccgccaucacgaagccuccagcagagcugauucuucccggcauagccagguggggcagggacaaucuuccggcccccgcaccagcagaaaccagggguccucuguuagccaggacuccgauagccaaggacacucugaggacuccgaacgguggagcggcucugccuccagaaaucaucucgggagcgcgugggagcagucucgcgauggaagccggcacccgggcucccaccaugaagacagagccggccacgggcauucugcugauagcucccgccagagcggaacacggcacaccgagucuuccagcagaggccaggccgcuuccucucacgagcaagcccgcagcuccgccggggaaagacauggaucucaccaucagcugcagagcgcugacuccagccggcacucuggcaucgggcauggccaggcguccagcgccguccgcgauucuggacacagaggcuacuccgggagccaagcuucugacuccgagggacacagcgaagacucugauacgcagagcguguccgcccagggcaaagccgggccucaucagcaaagccacaaggaguccgcucggggacagucuggcgagagcuccgggcgcucuggcagcuuccuuuaucagguguccacacaugaacagucugagagcacccacggacaauccgcccccagcacaggcgggagacagggaucucacuacgaccaggcgcaagauuccagccggcauucugcuucccaggaaggccaggacaccauucgcgggcaccccggaccuagcagaggcgggcggcagggcucucaucaagagcaguccgucgauagaagcggacacuccggcagccaucacucucacacaaccucccaggggcgcagcgacgccucucggggacagagcggcuccagaucugccagccgcaaaacguaugauaaggaacaauccggggacggaucucggcauagcggcucccaccaucacgaggcuagcucuugggccgauuccagcagacauucucugguggggcagggccaguccagcggaccgcgcaccucccggcccagaggcucuagcguuucccaggacagcgauucugaggggcacuccgaagacagcgagcggcgcucuggauccgcgagcagaaaccaccauggcucugcccaagaacagagccgggaugggucccgccacccuagaucucaucacgaggaccgggcuggacacggccauagcgccgaauccagccgccagucuggcacacaccaugcugagaauuccagcgggggacaagccgcuuccucucacgagcaggccagaagcuccgcgggcgaacggcaugggucucaccaccagcagagcgccgacuccagcagacauucuggaaucggccacgggcaagcuuccagcgccgugcgcgauucuggacaucggggcuccagcggcucucaggcuuccgacagcgaggggcacucugaagauagcgacacccaguccgucagcgcccacggacaggccggcccccaucaacagucccaccaggagucuacaagagggcgcagcgcuggacgguccggcagaucugggagcuuucucuaccagguguccacccaugaacaaucugagagcgcgcacggacgcacgggcacauccaccggcgggcggcagggaagccaucacaaacaggccagagauucuucccgccacagcacaucucaagagggccaggacaccauccaugggcacccuggauccagcucuggcgggcggcagggaucccauuaugaacagcugguugauagaagcggccacuccggcucucaccauagccacaccacaucccaagggcgcagcgacgcuucucauggacacagcggcuccagaucugccagccggcagacgcgcaacgaugagcaguccggggacggaucuagacauagcggcucccggcaccacgaagccagcucuagagcugauuccagcgggcauucucaggugggacaaggccaguccgagggcccccgcaccagccggaauuggggguccucuuucagccaggacuccgacucucagggacacagcgaggauuccgaaagauggagcggcucugccucccggaaccaucacgggagcgcgcaagagcagcugcgcgacggaucuagacauccucggagccaccaggaagaucgcgccggccacgggcauuccgcugacucuagcagacaguccggaacacggcacacccaaacaagcucuggcggccaggccgcuuccagccaugagcaggcccgcuccucugcgggggaaagacacggaagccaccaucaacaguccgccgauucuagccggcacuccggcauugggcauggacaggcuagcucugccguccgcgacuccggccacagaggguacagcggaucucaggcuuccgauaaugagggccauagcgaggacucugauacccaauccgugagcgcccacggccaggcugggucucaccagcagucccaucaagaaagcgcccggggacgcagcggcgagacguccgggcacucuggaagcuuccucuaccagguuuccacacaugaacagucugagagcucccacggcuggaccgggcccucuaccagaggccggcagggaagcagacacgaacaagcgcaggacuccagccgccauucugccucccaggauggccaagacacaauccgggggcacccgggaagcucuagaggcgggcgccagggauaucaucacgagcauuccguggauagcucuggccacuccgggagccaccauucccacaccacaucucagggccggagcgacgcuuccagaggacagagcggcucucgcuccgccagccggacgaccagaaacgaggaacaaucuggggacggaagccgccauuccggcucucggcaccaugaggcuagcacacacgccgauauuuccagacacagccaggccguccaggggcagucugaaggaucccgccggagcagacgccaaggcucuuccgugagccaggacuccgauucugaggggcauagcgaagacuccgagcgguggucuggcagcgcguccagaaaucaccauggaagcgcucaggagcagcugagagauggcucucggcacccucgcucccaccaagaagacagagccgggcauggacacagcgcugauucuucccggcagagcggcacccgccauacacagaccucuagcgggggacaggccgccuccagccacgagcaagcuagaucuuccgccggcgaacggcaugggagccaccaccagcaguccgcggacucuagccgccauuccggcaucggacacggccaagccucuagcgcugugagagauuccgggcaucggggauacucuggcagccaggccuccgacaacgaggggcacagcgaggauucugacacgcaguccgucagcgcucacggacaggccggcucucaucaacagucccaccaggaaagcgcgcgcggcagaucuggggagaccuccggacauagcggcuccuuucuuuaucagguuagcacacacgaacaaucugagagcucccauggguggaccggacccucuacacggggccgccaggggagcagacacgaacaggcccaggauuccucucggcacagcgcuucccaauacggacaggacaccauucgcggccauccuggcucuagcagagggggacggcagggcuaucaccaugagcacuccguggacagcucugggcacuccggaagccaucacucucauacaacgucccaaggcagaagcgaugccucccgcgggcagucuggaagccgguccgcuagcagaaccacacgcaacgaggaacagucuggcgacuccagccggcacucugugagcagacaucacgaggccuccacccacgcugauaucucucgccauagccaggccguccaaggccaguccgaagggucucggagaagccgccggcagggauccagcgugucucaggacuccgauagcgagggccacuccgaagacucugagagauggagcggguccgcgucucgcaaucaucggggaagcguucaagagcaguccagacacggcagccggcauccccgcucucaccacgaagauagagccgggcauggacacuccgcugaccggagcagacagucuggcacccgccaugccgagacauccagcggcgggcaggcugccucuagccacgaacaagcccgguccucuccgggagagagacacggcagccgccaucagcaguccgcggauagcuccagacacucugggaucccucggggacaggcuagcuccgccgugcgcgacucuagacauuggggcagcuccgggucucaagccagcgauuccgaaggacacagcgaggagucugacacgcaguccgucagcggccauggccaggcugggccccaccaacagucucaccaggaauccgcccgggaccgcagcggaggcagaucugggcgguccggaagcuuccuguaccagguguccacccaugagcaaagcgaaucugcucacggccgcacaagaaccagcacagggcggcgccagggaucccaucacgagcaggccagagauucuagccggcacuccgcgucucaggagggccaagacaccauuagaggccauccugggagcucccgccggggaagacagggcucucacuaugaacagagcguugaucgcuccgggcauagcggaucucaccauucccacacgacaagccagggccggucugacgccuccagagggcaaagcggaucccgcucugcuagccggcagaccagaaacgaugagcaguccggcgacggcagccgccacucuuggucccaucaccaugaagccagcacccaagcugauucuagccggcacucccagucugggcagggacagagcgccggccccagaacaucccggaaucaagggucuagcgugucccaggacagcgauucucagggacauuccgaggacagcgaacgcugguccggcucugcgagcagaaaccaccggggguccgcccaggagcaaucucgcgauggcagcagacaccccaccucccaucacgaggaccgggcuggacauggccacagcgccgaaucuuccagacagagcgggacacaccaugcugagaauucuuccggaggccaggccgcuagcucucacgaacaggcccgcuccagcgcgggggagcggcauggaucucaccaucaacagagcgccgauuccagcagacacuccggcaucgggcacggccaggcuucuagcgccguccgcgacuccggacaucggggcucuagcgggucccaagccucugacagcgaaggacacuccgaggauagcgacacccagucuguguccgcucauggccaggccgggccucaccagcaaagccaccaggagucuacgagaggacgcuccgcgggccggagcgggagaucuggcuccuuucucuaccagguuagcacacaugaacaguccgagucugcucacggacgcgccggcccgagcaccgggggaagacaaggcagccggcaugaacaggcccgcgauuccucuagacacagcgcuucccaggaggggcaggacacaauucggggacaucccggcucucgcagaggcgggcggcaaggaagcuaccacgaacaguccguggaucgcucuggccacagcgggucccaucacagccauaccacgucucagggaagauccgacgccagccacggccagucugggucccggagcgcuuccagagagacccgcaacgaggaacaaucuggagauggcagccggcauuccggcucuagacaccacgaggccagcacacaggcggacuccagccgccauucucaguccgggcaaggagaaagcgccggcucucggagaagccggcgccagggguccucugucagccaggauuccgacagcgaggcuuauccugaggauucugaaagacgguccgagagcgccucccgcaaucaccauggaucuagcagagaacagucccgggacggcucucgccaccccgggagcucccacagagauaccgcuagccaugugcaaucuuccccugugcagagcgacucuuccacagccaaggagcacggacauuucagcucucugucccaggacagcgcguaccacucuggcauccagagccggggcuccccccauagcuccucuagcuaucacuaccaauccgaagggaccgagagacagaaaggacagucuggccuugucuggcgccacgggagcuauggauccgccgauuacgacuauggcgagucuggguuucggcauagccagcacggauccguuagcuacaacucuaauccugugguguucaaggaaagauccgauauuugcaaggcuagcgccuuuggcaaagaccauccgcgcuacuaugcuacauacaucaacaaggaucccggccugugugggcacucuuccgacauuagcaaacaacucggauucucucagucccagcgguauuacuauuacgaguga

SEQ ID NO: 69372 - RNA, 1161 nt, Artificial Sequence
  derived and/or modified sequence opt5 from FLI1__Homo_sapiens__NP_001257939
auggagggcgggcuggccggagaaagagcucgggagagccccguggacugcuccgucucuaaguguagcaaacucguuggcgggggagaauccaacccuaugaauuacaacucuuauauggaugagaagaauggcccgcccccucccaacaugaccacaaaugaacgcagagugaucgugccugccgaccccacgcuguggacccaggagcacguccggcaauggcuugagugggcgauuaaagaauacagccugauggagaucgauacauccuucuuucagaacauggacgggaaggaacucugcaaaaugaauaaggaggauuuccugcgcgcuaccacacuuuauaacaccgaggugcugcucucucaucugagcuaccugagagaauccagccuccuggccuauaauacaaccucucacacggaccaguccagccggcuuucuguuaaggaggauccuuccuacgacagcgugcgcagaggagccuggggcaacaauaugaacucuggccugaauaaauccccgccccucgggggagcucagaccauuagcaagaacacagaacaacggccucagcccgauccuuaucagauccugggccccaccuccucucgccuugccaauccggggagcggacagauucaacuguggcaguuucuccuggagcugcucuccgacagcgcuaacgccucuuguaucacaugggaaggcaccaacggggaguucaaaaugacggauccugacgaggucgcgagacgguggggagaacgcaaguccaaacccaauaugaacuacgauaagcugagcagagcccuucgguacuauuacgacaagaauaucaugacaaaagugcauggcaagcgcuaugcuuacaaauuugacuuccacggcauugcccaggcucugcagccucaucccaccgagucuagcauguauaaguaccccuccgauaucucuuauaugccuagcuaccacgcccaccaacagaaaguuaacuuugugccgccccauccuuccagcaugcccgucacaucuuccagcuucuuuggggcggccucucaguacuggaccuccccuaccggaggcauuuaucccaauccgaacgugccuagacaccccaauacacaugugccuagccaccucggguccuacuauuga

SEQ ID NO: 69373 - RNA, 3645 nt, Artificial Sequence
  derived and/or modified sequence opt5 from FLII__Homo_sapiens__NP_001243194
auggaggccaccggcgugcugcccuucgucagagggguugaccucagcggaaacgauuuuaagggcggguacuucccugaaaaugugaaagcuaugacaucccugcgguggcuuaagcugaaccgcacgggacucugcuaucugccggaggaacuugccgcgcugcagaaacucgagcaccugucugugagccauaauaaccugaccacacuccacggcgaacuguccucucuucccagccugagagcuaucgucgcccgggccaauucccucaagaacucuggggugccugacgauauuuuuaaacuggacgaucuuagcguucuggaccucucccauaaucaacugaccgaguguccccgcgagcuggaaaacgcuaagaauaugcucgugcugaaccuuagccacaauagacagcugccugccaugacagcucuccagacccugcaucuucggucuacacagcgcacccaauccaaccugcccacgagccucgagggacugucuaaucuggccgaugucgaccucuccugcaacgaucugaccagagugccugaaugucuuuacacacugccgagccuccggcgccugaaucuuucuuccaaccagaucaccgagcugagccucugcauugaccaguggguucacguggagacacugaaccuguccagaaaucagcucaccucucugcccagcgcgaucuguaaacuuuccaaacugaagaaacucuaucugaacagcaauaagcuggauuucgacggccuuccuucuggcauugggaaacucacgaaccuggaagaguuuauggccgcuaauaacaaucuggaacucguccccgagucccugugccgguguccuaaacuucgcaagcuggugcucaacaagaaucaccuggugacacugcccgaagccauccauuuccuuaccgagaucgagguccucgauguuagagaaaacccgaaucuggugaugccucccaagccugcugaccgggccgcggagugguacaacauugacuuuagccugcaaaaucagcuccgccuggccggagcuucucccgccacaguggcugccgccgcugcgggcagcgggcccaaagauccuauggccagaaagaugcggcuuagacgccggaaagacuccgcucaggaugaccaggccaagcaaguccugaaaggaaugucugauguggcccaggaaaagaacaagaaacaggaggaaagcgcugacgccagagcgccguccggcaagguucgccggugggaucaagggcucgagaaacccagacuggacuauagcgaguucuuuaccgaagaugugggacagcugccuggccuuaccaucuggcagauugagaauuucguccccgugcucguugaagaggcuuuucacggcaaguucuacgaagccgacugcuauaucgugcugaaaacauuucuggaugacucugggucccucaacugggagauuuacuacuggaucggaggcgaggccacgcuggacaagaaggcuuguagcgccauucaugcugucaaccuucgcaauuaucugggggccgaaugccggaccgugagagaggaaaugggagaugagucugaggaguuccuccaggucuucgacaacgauaucuccuacaucgaaggcgggacagcgagcggauuuuauaccguggaagacacacacuacguuacccgcauguaucggguguacggcaaaaagaauauuaaacuggagccugucccccugaagggcacgucccuugauccgagauucguguuucuccuggaccgcgggcuggauaucuauguuuggcggggagcccaagcuacacucucuagcaccaccaaagccagacuguucgcugaaaagauuaacaagaaugagcggaaaggcaaggccgagaucacacuucuggugcaggggcaggaacucccugaguuuugggaagcgcugggaggcgagcccuccgaaauuaaaaagcacgucccugaggacuucuggcccccucagcccaaacuguacaagguggggcuuggccugggauaccucgagcugccgcaaaucaacuauaagcucucuguggaacauaaacagcgcccuaagguugagcugaugcccagaaugcggcuucugcagagccuccuggauaccagaugugucuacauccuggacugcugguccgauguguuuauuuggcuuggccgcaaaagcccccggcuggugagagccgcugcccucaagcuggggcaggaacucugcggaaugcugcaccgcccuagacaugcuacagucucucggucccuugagggcacggaagcccaaguguucaaagccaaguuuaaaaauugggacgauguucugaccguggacuauacacgcaacgcugaggcgguccuccagagcccggggcugucuggaaaggugaagagagacgccgagaaaaaggaucagaugaaagcugaccugaccgcccuuuuccugccccggcagccucccaugucccucgccgaagcugagcaacugauggaagaguggaaugaggaucucgacggcauggaaggguuuguucuggagggcaagaaauucgcccgccuuccugaagaggaauuuggacacuucuacacacaggauuguuauguguuccugugcagauacuggguccccguggaguaugaggaagaggaaaagaaggaggacaaagaagagaaggcggagggcaaagaaggggaggaagcuaccgccgaggccgaagagaagcagccugaggaagauuuucaauguaucguuuacuucuggcagggacgggaggcuagcaacaugggcuggcugacguuuaccuucucucuccagaaaaaguuugaaagccuguuccccgggaaacuugaggugguccgcaugacacagcaacaggagaauccgaaguuucugucccauuucaagagaaaauuuauuauccaccggggaaagcgcaaagccgugcagggcgcgcagcaaccuagccucuaccagauuagaaccaacgggucugcucugugcacacgguguauccagaucaauaccgacuccagccuccugaacuccgaguucugcuuuauucuuaaggugcccuucgaaucugaagauaaucagggcaucgucuaugccuggguuggcagagccagcgacccugaugaggcuaagcuggccgaagacauucugaacacgauguuugauacauccuacucuaaacaagugaucaacgagggagaggaacccgagaauuucuucuggguggggauuggagcucagaagccguaugacgacgaugccgaauacaugaaacacacccgccucuuucgguguagcaacgagaagggcuauuucgcggucacagaaaaaugcuccgacuuuugucaggaugaccuggccgaugacgauaucaugcuucuggacaaugggcaagagguguacauguggguuggaacccagaccucucagguggagauuaagcucagccugaaggcuugccaggucuauauccaacauaugagauccaaggaacacgagcgcccucggagacuccgccuggugcggaagggcaacgaacagcaugccuucacaagauguuuucacgcuuggagcgccuucugcaaagcccuugcuuga

SEQ ID NO: 69374 - RNA, 7944 nt, Artificial Sequence
  derived and/or modified sequence opt5 from FLNA__Homo_sapiens__NP_001104026
augagcuccucucacagcagagccggccaguccgcugccggggcggcucccggaggcggggucgacacccgggaugccgagaugccugccacagaaaaggaccuggcugaggaugccccguggaaaaagauccagcagaacacguucacccgcuggugcaaugaacaucucaaaugugucucuaagagaauugcuaaccugcagacagaccuuagcgauggacugcggcucaucgcccugcuugagguucugucccagaaaaagaugcaccgcaagcauaaucaaagacccaccuuucggcagaugcagcucgaaaacgugucuguggcgcuggaguuccuggaccgcgagagcauuaaacucgucuccaucgauagcaaggccauuguggacggcaaucugaaacuuauccuggggcucaucuggacacugauucuucacuacucuaucuccaugccuaugugggaugaagaggaagacgaggaggcuaagaaacagacccccaagcaaagacugcucggauggauucagaacaagcugccucagcugcccaucacaaauuuuagccgggauuggcagucuggccgcgcccucggcgcucugguugacuccugcgccccugggcuuuguccggauugggacagcugggacgcgucuaaacccgugaccaacgccagagaagcuaugcaacaggccgaugacuggcuggggauuccucaggucaucacgcccgaggaaauuguggauccuaauguugacgagcauuccgugaugaccuaucucagccaauuccccaaggcuaaacugaagccgggcgccccucuucggcccaaacugaacccuaagaaagcccgcgcuuacgggcccggaaucgaacccacaggcaauauggucaagaagagagcggaguuuaccguggagacacgguccgccgggcagggagaagugcucgucuauguugaggauccugcuggccaccaggaagaggccaaagugaccgccaacaaugacaagaaccgcacguucucugugugguacgucccggaagugacaggcacccacaaaguuacagugcuguuugcugggcagcauaucgccaagagccccuucgaggucuauguggauaaaucccaaggagacgcgagcaagguuaccgcucagggcccugggcuggagcccucuggaaauauugccaacaagaccacauacuuugaaaucuucacggccggcgcugggaccggagagguggaagucgugauucaggauccuaugggccagaaaggcacagucgagccccaacucgaagccagaggggacuccaccuaucggugcagcuaccagccgacaauggagggagugcacaccguucaugugacguuugcuggcgucccuauccccagaucuccuuacacagugaccguugggcaggccuguaaccccagcgcgugccgcgccgugggacggggccugcagccuaagggggucagagugaaagagaccgcugauuucaagguguauacaaaaggcgccggauccggcgaacuuaagguuaccgucaaggggcccaaaggagaggaacgcgugaagcaaaaagaccugggcgacgggguguacggauuugaguauuacccgauggucccuggcacauauauugugacgaucaccuggggaggccagaauaucggacggucucccuucgagguuaaggugggcacagaaugugggaaccagaaagucagagcuuggggacccggccucgaaggaggggugguuggcaagagcgccgauuucguggucgaagcgauuggggacgaugugggcacccugggauuuuccguugagggcccuagccaggccaagaucgaaugcgacgauaaaggggacggaucuugugaugugcgcuacuggccgcaagaggcuggcgaguaugccguccacgugcuuugcaauuccgaagacauucggcugagccccuucauggcugauaucagagacgccccucaggauuuucaccccgaccgcgugaaggcccgggggccuggacucgagaaaacaggcgucgcuguuaacaagcccgcggaguucaccguggaugccaaacaugggggcaaggcuccucugagagugcagguccaagacaaugagggaugucccguggaagcccugguuaaagacaacggcaaugggacguacucuugcuccuacgugccgcgcaagccugucaagcacaccgccauggugagcuggggaggcguuuccauucccaacucuccuuuucgggugaaugucggggcuggaagccaucccaacaaagugaagguuuauggcccgggcguggccaaaacagggcucaaggcgcacgagccuaccuacuucacagucgauugcgcugaggccggacagggcgacguguccaucgggaucaaaugugcccccggaguggucggcccugcugaagccgauauugacuuugauaucauuagaaaugacaacgauaccuucacgguuaaguauacaccccgcggggccggaucuuacaccaucauggugcuguuugcugaccaggccacacccaccagcccuauucgggugaaggucgagccgucccaugaugccagcaaagugaaggcugaaggccccggccuuucuagaaccgggguugagcugggaaaaccuacacacuucacggugaaugccaaggcugccggcaaagggaagcucgacguccaguuuuccggacugaccaagggcgaugcggugcgggacguugauaucauugaccaccaugacaacacauauaccgugaaauacacacccguccaacaggggccugugggagucaaugugaccuauggcggcgaucccaucccuaagagcccguucucuguugccgugucccccagccuggaccuuucuaaaaucaaggucagcgggcucggagaaaaaguggauguuggcaaggaccaggaguuuacggugaaguccaaaggggcuggaggccaggggaaggucgccagcaaaauugugggaccuucuggcgcugccgugcccugcaagguugagccuggccugggggccgauaacuccgucgugagauuccugccccgcgaagagggaccguacgaaguggaggucacauacgacggcgugccuguucccgggagccccuucccucucgaggcuguggcgcccaccaaaccuuccaaggucaaagccuuuggaccgggccugcaagggggaucugcuggcagccccgcccgguucaccaucgauacaaagggcgccgggaccggaggccuugggcugacaguggaaggaccuugugaggcucagcucgaaugccuggacaacggcgaugggacguguuccguuucuuaugugcccaccgagccuggagacuacaauauuaacauccuguuugccgauacacacauucccggcagcccguucaaggcgcaugucgugccuugcuuugacgcuuccaaaguuaaguguucuggccccgggcuugaaagagccaccgccggagaggugggccaguuccaggucgacugcagcuccgcugggagcgccgagcucacaaucgaaaucuguucugaggcgggacugccugcugaaguguauauucaagaucacggcgacgggacccacacgaucaccuacauuccccugugcccuggagccuauacagugaccaucaaauacggcggccagcccgucccgaauuuuccuuccaagcuccagguugagcccgccguggauacaagcggggugcaauguuauggacccggcauugaagggcagggagucuuccgcgaggcuaccacagaguuuucuguggacgccagagcucugacccagacgggcgggccucauguuaaagcccggguggcgaacccguccggcaaucuuacagaaaccuacguccaggaucgcggagacggcauguacaagguggaguauacccccuacgaagaggggcugcacagcguugaugugacauaugacggaucuccuguccccuccagcccuuuccaagugcccgucaccgaaggcugcgauccuuccagagugcggguucaugggccgggaauccagagcggcacgacaaacaagcccaauaaauuuaccguggagacacgcggggccggcaccggaggccucgggcuggcuguggagggaccuucugaagccaagaugagcugcauggacaacaaagauggcuccuguucugucgaguacauccccuaugaagcugggacauacagccugaauguuaccuauggaggccaccaggugccugggucccccuucaaggugccgguccaugacgugacggaugccucuaaaguuaagugcagcggcccuggacuuucccccggcauggugagagccaaccucccccagucuuuucaagucgacaccagcaaggcugggguggcgccucugcaggucaaagugcagggacccaagggccugguugagccuguggacgucguggauaaugccgacgggacacagaccguuaacuacgugccgucccgggagggacccuacagcauuucuguccucuauggcgaugaagaggugccucgcucccccuucaaagugaagguucugccuacacacgacgcuagcaaagucaaggccucuggccccgggcuuaauaccacgggagugccggccucccugccuguggaguucacaaucgaugcuaaggacgccggcgaggggcuccuggcgguccaaauuaccgaucccgaaggaaaaccuaagaaaacacacauccaggacaaccaugauggcaccuacaccguugcuuaugugcccgacgugacagggagauacacgauucugaucaaguauggaggcgaugagaucccuuuuagccccuaccggguccgcgccgugccgaccggcgacgccuccaaauguacaguuaccgugucuauugggggacacggccuuggggcuggaaucggcccuacaauucagaucggggaggaaaccgucauuacgguggauacaaaggccgcgggaaagggcaaaguuaccugcaccguguguacacccgacggcagcgaggucgacguggauguggucgaaaaugaggacgggaccuucgauaucuuuuauacagcgccccagccuggaaaguacguuauuugcgugagauucggcggggaacaugugccgaacucccccuuucaagucacggcucucgccggagaccagccuagcgugcagcccccucugcggucucaacagcuggcuccccaguacaccuaugcccagggcgggcaacagacaugggcuccugagagaccccucguuggagugaacggccuggaugucaccucccuucgcccguucgaccuggugaucccuuuuacaaucaaaaagggcgagauuaccggggaaguucggaugcccagcggaaaaguggcccagccuacgaucaccgauaauaaggacggcacagucaccgugagauacgcgcccucugaggccgggcuccacgaaauggauauucgcuaugacaacaugcauaucccgggaagcccucugcaguucuacguugauuaugugaauuguggccacgucacagcuuacgggcccggacugacccacggcguggucaacaaacccgccacauuuacggugaauaccaaggacgcuggcgaagggggacuuucccuggccauugaaggcccuucuaaggccgagaucagcugcacagacaaccaagaugggaccuguuccguuucuuaucuccccgugcugccuggagacuacagcauccucgucaaauacaaugagcagcaugugccgggcucccccuucaccgcucgggugacaggggaugacagcaugagaaugucucaccugaagguuggauccgcggccgauauuccuaucaacauuagcgaaacggaccuuucccugcucaccgcuacaguggugcccccuucuggccgcgaggaacccugccugcugaaacggcuuagaaauggccauguggggaucagcuuuguuccuaaggagaccggagagcaccuggugcacgucaaaaagaacggccagcauguggccuccucuccgauucccgucgugaucagccaguccgaaaucggggaugccagccgcguucgggugucuggacaaggccuccacgaggggcauacauucgaaccugcugaguucauuaucgacaccagagaugccggauauggcggccugucccucagcauugaagggcccucuaaggucgacaucaauacggaggaucuggaggacggaacaugucgggugaccuacugcccuaccgaacccggcaacuauauuaucaauauuaaauuugcggaucagcacguuccgggguccccuuucagcgugaaggucacaggagagggccgcgugaaagaaucuaucaccagacggcgcagagcccccagcguggcuaacguugggucccauugcgaccuuucucugaagauccccgagauuagcauccaggacaugacagcccaagucaccuccccuagcggcaaaacgcacgaagcugagauuguggagggagaaaaucacacauacuguauccgguuugugcccgccgagaugggcacccauacagucuccgugaaguauaaggggcagcacguuccuggaucuccguuccaguuuaccgugggcccccucggggaaggaggcgcgcauaaagucagagccgggggcccuggacuggagcgcgcugaagccggcgugcccgcugaguucagcauuuggacgcgggaggccggggcuggaggccuggccaucgcgguugaagggccuuccaaggccgagaucucuuuugaagauagaaaagacggaagcugcggcguggcuuacgucgugcaggagcccggggauuaugagguuuccgugaaguucaacgaagaacacauuccggacucuccuuuugucgugcccguggccagcccuuccggcgaugcucgccggcuuaccgucagcucucugcaagaauccggacucaaaguuaaccagcccgccagcuucgccgugucucugaauggcgcgaagggggcuaucgacgccaaggugcacuccccgagcggagcucucgaggaauguuacgucacagagauugaucaggacaaauacgccgugagauuuaucccucgcgagaacggcguuuaucugauugaugugaaguucaaugggacccauauccccggaucucccuuuaaaauccgggucggcgaaccugggcacggcggagaccccggccuuguguccgccuacggggcuggacuggagggcgggguuacaggaaacccugccgaguucguggucaauaccagcaacgcgggcgccggcgcucuguccgugacaauugaugggccgagcaaggucaaaauggacugccaggagugucccgaaggauauagagugaccuacacgccuauggcccccggcucuuaucucaucagcauuaaguacgggggaccuuaucauaucggcgggucccccuucaaagcuaagguuacaggaccucgccuggugucuaaucacagccuucaugagaccuccucugucuuuguggacagccugaccaaggccacaugcgcgccgcaacacggcgcccccggcccugggcccgcugaugccuccaaaguuguggcuaagggacucggccugucuaaagccuacgucgggcaaaagagcuccuucaccguggacuguagcaaagcuggaaacaauaugcuccuggugggcguucacgggccuagaacacccugcgaggaaauucuugucaagcaugugggaucucggcuguacuccgugagcuaucugcucaaggauaaaggcgaguacacgcuggucgugaaguggggcgacgaacacaucccggggucuccuuaucgcguugugguccccuga

SEQ ID NO: 69375 - RNA, 7902 nt, Artificial Sequence
  derived and/or modified sequence opt5 from FLNB__Homo_sapiens__NP_001157789
augcccgugaccgagaaggaccuggcggaagaugcuccuuggaagaagauucagcagaacacauucacgagauggugcaaugagcaccucaaaugugucaacaagcggauuggcaaucugcagaccgaccuuagcgaugggcugcgccucaucgcccugcuugaaguucugucccagaaaagaauguaccggaaguaucaucagcgcccgacauuuagacaaaugcagcucgagaacgugucuguggcgcuggaguuccuggaccgggagagcauuaagcucgucuccaucgauucuaaagcuauuguggacggaaaucugaaacuuauccugggccucguuuggacccugauccuucacuacagcauuuccaugcccgugugggaggaugaaggggacgaugacgccaaaaagcagacaccuaaacagcgccugcucggauggauccaaaacaagauucccuaucugccuaucaccaauuuuaaccagaauuggcaggauggcaaggcccugggggcucucgucgacucuugcgcccccggacuguguccugauugggagagcugggacccgcagaaacccguggacaacgcuagagaagccaugcaacaggcggaugacuggcuuggcguuccucaggugauuacacccgaggagaucauucauccugaugucgacgaacacuccgugaugaccuaccugagccaauuccccaaggccaaacucaagccgggcgcuccucugaaacccaaacuuaauccuaagaaggcccgggcuuaugggcgcggaaucgagcccacgggcaacauggugaagcagcccgccaaauuuaccgucgauacaaucucugcggggcagggagacguuaugguguucguggaagauccugagggcaauaaggaagaggcccaggucaccccggacuccgauaaaaacaagacauacagcguggaguaucugcccaaaguuaccgggcuccauaaggugacgguccuguuugcuggacaacacauuucuaaguccccuuucgaagugagcguugacaaagcccagggcgaugcuucuaaggugacagccaaaggccccgggcuggaggccgucggaaauaucgcuaacaagccuaccuacuuugacauuuacacagcgggcgccggggugggagacaucggcgucgaaguggaggauccccaggggaaaaacaccguugaacuccugguggaggacaagggaaaucaggucuauagaugcguguacaagccgaugcaaccuggcccccacguugugaaaauuuucuuugcuggcgauaccaucccuaagucccccuucgucguccaggucggggaggccuguaacccuaaugccugccgggcuagcggacgcggccuucagcccaaagggguuagaauccgggaaacaacggacuuuaaggucgauaccaaagccgcgggauccggcgagcugggggugacaaugaagggcccgaagggacucgaagaacuggugaaacagaaggacuuccuugauggcgucuaugcuuucgaauacuauccuucuacccccgggcgcuacagcauugccaucacauggggaggccaucacauucccaaauccccuuuugaggugcaaguugggccggaggccggaaugcagaaggugagagcuuggggccccgggcugcauggcggaaucgucggccggagcgccgacuucgugguugaaucuauuggguccgaggugggaagccucggcuuugcuaucgaagggccuucucaggccaaaaucgaguauaacgaucagaaugacggaagcugugaugucaaguacuggcccaaagagccuggcgaauacgcggugcacauuaugugcgacgaugaggacaucaaggacucccccuauauggccuucauucacccugcuaccgggggcuacaaccccgaucugguuagagccuauggaccgggccuggaaaagucuggguguaucgugaauaaccucgcugaguuuacggucgacccuaaagaugccggaaaggcgccccugaaaauuuucgcccaagacggcgaagggcagcgcaucgauauucagaugaagaaucggauggacggaacauacgcuugcagcuauaccccugugaaagccaucaagcauaccaucgcuguggucuggggcgggguuaacauuccccacuccccguacagagugaauaucggccaaggaagccauccucagaaggugaaagucuuuggccccgggguggagcgcucuggacuuaaggccaacgagccuacacacuucaccguugauuguacagaagccggcgagggggacguguccgucggaauuaaaugcgaugcucgggugcugagcgaagacgaggaagauguugacuuugauaucauucauaaugcgaacgacacguucaccgugaaguaugugccgcccgccgcuggcagauacacaaucaaagugcucuuugccucucaggagaucccugccuccccguuccgcguuaagguggaccccagccacgaugcuuccaaggucaaagccgagggcccugggcugucuaaggcgggaguggaaaauggcaaacccacccacuuuacaguguacaccaagggggcuggaaaagccccucugaacguccaguucaacagcccccuuccuggcgacgccguuaaggaucucgacauuaucgauaauuaugacuacucccauacggugaaguauaccccgacacaacaggggaacaugcaagugcuggucaccuacggaggcgaucccauuccuaaaucucccuucacagugggcguugcugccccucuggaccucagcaagaucaaacugaaugggcuugagaaccggguggaagucggaaaggaucaggaguuuaccguggacacgagaggcgccgggggacaaggcaaacuggauguuacaauucucucccccagccgcaagguggucccgugccuggugaccccugucacagggcgggaaaauucuaccgcuaaauucauccccagagaggagggacuguaugccguggacguuaccuacgacggccaccccgugccuggcucccccuauacagucgaagccagccuuccuccggaucccucuaaggugaaggcucaugggccuggacucgagggcgggcugguuggaaaacccgccgaauuuacgaucgacaccaagggcgcugggacaggaggccugggccucaccguggaggggccuugugaggccaaaauugaaugcuccgauaacggagacggcacauguagcgucucuuaccugcccaccaagccgggggaguacuucgugaauauccuuuuugaagaggugcacauuccuggaagccccuucaaagcggauaucgaaaugccuuuugaccccuccaagguugucgccagcggcccugggcuggagcacggaaaggugggcgaggcuggccuccugucuguggauugcuccgaagccgggcccggagcucugggccuugaggccgucagcgacuccgggacgaaagccgaagugucuauucagaacaauaaggauggaacauaugcuguuaccuacgugccgcucaccgcgggcauguauacacugaccaugaaauacgggggagagcuggucccucauuuccccgcccgcgugaagguugaacccgcuguggacacaagccggaucaaagucuuuggcccuggcaucgaggggaaggauguguucagagaggccacgaccgacuuuacaguugauucccggccgcucacccaggugggaggcgaccacauuaaggcccauaucgcuaaccccucuggggccagcacagaauguuucgucaccgacaaugcggauggaacguaucagguggaguacaccccuuuugaaaaaggccugcacguggucgagguuacauaugacgaugugcccauuccuaacucccccuucaagguggcugucaccgaagggugccaaccuucucgcgugcaggcccagggaccgggccuuaaagaggccuucacaaauaagcccaacguuuuuaccguggucacaagaggcgcugggaucggaggccuggggauuaccguggagggaccuagcgaauccaaaaucaauugucgggacaacaaggauggcagcugcucugccgaguacauucccuucgcgccuggggacuacgauguuaacaucacguauggcggagcucauauccccggcuccccguuuagagugccugucaaggacguggucgaucccagcaaagugaagauugccgggcccggacucggcucugggguucgcgcccgggugcugcaauccuucacaguggacagcucuaaagcuggacuggccccucuugaagucagaguucucggcccccgcgcugaugacaccgauucccagagcuggagauccccucugaaggcccugagcgaguuuuucaaaggggacccgaagggcgacuuuaauaagaccggacucguggagcccgugaacgucguggauaauggcgacgggacacacaccguuacguacacaccuucucaggaaggacccuauauggugagcgucaaauacgcggaugaggaaaucccucggucccccuucaaggugaaaguccugccgaccuaugacgccucuaaggugacagcuagcggcccugggcuuuccucuuacggaguucccgccagccugccuguggauuuugcuauugacgcccgcgaugccggcgaggggcuccuggcuguccagaucaccgaccaagaaggcaaacccaagagagcgauugugcacgauaacaaagacggaacauaugccguuaccuacaucccugauaagacgggccgguacaugaucggggugaccuauggaggcgacgacauuccccuguccccguaccgcaucagagcuacacagaccggggaugccucuaagugucuugccacaggaccuggcauugcuagcaccgucaaaacgggcgaggaggugggguucgugguugacgccaagacagcgggaaaaggcaaggugaccugcacagugcugacccccgaugggaccgaagcugaggccgacgugaucgaaaaugaggauggaacauaugacaucuuuuacacggccgcuaaacccggcaccuaugucaucuacguucgguucgggggaguggauaucccuaacuccccguucacagugauggccaccgacggcgaagucacagcgguggaggaggcccccguuaaugcuuguccucccggcuuucgcccuugggugaccgaagaggccuauguccccgugagcgauaugaacgggcucggauucaagccuuuugaccugguuauucccuucgcugugagaaagggcgaaaucacgggggagguccauaugccgucuggaaaaacagccaccccugaaauuguggauaauaaggacggcaccgugacaguccgguacgcucccaccgagguugggcuccacgagaugcauaucaaauacaugggaucccacauuccugaaagcccccugcaguuuuaugugaacuaccccaauucuggcuccgugagcgccuauggcccugggcuugucuacggaguggcgaacaagacagccacguucaccaucguuacagaggaugcuggcgaagggggacuggaccucgccauugagggccccuccaaagcugagaucucuugcaucgacaauaaggaugggaccugcacagugaccuaucugcccacgcugccuggagacuacagcauucuugucaaguauaacgauaaacauauccccggcuccccuuuuaccgccaagauuacagacgauagccgcagauguucucaggugaaacugggcuccgccgcugacuuccuccuggauaucagcgaaaccgaccucucuagccugacagcguccauuaaggccccgucugggcgggaugagcccugccuucugaaaagacucccuaauaaccacaucggaaucagcuuuauuccccgcgaaguuggcgagcaccugguguccaucaagaagaacgggaaucaugucgcuaacucuccugugagcauuaugguugugcaauccgaaaucggagacgcccggagagccaaagucuacggccgcgggcugagcgagggacggaccuucgagaugucugauuuuauuguggacacaagagacgcuggcuacggcgggaucucccuugccgucgaaggacccagcaagguggauauccagacggaggaccuggaagauggcaccuguaaaguuuccuauuucccuacagugccgggggucuacauugugucuaccaaguuugcggacgagcacgugcccggaagcccuuucaccguuaaaaucuccggcgaagggcgcgugaaggagucuauuacacggacgagcagagcccccuccgucgcuaccgugggaagcaucugcgaucucaaucugaaaauuccugagaucaacucuuccgacaugagcgcccauguuacaucucccuccggccgcgugaccgaagcugagauugucccgaugggcaagaauagccacugugugcgguucgucccucaggaaaugggggugcacacaguuucugugaaguauagaggacagcaugucaccggcagccccuuucaauucacgguggggccccucggagagggcggggcccacaaaguucgggcgggaggcccuggccuggaacgcggggaggccggagugcccgcugaguuuuccaucuggacaagagaagccggcgcugggggacuuucuaucgccgucgagggcccuagcaaggcugaaauuaccuucgaugaccauaaaaacggguccugcggcgugagcuacaucgcccaggagccgggaaauuaugagguguccauuaaguuuaacgaugaacacauccccgagucuccuuaccugguucccgucauugcgccuagcgacgaugcccggcgccugaccgugaugucccuccaggaaucuggccugaaagugaaucagcccgcuagcuucgccaucagacuuaacggggcuaagggaaagaucgacgccaaaguccauuccccgucuggcgccguggaggaaugucacguuagcgagcuggagccugauaaguaugcggugcgguuuauuccccacgaaaaugggguccauacaaucgacgugaaauucaacggaucccacguugugggcagcccuuuuaaggucagagugggggagcccggccaagcuggaaauccggcccucguuucugcuuacggcaccgggcuggaaggaggcacaaccgggauucaguccgaguucuuuaucaacacgacacgcgccggaccuggcacccucagcgugacaauugaagggcccucuaaagucaagauggacugccaggagacccccgagggcuacaaggugauguauacgccuauggcccccggaaauuaccugaucuccgugaaauauggcgggccuaaccauaucgucggaagcccguucaaggcuaaaguuaccggccaacggcuugugucucccggguccgccaaugaaacaagcuccauucugguggagagcgucaccagaucuagcacagaaaccuguuacuccgcgaucccuaaggccucuagcgaugcuuccaaagugacaucuaagggagccggccugagcaaggcuuuuguugggcagaaauccucuuuccucguggacugcagcaaggccggcuccaacaugcugcuuauuggaguccacggccccaccacgccuugugaggaagugagcaugaaacacguugggaaccagcaguauaaugugacauacgucgugaaggagcgcggagauuauguccuggcggugaaauggggcgaggaacauauccccgggucuccuuuccacguuaccgugccguga

SEQ ID NO: 69376 - RNA, 8079 nt, Artificial Sequence
  derived and/or modified sequence opt5 from FLNC__Homo_sapiens__NP_001120959
augaugaacaauagcggcuacuccgacgccgggcugggacucggcgaugagaccgacgaaaugcccucuacagagaaggaucuggcugaagacgccccuuggaaaaagauccagcaaaacacguucaccagauggugcaaugagcaccuuaaauguguggggaagcggcugacagaucuccagcgcgaccugagcgauggacuuagacugauugcccuccuggaaguccugucccagaaacggauguaucgcaaguuucauccgagacccaacuuccggcagaugaagcucgagaauguuucuguggcucuggaguuucuugaacgcgagcacaucaaacuggugagcauugacuccaaggccaucgucgauggcaaccucaaacugauucuugggcugaucuggacccucauccugcauuacucuauuagcaugccuaugugggaagacgaggaugacgaggaugccagaaagcaaacacccaaacagcggcugcucggauggauccagaauaaggugccucagcugcccauuaccaacuucaaucgcgacuggcaagacggcaaggcucuuggcgcccugguugauaacugcgcuccugggcucuguccggacugggaagccugggaucccaaucagccuguggagaacgccagagaagccaugcagcaggcugacgauuggcugggagucccccaagugaucgccccugaggaaauuguugaccccaauguggaugagcacuccgucaugacauaucuuagccaguuuccgaaagcuaagcugaaaccuggcgcccccgugcggucuaagcagcucaacccuaaaaaggcgaucgccuacgggcccggaauugagccccaaggcaauaccgugcugcagccugcucauuucacgguccagaccguugacgccggggugggagaagugcuggucuauaucgaggauccggaaggccacacagaggaagcuaaagugguucccaacaacgacaaggaucgcaccuacgccguguccuaugucccuaagguggccggccuccacaaaguuacagugcuguuugcugggcagaauaucgagagaagccccuucgaggucaacgugggaauggcgcuuggcgacgccaauaaggucucugcucgggggccuggacuggaacccgugggcaacguugccaauaaaccgaccuacuuugacauuuacacggccggggcuggaacaggcgauguggccgucgugaucguugacccucaaggccgcagagauaccguggaggucgcgcucgaagacaagggggauuccacauuccggugcaccuauagacccgcuauggagggaccucauaccgugcacguggccuuugccggcgcucccauuacacgcagcccuuuccccguucaugucucugaagccuguaacccgaaugcuugccgggccuccgggagaggacugcagccuaaaggcgugcgcgugaaggaggucgcggacuuuaagguguucacgaaaggggccggcagcggagagcuuaagguuaccgugaaaggccccaaggggacagaggaacccgucaaagugcgggaagcuggagauggcguuuucgagugugaguacuauccuguggucccggggaaguacgugguuaccaucacauggggaggcuaugccauucccagauccccuuuugaagugcaggucucucccgaggcuggggugcagaaggugcgcgccuggggcccuggacuggaaaccggccaagucgggaaaagcgcggacuucguuguggaggccaucggaacggaagugggcacacucggguuuuccaucgagggacccagccaggcuaagauugagugcgaugacaaaggcgaugggucuugugacguccgguacuggccuaccgaacccggcgaguaugccgugcacguuaucugcgaugacgaagacauuagagauuccccguucaucgcucacauucugccugcgcccccugacuguuuucccgauaaggugaaagccuucggaccgggccuggagccuaccgggugcaucgucgacaagcccgcugaauuuacaaucgaugcgcgcgccgcuggaaagggcgaccucaaacuguacgcccaggaugccgacgggugcccuauugauaucaaggugauucccaacggagacggcaccuuccgguguagcuacguucccacaaaaccuaucaagcauacgauuaucauuucuuggggaggcgugaaugucccgaaaagccccuuuagagugaacguuggagagggcucccacccugagcgcgugaaggucuaugggcccggaguggagaagacaggccuuaaggcuaaugagccuacauacuucaccguggauugcucugaagccgggcagggagacgucagcaucggcaucaagugugcgcccggcguuguggggccugcugaggccgauauugacuuugacaucauuaaaaacgauaaugacacauucaccgugaaguauacgccgcccggagccggccgguacaccaucaugguccuguuugcuaaccaagaaauuccugccucccccuuccauaucaaaguggauccuagccacgacgcgucuaagguuaaagcugaggggcccggacucaauagaacaggcguggaggucgggaagccgacccauuucacagugcugaccaagggagccggcaaagccaagcuggauguucaguuugcuggcacggccaaaggggaagugguccgggacuucgagaucauugauaaccacgacuauuccuacacagugaaguauaccgcuguccagcagggaaacauggccgugacaguuaccuacggcggggauccugugcccaaaagccccuuugucgugaauguugcgccuccccuugaccucucuaagaucaaggugcaaggacugaacuccaaagucgccgugggccaggaacaggcuuucagcgugaauacccgcggggccggaggccaaggccagcuggauguuagaaugacauccccuucucggagaccgauucccugcaagcucgagccugggggaggcgcugaggcccaggccguccgcuacaugcccccugaagaggggcccuauaaaguggacaucacguacgacggacacccggugccuggcagccccuuugcugucgaaggggugcugccucccgauccuuccaagguuugugcguauggacccggccuuaaaggcgggcuggugggaaccccggccccuuucucuauugacacaaagggcgcugggaccggaggccucgggcugacagucgagggacccugcgaagccaagaucgagugucaggauaacggcgacggcagcugcgccguguccuaccugcccaccgagccuggggaauauacgaucaauauucuuuuugcugaggcccauaucccgggaagccccuucaaagcgacaauucggccuguuuuugaucccucuaaggugagagcuuccggcccugggcucgaacgcggaaaagucggcgaggccgccaccuucaccguggacuguagcgaagcuggggaggccgagcugacaaucgaaauucugucugaugcgggaguuaaggcugaggugcucauccacaacaaugccgacggcaccuaccauaucacauauucccccgccuuuccuggcacguacaccauuacaaucaaauacgggggacacccgguccccaaguucccuaccagagugcacgugcaacccgcugucgauacaagcggcguuaaagugucugggccuggaguggaaccccauggcguccugcgggaggugaccacggaauuuaccguugacgcccgcagccuuacagcuaccgggggaaaccacgugacagccagaguccugaauccguccggcgcgaagaccgauacauaugugaccgacaacggcgaugggacguaccggguucaguauacagccuacgaggagggagugcaucucgucgaagugcuguaugacgaggucgcugugccuaagagccccuuccgcguuggcgugaccgaagggugcgaccccaccagagugcgggccuucggaccuggccuggaagggggccuugucaauaaagcuaaccgcuuuacaguugagaccagaggagccggcacagggggacucggccuggccauugaagggcccucugaggcuaagauguccuguaaagauaauaaggacggaagcugcacgguggaauacaucccuuucaccccgggcgauuaugacgugaacauuacauuugggggccggcccaucccuggaucccccuuccgcgucccugugaaagauguuguggaccccggcaaggucaagugcucugggccgggacugggcgcgggggugagagcccgggucccucagaccuuuacaguggauuguagccaggcugggcgggcgccccuccaaguugccgugcugggcccuaccggggucgcugagcccguggaaguucgcgacaauggcgauggaacgcacaccgugcauuacaccccugccaccgacggccccuacacagucgcggugaaauaugcugaucaggaggugccgcgguccccuuucaagauuaaaguucuucccgcccacgacgccucuaaggucagagcuagcgggcccggacugaacgccuccggcaucccugcgucucucccgguggaguuuaccaucgaugcccgcgacgcuggggaaggacugcugacggugcagauucuugaccccgagggcaaaccuaagaaggccaacauccgggauaauggcgacgggacauacaccgucagcuaucuccccgauauguccggaagauacacaauuaccaucaaauauggcggggacgaaauuccuuacagccccuuccgcauccacgcucugccuaccggagaugccucuaagugccugguuacaguguccaucggcgggcauggacucggcgcuugucugggcccccggauucagaucgggcaagagacggugauuaccgucgacgccaaagcggccggagaaggcaaggugacaugcaccguuagcacaccggauggggcugagcuugacguggaugucguggagaaccacgacggaaccuuugauaucuauuacacggccccugaacccggcaaauacguuauuacaaucagauucgggggagagcauaucccuaauucucccuuucacgugcuggcuaccgaagaaccggucgugccuguggaacccauggaguccaugcuccgccccuucaaccuggucauuccuuucgccguucagaagggcgagcugaccggcgaagugcggaugcccagcgggaagacagccagaccuaauaucaccgacaacaaagacggaacaauuacggugcgguaugcuccgaccgagaagggccuucaucagauggggaucaaauacgauggaaaucacauucccggcucuccucugcaauuuuaugucgacgcgaucaacucccgccacgugagcgccuacgggcccggacucucccauggcaugguuaauaagccugcuacauucaccauugugacaaaagaugccggcgaagggggacugagccucgccgucgagggccccucuaaggcugagaucaccuguaaggacaacaaagaugggacgugcaccgugagcuaucugccuacagccccgggagacuacuccaucauuguuagauuugaugacaagcacauccccggcucuccuuucaccgcgaaaauuacaggggaugacagcaugcggaccucccagcuuaaugugggaacaucuacggaugucagccugaagaucaccgaauccgaccucucucagcugacagccagcauucgcgcucccuccggcaacgaggaaccuugucugcuuaaaagacugcccaaucggcauaucggcaucagcuuuaccccgaaggaggugggggaacacguugugucugucagaaaauccggaaagcacgugaccaacagcccuuucaagauucucgucggccccucugagaucggggaugccuccaaagugcgcguuuggggaaagggccugagcgaggggcauacauuucagguggcugaguucauugucgacacgcggaaugccggauauggcggccucgggcuguccaucgagggacccucuaaaguggacauuaacugcgaagauauggaggacggcaccuguaaggugacauacugcccuaccgaacccgggacauacaucaucaacauuaaauuugcggauaagcacguuccuggaagcccguucaccgugaaggucacgggcgaggggagaaugaaagaguccaucacacgccggagacaagcccccagcauugcuaccaucggaucuaccugugaccuuaaucugaagauuccuggcaacugguuucagaugguguccgcccaggaacgccucacacggaccuucacaagaagcucucauaccuauacgcgcacagagagaaccgaaaucagcaaaacacggggcggggagaccaagcgcgaaguuagaguggaggaguccacgcaggucggaggcgaucccuuuccugcuguguucggggacuuccugggacgggaacgccugggcucuuuugggagcauuaccagacaacaggagggcgaagccuccucucaggauaugacagcucaggucaccagccccuccggaaaaguggaggccgcggagaucguugaaggcgaggacagcgccuacucugugcgguucgucccgcaagaaauggggccucacacaguggcuguuaaguauagaggacagcaugugcccggcuccccuuuucaguucaccgucgggccccuuggagagggcggggcccacaaggugcgcgcuggcggaacaggccuggaaagagggguggccggaguuccggccgaguuuagcaucuggaccagagaggcgggcgcugggggacucuccauugccgucgaaggcccuucuaaagcugagaucgccuucgaagaucgcaaggacgggagcugcggcguguccuacgugguccaggagcccggagauuaugaagugucuauuaaauuuaaugacgagcacauccccgacagcccuuucguugugcccgucgccucccugagcgaugacgcucggagacucacggugacaucucugcaagagaccggccuuaagguuaaccagccugccuccuuugcggugcagcugaauggggcccggggagucauugaugcucgcgugcauaccccgagcggcgccguugaagagugcuacgugucugaacuggacuccgauaaacacacaaucagauucaucccccaugagaacgggguccacagcauugacgugaaguuuaauggagcucacaucccuggcucucccuucaagauucgggugggggaacaaagccaggccggcgauccuggacucgucuccgcguauggccccgggcuggagggaggcaccacagggguuucuagcgaguuuaucgugaacacgcuuaaugccggauccggcgcucugagcgugaccauugacggcccuuccaaaguccagcucgauugucgcgaaugcccggaggggcaugugguuacauacacccccauggccccuggaaacuaccugaucgcuaucaaguauggcgggccccagcacauugugggaucuccuuucaaagccaaggucacaggccccagacucagcgggggacauucccugcacgaaaccucuacggugcuuguugagaccgugacaaaaagcuccucuagccggggcuccagcuacucuuccaucccgaaguucagcucugacgcuuccaaagucgugacccgcggcccugggcugagccaagccuuugucggacagaaaaauucuuucacaguggauuguuccaaggcgggcaccaacaugaugaugguuggggugcauggacccaaaacgcccugcgaggaagucuaugugaagcacaugggcaauagaguuuacaacgugacauauaccgucaaagagaagggggacuacauucugaucgugaaauggggagaugaaagcgugccuggcucccccuuuaagguuaaggucccuuga

SEQ ID NO: 69377 - RNA, 1284 nt, Artificial Sequence
  derived and/or modified sequence opt5 from FLOT1__Homo_sapiens__NP_005794
auguucuuuaccugcggccccaacgaggccaugguggucagcggguucuguagauccccuccgguuaugguggcuggaggccggguguuuguccugcccugcauccagcaaauucagcgcaucucucucaauacacugacgcuuaacguuaagagcgaaaaaguguacaccagacacggggugccuauuuccgucacaggaaucgcccaggugaagauucagggccaaaauaaagagaugcuggcggcugccugucagauguuccucgggaagaccgaagccgagaucgcucauaucgcccuggaaacacuugagggacaccagcgggcuauuauggcccauaugaccguugaggaaaucuauaaagaccgccagaaguuuucugagcaaguguucaaggucgcgagcuccgaucuggugaacaugggcauuucuguggucagcuacacacucaaagacauccacgaugaccaggauuaucugcauucccugggcaaggccagaaccgcucagguucagaaagacgcccggauuggggaagcugaggccaagcgcgaugcgggaaucagagaggccaaagcuaagcaagaaaaggugagcgcccaguaccucucugagauugaaauggcuaaagcccagcgggacuaugagcugaagaaagccgcuuacgauaucgaagugaauacgcgcagagcgcaagccgaccuugcuuaucagcugcaggucgccaagaccaaacagcaaaucgaggagcagcgggugcagguucagguggucgaacgcgcccaacagguggcuguucaggagcaggaaauugccagacgggagaaggaacucgaggcgcgcgugagaaaacccgcugaggccgaacgguacaagcuggagagacuugccgaagcugagaagucccaacugaucaugcaggccgaagcugaggccgcgagcguccgcaugcggggcgaggccgaggcuuuugccauuggggcuagagcccgcgcggaagccgaacagauggcuaaaaaggccgaggcuuuccagcucuaccaagaggccgcccagcuggauaugcugcucgaaaaacugccucagguggcugaggaaaucucuggaccccuuacauccgcgaacaagauuacccuggucagcucuggcuccgggacaaugggagccgcuaaagugaccggcgagguucucgacauccugacgcggcuuccugaaagcguggagagacugacaggcgucuccaucucucaagugaaucacaagccgcuccgcaccgccuga

SEQ ID NO: 69378 - RNA, 1287 nt, Artificial Sequence
  derived and/or modified sequence opt5 from FLOT2__Homo_sapiens__NP_004466
augggcaacugccacaccguggggcccaaugaggcccuggugguuagcggaggcuguugcggguccgacuacaagcaguauguguucggaggcugggcuugggccuggugguguaucucugauacacaaagaauuagccucgaaaucaugacgcugcagccucggugcgaggacguggaaaccgcggagggggucgcucuuacagugaccggaguugcccaggugaaaauuaugacagaaaaggagcugcucgccgucgcuugugagcaguuucugggcaaaaacgugcaagauaucaagaauguugugcuucagacccuggaaggccaucuccgcuccauucuggggacacugaccgucgagcagaucuaccaggacagagaucaauucgccaaacucgugcgggaaguggcugccccggacgucggacgcaugggcaucgagauucugucuuuuacgaucaaggauguuuaugacaagguggauuaccuuagcucccuggggaaaacccagacagcggugguccagagagacgccgauauuggaguggcugaggccgaacgggacgcuggcauccgcgaggccgaaugcaagaaagagaugcucgauguuaaguucauggcggacaccaaaauugccgacucuaagagagcuuuugaacugcagaaaagcgccuucuccgaggaggugaacaucaaaacagcugaagcccaacuugccuaugagcugcagggggcucgggaacagcaaaagauucgccaggaggaaaucgagaucgaggucgugcagagaaagaagcagauugcgguugaagcccaagagauccuccggaccgauaaagaacugauugcuacggugcgcagacccgccgaggccgaagcucaccggauccagcagauugccgagggagagaaggucaaacaggugcugcucgcgcaagcugaagccgagaagauccgcaagaucggcgaagccgaggcugccgucauugaggcuaugggcaaagccgaagcggagagaaugaagcugaaagccgaggcuuaccagaaguauggggacgccgcuaaaauggcccuugugcuggaagcgcucccucagaucgccgcuaagauugccgcuccccugacaaagguugaugaaaucgugguccuuagcggagacaauucuaaagugaccuccgagguuaaccggcugcucgccgagcugccugccagcgugcaugcucugacaggcgucgaucucucuaagauuccccugaucaaaaaggcgaccgggguccagguguga

SEQ ID NO: 69379 - RNA, 1983 nt, Artificial Sequence
  derived and/or modified sequence opt5 from FLRT2__Homo_sapiens__NP_037363
augggccugcagaccacaaaguggcccagccacggggccuucuuucucaaauccuggcugaucauuucucuuggacuguacagccaaguguccaagcuccuggcuugcccuucugucuguagaugcgaccggaacuucguuuauuguaaugagcgcagccuuacguccgugccgcugggcauccccgaaggggugaccguccucuaccugcauaacaaucagauuaacaaugccggauuuccugcggagcugcacaacgugcagucuguucauacaguguaucucuacggcaaucagcuggaugaguuccccaugaaccuuccuaaaaaugucagagugcugcaccuccaagagaacaauauccagaccauuagccgggcugcccuggcccagcuucugaagcucgaagaacugcaucuggacgauaacuccaucagcacaguugggguggaggacggagcuuuucgcgaagccaucucucucaaacugcuuuuccuguccaagaaucaccucagcucuguccccgugggccugccuguggaucuucaggagcugagagucgacgaaaaccggauugcuguuaucuccgauauggccuuucaaaaucucaccagccuggagcgccugauuguggacggcaaccuccugacaaacaaggggaucgcggagggaaccuucucucaccuuacgaaacugaaggaauuuuccauugugagaaauagccucucccauccgcccccugaucugcccggcacccaccuuauccggcuguaucuccaggacaaccagauuaaucauaucccucugacagccuucucuaaccugcgcaaacucgagagacuggauaucagcaauaaccagcuucggaugcugacccaaggggucuuugacaaucucuccaaccugaagcagcugacagcucgcaauaaccccugguucugcgauuguagcauuaaaugggugaccgaauggcuuaaguacaucccgucuucccucaauguuagaggauuuaugugccagggcccugagcaagugcgggggauggccguccgcgaacugaacaugaaucugcucagcugucccacgacaaccccuggacugccccuuuucacacccgcuccuucuaccgccagcccgaccacacagcccccuacgcuguccauucccaacccuucuagaagcuauacacccccgaccccuaccacauccaagcuccccaccaucccugacugggacggccgggagagagugacgcccccuauuagcgagcgcauccagcugucuauccacuucguuaaugauacauccauucaggugagcuggcugucucuuuuuaccgucauggcguacaaacucaccugggugaagaugggccacucccuggucgggggaaucgugcaagaacggauuguuagcggcgagaaacagcaucugucccucgugaaccuggaacccagaucuacauaccgcaucugccuugucccgcuggacgccuucaacuaucgggcuguggaggauaccauuuguagcgaagccacaacgcacgcuuccuaccucaauaacgggucuaauaccgccagcucccaugagcagacaaccagccacucuaugggauccccuuuucugcuggccggccuuaucgggggagcuguuaucuucgugcucgucgugcugcugagcguguuuugcuggcauaugcacaagaaaggcagauauacaucucagaaguggaaauacaaccgcggccggagaaaggacgauuauugugaggcggggaccaagaaagacaauuccauucucgaaaugacggagaccagcuuccaaaucguuucucugaacaaugaucagcuucugaagggagacuuucgccuccagcccauuuacacacccaacggcgggaucaauuauaccgauugccacauuccuaacaauaugcgguacugcaacagcuccgucccggaccuggaacauugucacacauga

SEQ ID NO: 69380 - RNA, 1950 nt, Artificial Sequence
  derived and/or modified sequence opt5 from FLRT3__Homo_sapiens__NP_938205
augaucagcgccgcuugguccauuuuccugaucggaaccaagauugggcucuuucuucagguggcgccccuuucugucauggccaaaagcugcccuuccguuuguagaugcgacgcuggauucaucuacuguaacgaucgguuucugacaucuauuccgacgggcauccccgaggacgccaccacacucuaucugcaaaauaaccagaucaauaacgccgggauuccuagcgaucuuaagaaucugcucaaaguggaacgcaucuaccuguaucacaacucccuggacgaguuccccaccaaucucccuaaguacgugaaagaacugcaucuucaggagaacaauauuagaacaaucaccuaugauucucugagcaagauucccuaccucgaggaacugcaccuugacgauaacuccgucagcgcugugucuaucgaggaaggagccuuucgggacuccaauuaucugcgccuccuguuccugagcagaaaccaucucucuacaauuccuuggggccugccgcggaccaucgaggaacuucgccuggaugacaauagaaucuccacgauuagcucucccucccuccaggggcugaccagccuuaagcggcugguucucgauggaaaccugcugaauaaccacggccucggcgacaaaguguuuuucaaccuggucaaucuuacagagcugucccucgugcgcaacucucugaccgcugccccuguuaaucuucccgggacaaaccugagaaagcucuaccugcaagauaaucauaucaaccgggugccucccaaugcguuuagcuaccugcgccagcucuauagacuggacauguccaacaauaaccuuagcaaucugccgcagggaauuuucgacgaucucgacaacaucacccagcugauucugcggaauaacccuugguacugcggcuguaaaaugaaguggguccgcgauuggcuucaaucucuccccgugaaagugaaugucagagggcugaugugccaggccccugagaagguucggggaauggcuaucaaggaccugaacgccgaacucuuugauuguaaagacuccggcaucgugagcacgauucagaucacaaccgcuauucccaacacaguguaucccgcccaggggcaauggccugcgccggucaccaagcagcccgauaucaaaaauccuaagcugaccaaagaccaccagacaacgggaucucccagcagaaagaccauuacaaucaccgugaaauccguuacaucugauaccauccacauuagcuggaagcuggcccugccuaugacggcucuccgccuguccuggcugaaacuuggccauagccccgccuucggcucuaucacagagaccauugugaccggggaacgguccgaguaccucgucacagcucuggaaccggacagcccuuauaaggugugcaugguucccauggagaccucuaaccuguaccucuuugaugagacaccuguguguaucgaaacggagaccgcuccccugagaauguauaauccuacaaccacacuuaaccgcgaacaagagaaggaacccuacaaaaauccgaaccugccucucgccgccauuaucggaggcgcggucgcccuggugaccauugcucugcuugcccucgucugcugguacgugcaccggaaugggucccuguucagcagaaacugugccuauuccaagggacgccggagaaaagacgacuacgcugaggccggcacgaagaaggauaauucuauccuggagauccgcgaaaccagcuuccagaugcuccccauuuccaacgagcccaucucuaaagaagaguuuguuauucauacaaucuucccuccgaaugggaugaaccuguauaagaauaaccacagcgaauccagcucuaaucgguccuacagagacagcggcauucccgauucugaccacucccauagcuga

SEQ ID NO: 69381 - RNA, 2064 nt, Artificial Sequence
  derived and/or modified sequence opt5 from FLT1__Homo_sapiens__NP_001153392
auggugagcuacugggacaccggcguccugcucugcgcccugcuuuccugucugcuccugacagggucuagcuccggaucuaaacuuaaagaucccgagcugagccucaagggcacgcagcacaucaugcaagcugggcagacccugcaucugcagugcagaggagaagccgcgcacaaauggucccucccugagaugguuucuaaggaaagcgagcggcuguccauuacaaaaagcgcuuguggccgcaacgggaagcaguucugcucuacccuuacacugaauaccgcccaagccaaccauacaggauuuuauuccuguaaguaccucgcugugccgaccagcaaaaagaaagaaacggagucugccaucuauauuuucaucuccgacaccggcagacccuuuguggagauguacagcgaaauuccugagaucauccacaugacagaaggccgggagcuggucauucccugccgcgugaccucuccuaauaucacaguuacccuuaagaaauucccccuggauacgcucauuccugacgggaagagaaucauuugggauucccggaagggauuuaucauuagcaacgcuacauauaaagagaucggccugcugaccugugaagccacagugaaugggcaucucuacaagaccaacuaucugacccaccgccagacaaauacgaucauugacguccagaucuccaccccgagacccgugaaacuucugcggggacacacacucguucugaacugcaccgcgacaaccccucuuaauacgcgcgugcagaugacauggucuuaccccgaugagaagaacaaaagagccagcguccggcgcagaauugaccaauccaauagccaugcuaacaucuucuacucugugcugaccauugauaagaugcagaauaaagacaagggccucuauaccugucgggugcgcuccgggccuagcuuuaagucugucaacacaagcguucacaucuacgauaaagccuucaucaccgugaagcauagaaaacaacaggugcuggaaacagucgcuggaaagcgguccuauagacugucuaugaaagugaaggccuuucccagcccggagguuguguggcucaaggacggccugccugcgacggaaaaauccgcccgcuaccuuacccggggcuauagccugauuaucaaggaugucacagaggaggacgcugggaauuacaccauucuccugucuaucaaacaauccaacguguucaagaaccuuacagccacccugauuguuaaugugaaaccccagaucuaugaaaaggcugucagcucuuuuccugaccccgcccucuacccccugggauccagacagauccugacgugcaccgccuacggcauuccucaaccgacaaucaagugguucuggcaccccuguaaccacaaucauagcgaggcucgcugcgauuuuugcuccaacaaugaagagucuuucauucucgacgcggauagcaacauggggaaucggaucgaauccauuacccagagaauggccaucauugagggaaagaacaagauggcuucuacacugguggucgccgacagccgcaucuccggcaucuauauuuguaucgccagcaauaaaguggggaccguuggacggaacauuucuuucuacaucacggaugugccuaauggcuuucacgucaaccuugagaagaugcccacagaaggcgaggaccugaaacucuccugcaccgugaauaaguuccuguauagagauguuacauggauucugcuucgcaccgugaacaaucggaccaugcauuacagcaucucuaagcagaaaauggcuaucacaaaggaacacuccauuacgcucaaccugaccaucaugaacgucagccugcaggacucugggacauaugccuguagagcgcgcaauguguacaccggagaggaaauucuccagaaaaaggagaucacaauucggggcgagcauugcaacaaaaaggcuguguuuagcagaaucuccaaauucaagagcacccggaaugauuguacgacacagucuaacguuaagcacuga

SEQ ID NO: 69382 - RNA, 2982 nt, Artificial Sequence
  derived and/or modified sequence opt5 from FLT3__Homo_sapiens__NP_004110
augcccgcccuggcuagagacggcgggcagcucccucugcuuguggucuucagcgccaugaucuuuggaaccauuacaaaccaagaucugccgguuaucaagugcgugcucauuaaucacaaaaacaaugacuccucugugggcaagagcuccucuuaccccauggucagcgaguccccugaagaucuggggugugcgcuucggccccagucuagcggaacgguguaugaggcugccgccguugaaguggacgucuccgcuagcaucacccuucaggugcucguugaugccccuggcaacauuucuugccuguggguguucaaacauuccagccugaauugucagccccacuuugaccuccaaaaccgcggggucgugucuauggugauccugaagaugacagagacccaggcuggagaauaccuucuguucauccaguccgaggccacaaauuauaccauucucuuuacagucagcaucagaaacacccugcuuuacacgcugcggcgcccuuauuucagaaaaauggagaaucaggaugcgcucguuugcauuucugaauccgugccggagcccaucguggaauggguccugugugacagccaaggcgaguccugcaaggaggaaucuccugccgugguuaagaaagaggaaaaggugcugcaugagcucuuuggcaccgauauucgguguugcgcucgcaacgaacuggggagagaguguacacggcuuuucaccaucgaccugaaucagacaccccagaccacgcucccucagcuguuucuuaaagucggagagccccuguggauucgcugcaaggccgugcacguuaaccauggcuucgggcucacaugggaacuggagaauaaagcucuggaagagggaaacuacuuugaaaugagcaccuauuccacaaauagaaccaugauccggauccucuucgccuuugugagcucugucgcgcgcaacgauaccggcuacuacacauguuccagcucuaagcacccgagccaauccgcccuggugacgauugucgagaagggguucaucaacgcuaccaauucuagcgaggacuaugaaauugaucaguacgaggaguucugcuuuuccgugagauucaaagccuauccucagauccggugcacauggaccuuuagccgcaagucuuuccccugugaacaaaaaggacuugacaacggcuacuccauuagcaaguuuugcaaucacaaacaucagccuggcgaauauaucuuccacgcugagaacgacgaugcccaguuuacaaagauguucacccugaauaucagacggaaaccccagguucucgccgaggcuucugcgucccaagccagcuguuuuuccgacggguacccccugccuucuuggacguggaagaagugcagcgauaaauccccgaacuguacagaagagauuaccgaaggaguguggaauagaaaggcuaaccgcaaagucuucggccagugggugucuagcuccacccuuaauaugagcgaggccaucaagggguuucugguuaaaugcugugccuauaacucucucggaacauccugcgagaccauucugcugaauagccccggcccuuuccccuuuauccaggacaacauuucuuucuacgcuacaaucggggugugucuccuguucaucgucgugcuuacgcugcucauuugccauaaguacaagaaacaguuucgguaugaaucccaacugcagauggugcagguuaccggaagcucugauaaugaguacuucuaugucgacuuuagagaauacgaguaugaucugaagugggaguucccucgcgaaaaccuugaguuuggcaaagugcucggcagcggggccuucggaaaggugaugaaugcgacagcuuacggcaucuccaaaaccggggucagcauucagguggccguuaagaugcugaaggaaaaagccgacucuuccgagcgggaagcucugaugagcgagcucaagaugaugacacaacugggaucccacgaaaacaucgugaaccuucugggcgccuguacccucucugggcccauuuaucugaucuuugaguacugcugcuacggcgaucugcuuaauuaucucagaagcaaacgcgagaaguuccaccggacguggaccgaaauuuuuaaagagcauaacuucuccuuuuacccgacauuccagucucacccuaauagcuccaugcccggaucuagagaaguccagauccauccugacagcgaucagaucuccggccugcacgggaacagcuuucauucugaggacgaaauugaguaugagaaucaaaagcgccuggaagaggaagaggaccucaacgugcugaccuucgaggaucuucuguguuucgcuuaccagguugccaagggaauggaauuucucgaguucaaauccugcgugcaccgggaccuggcggccagaaauguccuggugacacacggcaagguugugaaaaucugugauuuugggcuugcucgcgacauuaugagcgauucuaacuaugucgugcggggaaaugccagacuccccgugaaguggauggcuccugaaucccuguucgagggcaucuacaccauuaaaagcgacgucuggucuuaugggauccugcucugggaaaucuuuucccugggcguuaaccccuacccgggcauuccuguggaugccaauuucuacaagcugauccagaacggauuuaaaauggaccaacccuucuaugcgacggaggagauuuacaucauuaugcagagcugcugggccuuugauucccggaagcgccccagcuucccuaaucugacaucuuuucucgggugucagcuggcugacgccgaagaggcuauguaucagaacguggauggaagagucagcgaaugcccgcauaccuaccaaaaucggagacccuucucccgcgagauggaccugggccuucucucuccucaggcccagguggaagauagcuga

SEQ ID NO: 69383 - RNA, 708 nt, Artificial Sequence
  derived and/or modified sequence opt5 from FLT3LG__Homo_sapiens__NP_001450
augaccgugcuggcccccgcuuggagcccuaccacguaccuccugcuucugcuccugcuuuccucuggccugagcgggacccaggacugcuccuuccaacacucuccgaucagcuccgauuuugccgucaagauuagagagcucucugacuaucugcugcaggauuaccccguuacaguggcgagcaaccuccaggacgaggaacuguguggaggccuuuggcggcuggugcucgcucagcgcuggauggaaagacugaaaaccgucgccggguccaagaugcaaggacuucuggagcgggugaauacagaaauccauuucguuaccaaaugcgccuuucagccucccccuagcugucuccgcuucgugcagacaaacauuucuagacugcugcaggagaccuccgagcaacucgucgcucugaagcccuggaucacgcggcagaauuuuagccgcugccuugaacugcagugucagccugauucuuccacccucccgcccccuuggagccccagaccucuggaggccacagcucccaccgccccgcaaccuccccuucugcuccugcugcuccugccugugggccuucugcuccuggcggccgcuuggugccuucacuggcagcggacacgcagacggacaccccgccccggggaacagguuccuccggugcccucuccucaagaccugcuccuggucgagcauuga

SEQ ID NO: 69384 - RNA, 3897 nt, Artificial Sequence
  derived and/or modified sequence opt5 from FLT4__Homo_sapiens__NP_002011
augcagagaggcgccgcucugugccuccggcuguggcuuugucuggggcuccuggacggacuugugagcggcuacuccaugacacccccuacccugaacaucacggaggaaucucacgucauugauaccggggacagccucuccaucucuugccgcggacaacauccgcuggagugggccuggcccggcgcgcaggaagcuccugccacaggggauaaggacagcgaggauaccggaguugugagagacugugaaggcacagaugcccggcccuauugcaaagugcugcuccugcacgagguccaugcuaaugacaccggcuccuacguguguuauuacaaguauauuaaagcccgcaucgaggggacaaccgcugccucuagcuacguuuucgugagagauuuugaacagccuuucauuaacaagcccgacacgcuucuggucaaucggaaagaugcgaugugggugccuugccucguuuccaucccgggacugaacgugacccuucgcagccagucuuccguccuguggcccgacggccaagagguggugugggaugacagacgggggaugcucgucagcacaccucugcugcacgacgcccucuaucugcagugugaaaccacauggggagaucaggacuuucuuucuaaucccuuccugguucauaucaccggcaacgagcucuacgauauucagcugcuuccucgcaagucccuggagcuccuggugggggaaaagcuggugcucaauugcacggucugggcugaguuuaacagcggagugacauucgacugggauuaccccggcaaacaagccgaaagaggcaaguggguuccggagcggcgcucucagcagacccacacagaacuguccagcauccuuaccauucacaaugugucccagcaugaccuggggucuuaugucuguaaagcuaacaauggaauccaaagauuucgggagagcaccgaggugauuguucacgaaaacccuuucaucuccguggaguggcucaagggccccauucuggaagccacagcgggggaugagcuugucaaacugccugugaagcucgccgcuuacccuccgcccgaauuucagugguauaaggacggaaaagcccugagcggccgccauucuccccacgcucugguccucaaggaggugacggaggccuccaccgggacauacacccuggcccuuuggaauagcgcugcgggacugagacggaacaucucucucgaacugguugugaaugugcccccucagauccacgagaaagaagccagcucccccucuauuuauagcagacauucccgccaagcucugacaugcaccgccuacggcgucccucuuccccucagcauccaguggcacuggcggccguggacgccuuguaagauguucgcccagagaucucugcgccggagacagcaacaggaucugaugccccagugccgcgacuggcgggcuguuacaacccaggaugccgugaacccuauugagucccucgacaccuggacagaauuugucgagggcaaaaacaagaccgugagcaaacuggugauccaaaaugcgaacguuucugcuauguauaagugcgucguguccaauaagguggggcaggacgagagacuuauuuacuucuacgucacaacgauccccgauggauuuaccaucgaaagcaaaccuuccgaggaacugcucgagggccagcccgugcugcugucuugucaggccgacagcuauaaguacgagcaucuucgcugguaucggcucaaccuguccacacugcacgaugcccaugggaauccgcuccugcuugacugcaaaaacguucaccuguucgcuaccccucucgccgcuucucuggaagagguggcccccggagcgagacacgccacacugagccuuuccauuccccgcgucgcuccugaacaugagggccacuacgugugugaaguucaagaucggagaagccaugacaagcacugccacaaaaaguaucucucugugcaggcccuggaggcuccgcggcugacccagaaucucacggaucugcuugucaacguguccgacagccuggagaugcagugucucguugccggggcgcaugcccccucuaucgugugguacaaggaugaacgccugcuggaggaaaaauccggcgucgaccuugcugauagcaaucaaaagcucucuauucagagagugcgggaggaagacgccggaagauaucugugcagcguguguaacgcuaaaggcugcgucaauuccagcgccucuguugccguggagggguccgaggauaagggaagcauggaaaucgugauucuggucggcaccggggugaucgcuguuuucuuuugggugcuccugcuucugaucuucuguaacaugcgccggccugcgcacgccgacauuaaaacaggauaccucuccaucauuauggaccccggcgaggucccucuggaggaacagugcgaauaccugucuuaugaugcuagccaaugggaguuucccagagagcgccuucaucuggggagagugcucggcuacggagccuucggcaagguuguggaagccuccgcuuuugggauccacaagggaucuagcugugacaccgucgccgugaaaaugcugaaggagggcgcgacagcuuccgaacaucgggcccucaugucugagcugaaaauucuuauccacauugggaaucaccugaacguugugaaucuccugggagccugcaccaagccucagggcccccugauggucaucguggaguucugcaaauaugggaaccuuagcaacuuucugcgcgcuaagagagaugccuucuccccgugugcggaaaagagcccugagcagcggggccgcuuuagagcuaugguggaacucgcccggcuggaccgcagacggcccggaucuuccgaucgcguccucuucgccagauuuagcaaaacggagggcggggcucggagagccucuccugaccaggaagcugaggaucuguggcuuagcccccugacaauggaggaccucguuugcuacuccuuccaaguggcccgcggaauggaauuucuggcgucucggaaguguauccauagagaucuggccgcucgcaauauucuucuguccgagagcgacguggucaaaaucugcgauuucggccucgcccgggacauuuauaaggauccggacuacgugagaaaaggguccgcucgccugccucucaaguggauggcccccgaaagcaucuucgacaaaguuuauaccacacagucugauguguggagcuuuggaguccugcuuugggagauuuucucccugggcgccucuccuuaccccggggugcagaucaacgaagaguuuugucagcggcugagagacggcacccgcaugcgggcucccgagcucgcgaccccugccaucagacggauuaugcugaauugcuggagcggagauccgaaggcucgccccgccuucuccgaacuuguugagauccugggcgaccuccugcaagggagaggacuccaggaagaggaagagguguguauggccccucggucuagccaguccucugaggaaggcagcuuuucccaggucagcacaauggcucugcacauugcccaagcggaugcugaggacucucccccuucccuucagcgccauagccuggccgccagauacuauaacugggugucuuuccccgggugccuggcucggggagccgaaacgagaggcuccagccgcaugaagaccuuugaggaguucccuaugacaccgaccacauacaaaggcuccgucgauaaucagaccgacucugggauggugcucgcgagcgaagaguuugaacaaaucgagucccggcacagacaggaaagcggauuccgcuga

SEQ ID NO: 69385 - RNA, 1668 nt, Artificial Sequence
  derived and/or modified sequence opt5 from FLVCR1__Homo_sapiens__NP_054772
auggccagacccgacgaugaggaaggcgcugccguggcgccugggcacccgcuggcuaagggauaccucccccugccucggggcgcccccgucgggaaagagagcguugaacuucagaacggaccuaaggccggcaccuuccccgugaauggggcuccucgcgacucccuggccgcugccucuggagugcucggcggcccgcaaacaccccuggcgccugaggaagagacgcaggccagacuucugcccgcuggggccggagcugagaccccuggcgccgaaagcucuccccucccgcugacagcgcuguccccucggcgcuuugucgugcuccugaucuucagccuuuauucccugguuaacgccuuucaguggauucaguacucuaucauuagcaauguguucgagggguuuuauggagucacccuccugcauaucgauuggcuuuccaugguguacaugcuggcuuauguuccccucauuuucccugccacauggcugcuggacaccagaggccuccggcugacagcccuucuggggagcggacucaacugccugggcgcuuggaucaaauguggcucugugcaacagcaccuguuuugggucaccaugcuggggcagugccucuguuccguggcccagguguucauccugggacugcccagccgcauugcuucugucugguuuggccccaaggaaguuuccacggcgugcgccaccgcugugcucgggaaucaacugggaacagccgugggcuuccuucugccuccgguccucgugcccaacacccagaaugauacaaaccugcuugccuguaauaucagcaccauguuuuacgggacgucugcuguugccacacuucucuucauucugaccgcgaucgcuuuuaaagagaagccuagauaucccccuucccaggcccaggccgcucugcaagacagcccgcccgaggaauacuccuacaagaaaucuauucggaaccucuucaagaauaucccuuucgugcugcuucugauuacauauggaaucaugaccggcgccuuuuacagcgucuccacccuccugaaccagaugauccugacauauuacgagggcgaagaggugaaugcugggcgcauuggacuuacgcucguuguggccggcauggucgggagcauccugugcggacuguggcucgauuauaccaaaacauacaagcagaccacacugauuguguauauccuuucuuucauuggcauggucaucuuuaccuucacgcuggaccucagauacaucauuaucguguuuguuacagggggcgugcugggauucuuuaugaccggcuaccugccccuuggguucgaauuugcggucgagauuaccuauccugaguccgaaggaacaagcucuggccuccugaacgccagcgcucaaaucuucgggauucuguuuacccucgcccagggaaaacugacauccgauuacggccccaaggcugggaauaucuuccuuuguguguggauguuuaucggcauuauccugacggcccucauuaagucugaccugcggcgccauaacaucaacauuggaaucaccaauguugaugugaaagcgauuccugccgacagccccacagaucaggagccgaagaccgucaugcuguccaaacagagcgaaucugcuaucuga

SEQ ID NO: 69386 - RNA, 966 nt, Artificial Sequence
  derived and/or modified sequence opt5 from FLVCR2__Homo_sapiens__NP_001182212
augagcgccgacaacuccucuaccaucugcguguguagaagcguccggcaggagcugggcauugcuaucggguuccucguucccccugugcuggugccgaauauugaagaucgcgacgagcuugccuaccacaucuccauuauguuuuauaucaucggaggcgucgcgacacugcuccugauucuugugaucauuguuuucaaggaaaaacccaaguacccucccucuagagcucaaagccuguccuaugcccucacgucuccugaugccagcuaccugggguccaucgcucggcuguuuaaaaaccucaauuucgugcugcuugucauuaccuauggacugaacgccggcgcuuuuuacgcccucagcacacugcuuaaucgcauggugaucuggcauuaucccggggaggaaguuaacgcgggaagaauuggccugaccaucgugaucgccggcaugcucggggcugucauuucuggaaucuggcuggaccgguccaagacauacaaagagaccacacuggugguguacauuaugacccucgucggcaugguuguguauacguucacccugaaucuugggcaccuguggguggucuuuaucacagccggaaccaugggcuucuuuaugacaggguaccucccucugggauucgaguuugcuguggaacuuaccuauccggagagcgaaggcauuucuuccggccugcucaacaucagcgcccagguuuucgggaucauuuuuacgaucucucagggacagauuaucgauaauuacggcacaaagcccgggaacauuuuccugugcguguuccugacccucggagcggcccugacagcuuuuaucaaggccgaccuucgcagacaaaaagcuaauaaggagacccuggagaacaaacuccaggaagaggaagaggaauccaauaccagcaaggucccuacagccguguccgaggaucaucuguga

SEQ ID NO: 69387 - RNA, 3591 nt, Artificial Sequence
  derived and/or modified sequence opt5 from FMN1__Homo_sapiens__NP_001096654
auggagaacguggacaauagccuggauggcuccgacgucucugaacccgccaagccugaggcugggcucgaaguugcccagagcauccuguccaaauucucuaugaaaagccuuuuuggauucaccuccaaacuggagucugugaacccggaagaggaggaugcggugcucaaggcuuuucacagccuggacgucaaucccacaucccaacaggaugacagcucuaacggccuugauccucaggaagccggguccagagugagccccgaccugggaaaugaugagaaaauugccucuguugaaacggaguccgagggcagccagcggaaggaagcugggaccucucuccuggcccaagagcugcucccucuguccacacuuaagggaaccaaagacgaugugaucugcguccgcggcacacuggugcauaccacaagcgacuccgauucugacgacggcgggcaggaacccgaggaaggaagcuccaccaacggcccuaagagcccgucugggguucucuccgagcccagccaggagucuaaagaaaauccuggaggcuucagagagaacacggugaccggggaaaugaauggagcugagcugugugccgaagauccccagcggauuccucccgagaugagcuccaagcuggaggcgggcaacggcgggcugcaaacagaacgcagaccgucucaggaccaggucggagaggaaggcagccaggaucucccugccgugaccaaucaaaacuccagcguggggaucacagagucugcuuccagcaaaaaggaagucucuggagagaaguccuuucagcugcccgccuucuuuagcggccugcggguucucaaaaagggggcuaccgccgagggaggcgaaacgauuacagagaucaaaccuaaggacggcgaucuggcgcuucugaaacucacccagcccgugcaaaagucccuggugcaggccgggcuucagacagucaaaucugaaaagaaggcuaccgaccccaaagccaccccuacacugcucgagcagcugagccugcuccugaauaucgauaugccgaagacggagcccaaaggagcugacccugaaucuccccgcagagaggaaaugggcugcaacgccgaucaagagucccagagcgggccuggagugccccagacccagggcggggaaguuaagccgaaauccccugagacagcccuugaggcuuucaaggcgcuuuuuauucggcccccucgcaagggcaccacagccgacaccagcgaacucgaggcucugaagagaaagaugcggcacgaaaaagagucucuucgcgccguguucgaaagauccaauagcaagcccgccgauggaccuucugacuccaaaagccccgaccauucucugacggagcaagaugaccggacaccgggccgccuccaggcugucuggccuccucccaagaccaaggauaccgaggaaaaaguggggcugaaguacacagaggccgaauaucaggcggcuauccugcaccucaaaagagagcauaaggaagagauugagaaccugcaggcccaauuugaacuucgggccuuccacaucagaggagagcacgcuaugauuaccgcccgccuggaagagacaaucgagaaccucaaacaugaacuggagcaccgguggagaggcgggugugaagagagaaaggacguuugcauuagcacggaugacgauugucccccgaagaccuuucggaaugugugcguccagacagacagagaaaccuuccugaaacccugugaguccgagagcaagacaacccgcucuaaccagcuugugccuaaaaagcucaauaucuccagccugucccagcugucucccccuaacgaucauaaagacauccacgcugcccuccaacccauggaaggaauggcgagcaaucagcagaaggcccugccucccccgccugcuuccauucccccucccccgccucuucccucuggccuggggagccucuccccugccccucccaugcccccggucucugcuggcccuccccugcccccucccccuccgcccccucccccucugcccccgccuagcuccgccggacccccucccccucccccgcccccuccccuuccuaacagccccgcgccgccuaaucccggcgggccucccccugccccgcccccucccggacucgcucccccuccgcccccuggccuguucuuugggcugggaucuuccagcucucaaugcccccggaaaccugccaucgagcccuccuguccuaugaagccgcucuacuggacgcgcauucagaucagcgaucgcucucagaacgcuacccccacacugugggacucccuugaggagccugauauucgggaccccagcgaauuugaguaucuguucuccaaggacaccacacagcagaaaaagaaaccucucagcgagaccuacgaaaagaaaaauaaggugaagaaaaucaucaagcugcuggauggcaaaagaucucaaacgguugggauucuuaucagcucccuccaccuggagaugaaggacauucagcaggccaucuucaacguggaugacucugucguggaucuggaaacacucgccgcucuguaugagaaucgcgcgcaagaagacgagcuuguuaaaauucggaaguacuaugagaccagcaaggaagaggaacugaaacuccuggauaagcccgagcaguuucugcaugagcuugcccagaucccgaacuucgcugaaagagcccagugcaucauuuuucgguccguguucucugagggcaucacaagccuccaccgcaaagucgaaauuaucaccagagccuccaaggaccugcugcaugugaaaucugugaaggauauucucgcucugauccuugccuuuggaaauuacaugaacggcgggaaucggaccagaggacaagcggacggcuacagccuggagauucucccuaagcugaaagauguuaagucccgcgacaacgggaucaaccuggucgauuauguggugaaauacuaucuucgguacuaugaccaggaagcuggaacagaaaagagcgucuucccccugcccgagccucaggacuuuuuccucgccucucaagugaaauuugaagaucugaucaaggaccucagaaaacugaagcgccagcuugaggccuccgaaaagcagaugguuguggucuguaaagagagccccaaggaauaccugcagccuuucaaagauaagcucgaggaguucuuucaaaaagcuaagaaggaacacaaaauggaggaaucucaucuggagaaugcccagaaguccuucgaaacgaccgugagauauuuuggcaugaaacccaagagcggggagaaagagauuacaccguccuacguuuucauggugugguacgaauuuugcucugacuucaagaccaucuggaagcgggagagcaaaaacauuuccaaggaacgccugaaaauggcgcaggagagcgucucuaaacuuacauccgagaagaagguggaaaccaagaaaaucaauccuacggcuagccugaaggagagacuccggcagaaagaagccucuguuacaaccaacuga

SEQ ID NO: 69388 - RNA, 5169 nt, Artificial Sequence
  derived and/or modified sequence opt5 from FMN2__Homo_sapiens__NP_064450
augggaaaccaggacgggaagcugaaaagaagcgcuggagaugcucuccacgagggcgggggaggcgccgaagacgcgcuggggccccgggauguggaggcuaccaagaaaggauccggcggcaagaaagcccuugggaagcauggaaagggcgggggaggcgggggaggcggcggggaaucuggcaagaagaaaagcaaauccgacucucgcgccagcgucuucuccaaucugagaauccggaaaaaccucucuaagggcaagggggcuggaggcagccgcgaggauguucuggacucccaggcccuucagaccggggaacuggauagcgcucacucucuccugacgaaaaccccugaccugucccucagcgccgaugaggcgggacugucugacacagagugcgccgaucccuuugaagugaccggccccggcgggccuggacccgcugaggccagagugggcgggcggccuauugcugaagacgucgagacagccgcgggagcccaggauggccagcgcaccuccagcgggucugacacagacaucuacuccuuccauagcgcuaccgagcaagaagaucuucuguccgacauucagcaggccaucagacuccagcaacagcagcagcaacagcugcagcuucaacugcagcagcagcaacagcagcagcaacuccagggcgcugaggaacccgccgccccucccacggcugugucuccccagccuggagcguuucugggccuggaucgguuccuccuggggcccagcggaggcgccggggaggcuccuggaucccccgacaccgaacaggcccuuagcgcccugucugaucuccccgagucccuggcugccgagccucgcgaaccccaacagccucccagccccggcgggcuuccuguuucugaggcgccgagccugcccgcugcccagccugccgcuaaggacucccccucuagcacagccuuuccuuuccccgaagcuggcccgggagaggaagccgcgggcgccccugugagaggggcuggagauaccgacgaggagggcgaagaggaugccuuugaagacgcuccccggggguccccuggagaggaaugggcccccgaggucggcgaggaugcgccucagcgccucggggaagaacccgaagaggaggcccaaggcccggacgcuccugccgcugccagccugcccggaucucccgccccuucccagagauguuucaaaccguauccccugauuacaccuugcuauaucaagaccacgacacggcagcucagcucucccaaucacuccccuagccaaucccccaaccagucuccucgcaucaaaagacggcccgaaccgagccuguccagaggcucucgcaccgcucuugcgagcguggccgcuccugccaagaaacaucgggccgacgggggacuggcugccggccucuccagaagcgcggauuggacagaggaacugggggcucgcacaccccggguuggaggcucugcccaccuucuggagagagggguggccuccgacagcggcggaggcgucucuccugcucucgccgcgaaggcuuccggggcccccgccgcugccgauggauuucagaauguguucaccggccgcacacugcuggaaaagcucuuuagccagcaagagaacgggccgccugaggaagcugagaaauucuguucucggauuaucgccaugggacugcuucugcccuuuagcgacugcuucagagaaccuuguaaucagaacgcgcagacgaaugccgcuuccuucgaucaggaccaacucuauaccugggccgcugugagccagcccacacacucucuggauuacuccgagggccaguuuccccgccgggucccuagcaugggcccgcccuccaagccucccgacgaggaacauagacuggaggaugccgaaaccgagucucagagcgccguuuccgaaacaccucaaaaacgcucugacgcugugcagaaggagguggucgauaugaaaagcgaagggcaggcgaccgugauucaacagcuugagcagacgaucgaggaccuccggacaaagauugccgaacuggagagacaguaucccgcucuggauaccgaaguugccuccggacaccaaggccucgagaacggggugaccgccucuggagacgucugccuggaggcccuucggcuggaagagaaggaagugcgccaucacagaauccucgaggccaaaagcauucagacauccccuaccgaagagggcgggguucugacacugccgcccguggacggacuuccuggccggcccccuugucccccgggcgcggagagcgggccucagacgaaguucugcucugaaaucucccucaucgucagccccagacgcauuucugugcagcuggauucccaccaacccacccagagcaucucucagccucccccuccgcccucccugcucuggagcgcuggacagggccaaccugggucccagcccccucauagcauuucuacagaguuucagaccagccacgaacauuccgucucuagcgccuucaaaaauuccuguaacauccccucuccgccuccccugccuugcacagagagcuccucuagcaugcccggacuuggcauggugccucccccgccuccgccccucccugggaugaccguuccgacgcuccccuccaccgccauuccucagcccccuccccugcaaggaacagaaaugcugccuccgcccccucccccucuucccggcgcuggcaucccgccuccgcccccucuccccggggccggaauccugccucugccgccccucccuggcgcggggauucccccucccccgccucugcccggagcugccaucccucccccucccccgcuuccuggcgccgggauuccccugcccccuccgcuccccggagcuggcaucccucccccucccccucugcccggcgccgggauuccgccucccccuccccugccgggagcuggcaucccuccgcccccuccccuuccuggggccggaaucccgcccccucccccucuccccggcgcggggauuccuccgcccccuccccugccuggagccggcauucccccucccccgccccugccuggcgcugggaucccucccccgcccccucuccccggagccggcaucccucccccgccuccccugccuggggcuggaaucccgcccccuccgccccuuccuggcgccgggauucccccuccgcccccucugcccggagccggcauuccucccccuccgccccucccuggcgcugggauucccccucccccgccucugcccggagugggcauucccccucccccuccgcugcccggggcgggaaucccucccccucccccgcuuccuggcgccgggauucccccucccccuccccugccgggagcuggcauucccccucccccuccgcucccccgggucggcaucccucccccucccccucugcccggggccggcauucccccucccccuccccucccgggagccgggaucccuccgcccccuccccugccuggagugggcaucccgcccccucccccucuucccgggguuggcaucccgccucccccuccccugccuggagcuggcauucccccuccuccuccccuccccgggaugggcauuccgcccgcccccgcgcccccucugcccccucccggaaccgggaucccgccucccccucugcuucccgugagcggaccgccucugcucccccaggucggaucuuccacacugcccaccccucagguguguggguuucugcccccuccgcugcccagcggccuuuucggacugggcaugaaucaagacaaggggucuagaaaacagccuaucgagcccugccgcccuaugaagccccucuacuggacgagaauccagcugcacuccaagcgggauagcuccacaucucugaucugggagaaaaucgaggaaccuagcaucgacugccaugaauuugaggaacuuuucuccaagaccgcugugaaagagcgcaagaaaccgauuagcgauacaaucucuaagaccaaggccaaacagguugucaagcugcucuccaacaaaagaagccaagccgugggcauucugaugucuagccuccaccuggacaugaaggauauccagcacgcuguggucaaucuugacaacuccgugguugaucuggagacccugcaggcccucuaugaaaaccgggcgcagucugacgagcuggagaaaaucgagaagcauggccgcagcuccaaagauaaggagaaugccaagucucuugacaaacccgaacaauuucuguacgagcucagccugauuccuaacuucuccgaaagaguguuuuguauccucuuccagagcacauuuucugaguccauuugcagcauccggcgcaagcuggaacuucugcagaaacugugugagacgcucaagaaugggcccggagucaugcaagugcugggccuuguucuggcuuucgggaacuacaugaauggcggaaacaaaaccagaggccaagccgauggguucggacucgacauucugccuaagcucaaggacgugaaauccucugauaauagccggucccugcuuucuuauaucgucagcuacuaucugcgcaacuuugacgaggaugcuggcaaggaacagugccuguucccccucccggagccccaggaccuguuucaagccucccagaugaaauucgaagauuuucagaaggaccuuagaaaacugaagaaggaucucaaggcuugugagguggaagccgggaagguuuaccaggugagcucuaaagagcacaugcaaccuuucaaggagaauauggaacaguuuauuauccaggcgaaaaucgaccaggaggccgaagagaacucccugacagaaacccauaagugcuuccucgagacaaccgcuuacuuuuucaugaagcccaaacugggagagaaggaagucagcccuaaugccuuuuucucuauuuggcacgaguuuuccagcgauuucaaagacuucuggaagaaagaaaacaaacuucugcugcaagagcgggugaaagaggcugaagagguguguagacagaagaagggcaaaucucucuacaagaucaaaccccgccacgauagcggcauuaaggccaaaaucuccaugaagacguga

SEQ ID NO: 69389 - RNA, 3303 nt, Artificial Sequence
  derived and/or modified sequence opt5 from FMNL1__Homo_sapiens__NP_005883
augggcaacgccgcugggagcgccgagcagcccgcgggaccugcugccccgcccccuaagcaacccgccccucccaaacagccuaugccggcugccggcgaacuggaggaaagauucaaucgggcucucaacugcaugaaucugcccccugacaaggugcagcuucugucccaguacgauaacgagaaaaagugggaacucaucugugaccaagagcgcuuucaggucaaaaaucccccugccgcguauauucagaagcugaagucuuacguugauaccgggggagugagcagaaaaguggccgcugacuggauguccaaccuuggcuucaagcggcgcguccaggagucuacacaagugcugagagaacucgagacgagccugcggaccaaucacaucggguggguucaggaauuucugaacgaggagaaucgcggacucgaugugcugcuugaauaucuggccuucgcucagugcuccgucacauacgacauggagucuaccgauaacggcgccagcaauuccgagaaaaacaagccccucgaacagagcguggaagaccugucuaaaggcccgccuuccagcguucccaagucuagacaucuuacaauuaagcugaccccugcgcacucccggaaagcccuccgcaauagcagaaucgugucucaaaaggaugacguccauguguguauuaugugccugcgggcuaucaugaacuaucaguccggguuuagccuggugaugaaucaccccgccugugucaacgagaucgcucucucccugaacaauaaaaacccccgcacaaaggcccuuguucuggagcuccuggccgcugugugccuugugagaggaggccaugauauuauccuggcggccuucgacaauuuuaaagaagucuguggggagcagcaccgguucgaaaagcucauggaguacuuucgcaacgaagauucuaauauugacuucaugguggcuugcaugcaauuuaucaacauuguugugcacagcgucgagaauaugaacuucagaguguuucugcaguaugaguucacccaucugggacucgaccuguaccuugaacggcugagacucacggaguccgauaaacugcagguucagauccaagccuaccuugacaauauuuucgaugugggcgcccugcucgaagacaccgagacaaagaacgcuguccuggaacacauggaggagcugcaggaacagguggcccuccugaccgagcgccuucgggaugcggaaaaugagagcauggcuaagaucgccgagcuggaaaaacagcucucucaagccagaaaggagcuggaaacacugcgcgagcgguuuuccgaaagcaccgcuaugggggccucuagacgcccuccggagcccgagaaagcuccucccgccgcgccuacgcggcccagcgcccuugaacucaaggucgaggaacuggaggaaaaaggacugauccgcauucucagaggcccgggcgacgcuguguccaucgagauucugccuguugccguggcuacacccucugggggagaugccccuacccccggcgucccuacagggagccccuccccggaccuugcgccugccgcugagcccgcccccggagcugccccuccgcccccucccccucugcccggccucccuagcccccaggaagccccgccuucugcucccccucaggcgcccccgcugccugggucccccgagccuccucccgcucccccgcugcccggagaucuuccucccccucccccuccgcccccucccccucccggcaccgacggcccggugccucccccucccccucccccgcccccucccccugggggacccccggaugcccucggccggagagacagcgaacuggggccuggaguuaaggccaagaaacccauccagaccaaguuccgcaugccucugcucaacuggguggcccugaaacccucucaaauuacaggcacggucuuuaccgagcuuaaugacgaaaaggugcugcaggagcucgauauguccgacuucgaggaacaguuuaaaacaaagagccaggggccuucccuggaucugucugcucuuaagagcaaagccgcgcaaaaggcucccuccaaagccacccucaucgaggccaaccgggcuaagaaucuggccaucacacugagaaaaggcaaccucggagcggaacggauuugucaggcuaucgaggccuaugaccugcaggcccuuggccuggauuuccucgagcugcugaugcgcuuucuuccgaccgaauacgagagaucucucauuacgcgguucgaaagagagcaacgcccuauggaggaacugagcgaggaagaccgguuuaugcugugcuucuccagaaucccccgccuccccgagagaaugacaacccugaccuuucuugggaacuucccugauacagcucagcugcucaugccgcagcugaaugccauuaucgcugccagcaugucuaucaaguccagcgacaagcugcggcagauucuugaaaucgugcuggcguuuggaaacuauaugaacucuuccaaacgcggcgccgcuuacggguucagacuccaaagccuggaugcccuccuggagaugaagucuaccgaccggaaacagacacuucugcauuaucucguuaaggucauugcugaaaaauacccccagcugacgggauuccacagcgaucugcacuuucuugacaaggccggcuccgugagccuggauucugugcucgccgacguccgcucccugcagagagggcucgagcugacccaacgggaguucgugcgccaggacgauuguaugguucuuaaagaauuucugagagcuaauagcccuacaauggacaagcuccuggcggauuccaagaccgcccaggaggcuuucgaaucuguggucgaguauuuuggcgaaaaucccaaaacaaccagcccuggacuguucuuuucccuuuucucucgguuuaucaaggccuacaaaaaggccgagcaggagguggaacaauggaaaaaggaggcugccgcgcaggaagcuggcgccgacacgcccgggaagggagagccuccggcccccaaaagcccucccaaggcucgcagaccucagauggaucugauuuccgagcucaaacggagacaacagaaggaaccccugaucuacgagucugaccgcgauggcgccauugaagacaucaucaccguuauuaaaacagugccguucaccgcgcggacagggaagagaaccagccgccuccugugcgaggcuucccuuggagaagagaugccucuguga

SEQ ID NO: 69390 - RNA, 3279 nt, Artificial Sequence
  derived and/or modified sequence opt5 from FMNL2__Homo_sapiens__NP_443137
augggcaacgccgggagcauggacucccagcaaaccgauuucagagcucacaaugugccccugaagcucccuaugccggagcccggagaacuggaggaacgguuugccaucguccuuaacgcgaugaaucugccucccgacaaagcucgccuccugagacaguacgauaacgagaagaaaugggaacuuauuugcgaccaggagcgguuccagguuaagaauccuccccauacauauauccaaaaacugaagggcuaccucgauccugccgugacgcgcaagaaauuuagacggcgcgugcaggagucuacccagguccugagagaacuggagauuagccuccggacaaaccacaucgggugggugcgcgaguuccugaaugaagagaacaagggacuugacguucugguggaauaucucuccuuugcccaguacgcugucaccuucgauuuugagucuguggaaagcacaguugaguccucuguggacaaaagcaagccgugguccagaagcauugaagaucugcaucggggcucuaaucuucccuccccugucgggaacagcgugucucgcuccggaagacacagcgcccugcgguauaauacccuccccucucgcagaacacugaaaaacucccggcuggugagcaagaaggacgauguccauguuuguaucaugugccucagagcuaucaugaauuaccaauauggcuucaacauggugaugucccacccucacgccgugaaugagauugcgcugucucuuaacaacaaaaauccccgcaccaaggcccugguccucgagcugcuugcugccgugugucugguucggggcgggcaugaaaucauucucagcgcuuuugacaacuucaaagaggugugcggagaaaagcagagauuugagaaacugauggaacacuuccgcaaugaggauaacaauaucgacuuuauggucgccuccaugcaguucauuaacaucgugguucauagcguggaggacaugaauuuccggguccaccuucaguacgaauuuacgaagcucggccuggaugaguaccuugacaaacugaagcacaccgaaucugauaagcuccaagugcagauucaggcguaucuggacaacgucuucgaugugggggcccuucuggaggacgcugaaacgaaaaaugccgcucucgagagaguugaggaacuggaggaaaacaucucccaucugagcgagaagcuccaagauaccgagaaugaagccaugucuaaaaucguggagcuggaaaagcagcuuaugcagcgcaacaaagagcuggacgucgugcgggaaauuuacaaggaugccaauacacagguucacacccucagaaagauggugaaagagaaggaggaagcuauccaacgccagagcacgcuggagaaaaagauucaugaacuggagaaacagggaacaaucaagauucagaagaaaggcgacggggauaucgcgauccuuccggucguggccuccggaacccucucuaugggcagcgaagugguugcuggcaacuccgucgggccuacaaugggagccgccagcucuggcccccugccucccccucccccgccccugccucccuccagcgacaccccugagaccgugcaaaaugggcccgugacaccgccuaugcccccucccccucccccgccucccccucccccgcccccucccccucccccucccccgccuccccucccuggacccgcugccgagacggucccggcgccuccccuggcuccuccccuucccucugccccuccgcugcccggcaccuccagcccuacagugguuuuuaacuccgggcucgccgcugugaagauuaaaaagcccaucaaaaccaaguuccggaugccugucuuuaacuggguggcccugaagcccaaucagauuaacggaacaguuuucaaugaaaucgacgaugagcgcauucuggaagaccuuaacguggaugaguuugaagagaucuucaaaaccaaggcucagggcccugccaucgaccucucuagcuccaaacagaagauuccgcaaaaaggcucuaauaaggucacgcugcuggaggcgaacagagccaaaaaucucgcuaucacacugcggaaggccgggaagaccgcugaugaaauuuguaaagccauccacguguuugaccuuaagacccugcccguugauuucguggagugccucaugagauuucugccuacagaaaacgaggucaaagugcugcggcuuuaugagcgcgaaagaaagccccucgagaaucugagcgacgaagaucgguucaugaugcaguuuuccaaaauugagagacugaugcagaagaugaccaucauggcguucauuggaaacuucgccgaaagcauccagaugcucacaccucaacugcaugcuaucauugccgcuucuguguccaucaagagcucucagaaacuuaagaaaauucuggagaucauucucgcccugggcaauuacaugaacuccagcaagcgcggggccgucuauggauuuaaacugcagucucuugaccuccugcuggauacaaagagcaccgaccggaagcaaacacuccugcacuacaucuccaauguugugaaagagaaguaucaccaggugagccuuuucuacaacgaacugcauuacgucgagaaagcugcggccgugucucucgaaaauguucugcuggaugugaaggagcuucagagaggcauggaccugaccaaacgcgaauauacaaugcacgaccauaacacccuccugaaggaguuuauccucaacaaugaggggaagcugaaaaagcugcaggaugacgcuaaaauugcccaagaugccuucgacgaugucgugaaguacuuuggcgaaaaccccaaaacgaccccgccuuccguuuucuuucccguguucgucagauuugugaaggcuuauaaacaggccgaggaagagaaugaacugcggaagaagcaggagcaggcgcucauggagaaacugcuggaacaagaggcucuuauggaacagcaggaccccaagagcccuucccacaaaucuaagcgccagcaacaggagcugaucgccgagcucagacggcgccagguuaaagauaacagacacguguacgaaggaaaggacggcgccauugaggauaucauuacagaccugcggaaucaacccuaucgcagagcugaugccguccggcgcagcgugagacggagauucgacgaucagaaccuccgcuccgugaauggggcggaaaucaccauguga

SEQ ID NO: 69391 - RNA, 3084 nt, Artificial Sequence
  derived and/or modified sequence opt5 from FMNL3__Homo_sapiens__NP_783863
augggcaaccuggagagcgccgaaggggugcccggagagccuccguccgucccccuccugcuuccucccggcaagaugccuaugcccgaaccuugcgagcuggaagagagauucgcucucguucugucuagcaugaaucuuccgcccgacaaagcccggcugcuccgccaguacgauaacgagaagaaaugggaccugaucugugaucaagaaagauuucaggugaagaauccuccccacaccuauauucagaaacugcaguccuuccucgacccuucugugacacggaagaaguuucgcagacggguccaagagagcacgaaagugcugcgcgaacuugagaucucccugagaaccaaccauauuggguggguucgggaguuccucaaugaugaaaacaagggacuggacgugcuugucgauuaccugucuuuugcgcagugcagcgugauguucgacuuugagggccucgaauccggggaugacggagcuuucgauaaacugcgcagcuggucuagauccaucgaggaccugcagcccccgagcgcccucucugccccuuuuacaaauucccuggcucggagcgcccgccagucuguucuuagauauuccacccugcccggccggcgcgcucucaagaacagcagacuggugucccaaaaagaugacguccacguguguauucuuugccugcgggccaucaugaauuaccaguauggcuucaaccucgugaugucucauccucacgcggucaaugaaaucgcccugagccugaacaauaagaaccccagaacaaaggcucucguucuggagcuucuggccgcugugugucucgugcgcgggggacaugagauuauccuggccgcguuugacaauuucaaagaagucugcaaggagcuucaccgguuugaaaaacugauggaguacuucagaaacgaagauuccaacauugacuucaugguggccuguaugcaguuuaucaauauuguugugcacagcgucgaggauaugaacuuccgcgugcaucuccaguaugaguuuaccaagcugggccuggaagaguuccuccaaaaaucucggcacacagaauccgagaagcugcagguucagauccaagccuaccuugacaauguguuugaugucgggggacugcucgaagacgccgagaccaaaaacguggcucuggagaaggucgaagaacuggaggagcaugugagccaccuuacggagaagcuccuggaucuggaaaaugagaacaugaugagaguugccgaacucgagaaacagcugcuucagcgcgaaaaggagcuggagucuauuaaagaaaccuacgagaauacaagccaccaggugcauacccuccggagacugaucaaggaaaaagaggaagccuuccaacgccggugccaccuggagcccaacgucagaggccuugaguccguggacucugaagcucucgcgcgcguugggccugccgagcugagcgaaggaaugccgcccuccgaucuggaccuccuggcuccugcucccccucccgaggaagugcuuccgcugccucccccucccgccccuccccucccgccucccccucccccgcugcccgauaaguguccucccgcuccuccccugccuggcgccgcgcccagcgucgugcuuacagugggccucucugcuauccggauuaagaaaccgaucaagaccaaauuuagacugccuguuuucaauuggacggcccugaagcccaaccagauuuccgggacagucuuuagcgagcucgacgacgagaaaauccuggaagaucuugaccuggauaaguucgaggaacucuuuaagaccaaagcccagggaccugcucuggaccugauuugcucuaagaauaaaacagcccagaaggcugccuccaaagugacccuucucgaggcgaaccgggccaagaaucuggcuaucacccugcgcaaggccggcagaagcgcugaggaaaucugucgggccauucauacauucgaucuccaaacgcugcccguggacuuugucgagugccuuaugagauuccugccgaccgaagcggaggugaaacuccugcgccaguaugaacgggagagacagccucuggaggaacuugccgcugaggaucgcuucaugcugcucuuuuccaagguugaaagacugacacagcggauggccgggauggcuuuccucggaaacuuucaagacaaucugcagaugcuuacaccccagcugaacgccaucauugccgcuucugcgagcgugaaauccucucagaagcucaaacaaaugcuggagaucauucuggcccuuggcaacuacaugaauagcuccaagcgcggggcugucuauggauucaaacugcagagccucgaucugcuccuggacaccaagucuaccgauagaaagaugacgcuucugcacuuuaucgcccucacagugaaagaaaaguacccugaccuggccaacuucuggcaugagcugcacuuuguugagaaagcugccgcggugucccuugaaaauguccugcucgaugugaaggagcugggccggggcauggaacucauccgcagagagugcagcauucacgacaacucuguucugcggaauuuccuuuccaccaacgaagggaaacuggacaagcugcagcgcgaugcuaagaccgccgaggaggccuauaaugcuguggucagauacuuuggagaaagccccaaaacaacacccccuucuguguucuuuccgguguucguccgguuuauccgcagcuauaaggaggccgaacaagagaacgaggcgcggaaaaagcaggaagagguuaugagagaaaaacagcucgcucaggaggccaagaagcuggacgccaaaacccccucccaaagaaauaaguggcagcagcaggaacuuauugcugagcugcgccggagacaagccaaagagcaucgcccuguguacgaaggcaaggaugggacgaucgaggacauuaucaccggacuccacugucagcccauggugguccggcaucaggcuagaagcgccgcgccucccucuggcccuccgcgcgcccccgggccucacuga

SEQ ID NO: 69392 - RNA, 1611 nt, Artificial Sequence
  derived and/or modified sequence opt5 from FMO1__Homo_sapiens__NP_001269621
augcaggagaacauggccaagagaguggcuaucgucggcgccgggguuagcggacuggcguccauuaaaugcugucucgaagagggccuggaaccuaccugcuucgagcggucugacgaucuugggggacuguggcgcuuuacagaacacguggaggagggcagagcuagccucuacaaguccguggucucuaauagcuguaaagaaauguccugcuauucugacuuccccuuuccggaggauuaccccaacuaugugccuaauagccaauuccuggaauaccuuaagauguaugccaaccauuuugaccugcucaaacacauccaguucaagacgaagguuuguuccgugaccaaaugcagcgauucugccgucuccgggcagugggaggugguuacaaugcaugaggaaaagcaggagagcgcuauuuuugacgccgugauggucuguaccggauuccugacaaaucccuaccugccucucgauucuuuucccggcaucaacgcuuucaaaggccaauauuuucacucccggcaguacaagcauccugacauuuucaaagauaagcgcgugcuggugaucgggaugggaaauagcggcaccgacaucgccgucgaagcgucucaccuugccgagaagguuuuucuguccacaaccgggggaggcugggugauuagcagaaucuucgauuccggguacccgugggacaugguguucaugacgcgguuucagaacaugcuccgcaauucucugcccaccccuauugucacauggcuuauggaaagaaaaaucaacaauuggcugaaccacgcuaauuauggacucauucccgaggaucggacccagcugaaggaguucgugcugaacgacgaacucccuggccgcaucauuacaggcaaaguuuuuaucagacccagcaucaaggaggugaaagaaaauuccgucauuuucaacaacaccagcaaggaggaaccgaucgacauuaucguguuugccacgggguacacauucgcuuuuccuuuccuggaugagucuguugugaaagucgaggacggacaagccucccuuuauaaguacauuuuucccgcgcaucugcagaagccuacccucgccaucaucggccugauuaaaccccuugggagcaugauccccacaggagaaacccaggcucggugggccgugcgcguccugaagggcgugaauaaacucccuccgcccucuguuaugauugaggaaaucaacgcuagaaaggagaauaaaccuagcugguucgggcugugcuauuguaaggcccugcaguccgauuacauuaccuauaucgacgaacuccugacauacaucaacgccaagcccaaucuguuuucuaugcuucucacggauccucaccuggcucuuaccguguucuuuggacccugcagcccguaccaauuccggcugacaggcccuggcaaaugggagggggcgcgcaacgccauuaugacccagugggacagaacauucaaggucaucaaagcucgggugguucaggagucccccagcccuuuugaaucuuuccucaagguguuuuccuuccuggcccugcucgucgccauuuuucugaucuuccuuuga

SEQ ID NO: 69393 - RNA, 1608 nt, Artificial Sequence
  derived and/or modified sequence opt5 from FMO2__Homo_sapiens__NP_001451
auggccaagaaaguggcugucaucggcgccgggguuagcggacugauuucccucaagugcuguguggacgagggccuggaaccuaccugcuucgagagaacagaagauaucgggggaguguggcgguuuaaagagaacgucgaagacggccgcgcgucuauuuaccagagcgugguuacgaauaccuccaaggagaugucuuguuucagcgauuuucccaugccggaggacuuccccaacuuucuucacaauuccaaacugcucgaauauuucagaaucuuugcuaagaaguucgaucugcuuaaauacauucaauuucagacaaccgugcugucuguccggaagugcccugacuucagcuccagcgggcaguggaaagugguuacacagucuaacggaaaggagcaauccgccguguuugaugccgucaugguguguagcggccaucacauccucccccauaucccucugaaaucuuuccccggcauggaacgcuuuaaggggcaguauuuccacuccagacaguacaagcauccugacggauucgagggcaaacggauucuggugaucgggaugggaaauagcggcucugauauugcugucgagcucuccaagaacgccgcucagguuuuuaucagcacccgccacgggacaugggugauguccagaauuucugaagacggauauccgugggauagcguguuccacacccgguuucgcuccaugcugagaaauguccuuccccggacggccgugaaauggaugaucgagcaacagaugaaccgcugguucaaucaugaaaacuacggccuggagccucagaauaaguauauuaugaaagaacccguucucaacgacgaugugccuagcagacugcuuugcggcgcgaucaaggucaaaucuaccgugaaggagcugacagagaccuccgccaucuuugaagacgggacaguugaggaaaauauugacgugaucauuuucgcuaccggauacagcuuuucuuuccccuuucucgaggauagccuggucaagguggaaaacaauauggucucccuguacaaauauaucuucccggcccaccucgacaagucuacgcuggcuuguauuggccuuauccagccucuggggagcaucuuucccacagccgagcuccaagcgcggugggugacccgcguuuucaaaggacugugcucccuuccuagcgagagaacaaugaugauggauauuaucaagcggaacgagaaaagaauugaccuguuuggcgaaucucagucccagacccuccaaaccaacuacguggauuaucuggacgaacuggcccucgagaucggggcuaagcccgauuucuguagccugcuuuucaaggaccccaaacuggccguccgccucuacuuuggaccuugcaauucuuaucaguaccggcuggugggcccgggccagugggaaggggcuagaaacgccauuuucacacagaagcaacgcauccuuaaaccccugaagacgcgggcccucaaagauuccagcaauuuuuccguuucuuuccugcugaagauccucggacugcuugcuguggucguggcguuuuucugucagcugcaguggagcuga

SEQ ID NO: 69394 - RNA, 1599 nt, Artificial Sequence
  derived and/or modified sequence opt5 from FMO3__Homo_sapiens__NP_008825
augggcaagaaaguggccaucauuggggcuggagucagcggccuggccuccaucagaucuugccucgaggaagggcuggagcccaccuguuucgaaaagagcaacgacauuggaggccuuuggaaauuuuccgaucacgcggaggaagggcgggcuucuaucuacaagagcguuuucuccaauucuagcaaagagaugaugugcuuuccugacuucccguuucccgaugacuucccuaacuuuaugcauaauuccaagauucaggaguauaucaucgccuucgccaaggagaaaaaccugcucaaguacauucaauuuaaaacauucgugagcucugugaauaagcaccccgauuuugcuacgaccggacagugggacgucacaaccgagcgcgauggcaaaaaggaauccgccguguucgacgcuguuaugguguguagcggccaucacgucuauccuaaccugcccaaggagucuuuuccugggcuuaaucauuucaaaggaaagugcuuccacuccagagauuacaaagagccgggcguguuuaacgggaagcggguucugguggucggacucggcaauagcgggugugacaucgccacagaacugucucgcaccgcggaacaggugaugauuuccagcagauccggaucuugggugaugagccgggucugggauaacggcuaucccugggacaugcugcucguuacacgcuucggcaccuuucugaaaaauaaccuuccuacggccaucuccgauuggcuguacgugaagcagaugaaugcuagauucaaacacgaaaacuaugggcucaugccccugaauggagugcuucggaaggagccugucuuuaacgacgaacugcccgccagcauucucugcggcaucgugucuguuaagccgaacgugaaagaguucaccgagacauccgcuauuuuugaagacgggaccaucuucgagggaaucgauugugucauuuuugccacaggcuacagcuucgcguacccuuuucuggacgaaucuaucauuaagagccgcaauaacgagaucauucuguucaaagggguguuucccccucuccuggaaaaguccaccaucgccguuaucggauucgugcaaucucuuggcgcugccauucccacggucgaucugcagagcagaugggcugcccaggugaucaaaggcacaugcacccuccccuccauggaggacaugaugaaugauauuaacgagaagauggaaaagaaacggaagugguucgggaaaagcgagacaauccagaccgacuauauugucuacauggaugaacugucuuccuuuaucggagccaagccuaauaucccguggcuuuuccugaccgaccccaaacucgcuauggagguguauuuuggcccuuguagccccuaccaauuccgccugguugggccuggacaguggcccggcgcgagaaacgccauucugacacagugggaucggucucucaagccgaugcagacgcgcguggucgggagacugcaaaagccuugcuuuuucuuucauuggcuuaaacuguucgcuauccccauucuccugaucgccguguuucuuguucugaccuga

SEQ ID NO: 69395 - RNA, 1677 nt, Artificial Sequence
  derived and/or modified sequence opt5 from FMO4__Homo_sapiens__NP_002013
auggccaagaaaguggcugucaucggcgccgggguuagcggacuguccucuauuaagugcuguguggacgaggaucucgaaccuaccugcuucgagagaagcgacgauaucggcgggcuguggaaauuuacagaauccucuaaggacggaaugacgcggguguacaaaagccuugucaccaacguguguaaggagauguccugcuauucugauuucccuuuucacgaagacuacccgaauuucaugaaccaugagaaguuuugggauuaucugcaggaguucgcggaacacuuugaccuccugaaauacauucaauucaagacaaccguuuguagcaucacaaaacgccccgauuuuuccgagaccggccagugggacguggucacagaaaccgaggggaagcagaauagagcuguguucgaugccguuauggugugcacgggacauuuucuuaacccucaccuuccccucgaggccuucccuggcauucauaaauuuaagggccagauccugcacagccaagaauauaagauccccgagggguuccagggaaaacggguccuggugauuggccucgggaauaccggaggcgacaucgcuguggaacugucucgcacagccgcucagguccuucuguccaccagaacagggaccuggguucucggacggagcucugauuggggcuacccuuauaacaugauggugacgcgcagauguugcuccuucauugcccaggugcugccgagccgguuucuuaauuggauccaagagcgcaagcugaacaaaagauucaaucacgaagacuacggccucucuauuacaaaggggaaaaaggcgaaauuuaucgucaacgacgagcugcccaauuguauucugugcggagccaucaccaugaagacauccgugaucgaguucaccgaaaccagcgcuguuuuugaggauggcacaguggaagagaacauugacgucgugaucuucacgaccggguacacauuuuccuuccccuuuuucgaggaaccccucaagucucuguguaccaaaaagauuuuucuuuauaaacagguuuucccucugaaucucgagcgggccacacuggcuaucauuggacuuaucggccugaaggggagcauccucuccggaaccgaacugcaggcccgcugggugacgagagucuuuaaaggccugugcaagauucccccgagccagaagcucaugauggaggcgacagaaaaagagcaacugaucaagcggggcguguucaaagauaccucuaaggacaaauucgauuacauugccuauauggacgauaucgcugccugcauugggaccaagccuuccaucccccuucuguuucucaaggacccucgccuggcuugggaagucuucuuuggacccuguacacccuaccaguauagacuuaugggcccugggaaaugggauggagcccggaacgccauccugacccagugggacagaacacucaagccgcugaaaacgcgcauugugcccgauagcucuaagccugcuagcaugucccauuaccugaaagcguggggcgcccccguucuccuggcuucucuucugcucaucugcaagagcucccuguuccugaagcuggugcgggacaaacuccaagacagaaugagcccuuaucuggucucucuguggcgcggguga

SEQ ID NO: 69396 - RNA, 1131 nt, Artificial Sequence
  derived and/or modified sequence opt5 from FMOD__Homo_sapiens__NP_002014
augcaguggaccagccugcuccugcuugccggccuguucucccucucucaagcucaguacgaggacgauccccacuggugguuucauuaucugagaagccagcaguccacauacuaugacccuuacgauccguaucccuacgaaacguaugagccuuaccccuacgggguggacgaaggaccugccuauaccuacggcucucccagcccuccggauccccgggacugcccucaagagugugauugucccccuaacuuccccacagcgauguauugcgacaaucgcaaccuuaaguaccugccguuugucccuuccagaaugaaauauguuuacuuccagaauaaccagaucaccucuauucaggaagggguguuugauaaugcuacaggacuccuguggaucgcccugcacggcaaccaaauuaccagcgacaagguggggcggaaagucuucuccaagcuccgccaucuggagagacuuuaucuggaucacaauaaccucacacggaugcccggaccucugccccgcagccuuagagagcugcaucucgaccacaaucagaucucucgggugcccaacaaugcccuggaaggccuggagaaccucaccgcucuguaccuucagcacaaugaaauucaggagguuggcuccagcaugcgcgggcugagaucucucauccugcuugaucuguccuacaaccaucuccggaaagugccugacggacugccgagcgcccuggagcaacucuauauggaacacaauaacgucuacacggugcccgacucuuauuuucgcggcgcuccuaagcugcuuuacguuagacugucccauaacagccucaccaauaacgggcuggccuccaauacauucaacucuagcucccuucuggagcucgaucugagcuauaaucagcugcagaagauucccccugugaacaccaaucucgaaaaccuguaccuucaaggaaaucggaucaacgaguuuucuaucuccagcuucugcacagucguggacguggucaauuuuucuaaacugcagguucuccgccuggauggcaacgaaauuaagagaagcgcgaugcccgccgacgcuccgcugugucuucggcucgccucccugaucgagauuuga

SEQ ID NO: 69397 - RNA, 1614 nt, Artificial Sequence
  derived and/or modified sequence opt5 from FMR1__Homo_sapiens__NP_001172004
auggaggaacugguggucgagguuagaggcagcaacggggccuucuacaaggcuuuugugaaagacgugcacgaagauuccaucaccgucgccuucgagaauaacuggcagcccgaccggcaaauuccuuuucaugaugugcgcuucccgcccccuguuggauauaauaaggacaucaacgaaucugaugagguggaggucuacagcagagcgaaugaaaaagagcccugcuguugguggcucgcuaaggugcggaugauuaaaggcgaauuuuauguuaucgaguacgccgccugcgacgcuacauauaacgagauugugacgaucgaacgccugagauccgucaauccuaacaagcccgccaccaaggauacauuccacaaaaucaaacuugacgugccugaggaucugcggcagaugugugcuaaggaagccgcgcauaaggacuuuaaaaaggccgugggggcuuucucugucaccuacgauccggagaauuaucagcucguuauucugagcaucaacgaagugacauccaagcgcgcccacaugcuuauugacaugcauuuuagaucucugcggaccaaacucagccugaucaugcgcaaugaggaggcuuccaagcagcuggaaagcucuagacaacucgccucccgguuccacgagcaguuuauugugcgcgaagaucugaugggacuugcgaucggcacacacggggccaacauucagcaggcuagaaaaguccccggagugaccgccaucgaccuggacgaggauacgugcaccuuccauaucuacggcgaagaccaagaugcuguuaagaaagcccggagcuuucucgaguucgccgaggacgugauucaggucccucgcaaucuggugggcaagguuaucgggaaaaacggaaaacuuauucaggaaaucguggauaagucuggcgucgugagaguccggauugaggcugaaaaugagaagaacgugccccaggaagaggagaucaugccucccaacucccugccgagcaauaacucuagaguugggccuaaugcgcccgaagagaagaaacaccucgacaucaaggaaaacuccacacauuucagccaaccuaauuccaccaaagugcagcgcguccugguggccucuagcguuguggcuggagagucccagaagcccgagcugaaggccuggcaaggcaugguccccuuuguguucguggggacaaaagauagcauugccaacgcuaccguucuccuggacuaccaccuuaauuaucugaagcuccagcagcggaaaagaggacgcgccucuugugcggaagagacggauggcggcgucgaaggggaggaagaggacaaggaggaagaggauguggaagaggcuuccaaagaaacaaccaucacaccugagcagauuaucgugcacgucauucaagagcggcugaaggaggaacagcagauggacccguuuagaagcgaacuuaccgccaucaugaagggagugucuacccugaaacauuaccgcauucccccuguuaagguggucggcugcgcccgggugaaaaucguuacaagacgcaagcggagccagacggcuuggaugguguccaaccacucuuga

SEQ ID NO: 69398 - RNA, 7068 nt, Artificial Sequence
  derived and/or modified sequence opt5 from FN1__Homo_sapiens__NP_002017
augcugagaggccccgggccugggcuccugcuucuggccgugcagugccucggcaccgcugucccgagcacaggggccuccaagucuaaacggcaagcccagcagaugguucagccccaaagcccuguggcugugucccagucuaagcccggguguuacgacaacggcaaacacuaucagaucaaucagcaaugggagcgcacguaccuggggaacgcccuugucugcaccuguuauggaggcagcagaggcuucaauugcgaauccaagccugaggccgaagagacauguuuugauaaauacaccgggaacacauaucgggugggagacaccuacgaacgccccaaggauucuaugaucugggacugcacauguaucggcgcugggagaggacggauuagcugcaccaucgccaaucgcugucaugagggcgggcaguccuauaagauuggagauacguggagacggccucacgagaccggcggcuacaugcuggaaugcguuugucucgggaacggaaaaggcgaguggacaugcaagccgaucgcugaaaaaugcuucgaccaugccgcggggaccagcuacguggucggagagacaugggagaagcccuaucagggcuggaugaugguggauuguaccugccugggggaaggaucuggccgcaucacguguacauccagaaaucggugcaacgaccaggauacccgcacaagcuacagaauuggcgacaccuggucuaaaaaggauaaucgggggaaccugcuccaauguaucugcaccggaaauggccgcggggaguggaagugugaaagacacacauccguucagacgaccagcucuggauccggcccuuuuacagacgugcgggccgcugucuaucagccccaaccucauccccagccgccucccuacgggcacugcgugaccgauagcggcguggucuauuccguuggaaugcaguggcugaaaacacagggcaacaagcaaaugcuuuguaccugccuggggaauggagugucuugucaggagacggccgugacacagaccuacggcgggaacagcaauggagaaccuugcguccuccccuucaccuauaacggcagaacauuuuacuccugcaccacagaggggcgccaggacggccaccugugguguagcacgaccucuaacuacgagcaagaccagaaauauuccuucugcacagaucauaccgugcuuguucagacacggggaggcaauagcaacggggcucugugucacuuucccuuccucuacaauaaccauaauuauaccgacugcacgucugaaggaagacgcgauaacaugaagugguguggcaccacacagaauuacgacgccgaucaaaaauuuggguucugcccuauggcggcccacgaggaaauuuguaccacaaacgagggagugauguaucggaucggcgaccagugggauaagcagcacgacauggggcauaugaugagaugcaccugugucggcaauggacgcggcgaauggacgugcauugcuuacagccagcugcgggaucaauguaucguggacgauauuacauauaacguuaaugacaccuuucacaaaagacaugaggaggggcacaugcugaacugcacaugcuucggacagggccgcgggcgguggaagugugacccgguggaucagugccaagacuccgaaaccggaaccuuuuaccagaucggcgauucuugggagaaguacguccauggggugagauaucaguguuacugcuauggccgcggaaucggcgaauggcacugucagccccuccaaacauacccuagcuccagcgggcccgucgagguguucauuacggaaaccccuucucagcccaauucccacccgauccaguggaacgccccucagcccagccauauuucuaaauauauccugcgguggagaccuaagaauagcguuggacgguggaaagaggcuacaauucccggccaccuuaacagcuacaccaucaaggggcugaaaccuggaguggucuaugagggccaacucaucuccauucagcaguacggccaucaggaagugacacgcuucgacuuuaccacgacaucuaccagcacccccguuacauccaacaccgugacaggggagacgaccccguucucuccucuggucgccacaagcgaauccgugaccgagaucacagccagcucuuuugugguuuccugggucagcgcuucugauaccguguccggauucagaguggaguacgaacuuagcgaggaaggcgacgagccccaauaucuggaucuccccucuacggcgaccagcgucaauauuccugaccugcugccggggcggaaguacaucgugaacguuuaucagauuuccgaagauggagagcagagccucauccugucuacaucccaaaccacagcccccgacgcuccucccgauccuaccguggaccaggucgaugacacaagcaucgugguuagauggucccgcccccaggccccuauuaccggcuaccggaucguguauucucccagcgucgagggguccucuacggaacuuaaucugccggagacagccaacagcgugacccucuccgaccugcagccuggaguucaauacaauauuaccaucuaugcuguggaagagaaccaggaaucuacacccgucgugauucagcaggagaccacgggcacaccuagaagcgauaccgugcccuccccgcgcgaccuucaauuugucgagguuacagaugugaaggugaccaucauguggacaccucccgaaagcgccgucaccggcuacagaguggacguuauuccugugaaucugcccggggagcacggacagcggcuccccaucucucgcaacacguucgcggaagucaccggccuguccccuggggugacauacuauuuuaaaguuuucgcugugagccacggaagagagucuaagccgcugaccgcccagcagacaaccaaacucgaugcccccacgaaucugcaauuugucaacgaaacagacuccaccgugcuuguucgguggacaccuccccgcgcucagaucaccggcuacagacugaccguggggcucacacggcgcggacagccuagacaguauaaugucggccccagcgugucuaaguacccucugcggaaccugcaaccggccuccgaguauacggugagccuugucgcuauuaaaggcaaucaggagucccccaaggccaccgggguuuucacaacccuccagccuggaagcucuauucccccuuacaacacagaagugaccgagacgacaauugugaucaccuggacccccgcgccgcgcauuggcuuuaagcugggggucagaccuagccaaggaggcgaagcgccccgggaggugacauccgauucugggagcaucguuguguccggacugacccccggcgucgaguauguguacacaauccagguucucagagacggccaggaacgcgaugcuccuauugugaauaaagucgugacgccccugucuccuccgaccaaccuucaucuggaggccaaccccgacacagggguccucaccgugagcugggaacgguccacaaccccugauaucacgggauacagaauuaccacaacccccacaaauggccagcaagggaacucucuggaggaaguugugcacgcugaccagagcuccugcaccuucgauaaucugagcccuggacuugaguauaacgucucuguguacacaguuaaggacgacaaagaguccgugcccaucagcgauacgauuaucccggccgucccucccccuaccgaccuccgcuuuacaaauaucggccccgauaccaugcgggugaccugggcgccucccccgucuauugaccugacaaacuuccuggugagauauuccccuguuaagaaugaagaggaugucgccgaacucagcaucucccccucugacaacgcuguggugcugacgaaucuucugcccgggaccgaguacgucgugagcguuuccagcguguaugaacagcaugagucuacaccucuccgcggacggcagaaaaccggccuggauuccccgacaggcauugacuucagcgauaucaccgccaacucuuuuacgguccacuggauugcucccagagccacaaucaccggguaccgcauccggcaucacccugagcacuucagcggaagaccccgggaagaccgcgugccucauuccagaaauucuauuacccugacaaaccuuacccccggcacagaguauguugugagcaucgucgcccucaaugggcgggaagaguccccucugcugauuggacaacagucuaccgugagcgauguuccgcgcgaccucgaaguggucgcugcgacgcccacaucccugcuuaucagcugggacgccccugcugugaccgugagauacuaccggauuacauauggcgagaccgggggaaacucucccguccaggaguuuacgguuccuggcuccaagagcaccgccacaaucuccggccugaagcccgggguggauuacaccauuacaguguaugccgucaccggaagaggcgacucuccggcuagcuccaaaccuaucucuaucaauuaccgcacagaaauugauaagcccagccagaugcaagugaccgacguucaggauaacuccaucagcgugaaauggcuccccucuuccagcccugucacgggguaucgggugacaaccacccccaagaacggaccuggcccgacaaaaaccaagacagccgggcccgaccagacggagaugaccauugaaggacugcaaccuacaguugaguacguggucucuguguaugcgcagaaucccuccggcgagagccagccucugguccagaccgcugugacaaacaucgauagacccaaaggccuugccuucaccgacguugauguggacucuauuaagaucgccugggaaagcccgcaaggacaggugucccgcuaccgggucacguacucuagcccugaggauggaauccacgaacucuuucccgcuccugacggcgaggaagauaccgccgagcugcaggggcugagacccggauccgaguauacaguuagcgugguggcgcuccaugacgacauggaaucccagccucugauuggcacccaaucuacagcuauccccgccccgaccgaucuuaaguucacgcaggucacaccuaccagccuguccgcccaguggacaccgcccaaugugcagcucaccggguaccgcguucgggugaccccuaaagagaagacaggcccgaugaaagaaauuaaccuggcucccgacucuagcuccgucguggucucuggacugaugguggccacgaaguaugagguuagcguguacgcucuuaaagauacccugacauccagaccugcccaaggcgucgugaccacacucgaaaauguuucucccccucgcagagcgcgggugaccgacgccacggagacaaccaucaccauuuccuggcgcacaaagaccgagacaaucacgggguuucaggucgaugcugugcccgccaacggacagaccccuauccagagaacaauuaagcccgacgugcgguccuauaccaucacaggccugcaaccggggaccgauuacaaaauuuaucucuacacgcugaaugacaacgcucgcagcucuccuguugucaucgaugccuccaccgccauugacgcucccagcaaucuuagauuccuggcgacaaccccuaacucucuccugguguccuggcagcccccgcgggccagaaucacaggauacauuaucaaguaugaaaaaccuggcagcccuccccgcgagguggucccccggcccagaccugggguuaccgaagcuacaaucaccggccuggagccgggaacggaauacacaauuuaugugaucgcccuuaagaauaaccagaaauccgagccccugauuggccgcaagaagaccgaugagcucccucaacuggugacccucccccacccuaaucugcaugggcccgaaauccuugacgucccuagcacagugcagaaaacgccguuuguuacccaccccggauacgauacaggcaacgggauucagcugccuggaaccucuggccagcaacccagcguggggcagcagaugaucuucgaggaacacggcuuucggagaacaaccccucccacaaccgccacgccgauccggcaucgcccuagacccuaucccccuaaugucggacaggaggcucucucccaaaccacaauuucuugggcccccuuccaggacaccagcgaguacaucauuuccugucacccugugggcacagacgaggaaccccugcaguuucggguucccgggaccucuacgagcgcgacacugaccggacuuacacgcggcgcuaccuauaacaucauuguggaagcccugaaggaucagcaaagacauaaaguccgggaggaaguggugacggucggaaauuccguuaacgagggacucaaccagccuaccgacgauucuugcuucgaccccuacacagugagccacuacgccgugggcgaugagugggaacgcauguccgagagcggcuucaagcugcucugucagugccugggguuuggaucuggccacuucagaugugacuccagccgguggugccaugauaauggggucaacuauaaaaucggagaaaagugggaccgccaaggcgagaaugggcagaugaugucuugcaccugucuuggaaacggcaagggcgaauuuaaaugcgauccucacgaggcuacauguuacgacgaugggaagaccuaucaugugggagagcaguggcagaaagaauaccugggcgccaucugcuccuguacaugcuucgggggacaaagaggcuggcggugugacaauugcagacgccccgggggagagccgagcccugaaggcaccacgggccaguccuauaaccaguacucucagcgguaucaccaaagaacaaauaccaacguuaauugucccauugagugcuuuaugccucuggacgugcaggcggaucgcgaagacagccgggaguga

SEQ ID NO: 69399 - RNA, 930 nt, Artificial Sequence
  derived and/or modified sequence opt5 from FN3K__Homo_sapiens__NP_071441
auggagcagcugcucagagccgaacugcggaccgcuacacuucgcgccuucggcgggcccggagcgggcugcaucagcgaggggagagcuuacgacacggaugccggaccuguguuugucaagguuaaccggcgcacccaagccagacagauguucgaaggcgagguggcuucccuggaagcccuccggucuacagggcuggugcgcgucccgagacccaugaaagugauugaccuuccuggaggcggcgcugccuuuguuauggagcaccugaagaugaaaagccucuccucucaggcgagcaagcugggggagcagauggccgaucugcaucucuauaaucaaaaacugcgggaaaagcugaaggaggaagagaacaccgugggacgcagaggcgagggggcugaaccccaguacgucgacaaauucggauuucacacagugaccuguugcggcuucaucccucagguuaaugaguggcaggaugacuggcccacauuuuucgcccggcaucgccugcaagcucagcucgaucugauugaaaaggacuaugccgauagagaggcgcgggaacuuuggucccgccuucaggugaaaaucccugaccucuuuugugggcuggagauugucccggcccugcuccacggagaucuguggucuggcaacguggcugaggacgaugugggccccaucaucuacgacccugccagcuucuaugggcauuccgaauuugagcuugcuauugcccugauguucggaggcuuuccccggagcuucuucaccgccuaccacagaaagaucccuaaagcucccggguuugaccagagacuccugcuuuaucaacuguucaauuaccucaaccacuggaaucauuuuggacgcgaauaccggucuccgucccugggcacgaugagacgccugcucaaguga

SEQ ID NO: 69400 - RNA, 930 nt, Artificial Sequence
  derived and/or modified sequence opt5 from FN3KRP__Homo_sapiens__NP_078895
auggaggaacugcucagacgggagcugggcugcagcuccgugcgcgccaccgggcacucuggaggcggguguaucagccagggaagauccuacgacacagaucaaggccgggucuucguuaaggugaaccccaaagcugaagcccgcagaauguuugagggggaaauggcgucucuuacggcuauucugaagaccaauacagugaaagucccuaagccgaucaaagugcucgacgcccccggaggcggcagcguucuggugauggagcauauggauaugcggcaccuuuccucucaugccgcuaagcugggggcccagcucgcugaccugcaccuggauaacaagaaacucggagagaugcgccugaaggaagccggcaccgucgggagaggaggcgggcaggaggaacggccuuucguggcgcgcuuuggauucgacguugugacaugcuguggcuaucuuccccaggucaaugauuggcaagaggacugggugguguuuuacgccagacagcggauucagccucagauggauauggucgagaaagaaagcggcgaccgcgaggcucugcaacucugguccgcccugcagcuuaagauccccgaucuguucagagaccucgaaauuaucccugcucugcugcauggggaucucuggggaggcaacguugccgaggacagcucugggccggugaucuuugaccccgcguccuucuauggacacagcgaauacgagcuggccauugcuggcauguuugggggauucucuuccagcuuuuauucugccuaccacggcaaaaucccuaaggcucccggcuucgagaagcggcuucagcuguaucagcucuuucauuaccugaaucacuggaaccauuucggguccggauaccgcggcagcucccuuaauauuaugagaaaccuggugaaauga

SEQ ID NO: 69401 - RNA, 1854 nt, Artificial Sequence
  derived and/or modified sequence opt5 from FNBP1__Homo_sapiens__NP_055848
augagcuggggcaccgagcugugggaccaguucgauaaccucgaaaagcacacacaaugggggaucgacauucuggagaaauacaucaaguuugugaaagaaagaacggagauugaacuuuccuaugccaagcagcugcggaaucucucuaaaaaguaccagcccaagaaaaacagcaaggaggaggaagaguauaaauacaccuccugcaaggcuuucaucucuaaucugaacgaaaugaaugauuaugccggacagcaugaggucauuagcgagaacauggcgucccaaaucaucguugaccuugcucgcuacgugcaggaacugaaacaggagagaaagucuaauuuucacgauggccggaaggcccagcaacauauugaaacauguuggaaacagcucgagagcuccaagcgcagauucgaacgggacugcaaagaggccgaucgcgcucagcaguauuuugagaagauggacgccgauaucaacgugaccaaagcugacgucgaaaaggccagacaacaggcgcagauucggcaccaaauggccgaggauagcaaagcugacuacucuuccauccugcagaaguucaaucaugaacagcacgaguacuaucacacacauauuccuaacaucuuucagaagauucaagaaauggaggagcgcagaaucgugcggaugggggaaagcaugaaaaccuacgccgagguugaucgccaggugaucccgauuaucggaaagugucuggacggcauugucaaagcugccgaaucuaucgaccagaagaaugauucccagcucgugauugaggcguauaaaagcggguucgaacccccuggagacaucgaguuugaggauuacacacaacccaugaagagaaccguuucugacaacucccugagcaauucccggggcgaaggcaagccugaucuuaaauucgggggaaagucuaaaggcaagcuguggcccuuuaucaaaaagaacaagcucaugagccugcuuacguccccucaccagccgcccccucccccucccgccagcgcuucuccguccgccgugccuaaugggccccagagcccuaaacagcaaaaggagccccugucucaucgcuucaacgaauuuaugaccagcaaacccaagauucacugcuucagaucccucaaacggggacugucucugaagcucggcgcuacaccugaggacuucagcaaccugccgcccgagcagagacgcaagaaacuucagcagaaggucgaugaacugaauaaagagauccaaaaggaaauggaccagcgggaugccauuaccaaaaugaaggacguguaucucaaaaacccucagaugggggaucccgccucccuggaccacaaacuugcugaggugagccaaaauaucgaaaagcugagagucgagacacagaaguuugaggcguggcucgccgaaguugagggacgccugccugcucggucugaacaggccagacgccaguccggccuguacgacagccaaaaucccccgaccgugaacaacugugcccaggaucgggagucuccugacggcuccuauacggaagaacagagccaggaguccgaaaugaaggugcucgcuacagauuucgacgaugaguuugacgaugaggagccccugccugccauugggaccugcaaagcgcuuuacacauucgaaggacaaaaugagggcaccaucucugucguggagggggaaacccuguacguuaucgaggaagacaagggagauggcuggacacgcauuagacggaacgaggacgaggaaggguaugugcccacgagcuacgucgaggugugucucgauaaaaaugcuaaggacuccuga

SEQ ID NO: 69402 - RNA, 5685 nt, Artificial Sequence
  derived and/or modified sequence opt5 from FNDC1__Homo_sapiens__NP_115921
auggcccccgaggcuggcgccacccugagagccccucggcgccucagcugggcugcccugcuucugcucgccgcucugcuucccguggccuccucugcugccgccagcgucgaccacccccugaagccuagacacguuaagcuccuguccaccaagauggggcugaaggugacgugggaucccccuaaggacgccaccucucggcccguggaacacuacaacaucgcuuauggaaaaagccucaagucccugaaguacauuaaagucaaugccgagaccuauucuuuccuuaucgaagauguggagccuggcguuguguacuuuguccugcucaccgcugaaaaccauagcggggugucccgcccgguuuauagagccgagucucccccuggaggcgaguggauugaaaucgacggguuccccauuaagggaccuggccccuuuaaugagaccgugaccgaaaaagaggucccgaacaagccucugcgggugcgcgugagauccuccgaugaccggcuuagcgucgcguggaaagcgccccgccugucuggcgcuaaguccccuagacggagccgcggguuccuccugggauacggcgagucugggagaaagaugaauuauguuccccugacgcgggaugaacgcacccacgagaucaaaaagcucgccuccgaaagcguguacguggucucccugcagucuaugaacagccagggaagaucccagcccguguaccgggcugcccuuacgaaaagaaagaucagcgaggaagacgagcuggauguuccugacgauauuucugugcgcgucauguccagccagucugugcucguuagcuggguggacccgguccuggagaaacagaagaaaguggucgccucccggcaauauaccgugagauaccgcgaaaagggcgagcuugcucggugggauuauaagcagaucgcgaauagacgcguucugauugaaaaccucauccccgacacaguguacgaguuugccguccggauuucucagggggaaagagacggaaaauggagcaccuccguguuccagcgcacaccugagagcgcucccaccacggccccugagaaucugaacguuuggcccgugaauggcaagccgacagucguggccgcuucuugggaugcccugccugaaaccgagggcaaagugaaggaauauauccucuccuacgcgcccgcucugaaaccuuuuggggccaagagccuuacauaucccggagacaccaccucugcccugguugauggccuccaaccuggggagcgguaccuguucaagauuagagcuacaaaccgccggggacuuggcccccauuccaaagccuuuaucgucgcuaugccgacgaccagcaaggccgacguggaacagaauacagaggauaacgggaaaccugagaagcccgaacccuccucuccuagcccgagagcgcccgccuccucucagcacccuagcgugcccgcuuccccucagggacggaaugccaaagaccugcuccuggaucugaagaacaagauccucgcuaacggcggcgcgccccgcaaaccucaacugagagcgaagaaagccgaggaacuugaccugcagagcaccgagauuacaggggaggaggaacucggaucucgggaagauucccccaugagcccgucugacacccaggaucaaaagagaacgcugcgcccucccucccggcacggccauagcgucguggcuccugggagaacagccguucgcgcuagaaugcccgcccugccgcggcgcgagggaguggacaaaccuggcuucucucuugccacccagcccagaccuggggcuccgcccagcgcguccgccagcccugcucaccaugccucuacccagggcacaucccaccggccgagccuccccgccucccugaaugacaacgaucuggucgacucugaugaagacgagcgcgcugugggaagccuccacccuaagggcgccuuugcgcagcccagaccugcucugucccccucucggcaaagcccuuccucuguucuucgcgauagaagcuccgugcauccgggggccaagcccgccagcccugcucggcgcacaccccacucuggagccgcggaggaagacuccagcgcuucugccccucccuccagacugagcccgccucauggcgggucuucccggcuccugcccacacagccccaccugagcuccccucuuagcaaaggaggcaaggauggggaggacgcccccgcuacaaauucuaacgccccuagcagauccaccaugucuagcuccgucucuagccaucucuccucucgcacacaggugagcgaaggcgcugaggccuccgauggagaaagccacggcgacggggaucgggaggacggaggcagacaggcggaggccaccgcucaaacacugcgcgcccggccggcuucugggcacuuccaucugcucagacacaaacccuuugccgccaauggacgcuccccuagccgguucucuaucggcagagggccccgccugcagccuuccagcagcccccaaucuaccguuccgagccgggcucauccuagagugcccucccacagcgauucucacccuaaacuuuccagcggcauucauggagacgaagaggacgaaaaaccccugccugcgacggucgugaacgaucacgugcccucuagcucccggcagccgaucucucgcggcugggaggaccucagacggagcccucaacgcggggccucccugcauagaaaggaacccauucccgagaauccuaaaucuaccggagcugauacacacccgcagggcaaguacagcucccuggccagcaaggcccaggacguccagcaaucuaccgaugcugacacagaggggcauucccccaaagcccagccuggaagcaccgaucggcacgcgucccccgcuagaccucccgccgcccgcucucagcaacacccuagcguuccgcggagaaugacgcccggccgcgcuccucagcagcagcccccucccccgguggccacaucccaacaucacccugggccccagucucgggacgcgggcagaagccccucccagccucgccuuagccucacccaggcuggacggcccagaccuacaucucaaggccgcucccauuccucuagcgauccguauaccgccagcucuagagggaugcugcccaccgcccugcagaaccaggacgaagaugcucagggaagcuacgacgaugacuccacagagguggaagcccaagacguccgggcuccugcccacgcggcccgcgcuaaggaggccgcugccucucuccccaaacaucaacagguggagagcccuacgggcgccggggcuggaggcgaucacagaucccaacggggccacgcggccagccccgcucgcccguccagaccugggggaccccagucucgggccagaguuccuagccgcgccgcucccggcaaguccgaaccucccucuaaacggccgcugagcuccaagucucagcagagcguguccgccgaggacgaugaagaggaagacgcgggguucuuuaagggaggcaaagaggaucuucuguccucuagcgucccuaaguggcccuccucuagcacccccagagggggaaaagacgcugauggcagccucgccaaggaggaacgcgagccugccaucgcucuggccccgcggggcgggucucuggcgcccgugaaaagaccucuucccccucccccuggauccagcccccgggccucccauguuccgagccgccucccucccagaucugcugccacagugagcccugucgcuggcacccaccccuggccgcaauauacaacccgggccccucccgggcauuucuccacgacacccaugcugucucugcgccagagaaugaugcacgcucgguuucgcaauccucucagcagacagcccgcccggccuuccuaccgccagggauauaacggcagaccgaauguggaagggaagguucugcccggaucuaacggcaagccuaauggccaacggaucauuaacgggccccagggaaccaaauggguggucgaccuugauagaggccuggugcucaaugcggaggggcgcuaccugcaggacagccacggaaacccucugcggaucaaacuuggcggggauggaagaaccauuguggaccuggaaggcacacccgucguuuccccugacggccucccgcuguucgggcagggacgccauggcacaccccucgccaacgcucaagauaaaccuauccugucucuugggggaaagccccuggugggccucgaggugauuaaaaagacaacgcacccucccaccacaaccaugcagccgacaaccacgaccacaccucugcccaccacaaccacaccccggccuaccacggccacaaccagacgcaccacaaccacgcggagaacaaccacacgccggcccaccacaaccgucagaacgaccacacgcaccacaaccacgacaaccccuacaccgaccacccccaucccuacaugucccccugggacgcuggagcggcaugacgaugacggaaaucuuaucaugagcuccaacggcauucccgaaugcuaugcugaggaagaugaguuuagcggccuggaaaccgacacagccgugccgaccgaggaggccuacguuaucuacgaugaagacuaugaguucgaaacaucuagaccucccaccacgacagagccuuccaccaccgcuacaacaccccgcgugauuccggaggaaggggcgaucagcucuuuuccugaggaagaguucgaucucgccggaagaaagcgguuugucgcucccuacgugacauaucugaauaaagaccccuccgccccuugcagccucacggaugcccuggaccacuuccagguugauucccuugacgaaauuauccccaacgaccugaagaaaucugaucucccuccgcagcaugcuccccgcaauauuaccguggucgccguggagggcugucacagcuuugucaucguggacugggauaaggcgacaccuggggacguugugaccggauaccuggucuauuccgccagcuacgaggauuucaucagaaacaaauggucuacacaggcuuccagcgugacccaucugcccauugaaaaucuuaagccuaacacgcgguauuacuuuaaaguucaggcccagaauccccauggcuacgggccuaucucuccgagcguguccuucgucaccgagucugacaacccccugcucguggugagaccucccggaggcgaaccuauuuggauccccuucgcuuuuaagcacgauccgagcuauacagacugccauggccggcaauacguuaagcgcaccugguauagaaaauucgucgggguggugcuguguaauucccuccgguacaagauuuaucugucugauaaccuuaaagacacauuuuacagcaucggagauuccuggggccgcggggaggaccacugccaguucgucgauagccaccuggacggaagaaccggcccucagucuuauguggaagcccugcccacaauccagggguacuaccggcaauaucgccaggagcccguuagauuuggaaauauuggcuucggcacgccuuacuauuacguggggugguaugaguguggagucuccauccccggcaagugguga

SEQ ID NO: 69403 - RNA, 3597 nt, Artificial Sequence
  derived and/or modified sequence opt5 from FNDC3A__Homo_sapiens__NP_001073141
auggccgagcaucccccucugcucgacaccacacagauccugagcuccgauauuucucuucugagcgcuccgaucguguccgccgacggcacgcaacaggucauucucguucaggugaaccccggggaagcguucaccaucagacgggaggauggacaguuucaaugcauuacaggcccugcucaggugcccaugaugucuccuaaugggagcgugcccccuaucuacgucccgcccggauaugccccucagguuaucgaagacaacggcgugcgcagagucgugguugugccccaggccccugaguuccaccccgggucccacaccguccugcaucggucuccgcacccuccccuuccuggauuuauucccgugcccacaaugaugccuccgcccccucgccauauguacagccccgugaccggcgcuggcgauaugacaacccaauauaugccucaguaccaguccagccaggucuauggggacguugaugcccacucuacgcacggaagauccaauuuccgggacgaacgcagcucuaagaccuacgagagacugcaaaagaagcucaaagaucggcagggcacacagaaggacaaaauguccucucccccgagcuccccucaaaagugucccagcccuaucaacgagcauaaugggcugauuaagggacagaucgcuggcgggauuaacaccggauccgccaaaaucaagucuggcaaaggcaaagggggaacacagguggauaccgaaauugaggaaaaagacgaggagacgaaggcguuugaagcccugcucagcaauaucgugaagcccgucgcuuccgauauccaggcccgcacagugguucugaccuggagcccucccucuucccuuauuaacggcgagacagacgaaagcucugugccggagcuguauggguacgaaguccucaucagcuccaccggaaaagacggcaaguacaaaucuguguauguuggggaggagaccaauauuacacugaacgaucuuaagccugcuauggacuaccacgccaaagugcaagcggaauauaauagcaucaagggaacgcccuccgaggccgaaauuuucaccacacugagcugcgagcccgauaucccuaacccgcccagaaucgcuaaucggaccaaaaacucucucacacugcaguggaaggccccuuccgacaauggcagcaagauucagaacuuuguccuggaaugggaugagggcaaagggaacggagaguucugucagugcuacaugggcucucaaaagcaguuuaaaaucaccaagcucucccccgcuaugggguguaaauuccgccugagcgccagaaaugacuauggaacguccggcuuuucugaagaggugcuuuacuauacaagcgggugcgccccuuccaugcccgcuucuccuguccugaccaaggcgggcauuaccuggcucagccugcagugguccaagcccagcggaacaccgucugaugaaggcaucuccuacauucuugagauggaagaggagaccagcggguacggauucaaaccuaaguaugacggcgaagaucuggccuacacagugaaaaaccuccggcgcucuacgaaguauaaauuuaagguuaucgcuuacaauuccgagggaaagagcaaccccucugaaguggucgaguucaccacauguccugacaaacccgggaucccggugaagccuagcguuaaaggcaagauucauucccacagcuucaaaaucaccugggaucccccuaaggacaaugggggcgccacaauuaacaaguauguggucgagauggccgaaggaucuaauggcaacaaaugggagaugaucuacuccggggcuaccagagaacaccugugcgaccggcugaaucccggauguuuuuauagacuccgcguguacugcauuagcgauggcgggcaguccgccgugucugagagccugcuuguucaaacgcccgcggucccuccgggacccugucugccuccccggcuccagggcagaccuaaggcuaaagaaauccagcugcgcugggggcccccucuuguggacggcggauccccgauuucuugcuacagcguggagaugucccccaucgagaaggaugaaccucgggaggucuaucagggcucugaaguggagugcaccguuagcucccugcuccccgggaaaacauacagcuucagacugcgcgccgccaacaagaugggauuuggcccuuucucugaaaaaugugacaucaccacagcucccgggccgccugaucaaugcaagccuccccaggugaccugucgguccgccacgugcgcucaggucaauugggaggugccccugagcaacggaacagacguuaccgaguauagacucgaauggggcgggguggagggcucuaugcaaauuuguuacugcggacccggccuguccuaugaaaucaaggggcuuagcccugccacaaccuacuauugucgcguccaggcgcugucugugguuggagccggcccguuuuccgagguggucgcuugcgugacacccccuagcgugcccgggauugucaccugucuccaggaaaucuccgaugacgagauugagaauccucauuacagccccucuacgugccuggccaucagcugggaaaaaccgugugaucacggauccgagauccuggcuuacucuauugacuucggcgauaagcagagccuuaccguuggcaaagugacauccuauaucauuaacaaucuccaaccugacaccacauaccggauccgcauucaggcccugaacucucugggggcgggacccuuuagccauaugaucaagcucaaaaccaagccucugcccccugaucccccgagacuugaaugcguggccuucucccaccagaaccugaagcucaaauggggcgaggggacgccuaagacacugucuaccgacagcauccaguaucaucugcaaauggaggacaaaaauggacgguuugucucccuuuacagaggccccugccacaccuauaaggugcagcggcucaacgaaagcacaucuuacaaauucuguauucaggcuugcaaugaggccggggaaggaccccugucccaggaguauaucuuuaccacaccuaagagcguuccggcugcccugaaggcccccaaaauugaaaaggugaacgaucacaucugugagauuacgugggagugccuccaaccuaugaaaggcgaccccgucaucuacucucuucaggugaugcugggcaaggauuccgaguucaaacagaucuacaaggggccugacagcuccuuucgcuauucuagccugcaacucaauugugaauacagauuccggguuugcgcuauuagacagugucaggauucccugggacaucaggaccuggugggccccuauagcaccacaguccuuuucaucucucaacgcaccgaaccuccggcguccacaaaccgggauaccguggagagcacgagaacccgcagagcccucucugacgaacagugcgcugccguuauucuggugcuguuugccuucuuuagcauccucauugcuuucaucauucaguacuuugucaucaaguga

SEQ ID NO: 69404 - RNA, 3615 nt, Artificial Sequence
  derived and/or modified sequence opt5 from FNDC3B__Homo_sapiens__NP_001128567
auguacgugaccaugaugaugacagaccagaucccccuggagcucccuccgcugcuuaacggcgaagucgccaugaugccccaccugguuaauggggaugcugcccaacaggugauucucgugcaggucaacccuggagagacguucaccaucagagcggaagacggcacacugcagugcauucaagggcccgcugaggugccuaugaugagccccaauggauccaucccuccgauucauguucccccuggcuauaucucucaggugaucgaagauagcaccgggguccggcgcgugguugugacaccccaguccccugaguguuaucccccgucuuacccuagcgccaugucccccacccaccaucuuccucccuaccugacacaccauccccacuuuauucacaacucucauaccgccuauuacccuccggucacgggacccggcgacaugccuccccaguucuuuccucaacaccaucucccccacaccaucuauggcgagcaggaaauuaucccguucuacgggaugagcacauacauuaccagagaggaucaguauuccaagccuccccacaaaaagcugaaagaccggcagaucgaucgccaaaauagacugaacagcccucccucuuccauuuacaagagcucuugcacaaccguguauaauggauacggcaaagggcauuccggaggcagcgggggaggcggcucuggguccggaccuggcaucaagaagacggaacggcgcgcuagaagcucccccaaaucuaacgacagcgaucuccaggaguaugagcuggaagugaagcggguccaggacauccuuuccgggauugagaaaccgcaaguuagcaauauccaggcccgcgcuguggugcugucuugggccccucccgucggacucuccuguggcccccacagcgggcugucuuuuccuuacagcuaugaaguggcgcuuuccgauaagggaagagacggcaaauacaagauuaucuacucuggcgaggaacuggagugcaaccucaaggaucugcggccggccacagacuaucauguucgcguguacgcuauguauaauagcgucaaaggguccuguagcgagcccgugucuuucaccacacacuccugcgccccugaaugucccuuuccucccaagcuggcucauagaagcaaaucuucccucacccugcaguggaaggccccuauugacaacggaagcaaaaucaccaauuaccuucuggagugggaugaaggcaagcggaacuccggguuccgccagugcuuuuucggaucucaaaaacacuguaagcucacaaagcugugccccgcgaugggcuauacguuuagacuugccgcucggaaugacaucgggaccagcggcuacucccaggagguuguguguuauacacugggaaacauuccgcagaugccuucugcccccagacucguccgcgcuggcaucaccugggugacacugcaguggagcaaaccugaagggugcucccccgaggaggucauuaccuacacgcuggaaauccaagaggaugaaaacgacaaucucuuccacccgaaguacacaggagaggaucugaccugcaccgugaaaaaccuuaagcggagcacacaguauaaauuuagacugaccgccucuaauacagaaggcaaguccuguccuagcgagguucucgugugcacgaccucucccgaccgcccugggccucccacacggccccuggucaagggaccggugaccucccauggcuucagcguuaaaugggaucccccuaaggacaacgggggcucugagauucuuaaauaccugcucgaaaucacagauggaaauagcgaggccaaccagugggaaguggcuuauuccggcagcgcgaccgaguacacguucacccaccugaagcccgggacacuguauaaacucagagccuguugcaucucuaccggaggccauucccaguguagcgagucccugccuguccgcacacuuucuauugcucccgggcaaugccggccuccgagagugcugggacgccccaagcacaaggaagugcaccucgagugggacguuccugccagcgaauccggcugugaggucucugaauacagcguggagaugaccgagcccgaagauguggccuccgaggucuaucaugggccugaacuggagugcacggugggcaaucugcuucccggaacaguuuaccgguuuagagugcgcgcucucaacgacggcggguacggaccguauucugacgucagcgaaaucaccacagccgcgggcccucccgggcaguguaaagcucccugcauuuccuguaccccugauggaugcgugcugguuggcugggagagccccgacucuuccggggccgauaucagcgaguaccggcuggaauggggcgaggacgaagagucucucgaacugauuuaucacggaaccgauacaagauucgagauccgggaccuucugccugccgcucaguacugcugucgccuccaggccuuuaaucaagcuggcgccgggccguauuccgagcuggugcugugccagacgcccgcgagcgccccugaucccgucucuacccuuugugugcucgaagaggaaccucuggacgcuuaccccgauuccccgagcgccugccugguucucaacugggaggagccuuguaauaacggauccgaaauucuggcuuauacaaucgaccuuggcgauaccagcaucacaguggggaauaccacgaugcaugucaugaaggaccugcuccccgagacaaccuaccggauuagaauccaggccauuaacgaaaucggagcgggcccuuucucucaauuuauuaaagccaagaccagaccccugccuccccugccgccucgccuugagugcgcugccgcuggcccccagagccucaaacugaaguggggagauuccaauucuaagacacacgccgccgaagacaucguguacacccugcagcucgaggaccggaacaaaagauucaucagcauuuaucgcgggcccucccauacauacaaggugcagagacugacggaguuuaccuguuauucuuuccggauccaagcugcgagcgaagccggcgaggggccuuuuuccgaaacauacaccuucucuacaaccaaaagcgucccgcccacgauuaaggcuccucgcguuacccagcuugagggaaacuccugcgaaauccugugggagacagugcccagcaugaaaggcgauccugugaauuauauucuccagguccugguggggagagagucugaauacaagcagguuuauaaaggagaggaagccaccuuucaaaucuccggccugcagacaaacaccgacuaccgguuccgcgugugugccugcagacggugucuugauacaagccaggagcucucuggcgcuuuuucccccagcgccgcguucguccugcagcgcuccgaagugaugcugaccggggacaugggaucucucgaugacccuaagaugaaaagcaugaugccgacggaugagcaauucgcugccaucauuguucugggcuuugccacacuuuccauccuguucgcuuuuauucuccaguacuuccugaugaaguga

SEQ ID NO: 69405 - RNA, 705 nt, Artificial Sequence
  derived and/or modified sequence opt5 from FNDC4__Homo_sapiens__NP_073734
augcccagcggcugccacuccucuccuccgagcgggcugagaggagacauggccucccucgugccccugucuccuuaccuuagccccaccguccugcuccugguuuccugugaucuuggcuucgugcgggcugaccgcccucccucuccugugaacgucacagugacgcaucugagagccaauagcgcgaccguuuccugggaugugccggaggggaacaucgucauuggauauagcaucucucaacaacggcagaauggccccgggcagcgcgugauuagagaaguuaacacaaccacacgggcuugcgcccucuggggacuggccgaggacuccgauuacaccgugcagguccgcagcaucggccugagaggcgaaucuccucccgggccucgggugcacuuucgcacacucaagggauccgacagacugcccagcaauucuuccagcccgggcgauauuaccguggaggggcuugacggagaacggccucugcaaacgggcgaggucguuaucaucguggugguccuccugaugugggcugccgugauugggcuuuucugucgccaguaugauaucauuaaagacaacgauuccaauaacaaucccaaggagaaaggaaagggcccugaacagucuccccagggcagacccguugggacccggcagaaaaagagcccuuccaucaacacaauugacguguga

SEQ ID NO: 69406 - RNA, 1140 nt, Artificial Sequence
  derived and/or modified sequence opt5 from FNTA__Homo_sapiens__NP_002018
auggccgcuaccgagggcgugggggaagccgcgcagggaggcgagcccgggcaaccugcucagccgcccccucagccccacccucccccuccgcagcaacagcauaaggaagagauggccgccgaagcuggagaggccgucgcuagccccauggacgauggcuucguuucccuggacucuccuagcuacgugcucuauagagaucgggccgagugggcggacaucgaucccgugccucagaacgacgggcccaauccggucgugcagauuaucuacuccgauaaauuucgcgacguuuaugauuacuucagagccgugcugcaacgggacgaacgcucugagagagcuuuuaagcugacacgggaugccauugaacuuaacgcugccaauuauacggucuggcacuuccgcagagugcuccugaaaagccuucagaaggaccugcaugaggagaugaacuacaucaccgcgauuaucgaggaacagccuaaaaauuaucagguuuggcaccaucggcgcgugcucgucgaauggcugagagaucccucccaagagcuggaauuuaucgccgacauucucaaccaggacgcuaagaauuaccacgccuggcagcaccggcaaugggugauccaggaguucaagcugugggauaacgagcuucaguacguggaccagcugcucaaagaagauguccgcaauaacucuguuuggaaucaaagauauuuugugauuagcaacacaaccggauacaaugaccgggcugugcuggagcgcgaaguccaguauacacuugagaugaucaagcuggugccucauaacgaauccgccuggaauuaccucaaaggcauucugcaggauagaggccugagcaaguaucccaaccuccugaaccagcuucuggaccuccaacccucucacuccagcccuuaccugaucgccuuccuuguugauauuuaugaggacaugcuggagaaucagugcgauaacaaagaagacauccucaauaaggcucuggagcugugugaaauccucgcgaaggagaaagauaccauucggaaggaauacuggagauacaucgggcgcucucugcaguccaaacauagcacagagaacgacucuccgaccaaugugcagcaauga

SEQ ID NO: 69407 - RNA, 1314 nt, Artificial Sequence
  derived and/or modified sequence opt5 from FNTB__Homo_sapiens__NP_002019
auggccagccccuccucuuucaccuacuauugcccuccgagcuccucucccguguggagcgagccucuguacucccucagacccgaacacgcucgggagcgccugcaggacgauucugucgaaacaguuacgagcaucgagcaagccaagguggaagagaaaauucaggagguguuuuccagcuauaaguucaaccaucuugucccuagacuggugcuccagcgggaaaaacacuuucauuaccugaagcgcggccuuagacagcugaccgacgcguaugagugucucgaugcuucucggcccuggcugugcuacuggauccugcacucccucgaacugcuugacgagccuauuccgcaaaucguugccacagaugugugucaguuccuggagcucugccagagccccgaagggggauuuggcgggggaccuggccaguauccccaucuggccccuaccuacgcugccgucaaugcucuuuguauuaucgggacagaggaagccuacgacaucauuaaccgcgagaaacugcuccaauaucuguacucucugaagcagcccgauggauccuuccucaugcacgugggcggcgaaguugacgugagaagcgcguauugcgccgcuucugucgccucccugaccaauaucauuacaccggaucuuuuugaggggaccgcugaguggaucgcccggugucagaacugggaaggaggcauugggggagugccuggcauggaggcgcacgggggauacacguucugcggccuggccgcucucgugauccugaagcgcgaaagaagccuuaaucugaaaucccuccugcagugggucaccucucggcaaaugcgcuuugagggcggguuccagggaagauguaacaagcugguugacggcugcuauagcuuuuggcaggccgggcuccugccccuucugcaucgggcucuccacgcccaaggagauccugcccuguccaugagccauuggauguuccaccagcaggcgcuucaggaauacauucugauguguugccaaugccccgcuggcgggcuccuggacaaacccggaaagucucgcgauuuuuaucacacauguuacugccuguccggccucagcaucgcccagcauuucggcucuggggcuaugcugcacgacguggugcuuggagucccugagaaugcccugcagccgacccaucccguguacaacaucggcccugacaaaguuauucaggccacaaccuauuuccuccaaaagcccgugccuggguuugaggaacugaaggaugagacgagcgcugaacccgccacagacuga

SEQ ID NO: 69408 - RNA, 5406 nt, Artificial Sequence
  derived and/or modified sequence opt5 from FOCAD__Homo_sapiens__NP_060264
augagcgacgauaucagaaagcgguucgaguuucccaacucccugauucagucucaagcugugggccaccucaucgcugccguccugaaggaaaauggguucagcgagaagauucaccaguccaccaaccagacgccugcccuuaaucugcucugggaaaaaugcuguucugacaacguuguggugcgcacagcuugcugugagggacuggucgcccuuguggcccaggaucacgcugaauuuagcuacguucugaauggcauccucaaccugauuccguccaccagaaauacacacgggcugaucaaggccaucaugcaccuccugcaaaugcaggcucuuaaagagggacagggcggggagaagaacauucagucuaucuauaccauucggaaucauccccacccucugaucacagugcucgaacaccgccccgacugcuggccugucuuccugcaacagcuuaccgccuuuuuccagcagugucccgagagacuggaagugagcugcauucaaaucauggcgccuuuucucugguaccuguacugugagccgucccagcugcaggaguacgccaagcuccggcuggcccuucugaaaguucuccugcaaccccaggugcuuugcgauaaggaccagccuagcauucuggaacagcaaauccuccagcuguguugcgauaucguccccugucuccaggugaaagaccucauucagacaaccgaggccaugauguucaucgaagaggugugccugucucuucugcgccauccugucuuuuggaagauucaacucacgcagaugucccugcagcuucugugcguuagcgaagugucucucaaaaucaccggagaguguuccagcucuauucaucugcuggagcauuccguggaacuccugaaggaggauuuccccgucgaacuugugaucaucggcauugcucugcuccugcugcagacaccggccagccaacagaagccuauccuuaaccucgcgcugaaacugcucuccguuaccgaggaccagaagauucccaaaucuagccugcuucuggugaugccuauccuccagauucuguccagcacagcccuggaagauugcaucucugucgacgaggagggccccuccagacaacagcuugcucucaaucugcuggaaaugauccagcaagaguguuaucgggaugaccaccagaagcucagcuacaaacuggugugccccguuaccucuauguaugggacgauuuuuacagccuggcgcauccuugaagugaugaccgacagcuccgcugccucugauuggcuggccagcgucgagucccuccugccuauuacagcugugaucccggcgcccgccuuccugcuucucgcucaucugcuggucgaagacaagggacagaaccuccaucagauucugaaagugaccaccgagcuugcccaagccgauagcucucagguuccuaaucugauccccgugcucauguuuaagcugggcagaccucuggagcccauucuuuacaacgacauccucuacacacugccgaagcuggggguccacaaaguguguaucggacagauucuccggaucauucagcugcuuggcacgaccccucgccugagagcuguuacacuccggcugcugaccucccuuugggaaaagcaagaucgcguguaucccgagcugcagagauucauggccgucagcgacgugccuucucucuccguggggaaagaaguucagugggagaagcugaucgcgaaagcugccagcauucgggauaucugcaagcagagacccuaccaacauggagccgacaugcucgcugccaucucccagguccugaaugaguguacaaagccugaucaggcuacccccgccgcgcuugugcugcaaggccuccacgcccugugccaggcugaaguggucuguauucgcucuacguggaacgcccugagcccgaaacuuuccugcgacacacggccucugauccucaagacccugucugaacuguucagccuggugcccucccuuaccguuaacacaaccgaauaugagaauuuuaaagugcagguccugagcuuccucuggacacauacgcagaacaaggaucccauuguggcuaaugccgcguacagaucucuggccaacuuuuccgcuggcgaacacaccauccugcaccuuccugagaaaauucgcccggagauccccaucccugaggagcuggacgacgaugaagacguugaggauguggaccucagcguccccgggucuuguuaucugaagcuccugucccuuacaccuccccuggugcugccugcccucgaagaguucuuuaccagccugguuaagcaagagauggugaauaugccccggggaauuuaccauucugcucuuaaaggcggggccagaagcgaucagggaaagacagucgccggcaucccgaacuucauucugaaaauguaugaaaccaauaagcagccugggcucaaacccggacuggcuggcggcaugcucuuuugcuacgacguguccauguaccagagcaaggaugggaagccucugaaccgccuuauggcgucucggggaagauccuucaaacaaacgagccuggcccuggugcacgagguccauauccagcucuccgaauggcaccgcgcuauuuuucugccccaggccuggcuugccuauaugaaucgggcuuaccacgccauccugcagggcagacucggggagcuggaacuccaacugaagcauggaaaagaggagccggaagagguucaguauaagaaaucuaccgcguggcuuugggugcgcgacaugcugacagaugaaaucaccaaggcugccgccaaagagagcccuguggucaagggcaacgcucugcucgcccuguccucucuugcggugguugugagccggcacgaggcuucccugucuagcgacuccgaugggcuccuggaaguccagcccaauuuccucagcaugaaggagugggugucuaugguucuggacacacuucuggugauugucgauucccauuaccagccuagaggccaacugcucagcugguuuuauuacaaaucuuauuccggagaaaacaccgccagcgccaucgcucggucugccgcugccacggcgcugucccuucuggugcccguuuucauuaucagcugcaaggagaaaguggaagagauucucaauaugcugacagcccgccugcccggcaagccuuccgcugacgagagccaggccguccagauccacauggggcucgcucuuggaauguuucugucuagacugugugaagagaaacucagcgacauuuccggccaagaaaugaaccugcuucugaugaagucucucgaugcccuggagaauugcuguuucgacaccagccuggaauacaacacagggugcauccucggagugggccuugugcugucccugaugucucauagcucccagaugcagucucggguccacguugccgcucuccugagaaaacuuagcgcgcacguggaugacuccgggagccagucucgcaccuuccaagaggugcuggccuacacccucuccugugucugcacaagcgcuuuuucugccggcaucauugaggccacggaagcugaggaugugaugaacaaacugcggcugcucguugaaaauucccagcagaccagcggauucgcccuugcgcugggcaacaucgugcaugggcuguccgucuguggacacggcaaggcugaggaccucgggucuaaacugcuuccggccuggauuagaaucgugcugacagaaggaacccccacaaugcucugccuggccgcucugcauggcaugguugcccucguggggagcgagggcgaugucaugcagcuuaaguccgaggcgauucaaaccagccacuuucagggacgccugaaugaagugaucagaacgcugacacaggucaucucuguguccggcguuauugggcuccagagcaacgcuguguggcugcuuggacaucugcaccucucuacccugagcuccucucaaagccgggccuccgucccuaccgacuauucuuaccugcccgagagcuccuucaucggcgccgcuauuggguuuuucaucacaggaggcaaaaaggggccugaaagcgugcccccuucucuccuuaagguugugaugaaaccgauugccaccgucggcgaguccuaucaguaucccccugugaauugggcugcccugcugagcccccucaugcgccugaacuuuggagaggaaauccagcaacuuugucuggagaucauggugacacaggcgcaguccucucagaaugccgcugcccuccugggccuguggguuacgccuccccucauucacagccuuucccugaacaccaagagauaucugcucaucucugcuccgcuguggauuaaacauaucagcgaugaacaaauucuuggguucgucgagaaucugaugguggccguguuuaaggccgcuuccccucucggaagccccgaacugugccccucugcgcugcacggccucucccaggccaugaaacuuccuagccccgcucaucaccuguggucucugcucuccgaggccacagggaagaucuucgaccugcuuccuaacaagauucggcgcaaagaucuggagcucuacaucagcaucgccaagugucugcuggaaaugaccgacgaugacgcuaauagaauugcccaggucacaaaaucuaacaucgagaaggcggcuuuugugaaacucuaucuuguuagccagggacgguucccgcuggugaaucugaccgacaugcucuccgucgccgugcaacaccgcgaaaaggagguucuggccuggaugauucuucauucucuguaccaggcuagaaucgugagccacgccaacacgggcguccucaaacggauggaauggcugcuggagcucaugggcuacauucgcaauguggcguaucaguccaccagcuuucauaacacagcccuugauaaggcucuggacuucuuccugcucaucuuugccaccgcuguuguggccugggcugaucacacagcgccccugcuucuggggcucuccgcgucuuggcugccuuggcaucaggagaacggacccgccggcccuguccccagcuuccuggggagauccccgaugcaccgggugacccuccaagaagugcugacacuucugccuaauucuauggcucuccugcuucagaaggagcccuggaaagaacagacccagaaguuuaucgacuggcuguucagcauuauggaguccccuaaagaagcccucucugcucaaagcagagaucugcugaaggccacgcuccugucccuucgcguccugcccgaguuuaaaaagaaggccguuuggacacgggcuuacggaugguga

SEQ ID NO: 69409 - RNA, 2160 nt, Artificial Sequence
  derived and/or modified sequence opt5 from FOLH1__Homo_sapiens__NP_001014986
auguggaaccugcuccacgagaccgacagcgccguggcuacagccagacggccccgcuggcugugcgcgggcgcucuuguccuggccgggggauucuuucuccugggcuuccuuuuugggugguucaucaaguccucuaaugaagccacgaacauuaccccuaaacauaauaugaaggcuuuucuggaugagcucaaagccgaaaacaucaagaaauuccuguacaauuuuacacagauuccgcaccuggcuggaaccgagcaaaacuuccagcucgccaagcagauccagagccaauggaaggaauuuggccuggacuccguugagcuugcgcauuaugaugugcugcucucuuaccccaauaaaacacacccuaacuauauuagcaucaucaaugaggacgggaacgaaauuuucaauaccucccuguuugagcccccucccccuggauacgaaaacgugucugauaucgucccgcccuucagcgccuuuuccccucagggcaugcccgagggcgaccuuguguauguuaauuacgcuagaacagaggauuucuucaagcuggaacgggacaugaaaauuaacuguagcgggaagaucgugauugcccgcuauggaaaagucuuuagaggcaauaaggugaagaacgcucagcucgccggggcgaaaggaguuauccuguacucugauccugccgacuacuucgcucccggcgugaaguccuauccggauggguggaaccugccuggaggcggcguccagcgggggaauauucucaaccugaauggagccggcgacccccuuaccccuggguaccccgcuaacgaguaugccuaccgcagaggaaucgccgaagcugugggccugcccagcaucccugugcauccgauuggguauuacgaugcgcaaaaacuccuggagaagaugggaggcucugcucccccugacuccagcuggcggggcucucuuaaaguccccuauaauguugggccuggauuuacgggcaacuucuccacccagaaggugaaaaugcacauccacagcacaaaugaagugacccgcauuuacaacgucaucgggacacugagaggagccguggagcccgaccgguacguuauucucggcgggcaucgcgauuccuggguguuuggcggaaucgacccgcagucuggcgccgccgucgugcacgagaucguucggagcuucgggacccugaagaaggaaggauggagaccucgcagaacgauucuguuugcuuccugggaugccgaggaguucggccuccuggggagcacagagugggcggaagaaaauucucggcuucugcaggagagaggaguggcuuauaucaacgccgacuccagcauugaaggcaauuacacccuccgcgucgauugcacaccccugauguauucucuugugcauaaccugaccaaagagcucaagagcccugacgaaggguuugagggcaaaucccuguacgaaucuuggaccaagaaaagccccuccccugaguucagcggaaugccccggaucucuaagcugggcuccgggaaugauuuugaggucuucuuucaaagacucggaauugccagcggccgcgcucgguauacaaagaacugggaaacgaauaaauucucuggguacccgcuguaucacuccguguacgagaccuacgaacuuguugagaaguucuaugacccuauguuuaaauaccaccugacaguggcccaggucagaggaggcaugguguucgagcucgcuaacagcaucguucugcccuuugauugucgcgacuaugccgugguccugcggaaguacgcggauaaaaucuauuccauuucuaugaagcauccccaggaaaugaagaccuacagcguguccuucgacucucuuuuuagcgccgugaaaaacuucacagagaucgcuuccaaguuuagcgaaagacuccaagacuucgauaaaucuaagcacguuauuuaugccccuuccagccauaauaaauacgcuggggagucuuuuccgggcaucuacgacgcccuguucgauauugaauccaaggucgaccccagcaaggcguggggagaggugaaacgccagaucuauguggccgcuuuuaccguccaggccgcugccgagacgcugucugaaguggccuga

SEQ ID NO: 69410 - RNA, 774 nt, Artificial Sequence
  derived and/or modified sequence opt5 from FOLR1__Homo_sapiens__NP_000793
auggcccagagaaugaccacacaacugcuccugcuucuggugugggucgcuguugugggcgaggcccagacgcggaucgcgugggcucgcaccgaacuccugaacgugugcaugaaugccaagcaccauaaagagaagcccgggccugaagacaaacuucacgagcaguguagaccguggcggaagaacgccugcuguagcacaaauaccucccaggaagcucauaaagaugucucuuaccuguaucgcuucaacuggaaucacugcggagagauggcccccgcuuguaagagacauuuuauucaagacacaugccucuacgaguguagcccuaaccugggccccuggauccaacagguggaucaguccuggcggaaggaacgcguucugaaugugccucucugcaaagaggacugugaacaguggugggaggauugcagaaccucuuauacauguaagagcaacuggcacaaaggguggaauuggaccuccggauucaacaagugcgccgucggcgcggccugccagcccuuucacuucuacuuuccuacgccgaccgugcuguguaaugagauuuggacacauucuuauaaaguuagcaacuacucccgggggagcggacgcugcauccagaugugguucgaccccgcucagggcaauccuaacgaagagguggccagauuuuaugcugccgcgaugucuggcgccgggcccugggcugccuggccuuuccuucugucccucgcucugaugcuucuguggcuccugagcuga

SEQ ID NO: 69411 - RNA, 768 nt, Artificial Sequence
  derived and/or modified sequence opt5 from FOLR2__Homo_sapiens__NP_001107008
augguguggaaguggaugccccugcuccugcuucuggucugcguugccaccauguguagcgcucaggacagaacagaucuccugaacgugugcauggacgccaaacaccauaagacgaaaccuggcccggaggauaaacuucacgaccaauguucccccuggaagaagaaugcgugcuguaccgcuucuacaagccaggaacugcauaaggauaccucccggcucuacaacuucaauugggaccacugcgggaaaauggagccugccuguaagcgccauuuuauccaggauacaugccuguaugaauguucucccaaccugggaccuuggauucagcaagugaaucagagcuggagaaaagagcgguuccucgacgucccccugugcaaggaagauugucagcgcuggugggaggacugccacaccucccacacaugcaaaucuaacuggcauagaggcugggauuggaccagcggggugaauaaguguccugccggagcucuuugccggacguuugaguccuacuucccgacccccgccgcucugugugaaggccucuggagccacucuuauaagguuuccaacuacagccgcgggucuggaagaugcauccagaugugguuugacuccgcccaaggcaauccuaacgaggaaguggcgcgguucuaugccgcugccaugcaugucaaugcuggcgagaugcugcacgggacaggaggccuucugcucagccuggcccugaugcuccagcuguggcuucugggguga

SEQ ID NO: 69412 - RNA, 738 nt, Artificial Sequence
  derived and/or modified sequence opt5 from FOLR3__Homo_sapiens__NP_000795
auggacauggccuggcagaugaugcaacugcuccugcuugcucuggugaccgccgcgggcagcgcucagcccagauccgcccgggcccgcacagaucuccugaacgucugcaugaaugcuaagcaccauaaaacgcagccuucuccggaggacgaacuuuacgggcaguguagccccuggaagaaaaacgccugcuguaccgcuuccacaucucaagagcugcacaaggauaccagcagacucuauaauuucaacugggaccauugcggaaaaauggaaccuacauguaagcggcacuuuauccaggauuccugccuguacgaguguucucccaaucugggcccuuggauucgccagguuaaccagagcuggagaaaggaacggauccucaaugugccccugugcaaagaggacugugagcgcuggugggaagauugcagaaccuccuauacauguaagagcaacuggcauaaaggguggaauuggaccucuggaauuaacgagugcccugccggcgcgcuuugcuccacguucgaaagcuacuuuccgacccccgccgcucugugugaggggcucuggucucacuccuucaaggugagcaauuauucucggggauccggccgcugcauccaaaugugguuugacagcgcccagggcaacccuaaugaggaagucgcuaaauucuacgccgcggccaugaacgcuggggcccccuccagaggaauuaucgauucuuga

SEQ ID NO: 69413 - RNA, 525 nt, Artificial Sequence
  derived and/or modified sequence opt5 from FOPNL__Homo_sapiens__NP_653201
auggccaccguggcugagcugaaggccguccucaaagacacacuggaaaagaaaggcguucuugggcaccugaaggcgagaauccgggcugagguguucaacgcccucgaugacgaucgcgaacccagaccuagccugucccaugagaaucuucugauuaacgaacucauccgggaguaccuggaguuuaauaaauauaaguacacggccucugugcugauugcugaaagcggacagccggucgugccccucgaccgccaauuccugauccacgagcuuaacgccuuugaagaguccaaggauaauaccauuccucugcucuauggcauccuggcucauuuccuuagagggacaaaagacggaauccagaacgccuuucugaagggccccucucuccagccuagcgaucccucccuggggcggcagccuucucgcagaaaaccgauggacgaucaucugcggaaggaggaacagaaaagcaccaauauugaggaccuccacguuucccaagcggugaaccgcuga

SEQ ID NO: 69414 - RNA, 909 nt, Artificial Sequence
  derived and/or modified sequence opt5 from FOSB__Homo_sapiens__NP_001107643
auguuccaggccuuucccggcgacuacgauagcggguccagaugcucuagcuccccuucugcugagagccaauaucuguccucuguggacagcuucggauccccgcccaccgccgcggcuagccaggaaugugccggccucggggagaugccuggaucuuuuguccccacaguuacggccaucaccacaucccaggaucugcaguggcuugugcaaccuacccugauuagcucuauggcucagucccagggccagccccucgccagccaaccuccgguggucgaccccuacgauaugccugggacaucuuauuccacccccggaaugagcggcuacuccucuggcggggcuagcggauccggcgggccuagcacaucuggaaccacguccggccccgggccggcccggccugcgcgcgccagaccccggcgcccuagagaagagaccgaaacagaccagcuggaggaggaaaaggcugagcuugaaagcgagaucgccgagcugcagaaagaaaaggagcggcucgaguucgugcugguugcucacaaacccggaugcaagauucccuaugaagaaggcccuggcccggggccccuggccgaggugcgcgaucucccuggaucugcgcccgccaaagaggacggcuuuagcuggcugcuuccucccccgccucccccuccccugccuuuccagaccucccaagaugcucccccgaaccucacagccucucuguuuacccauagcgaaguccaggugcuuggggacccuuuccccguugugaaucccuccuacacgagcucuuuuguccugacauguccugagguguccgcuuucgccggagcccagagaaccagcggcucugaucaaccguccgacccccucaacagcccuucccugcuggcucucuga

SEQ ID NO: 69415 - RNA, 1143 nt, Artificial Sequence
  derived and/or modified sequence opt5 from FOS__Homo_sapiens__NP_005243
augauguucagcggcuuuaacgccgacuacgaggcuuccucuagcagaugcuccucugccagccccgcgggggauucccugucuuauuaccacagcccugcugacuccuucagcucuaugggauccccggugaaugcccaggauuuuuguaccgaccucgccgucagcucugcuaacuucauccccacaguuacggccauuuccaccagcccugaucugcaauggcuugugcagcccgcucuggugucuuccgucgccccuagccagacacgggcgccccauccuuuuggcgugccggcccccuccgcuggggccuauucucgcgcuggaguugugaagaccaugacaggcgggagagcccagagcaucggacggcgcggcaaagucgaacaacucuccccugaggaagaggaaaagagacggauucgcagagagcggaauaaaauggcggccgcuaagugccgcaacagacggcgcgagcugaccgacacacuucaggccgaaaccgaucagcuggaggacgagaaaagcgcucuccagacggaaaucgccaaucugcugaaggagaaggaaaaacucgaguucauucuggccgcucacagacccgcguguaagaucccugaugaccuuggcuuucccgaagagaugucuguggccucccuggaucucaccgggggacugccggaaguugcuacaccugagagcgaggaagccuucacccuuccccugcucaacgacccugagcccaaacccucuguggaaccugucaagagcaucuccucuauggagcugaaaacagaaccguuugaugacuuccuguuucccgccagcucccggccuagcggcucugagaccgcucgcuccgugcccgacauggaucucagcgggucuuucuacgccgcggacugggagccucugcauuccggaagccuuggcauggggcccauggcuacggaacuggagccgcucugcacaccuguggucaccuguacacccuccugcaccgccuauaccucuagcuuuguuuucacauacccugaagccgauuccuuccccucuugugcugccgcucacagaaagggaagcuccagcaaugagccuucuuccgacagccugucuucccccacgcuucuggcccucuga

SEQ ID NO: 69416 - RNA, 408 nt, Artificial Sequence
  derived and/or modified sequence opt5 from FOSL1__Homo_sapiens__NP_001287784
auguucagagacuuuggcgagcccgggccuagcuccggaaacggcgggggauacggcgggccggcccagcccccugcugccgcgcaagcugcccagcagaaguuccaccuggugcccucuaucaauaccaugagcggaucccaggaacuccaauggaugguccagccucauuuucugggccccucuagcuauccucggccgcuuacauacccccaguauuccccuccccagccucgccccggcguuauuagagcccuggggccgccucccggagugcggcgcagaccuugcgagcaacccggcgggcggggagcucccccuucuaaagcccgcgcugaacaggccggcuguggacaggugcaggagccggaagaggggacggauagacuccccgcgggcggcgacuga

SEQ ID NO: 69417 - RNA, 981 nt, Artificial Sequence
  derived and/or modified sequence opt5 from FOSL2__Homo_sapiens__NP_005244
auguaccaggacuaucccggcaacuucgauaccagcuccagagggucuagcggauccccugcccacgcugagucuuacagcuccggcgggggaggccaacagaaguuucggguggacaugccggggucuggaagcgccuucauccccacaauuaaugcgaucacgaccucccaggaucugcaguggaugguccaaccuacaguuauuaccagcaugucuaaccccuauccucgcucccaucccuacagcccucucccgggccuggcuucugugcccggccacauggcccuuccuagacccggggugaucaaaacaauuggaaccacagucggccggcgcagacgggacgaacagcuguccccugaggaagaggaaaagcgcagaauccggcgcgagagaaauaaacucgccgcugccaagugccggaaccgcagacgggagcugaccgaaaaacuucaggcugagacggaagaacuggaggaagagaagucugggcuccagaaggaaaucgccgagcugcaaaaagaaaaggagaaacuggaguuuaugcucguggcgcauggacccguuuguaagauuucuccggaggagcgcagauccccucccgccccuggccugcagcccaugcggagcgggggaggcuccgugggcgcugucgugguuaaacaggaaccccuugaggaagauucuccuagcuccagcucugccgggcuggacaaggcucagagauccgugaucaagccgauuagcaucgccggaggcuucuauggggaggagccccuccacaccccuauugucgugacaucuacccccgcggugacaccuggaaccagcaaucuggucuuuacguaccccuccguucuugaacaagagucuccggccagcccuuccgaaagcugcucuaaagcucaucgccgguccagcagcuccggcgaucagagcuccgacucucugaacagccccacacuccuggcccuguga

SEQ ID NO: 69418 - RNA, 1419 nt, Artificial Sequence
  derived and/or modified sequence opt5 from FOXA1__Homo_sapiens__NP_004487
augcugggcaccgugaagauggaggggcacgaaacaagcgacuggaacuccuacuaugccgauacgcaggaggcuuacucuagcguccccguuuccaauaugaacucuggacucggcagcaugaacuccaugaauaccuauaugacaaugaauaccaugacaaccucugggaacaugaccccugccagcuucaauauguccuacgcgaacccgggacugggcgcugggcuuagccccggagccguggccggcaugccuggcgggucugcuggagccaugaacuccaugacagcugccggcgugacggcgauggggaccgcccugagccccucuggaaugggcgcuaugggggcccaacaggcugccuccaugaauggacucggcccuuaugcggccgcuaugaaucccugcaugagcccuauggccuacgcuccgucuaaccugggcagaucccgggccgggggaggcggggacgccaaaacauuuaagcgcagcuauccccaugcuaaaccucccuacuccuacaucucucuuauuaccauggcgauccagcaggccccuagcaagaugcugacacucuccgaaauuuaucaauggaucauggaucuguuccccuacuauagacagaaucagcagcgguggcaaaacagcauucgccacucucuguccuuuaaugacuguuucgucaaaguggcuagaagcccggauaagccuggaaagggcucuuacuggacccuccaucccgacagcgggaacauguuugagaacggaugcuaucugcggcgccagaaaagauucaagugugaaaaacagccuggcgccggcgggggaggcggguccggaucuggcgggagcggcgccaagggaggccccgagucccggaaagaucccagcggggcuucuaauccuuccgccgacagcccgcuucaccgcggaguucauggcaagacggggcagcuggagggagcgcccgcuccuggccccgccgccucuccucaaacacucgaucacuccggggcuaccgccacaggcggagcuagcgaacugaagacccccgccuccucuaccgcgccgccuaucagcuccggccccggggcccuugcuucugugccugccagccaccccgcucauggacuggccccucacgagucccagcuccaucugaaaggcgacccccacuacagcuuuaaccacccguucucuaucaauaaccugauguccagcucugaacagcaacauaagcucgauuuuaaagcguaugagcaggcccugcaguacuccccuuacgggagcacacuucccgcuucucugccccucggaagcgccuccgucacgaccagaagcccuauugagccgucugcucuggaacccgccuauuaccagggcguguauucccggccuguucuuaauacaagcuga

SEQ ID NO: 69419 - RNA, 1392 nt, Artificial Sequence
  derived and/or modified sequence opt5 from FOXA2__Homo_sapiens__NP_068556
augcacagcgccuccucuaugcugggcgcugugaagauggaggggcaugaacccagcgacugguccucuuacuaugccgagccugaaggauacagcuccgucucuaauaugaaugcgggccucgggaugaacggaaugaauaccuauaugagcauguccgcugccgccaugggcagcgggucuggaaacauguccgcuggcagcaugaauaugucuuccuacguuggcgccgggaugagcccgucucuggcuggaaugucccccggcgccggggcgauggccggaaugggcgggagcgcuggagccgcuggcguggccggcauggggccucaccuuucccccucucugagcccucucggaggccaggcggccggggcuaugggaggccuggcccccuaugcuaacaugaacuccaugagcccuauguacgggcaagccggacuuucuagagcccgggauccgaaaacauaucgcagauccuacacgcaugcuaagcccccuuacagcuauaucucucugauuaccauggcgauccagcagagccccaauaaaaugcucacacuguccgagauuuaccaguggaucauggaccuguucccuuuuuaucggcaaaaucagcagcgcuggcagaacucuauuagacacagccucuccuucaaugauugcuuucugaaggugccccggagcccggacaaaccuggcaagggcucuuucuggacccuucaucccgauuccgggaacauguuugaaaauggauguuaccugcgcagacaaaagcgguucaaaugcgagaagcagcucgcccugaaagaggcugccggcgccgcugggagcggaaagaaagccgcggcuggcgcccaggccucucaggcucaacuuggggaagccgcuggcccugccuccgagacacccgcgggaaccgaaagcccccacuccucugccagcccuugucaggagcacaagcgcggcgggcugggagagcucaagggcacaccggcugccgcucugucucccccugaacccgccccuucccccgggcagcaacagcaggcggccgcucaucugcucggaccgccucaccaucccggccugccucccgaggcccaccuuaaaccugaacaccauuaugcuuuuaaccaccccuucagcaucaauaaccugauguccagcgagcagcaacaucaccauucucaccaccaucaccagccgcauaagauggaccucaaagccuacgaacaggucaugcacuauccuggguacggcucccccaugcccggaagccuggccaugggcccugugaccaacaagacggggcuugaugcuucuccgcuggcggccgacaccuccuacuaucagggaguuuacagcagacccaucaugaacucuagcuga

SEQ ID NO: 69420 - RNA, 1053 nt, Artificial Sequence
  derived and/or modified sequence opt5 from FOXA3__Homo_sapiens__NP_004488
augcugggcagcgugaagauggaggcccacgaccucgcugaaugguccuacuaucccgaggccggggaagucuacucuccuguuaccccggugcccacaauggcgccucugaacagcuauaugacgcuuaauccccuguccucuccuuacccuccuggaggccucccggcuagcccccugccuuccgggccccuugccccucccgccccggcugccccucugggacccaccuucccuggccucggggugucuggaggcagcuccagcucuggcuauggggcucccggacccggccugguccaugggaaagagaugccuaagggauacagacggccgcuggcccacgcgaaacccccuuauuccuacaucagccucauuacaauggccauccagcaagcucccggcaagaugcugacccuuucugaaauuuaccaguggaucauggaucuguuuccuuauuaccgcgagaaccagcagagauggcaaaauuccauucggcauagccucucuuucaacgacugcuuugugaaaguugcccgcucccccgauaagccggggaagggaagcuauugggcucugcacccuuccucuggcaauauguucgagaacggcuguuaccuuagacggcagaaacgcuuuaagcuggaagagaaagugaagaaagggggaagcggcgccgcgacaaccacaagaaaugggaccggauccgccgcuagcacgaccacacccgccgcuaccgucacaucuccuccccagccucccccgccugcccccgaacccgaggcccagggcggggaggacgugggagcucucgauugcggcuccccugcgagcucuaccccguauuucacgggccuggaacugcccggggagcucaagcuggacgccccuuacaacuuuaaucaucccuucagcaucaacaaucuuauguccgaacaaacacccgcucccccuaagcuggauguuggauuuggcggguauggagccgagggcggggaacccggcguguacuaccagggacucuauucucggagccugcuuaacgccuccuga

SEQ ID NO: 69421 - RNA, 978 nt, Artificial Sequence
  derived and/or modified sequence opt5 from FOXB1__Homo_sapiens__NP_036314
augcccagaccuggccggaacaccuacagcgaccagaagccgcccuauuccuacaucucucugacagccauggcuauucaaagcuccccugagaaaaugcucccccugucugaaaucuauaaguucauuauggaucgcuuuccuuacuauagagagaauacgcagcgguggcagaacagccuucgccacaaucuguccuucaacgacugcuuuaucaaaauucccagacggccugaucagccggggaagggaucuuucugggcccuccaucccagcuguggcgacauguuugaaaauggguccuuccugcgcagacggaaacgcuuuaaggugcuuaagagcgaucaccuggcgccuucuaaacccgcugacgccgcccaauaccuccagcagcaggcuaagcugagacuguccgcccucgcugccagcggaacccaucugccucaaaugcccgcggccgcuuauaaccuuggcggggucgcccagccgucuggauucaaacacccuuuugcuaucgagaauaucauugcccgggaauacaagaugcccggcggccuggcguucuccgccaugcagccuguucccgcugccuacccccucccuaaccagcugacaaccauggggagcucucuuggaacaggcuggccgcauguguauggguccgcuggaaugaucgauagcgccacccccauuuccauggccucuggcgacuacagcgcuuauggggugccucugaaaccccucugccacgcggccggacaaacacugccugcuauccccgucccgauuaagccuacccccgccgccgugccugcucugcccgcccucccugcgcccaucccgacgcugcuuuccaauagcccucccucucugucccccaccagcucucagacagcuaccagccaguccucuccugccacaccgagcgagacccucacgucccccgccagcgcucugcacucuguugccgugcauuga

SEQ ID NO: 69422 - RNA, 1662 nt, Artificial Sequence
  derived and/or modified sequence opt5 from FOXC1__Homo_sapiens__NP_001444
augcaggccagauacagcguguccucucccaacagccugggcgucguuccuuaucucgggggagagcaauccuacuaucgggcugccgcggcugccgccggcgggggauacaccgcuaugccggcccccaugucuguguauagccacccugcucaugccgaacaguaccccggcgggauggcgcgcgccuauggaccuuacacaccccagccucagccgaaggacauggugaaacccccuuacuccuauaucgcucugauuacgauggccauccaaaaugcucccgauaagaaaauuacccuuaacggcaucuaccaguucauuauggacagauuuccuuucuaucgggauaauaagcagggcuggcagaacucuauccgccacaaucugagccucaacgagugcuuugucaaagugcccagagacgauaagaagccggggaaaggauccuacuggacacuggacccugauagcuauaauauguucgaaaacggcucuuuucuucggcgcagacggcgcuucaagaaaaaggacgccguuaaagauaaggaggaaaaggacagacugcaucucaaagagcccccuccucccgggcggcaacccccgcccgcgccucccgagcaggccgauggaaaugcuccuggcccccagccgccucccgugcgcauccaggacauuaagaccgaaaacgggacauguccuucucccccucaaccccugagcccggccgcugcccugggaucuggcuccgccgcugcggucccuaaaaucgagagccccgauucuuccagcuccucucucagcuccggcagcucucccccugggucccugccgagcgccagaccccuuucucuggacggagcugacagcgccccucccccucccgccccuuccgcucccccgccucaccauucucagggcuuuagcguggauaauauuaugaccucccuccgggggagcccccagucugccgcggcugaacuguccagcggacuucuggccucugccgcugccuccagccgcgcuggcaucgccccuccccucgcgcugggggccuacuccccgggacaaucuagccuguauuccucuccuugcagccagacauccagcgcuggcuccuccggcgggggaggcgggggagccggcgcugccgggggcgcgggaggcgccgggaccuaccacuguaaccuccaggcuaugagccuguacgccgcuggagagagaggcgggcaccuucagggagcccccggcggggccggcggaucugcuguugacgauccucugcccgacuauucccugcccccugugacgagcucuagcuccagcucucucucccauggcgggggaggcgggggaggcgggggcggacaagaggcgggccaccauccggccgcucaccaggggcggcuuaccagcugguaccugaaucaggccggaggcgaucucgggcaccuggccuccgcugccgcggcugccgccgcugccggauaucccggccagcaacagaacuuccauucugucagagaaauguuugagagccagcgcauugggcugaauaacuccccugugaacggcaauucuagcugccagauggcguuccccuccucucaaagccucuaccggacauccggagcuuuuguguaugacuguagcaaguucuga

SEQ ID NO: 69423 - RNA, 1506 nt, Artificial Sequence
  derived and/or modified sequence opt5 from FOXC2__Homo_sapiens__NP_005242
augcaggccagauacagcguguccgaccccaacgcucugggcgucguuccuuaucucucugagcaaaauuacuaucgggccgcggggagcuacggaggcauggcuuccccgauggggguguauucuggacaccccgaacaguacagcgccggcauggggcgcuccuaugccccuuaccaucaccaucagcccgcugccccuaaggaucuggugaaacccccuuacucuuauaucgcucuuauuaccauggccauccagaacgcgccggagaagaaaauuacacugaauggaaucuaccaauucauuauggacagauuucccuucuaucgggaaaacaagcagggcuggcagaauagcauccgccacaaccucucccugaaugagugcuuugucaaagugccuagagaugacaagaagcccggcaaagggagcuacuggacgcuugauccugacucuuauaacauguucgaaaauggauccuuucugcggcgcagacggcgcuucaagaaaaaggauguuagcaaagagaaggaggaaagagcccaucucaaggagcccccgccugcugccucuaaaggcgcucccgccaccccucaccuggcggacgcccccaaggaagcugagaaaaagguggucaucaaauccgaggccgcuagccccgcccugccugugauuacaaagguugaaacccucucuccggaguccgcccugcaggggagcccccgguccgcugcgucuaccccugccggaagccccgauggcucccuuccugaacaccaugcugccgcccccaacgggcugccgggauuuagcguggagaauaucaugacacuccgcacaucuccucccggcggcgaacuguccccuggggcuggcagagccggacuugucgugcccccucuggcgcuccccuacgcugccgccccgccugcugccuaugggcaacccugugcucagggacuggaggccggcgcggccgggggauaccagugcagcaugcgggcuaugucucuguacaccggcgccgagcgccccgcucacaugugugugccuccggcccucgacgaagcgcugagcgaucaucccuccggcccuacgucuccccuuagcgcccugaaccucgcugccgggcaggagggagcucuggccgccaccggccaccaccaucaacaccaugggcaccaucacccucaggcucccccucccccgccugcgccccagccucaacccacaccgcagccuggagccgcugccgcccaggcugccuccugguaucuuaaucacagcggcgaccugaaccaucuccccgggcacaccuucgcggcucagcaacagacauuuccuaaugucagagaaauguucaacucucaucggcugggcauugagaacuccacccugggagaaagccagguuucuggcaaugccuccugccagcuccccuacagaagcacgcccccucuguaucgccacgccgcuccguacuccuaugauuguacaaaauacuga

SEQ ID NO: 69424 - RNA, 1398 nt, Artificial Sequence
  derived and/or modified sequence opt5 from FOXD1__Homo_sapiens__NP_004463
augacccugagcacagagauguccgacgccucuggccucgcugaagagacggauaucgacguggucggggaaggagaggaugaagaggacgaggaagaggaagaugacgaugagggcgggggaggcgggcccagacuggccguuccugcgcagcggcgcagacggcgcagaagcuacgcuggagaggacgaacuugaggaucuggaagaggaagaggacgaugacgauauucuccuggccccgcccgccggcggcuccccugcucccccugggcccgccccugcugccggagcgggcgccgggggaggcgggggaggcggcggggcuggaggcgggggaucugccggcagcggggcuaagaacccgcuugugaaacccccuuauuccuacaucgcccugauuaccauggcgauccuccaaucucccaagaaacggcugacacugagcgagauuugcgaguucaucuccggacgcuuuccuuauuacagagaaaaguuccccgccuggcagaauagcauccggcacaaccucucucugaaugacuguuuugugaaaauuccgcgcgaaccuggcaaccccggcaaggggaauuauuggacccuugacccugaguccgcugauauguucgacaacggcagcuuucugagacggcgcaagagauucaaacggcagccccuccugcccccuaaugccgcugccgccgaaucucuucugcuccgcggagcuggggcggccggaggcgcuggggauccggccgccgcugccgcgcuguuucccccugcucccccucccccgccucaugccuacggcuauggacccuacggcugcggguacggacugcagcucccucccuaugccccucccuccgcucuguucgccgcugccgcggccgcugccgcugccgcggccuuucacccgcauagcccucccccucccccgcccccucacggcgcugccgcugagcuugccagaacagccuucggguaccggccccauccucugggagcugcgcuccccggcccucugcccgccucugcugccaaggccgggggcccgggagcuuccgcccuugcgagaagcccuuuuuccaucgagucuauuaucggcgggagccugggacccgcugccgccgcugccgcggcugcccaagccgcugccgcugcccaggcguccccuagccccucuccggucgccgcuccucccgccccuggcuccagcgggggaggcugugcugcccaggccgcuguggggcccgcggccgcucucacccgcucucugguugccgccgcugccgcggcugccagcuccgugucuagcuccgccgcucugggcacacuccaccagggaaccgcccugagcucugucgaaaacuucacggcgcggauuuccaauugcuga

SEQ ID NO: 69425 - RNA, 1122 nt, Artificial Sequence
  derived and/or modified sequence opt5 from FOXE1__Homo_sapiens__NP_004464
augaccgccgagagcgggcccccuccgccccagccugaagugcuggcuacagucaaggaggaaagaggcgagacggccgcgggagcuggcguucccggggaagccaccggacggggcgccgggggacgcagacggaaacgcccucuccaaagaggcaagcccccuuacuccuauaucgcucugauugccauggcuaucgcccacgcgccggagcggcgccuuacacugggcgggauuuacaaauucaucaccgagagauuucccuucuaucgggacaacccuaagaaauggcaaaauucuauucgccauaaccucacacugaaugauugcuuucuuaagauccccagagaagccggacggccuggcaaggggaacuacugggcucuggaccccaaugccgaggauauguucgaaagcggauccuuucuccgcagacggaaacgcuucaagagaucugaccugagcaccuauccggcuuacaugcacgaugccgcggccgcugccgcugccgccgcugcggccgcugccgccgcugccaucuuuccuggcgcggugcccgcugcccggccucccuaucccggggccguguacgcuggauacgccccuccgucccuggcugcgcccccucccgucuauuacccugccgccucucccggcccguguagaguguucggccucguuccugagcgcccccugagcccugagcuugggcccgcuccuuccggacccggcgggagcugcgccuuugcuucugccggagcgccggccacaaccacgggcuaucagccugcuggguguaccggagcccggcccgcuaaccccuccgccuacgccgcugcguaugccggcccugacggcgcuuacccgcagggggccggaagcgccauuuucgcugccgcgggcagacuggcugggcccgccucuccucccgccggaggcuccagcgggggcguggaaacaaccgucgauuuuuauggacgcacaucuccuggccaguucggggcucucggagccugcuacaaucccggcgggcagcugggaggcgcguccgcuggggccuaccaugcccggcacgcugccgcuuauccuggcggaaucgacagauuugugagcgccauguga

SEQ ID NO: 69426 - RNA, 1140 nt, Artificial Sequence
  derived and/or modified sequence opt5 from FOXF1__Homo_sapiens__NP_001442
augagcuccgcgcccgagaagcagcaaccuccgcacggcgggggaggcgggggaggcgggggaggcggcgcugccauggaccccgcgucuagcgggccuuccaaagcuaagaaaaccaacgccggaaucagacggcccgaaaagccucccuacucuuauauugcccugaucgugauggcuauucagagcuccccuacaaaacgccucacgcugucugagaucuaccaguuccuucagagcagauuuccguucuuucggggcuccuaucaaggguggaagaauagcguccgccauaaccugucucucaaugaaugcuucauuaagcugcccaaaggacuuggcagaccugggaagggacacuacuggaccaucgaucccgccuccgaguuuauguucgaagagggcagcuuucggcgcagaccucggggcuuccgcagaaaaugucaggcucugaagcccauguauucuaugaugaacgggcucggauuuaaucaucugccggacacauacggcuuccagggguccgccggaggccugagcugcccucccaacucucucgcgcuggaagggggacuuggcaugaugaauggccaucugccugggaacguugauggaauggcccuccccucccacagcgugccccaucugccuuccaauggcgggcacucuuauaugggaggcugugggggcgcugccgcuggagaguacccgcaccacgacagcuccgugcccgccagcccucuucugcccaccggcgccgggggagucauggagccucaugcgguguacucuggcuccgcugccgcuuggcccccgagcgccucugccgcucucaacagcggggcguccuauaucaaacagcaaccucugucucccugcaauccugccgcuaacccccugagcggaucccucagcacacacucucuggaacagccuuaccuucaccaaaauucccauaacgcccccgccgagcugcagggcauuccgcgguaucacagccagucuccuuccaugugugaucgcaaggaguuuguuuucagcuuuaaugcuauggccuccucuagcaugcauuccgccgggggcggaucuuacuaucaccaacaggugaccuaccaggacaucaagcccugcgucauguga

SEQ ID NO: 69427 - RNA, 1335 nt, Artificial Sequence
  derived and/or modified sequence opt5 from FOXF2__Homo_sapiens__NP_001443
augaccacagagggcgggcccccuccggcuccccugagacgggccugcagcccugugcccggagcccuccaggcggcucugauguccccucccccugccgccgcugccgcugccgcggccgcuccggaaacgaccucuagcuccucuagcuccucuagcgccuccugugcuagcagcuccucuucuuccaacagcgccucugcgcccuccgccgcuugcaagagcgccggcgggggaggcgcuggggccggauccggcggcgccaaaaaggcuucuagcgggcuucgcagaccugagaaacccccuuacuccuauaucgcgcugauugucauggccauccaaagcucucccuccaagcggcucacacugagcgaaauuuaccaguuccuucaggcucgcuuuccguucuuuagaggagccuaucagggcuggaaaaauucuguucggcacaaccugagccucaaugaguguuucaucaagcugccuaaggggcugggacgccccggcaaagggcauuacuggaccauugacccugccuccgaauuuauguucgaggagggaucuuuuagacggcgccccagaggcuuccggcgcaagugccaagcucucaaacccauguaucacagaguggugagcggccugggguuuggagccucccuucugccucagggcuucgauuuucaggcgccgcccagcgcuccucucgggugucauucucagggaggcuacgggggacuggacaugaugcccgccggcuaugaugccggcgcuggggccccuucccacgcucauccccaccaccaucaccaucaccacgucccgcauaugagcccuaaccccggaucuacauacauggccuccugcccugugcccgcgggcccugggggaguuggcgccgcugggggcggaggcgggggagacuacggccccgauagcuccucuagcccggugccuuccucucccgccauggcuagcgccaucgaaugucacucccccuauaccagcccugcggcccauuggucuuccccgggggcuagccccuaccuuaagcaaccucccgcccugacaccuucuuccaaucccgcugccagcgccggacuccacucuagcauguccagcuauucucuggagcaguccuaccugcaucagaacgcucgggaagaccucagcgucggccugccucgcuaucagcaccacuccacccccgugugcgauagaaaagacuucguucuuaauuuuaacgggaucucuagcuuccauccguccgcgucuggcagcuacuaucaccaucaccaccaauccgugugucaggauauuaagccuugcgucauguga

SEQ ID NO: 69428 - RNA, 1470 nt, Artificial Sequence
  derived and/or modified sequence opt5 from FOXG1__Homo_sapiens__NP_005240
augcuggacaugggcgauagaaaggaggugaaaaugauccccaagagcuccuucucuauuaacagccucgucccugaagccguucagaaugacaaccaccaugcuucccacgggcaucacaauucucaucacccgcaacaccaucaccaucaccaccaucaccaucaccaucccccucccccugccccucagcccccgcccccuccccagcagcaacagccucccccgccucccccucccgcgccccagccuccgcagacccggggagcucccgccgccgaugacgauaaaggcccucaacagcugcuucugcccccucccccgccucccccucccgcugccgcucucgacggggccaaggcggauggacugggcgggaaaggagagccuggcggcgggcccggagaacuugccccggugggcccugacgagaaggaaaagggggcuggagccggcggggaggagaaaaagggagcuggcgaaggcgggaaagauggagagggcgggaaggaaggagagaaaaagaacggcaaguacgagaaaccucccuuuagcuauaaugcccugaucaugauggcgauucgccagucccccgaaaagagacucacacugaacgggaucuacgaguucauuaugaaaaauuuuccguauuaccgggaaaacaagcagggauggcaaaauucuauccgccacaaccugagccucaauaaaugcuucgugaagguccccagacacuaugacgauccuggcaaaggcaacuacuggaugcuggaccccuccagcgaugacguguuuaucgggggaacgaccggcaaacuucggcgcagaucuacaaccucccgggccaagcuggcuuucaagcgcggggccagacucacaagcaccggacugacauuuauggaccgggcuggcucucuuuauuggccuaugucccccuuccugagccuccaucacccucgcgccucuuccacccugagcuacaaugggacgaccuccgccuaccccucucauccgaugccuuauagcuccguucugacacagaacagccucggcaauaaccacucuuuuuccaccgcuaacggacugagcguggauagacuugucaauggcgagauucccuacgcgacacaccaucugaccgccgcugcccucgccgcuucugugccuugugggcugagcguucccugcuccggaacguauucucuuaacccguguagcgugaaucugcucgccggccagacauccuacuucuuuccucacgucccccauccuagcaugaccucucaauccagcacaucuauguccgcgcgggcugccagcuccucuaccagcccccaggcccccuccacccugccuugcgaaucucugcgcccgagccuccccuccuucacaacggggcugagcggaggccuuucugacuauuuuacccaccagaaccagggguccagcucuaauccucugauccauuga

SEQ ID NO: 69429 - RNA, 1098 nt, Artificial Sequence
  derived and/or modified sequence opt5 from FOXH1__Homo_sapiens__NP_003914
augggccccugcagcggguccagacugggaccuccggaggccgaaucucccagccagccucccaagcggcgcaaaaagagauaccuccggcacgacaaaccucccuauaccuaccuggcuaugaucgcccuugugauucaagcggcuccuucccgcagacugaagcucgcccagaucauucggcagguccaggccguuuucccguuuuuccgcgaggauuaugaaggcuggaaagacucuaucagacauaaccugagcuccaaucgguguuuucgcaaggugcccaaggauccugcuaaaccccaagccaaggggaacuucugggcuguggacgucucucuuauuccugccgaggcgcugagacuccagaauacagcccugugccggcgcuggcagaacggaggcgcuagaggggccuuugcuaaagaucugggacccuacgugcuccacggccggccguaucgcccucccagcccucccccucccccguccgaaggcuucagcaucaagucucugcuugggggauccggcgagggggcccccuggccuggacuggcgccccagagcucuccuguucccgccggcacgggaaauuccggggaggaagcugugccgaccccuccccucccuagcucugagagaccccuguggccucuuuguccccugccgggcccuacacgggucgaaggcgagaccgugcaagggggagccaucggccccuccacacucagccccgagccuagagcuuggccgcugcaucugcuccaggggaccgccguucccggaggccgcuccucugggggacaccgggccagccuguggggccagcuuccuacauccuaccugcccauuuauaccccuaacguggucaugccccucgcuccucccccgacgagcugcccucagugucccucuaccuccccugcguacuggggcguggcccccgaaacaagagggccgccuggacugcuuugcgaccuggaugcucucuuucaaggcgugcccccuaauaaaagcaucuacgacgucuggguuucucauccccgcgaucuggccgcccccgggccuggauggcugcucagcugguguucccuguga

SEQ ID NO: 69430 - RNA, 1137 nt, Artificial Sequence
  derived and/or modified sequence opt5 from FOXI1__Homo_sapiens__NP_036320
augagcuccuucgaccugcccgccccuucuccgcccagaugcagcccucaguuucccuccaucggccaggagccucccgaaaugaaccucuacuaugagaauuucuuucacccucagggggugccgucuccccagcggccuagcuucgaaggaggcggggaguacggagcuacccccaacccuuaucugugguuuaauggccccacaaugacgccgccucccuaccuuccugggcccaacgccucccccuuccugccucaggcguauggaguccaacgcccgcuccugcccucuguuagcggccuuggcggguccgaucugggauggcucccuauucccagccaggaggaacugaugaagcuggugagaccucccuacucuuauuccgcucucaucgccauggccauucauggcgcuccggacaaacggcugacccuuagccagaucuaccaguacguggccgauaauuuuccuuucuauaacaagucuaaagcuggguggcaaaauuccauucgccacaaccugagccucaaugacuguuuuaagaaaguccccagagaugaggacgauccuggaaagggcaacuacuggacacuggaccccaauugcgaaaagauguucgauaacgggaauuuucggcgcaaaagaaagcggaaaucugacguguccagcuccaccgccucucuugcgcuggagaagacagaaagcucccucccuguugauagccccaaaaccacagagccgcaggacauccuggauggagccucuccuggcggcaccacguccagccccgagaagcgccccucuccuccgcccagcggggcuccuugucugaacuccuuccucucuagcaugaccgccuauguguccggaggcagccccacaucucauccucuggucacccccgggcuuuccccugaacccagcgacaagacaggacaaaauucucugaccuuuaacuccuucagcccgcucacgaaccuguccaaucacucuggcgggggagacugggcuaacccuaugcccacaaauaugcuuagcuacggcggcuccgugcugucucaguucagcccucauuuuuauaacuccguuaauaccagcggggugcucuaccccagagagggaacagaagucuga

SEQ ID NO: 69431 - RNA, 1266 nt, Artificial Sequence
  derived and/or modified sequence opt5 from FOXJ1__Homo_sapiens__NP_001445
auggccgagagcuggcugagacucuccggcgcugggcccgccgaagaggcgggaccugaaggcgggcuggaggaaccggacgcucuugaugacucucugaccagccuccaguggcugcaagaguucuccauccuuaacgccaaggcccccgcucugccucccggaggcacagauccucacggguaccaucaggugcccggaucugccgcuccuggcagcccgcucgccgcggaccccgccugccugggccagccucacacgcccgggaaaccuaccuccucuuguacaagccgguccgcucccccgggacugcaggccccucccccugaugacgucgauuaugcuaccaauccccauguuaagcccccuuacagcuaugccacacucauuugcauggcgaugcaagccucuaaagcuaccaagaucacacuguccgccauuuacaaauggaucaccgacaacuuuuguuauuuccgccacgcugauccgacguggcagaauagcauuagacauaaccuuucucugaauaagugcuuuaucaaggugccccgggagaaagacgaaccuggcaaagggggauucuggcgcaucgauccccaguacgccgagagacuccuguccggcgccuuuaagaagcggcgccuuccucccgugcacauucacccggcuuucgcgagacaggccgcucaagaaccuagcgccgucccccgggccgggccucugaccgugaacacagaggcucagcagcuccugcgcgaguuugaagaggccaccggagaagcgggcuggggcgcuggggagggaagacugggccauaaacggaagcagccccucccuaagcgcguugccaaagugcccagaccgccuucuacacugcuucccacccccgaggaacaaggggagcuggaaccucucaagggaaauuucgacugggaggccaucuuugaugcuggcacgcuugggggagaacugggcgcccuggaggcucucgaacuguccccgccccugagcccugccucccacgucgacguggaccucacaauucauggccggcacaucgauugucccgcgaccugggggccuucuguugagcaggccgcugacagccuggauuucgacgagacauuucuugccaccuccuuccugcagcaccccugggaugaaagcggaucuggcugccucccucccgagccgcuguuugaagcuggggacgccacccuugcguccgaucugcaagacugggccagcgugggagcuuuccucuga

SEQ ID NO: 69432 - RNA, 1725 nt, Artificial Sequence
  derived and/or modified sequence opt5 from FOXJ2__Homo_sapiens__NP_060886
auggccagcgaccuggaguccucucucaccagcaucgauuggcugccccagcuuacacugagagcuacgauugaaaagcucggcuccgccucucaagcggggccuccgggaagcucccggaaaugcucucccggcagcccuaccgaccccaacgcuacacuguccaaggaugaggccgccgugcaccaggacgggaaaccucgcuacagcuaugcuacccuuaucacauacgccauuaauucuucccccgcuaagaaaaugacccugagcgaaaucuauagauggauuugugauaacuucccuuacuauaagaaugccggaaucggcuggaagaacucuauccggcauaaucucucccugaacaaaugcuuucgcaaggucccgagaccccgggacgauccugggaaaggaagcuacuggacaauugacaccugucccgauaucucucgcaagagacggcacccucccgacgaugaccugucccaggauagcccggagcaggaagcguccaaaucuccucgcggcggcguugccgggagcggagaggcuucccugcccccugagggcaauccccaaaugagccuccagucucccacguccauugccagcuauucucaggggaccggaagcguggacggcggggcuguggccgcgggagccuccggcagagaaucugcugagggcccuccgccccuuuacaacacaaaucaugacuucaaguuuagcuacuccgaaaucaacuuccaggaucugagcuggucuuuucggaaucucuauaaguccaugcuggagaaaucuagcuccagcucccaacacggguucucuagccuucugggagacauuccucccuccaacaauuacuauauguaccagcagcagcaaccucccccgccucagcagcaacagcagcagcaacagcccccucagcccccuccccagcaaucucagccgcagcagcaacaggccccugcucagggccccagcgccgucgggggagcucccccucuccauaccccguccacagauggcugcacgcccccugggggaaagcaggccggcgcggagggcuaugggcccccucccgugauggccaugcacccucccccgcugcaacacggaggcuaccauccucaccagcaucacccccacagccauccugcucagcaacccccgccuccccagccucaggcccaggggcaagcccccaucaacaauaccggauuugcuuuccccucugacugguguuccaacauugauagccugaaagaaucuuuuaagaugguuaaccgccucaauugguccagcaucgagcagucucaguucagcgaacugauggagucccuuagacaggccgaacagaaaaacuggacacuggaccagcaccauaucgcgaaucucugcgauagccugaaccacuuucuuacccagacaggccaugugccuccgcaagggggcacccaccggcccccugcucccgcccgcauugccgacucuugugcucugaccuccggaaagcaagagagcgccaugucccaggucaauucuuauggccacccucaggcuccccaucucuacccugggccgagccccauguacccuauccccacacaagauuccgccggauauaacagaccugcgcaccauauggugccccggccgucuguuccuccucccggcgccaaugaggaaauucccgacgauuucgacugggaccugaucacguga

SEQ ID NO: 69433 - RNA, 2202 nt, Artificial Sequence
  derived and/or modified sequence opt5 from FOXK1__Homo_sapiens__NP_001032242
auggccgaggugggcgaagacagcggggcuagagcccugcucgcgcugcgguccgcucccugcucuccuguccuuugugccgccgcugccgcugccgcguucccggccgcugcgcccccucccgcuccugcccagccccaaccuccgcccggaccucccccucccccgccucccccucugccucccggcgcgaucgccggggcuggaagcuccggcgggucuagcggaguuuccggcgauucugccguggcuggcgccgccccugcucucguggcggccgcugccgccagcguccgccaguccccggggcccgcucuggccagacuugagggacgggaauuugaguuccugaugcgccagccuagcgugaccauuggcagaaacucuucccaggggagcguugaccucucuaugggacuguccagcuuuaucucucggcgccaucugcaacucuccuuccaggaaccccacuuuuaccugagaugccuuggcaagaaugggguguucgucgauggagcguuucagcggcgcggcgcuccugcccugcagcuccccaaacaauguacauucagauuuccgagcacggccauuaagauccaguucaccucccuguaucacaaagaggaggcuccugccucuccccuucggccucuguacccccagauuagcccucucaagauccauauccccgaaccggaccugcgcuccauggugagcccuguucccucucccacaggcaccauuuccgugccuaacagcugcccggcuucucccagaggggccggaagcuccucuuaucgguuuguccagaaugugacaagcgaucugcaacucgcggccgaguucgcugccaaagcugccuccgaacagcaggcggacaccagcggcggggauucuccuaaggacgaguccaagcccccuuuuagcuacgcccaacugaucgugcaggcuauuucuuccgcccaggaucgccagcuuacacugagcggaaucuaugcucacauuaccaaacauuaccccuauuacagaacggccgacaagggcuggcaaaacuccauccggcacaaucucucucugaacagauacuucauuaaagucccucgcagccaggaggaacccgggaagggauccuucuggcggaucgauccggccucugaggcuaaacuuguugaacaggcguuuagaaagcgccggcagagaggcgugagcuguuuccgcaccccuuuuggcccccuguccagccggucugccccugcuucccccacacacccggggcucaugagcccuagaucuggaggccugcaaacccccgagugccugucccgcgaagggagcccuaucccccaugaccccgaguucggaucuaagcucgccagcgugccugaguaucgguacucccagagcgccccgggcucucccgucuccgcucagccugugauuauggccguucccccuagacccagcucccugguggcgaaaccugucgcuuauaugccggccucuaucgugacaagccagcaacccgccgggcacgcuauucauguugugcagcaggccccuaccgucacgauggugcgcgucgugacaaccuccgccaauucugcuaacggcuacauccuuacaagccagggagccgccggcgggucccacgaugcugccggagcugccguucuggaccucggcucugaagcgcgggggcuggaggaaaagcccaccauugccuuugcuaccaucccugccgcuggaggcgugauccaaacagucgccagccagauggcccccggggugccgggccacacgguuaccauucuucagccugcuacacccgugacccugggacaacaucaccuccccgucagagcggugacacagaauggcaaacaugccgugccuaccaacucccuggcugggaaugccuaugcccugacgagcccccuccagcugcuugcuacacaggccucuuccagcgcgccuguugucgugacccgggugugugaggucggaccgaaggaacccgcugccgccguggcugccaccgcgacaaccacacccgcuacggccaccacagccucugcuuccgccagcucuaccggcgagcccgagguuaaacgcuccagaguggaggaaccuagcggggcugucacaacccccgccggagugaucgcggccgcuggcccgcaagggccuggcacgggagaauga

SEQ ID NO: 69434 - RNA, 1983 nt, Artificial Sequence
  derived and/or modified sequence opt5 from FOXK2__Homo_sapiens__NP_004505
auggccgcugccgcggcugcccugagcggcgccgggacacccccugcuggaggcggggccggaggcgggggagcuggcggcgggggauccccgcccggcgggugggccguggcgagacucgagggacgggaguucgaauaccugaugaagaaacgcucugucacaaucggcagaaacagcucccaggggucuguugacgugagcaugggacacuccucuuuuauuagccggcgccaucuugaaaucuucacgccucccggcggcgggggacacggcggggccgcuccugagcugcccccugcccaaccgagacccgaugcuggaggcgacuuuuaucuccggugccuggggaagaauggaguguucgucgauggcguguuucagcgcagaggcgccccuccccuucagcugccucggguuuguaccuuccgcuuucccuccacaaacauuaaaaucaccuucacagcgcucagcucugaaaagagagagaaacaggaggccuccgaaagcccggugaaggcuguccaaccucauauuucuccccugaccaucaauaucccugacacaauggcccaccugauuagcccccuccccuccccuaccgggacgaucucugcugccaacuccugcccgagcucuccccggggagccggcuccagcggguacaaggugggacgcguuaugccuuccgaucugaaucuuauggcugacaacagccagcccgagaaugaaaaagaggcgucuggcggggauuccccuaaggacgauagcaaacccccguauucuuacgcccagcugauugugcaggcuaucaccauggccccugacaagcaacucacacugaacggcauuuauacccauaucaccaaaaauuaccccuauuacagaaccgccgauaagggauggcagaacagcauucggcacaaucuuucccugaaccgcuacuuuaucaaggucccuagaucucaggaggaacccggcaaagggagcuucuggcggaucgacccugcuuccgagagcaagcucauugaacaggccuuuagaaaacgccggcccagaggagugccguguuuccgcacgccucugggcccccugucuucccggagcgcgcccgcuucuccuaaucacgccggggugcucuccgcccauagcuccggagcucaaacaccggagucucugagcagagaaggcucccccgccccucuugagcccgagccuggggcugcccagcccaagcuggcggucauccaggaagcccgcuuugcucaaucugccccuggcagcccccucuccagccagccgguucugauuaccgugcagcggcagcuuccucaagcuaucaaacccgugacauauaccgucgccaccccugugacaacgucuaccucccagcccccgguugugcagacaguccacgugguucaucagauuccugcggugagcgucaccucuguggccggacuggcucccgccaacacauacaccgucuccggccaagcugugguuacgccugccgccgugcucgcuccucccaaggcggaggcccaggaaaauggggaucacagagaggucaaagugaagguugaacccaucccggcuaucggacacgccacacugggcaccgccagccgcauuauccagaccgcucagacaacccccgugcaaacagucacgauugugcagcaggccccucuggggcagcaucaacuccccaucaagaccgugacacagaacggaacccacguugcgucugucccuacagcugugcauggccaggugaacaaugccgccgcuagcccccugcacaugcuugccacccaugcguccgcuagcgccucucugccuacgaaacggcacaacggggaccaaccggagcagcccgagcucaagagaauuaaaaccgaagacggcgagggaaucgucaucgcccuguccguggauacaccucccgcugccguucgcgaaaagggcgugcagaauuga

SEQ ID NO: 69435 - RNA, 1038 nt, Artificial Sequence
  derived and/or modified sequence opt5 from FOXL1__Homo_sapiens__NP_005241
augagccaccuguucgaccccagacucccugcccuggcugccuccccgaugcuuuaccuguauggccccgagcggccugggcucccccuggcguuugcuccugccgccgcucuugccgcuucuggacgcgccgaaacaccccagaagccuccguacagcuauaucgcgcugauugccauggcuauccaagaugcccccgagcagagagugacccucaacggcauuuaccaguucaucauggaccgguuuccuuucuaucaugauaaucgccagggguggcaaaacuccauuagacacaaucugucucugaacgacugcuuugucaaaguuccccgggaaaagggacgcccuggcaaagggagcuacuggacgcucgaucccagaugucuggacauguucgagaauggaaacuaucggcgcagaaagcggaaaccgaagccuggccccggcgcuccugaagccaagcgccccagagcggagacccaucagcgguccgccgaggcucagcccgaagccgggucuggagcuggcgggagcggaccugccaucucccgccuucaggccgcuccggcgggccccagcccucugcucgaugggcccucuccucccgccccgcugcacuggccuggaacagcuucccccaaugaggacgccggcgaugccgcucaaggcgccgcggcuguggccguggggcaggccgcuagaaccggagacggcccugggagcccccuucggccugccucuagauccagccccaaaucuuccgauaagagcaaauccuuuucuaucgacagcauucuggcuggaaagcagggccagaaaccgccuuccggggaugaacuccugggaggcgccaagcccggccccgggggacgccugggcgcgagccuccuggccgcuucuuccagccuucggccuccguucaacgccucucugaugcucgacccccauguccaagggggauuuuaccagcugggcaucccuuuccuuagcuacuuuccccuccaggugccugacacaguucugcacuuccaauga

SEQ ID NO: 69436 - RNA, 1131 nt, Artificial Sequence
  derived and/or modified sequence opt5 from FOXL2__Homo_sapiens__NP_075555
augauggccagcuaccccgagccugaagacgcugccggcgcgcugcucgcuccggagaccgggagaacagugaaggaacccgagggaccucccccuucccccggcaaagggggaggcgggggaggcggcacggccccugaaaagccggaucccgcccagaaaccucccuauucuuacgucgcucugaucgccauggcuauucgggagagcgccgagaagcgccuuacccuguccgggaucuaucaauacauuaucgcgaaauucccuuuuuaugaaaagaacaagaaaggauggcaaaauucuauuagacacaaccucagccugaaugagugcuucaucaagguuccccgggaaggcgggggagagcgcaaaggcaacuacuggacacuugacccggccugugaggauauguuugaaaaggggaauuauagacggcgcagacggaugaaacgcccuuucagacccccucccgcucauuuucagcccggaaagggccuguucggcgccgggggagcugccggcgggugcggaguggcgggcgccggggcugacggauacggcuaccucgccccuccgaaguaucugcaguccggcuuucugaacaauucuuggccccucccucagcccccuagccccaugccguacgcuuccugucagauggccgccgcugcggccgcugccgccgcugccgcggcugccgccgggccuggaagccccggcgcugccgcuguggucaaagggcuggccggaccugcggccucuuauggccccuacacccgggugcaguccauggcccuuccucccgggguugugaacagcuauaauggccugggaggcccgccugccgcucccccucccccgccccacccucauccccacccucaugcccaccaccuccaugcggccgcugcucccccucccgcuccgccucaccauggggccgccgcucccccucccggacagcugucuccggcguccccugccacagcugcucccccugcccccgcccccaccagcgccccuggccuucaauucgcgugcgcucgccagccggagcuggccaugaugcacuguucuuacugggaucacgacuccaagacaggggcccuccauagcagacuggaucuguga

SEQ ID NO: 69437 - RNA, 2292 nt, Artificial Sequence
  derived and/or modified sequence opt5 from FOXM1__Homo_sapiens__NP_068772
augaagaccagccccagacggccucugauccucaaacgcagacggcugccgcuucccgugcagaacgccccuuccgagacaucugaagaggaacccaagcgcagcccugcucaacaggaguccaaucaggccgaagcgucuaaagaggucgcugagagcaacuccugcaaguuccccgccggcauuaaaaucauuaaucacccuacgaugccgaacacccagguuguggccauccccaauaacgcuaauauucauucuaucaucacagcccugaccgcuaaggggaaggaaagcggauccagcggcccuaacaaauuuauucucaucucuugugggggagcccccacacaaccucccggccugagaccgcagacccagacauccuacgacgcgaagcggaccgaggugacgcuugaaacccuggggccuaaacccgccgcucgcgaugucaaucucccuagaccucccggagcccugugcgagcagaagcgggagacaugugcugacggcgaagccgcgggcugcaccauuaacaauagccugucuaacauccaauggcuccgcaaaauguccagcgaugggcugggaucuagauccauuaagcaggagauggaagagaaggaaaauugucaccuugagcagcgccaggugaaaguugaggaacccagccggccguccgccucuuggcaaaacagcguguccgagagacccccuuauagcuacauggcuaugauccaguucgccauuaauucuacagaacggaagcgcaugacccugaaagacaucuauacguggaucgaggaucauuuucccuacuucaagcacauugcuaaaccuggcuggaagaacuccaucagacauaaccucagccugcacgacauguuuguccgggaaacaucugccaaugggaaagugagcuucuggaccauucaccccuccgccaacagauaucuuacacuggaucagguuuuuaagccgcucgacccuggaucuccccaacugccugagcaucuggagagccagcagaagcgccccaauccugaacuccggagaaacaugaccaucaaaaccgagcugccccuuggcgcucgccggaagaugaaaccgcugcucccuagaguguccagcuaccugguccccauucaguuccccgugaaucaaucucuugugcugcagccuuccgucaagguuccgcucccccuggcggccagccugaugucuuccgaacucgcucgccacagcaaacgggugagaaucgccccuaaggugcugcuugccgaggaagggaucgcuccccuguccucugccggaccuggcaaggaggagaaacuccuguuuggcgaaggguucagcccccuucugccuguccagacaauuaaggaggaagagauccagcccggagaggaaaugccgcaucucgcgcgcccuauuaaaguggagucucccccucuggaagaguggcccuccccggcuccuagcuuuaaggaagaguccagccacucuugggaggauuccagccaaucucccacgccucggcccaaaaaguccuauagcggccugagaucucccacccgcugcguuagcgaaaugcucgugauccagcaccgggagagacgggaacgcuccagaagccggagaaagcagcaucugcuuccuccgugugucgacgagcccgaacuccuguucucugaggggccuuccacaagccgcugggccgccgagcugcccuuuccugcugauuccucugaccccgccagccagcuguccuacucucaagaagugggaggcccuuucaaaaccccgauuaaggagacacuucccaucagcuccaccccuucuaaaagcguucucccccggacgccugaauccuggagacugacacccccggcuaaggucgggggacuggauuucagcccugugcagaccucucagggcgccuccgacccccuccccgacccucugggccuuauggaucugagcaccacaccccuccagucugcgccuccgcuggagagcccccaacgccugcuuuccucugaaccucucgaccugaucuccgugcccuuugggaacagcuccccuagcgauauugacguccccaaaccgggaucuccugagccccaggugagcggccuggccgcuaauagaucccucaccgaggggcugguucuugauacaaugaacgacucucugagcaagauccuccuggauauuuccuucccuggacuggacgaagauccccuuggcccugacaauaucaacuggucucaguuuauucccgagcuccaauga

SEQ ID NO: 69438 - RNA, 1947 nt, Artificial Sequence
  derived and/or modified sequence opt5 from FOXN1__Homo_sapiens__XP_005258103
auggugagccugcccccuccgcaguccgacgucacccuccccggcccuacaagacuggagggggaacggcaaggagaucuuaugcaggcccccggccugccugggucucccgcuccucagagcaagcacgccggauucuccugcucuagcuuuguuuccgacggcccgcccgagcgcacgccuucucugcccccucauagccccagaaucgcguccccggggccugaacaggugcaaggacacugucccgcuggcccuggccccgggcccuuccggcucagcccuucugauaaauacccgggauuuggcuucgaggaagccgccgcuuccagccccgggcgcuuucuuaagggaucucaugccccuuuccaccccuauaaaagaccuuuucaugaggacguguuccccgaggcugaaaccacacuggcccucaagggccacuccuuuaaaaccccggggccucuggaggcguucgaagagauucccgucgauguggccgaggcugaagccuuucugccuggauucagcgcugaggccuggugcaacggccuccccuacccuucucaggaacacggcccccagguucugggguccgaggugaaggucaagccgccugugcuugaaagcggagcgggcauguuuuguuaucagccuccccugcaacauauguacugcuccucucagcccccguuccaccaguauagccccgggggaggcuccuacccuauccccuaucucgggagcucucauuaccaguaccaacggauggccccucaggcuuccacagacggacaccagccccuguucccuaaacccauuuauagcuacucuauccuuauuuuuauggcccugaagaauagcaaaaccggcucccucccgguuucugagaucuauaacuucaugacagagcacuuuccuuacuucaagaccgcucccgauggcuggaaaaauagcgugcgccauaaccugucccugaauaaguguuuugaaaaggucgagaacaaaagcgggucuuccagcagaaagggaugccucugggcccugaauccugccaaaaucgacaagaugcaagaagaacuucagaaauggaagcggaaagaucccauugcugugcgcaagucuauggcgaagccggaggagcuggacucccucaucggcgauaaaagagagaagcuggggagcccucuucugggaugucccccucccggccucuccgggucuggccccauucggccucuggccccgcccgcuggacugagcccuccccuccacucccugcauccugcccccggcccuaucccggggaaaaacccccuucaggaccugcucaugggacacacgccuucuugcuauggccagaccuaccugcaucuuagccccgggcuggccccucccggaccgccucaaccccucuucccccagccugauggccaccuggaacugcgcgcucagcccgggacaccucaggacuccccgcuccccgcccacaccccucccagccauucugcgaagcugcuugcugagccuucccccgccagaacaaugcacgacacccugcucccggauggcgaccugggaacggaucuggacgccauuaauccuagccuuacagauuuugacuuccaaggcaaccucugggaacagcugaaagaugacucucuggcucucgauccccuggugcuugucaccuccagcccuacaucuagcuccaugcccccuccccagccgccuccccauuguuuucccccugggccgugccugaccgagaccggaagcggcgccggggaccucgcugcccccggaucuggcggguccggcgcgcugggagaucugcaccuuacaacgcucuauagcgccuucauggaacuggagccuacacccccuaccgcucccgccggcccuuccguuuaccugucuccgagcuccaagcccguggcucucgccuga

SEQ ID NO: 69439 - RNA, 1296 nt, Artificial Sequence
  derived and/or modified sequence opt5 from FOXN2__Homo_sapiens__NP_002149
augggccccgugaucgggaugaccccugacaagagagccgagacaccgggagcugagaaaauugccggccugagccagaucuacaagauggggucccuccccgaggcggucgaugcugcccggccuaaagccacgcugguugacucugaaagcgcugaugacgagcuuaccaaccugaauuggcuccacgaauccacaaaccugcuuaccaauuucucucugggaagcgagggccuccccauuguguccccucuguaugauaucgagggggacgaugugcccucuuuuggaccugccugcuaccaaaacccggaaaagaaaagcgcuacauccaagcccccuuauagcuucucucugcucauuuacauggccaucgagcauucccccaauaagugucugccugucaaagaaaucuauagcuggauucuugaccacuuucccuacuucgcgaccgccccgacaggcuggaagaacucugugcgccauaaucugucccucaacaaaugcuuucagaagguugagagaagccacggcaaagugaaugggaagggaucucuguggugugucgauccugaguauaagcccaaccuuauccaggcucugaaaaagcagccuuucuccagcgccuccucucaaaauggcagccucagcccccauuaccuguccucugugauuaaacagaaccagguucggaaucugaaggaauccgacaucgaugcugccgcggccaugaugcuccugaacaccagcauugagcaggggauccuugaaugcgagaaaccccugccucucaagacggcucugcagaaaaagcgcucuuacggaaaugccuuucaccacccgagcgcugugagacuucaagaauccgacucucuggccaccagcauugaucccaaggaggaccauaacuauuccgccagcucuauggcugcgcagcggugugccucccgcagcucugucuccagccucuccucuguggacgagguguacgaguucaucccuaaaaacagccacgucggcuccgaugggucugaaggauuucauagcgaagaggacacagauguugacuaugaagaugacccccugggcgauuccggcuacgcuagccagccuugcgccaagaucucugagaaagggcaauccggaaagaaaaugagaaagcagaccugucaggagauugacgaagaacugaaggaagccgcuggcagccuccugcaccuugccgggauccggacaugccugggaucucucauuuccaccgcgaaaacgcaaaaucagaagcagcgcaaaaaguga

SEQ ID NO: 69440 - RNA, 1473 nt, Artificial Sequence
  derived and/or modified sequence opt5 from FOXN3__Homo_sapiens__NP_001078940
augggccccgugaugccuccgagcaagaaacccgaguccucugggaucagcgucuccucuggacugagccagugcuacggcggguccggauucucuaaggcccuccaagaagacgaugaccuggauuuuagccuuccugacauuagacuggaggaaggcgcuauggaggaugaggaacucaccaaccugaauuggcuucacgaguccaaaaaccugcucaagagcuucggggaaucuguucugcgguccgugagccccgugcaggaccuggaugacgauacaccucccucuccugcccauuccgacaugccguaugaugcgcgccagaaucccaacuguaaaccucccuacagcuuuucuugccucaucuucauggcuauugaggacuccccuacgaagagacugcccgucaaggauaucuauaauuggauucuugaacacuuuccguacuucgccaacgccccuaccggauggaaaaauagcgugcggcauaaccugucccucaauaaguguuuuaaaaagguugacaaagagcgcucucagagcaucggcaagggcucccuguggugcaucgaccccgaguauagacaaaaccuuauucaggcucugaagaaaacaccuuaccacccccauccccacguguucaauaccccuccgacauguccccaggccuaucagagcaccucugggccucccaucuggccuggauccacauuuuucaagcggaacggcgcucuccugcaagaucccgacauugaugccgcgagcgccaugaugcugcucaauaccccgccugaaauccaggcuggguuucccccuggagucauucagaacggcgcccgcgugcugucuagagggcuuuuccccggaguucggccucugcccaucacgccgauuggcgugaccgcugccaugcgcaauggcaucacaagcugcagaaugcggaccgaguccgaaccuucuugugggagccccgucguguccggagaccccaaagaggaucacaacuacagcucugcgaaguccagcaacgcccgcucuacauccccuaccagcgacuccaucucuagcuccucuagcuccgcugaugaccauuacgaauuugccacgaaaggcagccaggaggggucugagggauccgaaggcagcuucagaucucacgaguccccgagcgauacagaagaggacgaucggaagcauucucaaaaagaacccaaggacagccucggggacuccggauaugcuagccagcacaagaaacgccagcacuucgccaaggccagaaaagugccuucugauacccugccccuuaagaaacggagaacagagaagccucccgaguccgacgaugaagagaugaaggaagcugcgggcagccugcuccaucuggccggcauucgcuccugccugaauaacaucaccaaucggaccgcuaaagggcaaaaggagcagaaagaaacaacgaagaacuga

SEQ ID NO: 69441 - RNA, 1968 nt, Artificial Sequence
  derived and/or modified sequence opt5 from FOXO1__Homo_sapiens__NP_002006
auggccgaggcuccccagguggucgaaaucgacccugauuucgagccgcugcccagaccucggagcugcaccuggccccucccucgccccgaauuuucccaaucuaacagcgccacauccucuccugcgccgagcggcuccgcugccgccaaucccgacgcugccgcugggcugccuucugccagcgcggccgcuguuuccgccgauuucaugagcaaccuuucucugcucgaggaauccgaggacuuuccccaggcuccuggaagcguggccgcggccguggcugccgcugccgccgcugcggccacgggcgggcuguguggagauuuccagggccccgaggcugggugccuucacccggccccuccccagccucccccucccggaccgcugucucaacaucccccugugcccccugccgcugccggcccccucgcgggccagccgagaaaguccuccucuucccggcgcaaugcuugggggaaccugagcuacgccgaccugauuaccaaagccaucgaauccucugcugagaagagacucacacugagccagauuuaugaauggauggucaaauccguuccuuacuuuaaggauaaaggagacagcaauucuuccgccggcuggaagaacagcauccggcacaaucuuucucugcauagcaaguucauucgcgugcagaacgaggggaccggaaaauccucuugguggaugcucaaucccgagggcggaaagagcgggaaauccccuagacggcgcgcugccagcauggauaacaauucuaaguuugcgaaauccagaagccgggccgcuaagaagaaagccucucugcaauccggccaggaaggcgcuggggacagccccggaucccaguucucuaaguggccugccagccccggcucccacucuaacgaugacuuugauaauuggagcacauuccgcccgagaaccuccagcaacgcgucuacaaucuccgggcggcuuagcccuaucaugaccgagcaggacgaccugggagaaggcgauguccauucuaugguguauccucccuccgccgcuaaaauggccagcacgcuccccucucugagcgagauuuccaauccggaaaacauggagaaccugcucgacaaucugaaccuucugagcucucccaccucccucacaguuagcacccaauccucuccugggacaaugaugcagcagacccccuguuacagcuuugcuccucccaauacgucccugaacucuccuagccccaauuaucaaaaguacacauauggacaguccucuaugagcccgcuuccucagaugcccauccagacccugcaagauaacaaauccagcuacggcggcaugucucaguacaauugcgccccugggcuccugaaggagcugcucacauccgacucucccccgcacaacgauauuaugaccccuguggaccccggagucgcccagccuaauagccgcgugcugggccagaacgugaugauggggcccaauuccgucaugagcaccuauggaucucaagcuagccacaacaaaaugaugaaucccagcucccauacacacccuggccaugcgcagcagacgagcgccguuaacgggagaccgcuuccccacaccgugucuacaaugccucacaccagcggcaugaaucggcugacacaggugaagacccccguccaagugccucucccccauccuaugcagauguccgcucugggaggcuacucuagcguuuccucuuguaacggguauggaagaaugggccuucugcaccaggaaaagcucccgagcgaucuggacgggauguucaucgagcgccuggauugcgacauggaauccauuauccggaacgaucucauggacggagacacgcuggauuuuaauuucgacaacgugcuucccaaucagucuuucccucauagcgucaaaacaaccacccacuccugggugagcggcuga

SEQ ID NO: 69442 - RNA, 2022 nt, Artificial Sequence
  derived and/or modified sequence opt5 from FOXO3__Homo_sapiens__NP_963853
auggccgaggcucccgccagcccugcgccgcugagcccccucgaaguggagcuggacccugaguucgaaccccagucuagaccucggagcugcaccuggccccuucaacgcccugaacugcaggcuuccccggccaagcccucuggcgagacagccgcugauagcaugaucccugaggaagaggacgaugaagacgaugaggacgggggaggcagagccggguccgcuauggccauuggaggcgggggaggcucuggcacgcucgggagcggacugcuucuggaggauuccgcgcggguccucgcccccggcgggcaggacccuggaagcggccccgcuaccgccgcugggggacugucuggcggcacacaggcccugcuccaaccgcagcagccucugcccccuccccagcccggggcggccggaggcuccgggcaaccucgcaaauguagcucuagacggaacgcuuggggaaaucuuuccuacgccgaucugaucacccgcgcuauugaaagcucuccggacaagagacucacacugucccagaucuaugaguggaugguucggugcgugcccuacuuuaaagauaagggcgacagcaacuccucugccggguggaaaaauagcauucgccacaaccuuucccugcauagcagauucaugcgggugcagaaugaaggaaccggcaagucuuccugguggaucaucaacccugauggcgggaaguccggaaaagcuccccgcagacgggccgucucuauggacaauagcaacaaguauacaaaaucccgcggcagagcggccaagaaaaaggcugcccuccagaccgccccugagucugcugacgauagccccucccaacugagcaaguggccggggucuccuacgucccggagcucugacgaacuggaugccuggaccgacuuuagaucccgcacaaauagcaacgcguccaccgugucuggacggcucagccccauuauggcuuccacagagcuggaugagguucaggacgaugacgccccucuuucucccaugcuguacagcuccagcgccucucucuccccuagcgugucuaaacccuguaccgucgaacugccgagacuuacggauauggcuggcacaaugaaucugaacgacgggcucaccgagaaucugauggaugaccugcucgacaacaucacacugccucccucccagcccagcccuaccggcggacuuaugcaacgcucuagcuccuucccguauaccacaaagggcagcgggcugggaucucccacguccagcuuuaauuccaccguguucggcccuucuagccucaacucccugcggcagucucccaugcagacaauucaggaaaacaaaccugccaccuuuagcuccaugucucacuacgggaaucaaacacuucaggaucugcucaccagcgacucccugagccauucugauguuaugaugacgcaguccgacccccugaugagccaggcuucuacagccguguccgcgcaaaacagcagacgcaaugucaugcuccggaacgauccuaugaugucuuucgccgcucagcccaaucagggaucccuggugaaccagaaucuucugcaccaucaacaccagacccagggcgcccucgggggcagcagagcucuguccaacagcgugucuaauaugggacugagcgaguccucuagccuuggcuccgccaagcaccagcaacagucuccggucagccaguccaugcaaacccucucugacagccuguccgggagcucucuguauuccacaagcgcgaaccucccuguuaugggacaugaaaaauuucccucugaucuggaccuugauauguucaauggcucccuggagugcgacauggagagcaucauucgcuccgaacucauggaugccgacgggcuggauuuuaacuucgacucucugaucagcacccagaauguggugggacuuaacgucggcaauuuuacaggggcuaagcaggccuccagccagucuugggugccuggcuga

SEQ ID NO: 69443 - RNA, 1353 nt, Artificial Sequence
  derived and/or modified sequence opt5 from FOXO4__Homo_sapiens__NP_001164402
auggaccccggcaacgagaauagcgccaccgaagcugccgcgaucauugaucuggacccugauuucgagccgcaguccagaccccggucuugcacauggccucucccccgcccugaaaucgcuaaccaacccagcgagccuccggaaguggagcccgaccugggggagaaggccauugaauccgccccugagaaaagacuuacgcuggcucagaucuacgaauggaugguccggaccguucccuauuuuaaggauaaaggagacucuaauagcuccgccggcuggaagaacucuauucgccacaaucucagccugcauuccaaauucaucaaggugcacaacgaggcuacagggaagucuucuugguggaugcuuaauccugagggaggcaaauccgggaaggcccccagacggcgcgcggccagcauggauucuuccagcaaacugcucagaggacggucuaaggcuccgaaaaagaagccuuccgugcugcccgccccucccgaaggcgcuacccccacaagcccugucggccauuuugccaaaugguccgggucuccguguagccgcaacagagaggaagcggacauguggaccacauuccggccccgcuccagcucuaaugccuccagcgugucuaccagacugagcccucuccggcccgaguccgaaguucuggcugaggagaucccugccucugugagcuccuacgcuggaggcgugcccccgacgcuuaacgaagggcuggagcuccuggauggacuuaaucugaccagcucucacucccuccugagccgcucuggccuguccggguuuagccuccagcauccuggagucacaggcccccugcacaccuauuccucuagccuuuucuccccugccgaaggcccccugucugccggggagggaugcuuuagcuccagccaggcucucgaagcgcugcuuacaucugacaccccucccccgccugccgauguucugaugacgcaaguggaccccauucucucccaggcucccacacugcugcuccugggcgggcuuccuagcagcuccaagcuggccaccggagucggccucuguccgaaaccccuggaggccccugggcccagcucucuugugccuacacugagcaugaucgcucccccucccgugauggccuccgcgccgauuccuaaggcucucggaacccccguccugaccccucccacagaggccgccagccaggauagaaugccgcaggaccuggaccucgauauguacauggaaaaccuggagugcgacauggauaauaucauuucugaccuuauggaugaaggcgagggccuggacuucaacuuugaaccugaucccuga

SEQ ID NO: 69444 - RNA, 1680 nt, Artificial Sequence
  derived and/or modified sequence opt5 from FOXO6__Homo_sapiens__NP_001278210
auggccgccaagcugagagcccaccagguggacgucgaucccgacuucgcgccucaaagccggccgcgcuccugcaccuggccccucccucagcccgaucuggcuggcgacgaggauggggcccuuggagccggcguugcugaaggggccgaggacuguggaccugaaagacgggcuacagcccccgcgauggccccugcuccgccccugggcgccgagguggggccucuccgcaaagcuaagucuagcagacggaacgccuggggaaaucuguccuacgcggaucuuaucacgaaagccauugaaucugcucccgacaagcgccugacccucagccagaucuaugauuggauggugagauacgucccuuauuuuaaagacaagggcgauuccaacucuagcgccggcuggaaaaauuccauucggcauaaccugagccugcacacacgcuucaucagagugcagaaugaggggaccggaaagucuuccugguggaugcucaaccccgagggcgggaagacaggaaaaaccccgcggcgcagagcuguuagcauggacaauggcgccaaguuucugcggauuaaagggaaggccucuaagaaaaagcaacuucaggcuccugaacgcucccccgaugacagcucuccuuccgcgcccgcccccggaccugugccggcugccgccaaaugggcugccagccccgcgucccaugcuucugacgauuacgaggccugggccgacuucagaggcggcgggcggccucugcucggagaagcugccgagcuggaggaugacgaagcucuugaggcccuggcgcccagcuccccucucauguaucccagcccggccucugcucuguccccugcccugggcagcagaugccccggggaacucccucgccuggcugagcuuggaggcccccuggggcuccacggaggcggcggggccggacugccugaaggccuucuggauggggcgcaggacgccuacggaccccgggcuagagccggcacaccggcuuauuuugggggcuguaagggaggcgccuacgggggaggcgggggauucggcccucccgccaugggggcucuccgccggcugcccaugcagaccauccaagagaacaaacaggcgucuuuugucccugccgcugccccguucagacccggcgcccugccugcucuccugcccccucccccucccgccccgcgcccuggacccgugcuuggcgcgccuggggagcuggcucucgccggagccgcugccgcguaccccggcaagggggcugccccguaugccccucccgcuccuagccgguccgcccuggcucaucccaucucucuuaugacgcugcccggagaagccggcgcggccgggcucgcuccuagcggccacgccgcugccuuuggaggcccgcccgggggacugcugcucgaugcccugccuggccccuacgcugcggccgcugccgggccucuuggagccgcucccgacagauucccugccgaucuggaccucgauauguuuuccggcagccuggagugcgacguugaaucuauuauccugaaugacuucauggauuccgacgagauggauuuuaacuucgacagcgcgcuuccgcccccucccccugggcucgcuggcgcucccccgccuaaucagucuugggugcccggauga

SEQ ID NO: 69445 - RNA, 345 nt, Artificial Sequence
  derived and/or modified sequence opt5 from FOXP1__Homo_sapiens__NP_001012523
augaugcaggagagcggcaccgaaacaaaguccaacgggucugccauccaaaauggaagcggcggguccaaccaucugcucgagugcggaggccugagagaagggcggucuaauggagagacgcccgcuguggacauuggcgccgcggaucuugcucacgcccagcagcagcaacagcaguggcaccugaucaaccaucagccuagccgcuccccgucuagcuggcucaaaagacugauuuccagccccugggaacuugagguccugcaaguuccucucuggggcgccguggcugagaccaagaugucugggcccgugugucagccuaaucccuccccuuucuga

SEQ ID NO: 69446 - RNA, 2145 nt, Artificial Sequence
  derived and/or modified sequence opt5 from FOXP2__Homo_sapiens__NP_001166237
augaugcaggagagcgccaccgaaacaaucuccaacucuagcaugaaucaaaacggcauguccacgcugucuagccagcucgacgcuggguccagagauggacggucuagcggcgacaccuccagcgaggugucuacagucgaacugcuucaccuccagcagcaacaggcccugcaggcggcucgccagcugcuucugcaacagcagaccuccgggcucaagagccccaaaucuuccgauaagcagagaccucugcaaguuccggugagcguggccaugaugacaccccaggucauuaccccucagcaaaugcagcagauccugcagcaacaggugcucucuccccagcagcugcaagcccuucugcagcagcagcaagcuguuaugcuccagcagcagcaacugcaggaguucuacaaaaagcagcaagaacagcuucaucugcagcuccugcagcaacagcagcagcaacagcagcagcaacagcagcaacagcagcagcaacagcagcagcaacagcagcagcaacagcagcagcaacagcagcaacagcagcagcaacagcagcagcaacacccuggaaaacaggccaaggagcagcagcaacagcagcaacagcagcagcuggcugcccaacagcucguguuucagcagcaacugcuucagaugcagcagcugcaacagcagcagcaucuccugucccuucaacggcagggccugauuagcauucccccugggcaggcggcccucccgguccaaucccugccccaggcuggacugucuccugccgagauccagcagcucuggaaggaagugacaggcguucacagcauggaggacaauggcaucaaacaugggggacuggaucuuaccacgaacaauuccagcucuaccacauccagcaacaccucuaaggcuucucccccuaucacacaccacuccauugugaauggccaaucuagcguccuguccgcccgcagagacagcagcucccaugaagagaccggggcgagccacacgcucuauggacauggcgugugcaaauggcccgggugugagucuaucugcgaagauuucggacaguuucugaagcaccuuaacaaugagcacgcccuggacgaucgguccacagcucagugucgcgugcagaugcaagucguucagcagcucgaaauucagcugagcaaagagagagaacggcugcaagccaugaugacccaucuccacaugcgcccguccgagccuaagcccucuccuaagccccugaaccuugugagcuccgugacaaugucuaaaaauaugcuggagaccagcccccagucccucccucagaccccgacaacgcccaccgcuccugucacacccaucacccaaggcccuagcgugauuacacccgccucuguuccgaacgugggcgccaucagacggcgccauuccgacaaguacaauauuccuaugagcucugaaaucgcucccaacuaugaguucuacaaaaaugcggaugucagaccucccuuuaccuaugccacgcugauccggcaggcuauuauggaauccagcgaccgccagcugacacuuaacgagaucuacucuugguucaccagaaccuuugccuauuuccggagaaacgccgcuacauggaagaaugccgugcgccacaaccucagccugcauaaaugcuuuguucggguggaaaaugucaagggggcgguguggaccgucgaugagguggaguaccagaaaagacgcucccaaaagauuacaggaagcccuacgcugguuaagaacauccccaccucucucggcuacggggcugcccugaaugccucccuucaggcugcccuggcugaaagcucccucccgcugcugucuaacccuggacuuauuaauaacgccagcuccggccuccugcaggcggugcacgaggaccugaaugggucucucgaccacaucgauagcaacggaaauuccucucccggcuguagcccccagccucauauccacuccauucaugucaaagaggaaccggugaucgccgaagacgaggauugccccaugagccugguuacaaccgcuaaccacucuccugagcuugaagacgaucgggagauugaagaggagccccuguccgaagaccucgaguga

SEQ ID NO: 69447 - RNA, 1191 nt, Artificial Sequence
  derived and/or modified sequence opt5 from FOXP3__Homo_sapiens__NP_001107849
augcccaacccuagaccgggcaagcccagcgccccuucccuggcucucgggcccucuccuggagccagccccuccuggcgggcggcuccuaaagccucugaccugcuuggcgcccgcgggccgggaggcaccuuccaggggagagaucugcggggaggcgcucacgccagcuccucuagccucaaucccaugccucccucccaacugcagcuuagcacaguggacgcucaugcccgcacgccuguccugcagguucacccccucgagucuccggcgaugaucucccugaccccucccacaaccgccacaggcguguuuagccugaaggcuagaccugggcucccucccggaauuaacguggccucucuggaaugggucucccgggagcccgcccuucugugcaccuucccgaaucccagcgcuccucgcaaagauucuacacucuccgcggugccccagagcuccuacccucugcuugccaacggcguuuguaaguggcccgggugcgaaaaaguguuugaggaaccggaggacuuccugaagcauugucaagcugaucaccuccuggacgagaagggacgcgcccagugccugcuccagcgggaaaugguccagucucuggagcaacagcuugugcuggaaaaagagaagcucagcgcuaugcaggcccaucuggccggcaaaauggcucuuaccaaggcguccagcguugccucuuccgauaaagggagcuguugcaucguggcugccggaucucagggcccugucgugcccgccuggagcggcccucgcgaggcucccgacucccuguuugccgugagacggcaccucugggggucucacggaaauagcacguucccugaauuucugcauaacauggauuauuucaaguuucacaauaugagacccccguucaccuacgcgacacugauuagaugggcuauccucgaggccccugaaaagcaacggacccugaacgagauuuaucauugguuuacacgcauguucgccuuuuucagaaaucaccccgcuaccuggaaaaacgccauccggcacaaucuuucccugcauaaguguuucgucagaguugaaagcgagaaaggcgcuguguggacgguggacgagcucgaauuucgcaagaaacggucucagagacccucccgcugcagcaacccuacaccggggcccuga

SEQ ID NO: 69448 - RNA, 2043 nt, Artificial Sequence
  derived and/or modified sequence opt5 from FOXP4__Homo_sapiens__NP_001012426
augaugguggagagcgccuccgaaaccaucagaucugcucccagcggccagaacggggucggaucccugucuggccaagccgacgggagcuccggaggcgcgacagggacgaccgcuucuggaacaggccgggagguuaccacaggcgccgauagcaauggggaaauguccccugccgagcuccugcacuuccagcagcagcaagcccuucagguggcucgccaguuucugcuccagcaagcuagcggacugucuuccccgggcaacaaugacagcaagcagucugccuccgcggugcagguccccgugagcguugccaugaugucuccucagaugcuuacaccccaacagaugcagcaaauucuguccccuccccagcuccaggcucugcugcagcaacagcaggcccucaugcugcagcaacuucaggaauacuauaaaaagcagcaggagcaacugcaucuccagcugcuuacacagcagcaagcugggaaaccucagccgaaggaggcccugggaaacaaacagcucgcguuccaacagcagcugcugcagaugcaacagcuccagcagcaacaucugcuuaaucugcagagacagggccucgugagccugcagcccaaccaagccuccgggccucuucagacccugccccaggcugccgucugcccuacggaucucccccaacuguggaagggagaaggcgcuccgggccagccugccgaggacucugugaagcaggaagggcuggaucucaccggaacagccgcuaccgcgaccagcuuugccgcucccccuaaaguuuccccuccccugagccaccacacccuucccaauggccagccgacggugcugacaucucggcgcgacuccagcucucaugaggagacccccgggagccacccucucuacggacacggcgaauguaaguggcccgggugcgagacacugugugaagaucuuggacaauucaucaaacaucugaacaccgagcacgcccucgacgauagauccaccgcccagugccggguccagaugcaaguggugcaacagcuggaaauucagcuggcuaaggagucugagcgccuccaggccaugauggcgcaucugcacaugagaccuagcgaacccaaaccguuuucccaaccucuuaaucccgucccuggcucuagcuccuucagcaagguuacagugucugcugccgacuccuuucccgauggccuggugcacccucccacgagcgccgcugccccggucaccccucuccggccucccgggcugggauccgcuucucugcauggcgggggacccgcccgcagacggagcuccgacaaguucuguucuccgaucagcuccgagcuugcgcagaaccacgaauuuuauaaaaaugccgaugugagacccccuuucacauacgcuagccucauucgccaggccauccuggagacccccgaccggcagcugacacucaacgaaaucuauaauugguuuacccgcauguucgcuuacuuuagacggaacacggccacauggaagaaugcgguuagacauaaccugucucuucacaaaugcuucgugcgcgucgagaacgugaagggcgccguuuggaccguggacgagcgggaauaucagaaaagacgcccucccaagaugaccggguccccuacacuggucaaaaauaugauuagcggccucucuuacggagcucugaacgccuccuaccaggcugcccuggccgagagcucuuucccccuucucaauagcccgggcaugcugaacccuggguccgcuagcucucugcucccccugucccaugaugacgugggagcgccugucgaaccccuuccgagcaauggcuccucuagcccuccccggcuguccccuccccaguauucucaccaagugcagguuaaggaggaacccgccgaggcugaggaagauagacagccugggccgccccucggagccccuaaccccagcgccuccggcccucccgaggaccgcgaucuggaagaggagcugccuggggaggaacuuucuuga

SEQ ID NO: 69449 - RNA, 1212 nt, Artificial Sequence
  derived and/or modified sequence opt5 from FOXQ1__Homo_sapiens__NP_150285
augaagcuggagguguucguccccagagccgcucacggcgacaaacaggggagcgaucucgaaggagccggcggguccgacgcgccuucuccgcugagcgcugccggagaugacucccuuggcucugauggggacugcgccgcuaacagccccgccgcuggaggcggcgcccgggauacccaaggggacggagagcaguccgcgggcgggggaccuggcgccgaagaggcuauccccgccgcugccgcggccgcuguuguggccgaaggggcugaggccggagccgcuggcccuggcgccgggggagcgggcucuggggagggagcucgcagcaagcccuacacaagacggccuaaaccgcccuauuccuacauugcccugaucgccauggcuauucgcgauagcgccggcgggagacucacgcuggcggaaaucaaugaguaucuuaugggaaaguuuccuuucuuucggggcucuuacaccggcuggcgcaacuccgugagacauaaucugagccucaacgacuguuucgucaaagugcugcgggaucccucucgcccuugggggaaggacaauuauuggaugcugaaccccaauuccgaauacacauuugcugauggaguuuucagacggcgcagaaagcggcucagccaccgcgccccggugccugcccccggccugagaccugaggaggcucccgggcuucccgccgcuccuccgcccgccccugcggcccccgcuucuccucggaugagaucccccgcccgccaggaggaacgggcuagcccggccggaaaauuuuccucuagcuucgcgauugacuccauccugagaaagccuuuucgcagccggagacuccgcgacaccgcccccggcacaacccugcaguggggcgcugccccuugucccccucuucccgcuuucccggcccugcucccugccgcucccugccgggcgcugcugccccucugcgccuauggggcuggagaaccugccagacugggcgcccgcgaggcugaagucccgcccacagccccuccccuucugcucgcgccucugcccgcugccgccccugcuaaaccccuucgggggccggccgcgggaggcgcucaucuguacuguccucucagacugcccgccgcccugcaagcugccucugugcgccggccugggccccaccucccguacccuguugagacccugcuugcuuga

SEQ ID NO: 69450 - RNA, 879 nt, Artificial Sequence
  derived and/or modified sequence opt5 from FOXR1__Homo_sapiens__NP_859072
augggcaacgagcuguuccucgccuuuaccacaagccaccuuccccuugcugaacagaagcuggccagauacaaacuccggaucgugaagccuccgaaacugccccuugagaagaaaccuaaucccgacaaggaugggccugacuaugaacccaaccuguggaugugggucaauccuaacauuguuuacccgcccggaaagcucgagguguccggccgcagaaaacgggaagaucugacgucuacccugccuagcucccaacccccucagaaggaggaggacgcgucuugcagcgaagcugccgggguggagucccucucucagagcuccagcaaacgcucucccccgagaaagcgguucgccuuuuccccuagcacaugggaacugaccgaggaggaagaggcugaagaucaggaggacucuuccagcauggcccuucccucuccucauaaacgcgcuccccugcaauccagacggcuccgccaggccagcucccaggcgggaagacuguggucucggcccccucuuaauuauuuccaccugaucgcccucgcucugcgcaacagcuccccguguggccugaauguccagcaaauuuacagcuuuacaagaaagcauuuccccuuuuuccggaccgccccugaaggguggaagaacacagugcgccacaaucucugcuuuagagauucuuucgagaaaguucccguguccaugcagggaggcgcuagcacccggccuagaucuugucuguggaagcugacggaggaaggccaucgccgguuugccgaggaagcgagagcccuggcuagcacccgccucgaguccauccagcagugcaugucucaacccgacgucaugccguuccuguuugaucuuuga

SEQ ID NO: 69451 - RNA, 936 nt, Artificial Sequence
  derived and/or modified sequence opt5 from FOXR2__Homo_sapiens__NP_940853
auggaccugaagcucaaagauugcgaguucugguacagccugcacggccaggugcccgggcuucuggacugggauaugagaaacgaacucuuucugccuuguaccacagaccaaugcucccuugccgagcagauccuggcuaaguaucgggucggaguuaugaaaccgcccgaaaugccucagaagcgcagacccucuccugauggcgacgggcccccuugugagccgaaucucuggauguggguggaucccaacauucugugcccucugggaagccaggaagcccccaaaccuuccggcaaggaggaccucacgaauaucucucccuucccgcaaccuccccagaaggaugaggggagcaacuguuccgaagacaaaguggucgagucucugccuagcuccagcucugaacagagcccccuucagaagcaaggcauucauucccccucugauuuugagcugaccgaggaagaggcggaggaaccugacgauaauucccuccagagcccggaaaugaaaugcuaccagucucagaagcuguggcaaaucaacaaucaggagaaauccuggcagcggcccccucuuaacuguagccaccugauugcucucgcccugcgcaauaacccccauugcggacuguccgugcaagagaucuauaauuucacaagacagcacuuuccuuucuuuuggaccgcccccgacggcuggaagucuacaauccauuacaaccucuguuuccuggacagcuuugaaaagguuccggauucccuuaaagacgaggauaaugcucggccucgcagcugccuguggaagcucaccaaagaagggcacagacgguucugggaggaaacacgcgugcuggccuuugcucagagagagcggauucaggaguguaugucucaacccgaacuucugaccucccucuucgaccuguga

SEQ ID NO: 69452 - RNA, 1461 nt, Artificial Sequence
  derived and/or modified sequence opt5 from FOXRED1__Homo_sapiens__NP_060017
augaucagacgggugcugccccacggcauggggcgcggacuccugaccagacggccuggcacacgcagagggggauucagccuugacugggauggcaaggucuccgagauuaaaaagaaaaucaagucuauucugccggggcggagcugcgaccuccugcaggauacgucccaucuucccccugaacacucugacguugugaucgugggaggcggcguccuggggcucagcguggccuacuggcugaaaaagcuggagucccgcagaggagcuauucggguucucguggucgaacgcgaucauaccuauucucaagccagcacaggccuguccguugggggaaucugucagcaguuuagccuucccgagaacauccagcugucucucuucuccgcgagcuuucugagaaauauuaacgaauaccuugcugugguggacgccccuccccuggaucuccgguucaauccuucuggcuaucugcugcucgccuccgagaaggacgcugccgcuauggagagcaacgucaaagugcaacgccaggaaggggccaaggugucucugauguccccggaucagcuuagaaauaaauuucccuggaucaacaccgagggagucgcgcuggccagcuacggcauggaagacgagggcugguucgauccuuggugccuccugcaggggcuucggcgcaagguucaaucccugggagugcucuuuugucagggcgaggugacaagauucgucucuagcucccagcggaugcugaccacagacgauaaagcugugguucugaagcgcauucacgaagugcaugucaagauggacagaagccucgaguaucagcccguggaaugcgccaucguuauuaaugcugccggggcguggucugcccaaaucgcugcccuggcuggagugggcgaggggccucccggaacccuucagggcacgaaacugccggucgaaccucggaagagauacguguaugucuggcacuguccccagggcccugggcucgagacaccccugguggccgacaccuccggagccuacuuucgccgggagggccuugggagcaacuaccugggaggcagaucucccaccgaacaagaggaaccugauccggcuaaucucgagguugaccacgauuucuuucaggacaaaguguggccccaucuggcgcugcgcgucccugccuucgaaacacucaaggugcagagcgcuugggccggguauuacgauuauaacaccuuugaccagaauggcguugugggaccccacccucuggucgugaacauguacuucgccacgggcuucuccgggcauggacuucaacaggcucccggcauugggcgggccguggcggagaugguucugaaaggaagauuucagacaaucgaucucucuccguuccuguuuacccgcuucuaucugggcgagaagauccaggaaaauaacauuaucuga

SEQ ID NO: 69453 - RNA, 1686 nt, Artificial Sequence
  derived and/or modified sequence opt5 from FPGS__Homo_sapiens__NP_001275732
augagcagagcccggucccaucugcgcgcugcccucuuccuggcggcugccucugccagaggcaucaccacacagguggcugcccggcgcgggcuuagcgcuuggcccgucccucaagagccguccauggaauaccaggacgccguuagaaugcugaacacgcuccagaccaaugcgggauaucuggaacaggugaagcggcaacgcggcgauccccagacacagcuugaggccauggagcuguaccucgcuagaucugggcuccagguggaagaccuggaucggcugaacauuauccacgucaccggaacaaaaggcaaggggagcacaugcgccuuuaccgaguguauucugcgcuccuauggacuuaaaaccggcuucuuuucuagcccucaccuggugcaaguuagagagcggauccgcauuaauggccagcccaucuccccugaacucuucacgaaguacuuuuggagacuguaucaucggcuugaggaaaccaaaguggaccuggcugucguggagguugggaucggaggcgccuacgauugcacaaacauuauccgcaagcccguggucuguggggugagcucucucggaauugaccacaccucccugcugggcgauacaguggagaagaucgcguggcagaaagggggaauuuucaagcagggcgucccugccuuuaccguucuccaaccggaaggcccccuggcugugcuuagagaccgggcccagcagaucagcugcccucuguaucucugucccaugcuggaggcucuugaagaagggggaccuccccugacgcucggccuggagggggagcaucaaagaucuaaugccgcccuggcucuccagcuggcgcacugcuggcuucagcgccaggaucggcacggagccggcgagccgaaggcuuccagaccugggcugcucuggcaacugccccuugccccuguguuccagcccacaagccauaugcgccugggacuccggaacaccgaauggcccggcagaacacagguccugcgccggggcccucugaccugguaccucgacggggcccacaccgcuucuuccgcccaggcgugugugagaugguuucgccaagcucugcagggacgggagagaccgagcggcgggcccgaaguucgcgugcuucuguucaaugccacaggagaucgggacccugccgcucuccugaaacugcuucagcccugccaguuugauuacgccgucuucuguccuaaccucacggagguguccucuaccggcaaugcugaccaacagaacuuuacaguuacccuggaccaggugcugcucagaugccuggaacaucagcaacacuggaaucaccuugaugaggagcaggccagccccgaccugugguccgcgccgagcccugaacccgggggcucugccucccuccugcuggcuccucaucccccucacacauguagcgccucuagccuugucuucuccugcauuucucaugcucuccaguggaucagccaaggacgggaucccaucuuccagccgccuuccccucccaaaggccugcugacccaccccguggcccauagcggggcgucuauucuccgcgaggccgcugccauccacguccuggugacgggaucccuucaccugguuggcggggugcucaagcugcuggaaccggcucuuagccaguga

SEQ ID NO: 69454 - RNA, 1053 nt, Artificial Sequence
  derived and/or modified sequence opt5 from FPR1__Homo_sapiens__NP_001180235
auggagaccaacagcucccugcccacaaauaucucuggcgggacgccugccgugagcgcuggauaccucuuccuggacauuaucaccuaucuugucuuugccguuacauucgugcugggcgugcucgggaacggacuggucauuuggguggcgggcuuuagaaugacccacacaguuaccacaaucuccuaccuuaaucuggcuguggccgauuucugcuuuaccucuacgcucccguucuuuaugguccggaaggccaugggagggcauuggcccuucggcugguuucuguguaaauucguguuuaccauuguugacaucaaccuguucggcagcguguuucucaucgcucugauugcccuugaucgcugcgucugugugcugcacccuguguggacacagaaucauagaaccgucucccucgcuaagaaaguuaucauugggcccugggugauggcccugcuucugacacucccugugaucauucgggucaccacggugcccggaaagacaggcaccguugcgugcacauucaacuucucuccuuggaccaaugacccgaaagaacgcaucaacguggccgucgcuaugcugaccgugagagggauuauccgguuuaucauuggauucagcgcccccauguccaucguugcugugagcuauggccugauugccacaaagauccacaagcaagggcucauuaaaucuucccgcccucugagaguccuuagcuuuguggcggccgcuuucuuucuguguuggucucccuaccaggucguggcccucaucgcuacgguucggauccgcgagcugcuucagggaauguauaaggaaauuggcaucgccguggaugucaccuccgcccuggcuuucuuuaauagcugccucaacccuaugcuguacguguucaugggccaggacuuuagagagcggcugauucaugcgcuccccgccucucuggaacgcgcucuuacagaggauuccacccaaacaagcgacaccgccacaaauuccacgcugccgucugccgagguugaacuccaggcuaaauga

SEQ ID NO: 69455 - RNA, 1056 nt, Artificial Sequence
  derived and/or modified sequence opt5 from FPR2__Homo_sapiens__XP_006723183
auggagaccaacuucagcacaccccugaaugaauacgaggaaguguccuaugagucugccggcuacacgguccucagaauccugccucuuguugugcugggggugaccuuuguccucggagugcugggcaacgggcuuguuauuuggguggcuggauuccggaugacacgcaccgucacaaccaucugcuaucugaaucucgcccuggcggacuuuagcuucacagcuacccugccguuucucauuguguccauggccaugggcgaaaaguggcccuucgggugguuucuguguaaacuuauccacauuguuguggauaucaaccuguucggaucugucuuucucaucggcuucauugcccuggacagaugcaucugugugcuucauccugugugggcucagaaucaccggacggucagccuggccaugaagguuauugugggccccuggauccucgcucuggugcugacccucccugucuuucuguuccuuacaaccgugacaauucccaacggggauaccuacugcacguuuaauuucgccuccuggggaggcacaccugaggagcgccugaaaguugcgaucaccaugcucacagccagagggauuauccgguucgugaucggauuuucucugccgaugagcauugucgcuaucuguuauggccuuauugccgcuaagauccauaaaaaggggaugauuaaguccagccgcccccugagagugcucaccgccguuguggcgucuuucuuuaucugcugguucccuuuucaacuggucgcccugcucggaaccguguggcugaaagaaaugcuuuucuacggcaaguauaaaaucauugacauccuggucaaccccacauccagccucgccuuuuucaauucuugucugaacccuaugcuuuacguguuuguuggccaggauuuccgggagcgccugauucacucccuccccacgagccuggaaagagcucugucugaggacuccgcuccgaccaaugauacagccgccaacagcgcuuccccucccgcggagaccgaacuccaggccauguga

SEQ ID NO: 69456 - RNA, 1062 nt, Artificial Sequence
  derived and/or modified sequence opt5 from FPR3__Homo_sapiens__NP_002021
auggagaccaacuucagcaucccccugaaugaaacagaggaagugcucccugagccggccggccacacgguccuguggaucuuuucccuucugguucauggggugaccuucguguuuggaguccucggcaacgggcuggugauuuggguugcuggauucagaaugacacggaccgugaauacaauuugcuaccuuaaccuggcccucgcggacuuuucuuucagcgcuauccugcccuuucgcauggucuccguggccaugagagaaaaguggccuuucggcucuuuucuguguaaacucguucacgugaugauugauaucaaucuguucgucagcguguaucuuaucaccauuaucgcccuggaccggugcauuugugugcuccaucccgcuugggcccagaaccaccgcacaaugucccuggcuaagagagucaugaccgggcuuuggaucuuuacgauuguucugacccucccuaauuucaucuuuuggacaaccauuucuacaaccaacggagauacguacugcaucuucaauuucgccuuuuggggcgacacagcgguggagcggcugaacguguucaucaccauggccaaagucuuucugauucuccauuucaucauuggcuuuagcgugcccauguccaucauuacaguuuguuaugggaucaucgcugccaagauucaccgcaaucacaugaucaaaagcucuagaccucugcggguguucgcugccgucguggcguccuuuuucauuugcugguuuccguacgagcuuaucggcauucugauggccguuuggcucaaggaaaugcugcuuaacggaaaguauaaaaucauccuggugcucauuaaucccaccagcucucuggcuuucuuuaacuccugucugaauccuauccucuacgucuucauggggcgcaacuuucaagagagacugauucggagccuucccaccucucuggaacgcgcccucacagaggugccugauuccgcucagacgagcaacaccgacacaaccuccgccucucccccggaggaaacagagcugcaggccauguga

SEQ ID NO: 69457 - RNA, 5931 nt, Artificial Sequence
  derived and/or modified sequence opt5 from FRAS1__Homo_sapiens__NP_001159605
augggcgugcugaaggucuggcucgggcuggcccuugcucuggccgaguucgcgguucucccccaccacagcgaaggagcuugcguguaccaggacucccugcuugccgaugccaccaucuggaaaccugacucuugucaaagcugcagaugucacggcgauauugugaucugcaagcccgcugucugucggaacccccagugcgccuuugagaaaggggaagugcugcagauugcugccaaccaguguugcccugaguguguucuccgcacccccggauccugccaccacgaaaagaaaauccaugagcacggcacggagugggcgucuagcccuuguuccgugugcucuugcaaccacggggaagucagauguacaccccaaccuugcccgccccugagcuguggacaucaggagcuggccuucauuccugaaggcuccugcugucccgugugcguuggccucgggaagccuuguagcuaugagggacacguguuucaggacggcgaggauuggcggcugucucgcugcgcuaagugucuuugcagaaauggggucgcccaguguuucacagcucaaugccagccccuguuuugcaaccaggacgaaaccguggugcgggucccgggaaaauguugcccucaguguuccgcccgcagcugcucugcggccggccaaguuuacgagcauggggaacagugguccgagaaugcuuguacaaccugcaucugugauagaggagaagugcggugccacaagcaggccugucucccccugcgcugcggcaaaggccaaagcagagcucggcgccacgggcaguguugcgaggagugcgugucuccugccggauccuguagcuaugacggcgucgugagauaccaggaugaaauguggaagggguccgccugcgaguucuguaugugcgaccauggacagguuacaugucaaaccggcgaaugcgcuaaaguggagugugcgcgggaugaagaacuuauccaccuggacgggaagugcugucccgagugcauuucucgcaacggauauugugucuacgaagagacgggcgaauuuaugagcuccaaugccagcgaggugaagagaauccccgaaggcgagaaaugggaggaugggccuugcaagguuugcgaaugucggggagcucaggugaccugcuaugagccgucuugucccccuugccccgucggcacacucgcccuggaagugaaagggcaguguugcccugacuguaccuccguccauugccaccccgacugucugacaugcagccagucuccggaucauugugaccucugccaagauccuaccaagcugcuucagaacggauggugcgugcacagcuguggccugggguucuaccaggccggcucccucugccuggcuugucagccccaaugcucuacguguacaagcggacuugagugcuccagcugucagccuccccugcucaugagacacggccagugcguuccuaccuguggggacggauuuuaccaggaucgccauucuugcgccgugugucacgaguccugcgcgggcugcugggggcccacagaaaaacauugucuggcuugccgggacccgcugcacguccucagagauggaggcugugagagcucuugcgggaagggcuucuauaaucgccaaggaaccuguuccgccugcgaccagagcugugauuccugcggcccuucuagcccccggugucugaccugcacagagaaaacggugcuucacgacgggaaguguauguccgagugccccggaggcuacuaugccgaugcuaccgggagauguaagguuugccauaacucuugcgccagcuguuccggaccuacaccgagccacugcaccgcuuguucucccccuaaagcccugcgccagggccauugccucccccgguguggggaaggcuuuuacuccgaccacggagugugcaaggcgugucauagcucuugccuggccuguaugggcccugcucccucccacugcacaggguguaaaaagccugaggagggacuucaagucgaacagcugagcgacgugggcauucccucuggggagugccucgcccagugcagagcucacuucuaucuggaaagcaccggaaucugugaggccugccaucaguccuguuuucgcugcgcgggcaaaagcccgcacaauuguacggauugcgggccuucucaugugcugcucgacggccaaugucugucccagugccccgauggauacuuccaccaggaaggcagcuguacagagugccauccuaccugucggcagugccacgggccccuugaguccgacugcauuucuuguuauccgcacaucagccugaccaacggaaauugcagaacauccugucgcgaagaacaauuccucaaccugguuggcuacugcgccgauugucaucaccugugccagcauugugcugccgaccuucacaauaccgggucuauuugccuccggugucagaacgcucacuaccugcugcucggagaucauugcgucccugacugucccagcggcuauuacgccgaaagaggcgccugcaagaagugccacuccucuugucggacaugccaggggcgcggaccuuuuagcuguuccagcugcgauacgaaccuggugcuuucucauaccggcacauguuccaccacaugcuuccccgggcacuaucuggacgauaaucaugugugucaacccugcaacacccacuguggaagcugcgacucucaggcuuccuguacgagcugcagagauccuaauaaaguccuccuguuuggcgagugccaguacgaaucuugugcgccgcaauauuaccuggacuucuccaccaacacaugcaaggagugugacuggagcugcuccgccuguagcgggccccuuaaaaccgauugccuccaguguauggacggauaugugcugcaggauggcgcuugcguugagcagugucugucuagcuuuuaccaagacuccggccucugcaagaauugugauucuuacugccugcagugccaggggccucacgaauguacacggugcaaaggacccuuccuucugcucgaggcccagugugugcaagaaugcggcaagggguauuuugccgaccaugcuaagcacaaauguaccgccugcccucagggaugucugcagugcagccauagagaucgcugucaccugugcgaccacggcuucuuucuuaaguccgggcucugugucuacaacugcgugcccggauucucuguucauacgagcaaugagacaugcuccggcaaaauccacaccccuucucugcaugugaacggcagccugauccucccgauuggguccaucaagccccuggauuuuagccuucugaauguccaggaccaagagggacggguggaagaucuccuguuccacguugugucuacaccuaccaacggccagcugguccuuuccagaaaugggaaagaggugcagcucgacaaggcgggacgcuuuagcuggaaggaugugaacgagaaaaaggucagauucguucauucuaaagagaagcugcggaaaggcuaucuguuccucaagauuuccgaccagcaauuuuucagcgaaccccagcugaucaauauucaggcuuuuuccacccaagccccuuacgugcuucgcaacgaggugcugcacaucucuagaggggagcgggccacaaucacgacccagaugcucgacauucgcgaugacgauaauccccaggacgucgugaucgaaauuaucgauccgccucugcacggacagcugcuucaaacacugcagagccccgcuacccccauuuaucaguuccagcucgacgagcuguccagaggccuccugcauuacgcccacgauggcagcgacucuacauccgauguugcggugcuucaagcuaacgacgggcauagcuuucacaacauccuguuccaggucaaaaccgugccucagaaugaucggggacuccagcugguugccaacucuaugguguggguccccgaaggcgggaugcugcaaaucacgaaucgcauucuucaggccgaggcuccuggagccagcgcugaagagaucauuuauaagaucacacaggacuacccgcaauuuggcgaggugguucugcucgugaacaugcccgccgacuccccugcggaugaagggcagcaucugcccgacggaagaaccgccaccccuacaucuaccuucacacagcaggauauuaaugagggcaucgucugguaccggcauagcggcgcucccgcccaauccgacucuuuucgcuucgaagugagcuccgcuagcaacgcccagacgagacucgagucucacauguuuaauauugccauccugccgcagaccccugaagcucccaaggugucccuugaggcgagccugcauaugacagcccgggaggaugggcucaccgucauccagccucacucccugucuuucauuaacagcgaaaaacccuccggaaagaucguuuauaauauuacacugccucuucaucccaaccaaggcaucauugagcacagagaccacccgcauucuccuauccgcuacuuuacccaggaagauaucaaucaggggaaagugauguaucggccgcccccugcugccccgcaucugcaggagcucauggccuucagcuucgcuggacugcccgaguccgugaaguuucauuucacggucagcgacggcgaacacaccucuccugagauggugcucacaauucaucugcuucccuccgaucaacagcugccuguuuuucaggugaccgcccccagacuggcggucagcccugggggaucuacauccgugggccuccagguugugguccgcgacgcugaaaccgccccgaaagagcuguucuuugaacuucggagacccccucaacacggcgugcugcucaagcacacagccgaguuccgccggcccauggcuaccggggauacguuuacauacgaggacgucgaaaagaacgcccugcaguauauccaugauggaagcucuaccagagaggacagcauggaaauuuccgugaccgacggccucacaguuaccaugcuggaggugcgcgucgaagugucucuuagcgaggaucgggggccuagacuggcggcuggauccagccuguccaucacgguugccucuaaaagcacagccauuaucacccggucccaccucgcuuacguggacgauucuagccccgacccggagaucuggauucagcugaauuaucuuccuuccuacggcacacugcuccgcaucucugggagcgaagucgaggaacuguccgaggugagcaacuucaccauggaagauauuaauaacaagaaaaucagauacucugccguguuugagacagacggacaucucguuaccgauuccuucuauuuuagcgucucugacauggaucacaaccaccuggacaaucaaauuuucacgaucaugaucacccccgcugagaaucccccucccgugauugccuucgcggaucuuaucacaguggacgaaggcggccgggccccucuguccuuucaucacuucuuugcuaccgaugacgacgauaaucugcagcgcgacgccauuaucaagcucagcgcucugccgaaauacggguguauugagaacacaggaaccggcgauagauucgggcccgaaacggccucugaccuugaggccuccuuuccuauccaggauguccuggagaauuauauuuacuauuuccagagcgugcaugaauccaucgagcccacacacgacaucuuuagcuucuacguuucugauggaaccagccgguccgaaauucauucuaucaacauuacaaucgaggugaagacccucgaagucggcaagguggagccucugaccacaauuuuucacacgaucagagagcucagccuguga

SEQ ID NO: 69458 - RNA, 840 nt, Artificial Sequence
  derived and/or modified sequence opt5 from FRAT1__Homo_sapiens__NP_005470
augcccugcagacgggaggaagaggaagaggccggcgaagaggcugagggggaagaggaagaggaggacagcuuccugcuccugcagcaauccguggcccuuggaucuagcggcgaagucgaucgccugguugcgcagaucggggagacccuccagcuggacgcugcccagcacuccccugccucuccguguggacccccuggcgcuccccuuagagccccugggccccuggcugccgcggugccugccgauaaggcucggagcccggccgugccccuccugcugccucccgcucucgccgaaacagucggaccugcgcccccgggcgugcugcgcugcgcccuuggcgacagagggcggguucgcggcagagcugccccuuacuguguggcugagcuggccacgggacccuccgcccucucuccucugccuccccaagcugaucuugacgggcccccgggagcgggcaaacaggggauuccccagccucugagcggacccugccggcgcggcuggcucagaggcgccgcugccucccggcgccugcagcaaagacgggggagccagccugaaacccgcacaggagaugacgauccccauagacugcuccagcagcugguccuuucuggcaaccugaucaaggaggccgugcggagacuccacucccgccggcugcaacuuagagcuaaacugccgcagcgcccucuccuggggccccugagcgccccuguucaugagcccccuucuccccgguccccgagagcggcuuguagcgacccuggagccucuggccgcgcccagcuccggaccggggauggagugcugguccccggcuccuga

SEQ ID NO: 69459 - RNA, 702 nt, Artificial Sequence
  derived and/or modified sequence opt5 from FRAT2__Homo_sapiens__NP_036215
augcccugcagacgggaggaagaggaagaggccggcgaagaggcugagggggaagaggaagaggacgauagcuuccugcuccugcagcaauccgugacccuuggaucuagcggcgaggucgaccgccugguugcccagaucggggaaacacuccagcuggaugcggcucaggacuccccugccucuccgugugcucccccuggagugccccuuagagcuccuggcccccuggccgcugccgugccugcggauaaggcccggccgcccgcugucccucuccugcugcccccugccagcgcugagacgguggggcccgccccguccggagcgcuccgcugcgcccugggcgacagaggccggguucgcgggagagcugccccuuacuguguggcugaagucgccgccggacccucugcccuuccuggccccugccggcgcggguggcugagagaugcggugaccagccggcgccuccaacagagacgguggacacaggccggagcucgcgccggcgacgaugacccccacagacugcuucagcaacugguucucuccgggaaccugauuaaagaggccgugcggagacugcagcgcgcugucgccgcgguggcugccaccggaccugccagcgcuccgggccccggcgggggacggucuggcccugauagaaucgcccuccagcccuccgggagccugcuuuga

SEQ ID NO: 69460 - RNA, 2148 nt, Artificial Sequence
  derived and/or modified sequence opt5 from FREM1__Homo_sapiens__XP_006716792
auggugacccaggagagcaugcugaaggccgcucucccccuguucacaagauuuaucauuuccaacggccuucggacggaacacggggucuucgagaucacccuggaaacaguugaccgcgcccucccuguggugaccagaaauaaaggacugcggcuugcgcaaggcgcugucgggcugcucucuccggaucugcugcagcucacagaccccgauaccccugccgagaaccugacauuucuucuggugcagcucccccagcauggacaacuguaccuuuggggcaccgggcugcuccagcacaauuucacgcagcaggacguugauagcaagaacguggccuaucgccauuccggaggcgacucucaaaccgauugcuuuacauucauggcuaccgacggcacaaaucagggguuuauugucaacggaagagugugggaggaaccuguucuguucaccauccagguggaucagcuggacaaaacggcuccccggauuacacuccugcacagcccuucccaagucggccuucugaagaauggguguuacggaaucuauaucaccucucgcgugcucaaagccagcgauccggacacagaggaugaccagauuaucuuuaagauucugcagggccccaagcaugggcaccuugaaaacaccaccacaggagaguucauccacgaaaaauuuucccaaaaggaccugaauagcaaaacgauucucuacaucauuaacccuucucuggaggucaauuccgauaccguggaguuccagaucauggaccccacaggcaacagcgccaccccucagauccuggaacucaaguggucucauauugaguggucccagacagaauaugagguuugcgaaaaugugggccugcuuccccuggagaucauuagacggggguacagcauggauucugcguuugugggaaucaaagucaaccaaguguccgccgcuguuggcaaggacuucaccgugauuccgagcaagcucauccaguucgauccugggauguccacgaaaauguggaauaucgccauuacauaugacggacuggaggaagaugacgaggucuuugaagugauccuuaacucucccguuaacgcugugcugggcaccaagaccaaagccgcggucaagauucucgauagcaaagggggacagugucacccuuccuacagcucuaaucaguccaagcauagcacaugggagaaaggcaucuggcaucugcugccucccggcucuagcuccucuaccacaagcggguccuuccaccucgaacgcagaccccugccgagcucuaugcaacuugccgugauucggggagacacgcugcgcggcuuugauuccaccgaccucagccagagaaagcugcggacacgcgggaacggaaagaccgucagacccucuuccguguaccggaauggcacagacaucaucuauaacuaccacgggauuguuagccugaaacuugaggaugacuccuucccuacccacaagagaaaagcuaaggugucuaucauuagccagccccagaaaacgaucaaggucgccgagcucccucaagcugauaagguggaauccaccacagacucucauuuuccccgccaggaucagcugccgagcuucccuaaaaauugcacccuggagcucaagggccuguuucacuucgaagagggcauucagaaacuuuaucaauguaacggaaucgccuggaaggccuggagcccccagacaaaagacguugaagauaagagcugcccugcuggguggcaucagcacucuggauacugucacauucugaucaccgagcaaaagggcacguggaaugcggccgcucaggccugccgggagcaguaucucgggaaccuggugacagucuuuuccagacagcauaugcgcuggcugugggacaucggaggccggaaauccuucuggauugggcuuaaugaucaagugcacgccggccauugggaauggaucggaggcgagcccguggcuuuuaccaacgggagacgcggaccuucucagcgguccaagcucggcaaaagcuguguucugguccagagacaggggaaguggcaaacaaaagacugccgccgggccaagccccacaauuacguguguucuagaaagcuguga

SEQ ID NO: 69461 - RNA, 9510 nt, Artificial Sequence
  derived and/or modified sequence opt5 from FREM2__Homo_sapiens__NP_997244
augcacagcgccggaacccccgggcuguccucucggcggacaggaaacagcacguccuuccagccuggcccgcccccucccccucgccuccugcuucugcuccugcuucugcucucucuggugagcagaguccccgcucaaccugccgccuuugggcgggcucugcucuccccgggacuggccggcgccgcugggguucccgccgaagaagcuaucgugcuugccaaucgcggacugagagugccuuucggccgggaagucuggcucgacccccugcaugaucuugugcugcagguucagccuggcgaccgcugcgcggugucuguccucgauaacgacgcccuggcucagagacccgggcggcugagcccgaagcgcuuuccuugugauuucggacccggcgaagugagauacucccaccucggggcccggagcccuucucgcgacagaguucggcugcaacuucgcuaugaugcucccggaggcgccgugguccugccccucgugcuggagguggaagucguuuuuacccagcuugagguggugacaagaaaucugccucucgucguggaggaacugcuggggaccuccaacgcgcucgacgcccggagccuggaguucgcuuuucagccggaaacagaggagugcagaguuggcauucuuucuggccugggcgcccucccccgcuacggggaacugcuucauuauccucaggugcccggaggcgcucgggaagggggagccccugaaacccugcucauggauuguaaagccuuccaagagcugggcgucagauaccgccacacagcugcgucccggagccccaauagagacuggaucccgauggugguugaacugcgcucuagaggggccccugugggaucccccgcucucaagagagagcauuuucagguccuggugcgcauucggggcggcgccgagaacaccgccccuaaacccagcuucgucgcuaugaugaugauggaaguggaucaguuuguucuuacggcccugaccccugacaugcucgcggcugaggaugccgaaucccccucugaccugcugaucuucaaucuuacaagcccguuucagccugggcaaggauaucucguguccaccgacgauagaagccugccccugucuuccuucacacagcgcgaccuccggcugcuuaagauugccuaccagcccccuagcgaggauucugaccaagaaagacuguucgagcucgagcuggaagucguggaucuggagggcgcugccagcgacccguuugcuuucaugguuguggucaaacccaugaacaccauggccccuguggugacgcggaauacagggcuuauccucuaugaaggacagucccgcccccugaccggcccugcggggucuggcccccagaaccugguuaucagcgaugaggacgaucucgaagccgucagacuggaggugguggcuggacuucggcacggccaccuggucauucucggggccuccagcggaucuuccgcuccuaagagcuuuacaguggccgagcuggcggccggccagguuguguaccaacaugacgauagagacgggucucuguccgacaaucuuguccuccgcaugguggauggaggcgggcggcaccagguucaguuccuguuucccaucacccuggugccggucgacgaucagccucccgugcucaacgcuaauaccggccugacacuugccgaaggagagacgguuccuauucugccccucagccuguccgcuaccgacauggauucugacgauagccugcuucucuucgugcuggaauccccguuucugacaaccggccaucuccugcuuagacaaacacacccuccccacgagaagcaggagcugcuccgcgggcuguggagaaaagaaggagccuucuacgagcggaccgucacggaauggcagcagcaagacaucacagagggccgccuguuuuauagacauucugggccucacagccccggacccgugaccgaucaguucaccuuucgggugcaggacaaccaugauccuccgaaucaguccggccuucaacgcuucgucauuagaauccaccccguugaccggcugccucccgaacucgggagcggcugcccucugcgcaugguggugcaggagucucagcucacaccccugagaaagaaauggcuucgguacaccgaucuggacacagacgaucgcgagcucagauauacggucacccaaccuccgacagacaccgaugaaaaccaucugcccgccccucugggaacacuugugcugaccgacaaccccuccguuguggucacgcacuuuacccaggcucagauuaaucaccauaagaucgcguaccggccucccggccaggagcucgggguggccacaagaguugcucaauuccaguuccagguggaagaucgcgccggaaacgucgccccgggcaccuuuacacuguaucuccacccuguggacaaucagccgcccgagauccugaacaccggguucacgauucaagaaaaaggacaucacauccuuagcgagacagagcugcacguuaaugauguggacaccgaugucgcucauauuucuuuuacacucacccaggccccuaagcacggccauaugcggguguccgggcagauccugcacgugggcggacuguuccaucuugaagacauuaagcagggcagagucagcuacgcgcacaacggggauaaaucucugaccgacagcuguucccucgagguuagcgaucgccaccauguggugcccaucacacugcgggucaaugugagaccuguugacgacgaagugccgauccucucucaccccacgggaacccuggaguccuaucuugauguccuggaaaacggcgcuacagagauuaccgccaaugugaucaaggggacaaacgaggaaaccgacgaucugaugcucacguuucugcuugaggacccuccccuguacggagaaauucucguuaauggcaucccugccgagcaauucacacagcgcgauauucuggagggcagcguggucuacacccauaccuccggggaaaucggacuccugcccaaagcugacucuuuuaaccuuagccuguccgauaugucucaggaguggcggaucggcgggaauacaauucaaggagugaccaucugggucacaauucugccgguggacagccaggccccugaaaucuucguuggcgagcagcucauugugauggaaggggauaaguccgucaucacgucugugcacauuagcgcggaggacguugauucccugaacgacgacauccuuugcaccaucgugauucagcccacaagcggauaugucgagaauaucucuccugcucccggcuccgaaaagagcagagccggcauugccaucucugcuuuuaaccugaaggaucuccgccaagggcauauuaacuacgugcaguccgugcacaaaggaguugagccugucgaggaccgguucguguuuagauguagcgauggcaucaauuucucugagcggcaguuuuuccccaucgugauuaucccgaccaacgacgaacagccugagauguucaugcgcgaguuuauggucauggaagggaugucccuggugauugauacacccauccucaaugccgcugacgccgauguuccccuggacgaucuuaccuucacgauuacccaauuuccuacacacggacauaucaugaaccagcugaucaauggcaccgugcuggucgagagcuucacacucgaccagauuaucgaauccagcucuauuaucuaugagcacgaugacagcgaaacccaggaggauuccuuugugauuaagcugacagacgggaagcauucuguugagaaaaccgugcuuaucaucgucauuccgguggacgaugaaacgcccagaaugacaaucaacaauggacuggagauugaaaucggcgacaccaagauuaucaacaauaaaauucucauggcgaccgaucuggacagcgaggauaagucccucguuuacaucauccgguauggcccugggcacggacugcuucaacgcagaaaacccacaggcgccuucgagaacauuacccuggggaugaauuuuacgcaggacgaaguggaucggaaccugauccaguacguccaccucggacaggagggcauuagagaccugaucaaguucgaugugacagacgggauuaauccucuuaucgaucgcuauuuuuacgugucuaucggaagcauugacaucgucuuccccgauguuauuuccaagggcgugucucugaaagaaggcgggaaggugacccucacaaccgaccugcugagcacauccgaccucaacagcccugaugagaaucuugucuuuaccaucacgcgggcuccgaugagaggacaucuggaaugcaccgaccaacccggcgugucuauuacauccuucacccagcugcagcucgccgggaacaaaaucuacuauauccacacagcugaugacgagguuaagauggauagcuucgaguuucaagugaccgacggacgcaacccugucuuccggacguuuagaauuucuaucuccgauguggacaauaaaaagcccguugugacaauucauaagcuggucgugagcgaauccgagaacaaacuuaucaccccuuucgaacugacagucgaggaucgcgacacccccgauaagcuccugaaauuuaccauuacacaggugccgauccacggccaucuccuguucaauaacacgcggccuguuaugguguuuaccaagcaggaccuuaaugaaaaccugauuucuuacaaacacgacgggacagagagcuccgaggauagcuucucuuuuaccgugacagacggaacccacacggauuucuaugucuuucccgacacaguuuucgaaaccagacgcccccaggugaugaagauccaagugcuggccgucgauaauuccgugccucagaucgccguuaacaagggcgcuagcacccucagaacacuggcgaccggccaucuuggguuuaugauuacaucuaaaauccugaagguggaggaccgggauagccuccacauuucccugcgcuucaucgucacggaagcgccccagcauggauaccugcucaaucuugacaaaggcaaccacucuauuacccaguucacacaagcugauaucgacgauaugaagaucuguuaugugcugagagagggggccaaugccaccagcgacauguuuuacuucgcugucgaagauggaggcgggaacaaacugacauaucagaauuuucggcucaacugggccuggauuuccuucgagaaggaguacuaccuggugaaugaagacucuaaauuucuugacguugugcugaagcgcagaggauaucucggcgagaccagcuucaucuccauuggcacgcgggauagaaccgcggaaaaggacaaagauuuuaaggggaaagcucagaagcagguccaauucaacccuggacagacacgcgccaccuggcgggugagaauccugagcgacggcgagcacgagcagucugaaacauuucaaguugugcuguccgagccgguccucgccgcucuugaguuccccaccguggccacaguggagauuguugauccuggggacgaacccacggucuuuaucccucagagcaaauacuccguggaggaggaugugggagaacuguucauccccauucgccggucuggcgacgucagccaggagcugaugguugugugcuauacccagcaagggacagcgaccggaaccgugccgacauccguccucucuuacagcgauuauaucuccagaccugaagaccauacgagcgugguucgguuugauaaggacgagcgcgaaaagcuguguagaauugugaucauugacgauucucuuuacgaggaggaagagaccuuccacguccugcucuccaugcccaugggcggccggaucgggagcgaguucccuggagcucaggugacaauuguucccgacaaagaugacgagccuaucuuuuauuucggcgauguggaauacucugucgacgaguccgccggguacguggaggugcaggucuggcgcaccggaacagaucugagcaagucuagcuccguuaccgugagaucucggaaaacggacccucccagcgccgaugcuggcacagacuauguggggaucucccgcaaccuggauuuugcccccggcgucaauaugcagcccgugagaguugugauucucgacgaucuuggacaacccgcucuggaaggcaucgagaaguucgaacugguccuccggaugccuaugaacgccgcgcugggggagccgagcaaagccaccguguccauuaaugacucuguuagcgaccuucccaagaugcaguuuaaggagcgcaucuacaccggauccgaaucugauggccagauugugacaaugauccauagaaccggggacguccaguaucggagcuccgugagaugcuacacacgccaaggaucugcucagguuaugauggauuucgaggaacggccuaacaccgacacgagcaucauuacauuucugcccggcgagaccgaaaaaccuugcauccucgagcugauggaugacgugcuguaugaggaagucgaggaacucagacuugugcuggggacaccccaguccaauagcccuuucggcgccgcugucggagagcagaacgaaacccugauucgcauccgggaugacgccgauaagacggugauuaaauuuggcgagaccaaguucucuguuacagagcccaaagaaccgggggaguccguggucaucagaaucccugugauucgccaaggagacaccagcaaggugucuaucguucgggugcacacaaaggauggcuccgccaccagcggggaagacuaccaucccgucucugaggaaauugaguuuaaagagggagaaacacagcacgugguugagaucgaagugaccuucgauggcgucagagagaugcgcgaggcuuuuacggugcaccucaagccugacgaaaauaugauugcggagaugcagcugacaaaagccaucgucuauauugaagagauguccagcauggcugacgugaccuuccccuccguuccgcaaaucgugagccuucugauguacgaugacaccucuaaggccaaagaaagcgccgagccuauguccggguaccccgucaucuguauuacagcuugcaaccccaaguauucugauuacgacaaaaccggcagcaucugugccuccgagaauauuaacgauacacucacgcgguauagauggcugaucucugcgccugcuggacccgacggcgugaccagcccuaugcgcgaaguugauuucgacacauuuuucaccuccucuaagauggugacacuggauagcauuuacuuucagccggggucccggguccagugcgccgccagagcugugaauaccaacggagacgagggccucgaacuuaugagccccaucgugacgaucucucgcgaggaagggcugugucagccuagaguucccggagucgugggcgccgagccuuucuccgcgaagcugcgguauaccggccccgaggaugccgacuacacaaaucucauuaaacugaccgugacaaugccucauaucgacgggaugcuuccggucauuagcacccgcgaacugucuaacuuugagcucacgcugucccccgauggaacaagagugggcaaucacaagugcagcaaccugcucgacuauaccgaaguuaaaacacauuacggguuccuuaccgaugcuaccaagaauccugagaucauuggagaaacauaccccuaucaauacucccugucuauccggggcagcacgacccugagauuuuaucggaaccucaaccuggaggccugucuuugggaguucguguccuacuaugacaugagcgaacugcucgcugauugcgggggaacaaucggcaccgacggccagguccugaaucuggugcagucuuacguuacacuccgcgugccucuuuaugucuccuacguguuucacagccccguuggggugggaggcuggcagcacuucgaucugaaaucugagcugagacucaccuuugucuacgacacggccauucuguggaacgaugggaucggaagcccgccugaagcugagcuucaaggcucccuguaucccacaucuaugcggauuggggacgagggacgccucgccgugcauuucaagaccgaagcgcaguuucacggccuguucgugcugagccaucccgccuccuucaccucuagcgucaucauguccgcugaucacccuggccucacauuuagccugagacuuauucggucugagcccaccuacaaucagccuguucagcaaugguccuucgugagcgacuuugccgugcgcgauuauuccgggacauacacggucaagcuggugccguguaccgcucccucucaucaggaauauagacucccuguuacaugcaacccccgggagccugugaccuucgaccuggacauccgcuuucagcaagucagcgaucccguggccgccgaguucucccuuaauacacagauguaccugcucucuaaaaagagccuguggcuguccgacggaagcaugggcuuugggcaggagucugauguugcuuucgcggagggagacauuaucuauggcagagugauggucgauccggugcagaaccucggggacuccuuuuacuguagcaucgaaaaagucuuccugugcaccggagccgauggcuacgugccuaaguauucucccaugaaugcugaguacggcugccuugccgacuccccuagccugcucuaucgguuuaaaauuguugauaaggcccaacccgaaacgcaggcuaccucuuucgggaacgugcuguuuaaugccaaacuugcggucgacgauccggaggccauccugcucgugaaccagccuggauccgacggcuucaaaguugauagcacaccccuguuccagguggcucuggggcgcgaaugguacauucacaccaucuauacagucagaucuaaggacaaugccaaccggggaauuggcaaacgcagcguggaguaccacucccucgugagccaagggaagccccaguccaccacaaaaucuagaaagaagcgggagaucagaagcaccccuucccuggcuugggaaaucggagccgaaaauucucgcggcacgaacauucagcauaucgcgcuugaccggacaaaaagacagauuccccacggccgcgccccuccggaugggauccugcccugggaacucaauagcccuuccucugcuguuagccuggucaccguggugggaggcaccacagucgggcuucugacgauuugucucaccgugaucgccguucugaugugccggggaaaggaguccuuuagaggcaaagacgcucccaagggguccucuagcagcgaaccuauggugcccccucaaucucaucacaacgauuccagcgaggucuga

SEQ ID NO: 69462 - RNA, 6420 nt, Artificial Sequence
  derived and/or modified sequence opt5 from FREM3__Homo_sapiens__NP_001161707
auggccggcgcuagccggcaccccaccgggaccccucggcaacugcucguggcccuggcgugccuucugcucucccgcccggcucugcaaggacgggccucuagccuuggcacggagcccgacccugcccuguaccuccccgcuagaggggcccuggauggaacccgcccugacggccccuccgugcugaucgcuaacccugggcucagaguuccgcugggacggucucuuuggcuggauccccuccgcgaccuggugauuggcgugcagccuggcgauagaugugaagucacagugcuugacgcccugccccggcucaagggggcgcugagcccucgcagauuccccugcaccuuuggaccgcggcagguucaguauacacauuucggcucccacucuccugggcgcgccagagugcugcuccaacugcgguacgaugcucccacccauacacuuguccugccuuuuacccucgccguggaccugguuuucagccagcuugagcuggugacgcgcaauagaccccucgucguggaaaaacugcgguccuggagcagagcuaucgaucgccgggugcuggacuuugccucucucaaguccggagcgaccgccacaagacgcugucggcugacaccccuuccucacgaggauggcccgcugcccaaauaugggagacucgucgacgcuguuggagccccucugccccgcggcaagggcguggauugcgaggcuuuccuucgggccggggugagauaccagcauacagccaccagcucuccuaaccgcgacuauguccccaugaugguggagcugcucggaccggagggccaggacgcuggguccgcgggaguucuggugcgggaacacuuucaacugcucguccgcauuagaggcggggccgagaauacgccuccccggccuagcuucauggcuacaaugaugauggaaguggauccccugguucuuaccgcccugacaccugacgcccucgcugccgaggauguggagucugaccccggagaucuggucuuuaacauccugaaugcgccgacccacccucccggccaucccggccagcagggguacguggucuccaccgacgauccucuuggacucccggugagcuucuuuacacagcaagaacugagagagcugaaaauugcuuaucagcccccugccgaaaacucccacggcgagagacucuuccagcuggaacuugagguuguggacggggauggagccgcuucugaccccuuugccuucauggucacggucaagagcaugaauacccugguuccuguggcuucccauaaccgcggccucguccuguucgaggggcaaagcagaccccugucuuccacacacagcaucccuaucucugauaaggacaaucuugaagaggugaaaauggccgcggugcggggccucagacacggacagcugguugucuuuggcgcccccgcuggguguaaguacuucaccccggccgaccuggcugccggacgcgugguguaccagcaugauggcagcaacacauauuccgacaauauuaucuuucggauggaagaugggcaccaucaggucgacuuccucuuuccucugaccauucuucccguggaugacgagccucccaugguuaacacgaauacaggacugucucucaccgaaggccaagugguccagaucagcccguucgugcuguccgcgaccgauauugacagcgaggauucuacaauccacuuuguucuggagaaccagccucuuaaagggaaugaagaggaaccccagugggagcucgccccuggcuccagccauucuggacacuaccugggcgaccugcuccugcaacaggcugaacuuccccuguccaccgaggaugaggacuggcacuauauggaaaaggaggggcucuacgaaaaaguggucacagaguggcugcagagagauauuauggagggacgccuguucuauagacaucuuggcccccacagcccucaguccgugaugguucaacucgccuuucaugugcaggacgaccacgauccgcccaaccugucuaagcagcacaucuucacgaucaagguccagccuguggacauucugagcccccaacucuacccugggaccacacuggaaaugaccgugcaggaguaucagcuuacacauuuucaaaagaacuuccugcgguacaucgaucaggacuccgaugaccagaaucucugguacacccugcugacgcuucccaccgauacagacggaaaccaccagguccgcgcuggcgaaauuguucugaccgauucuccugacacacucaucaugcauuuuacccaagcccaggugaaucagcacaagguggccuaucagccgccccaaaaacuggggauugcuccuagagucgugcaguucacguaccagguugaggaugcggccggcaacagcgugcccggaacauucacccucuuucugcagccugucgacaaucaacccccggaagugacaaaccggggcuucgcuauccuugaagggggauccuuuaaucugagcucuaacgagcuccauguuaccgauccugacaccgacaucgaucagauuguguucauccugguccgcggcccccagcacgggcaucugcaauauuuuaagagaugcauggugcccggagaauccuucaugcaggccgacguuauuaauggcagcgugucuuaccagcacgggcgggaucagacaacgaccuccgacacauuucaccuugaggucagcgauggcgugcaucacaucccuauuaccauccccaucucugugcauccuaacgucgccaaucgcagcccgagaauuucccugcgguccucuagccuccuggacguuagcaucgaugugcucgaaaacaaagcuacagagauuaccaugggagugauccacggcaagcgcaaagacgucggggaucugaugcuuuccuucauugugaaggacucucccaagcugggaacgauccucguuaauggccugccuacagaaagauuuacccaagaggaucugauuaacgggcggguggccuaugcgcacaccgcuggagaggucggcuuccagaaacagcaugacgccuuuagccuuauccuguccaaggacucuuaccagugggugguuggcaauagcaucauugaaaaagugcaaguccaggugacaguccuccccguggauaacguugggccuaagguguucgucggagaguccuuuaucguguaugaaggcgagaaaaacucucugacccuccagcaucugcacguugaagacguggauacacaccaggacgagcuucuguguacggucaccagccaacccgccuccggguaccuggagaagauugcuagcgccccgggaucuaagaugucccagagcggcucuccuaucuccgcguucagccucagagauauucaggugcgccacaucaauuacgugcagucuauccauaaagggguugaaccccaagaggaccaguucacauuuuauugcuccgauggaauuaacuucagcccuaaugucuuuuuccccaucauuauccugccuaccaacgacgaacagcccaaacuuuuugcucacgaguucaaagugcuggagggcaugucccucgugauugauacacaacugcucaauggcgccgacgccgaucugccgccuaacgaacuucauuuucagcugaccgcucugccccggcacgggagaaucauccagcagcucgccacgggaagccaacccauucauucuuucacccugaaggagauccaggaagcuagcacaauugucuacgagcacgacgauuccgaaaccaaagaggacucuuuugagguguggcuuagcgacggcaagcacacaacccaucgcaagguuccuaucguggucacacugguggaugacgaaaccccgcaccucacgguuaauaacgggcugaaaguggagaagggacauuccgaaauuaucacaaaucggauccucaaagccaccgaucuggacucugaugacaagagccuuuccuucguccugcacucuggcccccagcaggggcugcuccaaagacugcgcaaaccucggggagaggugagaaacaaucuuacccugggcaugaacuuuacacaggaugaaauuaaucgcggccucaucuguuauauucacaccgggcaggagggaaucguugacauuaucaaguucgaugugacggacggcgucaacacacugaccgaucauuacuucuaugugacaauugggaaucucgacagcguguuucccgaggucaucuccaagcggaucacccugauugaaggagcgagaguuacacuuaccaacaaccugcugacgaauagcgauaucaacucuuccgacgagcaccauuucagcauuacccgggccccuucucucggccaccuggaauccagcgacuacgcuggggagcccaucgccuccuuuacacagcuucaacuggcuucuaauaaaauuagcuaugugcauaccuccaacgaugaaaagaaaauggacagcuucgaguuucaggugaucggagagcucuacccugucuuccgcacauuuagaaucuucauuaccgauguggacaauaagaaaccgauccugacgauucaccggcugacacuccagaaggaagauucucaacuuaucacccugcuggagcucacaguugaagacuccgauacccccgacgaucugauucuuuuuaccaucacacaggugccuaugcacggcaaaauccuguacaacggcagccgccccgucacgaccuucacaaagcaggaccucaauaagaaccugauuucuuauaaacaugaugggagcgagaccacagaggacuccuuuucucugaccgugacggacggaacacacaccgauuucuacguucucccugacaccgcccuugccacacauaagccccaggugaugagaguccaaauccggagccuggauaauagacugccgcagauuaccacaaaccgcggcgcuccugcgcucaaacggcugcacacggggcacaugggauuucuuaucaccuccaagucucugaaagccgaagaccaggauagcccccauagacuccugaaguauaaggugacacgcggccccgagcacggguucauuaucaaaaccggacugggcaaucaguccacacgggucuucacccaagcugacauugaugaaaugaagaucagcuacgugcucaacgagggcucuaaugccuccaaagacaucuuuuauuucagcguugaagauaacgggggaaauaaacuuacgaaccagccuuuucaucugaacugggccuggauuugccuggagaaagaguacuauaucguggacgaagauuccaccuuccucgaggugacacugaccagacgcggcuaccuuggggaaacaucuuuuauuagcaucggaaccaaggacgagacagcuaagaaagauaaggacuucaaauggaagacgaauaaacagauucaguuuaaccccggccaaaccacagccaccuggcgggucagaaucaucccugacaaugaauacgagaccuccgagacauuccagauuauccugucugaaccgcucauggcgguucuggaguuucccgaaauggcuacgguggagauuguggauccuggggacgaaagcaccgucuauauccccgaggccgaguacaagauugaagaggauaucggagaacugcucaucccugugcgcagauccggcgacgccagccaggagcuuauuguuaucuguucuacacggcagggcuccgcuaccgggacaauuagcucuaccgugcuguucuccgauuauaucagccgccccgaggaccacacgucuauucugcauuuugauaagaacgaaacacagaagaccugccagguccucaucauugacgauagccuguacgaggaagaggaauccuucucugugagccuuagacugccggucggaggccagcucggggcccgguuuccuaccacaaaggugaccauccuggcggaccgcuaugaugagcccguucugcacuucggagacgcugaguaccacgugaaugaauccgccagauaugucgaggugugcguuuggcggagaggcacagaccucagccaaccuuccucuaucgccgugcgcagccggaaauccgaacaggagucugcugaagccgggaccgauuacgucggaauuagcagaaaccuugacuucgcucccggcgugcgcaugcagacguuucaggugacaauccuggaugaccugggccaaccuacccucgaggggcccgagaaguucgaacugcuucugcagaugccgaugggagccguucucggcgagccuaauaaaacaaccauuuuuaucgaagauacgauuaccgacuguaagcaguccgcgugcucuagcuucgauuga

SEQ ID NO: 69463 - RNA, 777 nt, Artificial Sequence
  derived and/or modified sequence opt5 from FRG1__Homo_sapiens__NP_004468
auggccgaguacagcuaugugaaguccaccaaacugguccucaagggcacaaaaacgaagucuaaaaagaagaaaagcaaggacaaaaagagaaaacgggaagaggaugaagagacccagcuggacaucguugggauuugguggacagugaccaacuucggagaaaucuccggcacaauugcuaucgagauggauaaggggaccuacauucacgcccuugacaauggacuguuuacacucggcgcgccccauaaggagguggaugaagggccuucuccgcccgagcaauucaccgcugucaaacugagcgacucccgcaucgcccuuaagucuggauauggcaaauaccugggcaucaacagcgaugggcucgugguuggaagauccgacgccauuggcccucgggaacagugggagcccguguuucagaaugggaagauggcucugcuggccagcaacucuugcuucauccgcuguaaugaggcuggagauauugaagccaaauccaagacggcgggcgaggaagagaugaucaaaauuagaagcugcgccgaacgggagaccaagaagaaagacgauaucccugaggaagacaaggggaacgucaaacagugugagauuaauuaugugaagaaauuucaaucuuuccaggaucacaagcucaagaucuccaaagaagacagcaagauccugaaaaaggcucgcaaagacggauuucuucaugagacacugcucgauagacgggccaagcugaaggcugaccgcuacugcaaauga

SEQ ID NO: 69464 - RNA, 837 nt, Artificial Sequence
  derived and/or modified sequence opt5 from FRG2__Homo_sapiens__NP_001005217
augggcaaggggaacgaggacagcgaucugcacugcuccucuauccaguguagcaccgaccaacccccuuuccagcagauuuccuuuacagaaaaaggaucugaugagaagaaaccguucaaggaaaaaggcaagacggccuuuagccauuccucugagaagcacauccagagacaagggagcgaacccaauccuaacaaagaaaauuccgaggagaccaagcucaaagcuggaaacagcacagccggcucugagcccgaauccagcucuuaccgggagaauugccgcaagagaaaaauguccagcaaggacucuugucaggauaccgcggggaacugcccugagaaggaauguucccugagccuuaauaaaaagucccggucuagcacagcugugcauaacuccgagauucaggaaaccugcgacgcccaccaucgcggacacagcagagccuguacaggccacucuaaacggcaucgcuccagagcucugggcguccagacccccagcauccggaagucucucguuacgagcgugcgcgccauguccgaggcuguguaucaagaucuggcccaggucugggcgcagcagauucacucuccucuuaccugcgaacaacugacacuccugaccagacugcgggggccgcucugugcccaggugcagacacuguacagcauggcuacccaagccgcuuauguuuuccccgccgaguccuggcuugugccugcgacgcugcccggaccuggcgagagcgcccucgaccgcgaagcucaucccuuuccggggcaggagaucacagaaaccgucucuggauccgaugaggccaaacuguga

SEQ ID NO: 69465 - RNA, 1518 nt, Artificial Sequence
  derived and/or modified sequence opt5 from FRK__Homo_sapiens__XP_011533957
augagcaacaucugccagagacugugggaguaccucgaacccuaucugccuugucuuuccaccgaggccgacaagucuacagugauugaaaauccgggcgcucugugcagcccccaaucccagcggcacgggcauuacuucgucgcccucuuugauuaucaggcgcgcacggcugaggaccugucuuucagagccggagauaaacuucagguucuggacacccuccacgaaggcuggugguuugcccggcaucuggagaagcgcagagaugggagcucccaacagcugcagggauacaucccuucuaacuauguggcugaggaccggagccuccaggccgaacccugguucuuuggcgcuauugggcgcuccgaugccgagaaacaacugcuuuacagcgaaaauaagacaggaucuuuccugaucagagaguccgagagccagaaaggcgaauuuucucucuccgugcuggacggcgcggucgugaagcacuaucggauuaagcgccuugaugaagggggauucuuucugaccagacggcgcaucuucagcacacucaacgaguuuguuucucauuacaccaaaacauccgacggccugugugugaagcuggggaaaccuugccucaagauccagguccccgccccuuucgaucugagcuacaaaaccguggaccagugggagauugauagaaauuccauccaacuucugaagcggcucggaucuggccaguuuggggaaguuugggagggacuguggaacaauacgaccccgguggcugucaagacacuuaaacccggcagcauggacccuaacgacuuccugcgcgaggcccagauuaugaagaaucucagacaccccaaacugauccaacuguaugcuguguguacccucgaagauccuauuuacaucauuacagagcugaugcggcacggcucccuucaggaauaucugcagaacgacaccgggagcaagauccaucucacgcagcaaguggauauggccgcgcaggucgccucuggaauggcuuaccuggaguccagaaauuauauccaccgcgaccuugccgcucggaacguucuggugggcgaacauaauauuuacaaaguggccgauuucgggcucgccagagucuuuaagguggacaacgaggauaucuaugagagccgccacgaaauuaaacugcccguuaaguggacagcuccggaggcgauccggucuaauaaguucagcauuaaauccgacguguggucuuuuggaauccugcucuacgaaaucauuaccuacggcaagaugccuuauagcgggaugacaggagcccaggucauccagaugcuggcucaaaacuacagacuuccccagccuuccaacugcccccagcaguucuauaauauuaugcuggaguguuggaacgccgaacccaaagagcgcccuaccuuugagacccuccgguggaagcuggaagauuacuucgagacagacagcucuuauuccgaugccaauaacuuuaucagauga

SEQ ID NO: 69466 - RNA, 1671 nt, Artificial Sequence
  derived and/or modified sequence opt5 from FRMD3__Homo_sapiens__NP_001231888
auguucgccagcugccacugugugcccagaggccggcgcaccaugaagaugauccauuuuagauccucuagcgucaaaucccugucucaggagaugcggugcacaauucgccuccuggacgauagcgaaaucuccugucacauucaaagagagacgaaggggcaguuccuuaucgaccauauuugcaacuacuauucucugcucgaaaaagauuacuuuggaauccgguauguugacccugagaagcagcgccacuggcuggaaccgaauaaaagcaucuucaagcagaugaagacccaucccccuuacacaauguguuuuagagugaaauucuauccccacgagccucuuaagauuaaagaggaacugacccgguaccuccuguaucugcaaaucaagcgcgauauuuuucacggcagacuccugugcuccuucagcgacgcugccuaccuuggggcguguaucgugcaggcugagcugggagauuacgaccccgaugaacauccugagaacuauauuucugaguuugaaaucuucccgaaacagucccagaagcucgagcggaagauugucgaaauccacaaaaaugagcugcgcggccaaucucccccuguggccgaauuuaaccuucugcucaaggcccauacacuggagaccuacgggguugacccccacccuugcaaagauagcacaggaaccacgaccuuccugggcuuuacagcugccggcuucguggucuuccaggggaauaagagaauccaccucauuaaauggcccgacguguguaagcugaaauuugagggaaagaccuucuauguuaucggcacacagaaggagaaaaaggcuaugcuugccuuucauaccuccacgccggcggccugcaaacaccuguggaagugugggguggagaaccaggcuuucuacaaauaugccaagagcucucaaauuaagacagucuccagcuccaaaaucuuuuucaagggaucucgguuucgcuacagcggcaaaguggcuaaggaaguggucgaggccuccagcaaaauucagagagaaccucccgagguucaucgggcgaauaucacccagucuagauccagccacucucucaacaagcaacugaucauuaauauggagccucuucagccccugcuccccagcccuuccgaacaggaggaagaacugccgcugggggaaggagugccccucccuaaggaggagaacaucucugcuccccugauuagcuccagcccugugaaagccgcccgcgaauaugaggaucccccgucugaagaggaggacaagaucaaagaggaaccucuuacaauuuccgaacuggucuacaaucccagcgcuucucuccugccuacccccguggacgaugacgagaucgauaugcuuuucgacugcccuucccggcuggaacucgagagagaggauaccgacagcuuugaagaucuggaggccgacgaaaacgccuuccugaucgcugaggaagaggagcucaaggaagcgcgccgggcccuguccuggucuuacgauauucuuacaggccauaucagaguuaauccccuggugaaauccuuuagccgccuccuggucgugggccuggggcuucuccuguucguuuuuccgcugcuccugcuucugcucgagucugugagcaugcaguga

SEQ ID NO: 69467 - RNA, 3120 nt, Artificial Sequence
  derived and/or modified sequence opt5 from FRMD4A__Homo_sapiens__NP_060497
auggccgugcagcugguccccgacagcgcucucggccugcuuaugaugaccgaggggagacggugccaaguucaucugcucgaugaccgcaagcuggaacuucuggugcagccuaaacuccuggccaaggagcugcucgaucugguggcgucccacuucaaccuuaaagaaaaggaguacuuuggaaucgcuuucacagacgaaacgggccaccugaauuggcuccagcuggauagacggguccuugagcaugacuuuccgaaaaagucugggcccgugguucuguauuucugugugcgcuuuuacauugagagcaucuccuaucucaaggauaacgccaccauugaacuguucuuucugaaugccaaaucuugcaucuacaaggagcucauugacgucgauagcgaagugguuuucgagcuggcuuccuauauccuucaggaggccaaaggagacuuuucuagcaacgaaguggucagauccgaucugaagaaacucccugcucugcccacacaagcccuuaaggagcacccuagccuggcguacugugaagaccgggugaucgagcauuauaagaaacucaauggccagacccgcgggcaggccauugugaacuacaugucuaucgucgaaucccugcccacauacggaguucacuauuacgcugugaaggauaaacagggcauuccuugguggcugggccucagcuauaaggggaucuuccaauacgacuaucacgacaaagugaagccgagaaaaauuuuucaguggcggcagcuggagaaucuuuacuuccgcgagaagaaguuuucugucgaagugcaugaucccagacgggccuccguuacccgcagaacauucggacacagcggcaucgcugugcauaccugguaugccugcccugcgcugauuaaaucuaucugggccauggcuaucucccagcaccaauucuaccucgaccggaagcagagcaaauccaagauucacgccgcucgcucucugagcgagaucgccauugaucuuacggaaaccgggacacugaaaaccuccaagcucgccaacaugggaagcaagggcaaaaucauuucuggguccagcggaucucugcugagcuccggcucucaggagagcgacuccagccaaucugcuaagaaagauaugcucgcggcccugaaguccagacaggaagcucuugaggagacacugcggcagagacucgaggagcugaaaaagcugugucuucgcgaagccgagcucaccggcaagcugcccgucgaauacccucuggaccccggggaggagccgccuaucgugcggagacgcaucggaacggccuuuaaacucgaugaacagaagauucugcccaaaggcgaggaagcugagcuugagcggcuggaaagagaguucgccauccaaagccagauuacagaagcggcucgccggcucgccucugacccuaauguuuccaagaaacugaagaagcagagaaaaaccagcuaucugaacgcccuuaagaaacuccaggagaucgaaaaugcuauuaacgagaaucgcaucaaguccgggaaaaagcccacacaacgggccucucugaucauugaugacggaaacaucgcuagcgaggauuccucucugagcgacgcccucgugcuggaagacgaggauucccaggucaccagcaccauuucuccccuucauuccccucacaaaggccugccgcccagaccucccagccauaaucgcccucccccgccucagucucucgaagggcugcggcagaugcacuaccauagaaacgacuaugauaagucccccaucaagccuaaaauguggagcgagucuagccuggacgaacccuacgagaaggugaaaaagcgguccagccacucucacuccagcucccauaaacgcuuuccuucuacaggaagcugcgcggaggccggcggcggguccaacucucuucaaaauagccccauuagaggacucccgcacuggaacucccagucuagcaugccuuccacgcccgaucugcgggucagaagcccccauuaugugcacucuacccgcuccguugacaucagcccuacacggcugcacucucucgcucugcauuucagacaccgcuccagcucucuugaaucccagggcaagcugcucgggagcgagaaugauaccggauccccggacuuuuacacacccagaacccggagcucuaacggcagcgauccuauggacgauuguuccucuugcacgagccauuccucuagcgaacacuauuaccccgcccagaugaaugcuaacuacuccacacuggccgaggacucuccuagcaaggcgcgccaaagacagcggcagcgccaaagagccgcuggggcccugggcuccgcuagcucuggauccaugcccaaucuugccgcccggggcggggcuggaggcgccgggggagcgggcgggggcguguaucuccauagccagucucagccuuccagccaguaccgcauuaaagaauauccccuguacaucgagggaggcgcuaccccggucgugguuagaucccuggagucugaucaagaagggcacuauagcgugaaggcccaguucaaaaccuccaacagcuacacagccggaggccucuuuaaggagucuuggcgcgggggaggcggggacgaaggcgacaccggacggcugacaccuuccagaagccagauccuucggacgcccucucugggcagagagggggcucacgauaaaggagccggccgcgcggcugucagcgacgagcuccggcagugguaucaaagauccaccgccucucauaaggaacacagccgccugucccauacaucuagcaccuccagcgauucugggucccaguacagcacauccucucagagcaccuucguggcccacucccgggugacgagaaugccucagauguguaaggcuaccucugccgcgcugccccaaagccagcgcuccagcacaccgucuuccgagauuggagcuaccccucccagcucuccucaucacauccuuacauggcagaccggcgaagccacggaaaauucccccauucuggacgggagcgaaucucccccucaccaaagcacagaugaguga

SEQ ID NO: 69468 - RNA, 3105 nt, Artificial Sequence
  derived and/or modified sequence opt5 from FRMD4B__Homo_sapiens__NP_055938
auggccagcguguucaugugcggcgucgaggaccugcucuuuuccgggucuagauucguuuggaaccugaccgugagcacacuucggcgcugguacacggaaagacugcgggcuugucaccaggugcuccgcaccuggugcggacugcaagaugucuaucagaugacagagggcagacauugucaggugcaccuucuggacgaucggcgccucgaacugcugguucagcccaagcuccuggccagagagcuucuggaccucguggcgucccauuuuaaucugaaagaaaaggaguacuucgggaucaccuuuauugaugacacaggacaacagaacuggcuucagcuggaucaccggguccucgaccaugaucugccuaaaaagccgggccccaccauccugcacuucgcugugcgcuuuuauauugagucuaucagcuuccucaaagacaagacaaccguugaacuguuuuuccuuaaugccaaggccugcgugcacaaagggcagauugaggucgaauccgagacgaucuuuaagcuggcugccuucauccuccaagaggcuaaaggagauuacaccucugacgaaaacgccagaaaggaucugaaaacacuuccugcguuucccaccaagacacugcaggagcauccuagccucgccuauugugaagaccgggugauugagcacuaccugaagaucaaaggccugacccgcggccaggcugugguccaguauaugaagauuguugaagcccuccccacguacggggugcauuacuaugcugugaaagacaagcaaggacugccuugguggcuuggcaucuccuacaaagggauuggacaguaugauauccaggacaaggucaaaccgagaaagcuguuccaauggaagcagcucgagaaucuguacuuccgggagaaaaaguuugccguggaaguucacgauccccgcagaauuagcgugucucggagaacauucggccaguccgggcuuuuuguccagaccugguaugcgaacagcucucugaucaaauccaucugggugauggccauuagccaacaccaguucuaccucgaccgcaagcagucuaaagcuaagaucccuuccgcccggagccuggaugagauugcuauggaccugacagaaaccggaacccagagagccuccaagcucguuacacuggaggccaaaucucaauuuaucauggcuagcaauggcucccuuauuagcucuggcucccaggauagcgaagugucugaggagcagaagcgcgagaaaauccuggagcucaagaaaaaggaaaagcugcugcaggagaaacuucucaagaaagucgaagaacugaagaaaaucugccugcgggaggcggaacucacggggaagaugcccaaggaguauccucugaacauuggagaaaaacccccgcaagugagacgccgggucggcaccgccuucaagcuggacgauaaucugcucccuagcgaggaggaccccgcucugcaggaacuggaguccaacuuucuuauccagcagaaacucguggaagccgccaagaaacuggcuaaugagccugaucuguguaagacaguuaaaaagaagagaaaacaagacuacaccgacgccaugaagaaacuccaggaaauugagaacgcgaucaaugaguaccgcauucggugcgggaagaaacccucucagaaggcuacagugcugcccgaagauaucaucccuagcgaguccagcucucuuuccgacaccacgacauaugaugacccgagcgaugccuucaccuuucccggacaaagaucuuccagcgucccucauucuccccgcauucugccucccaagucccucggcaucgaacggauucacuucagaaaaagcuccaucaacgagcaguuuguggacacccggcagucucgcgaaaugcugagcacacauuccagcccguacaagacccuggagagacggccucaagggggaagaucuaugcccacaacgccuguucuuacccgcaaugccuauuccagcucucaccucgagcccgaauccagcucucagcauugucggcagagaagcggcucccuggagagccagucucaccuucucuccgaaauggauagcgacaaaccuuucuuuucccugucuaagagccagcgcuccucuagcacagagauucuugaugacggcuccucuuacaccagccaauccagcacagaauauuacugcgugacccccgucacggggccguauuacaccacacagacccuggauacaagaacccggggacgcagacggucuaaaaagcagaacguguccacgagcaacucuggcuccaugccuaaucucgcucagaaggacagccugcgcaacgggguguacucuaaaucccaagagccucccagcuccagcuauuacaucgccggauauacacccuacgcugagugugauuucuauuacucuggcggguauguuuacgaaaaugacaccgagggccaguacagcgucaacccguccuauagaucuagcgcccacuacggauaugaacggcagcgcgacuacuccagaucuuuccaugaggaugagguggaccgggugccccacaauccuuaugcgacacugcgccuucccagaaaggccgcugccaaaagcgaacauauuaccaagaacauccacaaagcucucgucgccgagcaccuucggggcugguaccaaagagcguccgggcagaaggaucagggacauucuccucagaccagcuuugacuccgaucgcggcagccaacggugccugggguucgccggacuccaggugcccugcucuccuuccagcagagcuucuuccuauagcuccguuucuagcacaaaugccuccggcaacuggcgcacgcagcugaccaucgggcuuagcgacuacgaaacacccgcucacucuuccuacaccagcuguuauggcaauguguacaacccgcugccuucucccagccggcaguauacagagauuucccaacucgauggaaccgacggcaaucagcuggaagauaaccuggagucuagcgagcagagacuguuuuggcaugaagacuccaagccugggacgcuggucuga

SEQ ID NO: 69469 - RNA, 1245 nt, Artificial Sequence
  derived and/or modified sequence opt5 from FRMD5__Homo_sapiens__NP_001273419
augugcuucagagugaaguuuuaccccgccgacccugcugcccugaaagaggaaaucacccgguaucucgucuuccugcagauuaagcgcgaucuuuaccacggcagacugcucuguaaaacaagcgacgcggcucugcuugccgccuauauccugcaagcugagauuggggauuacgacuccggaaagcauccggaaggcuauucuagcaaauuucaguucuuucccaagcacuccgagaagcucgaacggaaaaucgccgagauucauaagacggagcugucugggcagaccccugcuacaagcgaacugaacuuccuccgcaaagcccagacccuggagacauacggaguugauccccacccuugcaaggacguguccggcaaugcggccuuucuugcuuucacccccuuuggguucgugguccugcaaggaaacaaaagagugcauuuuaucaaguggaaugaaguuacaaagcucaaauucgagggcaagaccuuuuaucuguacgagaaaaagaucauucuuacguacuucgccccuaccccggaggcuuguaaacaccuguggaagugcggcaucgaaaaccaggccuucuauaaacucgaaaagucuagccaggugcggacagucuccagcucuaaucuguuuuucaaggggucccgcuuuagauacagcggacggguggcgaaagagguuauggaaucuuccgccaagauuaaacgcgagcccccugagauccacagagcuggcauggugcccagccggucuuguccuuccauuacccaugggccccgccugagcuccgucccgagaacacggcgcagagccgugcacaucucuauuauggaaggacucgagagccugcgggauuccgcucauagcaccccugugagaucuacgucccacggcgacacauuccuuccccacguccgcagcucucggaccgauagcaacgaaagaguugccgugaucgccgacgaggcuuauuccccugcggauucugugcugcccacacccgucgccgaacauagccucgagcugaugcuucugucccgccagaucaauggggcuaccugcagcauugaggaagagaaggaaucugaggccuccaccccuacagccacggaaguggaggcucucggaggcgagcugcgggcccugugucaaggccacagcgggccggaagaggaacaggcgaugguuugccuccagaacccccugucuggagagccugcucauuga

SEQ ID NO: 69470 - RNA, 795 nt, Artificial Sequence
  derived and/or modified sequence opt5 from FRMD6__Homo_sapiens__NP_001253976
auggaccagcuggagaagagaagccgggccuccggcucuagcgcuggguccaugaaacacaagcgccucucuagacauagcaccgccucccacucuagcucccauacaagcggaaucgaagcggauacgaaaccccgggacaccggcccugaggauucuuacuccagcucugcuauucaccgcaagcugaaaacaugcuccagcaugaccucucauggguccagccacacauccggaguggaaucuggcgggaaggacagacuugaggaagaucugcaagacgaugagaucgagaugcucgucgacgauccgcgggaccuggaacagaugaacgaggaaagccuugagguuucccccgauauguguauuuauaucaccgaggacaugcugaugagccgcaagcucaauggacacucuggccugauugugaaagaaaucggcuccagcacaucuagcuccucugagaccguggucaagcugagagggcagagcacggauucccucccucagaccaucugccggaaacccaagacaagcaccgaccgccauucucugucccuugacgauauuagacuguaccaaaaagacuuccuccggaucgccggacugugucaggauacagcccagagcuauaccuuuggcugcgggcacgaacuugacgaggaaggacuguacuguaacucuugccucgcucagcaauguauuaauauccaggaugccuucccugugaagcgcacguccaaguauuuuagccuggaccugacacaugaugagguucccgaguucguggucuga

SEQ ID NO: 69471 - RNA, 2145 nt, Artificial Sequence
  derived and/or modified sequence opt5 from FRMD7__Homo_sapiens__NP_919253
augcugcaccucaaggugcaguuccuggacgauagccaaaagaucuuugucguugaccagaaguccucuggcaaagcccuuuucaaccugagcugcucccaucucaaucuggcugagaaggaauacuuugggcuugaguucuguucucacagcggaaacaauguguggcuggaacuccugaaacccauuaccaaacaggugaagaacccuaaagagaucgucuuuaaguucauggugaaauuuuucccgguugaucccggccaucugagagaagaacucacacgguaucuguuuacgcuucagauuaagaaagaccuggcccucgggcgccugccuugcuccgauaauuguaccgcgcuuauggugucucacauccugcaaagcgagcucggagacuuccaugaagagacagauagaaagcaccuggcucagacccgguaccugcccaaccaggacugccucgaaggcaagauuaugcacuuucaucagaaacacaucgggcgcuccccugccgagagcgauauccugcuucuggacauugccagaaagcucgauauguauggaauccggccccauccugcuucugacggcgagggcaugcaaauucaccuggccgucgcucacaugggggugcuuguucugcgcggaaauacaaaaaucaacaccuucaauugggccaagauuagaaaacucuccuuuaagcggaaacauuuccugaucaagcugcacgcgaacauucucgugcuguguaaggauacacuugaguucaccauggccagccgcgacgcuugcaaagccuuuuggaagacgugugucgaguaccaugcuuucuuuagacugucugaagaaccgaaauccaagcccaaaacccuccugugcagcaaggggucuuccuuccgguauagcggccgcacacagagacagcuucuggaauacggacggaagggccgccucaaaucccugccuuuugagagaaagcacuaucccucucaguaccaugagcggcaauguagaagcuccccugaccugcucagcgaugugucuaaacagguggaagaccugcgccuugccuacgggggaggcuauuaccagaaugucaacggcguucacgcguccgagcccgugcuggaaagccggagacgcaauucugcccucgaggugaccuucgcuacagaacuggagcacagcaagccggaggccgauccuacccugcuucaucaaucccagucuagcuccagcuuucccuucaucuauauggacccugucuuuaacacggaacccaaucccaacccugauccgcgggacaucuucucugagagauccagccucucuuccuuucagacaagcugcaaauucuccgggaaccacaugucuauuuacagcggacugaccuccaaggugcgccccgcuaagcagcugacauauaccgauguuccuuacauccccuguaccggccaacagguggggauuaugccuccccaggucuuuuucuauguggacaaaccgccucagguuccccgguggucuccuaucagagccgaggagcgcacaagcccccauuccuacguggaaccuacggccaugaagcccgcugagcggagcccgagaaauauucgcaugaaaucuuuccaacaggaucuccagguccugcaggaggcgaucgcccggaccuccggaagaagcaacaucaaugugggccuugaagaggaagacccuaaccuggaggaugcuuuugucugcaauauucaagagcagacacccaagcggucucagucccagagcgacaugaaaaccauccgcuuccccuuugggucugaguucagaccucucggaccgugccccgcccugagccacaaggccgaccuguuuacagauauguucgcugaacaagaacuuccugccgugcucauggaccaguccaccgcggagcgguacguugcuagcgaaucuuccgauagcgaguccgagauucugaagcccgacuauuacgcccuguauggcaaagaaaucagaucuccuauggcccgcauucggcucagcuccggcucucugcagcuugaugaggaagacgaggaugcuuacuuuaacacgcccacagccgaagacagaaccagccugaagccuuguaauuauuuccucgcuuga

SEQ ID NO: 69472 - RNA, 4737 nt, Artificial Sequence
  derived and/or modified sequence opt5 from FRMPD1__Homo_sapiens__NP_055722
auggaggaacuggagaccagccucuuccagacaagaaaggcccaccggaucgaacaaaugguggcucgcuggcugagacggucccgcgacucuagcgccagagcgaaagucgcugccgccgauggccccgcucggaacccuacgcagacccuuauuccgguucgccauacagugaagaucgacaaagauacccugcuccaggacuacggguuucacauuuccgagucucugccccuuacaguggucgccgugaccgcuggaggcagcgcccaugggaagcuguucccuggagaucagauccuccaaaugaauaacgaacccgcggaggaccuguccugggagagagccguugauauucugcgggaagcugaggacucucucagcaucacagugguccgcugcaccuccggcgugccuaaaagcucuuuucugacggaagagaagagagcccggcuuaagaccaaucccguuaaagugcacuucgcugaggaaguccugaucuccgggcauagccagggaaacucucuccuguguaugccuaaugugcuuaagcuguaucucgagaacggccagacaaaagccuuuaaguucgaagcgaauaccacagugaaagauauuauccugaccgucaaggagaagcuguccauucgcagcaucgaauacuuugcccucgcucuggaggagcaguauucuauuuccagacuucaucugcuccacgaagaggaacugauccaacagguuguggagcgggaagagagccacgacuaccgcugccuuuucagaguguguuuugucccgaaagauccccuggaccuccugaaggaggauccuguggccuucgaauaucuguaccuccaguccugcucugacguucugcaggagcgguuugcuguggaaaugaaauguagcuccgcccuuagacuggccgcucuccacauucaagagcgcaucuaugcgugcgcccagccccagaagaucagccugaaauacauugaaaaggacuggggcaucgagaacuucauuucuccuacgcuucugcggaauaugaaagggaaggauaucaagaaagcuauuuccuuucauaugaagagaaaccaaaaucuccuggagccccgccagaaacagcugaucagcgccgcccagcuccggcugaacuaccuucaaauccugggagaacucaagacauauggcgggagaauuuucaaugcuacccugaugcugcaggaccgcgagucuuacaucgcccuucucgucggagcgaaauauggcauuagccaggugaucaacuccaagcugaauauuaugucuacacuggcugaauuugccaacaucagccggguugagcucaccgaggaauccgagaaggugagcgucgugaaagucuaccugcaggaugugaagguucuuacccugcuccuggaaucuaacuccgccaaagaccuggcuugucuuaucgccggguauuacagacuccugguggauccggucacaagcauuuuucuguggccuggaaauaagcaacaggcucaccgcgugucugccgaggaaggcuaugagucccgggcgugcagcgacuccgaggaaucuagcgagguugauugugugcucgaaccccuguccgacagacgccuugucaaacuggccccuugccggucucucaucaaggaggaacagccucccggcaacagccccacgccggagguggcuagacgggggcccuccaccuguggagccagcucuacaaccgauuccgcugagagcgaagccucugacuccgcgaauacagagagccgcggcuacagaaccucugggagcuccgaaagcauggaugcccuggaggaagacgaccuggauacguguucuuccagccgguccacauucuuucacuucggaucuccuggccuugcugagagcauugacuccgauucucaggaggaaagaagcgggaucgagaccuccggauuucucugccugcuggaccucgcccaacgcgcuaacccccagugccagaagaccgaguucucugaaagcgccgcccuggagacauuuggcugggcuccugaacuuuccaccgugcggcuggaucccagacucuacgagggcagccaugcggacuauuacucucugugcuccagcguuucuccggccuccuaucugagcgauucuuccgaaagcacagcuucccgccaagggggagccccucccgccuggggccagcagggguggacggaggcucagccuagcucuaugcuugaaccccucgcccugcacccuccccuggcguucgaggacggaagcuccgaugaggaauacuaugacgcugccgauaaacucaccccgccuggcccucccucugggcccagagacgucagcacagccgagccguccgcuaccucucugcaaaauaaggccagcacauccucucccgaaaacagccuuccuuguggccccgauggacggcagccuucccgcagaggcggggugaaaaaguacgcgaaaacccugcggaagcgccggagcuuucuccagacggacuauaccucucagguguccuucccccuggucccuagcgcuucucuggaguccguggacgauguuugcuacuacgacagagaacccuaucuugcccugggagccccgagcccuacaguguccucucuccaagauaugcagggcgagcccgggcugcucgagaccaaggcucugggacuucuggccccucuccgcgaaacaaaaagcaccaaucccgcuuccagagucauggagauggaaccggagacgauggaaacaaagagcgugauugacucucggguuuccagcaucucugccauucgcuuuagaaucgauccuaacaauaaagagaacagcggcgugguccccgcggccuccucuagcgcuuccaccccucauuguucuaaucccgggagcuccggccccgacacagcccaggcucggccuagccagauccugccgcugucucaagaucuugacggaauugcccccaaggagccuaccaucgaacacggcgauuccagcuucucccugucuagcggggaccccaacccugauagagccugccucgcuuccaaucccggacugaacaaugugucucagggcgacacccucgagcugcagcuugaaccucauguucagcuggagauggggcucgagagcuuuuguacaaaccacauucaagaaacggcgccgaaauacaccgagccccugcuguccccucgcgaugaaccccggagcgacgagugcggaaucaacccuggcgaaaagauugccucuauccccacaaaagaggagccgcaggggcagcuuucccuggaaagagaccgcgaggugaccaauaagaacggcacaaaugucuuccaagaagagagccggaaggauucuggagacuccccuggcgaugugagcaacaaugugucucagacccucgacaucagcucccccgcugggaaaauugucacgucucugagccucgaugcccccguuacaggaaccgaacagaucccuccccacccuccgagagacccccagggccaaucccgcgagccucccgggcagggaugucaggcccaggagcaaaagcuguucguggaacuugaucuggacccugauuucuuccugggcaaacagaccgugagccccgcugucccgccugaggggauuaaggccgaagcgcccaaccaugugacaggccaggacaucgcuccucgggauucccccgaguggguuugcuuuaauccugaacccucucucccggagccucugcccuguccccaggaggacccucaccuugaaaccagcaaccauugccugcucuccgagggaaaaucugacagcuccucuauuugccugagcgccgaaaaguccuuccucuguuuugccccggagagccaccccgaggugucugcuucccugagagucgccacaagccuuggcuucgcggggaugaaugaaaugguggcuccucgcaucggaauggaucaaugcucuugucaguuuuccuaugccacgugcuuccggggcccccagccugagaccgaagaggaagacagagaucuggaggcccaccccauggcuccucugacaagcccgcccucugccggguccccuguugugcuccccuggcggccugcucgcgcccauagcuguaccacagcgccccuguccagaaagagccacaucuggccggaguacugcucucgggcccuucgccagcugaaagcuaccccugccagcacgcccgaaggauuuauucaacucauggagucccugcucgaacugcaggacauccuugagaccucuuggggcgucggcaacaagcaucccccugaaaaauguacauggcacuucaccgagagcagaucccggcugugcauggggucucagaagcugcucagcuccuguagacaugugauucgcauggaucaaucucccgaggaaaugcagggagcuguucgggacacauuucagcaccuggugcagcuugccggccugugcuuccaauuuaccgauuguagcagaugcuccgcccgccaccgggaggcugcggggaaucucagagacgucguguauacauaccaucaguucaucgaagccgcuaaaucuaccugcgagcgcggauaucacgaucugagcgugaagcuccuggcccggcaguguacggcccuuacagcugccgucuucugccugacccagaaguuuagagcguccaccgcucuguga

SEQ ID NO: 69473 - RNA, 3930 nt, Artificial Sequence
  derived and/or modified sequence opt5 from FRMPD2__Homo_sapiens__NP_001018081
augcagccccugaccaaggacgccggcaugagccucuccucugugacacuggcuagcgcccuucaagucagaggggaggcgcuguccgaagaggaaaucuggucucuccuguuccuugcugccgagcagcugcucgaagaucugcggaacgacagcuccgauuacguugugugcccuuggucugcccugcucagcgcugccggaucccugagcuuucagggccgcgugucucacauugaggcugccccguucaaagcgcccgagcuucugcaggggcaauccgaagacgagcagccugaugccagccagaugcaugucuauucucucggaaugacgcuguacugguccgcuggcuuucacgugcccccucaucagccccuucaacugugugaaccucuccacagcauccugcugaccaugugcgaggaccagccgcauagacgguguacacuccagucuguucuggaggccugccgcgugcacgaaaaggaggucuccguguaucccgcuccugccgggcuucacauuagacggcugguuggacucgugcugggcaccaucagcgaagucgagaaacgcgugguggaagaguccucuagcguccagcaaaauagauccuaccuucugcggaagcgccucagaggcacaagcucugagucccccgcggcccaggcuccugaaugucugcaucccugccggguuagcgagcgcucuaccgaaacacagagcuccccggagccucacuggucuacccugacgcauagccacuguucccuccuggugaacagagcccuucccggggcugauccucaagaccagcaggccggacggcgccugagcucuggcuccgugcacagcgccgcugauucuuccuggcccaccacacccagccagagaggguuccuccaacggagauccaaauuuucucgcccugaguucauucugcuugcgggagaggccccgaugacccugcaucuccccggcagcgucgugacaaagaaggggaaauccuaucuggcucugcgggaccucugcguugugcugcuuaauggacagcaccuggaggucaagugugauguggaaucuaccguuggcgccguguuuaacgccgucacgagcuucgcuaaucucgaggaacugacauacuuuggccuggccuauaugaaauccaaggaguucuuuuuccuugacagcgaaaccagacucugcaaaaucgcgccugagggguggcgcgagcagccccagaagacaucuaugaacaccuuuacccuguuccugcggaucaaguucuuugugucccauuacggacuccugcaacacagccuuacaagacaucaguucuaccugcagcuccgcaaagauauucuggaagaacggcuguauuguaaugaagagauccuucuccagcugggcguccuggcucuccaagccgaguuugggaacuacccuaaggaacagguggagucuaaacccuauuuccacguugaagacuacauuccggccucccugaucgagagaaugacggcucugcgcgugcaggucgaagugagcgagaugcaccggcugucuagcgcccucuggggagaggacgcugaacugaaguuucugagaguuacccagcaacuuccugaguauggcgugcucguccaucagguguucuccgaaaaacgccggcccgaggaagagauggcccuggggauuugcgcgaagggagugaucguuuacgaggucaaaaauaacagcagaauugccaugcugcgguuucaguggcgcgaaacaggcaagaucucuaccuaucaaaagaaauucacaaucaccuccagcgugacgggcaagaaacacacauuugugaccgauuccgcuaagaccucuaaauaccuccuggaccuuugcagcgcccagcauggguucaaugcucagaugggauccggccagccuucucacguccuguuugaucacgacaaguucgugcaaauggccaaccucagccccgcgcaucaggccagauccaagccucugauuuggauccagcggcugucuuguagcgagaaugaacuuuuuguuuccagacuccagggggcugccggaggccugcugagcacaucuauggauaacuucaauguggacggguccaaagaggcuggcgccgaaggaauuggccgcagccccugcaccgggcgggagcaacucaagucugccugugucauccagaaaccgaugacaugggauucccugagcggaccucccgugcagucuaugcacgcuggcuccaagaacaacagacgcaagagcuucauugcggagcccgggagagaaaucguucgggugacgcuuaaacgcgacccucauagaggauuuggcuucgucaucaaugagggggaauacuccggccaggccgauccgggaauuuuuaucagcucuauuauccccggcgggccugcugagaaggccaaaaccauuaagcccggaggccaaauccuggcccucaaccacaucagccuggagggguucacauuuaauauggcugugcggaugauucagaacuccccugacaauaucgaacugauuaucucucagagcaaaggaguuggcgggaacaaucccgaugaggaaaagaacuccaccgccaauucuggcgugagcuccacagacauucuuucuuucggauaucaaggcagccugcucucccauacccaggaccaggaucgcaacacggaggaacuggacauggcggggguccagagccucgugccuagacugcggcaccaacuuucuuuucugccccucaaaggagcuggcuccagcugcccgccuucucccccugagaucuccgccggggagauuuacuucguggaacuggucaaggaggauggaacccugggcuuuagcguuacagggggcaucaauaccuccgugcccuauggaggcaucuacgugaagucuauugucccugggggaccggccgcuaaagaaggccagauccuucagggggaccgccugcuccagguggauggaguuauucuguguggccucacacacaagcaagccgugcagugccugaaaggccccgggcaggucgcgagacuugugcuggagcggcgcguuccuagaagcacccagcaaugucccuccgcuaacgacagcaugggagaugaacggacggccgugucucucgucacagcccugcccggcagaccuuccagcugcgugucuguuaccgacgggccgaaguucgaggugaaacugaagaaaaaugcuaacggacuuggcuuuagcuucguccagauggagaaggaauccuguucucaucuuaagagcgaucucgugcgcaucaaacggcuguuucccgggcagccugccgaggaaaauggagcuauugccgcgggcgacaucauccucgccgugaacggcagauccacagaggggcugauuuuccaggaaguccuucaucugcugcgcggagcuccccaagagguuacccuccugcuuugccggccucccccuggcgcccugccggagcucgaacaggaguggcagacccccgaacugucugcugauaaggaguucacaagagccacguguaccgacagcugcacauccccuauccucgaucaagaggacagcuggcgcgacucugccucccccgaugcuggggaaggacugggccuucggccugagagcucccagaaagcgauuagagaagcccagugggggcagaaccgcgagcggcccugggcuucuagccugacccacuccccggaaucucacccucaucugugcaagcuccaccaagagagagacgagagcacacuggccaccucccuugaaaaagaugugcggcagaauuguuauagcgugugcgacaucaugcgccugggaagauacucuuuuuccagcccccucacgcggcugucuacagauauuuucuga

SEQ ID NO: 69474 - RNA, 3969 nt, Artificial Sequence
  derived and/or modified sequence opt5 from FRMPD4__Homo_sapiens__NP_055543
auggacguguucagcuuugucaagaucgccaaacuguccucucacagaaccaagagcuccggcuggcccccuccgucugggacauggggacucagccagguucccccuuacggcugggagaugacggcuaaccgggaugggcgcgacuauuucauuaaucauaugacccaagccauccccuuugaugacccuagacuggaauccugccagauuauucccccugcgccgcggaaaguggagaugcgcagagaucccgugcuuggauucggcuuugucgcugggucugaaaagccugugguugugcggagcgucacacccggaggcccuuccgagggcaaacugauccccggggaccagaucgugaugaucaacgaugaaccgguuagcgccgccccucgcgagagagugauugaccucguccggucuuguaaggaguccauccugcuuaccgugauucagcccuacccuagccccaagucugcuuucaucuccgccgcuaaaaaggcccgccugaaaagcaaucccgugaaggucagauuuucugaagagguuauuaucaacggacaaguguccgaaacagugaaagauaauagccuccuguucaugccuaacguccugaagguguaucucgagaauggccagaccaaguccuuucgguucgacugcucuacaagcauuaaagauguuauccugacccuucaggagaagcuguccaucaaagggauugaacacuuuagccucaugcuggagcagcgcacggaaggagcgggcaccaaacuucugcuccugcaugagcaagaaacacugacccaggugacacagagaccgucuucccacaagaugcggugucucuuccgcaucagcuuuguccccaaggacccuauugaucugcuuagacgggaccccguggccuucgaguaccuguauguucagucuugcaacgacgugguccaagagagauucgggccugaacucaaauacgauaucgcucugcgccuugccgcucugcagauguauauugccaccgugacgacaaagcagacccaaaagaucagccucaaauacaucgagaaggaauggggacuggagacauuucugcccuccgcgguccuccagucuaugaaagaaaagaauauuaaaaaggcccugagccaucuugugaaggcuaaccagaaucugguuccgccuggcaaaaagcucuccgcccugcaggcuaaagugcacuaccuuaaguuccugagcgaccuccggcuguauggcgggagagucuuuaaagccacccuggugcaagccgagaagcgcucugagguuacccuccuggugggaccccgguacggcaucucccacgucauuaacacaaagacgaaucuuguggcucugcucgcggauuucagccaugugaacagaaucgaaauguuuucugaggaagagucccugguucgcgucgaacugcacgugcuugacgugaaaccuauuacccuccugauggagagcuccgaugccaugaaucuggcuugucucacagccggguauuaccggcugcuugucgacucuagacgcagcaucuucaacauggccaacaagaaaaauaccgcuacacaggagaccggacccgaaaacaagggcaaacauaaucugcucgggccugauuggaacugcaucccccagaugacgacauuuauuggagagggcgaacaggaggcccaaaucaccuauauugacuccaagcagaagaccguggagaucacagauucuaccauguguccgaaagaacaccggcaccuguacauugacaaugcguauagcuccgauggccugaaccagcagcuuagccaaccuggggaggcucccugcgaagccgacuacagaucucucgcccagcgcucccugcugacacucagcggacccgagacgcugaagaaagcucaggaaucuccucggggcgccaagguuuccuucaucuuuggggacuucgcucuugaugacggaauuagcccgcccacccugggcuacgagacacuccuggaugaggggccugaaaugcuggagaaacagagaaaucuuuauaucggcucugccaacgacaugaagggacucgaucugacccccgaagcggagggcauccaauuuguggaaaauagcgucuacgccaacauuggggacgugaaauccuuccaggcugccgagggaaucgaggaaccucugcuccaugauauuuguuaugcugagaauacagacgaugccgaagacgaggaugaaguuagcugcgaggaggaccugguggucggcgaaaugaaccagcccgcgauccuuaaucugucuggguccagcgaugacauuaucgaccucaccucccugccucccccggagggagaugacaacgaagaugacuuucugcuucggucucucaauauggccaucgcugccccucccccuggcuuccgcgauagcuccgacgaggaggauucucaaagccaggcugccuccuuccccgaagacaaggagaaggggucuagccugcagaacgaugaaauuccggugucccugaucgacgccguuccuacgagcgcugagggcaaaugugaaaagggacucgauaacgcgguggucucuacccugggcgcccuugaggcucuguccgugagcgaggaacagcaaacaucugacaauuccgggguggccauucucagagccuacagccccgagucuuccagcgauuccggaaacgaaaccaauagcucugagaugacagaaagcuccgagcuggcuaccgcccagaaacagucugagaaccugagccggauguuucuugcgacgcacgaaggcuaucauccucuggcugaggaacagacagaguuccccgccuccaagacccccgccgggggacucccuccgaaaucuagccacgcucuggccgcgagacccgcuacagaccucccucccaaggucguuccuuccaagcaacugcuucauucugaccacauggaaauggagcccgagaccauggaaaccaaaagcgugacagauuacuuuuccaagcugcacaugggcagcguggccuauucuugcacguccaaacgcaagagcaaacucgccgacggggagggcaaggcuccuccgaauggaaacaccacaggcaagaaacagcaggggaccaagacagccgaaauggaggaggaggcuucuggaaaauucggcaccgucuccagccgggauucccagcaucugucuacguuuaaucuggaaagaacagccuuccgcaaggacagccaaagaugguacguggcgaccgaagggggaauggccgagaaauccggccuugaagcugccaccgggaagacauuuccccgggcuagcggccugggagcccgcgaggccgagggcaaggaagagggggcuccugauggagaaaccucugacggcuccgggcucggacagggcgauagauuccugacagacguuacgugcgcgagcucugccaaagaucucgacaaccccgaggaugcugacagcuccaccugugaccacccuucuaagcugcccgaagccgaugagagcguggcccggcuuugcgacuaccaucuggcuaaacgcauguccucucuccagagcgagggccacuuuucccugcaaagcucucagggguccagcgucgaugccggauguggcacaggguccucuggaagcgcgugcgcuaccccgguggaauccccucugugucccucucuuggcaagcaccugauccccgacgccagcgggaaaggaguuaauuauauuccuuccgaggaaagagcccccggccucccuaaccauggcgcuacauucaaggagcugcacccgcagaccgaagggaugugcccccggaugacggugccugcccuccauaccgcgaucaauacagagccccuguuuggaacccuucgcgauggcugucacagacugccuaaaaucaaggagacaaccgucuga

SEQ ID NO: 69475 - RNA, 1035 nt, Artificial Sequence
  derived and/or modified sequence opt5 from FRRS1L__Homo_sapiens__NP_055149
augagacggccccgccagggcgggggaggcgccgggggaagcgcugccgcgagagcucgggccggcgggcugggaggcggcuccgugccugcccgcgcuagaggggccccggcugccgcgcgggccgcuuggcuccgcgaccugugcgccagaauggcucggcccccucgccaacaccccggagucugggccucucuucugcuccugcuucugaccggcccugcggccugugcugccagccccgcugaugacggggccggaccuggcgggagaggaccgcggggccgcgccagaggcgauacaggggcugacgaggcgguuccccggcaugauuccucuuacggaacguucgccggcgaauuuuaugaccuccgcuaccugagcgaggaaggguauccuuuccccaccgcuccucccguggauccguuugccaagaucaaaguggacgauugcggaaagacaaaaggcuguuucagauacgggaagccuggaugcaacgccgagaccugugacuauuuucuguccuaccggaugauuggcgcugaugucgaguucgaacucucugccgacacagauggcuggguggcgguuggguuuagcuccgacaaaaagaugggaggcgacgaugugauggcuugcguccacgacgauaaugggagagugcgcauccagcauuucuauaacguuggacagugggccaaggagauucagcggaaucccgccagagacgaagagggcguguuugaaaacaaucgcgucaccugucgguucaaaagaccugugaacgugccccgcgaugagacaaucgucgaccugcaccuuagcugguacuaccuguuugcuugggggcccgccauucaaggcucuaucacccggcaugauaucgacuccccuccggcuagcgagagaguugugucuauuuauaaguacgaagauaucuucaugcccuccgccgcguaucagacguuuagcucuccuuucugccuccugcuuauuguggcccugaccuucuaccuccugaugggaacacccuga

SEQ ID NO: 69476 - RNA, 1527 nt, Artificial Sequence
  derived and/or modified sequence opt5 from FRS2__Homo_sapiens__NP_001265286
augggcagcugcuguuccugccccgacaaggauaccgugccugacaaccacagaaauaaauucaaggucaucaacguugaugacgaugggaaugagcugggaucuggcauuauggaacucacagacacggagcugauccuuuacacccggaaacgcgauagcgugaaguggcauuaucugugucucagacgguacggguaugacuccaaccuguuuucuuucgaaagcggacgcagaugccagacaggccaagggauuuuugccuucaaaugugcucgggccgaggaacuuuuuaauaugcugcaggagaucaugcagaacaauuccauuaacguggucgaggaaccggugguugagcgcaauaaccaccagaccgaacucgaggugcccagaacaccucggacccccacaaccccuggauucgcggcucaaaaucugcccaacggcuacccucgcuauccgucuuuuggcgaugccagcucccaucccagcucuagacacccuuccgucgggagcgcccggcugcccucugugggagaggaauccacgcauccucuccugguugcugaggaacaggugcacaccuacgucaauacaaccggcgugcaggaggaacgcaagaacagaacaagcgugcacgucccccuugaggcccggguuucuaaugcugaguccagcaccccgaaggaggaaccuuccucuaucgaagaccgcgauccccagauccugcucgagccugaaggggugaaauucgugcugggacccacgcccguccaaaagcagcuuauggagaaagagaagcuggaacagcucggcagagaccaggugagcggguccggagccaacaacacagagugggauaccggcuaugacagcgacgaacggagagaugcgccuucuguuaauaaacugguguacgagaacauuaauggccuguccaucccgagcgccucugggguccgccggggaagacucacaagcaccuccaccucugacacacaaaacauuaauaacagcgcucagcgccggacggcccugcuuaauuacgaaaaccugcccucccucccucccgugugggaggcuagaaagcugagccgcgaugaggacgauaaucuuggcccuaagacccccucucugaacggguaucauaauaaccucgacccgaugcacaauuacguuaacacagaaaaugugaccgucccugccuccgcgcauaaaaucgaguauagccggagacgcgauugcacacccaccguguuuaacuucgacauucggagaccuucucuggaacaccgccagcugaacuacauccaagucgaucucgagggaggcuccgacagcgauaauccccagacgccuaagacacccaccaccccgcugccucagacacccacccggagaacagagcuuuaugccgugauugacaucgaacggacggcugccauguccaaccugcagaaagcucucccccgcgacgaugggaccucuagaaagacacggcacaauagcaccgaccugccuauguga

SEQ ID NO: 69477 - RNA, 1479 nt, Artificial Sequence
  derived and/or modified sequence opt5 from FRS3__Homo_sapiens__XP_011512557
augggcagcugcuguuccugccugaacagagacucugugcccgauaaucacccuaccaaguucaaagucacaaacguugacgaugaggggguggaacucggaagcggcgugauggagcugacgcaguccgaacuuguccugcaucuccaccggcgcgaggccgugagauggccguaccugugucuucggcgcuauggguacgacucuaaucuguuuagcuucgaauccggaagacggugccaaaccggccaggggaucuuugcuuucaaguguucucgcgccgaggagauuuuuaaccuccugcaggaucugaugcagugcaauagcaucaacguuauggaagaacccgugauuaucacaagaaauucccauccugcggaacucgaccugccccgggcuccucaacccccuaacgcccuuggauauaccgucagcucuuucuccaauggcuguccgggcgaggggccccgcuuuagcgccccuagacggcugucuacauccagccuccgccaccccucucugggagaggaauccacccaugcucuuauugccccugaugagcagagccacacauacgugaacacccccgcuuccgaagacgaucacagacggggccgccauugccugcagccgcucccugaggggcaggcccccuuccugccucaagcgagaggacccgaccagcgggauccccagguuuuucugcagccuggccaagugaaauucguccucgggccgacgcccgccagacgccacauggugaagugucagggacugugcccuucucuucaugaucccccucaccacaauaacaauaacgaagcucccagcgaguguccggcccagccuaaaugcaccuaugagaaugugacaggcggccuguggagaggggcuggauggcggcucucccccgaggagccuggcuggaacgggcuggcccaucgccgggcggcccuucugcacuacgaaaaccucccuccccugcccccggucugggagagccaagcucagcagcugggaggcgaagccggggacgacggagacucuagagauggccucaccccuuccagcaauggcuuucccgacggggaggaggaugaaacaccccugcagaagccuaccucuacgcgcgcugccauccggagccauggauccuucccgguuccccuuacaagacgccggggcucuccuagaguguuuaacuucgacuuccgccggcccgggccugagcccccuagacaacugaauuauauccagguggaacucaagggauggggcggggaucggcccaaaggcccgcagaacccuagcagcccccaggccccuaugcccaccacacacccggcucgcuccucugacuccuacgcggucauugaucugaagaaaaccguggccaugagcaaucuucaaagagcucugccucgggacgauggaaccgccagaaagacacgccauaacucuacggaccucccccuguga

SEQ ID NO: 69478 - RNA, 9042 nt, Artificial Sequence
  derived and/or modified sequence opt5 from FRY__Homo_sapiens__NP_075463
auggccagccagcaagacuccggcuucuuugaaaucucuauuaaguaccugcucaagagcugguccaacaccucucccgucgggaauggauauaucaagccuccggugcccccugcuagcggcacccaccgggaaaaggggcccccuacgaugcugcccauuaacguugacccugacuccaagccgggagaguacgugcuuaaaucucuguucgugaauuuuaccacccaggccgaacggaagaucagaauuaucauggcggagccccucgaaaagccucugaccaaaagccuucagagaggcgaggauccccaguucgaccaagucaucuccagcaugucuucccugagcgaguauugccucccuucuauucugcggacacuguuugauugguacaagcgccagaacgggaucgaagacgagucccacgaauauagaccccggaccagcaauaaaucuaaguccgaugagcagcagcgcgacuaccucauggagagacgggaucuggcuauugacuucaucuuuagccuugugcugauugaaguucucaaacaaaucccgcugcacccugugauugauucccuuauccaugacgucaucaaccuggccuucaagcacuuuaaguauaaagagggauaccucggccccaauacaggcaacaugcauauuguggccgaucuguacgcugaaguuaucggggugcuggcccaggcuaaguucccugccgucaaaaagaaauuuauggcggagcucaaggaacugcgccacaaagagcagaaucccuauguggugcagucuauuaucagccuuauuaugggaaugaaguucuuuagaaucaagauguaccccgucgaggacuucgaagccucccugcaauucaugcaggagugugcucacuauuuucucgaaguuaaagacaaggauaucaaacaugcccuggcuggccuuuucguggagauucuggugccugucgccgcggccgugaagaacgaaguuaaugugccgugccuccggaacuuugucgagagccuguacgacaccacgcuggagcucucuucccgcaaaaagcacagccuggcucuuuauccccuggugaccugucuccugugcguuucucagaagcaacuuuuccugaauagauggcauaucuuucucaacaauugucugagcaaccugaaaaacaaggauccuaaaauggcccggguggcucucgaaucccuguaccgccuucugugggucuauaugauuagaaucaagugcgagucuaauacagccacccagagccggcucauuacaaucaucaccacgcuguuccccaaaggguccagaggaguggucccucgcgacaugccccugaacauuuuugugaagaucauucaguucaucgcccaggaacggcuugauuuugcuaugaaggagauuaucuucgacuuucucuguguuggcaaaccggcgaaggccuucagccugaauccugaaagaaugaacauugggcugcgcgcuuuucucgugaucgccgauucucugcaacagaaagacggagagcccccuaugcccgucacaggcgccgugcuuccuuccggcaauacccugcggguuaagaaaacauaccucagcaagacccugaccgaggaagaggcuaagaugaucgggaugucucuguacuauucccaggugagaaaagccgucgauaacauucuucgccaccucgacaaggaagugggacggugcaugaugcugacaaaugugcagaugcugaacaaagagcccgaggauaugaucacgggcgaaagaaagccgaaaauugaccucuuccgcaccuguguugcggcuaucccucggcugcuucccgacgggaugagcaagcuggagcucauugaucugcuggccagacuuuccauccacauggacgaugaacuccgccauaucgcccaaaauucucugcagggacugcucgucgacuucagcgauuggcgggaggacgugcuguuuggcuucacaaacuuucuucugagagaagugaaugauaugcaccauacccuccuggacuccucucugaaacuucuccugcagcugcucacacaguggaagcuggucauucaaacccaggggaagguguacgagcaggcuaacaaaauccggaauagcgagcuuauugccaacggauccagccaccgcauccagucugaaagaggcccccauugcuccguucugcacgcuguggagggcuucgcccucguccugcuguguagcuuucaaguggcgacgcggaaacuuucuguucugauucucaaagaaaucagagcccuguucaucgcucucgggcagccugaggaugacgaucgcccgaugauugacgugauggaucagcuguccagcucuauccuugagagcuuuauucacgucgccguguccgacagcgcuacacugccccucacccauaauguugaccugcaauggcugguggaauggaacgccguccuugugaacucucacuaugaugugaaguccccuagccaugucuggaucuucgcgcaguccguuaaagaccccugggugcugugccucuuuucuuuccugcggcaggagaaucucccuaagcacugccccaccgcccugagcuacgcuuggccuuaugccuuuacaagacuucaguccgugaugccccuggucgauccgaacucuccuauuaaugcuaagaaaaccagcacagccggauccggcgacaacuacgugacgcucuggcgcaauuaucugauccuguguuucgggguugccaagcccucuaucaugagcccuggacaccuuagagcuuccacccccgaaauuauggcgacaaccccggauggcacagugagcuacgacaacaaagccaucgggaccccuucugucggcgugcugcucaagcaacugguuccccucaugcggcuggaguccauugaaaucacggagagccuugugcugggauuuggccgcaccaauucucuggucuucagagaacucguggaggagcugcauccucuuaugaaagaagcucuggagcggcgccccgaaaacaagaagagacgggagcgcagagaucuccugcggcuccagcugcuucgcauuuucgagcugcuggccgacgccgggguuaucuccgauagcacaaauggagcucucgaaagagacacccuggcccuuggcgcgcuguuucucgaguacguggaucugacacggaugcuccuggaagcugagaacgacaaagaagucgagauucuuaaggauaucagagcccacuucucugccaugguggcuaaucugauccagugcgugcccguccaucaccgccgguuucuguucccucagcaaucccucagacaucaccuguuuauucuuuucagccagugggccgggccguuuuccaucauguucacaccccucgaccgcuauagcgaccggaaccaccagauuacgagauaccaguauugugcgcucaaagcuaugucugccguucugugcuguggaccuguguuugauaaugugggccucagccccgacggguaccuguauaaguggcuugauaacauccuggccugccaagaccugcgcguccaucagcucggcugugaggugguugugcugcuucuggaacucaauccugaucagauuaaccuguucaacugggcuaucgaccggugcuacacaggauccuaucaacuggccucuggcuguuuuaaagcuaucgccaccgucugcgggagcagaaauuaccccuucgauauugugacacuccuuaaccugguucuguucaaggcguccgacaccaaucgcgagaucuacgaaauuucuaugcagcucaugcagauccuggaggccaaacuuuuuguguauagcaaaaaggucgcugaacagcggccuggauccauucuguacggcacccacgggccgcugcccccucuguauucugugagccuggcccuccuuuccugugagcuggcuagaauguaccccgagcugacacucccucuguucagcgaagucucucaacgguuucccacgacccauccgaacggacgccagaucaugcuuacauaucugcucccuuggcugcacaauaucgagcugguggauuccagacuccuucugcccggcagcucucccuccagcccugaagacgagguuaaagaucgggaaggggacgugaccgccucccauggccugcgcggaaacggcugggggucucccgaggccacaagccucguccugaauaaccuuauguacaugaccgcuaaguauggagacgaggugccuggcccggaaauggagaaugcguggaacgcccuggcuaauaacgaaaaaugguccaauaaccucagaauuacgcugcaguuccugaucagccucugcgggguuucuuccgauacagugcuucugcccuacauuaagaaagucgccaucuaccugugccggaauaacaccauucagaccauggaggagcuccuguuugaacuucaacagacagagccugugaaccccaucgugcagcacugugacaauccucccuucuauagauuuaccgccagcucuaaggcuagcgccgcggcuuccggaacaacgucuagcuccaacaccguugucgccggccaggaaaauuucccggaugccgaggaaaacaagauucugaaagagucugacgagcgcuuuagcaaugugauccgggcucacacaagacucgaaucccgcuacagcaacucuuccgggggcagcuaugaugaggacaagaaugauccuaucucccccuacaccggauggcugcugacaauuaccgaaacgaaacaaccucagccccucccuaugcccugcaccggcggguguugggccccgcuuguggacuaucugccugagacaaucacaccccggggaccccugcauagaugcaacauugcggucaucuucaugacagaaauggugguugaucacucugugcgcgaggacugggcucuccaucugccucuucugcuccacgccgucuuucugggccuggaucacuaccggccggagguguucgaacauagcaagaaacuccuucugcaucugcucauugcccuguccuguaauucuaacuuucauagcaucgcuuccguucuucugcagaccagagagaugggggaagccaagacacucaccgugcagcccgcuuaucaaccugaguaccuguacacgggaggcuucgacuuccugcgcgaagaucagagcucucccgucccugacuccggccucuccucuagcagcacaucuagcuccaucucucuugggggaagcuccggcaaucugccccagaugacccaagagguggaggacguugauaccgccgcggaaacagacgagaaggccaacaaacugauugaauuucucaccacgagagcuuucgggccucuguggugccacgaggauaucacaccgaagaaucagaacagcaaauccgccgagcagcuuaccaauuuucugcggcauguggucucuguguucaaggacagcaaauccggauuucaccucgaacaccagcugucugagguggcucugcaaacagcccucgccagcuccucucgccauuaugcuggccgcagcuuccagauuuuucgggcgcuuaagcagccccuguccgcccacgcucugagcgaucuccugucucgccuugucgaaguuaucggggagcauggagacgaaauucagggcuacgugauggaggcccugcucacccuggaggccgcuguggauaaccuguccgacugucucaagaauagcgaucuucugacaguccugucuagauccagcucuccugaccucuccagcuccagcaaacugaccgccucuagaaagagcacgggccaacuuaacaugaaccccgggaccacauccggaaauaccgcgacagcugaaagaucucgccaccagcggagcuucuccgugccuaaaaaguuuggcguuaucgauagaucuagcgaucccccgcgcuccgccacccuggaucggauccaggccugcacgcagcaagggcucucuagcaaaacaagauccuccucuagccugaaggacagccugaccgacccuucucacauuaaccaucccacaaaucuccuggcuaccaucuucugggugaccgucgcccuuauggaguccgauuuugaguucgaguaucugauggcgcuccggcugcuuagccgccugcucgcccacaugccccuggacaaggcugaaaacagagagaaacuggagaagcuccaggcccagcugaaaugggcugauuuuuccggacuucaacagcugcuccugaagggcuucacaucucuuacgaccacagaccugacccuccagcuguucagccugcucacaccuguguccaaaauuagcaugguugaugccucucaugcuaucggguuuccccugaaugugcuuugucugcucccucagcugauucaacacuucgaaaacccgaaucaguuuugcaaggacaucgccgagcggauugcgcaggucugucuugaagagaagaaccccaaacuguccaaucucgcccaugugaugacccuguacaagacgcacagcuauacacgcgauugcgcuaccugggucaacgugguuugcagauaccugcacgaagccuaugcugacaucacccucaauauggugacauaccuggccgagcuucuggagaaaggacucccuucugugcagcaaccccugcuucaggucaucuacagccugcucuccuauauggaucugucuguugugccugugaagcaguucaacgucgaagugcugaaaaccauugagaaguacguucagagcgugcauuggcgggaagcccucaauauccugaaacuugucgugucccgcucugcuagccugguccuccccuccuaucaacacagcgaccugucuaagauugagauccauagaguguggacauccgcgagcaaggagcuuccgggcaaaacgcuggauuuucacuucgacauuuccgaaaccccuaucaucggccggcgcuacgacgagcuccagaacucuagcgggagagauggaaagccccgggccauggcuguuacaagauccaccucuagcacauccagcggcucuaauuccaacgugcuggucccugugagcuggaaacgcccccaguauucucagaagcggaccaaagaaaagcugguucacgugcucucccugugugggcaagaggucggacuuagcaagaacccuucugugaucuuuagcagcugcggcgaccuggaucuccuggaacaucagacgucucuugugagcuccgaggacggggccagagagcaggaaaauauggaugacaccaacagcgagcaacaguuccgcguuuuucgggauuucgacuuucuggaugucgaacucgaggacggagaaggcgaguccauggauaauuucaacuggggcgugagacgccggucucuggacagccuggauaaaugugacaugcagauccucgaggaaagacagcuguccgggucuacacccagccuuaauaagaugcaccaugaggacuccgaugaaucuagcgaggaagaggaccugaccgccucccaaauucucgagcacagcgaucugaucaugacacuuucuccguccgaagagaccaacccuauggaacugcucacaacggcuugcgacagcacccccgccgagccccauucuuuuaauacacgcauguccagcuucgaugcgucucugccugacaugaacaaucugcagauuuccgagggaagcaaagccgaagcugugcgggaggaagaggauaccaccguccacgaagacgaucuuucuuccagcaucaacgagcugccggccgcuuucgaguguagcgacuccuuuucucucgauaugacagaaggcgaggaaaaggggaauagagcccuggaccaguucacgcucgcgagcuuuggagagggcgaccgcgggguuucucccccucccagcccuuucuuuagcgccauccuggcugccuuccagcccgcugccugcgaugacgcugaagaggccuggcggucccacauuaaccaacuuaugugugauucugacggaagcugcgcgguguacaccuuucauguguucuccagccuguuuaaaaauauccagaagagauucuguuuucugacaugcgaugccgcuucuuaucucggcgacaaccugcgcggcauuggguccaaguucgucuccucuucccagaugcuuaccagcuguuccgagugcccuacacuguuuguggaugccgaaacccuccugucuugcggacuccuggacaaacugaaguucagcguucuugagcugcaggaauaccucgauacguacaauaacagaaaagaggcuacacuguccuggcuugccaacuguaaggccaccuucgcgggcgggucucgggacggagugauuaccugccaacccggcgauagcgaagagaaacagcuggagcucugucagcgccuguauaagcuccacuuucaacugcugcuucuguuccaguccuacugcaagcucauugggcagguccaugaagugagcucuaugccggagcugcuuaauauguccagagaacugagcgaccucaaaaagcaccugaaagaggcuucugccguuaucgcugccgauccucuguauagcgacggagccugguccgagcccacauuuaccucuacagaagcugccauucagagcaugcucgagugucugaagaacaaugaacuuggcaaagcgcugcggcaaaucagagagugccggucccucuggccuaacgacaucuucggcuccucuuccgaugacgaagugcagacccugcuuaauauuuacuuucgccaucagacgcuggggcagacaggaaccuaugcccucgucggcagcaaccaaucccugacagagaucuguaccaagcugauggagcucaauauggaaauuagagauaugauccggcgcgcucagucuuacagagugcugacgaccuuccuucccgacagcuccgugucugggacaagccuguga

SEQ ID NO: 69479 - RNA, 9042 nt, Artificial Sequence
  derived and/or modified sequence opt5 from FRYL__Homo_sapiens__NP_055845
auguccaauaucaccauugaccccgaugugaagccuggcgaguacgucaucaagucccuguucgccgaauuugcuguucaggccgagaagaaaauugaaguggugauggcggagccccucgaaaagcugcuuucucggucccugcaaagaggggaagaccuccaguucgaucagcugaucuccucuaugagcuccgucgcugagcacugccuucccucucugcuccgcacacuguuugacugguauagacggcagaauggaacggaagaugagagcuacgaauaucgcccuagauccagcaccaaaucuaagggcgacgagcaacagcgggagcgcgauuaccugcucgaaagacgggaccuggccguggauuucaucuuuugucuuguucugguggagguccucaagcagauccccgugcauccuguucccgacccucuggugcacgaaguccuuaaccuggccuucaaacacuuuaagcacaaagagggguauuccggaacaaauaccggcaacgugcacaucauugcugaucucuacgccgaagugaucgggguccuggcucagagcaaguuccaagccguucgcaaaaaguuugugacagagcugaaggagcucagacagaaagaacagucuccgcacgugguccaguccgugauuagccugaucaugggaaugaaguucuuucggguuaaaauguaucccguggaggacuucgaagcgucuuuucaauucaugcaggagugcgcccaguacuuccuugaagucaaggauaaagacauuaagcacgcucuggccggccucuuuguggagauccugauuccuguugcugccgcggugaaaaaugaggucaacgugcccugucuuaagaauuucgucgaaaugcuguaccaaaccacauuugagcucuccagccgcaagaaacauucccuggcccuguauccucucauuaccugccugcuuugugugucucagaagcaguucuuucugaacaauuggcacaucuuccuccagaacugccugagccaucuuaaaaauaaggaccccaaaauguccagaguugcucuggaaagccucuaccggcugcuguggguguaugucauucgcaucaagugugagucuaacacggugacccaauccagacucaugagcauuguuucugcccuguuuccgaagggcagccgguccguggucccuagagauacaccccuuaauaucuucgugaaaauuauccaguuuaucgcucaggaacgccuggacuucgccaugaaggagauuaucuuugaucuccugucuguggggaaaagcaccaagacauucaccauuaacccugagcggaugaauaucggacugagaguuuuucuugucauugccgacucccuccagcaaaaagauggcgaaccgcccaugccuacgacaggggugauccugccgagcggaaacacccugcgcgugaagaagaucuuccucaacaaaacacugaccgacgaggaagcuaaggucauuggcaugucuguguacuauccccagguucggaaagcgcuugauuccauccugagacaccucgacaaggagguggggcgcccuaugugcaugaccagcguccagaugucuaauaaagagcccgaagauaugauuacaggagagcggaagccuaagaucgaccuguucagaacguguauugccgcuaucccccgccugauuccggauggcaugucccggaccgaccuuaucgaacuccuggccagacugacaauccacauggacgaggaacuccgcgcccuggcuuuuaacacccuucaggcccugaugcucgauuucccugacuggcgggaggaugugcugagcggcuuuguuuacuucauugugagagaggucacagacgugcaucccacccugcuugauaaugcgguuaaaaugcucgugcaacugaucaaccaguggaagcaggcugcccagaugcacaauaaaaaccaagacacgcagcauggggucgccaauggagcuucccacccucccccucuggaacggucucccuauagcaacguguuucauguggucgagggcuucgcccucguuauucugugcuccucucgcccggcuacaagacggcuugccgugagcgugcugagagaaauccgcgcgcucuuugcccugcuggagauuccuaagggggaugacgaacuugcuaucgaugucauggaccggcucucccccagcauccuggagucuuucauucaccugaccggagccgaucagaccacacuccuguacugucccuccagcaucgaccuucaaacccuggcugaguggaacucuuccccuauuagccaccaguuugaugugaucucuccgagccauauuuggaucuucgcccacguuacacagggccaggaccccuggaucauuucccucagcucuuuucugaaacaagaaaaccugccuaagcauugcuccacggcggugagcuacgccuggauguucgcuuauaccagacuucagcugcucagcccccaggucgacaucaauucuccuauuaacgccaaaaaggugaauacaaccacaagcuccgauucuuacaucgggcuguggcgcaacuaucucauucugugcuguagcgcugccaccuccucuagcuccacgagcgccggaucuguuagaugcucucccccugagacccuugcuagcacacccgacagcggcuacuccaucgauagcaagaucauuggcaucccgucuccuuccagccuguuuaaacacauugugcccaugaugcgguccgaaagcauggagaucaccgaaucucucguccuggggcugggacgcacaaauccuggcgcguucagagagcuuauugaggaacugcaccccaucauuaaggaggcccucgaacggcgcccggagaacaugaaaagacggcgcagacgggacauccugcgcgugcagcucguuagaaucuucgagcugcuugcugaugccggggugauuagccauuccgccucuggaggccuggacaacgaaacccacuuucucaauaacacgcugcuggaguaugucgaucuuacacggcaacugcucgaagcugagaaugaaaaggacagcgauacccugaaagacaucagaugucauuucuccgcccucguggcgaacauuauccagaaugugccuguccaccagcgccggucuauuuuuccccagcaaagccugagacauucccuuuucaugcuguuuucucacugggcugggccuuucagcaucauguuuacaccccuggaucgcuacuccgaccggaacaugcagaucaauagacaccaguauugcgcccucaaggccaugagcgcuguucuguguugcggccccguggccgauaacgugggacuuucuuccgacggcuaccuguacaaguggcucgacaauauucuggauagccucgacaaaaagguccaucaacuggggugugaggcggugacccuucugcuggagcucaacccugaucagucuaaucugauguauugggcuguugaccgcugcuacaccggauccggccggguggccgccggguguuucaaagcuaucgccaacgucuuucagaauagagauuaucagugcgacacagugaugcuucugaaccucauucuguucaaggcugccgauagcucccgcucuaucuacgaaguugcgaugcaacuccugcagauucuugagccgaaaauguuucgguaugcccacaagcuggaagugcagagaacggacggaguccugagccagcucagcccccugccucaucuuuacagcgugucuuauuaccaacuguccgaggaacucgcucgggccuaccccgagcugacccucgcuaucuucagcgagaucucucagcgcauucagacagcccacccugccggcagacaggucaugcugcauuaucuucugcccuggaugaauaacaucgaacugguggaucucaagccucugccgaccgcucggcgccacgacgaggaugaagacgacagccuuaaagauagagagcugaugguuacaucccggagauggcuccgcggggaaggcuggggaucuccccaagcgaccgccauggugcugaacaaucugauguacaugacggcuaaguauggcgacgagcucgccuggagcgaggucgaaaacguguggacaacccuugccgauggguggccuaaaaaucugaagauuauccugcacuuccucauuuccaucuguggaguuaacucugagcccagccugcuuccuuacgugaaaaaggucauuguguaucugggccgggacaagaccaugcagcuccuggaggagcugguguccgagcuccagcuuacagaucccguuagcucuggggucacccauauggacaauccgccuuacuauagaaucacauccagcuacaaaauccccuccgugacgucuggaaccacaagcuccucuaacaccaugguggcucccacagauggcaauccugacaacaagcccauuaaagaaaauaucgaggaaagcuacguccaccuggauauuuauuccgggcugaacagccaucucaaucgccagcaccaccggcuggagucuagauacuccuccucuuccggcggaagcuaugaagaggagaagucugacagcaugccucuuuacuccaacuggcgccugaaagugauggaacauaaucaaggcgagccgcuccccuuuccucccgccgggggaugcuggucuccucugguugauuaugugcccgaaaccagcuccccgggccugccucuccaccggugcaacaucgcggucauucuucugacggaccugaucaucgaucauagcgugaagguugaguggggguccuaccuccaucugcuucugcaugcuauuuucaucggauuugaccacugucaccccgaaguguaugagcauugcaaaagacuccugcugcaccuccuuauugucaugggcccuaauucuaacauccgcaccguggccagcguucugcugagaaacaaggaguucaaugaaccccgggugcucacagucaaacagguggcccaucuggacuacaacuuuaccgcugggauuaaugauuucaucccugacuaccagcccuccccgaugacagauucuggccuuagcuccucuagcaccuccagcucuaucucccugggaaacaauagcgccgcgauuucucaccuccacacaaccauccugaacgagguggacauuuccgucgaacaagauggcaaaguuaagacgcugauggaguuuaucacaagccgcaaaagagggccucucuggaaucaugaagacgugucugcuaagaaccccuccauuaaaagcgccgagcagcuuaccaccuuccugaagcacguggucuccguguuuaagcagagcucuagcgagggaauccaucuggaacaccaucucuccgagguugcccugcagacagcucuuucuuguagcucccggcacuaugccggccgcucuuuccaaauuuuuagagcucugaaacagccccucaccgccacgacacugagcgaugugcugucccggcucgucgaaaccgugggggacccuggagaggaugcgcagggcuucguuaucgagcuucugcugacacucgaaucugccaucgacacccuggcugagacaaugaagcacuacgaucuucugagcgcccucucccagaccagcuaucaugacccgauuaugggcaauaaauacgcugccaacagaaagucuacggggcaacugaaucuguccaccagccccaucaacucuuccagcuaucucggauacaauuccaacgcccgcucuaauagccuucggcugucccugauuggcgauagacgcggggaccggagacggagcaacacacucgacaucauggauggacgcauuaaucacucuuccagccuggcuagaacccggucucuuagcucccugcgcgaaaaaggcauguaugacgugcagucuacaaccgagccuacgaaccucauggcgacaaucuuuuggaucgccgcuagccugcuggaauccgauuacgaguacgaguaucuccuugcccugagacugcucaacaagcugcuuauucaucugccccucgacaagucugaaagccgggagaaaaucgaaaauguccaguccaagcugaaauggaccaacuucccugggcugcagcaacucuuccuuaagggauuuacaagcgccucuacccaggagaugaccgugcaucugcuguccaaacucauuagcgucuccaagcacacacugguggaucccucucagcuuagcggcuucccucugaauauccucugccugcugccgcaucucauucaacacuuugacucccccacgcaguucuguaaggaaaccgcuucucgcaucgccaaaguuugcgcggaggagaaguguccuacacuggugaaccuugcucauaugaugagccuguacuccacccacacauauagcagagauugcucuaauuggaucaacguggucugucgguaccuccaugacuccuuuagcgauaccacguucaaucugguuacauaucuugccgaacugcucgagaaaggccugucuuccaugcagcagagccugcuccaaauuaucuacucucugcuuucccacauugaccugagcgccgcucccgccaagcaguuuaaccucgaaaucauuaaaaucauugggaaguaugugcagucuccuuacuggaaggaggcgcugaauauccuuaaacugguggucagccgcuccgccagccucgugguucccuccgauaucccgaagaccuacggaggcgacaccgggucuccugaaauuagcuucacaaaaaucuuuaacaauguguccaaggagcugcccggaaaaacccuggacuuccacuuugauauuucugagacacccaucauuggcaacaaguauggggaccagcauagcgcugccggaagaaauggcaaaccuaaggucaucgcugugacgcgguccaccucuagcacauccagcggcucuaacuccaaugcccucguccccgugagcuggaagagaccucaacugucucagcgccggaccagagaaaaacuuaugaacguucugucccucugcgggccggagagcggacugcccaagaacccuucuguggucuucuccagcaaugaagaucuugaggugggcgaccagcagacaucucugaucuccaccacggaggauauuaaccaagaagaggaaguugcuguggaggacaauagcagcgaacagcaguuuggggucuucaaagauuucgacuuucucgauguggagcuggaggacgccgaaggagaguccauggauaacuucaauuggggcgugcgccggagaucucuggacagcaucgauaagggggacacccccucccuccaggaauaccaauguucuagcuccacaccuucucugaaccuuaccaaucaggaggacacagaugaaagcuccgaggaggaagcggcccugaccgcuagccagauucucucucgcacacaaaugcugaacuccgacagcgccacggaugagaccauccccgaccacccggaucuucugcuccagucugaagacuccacaggaagcauuaccaccgaggaaguucugcagauccgggaugagacaccuacgcuggaggcuucccucgacaaugccaacucuagacugcccgaagauaccacaagcguccuuaaagaggaacaugugaccacauuugaggacgagggcuccuauaucauucaggaacaacaggagucucuggugugccagggcauccucgaucuggaagagaccgaaaugccugagccccuugccccugagagcuaccccgaauccgucugcgaggaagacguuacgcuggcucucaaggagcuggacgaacgcugugaggaggaagaggcggauuucagcgggcugucuucccaggacgaagaggaacaagauggauuuccggaggugcagacaagcccucuccccucucccuuccugagcgccauuaucgcugccuuucagccuguggccuaugacgaugaggaagaggcuuggcggugccacgucaaucagaugcuuuccgacaccgauggcucuagcgccguguucaccuuucauguuuucuccagacuguuucaaacaauucagcgcaaguucggggaaaucaccaacgaggcggugagcuuucucggagacucucugcagcggauuggcacaaaauucaaguccagccuugaggucaugaugcuguguuccgaaugcccgaccguguucguugaugccgagacgcucaugucuugugggcugcuggaaacacucaaauuuggagugcuggagcuucaagaacaccuggacaccuacaaugucaagagagaggcugccgagcaguggcucgaugacugcaaacgcacauucggcgcuaaggaagauauguauagaaucaacaccgacgcccagcagauggagauccuggcggaacuugagcugugucggcgccucuacaagcugcacuuucaacugcuucuccuguuccaggccuacugcaaacugauuaaucaggugaacacgaucaagaacgaagcugaggugauuaauaugagcgaggaacucgcccagcuggaguccauccuuaaagaagcugagucugccagcgaaaacgaggagauugacaucuccaaggcugcccaaaccacaaucgaaaccgcgauucauucucugaucgagacacugaaaaauaaggaauuuauuagcgccgucgcucagguuaaggccuucagaucccucuggcccagcgauaucuuuggcucuugugaggacgauccugugcagacccugcuucacauuuauuuccaucaccagacacuggggcaaaccggauccuuugcugugaucggcagcaaccucgacaugucugaggccaauuacaaacugauggaacucaaccuggagauccgggaaucccugagaaugguccagagcuaucagcuucuggcccaagcgaagcccauggggaauauggugucuacgggauucuga

SEQ ID NO: 69480 - RNA, 978 nt, Artificial Sequence
  derived and/or modified sequence opt5 from FRZB__Homo_sapiens__NP_001454
auggugugcggcagccccgggggaaugcugcuccugagagccggccuucuggcucucgccgcgcugugccuucugcgggucccuggggcucgcgccgccgcuugcgagccgguuagaaucccccucuguaagucccugccuuggaacaugaccaaaaugcccaaucaucugcaccacucuacacaggccaacgcuauucucgccaucgaacaauucgagggacugcuuggcacgcauugcagcccugaccugcucuuuuuccugugugcgauguacgcccccauuugcaccaucgauuuucagcacgaaccuauuaagccguguaaauccgugugcgagcgggcucgccaggggugugaacccauccuuaucaaguauagacauucuuggccugagaaucuggccugcgaggaacuccccguguacgaccggggagucuguauuagcccugaggcuaucgugacagccgauggcgcggacuuccccauggauuccucuaacggcaauugccgcggggccagcuccgaaagaugcaaauguaagccgauucgggcuacccagaagacauauuuucgcaacaauuacaacuauguuaucagagccaaagugaaggagauuaaaaccaagugccacgacgucacagcugugguugaggugaaagaaauccucaagagcucucuggucaauauuccucgggauaccgugaaccuguacacguccagcggaugucugugucccccucuuaaugugaacgaggaauauaucaucaugggcuacgaggacgaggaacgcucuagacugcuccuggucgagggguccauugccgaaaaguggaaagaucggcuuggaaagaaaguuaagcgcugggacaugaaacugagacaccucggccugagcaagucugauuccagcaauuccgacucuacccaaagccagaaauccgggcggaacagcaaucccagacaggcccgcaacuga

SEQ ID NO: 69481 - RNA, 900 nt, Artificial Sequence
  derived and/or modified sequence opt5 from FSBP__Homo_sapiens__NP_001243070
auggugggcaaggccagaagcuccaacuucacccugucugagaaacucgaccugcuuaagcuggucaaacccuacguuaagauccucgaagaacacacaaauaaacauagcgugauuguggaaaagaaccggugcugggauaucauugcugucaauuauaacgccaucgggguggaccgcccuccgagaacggcgcagggacugcggacccuuuacaagcgccugaaagaguaugcuaagcaagaacuccugcagcagaaagagacacaguccgauuuuaagucuaauauuagcgagcccaccaaaaagguuauggaaaugaucccucaaaucuccucuuucugucuggugagagaccggaaccacauucagagcgccaaucucgaugaggaagcccaggcuggcacauccagccugcaggucaugcuugaccaucaccccguggccaucaccguugaggugaagcaagaggaagauauuaaaccucccccuccgcugguccucaacucucagcaguccgacacacuggagcagcgcgaggagcaugaacuugugcacgugauggagagaagccugucucccucccucagcucugucgauaugcggaugaccuccagcccuuccucuaucccccgcagagacgacuuuuuccggcacgagagcggggaacauuuucgcucccugcugggauacgauccucaaauucuccagaugcugaaggaggaacaccagaucauucuugagaaucagaaaaacuucggccuguauguucaagaaaagagagaugggcucaaacggcgccagcagcuggaggaggaacuucugagagcuaagaucgagguggaaaaacucaaggccauccggcugagacaugaccugcccgaguacaauagccucuga

SEQ ID NO: 69482 - RNA, 2478 nt, Artificial Sequence
  derived and/or modified sequence opt5 from FSCB__Homo_sapiens__NP_115511
auggugggcaagagccagcaaaccgacgucaucgagaaaaagaaacacauggccauucccaaguccucuagcccuaaagcuacacaucgcaucgggaacacguccggaucuaagggcagcuacuccgccaaggcguaugaaucuauucggguuagcuccgagcugcagcagaccuggacaaaacgcaagcacgggcaggaaaugaccagcaaaucucuccaaacagauaccaucguggaggaaaagaaagaggugaagcuggucgaggaaacagugguuccggaggaaaaguccgcugacgugagagaggccgccauugagcuucccgaaagcguccaggauguggagaucccucccaauaucccuucuguucagcugaaaauggaccggucccagcaaaccagccgcacgggauacuggaccaugaugaacauucccccuguggaaaaggucgauaaagagcagcagacauauuucucugaauccgagaucguggugauuagcagaccggacuccucuagcaccaaguccaaagaggaugcucucaagcauaaaagcucuggcaagaucuuugccuccgaacaccccgaguuccagccugcuacaaauagcaacgaagagauugggcaaaagaauaucucucggaccagcuuuacgcaggaaaccaaaaagggacccccuguccugcuugaggacgagcugcgcgaagagguuacagugcccgugguccaggaaggcuccgccgugaaaaagguugcgucugccgagauugaaccgccuagcacagagaaauuccccgcuaagauccaaccuccccucguggaggaagccaccgcuaaggccgagcccagaccugcggaagagacccauguccaggugcagccguccacagaggaaacgcccgaugccgaggcugccaccgcuguugccgaaaacagcgugaaaguccagccucccccugccgaggaagcuccccugguggaguuuccggcggagauccaaccucccucugccgaagaguccccuagcgucgaacugcucgcugagauucugcccccuucugccgaagagucccccagcgaggaaccgccugccgagauccuuccgcccccugcugaaaaguccccgucuguggagcugcucggcgaaauucggagccccuccgcccagaaagcgccuaucgagguucagccccugccugcugagggggcccuugaagaggcccccgcuaagguggaaccucccacagucgaggagacccuggccgacgugcagccgcuccugccugaagaggcuccccgcgaagaggccagagaacugcaacucucuacagcgauggagaccccugccgaggaagcucccacggaguuccagagcccgcugccuaaagaaacaaccgccgaggaggcuuccgccgaaauucagcuucuggcggccaccgagcccccugcugaugaaacacccgccgaggcucggagcccccucucugaagagaccuccgccgaagaggcccacgcugagguucagagcccucuggcggaagagacaacggccgaagaggcuucugccgagauccaacuucuggccgcuaucgaagccccggcggacgagacccccgcugaagcccaguccccucucagcgaggaaacaucugccgaggaggcucccgccgaagugcagagcccuuccgcgaagggagucagcauugaggaagcuccccuggagcugcagccuccgucuggcgaagagaccacagccgaggaagccuccgcugccauccaacuccuggcugccaccgaggcgagcgccgaagaggcucccgccgaagugcagccucccccugcugaggaggcccccgccgaagugcagccgccucccgcugaggaagcgcccgccgagguucaaccucccccugcugaggaagccccggccgagguccagcccccucccgcugaagaggccccugcggaagugcagcccccgccugcugaggaggcccccgccgaagugcagccucccccugcugaggaagcccccgcggagguccaaucccuuccggcugaagagacgccuauugaggaaacccuggccgccgugcacucuccucccgcugaugacguucccgccgaggaagcuagcguggacaagcauuccccgcccgccgaucuccugcuuacagaggaauuuccuaucggggaggcgucugccgaggucagcccuccucccuccgaacagacccccgaggacgaagcucugguggagaauguuucuacagaguuccagagcccccagguggccggcauucccgcugucaaacucggauccgugguucuggaaggggaggccaaguuugaagaggugagcaaaaucaacucuguccugaaggaucucuccaauaccaacgacggacaagccccuacgcuggaaaucgagagcguguuccacauugagcuuaaacagagacccccugaacuguga

SEQ ID NO: 69483 - RNA, 1482 nt, Artificial Sequence
  derived and/or modified sequence opt5 from FSCN1__Homo_sapiens__NP_003079
augaccgccaacggcacagcugaggccgugcagauccaauucgggcugauuaauugcggaaacaaguaccucacggcggaggcuuuuggcuucaaagucaaugccagcgccuccucucugaagaaaaagcagaucuggacccuugaacagcccccugacgaagcugggagcgccgcuguuugucugagaucccaccucggacgguaucuggccgcggauaaagacggcaacgugacaugcgagcgcgaagugccggggcccgauuguagauuucuuauugucgcccaugacgauggacgguggucucugcagagcgaggcucaccgcagauacuucggcggcaccgaggaccggcucuccugcuuugcccaaacagugucuccugcugaaaaguggagcguucauaucgccaugcacccccaggugaauauuuauuccgucacccgcaagagauacgcgcaucugagcgcccggccugcugaugagaucgccguggaccgcgauguucccuggggaguggacucucugaucacacucgcuuuccaggaucagagauauuccguccaaaccgccgaccaccgguuucugcgccacgaugggagacuuguggcccggccugaaccggcuacgggcuacacccuggaguuccgcagcgggaaaguggcguuuagagacugugagggacgguaucucgcccccucuggcccuuccgggacacugaaggcuggaaaagccaccaaggucggcaaagacgaacuuuucgcccuggagcagagcugcgcucagguugugcuccaggccgcgaacgaaagaaaugugucuacacgccaaggcauggaucuguccgcuaaccaggacgaggaaaccgaucaggagacguuucaacuggagauugaccgggauacaaagaagugugccuucagaacccauacagggaaauacuggacccucaccgccacaggaggcguccagagcacggcuuccucuaagaaugccagcugcuacuuugacaucgaauggcgcgaucggagaauuacccugcgcgcuuccaacgggaaauucgugacaagcaagaaaaauggacagcuugccgcgucuguugagaccgccggcgacuccgaacuguuccucaugaagcugaucaaccggcccauuaucguguuuagaggggagcacggauucauuggcugucgcaaagucacaggcacccuugaugcuaaucggagcucuuaugacguguuucagcuggaauuuaacgauggggccuacaauaucaaggacagcacgggaaaguauuggacaguuggcuccgacucugcugugaccagcuccggggauaccccugucgacuucuucuuugaguucugcgauuacaacaaaguggccaucaaggucggaggcagauaucucaaaggggaccaugcgggcgugcugaaggccagcgcugagacaguugaucccgccucucugugggaauacuga

SEQ ID NO: 69484 - RNA, 1551 nt, Artificial Sequence
  derived and/or modified sequence opt5 from FSCN2__Homo_sapiens__XP_011522894
augcccaccaacggccugcaccaggugcucaagauccaauucgggcuggucaaugacacagauagauaccuuacggccgagagcuuuggauucaaaguuaacgcuuccgccccuucucugaagcggaaacagaccugggugcucgaaccggaccccggccaggggacagcggugcugcuucgcagcucccaucugggaagauaucucucugcugaggaagauggccgggucgccugcgaggccgaacagccugggcgcgacuguagauuucuggugcugccccaaccugauggacgguggguucuccgcagcgagccccacggcagauucuuuggcgggaccgaggaccagcuguccugcuucgcuacagccgugucuccugcugaacuuuggaccguccaucuggccauucacccgcaggcgcaucuccugagcgugucccggcgcagauacguucaccuuuguccccgggaggaugaaauggccgcugacggagauaagccuuggggcguggacgcccugcucacacugaucuuucgcagcagacgguauugccugaaaucuugugauucccgcuaccucagaagcgacgggcggcuggucugggagcccgagccuagagcuugcuauacccuugaguucaaggccggaaagcuggcguuuaaagauugugacggccacuaccucgcccccguggggccggcuggaacgcugaaggccggccgcaauacccggccuggcaaagacgaacuuuucgaucuggaagagucucauccccaggugguccucguugcugccaaccacagauauguguccgugcgccaaggggucaaugugagcgccaaccaggacgaugaacuggaccaugagacauuucugaugcagauugaucaggagaccaagaaaugcacauucuacucuuccaccggaggcuacuggacgcucguuacacacgggggaauccacgcuaccgcgacacaagugagcgccaauaccauguuugaaauggaguggcggggcagacgcgucgcucugaaggccuccaacgggcgguauguguguaugaagaaaaauggacagcuugccgcuauuucugacuucguuggcccuccucccagacccgccuggaccggcaagguggcugggggagcggcccagcaaacacugagcccgcccggcaaagaugaagaguucacgcucaagcugaucaaccgcccuauccuuguccugcgggggcucgacggauuugugugccaucacagaggcuccaaucagcuggauaccaaccgcagcgucuacgacguguuccaucugucuuuuuccgauggggccuaucggauuagaggccgggacggaggcuucugguacacagggagccacggaucuguuuguagcgacggcgaacgcgcugaggauuuuguguucgaguuuagagaacgggggagacucgccauccgcgcucgguccggaaaauaucugagaggcggggccucuggccuucugcgcgcggacgccgaugcucccgccggaaccgcucucugggaguacuga

SEQ ID NO: 69485 - RNA, 1491 nt, Artificial Sequence
  derived and/or modified sequence opt5 from FSD1__Homo_sapiens__NP_077309
auggaggaacagagagaggcccugcggaagaucauuaaaacccucgcugugaagaacgaagagauccagagcuucauuuacucccugaaacaaaugcuucugaaugucgaagccaacucugcgaagguucaggaggaccucgaggcugaauuucagagccuguucucccuucuggaggaacucaaagagggcaugcugaugaagaucaagcaagaucgcgccucuagaacauaugagcugcagaaucagcucgccgcuugcacgcgggcccuggaaagcuccgaggaacuucuggagaccgcuaaccagacacuccaagccauggacucugaagauuuuccccaggcggccaaacagauuaaggacggggugaccauggcuccugccuuccgccugagccuuaaagcuaagguguccgauaauaugagccaccugauggucgacuuugcccaggagagacaaaugcuccaggcgcugaaauuccugccggugcccucugccccuguuaucgaucucgcugagucccugguggccgacaacugugucacacuuguguggcggaugcccgaugaagacagcaagaucgaucauuacguucuggaguaucgcagaaccaauuuugaaggaccuccccggcucaaggaggaccagccuuggauggugauugaaggcauccgccaaacagaguacacccugacggggcuuaaauucgauaugaaguauaugaacuuuagagucaaggcuugcaauaaggccguggccggagaguucucugaaccggugacccuggagacacccgcuuuuauguuccggcucgacgcguccaccagccaccagaaccugcgcgucgacgaucugucuguugaaugggacgccaugggcgggaaagugcaggauauuaaggcuagagagaaagacggaaagggccggacagccuccccuaucaauagccccgcccgcggcaccccuucccccaagagaaugccgucugggcggggaggcagagaucgcuuuacggcugaaagcuacacagugcucggggacacccugauugauggaggcgagcauuauugggagguccgguacgaaccugacuccaaagccuucggggugggaguugcguacagaagccuuggccgcuucgagcagcugggcaagacagcugccucuuggugucuccacgugaacaauuggcugcaagucuccuuuaccgccaaacaugcuaacaaggugaaaguucuugaugcccccgugccugacugccuggggguccacugugauuuccaccagggacuccugagcuuuuauaaugcucggaccaaacaggugcugcauacauucaagacgagauuuacccagccccuccugcccgccuucacagucuggugcggcucuuuucaagugaccacagggcuucagguuccuagcgcggugcgcugucugcagaaacggggauccgccaccucuagcuccaacacgagccucacauga

SEQ ID NO: 69486 - RNA, 1593 nt, Artificial Sequence
  derived and/or modified sequence opt5 from FSD1L__Homo_sapiens__NP_001138785
auggacagccagaaguacugcuucaaagagaacgaaaaugugaccgucgauaaggccuguuuucugaucuccaacauuacaaucggccccgagucuauuaaucuccagcaggaagcucugcagagaaucauuagcacgcuugccaacaaaaaugacgagauccagaacuucaucgauacccugcaccauacacucaaggggguucaagaaaauuccucuaacauucugagcgagcuugacgaggaauuugauucccuguauucuauccucgacgaggugaaagaaagcaugauuaauugcaucaagcaggagcaggcgcggaagucccaggagcugcaaagccagauuucucaguguaacaaugcucuggaaaacuccgaggaacuccuggaguucgccacccgcagccuugauaucaaagaaccugaggaguuuucuaaggccgcuagacagauuaaagaccgggugacaauggccuccgcuuuccgccugagccucaagccgaaagucucugauaauaugacccaccugaugguggacuuuucccaagaaagacagaugcuucagacacugaaguuccuccccguuccuaaggcccccgagaucgauccuguggaaugccuggucgcggacaacagcgugaccguugccuggcggaugcccgaggaagauaauaaaaucgaccauuuuauucuggagcaccgcaagacgaacuucgacggacucccuagagugaaagaugagcgguguugggaaaucauugacaacaucaagggcaccgaguacacacuguccgggcuuaaauuugauucuaaguauaugaauuuccgcgucagagcuugcaacaaagccguggcuggagaauacagcgacccggugacccuggagacaaaggcccucaauuuuaaccuggauaauuccagcucucaucuuaaccugaaggucgaagacaccuguguugagugggaucccacgggcgggaaaggacaagaguccaagauuaaaggcaaggaaaauaaaggccggagcgggacaccuucucccaagcgcaccagcgugggauccagaccucccgcggugcggggcucucgcgacagauucacaggggagagcuauaccguccucggagauaccgccaucgaauccggccagcacuacugggaggugaaggcucagaaagacugcaagagcuauucuguugggguggccuacaaaacacugggaaaguucgaucagcugggcaaaacgaacaccuccugguguauccacgucaauaacuggcuccaaaauacauuugcugccaagcauaacaauaaggugaaagcccuggacguuaccgugccggagaagauuggcgucuucugcgacuuugaugggggacagcuuagcuucuacgacgcuaacucuaaacagcugcucuauuccuuuaagacaaaauucacccagccugugcugcccggcuuuauggucuggugugggggacuuagccuguccacgggcaugcaagugccuucugcgguucggacacuccaaaagagcgaaaaugggaugaccggauccgccucuagccugaacaacguggucacccaguga

SEQ ID NO: 69487 - RNA, 2250 nt, Artificial Sequence
  derived and/or modified sequence opt5 from FSD2__Homo_sapiens__NP_001007123
auggaggaagagagcggcgaagaacuggggcucgacagauccacccccaaggauuuccacuuuuaccauauggaccuguaugauucugaagaccggcuucaccuguucccugaggagaacacacgcaugagaaaagugguccaggccgaaauggcuaaugagagccggggagccggcgaugggaaggcgcaacgcgaccuccaggaagagguugaugagcuggugcaucuuuacggacuggaagacgaucacgagcucggcgacgaauuuguggaugagaacaucccgagaacgggggucuccgaauaucccccuuacaugaugaaacggcgcgaccccgcuagagagcagcgggauuggcgccugucuggagaggccgccgaagcugaggaccugggcuucggcggguggggaagcgccggccagugccaagaccucagagaggcuuaucgguacacccaugggcgcgccuccgaggaauaugaguguuacgugauuccugaggaagaggaugaagaggaagcggccgacguuuucugcgugacauguaagacccccaucagagcuuuccagaaagucuuugaugagcacaaggagcacgaagugauuccucugaaugaggcccuugaaucugcuaaggacgagauccauaaaaacauguacaagcuggagaaacagauuaucgaaauggagaauuucgccaaccaccucgaagagguuuuuaucacaguggaagagaauuucggaaagcaggagcaaaacuuugaaagccauuauaaugagauucuggaaacccuugcgcagaaauacgaggaaaagauccaggcccugggcgagaagaaaaaggagaaacucgaagcucuguaugggcagcuggucuccugcggagagaaccucgauacauguaaggaacugauggagaccauugaagagaugugccacgaggaaaaaguggacuucaucaaggaugccguggcuauggccgaccggcuuggcaaauuucugaagacgaagaccgaugucgagauuagcgcccaaccggaauuugaggaccagacacucgauuucucugacguugagcagcugaugggcuccaucaauaccauucccgcuccuagcgcgcccgugaucaacccucaagugcccaauucugccacaggguccagcguccgcguguguuggucucuuuacuccgacgauaccguugaaagcuaucagcuguccuacagaccggugcaggacucuagcccuggaacggaucaggcugaguuuacagucaccgugaaagaaacauauugcuccguuaccaaccucgugcccaauacccaauacgaguucugggucacagcccacaaccgggccggcccuagccccucuuccgaaagagcuguguacaugacggcccccagcccuccgaucauuaagaccaaagagauccgcucuugugaggaagcgguccugauuugcugggagagcgggaaccugaaucccguggacuccuauacaguugaacucacccaggcugagucuccugaagccagcggagugacagaguccgucgugggcauccccaccugugagagcguugugcagcugcagccugggcggucuuacauuaucuaugucagagcccuuaacaugggaggccccuccgugcgcagcgaaccggcuacggugcauacaaucggcucuuacuuucggcugaauaaggauaccugccacccuuggcucaccauuuccgaggacgggcugacagccguuagaagcgaacgccggacccccgcuagagagcuuuccccuucugauacacauuucacgcgcugcgucgccgugaugggaaaccugauccccgugcggggccaccauuauugggaagucgagguggacgagcaccucgauuacagaguugggguggcguuugccgacguccgcaaacaagaagaucugggagcuaauugucugagcuggugcaugcggcacaccuucgccuccucuagacauaaguaugaguuucuccacaaccggacaaccccugacauucgcaucacagugcccccgaagaaaauuggcauccugcuugauuacgaacauagcaagcuguccuucuuuaauguugaccucagccagcaccuguacaccuucucuugucagcugcacgaguuugugcauccuugcuucucccuugagaaacccgggugucucaagguccacaacggcaucagcaugcccaaacaugugacguuuuauuga

SEQ ID NO: 69488 - RNA, 390 nt, Artificial Sequence
  derived and/or modified sequence opt5 from FSHB__Homo_sapiens__NP_001018090
augaagacccugcaguucuuuuuccucuuuugcuguuggaaagccaucugcuguaacagcugcgagcugacaaauauuacgaucgcuauugaaaaggaggaauguagauucugcaucuccauuaacaccacauggugugccggcuacugcuauacccgggaccuuguguacaaagaucccgcgcgcccuaagauccagaaaacauguaccuuuaaggagcuggucuaugaaacaguuagagugccggggugcgcucaccaugccgacucucucuacaccuaucccguggccacgcaaugucacugcggaaagugcgauagcgacuccaccgauuguacaguccggggccuggggccuucuuacugcagcuucggagagaugaaagaguga

SEQ ID NO: 69489 - RNA, 2088 nt, Artificial Sequence
  derived and/or modified sequence opt5 from FSHR__Homo_sapiens__NP_000136
auggcccugcuccuggugagccuucuggcuuuccucucccugggcucugggugccaccauagaaucugucacugcagcaaccgggucuuucuuugucaggaguccaagguuaccgaaauucccucugaccugccucgcaaugccaucgagcucagauucgugcugacaaaacugcgggugauucaaaagggagcguuuagcggcuucggggaucucgagaaaaucgaaauuucccagaacgacguccuggaagugaucgaggcugauguguuuucuaaucuuccgaagcugcaugagauccgcauugaaaaagccaacaaucuccuguacaucaaccccgaggccuuccagaaucuuccuaaccugcaguaucuccugauuagcaauacgggaaucaagcaccuucccgacguucauaagauucacucccuccaaaaaguccugcuugauauccaggacaacauuaauauccacaccaucgaaagaaacagcuuugugggccugucuuucgaguccguuauucucuggcugaauaagaacgggauccaggagauucauaauugcgcuuuuaacggaacacagcuugaugaacugaaccucagcgacaauaacaaucuggaggaacugccuaacgauguguuccacggcgccucuggccccgucauccucgacauuucccggacccgcauccauagccugccuucuuacgggcuugagaaucugaaaaagcucagagcucgguccacauauaaccugaaaaagcugccgacccuggaaaagcucguggcccugauggaggcgagccugacauaccccucccacuguugcgccuuugcuaauuggcgcagacaaaucucugagcuccacccuauuuguaacaaaagcauccugcggcaggaaguggauuauaugacccaggcccgcggacagagauccagccuugcugaggacaaugaaucuuccuacagccggggcuucgauaugacguauaccgaguuugacuacgaccugugcaacgaagucguugaugugacauguucucccaagccugacgccuucaaucccugcgaggauauuaugggguacaacauccuccgcgugcugauuugguucaucagcauccuggcgauuaccggaaauaucauuguccuugugauccucacaaccucccaauauaaacugacgguuccgagauuucugauguguaaccucgccuucgcugaccugugcauuggcaucuaccuucugcucauugccucuguggauauccauacaaagagccaguaucacaauuacgcuaucgacuggcagaccggggccggaugcgaugccgcuggcuuuuucacagucuuugcguccgagcugagcguguauacccugaccgccauuacacuugaacgguggcauacgaucacccacgcuaugcaacucgacuguaaaguucagcugagacaugccgccucugugauggucaugggcuggauuuucgcuuuugccgcggcucuguucccuaucuuugggauuuccagcuacaugaaggugucuaucugccuccccauggauaucgacuccccucugagccagcuuuaugucaugucccugcucgugcugaacguucuggccuucguggucauuuguggaugcuacauccacauuuaccuuacagugcgcaaccccaauaucguuucuagcuccucugauacccggauugccaaaagaauggcuaugcucaucuuuacagacuuccuguguauggcccccaucagcuuuuucgcuauuuccgccagccugaaggugccucucaucaccgucucuaaggcgaaaauucugcuugugcuguuccacccgaucaacuccugcgccaaucccuuucucuaugcuauuuucacgaagaacuuucgccgggacuucuuuauccugcugagcaaauguggcugcuacgagaugcaggcccaaaucuauagaacagaaaccucuuccaccgugcauaauacacacccucgcaacgggcauuguagcucugcuccccggguuaccagcggauccacauacauucuugucccucucagccaccuggcccagaauuga

SEQ ID NO: 69490 - RNA, 1746 nt, Artificial Sequence
  derived and/or modified sequence opt5 from FSIP1__Homo_sapiens__XP_011519608
auggacaucauuaagggcaaccuggaugggaucagcaaacccgccuccaauucucggauuagaccuggaagccgcuccucuaacgcuagccucgaggugcuguccaccgaaccgggcucuuucaaggucgacacagccagcaaucuuaacuccgggaaagaggaucacagcgaaucuuccaauacggagaacagacggaccagcaaugacgauaagcaggaaucuugcuccgagaaaaucaagcuggcggaggaaggaagcgacgaggaucucgaccugguucaacaucagauuaucucugaauguuccgaugagcccaaacuuaaagagcuggacagccagcuccaggaugcuauccaaaagaugaaaaagcuggacaaaauucuggccaagaagcagcgcagagaaaaagagaucaagaaacagggccucgaaaugcggauuaagcugugggaggaaaucaaauccgccaaguacucugaggcuuggcagagcaaagaggaaauggagaacacaaagaaguuucuuucccugaccgccgugagcgaagagacaguggggccuucucacgaagaggaggauaccuucuccagcgucuuucauacacaaauucccccugaagaguaugaaaugcagaugcagaaacucaauaaggacuuuaccugcgacguggagcgcaacgaaucucugaucaaaagcggaaagaaacccuucuccaauacggagaagauugagcuuagaggcaagcacaaccaggauuucaucaaacggaauaucgaacuggcuaaggagucucgcaacccuguugugauggucgacagagaaaagaagcggcucguggagcugcugaaagaucucgacgagaaggauagcggccuguccagcucugaaggggaccaauccggauggguugugccggucaagggcuacgagcuugccgugacccagcaucagcaacuggcggaaauugauaucaaacuccaggagcugagcgccgcuucucccacaauuuccagcuuuuccccucgccuugaaaauagaaacaaccagaagcccgaccgggauggggagcgcaauauggaggugaccccuggagaaaagauccugagaaacacaaaggagcagcgggaccuccacaauagacugcgcgaaauugaugagaaacugaagaugaugaaggaaaacguccucgagucuaccagcugucuguccgaggaacaacuuaaaugccugcucgacgaguguauccugaagcagaaaucuaucauuaaacuuagcuccgaacggaaaaaggaggacaucgaagauguuacgcccguguucccgcagcugagcagaucuauuaucuccaaacuccugaaugagagcgagacaaaggugcagaagaccgaagucgaggacgccgauaugcuggaaucugaggagugcgaggcuuccaaaggcuauuaccucacaaaggcccugaccgggcacaacaugagcgaagcgcuugugaccgaagccgagaauaugaaaugucugcaauuuucuaaggacguuauuaucagcgauacaaaagacuauuucauguccaagacgcucggaaucggccgccugaagcggccuagcuuucuggaugacccccuuuacggcauuucugugucccucagcuccgaagaucagcaucugaaacugucuagcccugagaacaccaucgcugacgagcaggaaacaaaggaugccgcugaggaaugcaaagagcccuga

SEQ ID NO: 69491 - RNA, 954 nt, Artificial Sequence
  derived and/or modified sequence opt5 from FST__Homo_sapiens__NP_006341
auggugagagcccggcaccagcccggcgggcugugccuccugcuucugcuccugugucaauucauggaggaccgcagcgcucaggccggaaacugcuggcuuagacaggcgaagaauggccggugucagguccuguacaaaaccgaacucuccaaggaggaaugcuguucuacagggcgccugagcacguccuggaccgaggaagauguuaacgacaauacacuguuuaaauggaugaucuucaacggaggcgcuccuaauugcauuccguguaaggagaccugcgagaacguggauugugggcccggcaaaaagugcagaaugaauaagaaaaacaagccucggugugugugcgcccccgacugcucuaauaucacauggaaaggaccugucuguggccucgaugggaagaccuaucgcaacgaaugcgcccugcuuaaagcuagauguaaggagcaacccgaacuggaggugcaguaccagggacggugcaagaaaacaugucgcgacguguuuugcccuggcagcuccaccuguguugucgaucagacgaauaacgccuauugcgugaccuguaauagaauuugcccggagcccgcuucuagcgaacaauaccucugugggaacgacggaguuacauauuccagcgccugccaucugcggaaggcgaccugccuucugggccgcucuaucgggcucgccuacgagggaaaauguauuaaggcuaaauccugcgaagauauccaguguacaggcggcaagaaaugccugugggacuucaagguggggagaggacgguguagccugugcgaugagcucuguccugacucuaaguccgaugaacccgucugcgccagcgacaaugcuaccuaugccucugagugugcgaugaaagaggccgcuugcuccagcggcgugcugcuugaagugaagcacuccgggucuuguaacuga

SEQ ID NO: 69492 - RNA, 927 nt, Artificial Sequence
  derived and/or modified sequence opt5 from FSTL1__Homo_sapiens__NP_009016
auguggaagagauggcuggcccucgcucuggcccuuguggcggucgcuuggguucgggccgaggaagaacugcgcagcaaauccaagaucugcgccaacguguucuguggcgcugggagagaaugcgccgugaccgagaaaggagaacccacaugucucugcauugagcaguguaagccucacaaacggccggucugcggcucuaaugggaagacguaccugaaccauugugagcuucaccgcgacgcuugccugaccggaagcaagauccaaguggauuaugacggccauuguaaagaaaagaaauccguuucucccagcgccuccccuguggucugcuaccagucuaauagagaugagcuccggcgcagaauuauccaguggcuggaagcggagauuauccccgacgggugguuuagcaagggauccaacuauagcgagauccuggauaaauacuucaagaauuuugacaacggcgauucucggcucgacuccagcgaguuccugaaguuuguggagcagaaugaaacagccauuaacaucaccacauauccugaucaagagaauaacaaacuucugcgcggccucuguguugacgcucugauugaacuuucugaugagaaugccgacuggaagcuguccuuccaggaguuucucaaaugccugaaccccagcuucaauccuccggaaaagaaaugcgcucuggaggaugaaaccuacgccgacggggcggagacagaaguggacuguaacagaugcgucugugccugcggaaauuggguguguaccgcuaugacgugcgauggcaagaaccagaaaggggcccagacccaaacagaggaggaaaugacccgguaugugcaggagcuccagaagcaccaggaaacagcugagaagaccaaacgcgucucuacgaaggaaaucuga

SEQ ID NO: 69493 - RNA, 792 nt, Artificial Sequence
  derived and/or modified sequence opt5 from FSTL3__Homo_sapiens__NP_005851
augagacccggcgccccugggccgcuguggccccucccuuggggagcucuggccugggcggugggcuucgucagcuccauggggucuggaaaccccgcuccuggcgggguuugcuggcuucagcaaggacaggaggccaccuguagccuggugcuccagacagacgugacgcgggccgaaugcugugcuuccggcaauaucgauaccgccuggucuaaccugacacaccccggcaauaagauuaaccuucugggguuucucggacugguccauugccugccuuguaaagacagcugcgauggcguggagugugggccgggaaaggcuugccgcaugcucggcgggagaccccggugugaaugcgccccugacuguuccggacugcccgcgcgccuucagguuugcggcucugauggcgccaccuacagagacgagugcgaacugcgggcugcccgcuguagagggcacccugaucucagcgugauguaucggggacgcugcagaaaauccugugagcaugucgugugcccccggccgcaaagcuguguuguggaccagacaggcucugcucacugcgucgugugucgcgccgcgccuugccccgugccuuccagccccgggcaggagcuguguggaaauaacaaugucaccuacaucucuuccugccauaugagacaggccacauguuuccuuggccggagcauugggguucgccacgcuggaucuugcgccggcacccccgaggaaccuccgggcggggaauccgcugaggaggaagagaacuuuguguga

SEQ ID NO: 69494 - RNA, 2529 nt, Artificial Sequence
  derived and/or modified sequence opt5 from FSTL4__Homo_sapiens__NP_055897
augaagcccggcggguucuggcugcaccucacccugcuuggagccagccugccugcugcccucggcuggauggacccggggacauccagaggacccgaugugggcgucggggagucucaggcggaagaaccucggagcuuugaaguuacgcgcagagagggacuguccucucauaacgaacuucuggcuagcugcggcaaaaaguucuguucccggggcucucgcugcgugcucagcagaaaaaccggggagcccgagugucaaugccuggaagccugucggccuuccuacgugcccgucugcggaagcgacggccgcuuuuaugagaaucacuguaagcugcauagagccgcuugccuccuggggaaacggaucacagugauucacucuaaggauuguuuccuuaagggagacacaugcacaauggccggcuacgcucgccugaaaaacguucuccuggcccuucagaccagacugcagccucuccaggaaggggauucccggcaagacccggcgagccagaagcgccugcugguggagucucucuuuagagaucuggacgccgauggaaauggccaucuuuccagcucugagcuggcucagcacguccucaaaaagcaggaccuggaugaagaccuucugggcuguucccccggggaucuccugcgguucgacgacuauaacagcgauuccucucugacacuccgcgaguuuuacauggccuuccaagugguucagcugagccuugcuccugaagacagaguguccgucaccacggugaccgugggacugagcacaguccugaccugcgccguucacggcgaucugcggcccccuaucauuuggaaaagaaaugggcuuacacugaacuuucucgaccuggaggauaucaaugacuucggagaagaugacucucuguauauuaccaaggugacgacaauccauaugggcaacuauaccugccacgcguccgggcaugagcagcucuuucagacacacgugcugcaagucaaugugcccccgguuauccgcguguacccugagagccaggcccaggaacccggagucgcugccucucuucggugucacgcugagggcauuccuaugcccagaaucaccuggcugaagaacggcguggauguuagcacccaaauguccaaacagcucucucugcuggccaaugggagcgaacuucauauuuccagcgugcgcuacgaggacacaggagccuacacgugcaucgcuaagaacgaagucggcguggaugaggacauuucuucccucuucaucgaggacagcgcgcggaaaacccuggccaauauucuguggagagaagaggggcucucugucggaaacauguuuuauguguucuccgaugacggcaucaucguuauucaccccguggauugugaaauccagcgccaucugaagccuacagagaaaauuuucaugagcuacgaagagaucugcccgcagcgggagaagaaugcuacccaacccugucagugggucuccgccgugaacguuagaaaccgcuauauuuacguggcccagccugcucuuucucggguccuggugguggacauccaggcccaaaaaguucuccagagcaucggggucgauccccugccugcgaagcuguccuaugacaagucucacgaucaggugugggugcuuagcuggggcgacguccauaaauccagacccagccuccaggugauuacagaggcuucuaccggacaaucccagcaccugauccgcacgccguuugccggcguugaugacuucuuuauuccucccacaaaucugaucauuaaccacauccgguucggguuuaucuucaauaagagcgauccugccgugcauaaagucgaccucgagaccaugaugccccugaagaccauuggacuucaccaucacggcugcgugccucaggcuauggcccacacacaucucgggggauacuuuuucauccaguguagacaagauucucccgcuuccgccgcgcggcagcuccugguugacagcgugaccgacucuguccugggcccgaacggggaugugacaggcacgccucacaccagccccgacggacgcuuuauuguuuccgccgcugccgauagccccuggcuucaugugcaggaaaucacagucagaggcgagauucaaacccucuaugaccugcagaucaauucugggauuuccgaucuggcuuuccagcggagcuuuacagaguccaaccaguacaauaucuacgccgcgcuccacaccgaaccugaccugcuuuuccuggagcucucuacgggaaaagugggcaugcugaagaaccugaaggaaccgcccgccgggccugcucaacccuggggaggcacccauagaaucaugcgcgauagcgggcuuuuuggccaguaucuccugaccccugcccgggagucccuguuccucauuaauggaagacagaacacccugcgcugcgaagugucuggcaucaaagggggaacaaccgucguuugggugggcgagguguga

SEQ ID NO: 69495 - RNA, 2541 nt, Artificial Sequence
  derived and/or modified sequence opt5 from FSTL5__Homo_sapiens__NP_001121899
auguucaagugcuggagcgugguccugguucucggcuuuaucuuccuggaguccgaagggagacccaccaaagagggaggcuacgggcuuaagucuuaucagccucugaugcggcuccgccacaaagaaaagaaccaagagagcuccagagugaaaggauuuaugauucaggacggcccguucgggucuugugaaaauaaguacugcggacugggccggcauugugugacaagccgcgagacgggccaggccgagugcgcuuguauggaucuuugcaagagacacuauaaacccgucuguggguccgacggagaauuuuacgagaaccauugcgaagugcaccgggccgcgugucugaagaaacagaagaucaccauuguucauaaugaggauugcuucuuuaaaggcgacaaguguaagacaaccgaguauucuaaaaugaagaacaugcuccuggaucugcaaaaucagaaauacaucaugcaggaaaacgagaauccuaacggggacgauauuagccgcaagaaacuccugguggaccagauguucaaguauuuugaugcugacuccaauggacuugucgauaucaacgaacugacacaagugaucaaacaggaggaacucggcaaggaccuguucgauugcacccuuuacguucugcucaaguacgacgacuuuaaugccgauaaacaccuggcccuggaggaguucuauagagcuuuucaggugauucagcucagccugcccgaagaccaaaaacuuucuaucacagccgcuaccgucgggcaguccgccgugcugagcugcgcgauucagggaacgcuccggccucccaucauuuggaagcgcaacaauaucauucugaacaaucuugaucuggaggacaucaacgauuucggcgacgauggcucucucuacaucaccaaggugacaaccacacacgucgggaacuauaccuguuacgccgacggauaugaacaaguuuaccagacgcauauuuuccaggugaaugugccuccggucaucagaguguaucccgagucccaggcucgggaaccuggcguuacagccagccugcgcugccacgcugaggggauucccaaaccucaacugggauggcucaagaacggcaucgauauuacccccaagcugucuaaacagcuuacacugcaggccaauggguccgaggugcauaucagcaacgucagauacgaagacaccggagcguacaccuguaucgccaagaaugaggcuggcguggaugaagacauuuccucucucuuuguugaggacagcgcccggaaaacacuggcuaacauccuuuggcgcgaagagggccuggggauuggaaauauguucuauguguuuuacgaggauggcaucaaggucauucagccgaucgaaugcgaguuccaaagacacaucaaaccuuccgaaaagcuccugggguuucaggacgaggugugucccaaggccgagggagaugaaguccagcggugcgugugggccagcgcuguuaacgugaaagacaaguucauuuaugucgcgcagccuacgcuggauagagugcucaucguugacgugcaaucucagaaagucgugcaggccguguccaccgaucccguucccgucaagcugcacuacgacaaaagccaugaucaggugugggugcuuucuuggggcacacuggagaagaccagcccuacacuccaagucauuacccuggcuuccgggaaugugccgcaccauacgauccacacacagcccguuggcaagcaguuugaccgcguggaugacuucuuuauuccuaccaccacacugaucauuacccauaugcgguucggauuuauccuucacaaagaugaagccgcccuccaaaagaucgaccuggagacaaugucuuauauuaaaacgaucaaccugaaggacuacaaaugugucccccagagccucgcuuauacccaccugggcggguacuacuucauuggaugcaagccugauuccacaggcgccgugagcccccagguuaugguggacggggucaccgauucugugaucggauuuaauuccgacguuacaggcaccccguaugugagcccugaugggcauuaccuugucucuauuaacgacgugaaaggccuggugagaguccaguauaucacgauccgcggagaaauucaagaggcguucgauaucuacaccaaucuccacauuuccgaccuggcuuuccagcccagcuuuacagaggcccaucaguauaacaucuacggcuccucuagcacccagacagauguucuguucguggaacuuuccucugggaaggugaagaugauuaaaagccucaaggagccucugaaagccgaagaguggcccuggaaucggaagaacagacaaauccaggacuccggacuguuuggccaguaucucaugaccccuagcaaagauucucuguucauccuugacgggcgccugaacaagcucaauugugaaauuacggaggucgagaagggaaacacagugaucuggguuggcgaugcuuga

SEQ ID NO: 69496 - RNA, 1626 nt, Artificial Sequence
  derived and/or modified sequence opt5 from FTCD__Homo_sapiens__NP_996848
augagccagcugguggagugcguccccaacuucuccgaaggcaagaaucaagagguuaucgacgccauuucuggggcuaucacccagacaccuggaugugugcuccuggauguggacgccggcccgagcacgaacagaaccgucuacacauuuguggggcccccugaaugcguuguggagggagcgcuuaaugcugcccgggucgccucccgccugauugauaugucuagacaccagggcgaacauccccggaugggggcucucgacguguguccuuucauccccguucgcggagugagcgucgaugagugcgugcugugugcccaggcuuuuggccaaagacuugccgaggaacuggacgugccugucuaucucuacggcgaggcggcccggauggauucccgcagaacccugccggcuauucgggccggggaauaugaggcucugcccaaaaagcuccagcaggccgacugggcgccugauuucggacccucuagcuuuguuccuuccuggggcgccacagcuaccggggcccgcaaauuccugaucgcuuuuaacaucaaucuucugggaacaaaggagcaggcccacagaauugcccucaaccugcgggaacaaggccgcgggaaagaccagcccggaagacuuaagaaggugcagggcaucggcugguaccuggaugagaaaaaucucgcucaggugagcaccaaccugcuggacuucgaagucacggcgcuccauaccguguaugaggaaacaugccgggaggcccaagagcugucucuuccgguuguggggucccagcuggucggacucgugccucugaaggcccuucuggaugcugccgcuuuuuacugugaaaaagagaaucucuucauucuggaagaggaacagcgcaucagacugguugugagccggcucggccuggacucucuuugccccuuuuccccuaaggagagaauuaucgaguaucugguccccgaacgcgggcccgagcggggacucggcagcaaaucucugagagccuucgugggggaagucggagcgcgcuccgcugccccuggcggcgggagcguggccgcugccgcugccgcgaugggagccgcucuuggcuccaugguugggcugaugaccuacggacggagacaauuucagucucucgacacaaccaugcgccggcugauuccgcccuucagagaggccagcgcuaagcugacgacacucguggaugccgacgcggaagccuucaccgcuuaccuggaggccaugcgccuuccuaagaacacacccgaggaaaaagaucggagaaccgcugcccugcaggagggccuccgccgggccgucuccgugccucugacccuggcugaaacaguugcgagccuuuggcccgcccuccaggagcuggcuagaugugggaaucuggccugccggucugaccuccaaguggccgcuaaggcccuggagaugggcgucuuuggagcguauuucaacgugcuuaucaaucugcgcgauaucacggacgaggcuuuuaaagaucagauucaccauagaguguccagccuccugcaggaagccaagacccaggccgcucugguucuugacugucucgaaacacggcaagaguga

SEQ ID NO: 69497 - RNA, 552 nt, Artificial Sequence
  derived and/or modified sequence opt5 from FTH1__Homo_sapiens__NP_002023
augaccacagccagcacgucccaggugagacaaaacuaccaccaggacucugaggcugccaucaaucggcagauuaaccuggaacucuaugcgagcuacgucuaucuguccaugucuuacuauuucgaucgcgacgauguugcucuuaagaauuuugccaaauacuuccugcaucagagccacgaggaaagagagcaugccgaaaagcucaugaaacugcaaaaccagcggggcgggcgcaucuuucuucaggacauuaagaaacccgauugcgacgauugggaguccggacugaaugcuauggagugugcccuccaccuggaaaagaacgugaaucagucucugcucgagcugcauaaacuugcuaccgacaagaacgauccucaccugugcgacuucaucgaaacacacuaucucaaugagcaagugaaggccauuaaagagcugggcgaucaugucaccaaccuuagaaagaugggggcgccggaaagcggacuggccgaguaccucuuugacaaacacacacugggcgauuccgacaaugaaagcuga

SEQ ID NO: 69498 - RNA, 528 nt, Artificial Sequence
  derived and/or modified sequence opt5 from FTL__Homo_sapiens__NP_000137
augagcucccagaucagacaaaacuacucuaccgacguggaggccgcugucaauagccugguuaaccucuaucugcaggccuccuacacauaucuuucucugggcuucuacuuugaucgggacgauguggcgcucgaaggggugagccacuucuuucgcgagcuggcugaagagaagagagaaggauaugagcggcuucugaaaaugcagaaucagcgcggcgggagagcccucuuccaagacauuaagaaacccgccgaggaugaauggggaaagacgccugacgcuaugaaagccgcuauggcccuggagaagaagcugaaccaggcgcuccuggaucuucaugcccugggcuccgcucggaccgacccgcaccucugcgauuuucuggaaacacauuuccuugacgaggaggucaaacugaucaagaaaaugggggaucaccucaccaaucugcaucgccugggaggccccgaagccggccucggggaguaccuguuugaaagacuuacacugaagcacgacuga

SEQ ID NO: 69499 - RNA, 729 nt, Artificial Sequence
  derived and/or modified sequence opt5 from FTMT__Homo_sapiens__NP_803431
augcugagcugcuucagacuccugucccggcacaucucucccagccuugccucccugcgcccugugagauguugcuuugcucucccgcugcggugggcccccggccgcccucuugaccccagacagauugcgccucggcgcccccuggcugccgccgcuucuagcagagauccuaccgggccggccgcuggacccucccggguccgccaaaacuuccauccugacucugaggccgcgaucaauagacagauuaaccucgaacuguacgccagcuauguuuaccuguccauggcuuauuacuuuagccgggaugacguggcccucaauaacuucucucgcuauuuucugcaccaguccagagaggaaacagagcaugcugaaaaacuuaugcggcugcagaaucaacgcggcgggagaauccggcuccaggauauuaagaagcccgagcaggacgauugggagagcggacugcacgccauggaaugugcgcuucugcucgagaaaaacgugaaucagucucugcuggaacuccaugcccuggcuuccgacaagggcgauccucaccuuugcgacuuccuggagacguacuaucucaacgagcaagucaaaagcaucaaggaacugggggaucacgugcauaaucuuguuaagaugggagcccccgacgcuggccuggccgaguaccucuuugauacccacacacugggcaacgaaaauaaacagaacuga

SEQ ID NO: 69500 - RNA, 1518 nt, Artificial Sequence
  derived and/or modified sequence opt5 from FTO__Homo_sapiens__NP_001073901
augaagagaacccccacagccgaggaacgggagcgcgaagcuaaaaagcugagacuccuggaggaacuugaggacacguggcugccuuaccucaccccgaaagaugacgaguucuaucagcaauggcagcugaaguaccccaaacuuauccugcgggaagccagcuccgugucugaggaacuccacaaggagguccaggaggcguuucugacacugcauaagcacggcugccucuuccgcgaucugguucggauucaggggaaagaccuucugaccccugugagcagaauccucauuggaaaccccggcuguacauauaaguaccugaauacccgccuuuuuacagugccuuggcccgucaaaggguccaacaucaagcauaccgaagcugagauugccgccgcuugcgaaacguuccugaaacucaaugauuaucugcaaaucgagaccauccaggcccuggaagaacucgcugccaaggagaaggcgaacgaagacgccgugccucuguguaugucugcugauuuuccgagaguuggaaugggcagcuccuacaaugggcaggacgagguggauauuaaaucucgggccgcuuauaacgucacacuucugaauuucauggacccccagaagaugccuuaccucaaagaggagcccuacuuuggaaugggcaagauggccgugagcuggcaccaugaugaaaaccugguugaccgcuccgcgguggccgucuauagcuacucuugcgagggcccugaggaagaguccgaagaugacagccaccuugaggggagagaccccgauaucuggcacgugggauucaaaauuucuugggacaucgaaaccccgggccuggcuauuccucuccaucaaggggauuguuauuuuaugcuggacgaucugaaugccacacaccagcauugcgugcucgcuggaucccagccccgguucagcucuacccaccgcgucgccgaguguuccacgggcacacuggacuacauccuucagagaugccaacuggcccuccagaacguuugugaugacguggauaaugacgaugugagccugaaguccuuugagccugcuguccuuaaacagggggaagagauucacaacgaaguggaguucgaguggcugcggcaauuuugguuccagggaaaucgcuauagaaagugcaccgacugguggugucagcccauggcgcagcucgaagcccuguggaagaaaauggagggcguuacaaacgcugugcugcaugaagucaagcgggagggccuccccguggaacaaagaaaugagauccugaccgccauccuugccucucugaccgcucgccagaaccuccggagagaguggcacgcccgcugccagagccggauugcgagaacacugccugcugaccagaaaccggaaugccgccccuacugggagaaggaugacgccuccaugccucugcccuucgaucuuacggacaucguuagcgaacuccgggggcaacugcuggaggccaaaccuuga

SEQ ID NO: 69501 - RNA, 579 nt, Artificial Sequence
  derived and/or modified sequence opt5 from FTSJ1__Homo_sapiens__NP_001269086
auggcccugaacaucgcuacccacgugcucaagcccggcgggugcuucgucgccaaaauuuuuagaggacgggacguuacacugcuuuacagccagcugcaaguguucuuuuccucugugcucugugcgaagccucgcagcuccagaaauucuagcaucgaggcuuucgccgucugccagggcuaugauccgcccgaaggguuuauuccugaccuguccaaaccccuucuggaucauucuuacgacccugauuucaaccagcucgacggacccacgcggaucauugugccuuuuguuaccuguggcgaucugagcuccuaugacagcgaucgcucuuacccgcuggaccucgaagggggauccgaguauaaguacacacccccuacccagcccccuaucucucccccguaucaagaggccugcacacugaaaagaaagggccagcuugcuaaggaaauccggccucaggauugucccauuagccgcguggacaccuucccucagccccuggccgcuccccaaugccacacacuccuggccccugagauggaggauaaugaaauguccuguagcccguga

SEQ ID NO: 69502 - RNA, 741 nt, Artificial Sequence
  derived and/or modified sequence opt5 from FTSJ2__Homo_sapiens__NP_037525
auggccggcuaccugaagcucgugugcgucagcuuccagagacaaggguuucacaccguuggaucccgguguaaaaaccgcacaggcgcugagcaucuguggcuuacgagacaucugcgggaccccuucgugaaggccgcgaaaguggaaucuuaucgcugcagaagcgcuuuuaagcuccuggaggucaaugaacggcaccagauccuucgcccugggcugagagugcucgauuguggagccgccccgggcgcuuggucccagguugccgugcagaaagucaacgcugccgggaccgaccccucuagcccugugggauucguucugggcguggaucugcuccacauuuuuccccuggagggcgcgacauuccuuugcccugccgacgucaccgauccccggacaucccaacgcauccuggaagugcucccugggagacgggcugacgugauucugucugauauggccccgaaugcuaccggauuucgcgaccuugaucaugacagacugaucagccucugucugacacugcucuccgucacccccgauauucugcagccuggcgggacguuccuuugcaagaccugggccggaagccagucucggcgccugcagagacggcucacagaggaguuucaaaacguuagaaucaucaagcccgaagcgucccgcaaagagagcucugaaguguacuuccuggccacccaguaucacggccggaaggggacagugaaacaguga

SEQ ID NO: 69503 - RNA, 2544 nt, Artificial Sequence
  derived and/or modified sequence opt5 from FTSJ3__Homo_sapiens__NP_060117
augggcaagaaagggaaggugggaaaaagcagacgggacaaguucuaccaccuggccaaagagaccggcuaucgcuccagaucugcuuuuaagcucauccagcugaaccggcgcuuccaauuucuucagaaggccagagcgcugcucgaucugugcgcugcccccgggggauggcuucaggucgccgcuaaauucaugccuguuagcucccugauugugggcguggaccucgucccgaucaagccccugccuaaugugguuacacugcagcaagauauuacgaccgaacggugucgccaggcccucagaaaagagcugaagacauggaaaguggacgucgugcuuaacgauggggcucccaauguuggagccucuugggugcaugacgcguacagccaggcccaccugacccucauggcucugcggcuugccugcgauuuucuggcucgcggcggcuccuucaucacaaaggucuuuagaucucgggacuaucagccucuccuguggauuuuccaacagcuguuucgcagagugcaggccaccaagccccaggcgagccggcaugaauccgccgagaucuucguggucugucaaggguuucucgcuccugauaaaguugacagcaaguucuuugauccgaaauucgccuucaaggaaguggaggugcaggcuaaaacagucaccgagcuggugacgaagaaaaagcccaaggccgaaggauacgccgagggcgaccuuacccuguaucaccgcacaucuguuaccgauuuucucagagcugcgaacccuguggacuuccuguccaaagccagcgaaaucauggucgacgaugaggagcuugcucagcaucccgccacaaccgaagacauucgggugugcugucaagauaucagaguucuggggcgcaaggagcuccggucucugcugaauuggagaacgaaacuccgccgguacguggccaagaaacugaaggaacaggcuaaggcccuugacauuucccugagcucuggagaggaagaugagggcgacgaggaagauuccacagcggggaccacaaaacagccuagcaaggaggaagaggaagaggaggaagaggaacagcucaaccaaacccuggcugagaugaaagcccaggaagucgccgagcuuaagcgcaaaaagaagaaacugcucagagagcagcggaagcagagagaacgcguggagcugaaaauggaccugcccggagucuccaucgcugaugaaggcgagaccggcauguuuucucucagcacaauucgggggcaccaacugcuugaggaagugacgcagggagacauguccgccgcugauaccuuccugagcgaccucccgagagacgauaucuauguuucugacguggaggaugacggcgaugacacaucccuggauagcgaccuggauccugaggaacuugccgggguccgcggacaccagggccuccgggaccagaagagaaugcggcugaccgaagugcaagaugacaaagaggaggaagaggaagagaauccccugcucguuccucuggaagagaaggcggugcuucaggaggaacaggccaaccugugguuuucuaaggggagcuucgcuggaauugaggaugacgccgacgaagcucucgagaucucccaggcccaacugcuguuugaaaaucgcagaaaaggccggcagcagcaacagaagcagcagcuuccccaaacacccccuucuugccucaaaaccgagaucaugagcccgcuguaccaggaugaggcgcccaagggcacggaagccuccagcgggacagaggcugccaccggacuggaaggcgaggagaaagacgggauuucugauuccgacagcucuaccuccagcgaagaggaagaguccugggaaccucucagaggaaagaaacgcucucggggccccaagagcgaugacgauggguucgagaucgucccuauugaggaccccgcuaagcauagaauccuggauccggaaggccuugcccugggagccgugauugcuuccucuaaaaaggcgaaacgcgaccucaucgauaacagcuuuaauagauacacauucaacgaggacgaaggcgagcugccugaaugguuugugcaggaggagaagcagcaccggauccgccaacugcccguugggaaaaaggaagucgagcauuauagaaagcgguggcgcgaaauuaaugccagaccuaucaaaaagguggcugaggccaaagcccggaagaaacgcagaaugcuuaagcggcucgaacagacccgcaagaaagcugaggccguggucaacacaguggauauuuccgagagagaaaagguugcgcagcugcggagccuguacaaaaaggcuggacucggcaaagagaagagacacgugacguaugucguggccaagaaagggguuggacgcaaggugcggagacccgccggcguccgcgggcacuucaaagugguugacucucggaugaagaaagaccagagagcucaacagcgcaaggaacagaaaaagaagcauaaacggaaguga

SEQ ID NO: 69504 - RNA, 1998 nt, Artificial Sequence
  derived and/or modified sequence opt5 from FUBP1__Homo_sapiens__NP_001290362
auggccgacuacagcaccgugcccccuccguccucuggcagcgcugggggaggcgggggaggcgggggaggcggcggggucaacgaugccuucaaggacgcgcugcagagagcucggcaaaucgccgccaaaauuggaggcgaugcugggacaucccucaauucuaacgacuauggauacggcgggcagaagcgcccccuggaggauggagacggcagcuggacguccccuucuagcaccacacacugggaaggcaugcccuccccuuuuaaagaucagcccgacgccaagaaaguugcuccucagaaugauagcuucgggacccaacuuccgcccaugcaucagcagcagucuagauccgugaugacagaggaauauaaggugccugacggaauggucggcuuuaucauugggcggggaggcgagcaaaucagccgcauucagcaggaaucugggugcaagauccagaucgcccccgauuccggaggccugccugagagaagcuguaugcucaccggcacacccgagucugugcaauccgcgaaacggcugcuugaccagauuguugaaaaggggcgcccggccccuggauuccaccauggcgaugggcccggaaacgcugugcaggagaucaugauuccugccagcaaagcuggccuggucaucgggaagggcggagaaaccauuaaacaacuccaggagagagccggcgugaagaugguuaugauccaggacgggccccagaauacgggagcggacaagccccugcggauuaccggcgauccuuacaaagugcaacaggccaaggagaugguccuggaacucauccgcgaccaagggggauuuagagaggugcggaacgaauauggcucccgcaucgggggcaaugagggaauugaugugccgauccccagauucgcugucggcauuguuaucgggcggaacggagaaaugauuaaaaagauccagaaugacgccggcgugcgcauccaguuuaaaccugaugacgggacaacccccgagagaauugcucagaucacaggaccucccgaucggugccagcacgccgccgagauuaucaccgaccugcuuagaucugugcaggcuggcaaccccgggggcccuggacccggcgggcgcggacggggcagagggcaaggaaauuggaacaugggcccucccgggggccugcaggaguucaauuuuauugucccuacgggaaagacaggccucaucaucgggaaaggaggcgaaaccauuaagagcaucucccagcagagcggggcgcgcauugaacugcaacggaaucccccgccuaacgccgaucccaacaugaaacuuuucacaaucagaggaacaccccagcagauugacuacgcucgccaacugaucgaggagaaaauuggcggcccugugaacccgcucgggcccccuguuccccauggaccucacggcgugcccgggccucacggacccccgggcccucccgggccuggaacccccaugggcccguauaauccugcccccuacaacccuggcccgcccgggccugccccgcauggacccccugcucccuacgccccucagggcugggggaaugcguauccccacuggcagcagcaagcuccuccggaucccgccaaggccggaaccgacccuaacucugcugccugggcugccuacuaugcgcauuacuaucagcagcaggcccaacccccucccgcugccccggcuggcgccccuacgaccacacagaccaaugggcagggagaccagcaaaaccccgcgcccgccggccaggucgauuacacaaaggcuugggaagaguauuacaagaaaaugggccaggccgugccugcucccaccggggccccuccgggaggccaacccgacuacuccgccgcuugggcggaauauuaccggcagcaggccgcuuauuacgcccagacgagcccucaagggaugccccagcacccucccgccccgcagggacaguga

SEQ ID NO: 69505 - RNA, 1719 nt, Artificial Sequence
  derived and/or modified sequence opt5 from FUBP3__Homo_sapiens__NP_003925
auggccgagcuggugcagggccaaagcgcucccgucgggaugaaggccgaaggauucguugacgcgcuccacagagugcggcagaucgcugccaaaauugauuccaucccucaucugaacaauucuaccccgcuuguggaccccagcgucuacggcuauggggugcagaagcgcccucuggaugacggaguuggcaaccagcucggggcccuggugcaccaaagaacagucauuacggaggaauuuaaagugcccgauaagaugguuggauucaucauuggccggggcggggagcagaucucccgcauccaggcugaaucuggaugcaaaauucagaucgccagcgaguccucuggcauuccugagagacccugugugcuuaccgggacaccugaaagcaucgagcaagcuaagcggcugcucggacagauugucgaccgcugcagaaauggcccgggguuucauaacgauaucgacuccaauagcaccauucaggaaauccugauccccgccucuaaggugggacuggugauuggccggggcggggagacaaucaaacagcuccaagagcgcaccggagucaagaugguuaugauucaggauggcccucugcccacaggggcggacaaaccucuuagaaucaccggagaugccuucaaggugcagcaagcucgggaaauggugcuggagauuauccgcgaaaaagaccaggccgauuuuagaggcgucagaggggacuucaacucccgcaugggaggcggcagcaucgaggugucuguucccagauuugcuguggggauugucaucggacggaauggcgaaaugauuaagaagauccagaacgacgccggggugcggauucaguucaaaccggaugacggaaucuccccugagcgcgcggcccaaguuauggggcccccugaucggugucagcacgcugcccauaucauuagcgagcucauccugacggcucaggaaagagacggcuuuggcggacuugccgccgcucgcggccgggggagaggacgcggcgauuggucugugggggcgcccggaggcguccaggagauuaccuacacagugcccgccgacaagugcgggcuggucaucggcaaaggaggcgaaaauauuaaguccaucaaccaacagagcggggcucacguggagcuccagcggaauccuccgcccaacuccgauccuaaucugagacgcuucaccauucggggaguuccccagcaaaucgaaguggccagacagcugaucgacgagaaagucggcgggacaaaccucggagccccuggcgcuuuugggcagucucccuucagccagccgccugcucccccucaccaaaauaccuuucccccucgcuccagcggcuguuuccccaacauggcggcuaaggugaacggaaauccgcauucuacgccuguuuccggcccucccgccuuccugacacagggguggggaagcaccuaucaggccuggcaacagcccacacaacaggugccgucucagcagagccagccccaguccucucaaccuaacuacagcaaagccugggaggauuauuacaagaagcagucccacgccgcuagcgccgcgccccaggccucuuccccucccgacuauaccauggcuugggccgaauacuaccggcagcaagucgcuuuuuauggccagacccuugggcaggcccaagcgcauagccaggagcaguga

SEQ ID NO: 69506 - RNA, 768 nt, Artificial Sequence
  derived and/or modified sequence opt5 from FUCA1__Homo_sapiens__XP_011539469
augcccgaacuguacgaccucgugaacagcuauaagccugaucugaucugguccgacggcgaaugggagugcccggauaccuacuggaacucuacaaauuuccuuagcuggcuguauaaugacucccccgucaaagaugaaguuguggugaacgacagaugggggcagaauuguucuugccaccauggaggcuacuauaacugugaggauaaguuuaaaccucaaagccuccccgaccacaagugggaaaugugcacguccauugauaaauucucuuggggguaccggcgcgacauggcccugagcgaugucaccgaggaguccgaaaucauuagcgagcuugugcagacaguuucucugggaggcaauuaucuccugaacaucgggccuaccaaggacggacugauugugcccaucuuucaggaaagacuccuggcugucggcaaguggcuuuccaucaauggcgaggccauuuacgcgagcaaaccuuggcgggugcagugggagaagaacacaaccucuguuugguacacauccaaagggagcgcuguguaugccaucuuccugcauuggccggaaaauggaguccucaaccuggagucucccauuaccacguccaccacaaagaucaccaugcuuggcauucaaggggaucugaaauggagcacagacccugacaagggacucuuuaucucccugccccagcugccucccucugccgugccggcugaguucgccuggaccauuaagcucacgggcgugaaauga

SEQ ID NO: 69507 - RNA, 1404 nt, Artificial Sequence
  derived and/or modified sequence opt5 from FUCA2__Homo_sapiens__NP_114409
augagaccccaggagcugccucggcucgccuucccgcugcuucugcuccugcuucugcuccugcccccucccccuugccccgcucacagcgccacccgcuuugacccuacaugggaaucccuggaugcgagacaacucccggcuugguucgaccaggccaaguuuggcaucuucauucauuggggaguguuuucuguccccagcuucggguccgagugguuuuggugguacuggcagaaagaaaagaucccuaaauauguugaguucaugaaggauaacuaucccccuucuuuuaaauacgaagacuucggcccccuguuuacggccaaguucuuuaaugcuaaccagugggccgauauuuuccaagcuagcggggccaaguacaucgugcuuaccuccaaacaccaugagggauucacacuguggggcucugaguauagcuggaauuggaacgcgauugacgaagggccgaagcgggauaucgugaaagagcucgaagucgccauccgcaauagaaccgaccugcgguuuggacuuuacuauucccuguucgagugguuucacccucucuuccuggaggaugaaucuagcuccuuucauaagcgccaguuccccgugagcaaaacacugccugagcucuacgaacugguuaacaauuaccagcccgaggugcuuuggucugacggcgauggcggggcucccgaccaguauuggaacuccaccggauuucuggccuggcucuacaaugaaagcccugucagaggcacagugguuaccaacgaucgguggggagcugggucuauuuguaagcacggcggguucuauacgugcuccgaccgcuacaauccgggacaucugcuuccccacaagugggagaacuguaugaccaucgacaaacugagcuggggcuauagacgggaggccggcauuuccgauuaccucacaaucgaggaacuggugaagcaacuggucgaaaccgugucuugcgggggaaaucuccugaugaacauuggcccuacacuugacgggaccaucagcguggucuuugaggaacgccugagacagaugggauccuggcucaaaguuaauggcgaggcgauuuaugagacgcacacauggcggagccagaacgauaccgugacacccgacgugugguacaccucuaagccuaaagaaaagcuggucuacgccaucuuccuuaaauggcccaccuccgggcagcuguuucucggacauccgaaggcuauccugggcgccacagaggugaagcugcucggccacgggcaaccucugaacuggauuagccuugaacagaauggaaucaugguugagcugccccagcucacgauucaccaaaugccuuguaaauggggcugggcucuggcccugaccaacgugaucuga

SEQ ID NO: 69508 - RNA, 468 nt, Artificial Sequence
  derived and/or modified sequence opt5 from FUNDC1__Homo_sapiens__NP_776155
auggccaccagaaaucccccuccgcaggacuacgaaagcgaugacgauuccuaugaagugcuggaccucacagaguacgcucggcgccaccaaugguggaacagagucuucggccauucuagcgggcccaugguugaaaaguauuccguggccacgcagaucgugaugggaggcgucaccggguggugcgcgggauuucuguuccagaaagugggcaaacuugcugccacagccguugggggaggcuuucugcuccugcagauugcuucucacagcggcuacgugcaaaucgauuggaagcgggucgagaaggacgugaacaaagccaagcgccagauuaagaaaagagcuaauaaggccgcgccugaaaucaacaaucuuauugaggaggccaccgaguucaucaaacagaacaucguuauuuccucuggguuugugggaggcuuccugcucgggcuggcuagcuga

SEQ ID NO: 69509 - RNA, 570 nt, Artificial Sequence
  derived and/or modified sequence opt5 from FUNDC2__Homo_sapiens__NP_076423
auggagacgagcgcccccagagcuggcucccagguggucgccacaacggcgcggcacucugcugccuaccgcgccgacccucugagaguuagcucccgggauaagcucaccgaaauggcugccucuagccaagggaacuucgagggaaauuuugaaucccuggaccuugcugaguucgccaaaaagcagccgugguggcgcaaacuguuuggccaggaaucugggcccagcgcggagaaguauuccguggccacacaacucuucaucggaggcgugaccggguggugcacaggauuuauuuuccagaaagucggcaagcuggcugccaccgcugugggcgggggauuuuuccuucugcagcucgccaaccauacaggcuacaucaagguugauuggcagagaguggagaaagacaugaagaaagcgaaggaacagcugaaaauucgcaagagcaaucaaaucccuaccgagguccggucuaaggccgaagaggugguuuccuuugugaaaaagaacguccuggugaccgggggauucuuuggcggguuccuccugggaauggcuagcuga

SEQ ID NO: 69510 - RNA, 2385 nt, Artificial Sequence
  derived and/or modified sequence opt5 from FURIN__Homo_sapiens__NP_001276752
auggagcugagacccuggcuccuguggguggucgccgcuaccggcacacuuguucugcucgccgcggacgcucaggggcaaaagguguucacgaacaccugggccgugcggaucccuggaggcccggccgucgcuaauagcguggcccgcaaacacggguuucugaaccuuggacagauuuucggcgauuacuaucauuuuuggcacagagggguuacaaagcggucccugucuccccaucgcccuagacacagccggcuccagcgcgaaccccaggugcaauggcuggagcagcaggucgcuaaaagacggaccaagcgcgacguguaccaggaaccuacagaucccaaauucccucaacagugguaucuguccggaguuacccagagagaccucaaugugaaggccgcgugggcccagggcuacacaggccaugggaucgucgugucuauucuggaugacggaaucgagaagaaccacccggaucuugcuggcaauuaugaccccggggccagcuuugaugugaacgaccaagauccugacccccagccucgguacacccagaugaaugauaaccgccacggaacgagaugcgcuggcgaagucgccgcgguugccaauaacgggguguguggagugggcgucgcuuauaaugcccggauuggcggggugcgcaugcuggacggagagguuaccgacgcuguggaggccagaucccucggccugaaccccaaucauauccacaucuacucugccagcugggggccggaagaugacggaaaaacagucgauggcccugcucggcuugcggaggaagccuucuuuagaggggugucccaaggacgcggcggccuggggagcauuuucguuugggcuucuggaaacggcgggcgggagcaugacuccugcaauugugauggauacaccaacagcaucuauacacucucuauuuccagcgccacccaguuuggcaacgugcccugguacucugaggccugcuccagcacgcuggcuacaaccuauuccucugggaaucagaacgaaaagcagaucgucacaaccgaccugagacaaaaauguaccgagagccacacaggcacguccgccagcgcgccucucgcugccggaauuaucgcccugacccuugaagcuaauaagaaccugacauggcgcgauaugcagcaccucgugguccagaccucuaaacccgcccaucugaaugcuaacgacugggccacaaauggcguggggcggaagguuucccacagcuacggauauggccuucuggaugcgggggccaugguggcucucgcccagaacuggaccacggucgcuccccaaagaaagugcauuaucgacauccugacagagccuaaagauauuggaaagcgccuggaagugcggaaaaccguuaccgccugucucggcgagccgaaucauaucacaagacuggagcacgcgcaggcccgccuuacccugucuuacaaccggagaggggaccucgcuauucaucuggugagccccaugggcacacgcuccacgcuucuggccgcucggccucacgacuauucugccgauggauucaaugacugggccuuuaugaccacacacagcugggaugaagaccccuccggcgaguggguccucgaaaucgagaacaccagcgaagcuaauaacuacgggacacugaccaaguucacgcuggugcucuacggaaccgcgccugagggccugcccgugccgccugagucuuccgggugcaaaacacuuaccagcucucaggccuguguugucugcgaagagggauuuucccugcaucaaaagagcugugugcagcacugucccccuggcuucgcuccccaggugcucgauacacauuauuccaccgaaaaugacgucgagacgauuagagccucugugugcgccccuugccacgcuagcugcgccacaugucaggggcccgcgcugaccgauugccuguccuguccgucucacgcuagccuugacccuguugaacagacaugcucccggcaaagccagucuucccgcgagagcccuccccagcaacagcccccgagacugcccccugagguggaagccggccagcggcucagagccggacugcuccccucucaucugccugaggucguggcuggccuuuccugugccuucaucguucugguguuugucaccguguuccucguucugcagcugcgcagcggguuuucuuuccggggagugaaagucuacaccauggauagaggccuuaucagcuauaaggggcugcccccugaagcguggcaagaggagugccccuccgacagcgaagaggaugaaggacgcggcgagagaacagcuuuuauuaaggaccagucugcccucuga

SEQ ID NO: 69511 - RNA, 1569 nt, Artificial Sequence
  derived and/or modified sequence opt5 from FUS__Homo_sapiens__NP_001164408
auggccagcaacgacuacacccagcaagcuacacaguccuauggcgccuaccccacgcagccugggcagggauauucucaacagagcucccagccguacggccagcaaucuuauagcggguacucccagucuaccgauacaagcggauauggccaguccagcuacucuuccuacgggcagagccaaaauaccggauauggcacacagucuacaccccagggcuacggguccaccggaggcuaugggagcucucaauccagccaguccucuuacggacagcagagcuccuauccuggcuacgggcaacagcccgcgccuagcucuaccuccggaagcuauggcucuagcucccagucuagcuccuacggccagccccaaagcgggucuuacucccagcagccuagcuauggaggccagcaacagucuuacgggcagcagcaauccuauaacccgccccagggauacggccagcaaaaucaguauaacagcuccucugggggaggcggcgggggaaauuacggccaggaccagagcuccaugucuagcgggggaggcuccgggggcggauauggcaaccaagaucagagcgggggaggcgggucuggaggcuacgggcagcaggacagaggcggacggggccgcgggggauccggcgggggaggcgggggcggaggcgggggauacaauagaagcucuggcggguaugagccucggggacgcggcgggggcagaggaggccgcgggggaaugggcggguccgaucggggaggcuucaacaaguuuggcgggcccagagaccaaggaagccggcacgauucugaacaggacaauagcgauaacaauacgaucuucgugcagggccugggggagaacgucaccauugaauccguugcugacuacuuuaaacagaucggaauuaucaagacaaauaaaaagaccggccaaccuaugauuaaccucuauacagaucgcgagaccgggaaacugaagggagaagccacggugagcuucgacgaucccccgucugccaaggcugccaucgacugguuugacggcaaagaguucuccggcaauccuaucaaggugagcuuugcuacaagacgggccgauuucaaccgcgggggaggcaacgggagaggaggccgggggcgcggaggccccaugggcagagggggauacggcgggggaggcuccgggggaggcggcagagggggauuuccuucuggcgggggaggcgggggaggccagcagcgggcgggcgacuggaaaugccccaaucccaccugugagaacaugaauuucagcuggcgcaacgaaugcaaucaauguaaggccccuaaaccggaugggcccggaggcgggccuggaggcucccauaugggagggaacuauggcgacgaucggagaggcgggcgcggaggcuacgacagagggggauaucggggccgcgggggagaucggggcggcuuuagagggggacgcggcgggggagaccggggcggguucggccccggaaagauggauucuagaggcgagcaccgccaggaccggagagaacggccuuacuga

SEQ ID NO: 69512 - RNA, 1440 nt, Artificial Sequence
  derived and/or modified sequence opt5 from FUT10__Homo_sapiens__NP_116053
auggugagaauccagcggcgcaagcugcucgccagcugccugugugucaccgcuacaguuuuccuucuggugacgcuccaagugauggucgagcugggcaaauuugaaagaaaggaguucaaauccucuagccuucaggacgggcacaccaagauggaagaggcccccacacaucugaacuccuuucucaaaaaggaaggacugaccuucaaucggaagcgcaaaugggagcuggauucuuacccuauuaugcucugguggagcccgcugacaggcgagaccgggagacuuggacagugcggcgcggacgcuugcuuuuucacaaucaaccggaccuaucugcaccaucacaugacgaaggccuuucucuucuacgggaccgauuuuaauauugacucccugccccuuccucgcaaagcccaucacgauugggcuguguuccacgaagagucucccaagaacaauuauaaacuguuucauaagccuguuaucacacucuucaacuacaccgccacauuuagcagacacucccaucugccccugaccacgcaguaucucgaaagcauugaggugcugaagucucuucgguaccuggucccucuccaauccaaaaauaagcugcgcaaaagacuugcuccgcugguguauguucagagcgacugugaucccccuucugaccgggauuccuacgugcgcgagcucaugacauacaucgaagucgacagcuauggagagugucugagaaacaaggaucugccccagcagcucaaaaauccugccucuauggacgcggauggcuucuaccggaucauugcccaauauaaguucauccuggcuuuugaaaacgccgugugcgacgacuacauuaccgagaaauucuggcgcccccuuaagcugggcguggucccgguuuauuacggguccccuagcaucacagauuggcuccccuccaauaagucugcuauucuggugagcgaauuuucccacccuagagagcuugccagcuauauccggagacuggacucugaugaccgccucuacgaggcguacguggaauggaaacugaagggagagauuuccaaccagcggcugcucaccgcccugagagaacgcaaauggggcguccaggaugugaaucaggacaacuauaucgaugcuuucgaguguaugguuugcaccaaggugugggccaauauccggcuucaagaaaaagggcugccucccaagagaugggaggcugaggacacacaccucagcugucccgaaccgacggucuuugccuucucuccccugcgcaccccuccccugagcucccuucgggagauguggauuucuagcuuugaacaguccaagaaagaggcccaggcucucagauggcugguggaucgcaaccaaaacuucagcucucaggaauuuuggggacugguuuucaaggacuga

SEQ ID NO: 69513 - RNA, 1431 nt, Artificial Sequence
  derived and/or modified sequence opt5 from FUT11__Homo_sapiens__NP_001271123
auggccgcuggccccaucagagugguccugguucuccugggggugcuuagcgugugcgccgcguccggacacggcucugucgcugagcgggaagccgggggagaggccgaaugggcugagccuugggacggcgccguguuccgcccgcccagcgcucugggggccguuggagugaccagauccucuggcacaccucggcccggccgcgaagaggcgggggaucucccuguccugcuuugguggagccccggacuguuuccucauuucccgggcgacuccgagagaauugaaugugcccgcggggcuugcguggccucucggaacagacgggcucuccgcgauagcagaacgcgggcccugcuguuuuacggaaccgacuuccgcgcguccgccgcuccccucccuagacuggcccaccagagcugggcccuucugcaugaggaaucuccccucaauaacuuucugcuuucccacggcccugggauccggcuguucaaucucacaagcaccuuuucucgccauuccgauuauccccugagccugcaauggcucccgggaacagcuuaccugagacggccuguucccccucccauggagagagccgaguggcgccggagaggcuaugcuccccuucuguaccuccagucucacugugacgugccugcggaucgcgaccgguaugucagagaacugaugcgccacauuccgguggauuccuacggcaagugccuucagaaccgggagcugcccaccgccagacuccaggacacagcuaccgccacgaccgaagauccugagcugcuggccuuccucagccgcuauaaauuucaucuggcucuugaaaaugccaucuguaacgacuacaugacagagaagcuguggcggcccaugcaccucggggcggugccugucuacagaggaucccccucuguucgcgauuggaugccgaauaaccauagcgugauucugaucgacgacuucgaguccccucaaaaacuugcugaauuuaucgauuuccuggacaagaaugaugaggaauauaugaaauaccucgccuauaagcagcccggcgggauuaccaaccaguuucugcuggacagccucaagcaccgggaguggggagugaaugauccucugcuucccaacuaccugaauggcuucgaaugcuucgucugugacuaugagcucgccagacuggaugcugagaaagcccacgcugccucuccuggggacucccccguguuugaaccgcauaucgcgcagccuagccacauggauugccccguucccacaccuggauucggcaacguggaggaaauuccggagaaugacucuagccugguccaagugcgggaucauuguaucugccuucgcuuucucuggccccacuccgaaaagggcagaacccauaacuacgccgcuguuccuuga

SEQ ID NO: 69514 - RNA, 1098 nt, Artificial Sequence
  derived and/or modified sequence opt5 from FUT1__Homo_sapiens__NP_000139
auguggcugagaagccaccggcagcucugccuggccuuccuucugguguguguccucuccguuaucuuuuuccugcauauucaccaagacucuuuuccccauggccuugggcugagcauccucugcccugaucgcagacuggugaccccgcccguggcuauuuucugucugccuggaacagccaugggccccaacgcguccucuagcugcccucagcaccccgcuucccucucugggacguggaccgucuacccuaauggacgguuuggcaaccagauggggcaguaugccacacugcuugcccuggcucaacucaauggacgcagagccuucauccugccggcuaugcaugccgcgcuugcccccguguuucggauuacccugccuguucucgcucccgagguggacagccgcacaccuuggagagaacugcagcugcacgauuggauguccgaggaauacgccgaccuccgggaucccuuccugaaacuuagcggcuuuccguguucuuggaccuucuuucaccaucugcgcgagcagaucagacgggaguucacacuccacgaccaucugcgcgaagaggcucaguccguccuuggccaacugagacucgggcggaccggagaucgcccuagaacguuugugggcguucacgugcggagaggggacuaucugcaggucaugccccagcgcuggaagggaguggugggcgauagcgccuaccugcggcaggcgauggacugguucagagcccgccacgaagcuccugucuucguugugaccucuaacgggauggaguggugcaaggaaaauaucgauacaucccaaggagacgugaccuuugccggcgauggccaggaggcuacacccuggaaagacuucgcccuccugacccaguguaaccauacgauuaugacaaucgggaccuuuggauucugggccgcuuaucuugcgggcggggacacagucuaccuggccaauuuuacccuccccgauagcgaguuccugaagauuuuuaaaccugaagcugccuuccuuccggagugggugggaaucaacgccgaccugucuccccucuggacccuggcuaagccuuga

SEQ ID NO: 69515 - RNA, 1032 nt, Artificial Sequence
  derived and/or modified sequence opt5 from FUT2__Homo_sapiens__NP_001091107
augcuggugguccagaugcccuucuccuuuccuauggcccacuucauccucuuuguuuucaccguguccacaauuuuucaugugcaacagagacuggcuaagauccaggccaugugggagcuuccgguccagauucccgugcuggcgucuacgagcaaagcucucggcccuucccaacugcgggggauguggaccaucaacgccauuggacgccuuggcaaucagaugggggaauacgccacacuguaugcucucgccaagaugaacggaagacccgcuuucaucccugcccagaugcacucuacccuggcgcccaucuuucggauuacacugccuguucuccauagcgccaccgcuucccgcaucccguggcagaauuaccaccugaacgacuggauggaggaagaguauagacauauucccggcgaauacgugcgguucacaggguauccuugcucuuggaccuuuuaccaccaccuucgccaagagauccugcaggaguucacgcuccaugaucacgucagagaagaggcccagaaauuucugcggggacuucaggugaauggcagccgccccggcaccuucguuggggugcaugucagacggggagacuaugugcacgugaugccuaaggucuggaaaggcguuguggcugaucgcagauaccugcaacaggcccucgacugguuucgggcgcgcuacuccagccugauuuucguggucacaucuaacgggauggccugguguagagaaaauaucgauaccucccacggagacgugguuuucgcuggcgaugggauugagggaagccccgccaaggacuuugcucugcucacacagugcaaccauaccaucaugacgaucggcacauucggcauuugggccgccuaucugaccgggggagauacaaucuaccuugcuaauuauacccugccggacucuccuuuucucaagauuuucaaacccgaggcggccuuucugccugaauggaccggcaucgcugccgaucuuagcccccugcucaagcacuga

SEQ ID NO: 69516 - RNA, 1086 nt, Artificial Sequence
  derived and/or modified sequence opt5 from FUT3__Homo_sapiens__XP_011526169
auggacccccugggcgccgcuaagccucaguggccguggagacggugccucgccgcgcugcuuuuccaacugcucguggcugucugcuuuuucagcuaccugcgcguuuccagagaugacgccaccgggucuccccgggccccuagcggauccucucgccaggauacaacgcccaccagaccuacacuucugauccuccugcggaccuggcccuuucacauuccuguggcucugagccgcuguuccgagauggugccgggcacagccgacugucauaucaccgcugauagaaaagucuauccccaggccgacauggugauuguucaccauugggauaucaugucuaacccuaagagccggcugcccccuagcccccgcccgcaggggcaaagauggauuugguucaaucucgaaccucccccuaacugccagcaccuugaggcgcuggaccgguacuuuaaucucacaauguccuaucgcucugauuccgacaucuucacccccuacggauggcuggaacccuggagcggccagccugcccauccgccccuuaaccugucugcuaaaacggagcucguggccugggcugucuccaauuggaagccugauagcgccagagugcgguauuaccagucucugcaagcgcaccugaaaguugacguguaugggcgcucccacaagccccucccuaagggaaccaugauggaaacacugagcagauacaaauuuuaccuugccuucgagaacucccugcaucccgauuauaucaccgagaagcucuggcggaaugcucuggaagccugggcugucccgguggugcuuggcccuucuagaagcaacuacgagcgcuuucugcccccugacgccuucauucacgucgacgauuuucagucccccaaagaccucgcccgguaucugcaggaacuggauaaggaccaugcuagauaccucagcuauuuccgcuggcgggagacacugagaccucgcucuuuuuccugggcgcuugauuucuguaaagccugcuggaagcugcagcaagagagccgguaccagaccguuagaucuaucgcugccugguucacguga

SEQ ID NO: 69517 - RNA, 1593 nt, Artificial Sequence
  derived and/or modified sequence opt5 from FUT4__Homo_sapiens__NP_002024
augagacggcuguggggcgccgcucgcaagcccagcggggccggaugggagaaagaaugggcggaggcuccucaggaagccccgggcgccugguccgggagacucggacccggccggucugggcgcaagggcagagcugugccuggcugggccagcuggcccgcucaccuggcccuugcggcccggccugcucgccaucugggcggggccggacaaggccccagaccucuccacuccgggaccgcuccguuccauucucgggccagcggagagcgccagagacggcuggaaccccagcuucagcacgagucccgcugcagaucuagcacgccugcggacgccuggcgggcugaggccgcucugcccguccgcgccaugggcgccccuugggggucccccacagcugcggccggaggcagacggggcuggagacgcgggcggggacucccguggaccguuugugugcuggcugccgccggccugacaugcaccgcucucaucacauacgccuguugggggcaacugccuccccuuccuugggcgagccccacccccucuagaccugugggaguccugcucuggugggaaccguuuggcgggcgcgauuccgcuccccggccucccccugacugcagacugcgcuucaacauuagcggaugucggcuucugacagauagagccucuuauggcgaggcccaggcugugcucuuucaucaccgcgaccugguuaaaggacccccggauuggccucccccuugggggauccaggcccacaccgcugaagagguggaccugcggguccucgauuacgaggaagccgcggccgcugccgaggcucuggccacguccagccccagaccucccggacagcgcuggguguggaugaauuucgaaucuccgucccauagcccuggccuucggucccuggcgucuaaccucuuuaauuggacccugagcuauagagccgacuccgauguuuucgugcccuacggguaucuuuacccccggagccacccuggagacccgcccucuggccuggcuccuccccucucccgcaagcaagggcuggucgccuggguggugagccauugggaugagagacaggcucgggucagauauuaccaccagcugucucagcacguuacaguggacguguuuggccgcggaggcccugggcaacccgucccugaaauuggacuccugcauaccguggcccgguacaaauucuaucuugccuuugagaacagccagcaccuggauuacaucacagagaagcucuggagaaaugcucugcuugcgggcgccguucccgugguccuggggccggaccgcgcuaacuaugaaagauucgugccucggggagccuuuauucauguugacgauuuccccuccgccucuagccucgcuuccuaccugcuguuucucgaccgcaauccugccguguauagacgguacuuccacuggcgcagaagcuaugcgguccauaucaccucuuucugggaugagcccuggugccgggugugucaggcuguccaacgcgccggcgacagaccgaaguccauccggaaccuggccagcugguuugaacgcuga

SEQ ID NO: 69518 - RNA, 1125 nt, Artificial Sequence
  derived and/or modified sequence opt5 from FUT5__Homo_sapiens__NP_002025
auggacccccugggcccugccaagccgcaguggcucuggagacggugccuggcugggcuucuguuccaacuccugguggccgucugcuuuuucagcuaccuucgcguuuccagagaugacgcgaccggaucuccccggccuggccugauggcuguggagcccgugacaggggccccuaacggaagccgcugucaggauuccauggccacgcccgcucacccuacccuccugauccugcucuggacauggccguuuaauacccccgucgcccugccuagauguucugaaauggugcccggcgcugccgacugcaacauuacagcggauagcuccguuuauccucaggccgacgcugugaucguccaucacugggauauuauguacaaucccucugccaaccuuccgccucccacccggccucaggggcaacgcuggaucugguucagcauggagucccccagcaauuguagacaucuggaagcucucgacggauauuuuaaccugacaaugucuuaccgguccgauagcgacauuuucacccccuauggcuggcuugagccuuggucuggccagccggcccaucccccucugaaucucuccgcgaaaacggaacugguggccugggcuguuagcaacuggaagcccgauucugcccgcgugagauacuaucagucccugcaggcucaccucaaagucgacguguacgggcggagccacaagccucugcccaaaggaaccaugauggagacacuuucccgcuacaaguuuuaucuggccuucgaaaauucucuccacccggauuacaucaccgagaagcuguggagaaacgcccuugaggcuugggcggugccugucguucugggccccagccgguccaauuaugaacgcuuucucccucccgacgccuucauccauguggacgauuuucaaagcccuaaagaccuggcuagauaccugcaggagcucgauaaggaccacgcccgguaucugucuuacuuccauuggagagagacacuucgcccccgguccuuuagcugggcccuggcuuucugcaaagccuguuggaagcuccagcaggaaucuagauaucaaaccgugcgcagcauugcggcuugguucacguga

SEQ ID NO: 69519 - RNA, 1080 nt, Artificial Sequence
  derived and/or modified sequence opt5 from FUT6__Homo_sapiens__NP_001035791
auggacccccugggcccugccaagccgcaguggagcuggagaugcugucucaccacacugcuuuuccaacugcucauggcugugugcuuuuucuccuaccugcgggucucucaggaugaccccacgguuuauccuaacgggagccgcuuucccgauuccaccggaaccccugcccacucuaucccccuuauucugcucuggacauggccuuucaauaaaccgaucgcgcugcccagauguagcgagauggugccuggcacagcugacugcaacauuaccgccgaucggaagguguacccccaggccgacgcugucaucgugcaucaccgcgaaguuauguauaauccuuccgcccagcugcccagaucuccgcggcgccaagggcagagauggauuugguuuagcauggaguccccuagccauuguuggcagcucaaagcuauggauggauacuucaaccugacaaugucuuaucgguccgacagcgauaucuuuacccccuacggcuggcuugaaccuuggucugggcagcccgcccacccgccucugaaucucuccgcgaagacggagcugguggccugggcugucagcaacuggggacccaauucugcccgcgugagauauuaccaaucccuucaggcucaucugaaaguugacguguacggccggagccacaagccccucccucagggcaccaugauggaaacacugucccgcuauaaguucuaccuggccuuugagaacucucuccaccccgauuauaucaccgagaaacuguggagaaaugcgcuugaagccugggcugucccuguggugcuggggcccagccgguccaacuacgagcgcuuccucccgccugacgccuuuauucaugucgaugacuuccagagccccaaggaccuggcuagauaucuucaagaacuggauaaagaccacgcccgguaccucucuuauuuuagauggcgcgagacacugcggccuagauccuucagcugggcccuggcuuucugcaaggcguguuggaaacuccaggaggaaucucgcuaccagacccggggaaucgccgcuugguuuacguga

SEQ ID NO: 69520 - RNA, 1029 nt, Artificial Sequence
  derived and/or modified sequence opt5 from FUT7__Homo_sapiens__NP_004470
augaacaaugccggccacgggcccaccagacggcugcgcggacucggcgugcuggcuggggucgcccuucuggcggcucucuggcugcuuuggcugcucggaagcgccccuagaggcacaccggcuccccagccuacgaucaccauucugguuuggcauuggcccuucacagaccaaccucccgagcugccuuccgauaccugcacacgguacgggaucgcccgcugucaccucucugccaacagaagccugcuugcuuccgccgacgcggugguguuucaucaccgggaacugcagacccgcagaucucaucucccgcuggcccagcggccccgcggacagccuugggucugggcuagcauggagucccccucucacacacacggccuuagccaucugagaggcauuuucaauugggugcucuccuaucggcgcgauagcgacaucuuuguuccuuacgggagacuggaaccccacuggggaccgucuccuccccugccugccaagucccggguggcugccugggucgugagcaacuuccaagagcgccagcucagagcgcggcuguauagacagcuugcuccccaucugcgcguugauguguuuggccgggccaaugggagaccccucugcgccucuugucuggucccuaccguggcucaguaccgcuucuaucuuuccuuugaaaacagccaacaccgggacuacauuacggagaaauucuggagaaaugcccugguggccggaaccgucccgguugugcucgggcccccucgcgcuacauaugaggcguuugugcccgccgaugcuuucguccacguggacgauuuuggcucugcccgggaacuggccgcuuuccugaccggaaugaacgaguccagauaccagcgcuuuuucgccuggcgggacagacuccgcguucggcuguucacagauuggagagaacgguuuugcgcgaucugugaccgcuacccucaucuucccagaagccagguguaugaggaucuggagggcugguuccaggcuuga

SEQ ID NO: 69521 - RNA, 1239 nt, Artificial Sequence
  derived and/or modified sequence opt5 from FUT8__Homo_sapiens__NP_004471
augaccgaccuguacuaucucagccagacagauggcgccggggacuggagagagaaggaagcuaaagaucugacggagcuugugcaacggcgcaucaccuaccugcagaaccccaaggacugcuccaaagccaagaaacucgucuguaauauuaacaagggaugcggcuaugggugucagcugcaccauguuguguacugcuucaugaucgcguauggaacacagagaacccuuauucuggaaucucaaaauuggcgguacgcuacaggcgggugggagaccguguuucgcccugucagcgaaacauguaccgauagauccggaaucucuacgggccacuggagcggcgaggugaaggacaaaaacguucagguggucgagcucccgauuguggauucccugcauccccggccucccuaucugccucucgccguucccgaagaccuggccgaucgccuugugagaguccacggggacccugcuguguggugggugucucaguucgucaaguaccugauccggccgcagcccuggcucgagaaagaaaucgaggaggccaccaagaaacugggauuuaagcauccuguuauuggcgugcacgugcgcagaacagauaaggucgggaccgaagcugccuuccaccccaucgaggaauacauggugcauguugaggaacacuuucaacuucuggcgcggcgcaugcaaguggacaaaaagagagucuaucucgccacagaugacccuagccugcugaaagaggcuaagaccaaauaccccaauuaugaguucauuuccgacaacagcaucucuugguccgccggacuccauaaucgguacacggaaaacagccugcgcggcgugauucuugauauccacuuucugucucaggcugacuuccucguuugcacauuuuccagccagguguguagagucgccuaugagauuaugcagacccugcacccggaugcgucugccaauuuccauucccuugacgauaucuacuauuuugggggacagaacgcucacaaucagaucgccauuuacgcucaucaaccucggacagccgacgaaauccccauggagccuggcgauauuaucggcguggccgggaaccacugggacggauacagcaagggcgucaauagaaaacuggggcgcaccggacucuaucccuccuacaaggugcgggaaaagauugagaccguuaaauaucccacauacccugaggcugaaaaguga

SEQ ID NO: 69522 - RNA, 1080 nt, Artificial Sequence
  derived and/or modified sequence opt5 from FUT9__Homo_sapiens__XP_011533687
augaccagcacauccaagggcauccugagacccuuccucauugugugcaucauucugggguguuuuauggccugccuucugaucuacauuaaaccuacgaacucuuggaucuucagcccgauggaguccgcuucuagcguccucaagaugaaaaacuuuuucuccaccaagacagacuauuuuaaugaaaccacaauccugguuuggguguggcccuucggacagaccuuugaucuuacaucuugucaagccauguucaauauucagggcugccaccugaccacggaccggagccucuacaacaaaucccaugcggugcugauccaccaucgcgauauuagcugggaccugaccaaucucccucagcaggcuagacccccuuuucaaaaguggaucuggaugaaccuggagucucccacacacaccccucagaaguccgggauugaacaucuuuucaaucugacacucaccuaucggcgcgauagcgacauccaggucccguacggauuucugacggugucuacaaaccccuucguuuuugaggugccuuccaaagaaaaacuugucuguugggugguuagcaauuggaaccccgagcacgccagagugaaguauuacaaugagcugucuaaguccauugaaauccacaccuauggccaggccuucggggaguacgucaacgauaaaaaucucaucccuacaauuagcacaugcaaguucuaccuguccuuugaaaacucuauccauaaggacuauauuaccgagaaacuguacaaugcuuuccucgccggaagcgugcccgugguccugggcccgucccgggagaacuaugaaaacuacaucccugcugauagcuuuauucacguugaggacuauaauucucccuccgaacuugccaaguaccugaaagagguggauaagaacaauaaacucuaucugagcuacuucaacuggcgcaaggacuuuaccgugaaucuuccuagauucugggaaucucaugcgugucuggccugcgaucacgucaaacggcaccaagaguacaagagcgugggcaaccucgagaagugguuuuggaauuga

SEQ ID NO: 69523 - RNA, 1149 nt, Artificial Sequence
  derived and/or modified sequence opt5 from FUZ__Homo_sapiens__NP_001165408
augggcgaggaagggaccggaggcacagugcaucugcucugccuggccgcuagcuccggggucccccuuuucuguagaucuagccggggaggcgccccugcgcgccagcaacugccguuuuccguuaucgggucucucaacggagugcacauguucggccagaaucuggaggugcagcuuagcuccgcuagaacggaaaacaccacagucgugcugcucguuggccuggaggaacugaccaauauucggaacguggagcgccucaagaaagaccugagagccucuuacugccuuaucgauagcuuucugggggacuccgagcucauuggagaucugacacagugugucgacugcgugauucccccugaaggcagccuucugcaagaggcccucucuggguucgcugaagccgcuggaaccacauuuguuucccugguggucagcggccgggugguggccgcgaccgaggggugguggcgccugggaacgcccgaggccguccuccugccuuggcuuguuggcucucugcccccucagaccgcuagagauuauccgguguaccucccccacggcuccccuacagugccccaucggcugcuuacccugacacuccugccuagccuggaacucugucugcuuugcgggcccucuccgccucugucccagcucuauccccagcugcuugagcgcugguggcaaccucugcucgacccccugagagccugucugccccucggaccucgggcucugccgagcggcuucccccuucacaccgauauccuggggcuccugcugcuucaucucgaacugaagcgcugccuguuuacggucgagccucucggagacaaagaacccuccccugagcagagacggcgccugcuuagaaauuucuacacacuggugaccucuacacacuuucccccggagccugggcccccugaaaagaccgaggaugaaguuuaucaggcccagcucccccgggcguguuaccuggugcugggcaccgaggaaccuggaacaggcgucagacuuguggcccuccaacugggccugcgccggcuccugcuucugcucagcccccaguccccgacgcacgggcugagaagccuggcuacccauacacuucacgcccucaccccucugcuguga

SEQ ID NO: 69524 - RNA, 633 nt, Artificial Sequence
  derived and/or modified sequence opt5 from FXN__Homo_sapiens__NP_000135
auguggacccugggcagacgggccguggcugggcuccuggccagccccuccccugcgcaggcucaaacacuuacgcgcgucccgagacccgccgagcuggccccucucugcggacggcgcggccugagaaccgacaucgaugcuacauguacaccccggcgcgccucuagcaaccagagagggcuuaaucagauuuggaacguuaagaaacaguccguguaccugaugaaucuccggaagucuggaacccugggccacccugggagccuggacgaaaccacauaugagcgccucgcugaagagacccuggauucccuugccgaguucuuugaagaccuggcggauaaacccuacacguucgaggacuaugaugugucuuuuggaagcggcguccucaccgugaagcugggcggggaccuuggaacauacguuaucaacaaacaaaccccuaauaagcagauuuggcuguccagcccgucuuccggccccaagagauaugauuggacagggaaaaacuggguguacagccaugacggagucucucuccacgaacugcuggccgcugagcucaccaaggcccugaaaacgaaacuugaucuguccagccucgcuuauucuggcaaggacgccuga

SEQ ID NO: 69525 - RNA, 1620 nt, Artificial Sequence
  derived and/or modified sequence opt5 from FXR1__Homo_sapiens__NP_001013456
auggccgagcugaccguggaagucagaggcagcaacggggcuuucuacaagggauuuaucaaagacguucacgaggauucccucacagugguguucgaaaauaacuggcagcccgagcggcaagucccuuuuaaugaagugcgccugccgcccccucccgacauuaagaaagagaucucugagggcgaugaaguugagguguauagcagagccaacgaccaggaaccuugcgggugguggcuugcgaagguccggaugaugaaaggagaguucuacgugauugaguaugcugccugugaugccacguacaaugaaaucguuaccuuugagcgccugagacccgugaaccagaauaagacagucaagaaaaacaccuucuuuaagugcacaguggacgugccugaagaucuccgggaggcuugugccaaugaaaacgcucauaaagacuucaagaaagccgucggcgcgugccgcauuuucuaucacccggagaccacacagcugaugauccuuuccgccucugaggcuaccguuaagagagugaauauccugagcgauaugcaucuccgguccauucgcacgaagcugaugcugaugucuagaaacgaagaggccaccaaacaccucgaauguacaaagcaacuggcugccgcguuccaugaggaauuugugguccgggaggaccuuauggggcuggccaucggaacccacggcagcaauauucagcaggcucgcaaagugcccggcguuacagccaucgagcucgaugaagacaccgggacguucagaauuuacggagaguccgcugaugccgugaagaaagcccggggcuuucuggaauuugucgaggacuucauccaggugccucgcaaccuuguugggaaggugauuggcaaaaauggaaaggucauccaagaaaucguggacaagagcggggucgugagaguucggauugagggagauaacgagaacaaacugcccagagaagacggcauggugccuuuugucuucgugggcacaaaggagucuaucgggaauguucaggugcuccuggaauaucacauugcuuaccugaaagaggucgagcagcuccgcauggaacggcugcagaucgaugagcaacuuagacagauuggaucccgcagcuacucuggccgggggagaggacgccggggccccaacuauaccuccggguacggaacaaauagcgaacugucuaacccguccgagaccgaaagcgagagaaaggacgagcucuccgauuggucucuggcgggcgaagacgaucgcgacagccggcaucagagagauucccgccggagaccuggcgggcggggacgcagcgugucuggcgggagaggacggggcgggcccagaggcggaaaauccagcaucucuagcgugcuuaaggacccugauuccaaucccuauucucugcucgacaacaccgagagcgaccaaacagccgauacggacgcuuccgaaagccaccauucuaccaaucgccggagacgcuccagacggcgcagaacagaugaggacgccguucugauggauggcaugaccgaaagcgacacagccucugucaacgagaaugggcugggaaagcggugcgauuga

SEQ ID NO: 69526 - RNA, 2022 nt, Artificial Sequence
  derived and/or modified sequence opt5 from FXR2__Homo_sapiens__NP_004851
augggcgggcuggccagcggaggcgacguggagcccgggcucccugucgaaguuagaggauccaacggcgcuuucuacaagggguuugugaaagaugugcacgaggacucugucaccaucuucuuugaaaauaacuggcagagcgagcggcaaauuccguucggagaugugcgccugcccccucccgccgacuauaauaaggaaaucacagagggcgaugagguugaaguguacuccagagcgaacgagcaggaaccuugcggcugguggcuugcucggguccgcaugaugaaaggggacuuuuaugugauugaguacgccgccugugaugcuacguauaaugagaucguuacccuggaaagacuccggcccgugaacccuaauccgcuggccacaaagggaucuuucuuuaaagucaccauggcugugcccgaggaccuucgcgaagccugcagcaacgagaaugugcauaaggaguucaagaaagcgcugggcgccaacuguauuuuucucaauaucacaaacuccgaacuguucauccugucuaccacagaggcuccugucaagagagccagccuccugggggauaugcacuuucggucccuucgcaccaaacugcuccugaugagcagaaaugaagaggcuacgaagcaucuugaaaccucuaaacagcuggccgcggccuuccaggaggaauuuacaguucgggaggaccucaugggacuggcuauuggcacccacggggccaacauccaacaggcucgcaaggugcccggagugacagccauugagcugggcgaagagaccugcacguucagaaucuacggcgaaacaccugaggccugucggcaggcucgcuccuaucucgaguucagcgaagauucuguccaggugcccagaaaucugguugggaaggugauuggcaaaaacggaaaggucauccaagagauuguggacaaauccgggguugugcgggucagaguggaaggagauaacgacaagaaaaauccgcgcgaggaaggcauggucccuuuuaucuucguggggacccgggagaacaucagcaaugcgcaggcccuucuggaguaccaucucucuuaccugcaggaaguugagcagcuuagacuggaacgccuccaaauugacgagcagcugcggcagaucggacugggcuuuagacccccuggcuccgggcgcggaagcggcggguccgauaaggcuggauauucuacagacgaaagcuccucuagcucccuccacgccacccggaccuacggcgggagcuauggcggaagaggccgcgggcggagaacaggaggccccgccuacgggcccucuagcgauguguccacggcuucugagaccgagagcgaaaaacgcgaggaaccuaaccgggccggaccgggcgacagagaucccccuacacgcggggaggaaucccgcagacggcccaccggcggaagaggccgcgggccucccccggcgccucggcccacaagcagauauaauucuuccagcauuucuuccguccugaaggacccugauagcaaccccuacucccuucuggacaccucugagccugagcccccgguggauagcgaaccuggagagcccccucccgcuuccgcccgcagacggcgcucuagacggcgcagaacggacgaagaucggacaguuauggacggcgggcucgagagcgacggaccgaauaugaccgaaaacggccuggaggaugagucccgcccccaaagacggaaucgcagcagacggagacgcaaccgggggaauagaaccgacggcucuaucuccggagaucgccagccugugacagucgccgacuauauuagccgggcugaaucucaguccagacagcggcccccucuugagcggaccaagcccagcgaagauucucugagcggccaaaaaggggacuccgugagcaagcucccuaaaggacccucugagaacggcgagcuguccgccccgcuggaacucgggagcauggugaauggaguuuccuga

SEQ ID NO: 69527 - RNA, 279 nt, Artificial Sequence
  derived and/or modified sequence opt5 from FXYD1__Homo_sapiens__NP_001265647
auggccagccugggccacauccucguguucugcgucgggcugcuuaccauggcuaaggccgagucccccaaagaacaugacccuuuuacauacgauuaucagucucugcaaauuggaggccucguuaucgcggggauucuguucauccuuggcauucugaucgugcucagcagacggugucgcugcaaguuuaaccagcagcagagaacgggagagccggacgaagaggaagggaccuuccgguccucuauccgcagacugagcacacggcgcagauga

SEQ ID NO: 69528 - RNA, 201 nt, Artificial Sequence
  derived and/or modified sequence opt5 from FXYD2__Homo_sapiens__NP_001671
augaccggccugagcauggacgggggaggcucccccaagggggauguggacccuuucuacuaugauuacgagacagucagaaacggaggccucaucuuugccgggcuggcuuucauuguuggacuucugauccuccugucucggcgcuuuagaugcggcggcaauaaaaagcggcgccagauuaacgaagacgagccguga

SEQ ID NO: 69529 - RNA, 435 nt, Artificial Sequence
  derived and/or modified sequence opt5 from FXYD3__Homo_sapiens__NP_001129479
augggcagaggguacagcggagcccugcaggcucggggcgggcucgaggaaccccuggagcgcggacuuagaggcccuuccuucacccaaucuccgcugcacggggccgcggcugccuaucucagcgcccagcgggacgcuucccugcccgugccuggacagcgcucugauaugcagaaggucacacuuggccugcucguuuuucuggccggcuuccccgugcuggacgcuaacgaucucgaagacaaaaauagcccuuuuuacuaugauuggcauucccugcaagucgggggacuuaucugcgccggcgugcugugugcgauggggauuaucauugugaugucugccaagugcaaauguaaguucggacagaaaagcggccaccaucccggggagacgccuccgcucaucacccccggauccgcucagagcuga

SEQ ID NO: 69530 - RNA, 537 nt, Artificial Sequence
  derived and/or modified sequence opt5 from FXYD5__Homo_sapiens__NP_659003
augagccccuccggcagacugugccuccugaccaucguggggcuuauucugccuacacggggacagacgcucaaggacaccacaucuagcuccucugccgauagcaccaucauggacauucaagucccgacacgcgcucccgaugccguuuacaccgagcugcagccuacaucccccaccccuacguggcccgcggacgaaaccccucagccgcagacacaaacccagcagcuugagggcacagaugggccccuggugaccgacccugaaacgcacaaaucuacaaaggcugcccaucccaccgaugacacaaccacccucagcgagagaccuucccccagcacagaugugcagacggacccgcaaacccugaaaccuucuggauuccacgaagaugaccccuuuuucuaugaugagcauacacugcggaagcgcggccuccuggucgccgcugugcuuuuuaucaccgggauuaucauccugacauccggaaaauguagacagcucagccggcugugccgcaacagaugucgguga

SEQ ID NO: 69531 - RNA, 288 nt, Artificial Sequence
  derived and/or modified sequence opt5 from FXYD6__Homo_sapiens__NP_001158303
auggagcuggugcucgucuuccugugcagccuucuggcccccaugguucucgcuuccgccgcggaaaaggagaaagaaauggacccuuuucacuacgauuaucagacccugagaaucggcgggcuuguguucgcugugguccuguuuucugugggcauucuccugauccugagccggcgcuguaagugcuccuucaaccaaaaaccgagagcccccggagacgaggaagcccagguugagaaucucauuacagcuaacgccacggagccucagaaggcugaaaauuga

SEQ ID NO: 69532 - RNA, 2520 nt, Artificial Sequence
  derived and/or modified sequence opt5 from FYB__Homo_sapiens__NP_001230022
auggacggcaaggccgaugugaaaagccugauggcuaaguacaacaccgggggaaaucccacagaggacgucuccguuaacucuagaccuuuccgggugacgggcccgaauagcuccucugggauccaggcccgcaaaaaccucuuuaauaaccaaggaaaugcgagcccucccgcuggccccuccaacgugccuaaguucgggucucccaaaccuccggucgccgugaagcccagcuccgaagagaagccugauaaagaacccaagccucccuuucugaaaccgaccggagccggccagagauucggcaccccugcuagccuuacaacacgggaccccgaggccaagguuggguuucugaaaccugugggacccaagcccauuaaucucccuaaggaagauucuaaaccgaccuuccccuggccucccggcaacaagccuucccugcacagcgucaaucaggaccaugaucuuaaaccccuggggccgaagucuggaccuacacccccuaccuccgagaacgagcagaaacaggcuuuucccaagcucacgggcgugaaagggaaguucaugagcgccucucaagaccuggaaccuaagccccuguuuccgaaaccugcguucggacagaagccuccccucuccaccgagaauagccacgaagaugagucccccaugaaaaacguuucuagcuccaagggcagcccggcuccccugggcgugcgcucuaaauccgggccucuuaagcccgccagagaggacagcgaaaauaaggaucaugccggagagaucucuagccugccuuuucccggcgucgugcucaaaccugcugccucccgcgggggacccggccugucuaagaacggggaagagaaaaaggaagaccggaaaauugaugcggccaagaacacauuccagagcaagaucaaucaagaggagcuugcuuccggaaccccgccugccagauuucccaaagcuccuagcaagcugacagugggcggccccugggggcagucucaggaaaaagagaagggagacaaaaacuccgccaccccgaagcagaagccucugcccccucucuucacgcuggggcccccucccccgaaacccaaucggccucccaacgucgaccucacaaaguuccacaaaaccagcucuggcaauuccacaagcaagggacaaaccuccuauucuaccacaagccugccucccccuccgcccucccauccugccucucagcccccucuucccgcuagccacccgucccagccucccguucccagccugccuccccgcaacauuaaaccuccguuugaucucaagucucccgugaaugaagacaaccaagauggcgugacgcacuccgacggggcgggcaaucuggaugaggaacaggacagcgagggagagaccuacgaagauaucgaggccucuaaagaaagagagaagaagcgggaaaaagaggagaagaaacgccuugaacuggagaagaaagaacagaaggagaaggagaaaaaggaacaggagaucaaaaagaaauucaagcucacaggcccuauucaagucauccaucuggcuaaggccugcugugacgugaaagggggaaagaacgaacuguccuuuaaacagggcgagcagauugaaaucauuagaaucaccgauaaucccgaggggaaguggcucggacggacagcccgcggcagcuauggguacauuaaaaccacggcuguugagaucgacuaugauucucugaaacuuaagaaggacagccugggcgccccuuccagacccaucgaagacgaucaggagguguacgacgaugucgcggaacaagacgauauuagcucucacucccagagcggauccggcgggaucuucccgccucccccugacgaugacauuuaugauggaaucgaggaagaggacgcugaugacggcucuacacuccaggugcaggaaaagagcaacaccugguccugggggauucugaaaaugcuuaagggaaaagaugaccggaagaaaucuaucagagagaagcccaagguuagcgacuccgauaauaacgagggcucuagcuuuccugcucccccgaaacaacuggacaugggggaugaaguguacgacgaugucgacaccuccgauuucccugugagcucugccgagaugucccagggcacaaaugucggaaaggccaaaaccgaagagaaggaccucaaaaagcugaagaaacaggagaaggaagagaaagauuuucgcaagaaauucaaguacgacggcgaaauccgggugcuguauagcacaaagguuacgaccucuauuacauccaaaaagugggggaccagagaucuccaggugaaacccggagagagccuggaggucauccaaacaaccgacgauacgaaggugcuuugccgcaacgaagagggcaaauacggguauguucugcggucuuaccucgccgacaacgacggagaaauuuaugaugacaucgcugauggcuguauuuacgacaaugauuga

SEQ ID NO: 69533 - RNA, 4437 nt, Artificial Sequence
  derived and/or modified sequence opt5 from FYCO1__Homo_sapiens__NP_078789
auggccagcaccaacgcugagucccagcugcaaagaaucauucgggaccuccaggaugccgugacagaacugucuaaggaguuccaggaagcgggcgagcccaucacggacgauagcaccucccuucacaaauuuucuuacaagcuggaauaucuccugcaguucgaccaaaaagagaaggcuacacuucuggggaauaaaaaggauuacugggacuauuuuugcgccugucucgccaaggucaaaggagcuaacgauggcauucgcuucguuaagagcaucuccgagcugagaaccucucuggggaaaggacgggccuuuauucgcuacagccucgugcaucagagacuggcugacacacuucagcagugcuucaugaauaccaaggugacauccgauugguauuacgcccggagcccuuuucugcaaccgaaacucucuuccgacaucgucggccagcuguaugaacuuaccgaggugcaguucgaucuggcgagccgcggguuugaccucgaugccgcuuggcccacguucgccagacggacccugacaaccggaucuuccgcuuaccuguggaagccucccagcagaucuuccagcauguccucucucguuagcuccuaccugcagacacaagaaauggugagcaacuuugaccuuaauucuccucugaacaaugaggcccucgagggcuucgacgaaaugcgccuggagcuugaucagcuggaaguccgggagaagcagcuccgcgaaagaaugcaacagcuggaccgggagaaccaggagcugcgcgcggccgugucccagcaaggcgaacagcuccagaccgagagagaacgggggagaacggcugccgaggauaauguucgccugacaugucuuguggcugaacugcagaaacaaugggaggucacccaggccacacagaacaccgugaaggagcuccagaccugccugcaaggacuugaacugggcgccgcugagaaagaagaggacuaucacacagcgcuccggagacuggaaagcaugcugcagccccucgcccaggagcuggaggcuacgcgcgauucucuugacaagaaaaaucagcaucuggccagcuuuccuggguggcucgccauggcucaacagaaggccgauaccgcguccgacacaaaaggacggcaggaaccgauccccucugaugcugcccaagagaugcaggaacugggcgagaagcugcaggcccuugagagagaacgcaccaagguggaggaagucaaccggcagcaaagcgcucagcucgagcagcugguuaaagaacugcagcucaaggaggacgccagagcuucccuggagcgccuugugaaagaaauggccccucugcaagaggaacucagcgggaagggacaggaggcggaucagcuguggcggagacugcaggaacuucucgcccacacaucuuccugggaggaggaacuggcugagcugcgccgggagaaaaagcaacagcaggaagaaaaggagcuccuggagcaagaagugagaagccuuacccggcagcugcaguuccucgagacgcagcuggcccaagucucucagcauguguccgaccuggaggaacagaaaaagcagcuuauucaagacaaagaucaccucagccagcagguuggcaugcuggagcgccuggcugggcccccuggccccgaacucccgguggccggagagaagaaugaagcgcuggucccugugaacuccucucuucaggaggccuggggcaaacccgaagaggagcaaagagggcugcaggaagcucagcucgacgauacaaagguucaggagggaagccaagaagaggaacugcggcaggccaauagagagcuggagaaggaacuucagaacguggucggccgcaaccaacuccuggaggggaaacugcaggcucuccaggccgacuaccaggcccugcaacagcgggaauccgcuauccagggaucucuugcgagccuggaggccgaacaggcuuccauuagacaccucggcgaucaaauggaggccagccugcuggccgugcgcaaggcuaaagaggccaugaaggcgcagauggcugaaaaagaggccauccuucagucuaaggaaggcgagugucagcaacugagagaggaagucgagcagugccagcaacucgccgaagcucggcaucgcgagcugagagcccucgaaucccagugucagcagcaaacccagcugauugaggugcuuaccgcggagaaggggcagcagggaguuggcccucccacagacaaugaagcucgggagcuggccgcccaacucgcucugagccaggcccagcuggaagugcaccagggggagguccaacgccuucaggcucaggugguugaucugcaggccaaaaugagagcggcccucgacgaucaagacaaggugcagucucagcuguccauggcugaagccguccuccgggagcauaaaacccuggugcaacagcuuaaggagcagaacgaagcucugaaucgcgcccacgugcaggagcuccugcaaugcagcgaaagagagggagcccugcaggaggaacgggcugaugaggcgcagcagcgcgaagaggaacuuagagcccugcaagaggagcucucucaggcuaaauguagcuccgaagaggcccagcuggaacacgccgagcuccaggaacaacugcaucgggcuaacacagacacggccgagcuuggcauccagguuugcgcgcugaccgucgagaaggaaagaguggaggaagcucuggccugugccgugcaggagcuccaagaugcuaaagaagccgcgagccgcgagcgggaggggcuggaaagacaggucgcuggccuucagcaggagaaggaaucucugcaagagaagcucaaagccgccaaggcugccgcuggaucccugcccggccuccaggcccagcuggcgcaggccgaacaacgcgcucagagccuucaggaggccgcucaccaggagcugaauacacugaaauuccaacucuccgccgaaauuauggacuaucagucucggcugaagaacgccggggaggaaugcaaaagccuuagaggacagcuggaggagcaaggccgccagcuccaggcugcggaagaggccguggaaaagcugaaggcuacccaggccgacaugggggagaaacucuccugcacaucuaaucaucuggccgaaugucaagcugccaugcuucggaaggauaaagagggagcggcucugagagaggaccuggaacgcacccagaaggagcucgaaaaagccacgaccaagauccaggaguacuauaacaagcugugccaggaaguuacaaaucgggagagaaacgaucagaaaaugcuugccgaccuggaugaccucaaucggaccaagaaauaccuggaggaacgccucaucgagcugcuuagagauaaggacgcucuguggcagaaaagcgaugcccuggaauuucaacagaagcucuccgcggaggaacgguggcugggcgacacagaggccaaccacugucuugauugcaagcgcgaguucucuuggauggugagacggcaucacuguagaauuugcgggcgcaucuuuuguuauuacugcuguaauaacuacguccugagcaaacacggcggaaagaaagaacggugcuguagagcuugcuuccaaaagcucuccgagggcccugggagcccggacucuuccggaagcggcaccucucagggggaacccuccccugcccugagccccgcuucuccuggaccccaggccacgggcgggcagggcgcuaauacagauuaucgcccgccugacgacgccguguuugauauuaucaccgacgaggagcugugccaaauucaggaauccggaagcucccuccccgagacaccuaccgaaaccgauagccuugaccccaacgcggccgagcaggauacaacgucuaccagccugacaccugaagacaccgaggauaugcccguuggccaagacuccgagaucugucugcucaaaucuggggaacugaugaucaaggugccgcuuacagucgaugagauugcuagcuucggagaaggcucccgggagcuguuugugagaucuagcaccuacucccucaucccuauuacgguugccgaagcugggcugacaaucucuuggguguucagcuccgaccccaaaagcauuucuuuuuccgucguguuccaggaggccgaggauacaccccuggaccagugcaaggugcucaucccuaccacccgcuguaacagccauaaggaaaauauccagggacaacuuaaaguccggaccccgggcauuuauaugcugaucuuugacaacacauucucuagauuuguuuccaagaaaguguucuaccaccugacgguggaucgccccgucauuuaugacgggagcgauuuccucuga

SEQ ID NO: 69534 - RNA, 1614 nt, Artificial Sequence
  derived and/or modified sequence opt5 from FYN__Homo_sapiens__NP_002028
augggcugcgugcaguguaaggacaaagaggccaccaagcugacagaagagagagaugggagccucaaccaauccucuggauaccgguauggcacggaccccaccccucagcacuacccgagcuucggggucacauccauccccaauuauaacaauuuucaugcugccggaggccaggggcugaccguuuucggaggcgugaacucuagcucccacacaggcacccuucgcacaagagggggaaccggcgugacgcuguuugucgcgcucuacgauuaugaagcucggaccgaggacgaucugucuuuccauaaaggggaaaaguuucagauucuuaauagcuccgagggagacuggugggaggcccgcagccugacaaccggcgaaacaggguacaucccuucuaacuauguggcccccguugauuccauucaagcugaggaaugguacuucggaaaacucggcagaaaggacgccgagcggcagcugcugagcuuuggcaauccucgcgggaccuuccucaucagagagucugaaacgacaaagggagcuuacucccugagcauucgggauugggacgauaugaaaggcgaccacgugaagcauuauaaaauccgcaaacuugauaacgggggauacuauaucaccacaagagcccaguuugagacccugcagcaacucguccagcacuacucugaacgggcggccggccugugcugucgccuugugguucccugccacaaggggaugccuagacugaccgaccucuccgugaagacaaaggacgucugggagauuccgcgggaaagccugcagcugaucaaacgccucggaaauggccaguucggcgagguguggauggggacguggaacggaaauaccaagguggcuauuaaaacacugaagcccggcaccauguccccugagucuuuucuugaagaggcccaaaucaugaaaaagcugaaacaugauaagcucguccagcuguaugcuguugugagcgaggagcccauuuacaucgugacagaauauaugaacaaggggucccuucuggacuuccucaaagauggagagggcagagcccugaagcugccuaaucucgucgacauggcggcccagguggcugccgggauggcuuacauugagcggaugaacuacauccacagagaucugcgcagcgccaauauccuuguuggcaacggacugauuuguaaaaucgccgacuuuggccucgcucggcugauugaagauaacgaguauaccgcgagacaaggggccaaguuccccaucaaauggacggcuccggaagccgcccuuuacggacgcuucacaauuaagucugacgugugguccuuuggcauccugcucaccgagcuggucaccaaggggcgggugccuuaucccggaaugaauaacagagaaguucuggaacagguggagcgcggcuaccggaugccuugcccccaggauugucccaucagccuccaugaacugaugauucacugcuggaaaaaggacccugaggaaagaccgacauucgaguaucuucagucuuuucuggaggauuacuucaccgcuacagaaccccaauaucagccuggggagaaucucuga

SEQ ID NO: 69535 - RNA, 1746 nt, Artificial Sequence
  derived and/or modified sequence opt5 from FZD10__Homo_sapiens__NP_009128
augcagagacccggcccucggcuguggcucgugcugcaagucauggggagcugcgccgcuaucuccucuauggacauggagcgcccgggagauggcaagugucagcccauugaaaucccuaugugcaaagacauuggguacaacaugaccagaaugcccaaucuuaugggacacgagaaccagcgggaagccgcgauccagcugcaugaguucgcuccucucguugaauauggcugucacgggcaucugcgcuuuuuccuuugcagccuguacgcccccauguguacagagcaaguguccacgccuauuccggccugcagagugaugugugagcaggcucggcucaagugcucucccaucauggaacaguuuaauuucaaauggccugauagccuggacugucgcaagcugcccaacaaaaaugauccuaacuaucucugcauggaggcccccaauaacggauccgacgaaccgaccagaggcucuggccuguuuccuccccuuuuccggccucagcgcccccacagcgcucaagagcauccccugaaggaugggggaccuggcagagggggaugugacaauccgggcaaguuucaccacgucgagaaauccgccagcugcgcgccccucugcacaccugggguggauguuuacuggucucgggaagacaagcgcuucgccguggucuggcuggcuaucugggccgugcuuuguuucuucuccagcgcuuuuaccguucugacauuccucauugaucccgccagauuucgguauccugagcgccccaucauuuuccugucuaugugcuacuguguguauuccgucggauaccugaucagacucuucgcgggcgccgaaagcauugcuugcgaccgggauucuggccagcuguacgugauccaggaggggcuugaauccaccggauguacacugguguuucucguccuguauuacuucggcauggccagcucccuuugguggguugugcugacccucacgugguuucuggcugccgggaaaaaguggggacaugaggccauugaggcuaacucuagcuauuuccaccuggcggccugggcuaucccggccgugaaaaccauccucauucuggucaugagacgcguggccggcgacgaacuuacagggguuugcuacgugggauccauggacgucaaugcucugaccggcuuugugcucaucccucuggccuguuaucuuguuauuggcaccagcuucauccugucuggguuuguggcgcucuuucauauucggagagucaugaagacaggaggcgagaacacggauaagcuggaaaaacugauggugcgcaucgggcucuuuuccguccuguacacagugcccgcuaccugcguuaucgccuguuauuucuacgagcggcuuaauauggacuacuggaagauucuggccgcucagcacaaaugcaagaugaacaaucaaacaaaaacccucgauugucugauggccgcuagcaucccugccguggaaauuuuuauggucaagaucuucaugcugcuugugguuggaauuaccucuggcauguggaucuggacaagcaaaacgcuccaguccuggcagcaagugugcucuagacgccugaagaagaaaagccggagaaagcccgcguccgucaucaccagcgggggcauuuauaaaaaggcccagcacccucagaaaacacaucacggaaaguacgagauccccgcucagucuccgaccugcguguga

SEQ ID NO: 69536 - RNA, 1944 nt, Artificial Sequence
  derived and/or modified sequence opt5 from FZD1__Homo_sapiens__NP_003496
auggccgaggaagaggcucccaagaaaagcagagccgcgggcgggggagcuuccugggaacugugcgccggcgcccucucugcucggcuggccgaggaagggagcggagacgcuggcgggcgcagacggccuccgguggauccccgcagacuugcccggcagcugcuccugcuucuguggcuccuggaggcgccucugcuccugggaguccgcgcccaagcugccggccagggccccgggcagggaccuggccccgggcagcaaccuccgcccccuccccagcagcagcaauccggacagcaguacaacggcgagagagggaucucuguuccugaccacggauauugucagcccauuagcaucccgcuuugcaccgauauugcuuacaaucaaacaaucaugccuaaccugcucggccauacgaaucaggaagacgccggccuggaggugcaccaguucuauccccuugugaagguccaauguuccgcggaacugaaauuuuuccucugcucuauguacgccccuguguguaccguucuggagcaggcucugccucccugccggagccucugugagcgcgccagacaggggugcgaagcucugaugaacaaguuuggauuccaguggcccgauacacuuaaaugugagaaguuuccggugcauggcgccggggaacugugcgucggacaaaauaccuccgacaagggcacacccaccccuagccuccugcccgaguucuggacaucuaacccucagcacgggggaggcggccaucgcgggggauuucccggcggggccggagcuuccgaacggggcaaauucagcuguccgagagcgcuuaaggugccuucuuaucugaauuaccacuuucucggggagaaagauugcggcgcccccugcgagccuaccaagguuuauggacugauguacuucggccccgaggaacugcgguuuucccgcacguggauugggaucuggagcgugcucuguugcgcuucuacccuguucacaguccuuaccuaccugguggacaugagacgguuuuccuauccugaaagacccaucauuuuccucagcggauguuacacagccguggccgucgcuuauaucgccggcuuccugcuugaggaucgcguugugugcaacgacaaauuugcggaagauggggcucggaccguggcccagggaacgaagaaggagggcuguacaauucuguucaugaugcucuacuuuuucuccauggccucuagcaucuggugggucauucugucccugaccugguuucucgcugccgggaugaaauggggccacgaggcuaucgaagccaauagccaguauuuccaucuggcggccugggcugugccggccauuaagacaaucaccauccuugcucugggacaaguugacggcgaugugcucucuggggucugcuuugugggacugaacaauguugacgcccugagaggcuucgugcuugcgccucucuuugucuaccuguucauugggaccuccuuucugcucgccggauucgugagccuguuucgcauccggacaauuaugaaacacgacggcacgaagaccgagaaacuugaaaagcugauggucagaaucgggguguucucuguucucuauacagugcccgcuaccauugucaucgccuguuacuucuacgagcaggcuuuucgcgaucagugggaacggagcuggguggcccaguccugcaaaucuuaugccauccccuguccucaucugcaagcuggcggaggcgcgccgccccacccucccaugagcccugacuucacaguuuuuaugauuaaguaccugaugacccuuaucguggggauuacguccggauucuggaucuggagcggcaagacacucaacucuuggagaaaauuuuauacccgccugaccaauuccaagcagggggagacaaccgucuga

SEQ ID NO: 69537 - RNA, 1698 nt, Artificial Sequence
  derived and/or modified sequence opt5 from FZD2__Homo_sapiens__NP_001457
augagaccccggagcgcccugccucgccuccugcuuccgcugcuccugcuucccgcugccggcccugcgcaguuccacggggagaagggaaucuccauucccgaccauggcuuuugccaaccuaucucuauuccccuguguaccgauaucgcuuacaaccagacaauuaugccuaaucuccuggggcacacgaaccaggaagacgccggacuggaggugcaucaguucuauccgcucgucaaaguucaaugcagccccgaacugagauuuuuccuuuguuccauguacgccccugugugcaccgugcuggagcaggcuaucccgccuugucggucuaucugcgaacgcgccagacagggcugugaggcucucaugaauaaguuuggguuccaguggcccgagcggcugcgcugcgaacacuuuccgagacauggagccgagcaaauuugugucggccagaaccacagcgaagauggcgcgccugcccuucugacaaccgcucccccucccgggcuccagcccggagccggcgggacaccuggaggccccgggggaggcggcgcucccccucgguaugccacccuggagcaccccuuccauugcccucgcgugcugaaaguucccuccuaccucucuuauaaguuucugggggagagagacugugcggccccgugcgaaccugcucggcccgauggaagcauguucuuuucccaggaggaaacacgcuucgccagacuuuggauccugaccuggagcgugcucugcugugcuucuacguuuuucaccgucacaaccuaccugguggacaugcaacgguuccgcuauccugagagacccauuaucuuucuuuccggcugcuacacaaugguuagcguggccuacauugccggguucguccugcaggaacgggugguguguaaugagagauuuucugaggauggauaucgcaccgucguucagggcacgaaaaaggaagggugcacaauccucuucaugaugcuguacuuuuucuccauggcuagcucuauuuggugggugauccugucccucaccugguuucuggcggccggaaugaaguggggccacgaggcuaucgaagccaacagccaauauuuccaucuugccgcuugggccgugccugcggucaaaacaauuaccauccuggcuaugggccagauugacggggaucuccuguccggaguguguuuuguuggccuuaauucucuggacccccuccggggguucgugcuggccccgcuguuugucuaccucuucaucggaaccagcuuucugcuugccggcuucgugucccuguuccgcauuagaacaaucaugaagcacgaugggacgaaaaccgagaagcucgaacggcugaugguuagaaucggcguguuuagcguccuguauacagugccugcuaccauugucaucgccugcuacuucuaugagcaggcuuuucgcgagcacugggaacggucuugggugucccagcauuguaaaagccuugccauucccugccccgcgcacuacacaccuagaaugucuccggacuucaccguuuacaugaucaaguaucucaugacgcugauugugggaaucacaagcggcuuuuggaucugguccgggaagacccugcauucuuggcgcaaauucuacacccggcucacaaacagcagacacggagagaccacagucuga

SEQ ID NO: 69538 - RNA, 2001 nt, Artificial Sequence
  derived and/or modified sequence opt5 from FZD3__Homo_sapiens__NP_665873
auggccaugaccuggaucguguucagccuguggccccucacagucuuuaugggccacauugggggacauucccuguucucuugcgagccuaucacgcuuagaaugugucaggaccugccguacaacaccacauuuaugcccaaucuccugaaccacuaugaucaacagaccgcugcccuugcgauggaaccuuuccaucccaugguuaaucuggacugcagccgggauuuucgcccuuuccucugugcucuguacgcccccauuugcauggaguauggcagagugacacugccuugucggcgccucugccagagagccuacuccgaauguucuaagcugauggagauguuuggggugccguggcccgaagacauggagugcagccgguucccugauugugacgagcccuauccucgccuugucgaucugaaccucgcuggagaacccaccgagggcgccccgguggcuguucagagagacuacggguuuuggugcccucgggaacugaaaaucgaucccgaccuuggauauuccuuccugcacgugcgcgauuguucuccucccugccccaauauguacuuuagacgggaggagcucagcuucgcccgcuacuuuauuggccugaucuccaucauuugccugagcgcgacacucuucaccuuccugacguuucuuaucgacgucaccagauuccgguauccugaacgcccgauuaucuuuuacgccguguguuauaugaugguuucucugauuuucuuuaucggcuuccuccuggaggauagaguggcuugcaacgccuccauucccgcucaauacaaggccagcacagucacccaggggucucauaauaaagcguguacaaugcuuuuuaugauccuguauuucuuuaccauggccggauccguguggugggugauccucacgauuacaugguuccuggcugccgucccuaaguggggcagcgaagcuaucgagaaaaaggcccugcucuuucacgccucugcuugggggauucccggaacccugacaaucauucuucuggcgaugaacaagaucgaaggcgacaauaucuccgggguuugcuucgugggacucuacgacguggaugcccugcgguauuuuguccuugcuccucugugucucuacgugguugugggcgucagccugcugcucgccggcauuaucucccugaacagagugcgcauugagaucccccuugagaaagaaaaucaggacaagcugguuaaauucaugauucggaucgggguguucucuauccucuaccuggucccgcugcuuguggucauuggaugcuauuuuuacgagcaggccuauagaggcaucugggaaaccaccuggauucaagagcgcugucgggaauaccacaucccuugccccuaucaggugacacagaugagcagaccugaucucauucuguuccugaugaaguaccucauggcucugaucguugggauucccuccguguuuugggucggaagcaaaaagacguguuucgagugggccuccuuuuuccauggccgccggaagaaagagaucgugaacgaaucuagacagguucuucaagagccugacuuugcgcagagccugcuccgcgaucccaauaccccgaucauucggaagucuagagggacaagcacccagggaacauccacccacgcuucuagcacgcaacuggccaugguggacgaucagcgcuccaaagccggcagcauccauucuaaggucuccagcuaucacggcucucugcaccgguccagagacgggcgguacacaccuugcagcuaccgcggaauggaagagagacuuccccauggcuccaugucucggcucaccgaucacagcagacauuccucuagccaccgccugaacgaacagucccggcauagcucuauuagagaccuguccaauaaccccaugacccacaucacacacgggaccagcaugaaccgcgugauugaggaggauggaacaucugcuuga

SEQ ID NO: 69539 - RNA, 1614 nt, Artificial Sequence
  derived and/or modified sequence opt5 from FZD4__Homo_sapiens__NP_036325
auggccuggagaggcgcugggcccagcgugccuggagccccgggcggggucggacugucccucggccugcuucugcagcuccugcuucugcucgggcccgcgcggggauucggcgacgaggaagaacgcagaugcgauccuauccggauuucuaugugucaaaaccugggcuacaauguuaccaagaugcccaaccugguggggcacgaacuccagacagacgcugagcugcagcuuacgaccuuuacaccucugauccaguauggaugcagcucccaacuccaguucuuucuguguucuguguacguccccaugugcaccgagaaaauuaauaucccuauuggcccgugugggggaaugugccuuagcgugaagcgcagaugugagcccguucugaaagaguucggcuuugccuggccugaaucccucaacugcucuaaguuucccccucagaaugaucauaaccacauguguauggaggggcccggagacgaagaggugccgcugccucauaaaacacccauccagccuggcgaggaaugccacagcgucggcaccaauuccgaucaauauaucugggugaagcggagccugaacuguguucucaagugcggguacgacgccggacuguauucucgcuccgcuaaagaguucacagauauuuggauggccgugugggcuagccuuugcuucaucucuaccgccuuuacgguccugaccuuccucauugacuccagcagauuuucuuaccccgaacggcccaucauuuuccuguccauguguuauaauaucuacagcauugcguacaucgugcgccuuacagugggcagagagcggaucuccugcgauuuugaagaggccgcugagccuguccugauucaggaagggcucaagaacaccggaugugccaucauuuuccugcugauguauuucuuuggcauggcuucuagcaucugguggguuauucucacacugaccugguuccuugccgcggggcugaaauggggacaugaggccaucgaaaugcacuccagcuacuuucacaucgcugccugggcuauuccggccgugaagacgaucgugauucucaucaugcgccuggucgacgccgaugagcuuacaggccugugcuaugugggcaaucagaaccucgacgcucugaccggguucguuguggcgccccuguuuacauaccucgucauuggaacccuguucaucgccgcuggccuuguggcccuguuuaaaaucagaucuaaucuccagaaggaugggaccaagacagacaaacuggaacggcugaugguuaagauuggaguguucuccguccuuuauacggugccugccaccugugucaucgcuugcuacuuuuaugagauuagcaacugggcccucuuccgcuacucugcggacgauagcaauauggcuguggagaugcugaaaaucuuuaugucccugcucguuggcauuacaucugggauguggaucuggagcgccaagacccugcauacauggcaaaaauguuccaacagacuugugaacagcggcaaggucaaacgggaaaagagaggaaauggcugggugaagcccgggaaaggaucugagaccguuguguga

SEQ ID NO: 69540 - RNA, 1758 nt, Artificial Sequence
  derived and/or modified sequence opt5 from FZD5__Homo_sapiens__NP_003459
auggccagacccgacccuagcgcuccgcccucccugcuccugcuucugcucgcccagcuggugggccgggcggcugccgccucuaaggcuccugucugccaagagaucaccguucccaugugucgcgggauuggauacaaccuuacacacaugccuaaucaguucaaccaugauacgcaggacgaagccggccuggaggugcaccaguuuuggccccucguggaaauccaaugcagcccugaucugagauucuuucuguguuccauguauaccccgauuugccuccccgacuaccauaaaccucugcccccuugucggucugucugcgagcgcgcuaaggccggguguagcccccuuaugagacaguauggauucgcguggccggaacggauguccugcgaucgccugccugugcucggcagagacgccgagguucuguguauggauuacaaucggucugaggcuacaaccgcucccccucgccccuuucccgccaaaccuacacuuccggggcccccuggagcccccgcgagcggcggcgaaugcccugccgggggacccuucguguguaagugcagagagccguuugucccuauccugaaagaaucccacccccucuauaacaaggugcggaccggccagguuccuaauugcgcugugcccuguuaccagccuagcuucucugccgacgagcgcacauuugcuaccuucuggauugggcugugguccguccugugcuuuaucagcacgucuaccacaguggccaccuuccucaucgauauggagagauuucgguaucccgaacgcccgauuaucuuccuguccgccuguuaccuuugcgugagccugggauuccucgucagacugguugugggccaugcuucuguggcguguucccgggagcacaaccacauucauuacgaaacaaccgggccugcccuuugcacgaucgucuuucugcucguguauuucuuuggaauggcuagcuccauuugguggguuauccugucucugacaugguuccucgccgccggcaugaaguggggcaaugaggcuauugccggguacgcgcaauauuuucaccuggcugccuggcuuauccccagcgugaaauccaucaccgcccuggcucucagcucugucgacggagaucccguggccggcauuuguuacguugggaaccagaaucugaacucccuuagaggauucgugcugggcccucucguccuguaucugcucguggggacacuguuucuucuggcuggauucgucagccucuuucgcauccggucugugauuaagcagggcggcaccaaaaccgacaagcuggaaaaacugaugaucagaauugggaucuucacacuucucuacacgguuccggccagcaucguggucgcgugcuaucuguacgagcagcauuaccgcgaguccugggaagccgcucugaccugugccugccccggacacgauacaggccaaccucgggcuaagcccgaguauugggugcucaugcugaaguacuuuaugugucuuguuguggggauuaccucuggagucuggaucuggagcggcaaaacaguggaauccuggagacgcuucaccagccggugcugcuguagaccucgccgggggcacaagucuggcggagccauggcggccggcgacuaucccgaggcuuccgccgcucugacggggagaacaggaccucccggcccggccgccaccuaccauaaacaggugagccucucucacguuuga

SEQ ID NO: 69541 - RNA, 2025 nt, Artificial Sequence
  derived and/or modified sequence opt5 from FZD6__Homo_sapiens__NP_001158088
augaagauggccuacaacaugaccuucuuucccaaucugaugggccacuaugaccagagcaucgcugccguggagauggaacauuuccucccucuggcgaaccuugagugcuccccgaauauugaaacauuucuguguaaggcuuucguccccacgugcaucgagcaaauucacguugugccucccuguagaaaacucugcgaaaaaguguacucugauuguaagaaacugaucgacaccuuugggauucgguggccugaggagcuugaaugcgaucgccugcaguauugugacgagacaguccccgugaccuucgauccucauacagaauuucucggaccgcagaagaagaccgagcagguucaaagagacaucggcuucuggugcccccggcaccugaaaacaagcgggggacagggcuacaaguuucuggggaucgaucagugugccccucccugcccuaacauguauuucaaauccgacgagcucgaauuugccaagucuuucauuggaaccgugagcaucuuuugucugugcgcuacgcuuuucaccuuccugacauuucucauugauguccgcagauuccgguaccccgagcgcccgaucauuuauuacuccgugugcuacucuaucguuagccugauguauuuuauuggcuuccuucugggcgacuccaccgccuguaauaaagcugaugaaaagcucgagcugggggacacagugguccugggaagccagaacaaggccugcaccgugcucuuuaugcugcuuuacuucuuuacgauggcgggcacaguguggugggucauccugaccaucacaugguuccucgccgcugggagaaaauggucuugugaagccauugagcaaaaggcuguuugguuucaugccguggcguggggaaccccuggcuuccugaccgugaugcuucuggccaugaauaaagucgagggggauaacaucuccggagugugcuuuguuggccucuaugaccuggacgcuagccgguacuucgugcugcucccccugugucuuugcgucuuugugggccugucucuccugcuugccgggauuaucucccugaaucacguucgccaggugauucagcacgauggaagaaaccaggaaaagcucaaaaaguucaugauccggaucggcgucuucagcgggcuguaucuggugccucucgucacacugcuuggauguuacguguaugagcaaguuaaucgcauuacgugggaaaucaccugggugucugaccauugcagacaguaccacauucccugucccuaccaggcuaaagccaaggcccggccugagcuggcucucuuuaugaucaaguaucugaugacacugauugucggcaucuccgcgguguucuggguugggagcaaaaagaccugcacagaaugggccggauuuuucaaacgcaacagaaagcgggauccgaucuccgagucuagacgcgugcuucaagagagcugugaauuuuuccucaaacauaauuccaaggucaagcacaaaaagaaacacuacaagcccagcucucauaaacugaaggugauuuccaagagcaugggcaccucuacgggcgcuacagccaaccacgggaccagcgccguggcuaucaccucccaugacuaucugggacaggagacacucaccgaaauucagacaucuccugagacgagcaugcgggaaguuaaagccgauggcgcguccacccccagacugcgcgagcaggacugcggggagccugcuagccccgccgccucuaucucccggcuuagcggagaacaagucgauggcaaggggcaggcuggcucuguguccgagagcgccagauccgaaggacgcauuucuccgaaaagcgacaucacagauaccggccuggcucaguccaauaaccuccaggugccuucuagcuccgagcccagcucucugaagggguccacaagccugcuuguccacccugugucuggaguucggaaagagcaaggcgggggaugccauuccgacaccuga

SEQ ID NO: 69542 - RNA, 1725 nt, Artificial Sequence
  derived and/or modified sequence opt5 from FZD7__Homo_sapiens__NP_003498
augagagaccccggcgccgcugccccucugagcucccucgggcugugcgcgcuugugcuggcucuccugggagcccuuucugccggcgcuggggcccagccguaccacggagagaagggcaucagcguccccgaucauggguucugucaaccuauuuccaucccccugugcaccgacauugcuuauaaccagacaauccucccuaaucugcugggacacacgaaccaggaagaugccggccucgagguucaucaguuuuacccccuggugaaagugcaauguucuccugaacuucgguucuuucugugcagcauguaugcgccggucuguaccgugcucgaccaggccauucccccuugccgcucccugugugagagagcucggcagggcugcgaagcccuuaugaauaaguucggguuucaguggcccgagcgccugagaugugagaacuucccuguucacggagcuggcgaaaucugcguggggcaaaauacaucugauggaagcggcgggcccggaggcggcccgaccgccuacccuacagcgcccuaucucccugaccugcccuuuaccgcccugcccccuggggcuuccgauggacggggccgcccggccuuccccuuuagcuguccuagacagcucaaagugcccccuuaccugggguaucgguuccuuggagagcgcgacugcggcgcucccugcgaaccggggagagccaacggacugauguacuuuaaggaggaggaacggcgcuucgccagacucugggucggcguuuggucugugcuguguugcgcuuccacacuuuuuaccguccugacguaccucguggauaugcggcgcuucagcuauccugagagacccaucauuuuccugucuggcuguuacuuuaugguggcggucgcccauguugcuggguuccugcucgaagaccgggccgugugcguggagagauuuuccgaugacggauaucgcaccgucgcccagggcacaaagaaggaaggguguaccauccuguucauggugcuuuacuuuuucggaauggcuagcucuauuugguggguuauccugucccucacaugguuucuggccgcgggcaugaagugggggcacgaggcuauugaggccaauagccaguauuuccaccuugccgcuugggccgugccugcugucaaaaccaucacgauucuggccaugggccaaguggauggagaccuccuguccggcguuugcuacguggggcugucuagcgucgacgcgcuccggggauuugugcuggcuccccuuuucgucuaucuguuuaucggcacauccuuccuccuggccggguuugugagccuguucagaauccgcaccauuaugaagcaugauggaacaaaaaccgaaaaacuugagaaacucaugguucggaucggcguguucucuguccuguacaccgugccugccacaauuguucuggcuuguuacuuuuaugaacaggccuucagagagcacugggaacgcacguggcuccugcagaccugcaaguccuacgcggugcccuguccgccugggcauuuuccucccaugagccccgacuucacagucuuuaugaucaaguaucuuaugaccaugauugugggcaucacaaccggauucuggaucuggucuggcaaaacgcugcaaagcuggcggagauuuuaccaccgccucucccacucuagcaagggggagacagccguguga

SEQ ID NO: 69543 - RNA, 2085 nt, Artificial Sequence
  derived and/or modified sequence opt5 from FZD8__Homo_sapiens__NP_114072
auggaguggggcuaccugcucgaagugaccagccugcuugccgcucuggcccuccugcagagauccucuggggcggcugccgccagcgcuaaggagcuugccugccaagaaaucacagucccccuguguaaaggaauuggcuauaacuacacguauaugccuaaucaguucaaccacgacacccaggaugaggcugggcucgaaguucaucaguuuuggccgcugguggagauccaaugcucccccgaccugaaguucuuucucuguucuauguacacaccuauuugccuggaggauuauaaaaagccccuuccucccugucggagcgugugcgaacgcgccaaagcgggaugugccccucugaugagacaguacggcuucgcuuggccggaccggaugcgcugcgauagacuccccgagcaggggaauccugacacccuguguauggauuauaaccggacagaccuuaccacagccgcucccuccccuccccgcagacugccgccucccccucccggagaacagcccccuucuggcagcggccacgggcggccgcccggagcccgcccuccccauagaggcgggggacggggcgggggaggcggcgaugcggccgcuccucccgcccgcgggggaggcgggggaggcaaggcuagaccgccugggggaggcgccgcccccugcgagccuggcugucaaugccgggcucccauggucuccgugagcucugagcgccacccucucuacaauagaguuaagaccgggcagaucgcgaacugcgcccugcccugucauaauccguuuuucucccaggacgaacgggcuuuuacgguguucuggauuggacuguggagcguccucugcuuugugucuaccuucgccacaguuuccaccuuucugaucgauauggagagauucaaauacccugaacgccccaucauuuuucuuagcgccuguuaucuguucgugucugucggcuaccucgugcggcugguggcugggcacgagaaggucgccugcuccggaggcgcgcccggggcuggcggagccggcggggccggaggcgcugccgcuggggccggagcggccggcgcuggggccggcggaccuggcgggagaggagaauaugaggagcuuggcgcuguugaacagcacgugcgcuacgagacaaccgggccggcccuguguacgguggucuuccuccugguguacuuuuucggaauggcgagcuccaucugguggguuauucugucucucacaugguuucuggccgcuggcaugaaaugggggaacgaagccaucgcuggcuauagccaauauuuccaucuugccgccuggcuggugcccuccgucaagagcauugcugugcucgcgcugucuuccguugacggagauccuguggccggcaucugcuacgucgggaaucagagccuugacaaccugcggggauuugugcucgcuccccuggucauuuaccuguucaucggcaccauguuucuccuggccggguucgugucucuuuuuagaauccgcagcguuauuaaacagcaagacggaccuacaaagacccacaagcuggagaaacucaugauccggcugggccuguucaccgugcuuuauacaguccccgccgcugugguuguggccugucucuuuuacgaacagcauaauagaccucgcugggaggcgacgcacaacugccccugucugcgggaucugcagccggaccaggcuagacgcccugauuaugccgucuucaugcucaaguacuuuaugugccuggugguggggauuaccuccggcguuugggucuggucuggaaaaacacuugagagcuggcggucccuguguaccagaugcugcugggccagcaagggcgcugccgucgggggaggcgcgggggcuacagccgccggaggcggcgggggacccggcgggggaggcgggggaggcccuggcgggggaggcgggcccggaggcgggggaggcucucucuauuccgacgugagcaccggccugacguggcggucugggacagcuuccagcguguccuacccgaaacaaaugccucugucucagguguga

SEQ ID NO: 69544 - RNA, 1776 nt, Artificial Sequence
  derived and/or modified sequence opt5 from FZD9__Homo_sapiens__NP_003499
auggccguggcuccccugagaggcgcccuccugcuuuggcagcugcucgcggcugggggagccgcccuggagaucggccgguucgacccugaacgcgggagaggagcugccccgugccaagcugucgagauucccaugugucggggcaucggguacaaccuuacccgcaugccuaaucugcucggacacacaagccagggcgaagccgcggccgagcuggcugaauuugcuccccugguucaguauggcugccauucccaccucagauucuuucuguguucucuuuacgccccuaugugcacggaucaggugagcacccccauuccugccugucggccgaugugcgagcaagcgcgccugagaugugcccccaucauggagcaguucaacuuuggguggccugacucccucgauugcgcucggcugcccacacgcaaugacccucaugcccuuuguauggaagcucccgagaacgccaccgccggaccggcugaaccucacaagggccuggggaugcuccccguggcgccuagacccgcccggcccccuggagaucugggcccgggggcuggaggcucuggcacaugcgagaaucccgagaaauuccaguaugucgaaaagagccgcuccugugccccuagaugcgggcccggaguggagguguuuuggucucggcgcgacaaagauuucgcccugguuuggauggcugucuggagcgcccucugcuuuuucuccaccgcguuuacagugcugaccuuccuucuggaaccucauagauuucaguaccccgagcggccgauuaucuuccucagcauguguuauaacguuuacucucuggcuuuccuuaucagagccguggccggcgcucaauccgucgccugcgaccaggaagcuggggcccuguaugugauucaggagggacucgagaauacgggcuguacccugguguuucugcuccuguacuacuucgggauggcgagcucucuuuggugggucguucugacacucaccugguuucuggccgcuggaaagaaauggggccacgaagccaucgaggcucacggcuccuauuuccauauggccgcgugggggcuuccugcccugaagacaauugugauccucacccugcgcaagguggcuggagaugaacugacgggccucugcuacgucgccagcacagacgcugccgcccugaccggguuugugcuuguuccccugucuggauaucucgugcugggcuccagcuuccugcuuacaggguuugucgcucucuuccacauucggaaaaucaugaagaccggcggaaccaacacagagaaacuggaaaagcugauggugaaaauuggcguguuuuccauccucuacacgguuccugcgaccugugucaucgugugcuaugucuacgagagacugaauauggauuucuggcgccuucgggccacagagcagcccugugcugccgccgcugggccuggaggcagacgcgacugcucucugcccgggggaagcgugccgaccguugccguguuuaugcucaagauuuucaugucccuggucgugggcaucacaagcgggguuuggguguggucuuccaagaccuuucaaacguggcagagccuguguuaucggaaaauugcggcuggcagagcccgcgccaaggcuugccgggccccuggaucuuacggcagagggacacauugucacuacaaagcgcccaccgucgugcuucacaugaccaagacagaucccagccucgaaaacccuacccaucuguga

SEQ ID NO: 69545 - RNA, 1215 nt, Artificial Sequence
  derived and/or modified sequence opt5 from FZR1__Homo_sapiens__NP_001129669
auggaccaggauuacgagagacggcugcuccgccaaaucgugauucagaacgaaaauaccaugcccagagucacagagaugcggcgcacgcugaccccugccagcuccccgguuucuagccccuccaagcacggcgacagauucaucccuucucgggcuggggccaacuggagcgugaauuuucaucgcauuaacgaaaaugagaaaucccccucucagaacagaaaggcgaaagaugcuacaagcgacaauggaaaggauggccuugccuauuccgcccugcucaaaaacgaacugcuuggggcuggaaucgagaaggugcaggacccucaaaccgaggaucggcgccugcagcccagcacaccugaaaagaaaggccucuucaccgucacaagacugugcgaccugucuguggagggggauuccguuaccagcgugggauggucugaacggggcaaucucgucgccgugggcacgcacaagggguuuguucagauuugggacgcugccgcgggcaaaaagcuguccaugcuugagggacauaccgcccgcgugggggcucuggccuggaacgcugagcagcucagcucuggauccagagaucggaugauccugcaacgcgacaucagaacaccgccccuucagagcgaacggagacugcagggccaccgccaggaggucugugggcucaaaugguccaccgaucaucaacugcuggccucuggaggcaaugacaacaagcuccugguguggaaucacagcucccuuagcccugugcagcaguacacagaacaccuggcggccgucaaggcuauugccuggucuccccaucaacacggccuccuggcuuccgggggaggcaccgccgaccggugcaucagauucuggaacacgcuuacagggcagccucugcaguguauugauaccggaagccagguuugcaaucucgccuggucuaaacaugcuaacgagcuggugagcacacacggcuauucccaaaaccagauccugguguggaaguaccccucucucacccaggucgcgaaacugaccgggcacagcuaucgcgugcuuuaccuggccauguccccggacggagaagcuauuguuacaggcgccggcgaugagacgcuccgguuuuggaauguguucagcaagaccagaucuacaaaagaguccgucagcgugcugaaccuuuuuacccgcauccgguga

SEQ ID NO: 69546 - RNA, 312 nt, Artificial Sequence
  derived and/or modified sequence opt5 from G0S2__Homo_sapiens__NP_056529
auggagaccgugcaggaacugaucccccucgccaaggagaugauggcucagaaaagaaagggcaaaauggucaagcuguacguucuugggagcgugcuggcccucuucggagugguccugggccuuauggaaacagugugcuccccuuuuacggcggcucggcgccugagagaccaagaggccgccguugcugaacuccaggccgcucuggagcggcaggcccugcaaaaacaggcgcuccaggagaaggggaagcagcaagauaccgugcugggaggccgcgcccuuucuaacagacagcacgcuagcuga

SEQ ID NO: 69547 - RNA, 2121 nt, Artificial Sequence
  derived and/or modified sequence opt5 from G2E3__Homo_sapiens__NP_060239
augaacgagagcaagcccggcgacucccagaaucuggccugcguguucuguagaaaacacgaugacugcccuaacaaguacggggagaaaaagaccaaagagaaguggaaucucacaguccauuauuacugucugcuuaugucuagcggaaucuggcaacggggcaaggaagaggaagggguuuauggauuucugauugaggauauccgcaaagaggugaacagagcuuccaagcucaaaugcugugugugcaagaaaaauggcgccucuauugggugugucgcgccgcggugcaagcgcagcuaccacuuccccuguggacugcagagagaaugcaucuuucaguucacgggcaacuuugcuuccuucuguugggaccaucggccugugcagauuaucaccucuaauaacuaucgcgagagccuucccugcacaaucugccuggaauuuauugagccuauccccuccuacaauauucucagaagcccuuguugcaagaacgccugguuccaccgggauugucugcaaguucaggccaucaaugcuggcguguuuuucuuucgcugcaccauuuguaacaauucugacaucuuccagaaagagaugcugagaauggggauucauaucccggaaaaggaugccuccugggagcucgaagagaacgcuuaucaggaacugcuucaacacuacgagcggugcgacguccgcagaugucggugcaaagagggacgcgauuacaaugcccccgacagcaagugggaaaucaaaagaugucagugcugugggucuuccggcacacaccuggcgugcagcucucuccgguccugggagcagaacugggaaugccuggaguguagaggaauuaucuauaacagcggcgaauuucagaaggccaaaaagcaugugcuuccuaauuccaacaauguugggauuaccgauugccugcucgaggagucuagccccaagcugccucgccaaucccccggaagccagucuaaagaccugcuccggcagggcuccaaguucagacgcaacgugagcacacugcuuaucgaacugggcuuccaaauuaaaaagaaaaccaagcggcucuacaucaauaaggcuaacaucuggaacucugcccuggaugcuuuuagaaaucgcaauuucaacccgagcuaugccauugaggucgcguacgugaucgaaaaugacaacuuuggguccgagcacccuggaucuaaacaggaguuccuuagccugcucaugcagcaucuggaaaauuccagccuguuugaaggcucucucuccaagaaccugagccuuaauucucaggcccugaaagaaaaccucuauuacgaggcugggaagaugcuggccauuucccuugugcacggaggccccagcccuggguucuuuuccaaaacgcuguucaacugucucgucuauggacccgaaaauacccaacccauccuggacgauguuucugacuuugauguggcucagauuaucauccggauuaacacagccaccacaguggccgaccucaagagcaucauuaaugagugcuacaacuaccuggagcugaucggcugucuuagacugauuaccacgcucuccgauaaguauaugcuggucaaagacauccugggcuaccacgugauucagcgcguucauacaccuuucgaaucuuuuaagcaggggcuuaaaacccucggagugcuggagaagauccaggcuuauccggaagcguucugcagcauccugugucacaaacccgagucccucagcgccaagauucugucugaacuuuuuacaguccauacccugccugaugugaaggcucucggcuucuggaacuccuaccugcaagccguugaggacgggaaaagcaccacaacgauggaggauauccugauuuucgccaccggauguucuuccauucccccugcuggcuuuaagcccacaccgagcaucgaaugccuucacguggacuucccugucgggaauaaaugcaauaacugucucgccauccccaucaccaauacauauaaggaguuucaggaaaacauggauuucaccauucggaauacgcugagacuggagaaagaagagucuagccauuacaucggccacuga

SEQ ID NO: 69548 - RNA, 1401 nt, Artificial Sequence
  derived and/or modified sequence opt5 from G3BP1__Homo_sapiens__XP_006714813
auggugauggagaagcccagcccucugcucgucggcagagaguucguucggcaguacuauacccugcuuaaccaagccccggacaugcugcaccgcuuuuacgggaaaaauuccucuuaugugcauggaggccucgauagcaacgggaagcccgcugacgccguguacggacagaaagagauccacagaaaggucaugucccagaauuucacaaacugccauacgaaaauucggcacguggaugcgcaugcuacccugaaugacggcguugugguccaggugauggggcuucugucuaacaauaaccaagcccuccgcagauuuaugcagacauucguucuggccccugaaggaagcguggcuaauaaguuuuauguccacaacgauaucuuccgguaccaggacgagguguuuggcggcuucgugaccgaaccccaggaggaguccgaagaggaagucgaggagccugaagaacgccaacagacacccgaaguugugccugaugacucugggaccuuuuaugaucaggccguggucagcaaugacauggaggaacaccuggaggagccgguggcugaacccgagccugaucccgaaccugagcccgaacaggagccgguuuccgagauucaagaagagaagccugaacccgugcucgaggaaacagccccugaggacgcgcagaaaucuagcucccccgcccccgcugauaucgcccagaccguccaagaggaccugagaacguucagcugggcuucugugaccuccaagaaccuuccuccgagcggagccguucccgugacaggcauuccuccccaugucgugaaagucccugcgucucagccccggccggaauccaagccugagagccagauucccccucagcgcccccaaagagaccagcgggugcgcgaacagagaaucaauaucccuccccagcgggggccgcgcccuaucagagaggccggagagcaaggcgauauugaaccccggagaaugguucgccaccccgacucccaucagcuguuuaucgggaaccucccucacgagguggauaaaucugaacugaaggacuucuuucagagcuacggaaaugucguggagcuucggauuaacuccggcggcaagcugccgaacuucggguucguuguguuugaugacagcgaacccguccagaaagugcucucuaauagaccuaucauguuccgcggagaggugcggcugaacguugaggaaaagaaaaccagagcugcccgcgagggcgaucggagagacaaucgccugcgggggcccggaggcccuagagggggacucggcggcgggaugcgcggacccccucggggcgggaugguccaaaagcccggauuuggcguggggagaggccuggcuccgcggcaguga

SEQ ID NO: 69549 - RNA, 465 nt, Artificial Sequence
  derived and/or modified sequence opt5 from G6PC2__Homo_sapiens__NP_001075155
auggacuuccugcacagaaacggcgugcucaucauucagcaucugcaaaaggauuaccgggccuauuacaccuuucuuaauuucaugagcaacgucggggacccccgcaauaucuuuuucauuuauuuuccucugugcuuccaguuuaaccagacaguuggaacgaaaaugaucuggguggcugugauuggcgauuggcucaaucugaucuucaaguggauccuuuuugggcacagaccguacugguggguccaggagacccaaauuuaucccaaccauuccucuccuugucuggaacaguuccccacaaccugcgagacaggaccuggcagccccuccgggcacgccaugggagcgucuugugugugguacguuauggugaccgcugcccucagccauacagucugcggcauggacaaauuuuccaucacccugcaccggcacgccggcgggcgcggacuguga

SEQ ID NO: 69550 - RNA, 1041 nt, Artificial Sequence
  derived and/or modified sequence opt5 from G6PC3__Homo_sapiens__NP_612396
auggagagcacccugggcgccgggaucgugauugccgaagcccuccagaaccaacuggcguggcuugagaaugucuggcuguggaucacauuccucggagaccccaagauucuguuucuuuucuacuuuccugcugccuauuacgccuccagacggguuggcaucgcugugcuguggauuucucucaucacggaauggcugaaccugaucuucaaaugguuucucuucggggaucgcccguuuuggugggugcacgagagcggauauuacucccaggcccccgcucagguccaucaguucccuucuagcugcgaaaccggccccggguccccuucuggacacuguaugauuacaggcgccgcgcuguggcccaucaugaccgcccuuagcucccaaguggcuacaagagcccggagccgcuggguuagagugaugccuucucuggcuuauugcaccuuucuccuggccgucggccuuucccggauuuucauccuggcgcauuuuccgcaccaggugcucgccgggcugauuacaggagcuguucugggcuggcucaugacgccccgcgugccuauggagagagagcugagcuucuacgggcuuaccgcccuggcucucaugcugggaaccucucuuaucuauuggacacuguuuacccucggccuggaccuguccuggagcauuucucucgccuucaaguggugugaacggcccgaguggauccaugucgauucccgcccuuucgccagccuguccagagacucuggggcugcgcuuggacugggcaucgcccuccacagccccugcuacgcucaggugcggcgcgcccagcugggcaaugggcagaaaauugccugucuugugcuggcuaugggacuccugggcccgcuggauuggcucgggcacccuccccaaaucucccuguuuuacauuuucaacuuucuuaaguauacacuguggccuugccucguccuggcccugguucccugggcggugcauauguucagcgcucaggaagcucccccuauccacucuuccuga

SEQ ID NO: 69551 - RNA, 1074 nt, Artificial Sequence
  derived and/or modified sequence opt5 from G6PC__Homo_sapiens__NP_000142
auggaggaaggcaugaacgugcugcacgacuucgggauccagagcacccauuaccuccaagucaauuaucaggauucccaggacugguuuauucugguuucugugaucgccgaucuuagaaacgcuuucuacgugcuguuucccauuugguuccaccuccaggaggccgucggaaucaagcugcuuuggguggcgguuauuggcgacuggcugaaucucguguuuaaauggauccuguucgggcaacggccuuauugguggguccuggauacagacuacuauagcaacacguccgugccgcucaucaagcaguuucccguuaccugcgaaacaggaccuggcucucccagcgggcaugcuaugggaaccgccggcguguacuaugucauggugacauccacccugucuauuuuccagggcaaaaucaagccuacauaccgcuuuagaugucuuaaugugauucuguggcucggguucugggccguccagcugaacguuugccuuagccggaucuaccuggcugcccacuuuccccaucaagugguggcuggaguccucuccggcauugccguggcggagaccuucagccacauccacucuauuuauaaugccucccugaaaaaguacuuucugaucacguucuuccucuuuagcuucgcuaucggguuuuaucugcuucugaagggacucggcguugaucugcuuuggacccuggaaaaagcccagcgcuggugugagcagccugagugggugcauauugacacaaccccguucgcuucucuccugaagaaccuggggacacucuuuggacugggccuugcccucaauuccagcauguacagagaaucuugcaaaggcaagcuguccaaauggcugcccuuccggcuuagcuccaucgucgcgucucuggugcuccugcacguuuuugauagccugaagccucccucccagguggagcucgucuucuaugugcugagcuuuuguaagucugccgucgugccucuugcuuccguuagcgugauucccuacugccuggcccaaguccucgggcagccgcauaaaaagucucuguga

SEQ ID NO: 69552 - RNA, 1638 nt, Artificial Sequence
  derived and/or modified sequence opt5 from G6PD__Homo_sapiens__NP_000393
augggcagacgggggagcgcccccggaaacggccgcacccugagagggugcgagcggggaggccgcagacggcgcuccgcugacucugugauggccgaacaggucgcgcucagcagaacacaaguuugugggauccugcgggaggaacuuuuccagggagaugcuuuucaccaguccgacacgcauauuuucaucauuaugggcgccucuggcgaucuggccaagaaaaagaucuacccuaccauuugguggcucuuucgcgacgggcugcuuccggagaauacauucaucgugggauaugcuagaagccggcugaccguggccgauauccgcaaacaguccgaacccuuuuucaaggcuacaccugaggagaaacucaagcuggaagacuuuuucgccagaaacucuuacgucgcgggccaauaugaugacgccgcuagcuaccagcggcucaauucccacaugaacgcccuccaucuggggagccaggcuaaucgccuguuuuaucuggcccugcccccuaccguguacgaggcgguuacaaagaacauucacgaaucuugcaugucccagaucggauggaauagaauuaucguggagaaacccuucggccgggaucugcaaagcucugacagacuuuccaaccauauuagcucucuguuucgcgaggaucagaucuaucggauugaccacuaccucgggaaggaaaugguccagaaucugauggugcugagauucgccaaccgcaucuuuggaccuaucuggaaucgggauaacauugcuuguguuauccucaccuucaaagagccguucggcacggaaggcagagggggauacuuugacgaguucggcauuauccgcgacgugaugcagaaucaccuucuucaaaugcugugccucgucgccauggaaaagcccgcuuccaccaacagcgaugacgugcgggaugagaaagugaagguccugaaguguauuuccgagguucaggccaauaacguggugcuugggcaguaugucggaaacccugacggcgaaggggaggccacaaaaggauaccuggaugaccccaccgugccuagaggcucuacaaccgcuacguuugcggccguugugcucuaugucgaaaaugagcgcugggauggcgugcccuucauccugcggugcgggaaggcucugaacgaaagaaaagccgagguucgccuccaauuucaugacguggccggagauaucuuccaccagcaguguaagcggaaugagcuggucauuagagugcagccgaacgaagcugucuacacaaaaaugaugaccaagaaaccuggcauguuuuucaaucccgaggaaagcgagcuugaccugacauaugggaaccgguacaagaaugugaagcucccugaugccuaugaacgccugauccuugacguguuuugcggaucccaaaugcauuucguuagaagcgacgagcugcgggaggcguggagaauuuuuacaccccuccugcaccagaucgaacuggagaaacccaagccuauuccguacaucuacggcucucgcgggcccaccgaagcugaugagcucaugaaacgggucggcuuccaguaugagggaaccuacaagugggugaacccucacaaacuguga

SEQ ID NO: 69553 - RNA, 2859 nt, Artificial Sequence
  derived and/or modified sequence opt5 from GAA__Homo_sapiens__XP_005257251
augggcgugagacaucccccuugcagccaccggcugcucgccgucugugcccugguuucccuugccaccgcggcucugcucgggcacauccugcuucaugacuuccugcucgugccgcgcgagcugucuggaagcucccccgugcuggaagagacacacccugcccaucagcaaggcgccucuagacccgggccucgggaugcucaggcccaccccggacgcccuagagcugucccgacgcagugcgacgugcccccuaacagccgguuugauugugcccccgacaaggcgauuacccaggaacaaugcgaggcccgcggcuguugcuacaucccugcuaaacaggggcuccagggagcccagaugggccaacccugguguuucuuuccgccuuccuaucccucuuacaagcuggaaaaucuuagcuccagcgagaugggcuauacagcuacccugacaagaaccacaccuaccuucuuucccaaagauauucucacgcugcggcuugacguuaugauggagaccgaaaaccgccugcacuucacaaucaaggaucccgccaauagacgguacgaggugccucucgaaaccccgcauguccacucucgcgcgcccuccccucuguauagcguggaguuuucugaggaacccuucgggguuauugugagacggcagcuggacggacgcguccuccugaacacaaccguggccccucuguuuuucgcugaucaguuucugcagcucuccacgagccugcccucucaauacaucacaggccuugccgagcaucuguccccgcucaugcugagcaccuccuggacaagaaucacccuguggaaucgggaccucgcuccuacccccggggccaaccuguauggaucucacccuuucuaccuugcccuggaagauggcgggagcgcucacggaguguuucuccuuaauuccaacgcgauggacgucguucuucagcccagcccugcccugucuuggagauccacaggcggcauucucgauguguacaucuuccuggggcccgagccgaaaagcgugguccagcaauaucuggacgugguuggauacccuuucaugccucccuauuggggccucggguuucaucugugccgcuggggauacucuagcacggcuauuaccagacagguggucgaaaauaugacacgggcccacuucccccuugacgugcaguggaacgaucuggacuauauggauucccgccgggacuuuaccuucaauaaggauggcuuuagagacuucccggccaugguucaggagcuccaucaagggggacgccgguacaugaugaucguggaucccgcuauuucuagcuccggcccugccggcagcuauagacccuacgacgaggggcugcgccggggagucuuuaucacaaacgaaaccggccagccucugauugggaagguguggcccggaucuacggcguucccugauuuuacaaaucccaccgcucuugccuggugggaggacauggucgccgaguuccacgaucaggugccguuugacggcauguggaucgacaugaacgaaccuuccaauuucaucagagggagcgaagauggcugucccaacaacgagcucgagaauccucccuacguuccgggaguggucggcgggacccugcaggcugccacaauuugcgcuucuucccaucaauuucugagcacccacuauaaccuccacaaucuguacggacuuacagaagccaucgcgucccaucgcgcccuggugaaagcucggggcacgagaccuuucguuauuucucggagcaccuucgccgggcacggacgcuaugcuggccauuggacaggggacgugugguccucuugggagcagcucgccagcuccguccccgaaauccugcaguuuaaccugcuuggcgugccucucgugggagcggauguuuguggcuuccuggggaauaccagcgaggaacugugcgucagauggacacagcucggagccuuuuaccccuucaugcggaaccacaauucucugcuuucccugccccaagagccuuauagcuuuucugagccggcucagcaggccaugagaaaggcucucacccugcgcuacgcccugcuuccccaccucuauacgcuguuccaucaggcccacguggcuggcgaaaccguggcgcggccucuguuucucgaguuccccaaagacuccagcacauggaccgucgaucaucaacugcuuuggggagaagcccugcucauuacaccugugcugcaggcugggaaggccgagguuaccggcuacuuuccccuggggacgugguacgaccuucagacagugccugucgaggcccucggcucucugccgcccccucccgcugccccuagagaacccgcgauccacagcgagggacaaugggugacccugccggcuccucucgauacaaucaacguucaucugcgcgccggcuauauuaucccccuucaggggcccggacugaccaccacagaauccagacagcagccuauggcccucgcuguggcccugacgaaaggcggggaggcgcggggagaacuguucugggacgauggcgagagccuugagguccuggaacgcggggcuuacacccaagugauuuuucucgccagaaauaacacaaucguuaaugagcuggugcgggucaccucugaaggcgccggacuccagcugcagaaggugacagugcuuggcgucgcuaccgcuccccagcaaguucuguccaacggggugccugugagcaauuucacguauuccccggacacaaagguccucgauauuugcgugucucugcugaugggagagcaguuucuuguuagcugguguuga

SEQ ID NO: 69554 - RNA, 2085 nt, Artificial Sequence
  derived and/or modified sequence opt5 from GAB1__Homo_sapiens__NP_002030
augagcggcggggagguggucugcuccggauggcugagaaagucucccccugagaaaaagcucaaacgguacgccuggaagcgcagaugguucguucugcggagcggccgccuuaccggggacccggaugugcuggaguauuacaaaaacgaccacgcuaagaagcccaucagaauuaucgaucucaaucugugucagcaaguggacgccggacuuacauuuaacaaaaaggaguucgaaaauuccuauauuuuugauaucaacacgauugaccggaucuucuaccuggucgcggauucugaagaagagaugaauaaaugggugcgcugcaucugugacauuugcggcuuuaacccuaccgaagaggaucccguuaagccucccgggagcucccuccaggcuccugccgaccugccgcuggccaucaauacagcucccccuucuacccaggccgauagcuccagcgcuacacugcccccucccuaucagcugauuaacgugccgccucaucuugaaacccugggaauccaagaggacccccaggauuaccuccugcuuauuaauugucagucuaaaaagccugagcccacaagaacccacgccgacuccgccaagagcacgucuuccgaaaccgacugcaacgauaauguccccagccauaaaaacccugcgucuucccagagcaagcacggcaugaauggcuucuuucaacagcagaugaucuaugacuccccgcccucucgggcuccuagcgccuccguggauagcucucuguacaaccucccccgcuccuacagccaugacguucugccuaaagugucucccagcuccacagaggcugauggggaacuguaugucuucaauaccccgucuggaacaagcuccguggagacccagaugagacacgugagcauuucuuacgacaucccucccacgccuggcaacacauaucaaaucccccggaccuuuccugaagggacacucggacagaccuccaagcuggauaccauucccgacaucccgccucccagacccccuaaaccgcaccccgcccaugaucgcagcccugucgagacauguucuauuccccggacggcguccgacaccgauagcuccuacugcaucccuacagccggcaugucucccagccgcuccaacaccauuucuacaguugaccuuaauaagcugagaaaagacgcuagcucccaggauuguuaugacaucccucgggccuuccccagcgauagaucuuccagccucgagggguuucacaaccauuucaaggugaagaaugugcugaccgucggaucuguguccagcgaggaacuugacgaaaacuacguuccgaugaauccuaacucucccccucgccaacacagcuccagcuuuacggagcccauccaggaagcuaauuaugugccgaugacaccuggcaccuucgauuucucuuccuuuggcaugcaagugcccccucccgcccacaugggguuccggagcucccccaaaaccccuccgagacgccccgucccuguugccgacugcgagcccccucccguggaucggaaccugaagccugacagaaaagucaagccggcuccccucgagauuaaaccucugcccgaaugggaggaacugcaggcgccugugcgcucucccaucacacggagcuuugccagagauuccucucgcuucccgaugagcccucggcccgacuccguccauucuaccacaagcuccagcgauucucacgacuccgaggaaaauuacgugcccaugaacccuaaucucagcucugaggaucccaaccuguuuggauccaauagccuugacggcgggucuuccccuaugauuaagccgaagggagacaaacagguugaguaccuggaucucgaccuggauagcggcaaguccacgcccccuagaaaacaaaagagcucugggagcggauccucuguggcugacgaacgcgucgauuaugugguuguggaccagcagaaaacccuugcccucaagagcacacgggaggccuggaccgauggcagacaguccacagaaucugagacccccgcuaagagcgucaaauga

SEQ ID NO: 69555 - RNA, 1917 nt, Artificial Sequence
  derived and/or modified sequence opt5 from GAB2__Homo_sapiens__NP_036428
augagcggcgaccccgaugugcuggaguacuauaagaacgaccacuccaaaaagccucucagaaucauuaaucugaacuucugcgaacaggucgaugccgggcuuaccuuuaauaaaaaggagcugcaagacucuuucguuuuugauaucaaaacaagcgaacggacguucuaccucguggcugagaccgaagaggacaugaacaagugggugcaguccauuugucagaucugcggauuuaaucaggccgaggaaucuacagauagccugcgcaacgucuccucugcgggccaugggccgagaagcucccccgcugagcuuucuagcuccagccaacaucugcuccgggaacgcaagucuuccgccccuagccacucuucccagcccacccuguucacauuugagccucccgugagcaaucacaugcagccuacccuguccacaucugccccgcaggaguaucucuaccugcaucaauguauuagcagacgggcugaaaacgcccgcuccgcuagcuucucucagggaaccagagccuccuuucuuaugcggagcgacacggcgguucagaaacuggcccagggcaaugggcacugcgugaacggaaucucuggccaaguccacggcuucuauagccuccccaagccuucccgccauaauaccgaguuuagagauucuacauacgaccugccccggagccuugcuucccacgggcauaccaaaggaagccugacaggcucugaaaccgauaacgaggacguguauacguucaagacaccuuccaauacccucugucgcgaauuuggggaucugcugguugacaacauggacgugcccgccacaccgcucagcgcuuaccagaucccuagaaccuucacccuggauaaaaaucacaacgccaugacagucgcgacgcccggagacucugccauugcuccuccuccccggcccccgaagcccucccaggccgagaccccucgcuggggcagcccccaacagagaccucccaucuccgagaacucucggagcguggcugccacaauuccgagacgcaauacccuuccugccauggauaacucccggcugcacagagcuucuagcugcgaaacauacgaguauccccagcgcgggggagaauccgcgggccggagcgccgagucuauguccgacggcguggggagcuuccucccuggaaagaugaucgucggcagaucugauuccaccaauagcgaagacaacuacguucccaugaauccugggucuagcacgcugcuugcuauggagcgcgccggagauaacucccagagcguguauauucccaugucuccgggcgcccaucacuuugacucccugggguacccuagcacaacccuccccgugcaucggggacccuccagaggcucugagauccaaccuccgcccgucaaucgcaaccugaaaccugaucggaaggcuaaacccaccccucuggaccucagaaauaacacagugauugaugaacugcccuucaagagcccuaucaccaaauccuggucucgcgccaaucacacauuuaacagcuccucuagccaguauugucggcccaucuccacgcagagcauuaccucuacagacuccggcgacagcgaggaaaauuacguuccgaugcagaacccugugucugcgucccccgucccuagcgggaccaauucucccgcuccgaagaaauccacaggaagcguggauuaucuugcccuggacuuccaaccuuccagccccucuccucauagaaagcccagcaccuccucuguuacgagcgaugagaagguggacuacguccagguggauaaagaaaagacccaggcccuccagaacacaaugcaagaguggaccgacguccggcaguccucugagcccagcaaaggcgcuaagcuguga

SEQ ID NO: 69556 - RNA, 1764 nt, Artificial Sequence
  derived and/or modified sequence opt5 from GAB3__Homo_sapiens__NP_001075042
augagcgccggcgacgcugugugcaccggguggcuggucaagucucccccugagagaaaacuccagcgguacgccuggcgcaagagaugguucguucugcggcgcggaagaaugucuggcaacccggaugugcuugaauauuaccggaauaaacacagcuccaagcccauccgcgugauugaccugucugagugugcggucuggaaacauguggggccuagcuuuguuagaaaggaguuccaaaacaauuuuguguucaucgucaagacaacgucccggaccuuuuaucucguggcuaaaacagagcaggaaaugcagguuugggugcacucuauuagccaggucugcaaccugggacaucuugaggauggcgccgccgacuccauggagagccugucuuacacccccuccagccuccaaccuucuuccgcuagcucucugcugacagcccacgcugccuccagcucccucccccgcgaugacccuaauaccaacgcgguggccacagaagagaccagaucugaaagcgagcugcuuuuccugccggauuaucucgugcuguccaauugugagacggggcggcuucaucacaccagccugcccacacgcugcgacucuugguccaacagcgauagaucucucgaacaggcuagcuuugacgaugucuucguugacugucugcagccucugcccuccucucaccucgugcauccuagcugccacggauccggcgcccaggaggugcccagcucucggccgcaagcugcccugaucuggucccgcgaaauuaauggcccucccagagaucaucuuagcuccuccccucugcucgagagcucccugucuagcaccauccaggucgacaagaaccaggggucccuucccuguggagcgaaagaacuggacaucaugucuaauacacccccuccgcggcccccuaagcccagccaccucuccgagagacgccaggaggaauggagcacccacucuggcuccaaaaagccugagugcacgcuggugccccggagaauuagccugucugggcucgauaacaugcgcacauggaaggccgacguugaaggacaaucccugcggcauagagauaaacgccuuagccugaaucucccgugucgguuuucuccuauguaccccaccgcuagcgccuccaucgaggacagcuaugugccuaugucuccccaggcuggcgccuccgggcugggaccucacugcagccccgaugacuacauuccgaugaacuccggcucuaucagcuccccucuucccgaacugcccgccaaucucgagccuccgcccgucaacagagaucugaagccucagcgcaaaucucggcccccuccccuggaccucagaaaccugagcauuauccgcgagcaugcuucccuuacacggaccagaaccgugccuuguucucggacgagcuuccugucccccgaacgcaauggcauuaacagcgcgagauuuuucgccaauccgguuucucgggaggaugaagaguccuacaucgaaauggaggagcacagaacagcuagcucucucuccagcggggcccugaccuggacaaagaaauuuucucuggacuaucuugcccucgauuucaacuccgcuagcccugcccccaugcaacagaagcugcugcucuccgaagaacagcgcguggacuacguccagguggacgaacagaaaacccaagcgcugcagagcacaaagcaggaguggaccgaugagcggcaaucuaaggucuga

SEQ ID NO: 69557 - RNA, 354 nt, Artificial Sequence
  derived and/or modified sequence opt5 from GABARAP__Homo_sapiens__NP_009209
augaaguucguguacaaagaggaacaccccuuugagaagagacggagcgaaggcgagaaaauccgcaagaaauauccugacagagucccgguuauuguggaaaaggcccccaaggcucggaucggggaucuggacaaaaagaaauaccucgugccuuccgaucugaccgucggacaguucuauuuucuuauucgcaagagaauccaucugcgggccgaggacgcucucuucuuuuucgugaacaauguuauucccccuacaucugcgacgaugggccaacuguaccaggagcaccaugaagaggacuuuuuccuuuauaucgccuacagcgaugaauccguguaugggcuguga

SEQ ID NO: 69558 - RNA, 354 nt, Artificial Sequence
  derived and/or modified sequence opt5 from GABARAPL1__Homo_sapiens__NP_113600
augaaguuccaguacaaagaggaccaccccuuugaauauagaaagaaagagggcgaaaagauccggaaaaaguacccugaucgcgugccggucauuguugagaaggcccccaaagcuagagugccugaccuggauaagcggaaauaucucgugcccagcgaccugaccgucgggcaauucuacuuucuuauccgcaagagaauccaucugcggccugaagaugcccucuucuuuuucgugaacaauacaauucccccuacguccgcgaccaugggacagcuguaugaggacaaccacgaggaagauuacuuucuuuauguugcuuacucugacgagagcguguacggcaaauga

SEQ ID NO: 69559 - RNA, 354 nt, Artificial Sequence
  derived and/or modified sequence opt5 from GABARAPL2__Homo_sapiens__NP_009216
augaaguggauguucaaagaggaccacagccuggaacauagaugcguggaguccgccaagauccgggcuaaauaccccgaucgcgucccuguuauuguggaaaaggugucuggcagccagaucgucgacauugauaaaagaaaguaucucgugccguccgacaucaccguugcccaauuuauguggauuauccggaagcgcauccagcugcccucugagaaagcgauuuuccuuuuuguggauaagacagucccucagagcucccugacgauggggcagcucuacgaaaaagagaaggacgaggauggauuccuguauguggcuuacucuggcgaaaacaccuuuggguucuga

SEQ ID NO: 69560 - RNA, 2886 nt, Artificial Sequence
  derived and/or modified sequence opt5 from GABBR1__Homo_sapiens__NP_001461
augcugcuccugcuucugcucgcuccccuguuccuuagaccuccgggcgccgggggagcccagacccccaacgcgacaagcgagggcugccaaaucauucacccucccugggaagggggaauccgguaccgcggccugacgagagaccaggugaaggcuauuaauuuucucccugucgauuaugagaucgaauacguuugucggggcgagcgcgaaguggugggacccaaagucagaaagugccuggccaacggcuccuggaccgacauggauacaccuucucggugugugcgcauuugcagcaaauccuaucugacccucgagaauggcaagguuuuccugacagggggagaccuuccggcccuggauggcgcuagaguggacuuucggugugaucccgacuuccaucucgucgggucuagccgcuccaucugcucucagggacaguggagcaccccuaaaccccacugucaagugaacagaacaccucauuccgagcggcgcgccguuuacaucggcgcucuguuucccaugagcgggggauggccgggcggccaggccugccagccugcgguggaaauggcccuugaggaugucaauucuagacgggacauucugcccgauuaugaacucaagcugauccaccaugacuccaagugugauccugggcaggcuaccaaauaccuguaugagcuccuguacaacgaccccauuaagaucauucuuaugcccggaugcagcucuguguccacgcugguggccgaggcugcccgcauguggaaucucaucguccugagcuacgggucuuccagcccugcgcuuuccaacagacaacgguucccgaccuuuuucagaacacaccccucugccacccugcacaauccuacacgcguuaaacucuuugaaaaguggggguggaaaaagauugcuaccauccagcagacgacagagguguucaccagcacacuggacgaucuggaggaacgggugaaggaagccggaaucgagauuaccuuuagacaguccuucuuuagcgaccccgcugucccugugaaaaaccucaagcgccaagaugcccggaucauuguuggccuguucuaugagaccgaagccagaaaaguguucugugaggucuacaaggaacgccuuuuugggaaaaaguaugugugguuccugaucggaugguacgcugacaauugguuuaaaauuuaugaucccucuaucaacugcacaguugacgagaugacggaagcgguggagggccauaucaccacagagauugucaugcucaauccggccaacacccgguccaucagcaauaugacaucucaggaauuuguggagaagcugaccaagagacuuaaacgccacccugaagagacgggcggguuucaggaagcuccccuggccuacgaugccauuugggcucucgcccuggcgcugaacaagacaagcggaggcgggggacgguccggcgucagacucgaggacuucaacuauaauaaccaaaccaucaccgaucagauuuaccgcgcuaugaacucuagcuccuuugagggggugagcggccauguuguguucgacgccucuggaucccggauggccuggacacugaucgaacagcuucagggcgggagcuacaaaaagaucggauauuacgauucuaccaaagacgaccuguccuggagcaagacagauaaguggauuggcggguccccucccgcugaccaaacgcucgucaucaaaaccuuuagauuccugucucagaagcuguuuauuagcguguccguucuuucuagccucggaaucgugcuggccgucgugugccuguccuucaauauuuauaauagccacgugcgguacauccagaacucucagccuaaucucaacaaucugacagcuguuggcuguucccuugcccuggcggccgucuuuccccucgggcuggauggcuaucacauuggacgcaaccaauucccguucgugugccaggcuagacuguggcuucucggccugggguuuagccugggauacggcucuauguucaccaaaaucuggugggugcauacagucuuuaccaagaaagaggaaaagaaggaguggcggaaaacgcucgagccuuggaagcuguaugccaccguggggcuucugguuggaauggacgugcucacacuggcuaucuggcagauugucgauccccugcacagaaccaucgaaacauucgccaaagaggaacccaaggaggacauugauguguccauccuuccucagcucgaacauuguagcucucgcaaaaugaauaccuggcugggcauuuucuacggguacaagggccugcuccugcuucugggaaucuuccucgcguaugagacaaagagcguuuccacggagaaaaucaacgaccaccgggccgugggcauggcuauuuacaaugucgccgugcugugccugaucaccgcuccgguuacaaugauucuuagcucucaacaggaugccgccuuugcuuucgcgucccucgccaucguguuuagcuccuauauuacccuggucgugcuguucgugcccaagaugagacgccucaucaccagaggggaauggcagucugaggcucaggacacaaugaaaacgggaagcuccaccaacaauaacgaagaggaaaagucucggcugcuugagaaagagaaccgcgaacuggagaagaucauugccgaaaaagaggaaagagucagcgagcuccggcaucaacugcagucccgccagcaacugagaucucggcgccacccucccacaccucccgagccuagcggcgggcuucccagaggaccgccugaacccccugaucggcuguccugugacggcagccgcguucaccuccuguacaaguga

SEQ ID NO: 69561 - RNA, 2826 nt, Artificial Sequence
  derived and/or modified sequence opt5 from GABBR2__Homo_sapiens__NP_005449
auggccagccccagauccucuggccagcccgggccgcccccucccccucccccuccgcccgcucggcugcuccugcuucugcuccugccucuucugcucccccuggccccuggagcguggggcugggcucgcggggcccccagaccgccucccagcuccccuccccugucuaucaugggacucaugccccugaccaaggagguggccaaaggcagcauugggcggggaguccuuccugcuguugaacuggccaucgagcaaauucgcaacgaaucccuccugagaccguacuuccuugaccugcggcucuaugauacagagugcgacaaugcuaagggccugaaagccuuuuacgaugcgaucaaguauggccccaaccaccugaugguguucgggggaguguguccuucugucacgagcauuaucgccgaaucccuccagggcuggaaucuggugcagcuuagcuuugcugccaccacacccguucuggcugacaaaaagaaguacccuuauuucuuucgcaccgugcccucugauaacgccgucaauccggcgauccucaaacugcuuaagcauuaccaguggaaaagaguggggacacugacccaagacguucagcgguucuccgaggugcgcaacgaucucacaggaguccuguauggcgaggacauugaaaucagcgauaccgagucuuuuuccaaugacccuugcacgagcgugaagaaacugaaggggaacgaugugagaauuauccucggacaguucgaccagaauauggccgcuaaggucuuuuguugcgccuacgaagagaacauguacggcucuaaauaucaauggauuauccccggcugguacgagccuuccuggugggaacagguucacaccgaggcuaauagcucccggugucugcgcaagaaccuucuggccgccauggaaggguauauuggaguggauuucgagccccucucuagcaaacagaucaagacaaucuccggcaaaaccccucagcaauacgaaagagaguauaauaacaagcggagcggggugggacccucuaaauuucauggcuacgcuuaugacgggauuugggucaucgcgaagacacugcagcgcgccauggagacccuucacgcuuccagcagacaucagcggauucaagacuucaauuacacggaucacacacugggaagaaucauucucaacgccaugaacgaaaccaacuuuuucggcgugacaggccagguuguguuccgcaauggggagcggaugggaaccaucaaguuuacccaguuccaggacucuagagaagucaaagugggcgaguacaaugccguugcugauacacuggaaaucauuaacgacacgauccgcuuucaagggagcgagccgccuaaggauaaaaccauuauccuggagcagcuccggaagauuucccugccccuuuauucuauccugagcgcccucacaauccugggaaugauuauggcguccgcuuuccuguuuuucaauaucaaaaacagaaaucagaaacuuauuaagaugagcucucccuacaugaacaaucucaucauucugggcgggaugcuguccuaugccagcaucuuucucuucggccuggacggaucuuuuguguccgaaaagaccuucgagacacuuugcaccguccgcacguggauucugacagugggcuacaccaccgccuuuggggcuauguucgccaagacauggcggguccacgcuaucuuuaaaaacgugaagaugaaaaagaagaucauuaaagaucagaagcuccugguuaucgugggaggcaugcugcuuauugaccucuguauccugauuugcuggcaagccgucgauccucugagacgcaccguggaaaaauauagcauggagccggaccccgcggggcgggauaucuccaucagaccucuccuggaacauugugagaauacacacaugacgauuuggcuuggaaucguuuacgccuauaagggccugcucaugcuguucgggugcuuccuggcuugggagacccgcaacgugucuauucccgcccuuaaugacagcaaauacaucggcauguccgucuacaacgugggaauuauguguaucaucggcgcugccgugucuuuucucacacgggaccagccuaauguucaguucugcauugucgcgcuggugaucaucuuuugcagcaccauuacacugugucucguguucguccccaagcugauuacccuuagaacgaacccugaugccgcuacccagaaccggcgcuuucaauucacacagaaucagaagaaagaagacuccaagaccagcacaucugugaccuccguuaaccaggccagcacgucuagacuggaggggcuccaauccgaaaaucaucggcugagaaugaaaaucacagagcuggauaaggaccuugaggaagugaccaugcagcuccaggauacacccgagaaaaccaccuauaucaagcaaaaccacuaccaggaacugaaugacauucugaaccucggaaauuuuacagagagcacggauggcgggaaagcuauccugaagaaccaccuugaccagaauccgcagcugcaauggaacaccacagaaccuucucggaccugcaaggaucccauugaggacaucaauagcccugagcauauucagcgcagacucucccugcagcugcccauccuucaccaugccuaucugccgagcauuggaggcgucgaugccucuuguguguccccuugcguuagccccacagcuuccccucgccacagacaugugccucccucuuuccgggucauggugagcgggcucuga

SEQ ID NO: 69562 - RNA, 1365 nt, Artificial Sequence
  derived and/or modified sequence opt5 from GABPA__Homo_sapiens__NP_002031
augaccaagagagaggccgaggagcugaucgaaauugagaucgacggcacagaaaaagcugagugcacggaggaaagcauuguggagcagaccuacgcccccgcggaaugugucucccaagcuaucgauauuaacgagccuaucgggaaucucaagaaacugcuugagccgcggcugcagugcucucucgacgcccacgaaaucugucugcaggauauucagcuugaccccgagcgcagccuguucgaucaaggaguuaagacagacggcaccgugcagcucuccgugcaggucaucucuuaucaggggauugaaccuaaacugaacauccuggagauugugaagcccgccgauacaguugaaguggucaucgacccugaugcucaucacgccgagagcgaggcucaucucguggaagaggcccaaguuauuacccuggacggaacaaagcacaucaccacgaucuccgaugaaaccucugaacaggugacaagaugggcggccgcucuugaaggcuaccggaaagagcaggagcgccuggggauucccuaugacccuauccaguggagcaccgaucaaguccuccauuggguggugugggucaugaaggaauuuuccaugacagacauugaccugaccacgcuuaauaucagcggaagagagcugugcucucucaaccaggaagauuucuuucagcggguuccgcgcggcgagauucuguggucccaccuggaacuccugagaaaauacgugcuugccagccaagagcagcagaugaaugagaucgugacaaucgaccagcccguccaaauuaucccugcuucugugcaguccgccacccccacaaccauuaagguuaucaacagcucugcgaaagccgcuaaggugcagcgggccccucgcauuuccggcgaagauagaagcucccccgggaaucggaccggaaacaauggccagauccaacuguggcaguuccuccuggagcuucugacagacaaggaugcucgcgacuguaucucuugggucggggaugaaggagaguuuaaacucaaccagccggagcugguggcccagaaguggggccaacggaaaaauaagccuacgaugaacuaugaaaaacugagcagagcccuccgcuacuauuacgacggggauaugauuugcaagguucagggaaaaagauucguguacaaguuugucugugaccugaagacccuuaucggcuauuccgcugcggagcugaaucggcucgugacagaaugcgagcagaaaaagcuggccaaaaugcagcuucacggcauugcucaacccgucaccgccguggcccuggcuacagccagccuccagaccgaaaaggauaacuga

SEQ ID NO: 69563 - RNA, 1083 nt, Artificial Sequence
  derived and/or modified sequence opt5 from GABPB1__Homo_sapiens__NP_002032
augagccugguggaccucggcaagaaacugcuugaggccgcuagagccgggcaggaugacgaaguccggauccugauggcgaacggagcucccuucaccacagauuggcucggcacguccccucugcaccuugccgcccaauacgggcauuauucuaccacagagguucugcuccgcgcuggagugagcagagacgcccggaccaagguggaucgcacaccgcugcacauggcugccuccgaaggccaugcgucuauugucgaggugcugcucaaacacggggccgacguuaaugcuaaggauaugcugaaaaugaccgcccuucauugggcuacagaacacaaccaccaggagguggucgagcugcucaucaaguacggagccgacgugcauacccagagcaaguuuugcaaaacggcguucgauauuuccaucgacaauggcaacgaagaucuggccgagauucuucagaucgcuaugcaaaaucagaucaacaccaaucccgaaucuccugacacaguuaccauucacgccgcuacaccccaguuuaucauuggcccugggggaguggucaaccugaccggccucgugagcuccgagaauagcucuaaggccacggaugagacagggguguccgccguccaguucggaaacagcucuaccuccguucuggcuacacuggcggcccucgcugaagccagcgcuccccugucuaauuccagcgagaccccugugguggccaccgaagaggucgugacagccgaauccguugacggcgcgauccaacagguggucucuagcgggggacaacaggugauuacgaucguuaccgacggcauucagcuuggcaaccugcauuccaucccgacaagcgggaucggacagcccauuaucgugaccaugccugauggccagcaaguccucacagugcccgcuaccgacauugccgaggagacggucaucucugaggaaccucccgccaaaagacaguguauugaaaucaucgagaaucggguggaauccgcugagauugagguucgcagccugcuuccgggggugcugugcagaucucacccuaaguga

SEQ ID NO: 69564 - RNA, 1371 nt, Artificial Sequence
  derived and/or modified sequence opt5 from GABRA1__Homo_sapiens__NP_001121120
augagaaagagccccggccuguccgacugccucugggccuggauccugcuucugucuacccucacagggcggagcuacggacagccuucccugcaagaugagcuuaaagacaacacgaccguguucacacgcauucuggauagacuccuggacggcuaugauaaucggcugcgcccggggcucggagaaagagucaccgagguuaagacagacaucuuugugaccucuuucggccccgugagcgaucacgacauggaauacacaauugaugucuuuuuccggcaguccuggaaagacgagcgccugaaguuuaaagggccuaugaccgugcuuagacugaacaaucucauggcuucuaagaucuggacgcccgauaccuucuuucauaacggaaagaaaagcguugcccacaauaugacaaugccuaacaagcugcuucggauuaccgaagacggcacacugcucuauaccaugcgccugacggugagagcggagugucccaugcaucuggaggauuucccuauggacgcucacgccugcccgcucaaauuuggcuccuacgccuauacacgggcugaagucguguacgaguggacccgcgaacccgccagaagcguuguggucgcugaggacgggucucggcugaaucaguaugaucuucugggacagacaguggacuccggcaucgugcaaagcucuaccggggaguacgucguuaugaccacacauuuccaccucaagcgcaaaaucggauacuuugugauucagacguaucugccuuguaucaugaccgugauucuuucccaggucagcuucuggcugaacagagaaucugugcccgcccggacaguuuuuggcgugaccacaguccucaccaugacgacacuguccaucagcgcgagaaauucccugccuaagguggccuacgcuaccgccauggauugguucauugcuguuugcuaugccuucguguuuucugcgcucaucgaguucgccaccgucaacuacuuuacaaagcgcggguaugcuugggacggaaaaagcgugguccccgaaaagccgaaaaaggugaaagauccucugauuaagaaaaauaacaccuacgcccccacagcuacguccuauaccccuaaucuugcccggggcgaccccggccuggccacaaucgcuaagagcgcgaccaucgagcccaaggaaguuaaaccugagacaaagccgcccgagccuaaaaagaccuucaacucuguguccaaaauugauagacucagccgcaucgccuuuccccugcuuuucgggauuuuuaaucuggucuacugggcuacguaccucaaccgggaaccucagcugaaggcccccaccccgcaccaauga

SEQ ID NO: 69565 - RNA, 1356 nt, Artificial Sequence
  derived and/or modified sequence opt5 from GABRA2__Homo_sapiens__NP_000798
augaagaccaaacugaacaucuacaauaugcaguuccuccuguuuguguuccuugucugggaccccgccagacugguucucgcuaacauucaagaggaugaagccaagaauaacaucacaauuuuuacgcggauccuggaccgccuucuggauggcuaugacaauagacuccggccugggcugggagauagcauuaccgagguguucacaaacaucuacgugaccuccuuuggcccggucucugacacagauauggaauauaccaucgacguguucuuucgccagaaauggaaggaugagagacugaaauucaaggggcccaugaauauucuccggcugaacaaucuuauggcgagcaagaucuggacaccugacaccuuuuuccacaacggcaaaaaguccguugcucauaauaugacgaugcccaacaaacugcuccgcauucaggaugacggaacccugcuuuacacaaugagacugaccgugcaggccgaaugcccuaugcaccucgaggauuuucccauggacgcccauucuuguccucugaaguucgggagcuaugcuuacacaaccuccgaggucacguauaucuggacauacaaugccucugacagcgugcaaguugcuccggauggaucccggcugaaccaguacgaccuccugggccagagcauuggcaaagaaaccaucaagucuuccacaggggaguauaccgugaugaccgcccacuuucaucuuaagcgcaaaauuggauacuucgucauccagacauaucugcccugcaucaugacggugauucucagccaagugucuuucuggcugaauagagaauccgucccugcgcggaccguuuuuggcgugacaaccgugcuuacaaugaccacgcugagcaucucugcccgcaacucccuccccaaggucgcuuacgccacagcuauggauugguucauugccguguguuaugcguuuguuuucagcgcccugaucgaguuugcuaccgugaacuacuucaccaaaagagggugggccugggacggaaaguccgucgugaaugauaaaaagaaagagaaggcuucuguuaugauucagaacaaugccuaugccguggcugucgcgaacuacgccccuaaucugagcaaggaccccgugcucuccacaaucagcaaaucugcuaccacaccggaaccuaacaagaaacccgagaauaagccugccgaagccaaaaagacguuuaacuccgucagcaagaucgaucggaugucucgcauuguguuccccguucuguuuggcaccuucaaucuuguguacugggcuacauaucugaacagagagcccguccucggggugagcccuuga

SEQ ID NO: 69566 - RNA, 1479 nt, Artificial Sequence
  derived and/or modified sequence opt5 from GABRA3__Homo_sapiens__NP_000799
augaucauuacccagacaagccacugcuacaugacgucccugggcauccucuuccugauuaacauccuucccgggaccacaggacaaggcgagucuagacggcaggaaccuggggacuuugugaagcaggauauuggaggccugagcccgaaacaugcccccgacaucccugaugacuccaccgauaauaucacaauuuucacccgcauccucgacagacugcuugauggguaugacaaccggcugcgccccggacucggcgaugcugucacagagguuaagaccgacauuuacgugacgucuuuuggcccugugagcgauaccgacauggaauauacaaucgaugucuucuuuagacagaccuggcacgacgagcggcugaaauucgacgggcccaugaagauucugccucucaauaaccugcuugccuccaaaaucuggacaccggauaccuuuuuccauaauggaaagaagucuguggcgcacaacaugacgacacccaauaaacugcuccgccugguugacaacggcacccuucuguacacaaugagacucaccauucaugcugaauguccuaugcaccuggaggauuuucccauggacgugcacgccugcccucugaaguucgggagcuaugccuacaccacagcugaggucguguauuccuggacgcucggcaaaaauaagagcguugaaguggcccaagauggaucucggcugaaccaguacgaccuucuggggcaugucgugggaaccgagaucauccgcuccagcacaggcgaauacguggucaugaccacacacuuucaucucaaaagaaagauuggcuauuucguuauccagaccuaccugcccuguauuaugacggugauccuuucucagguguccuuuuggcugaaucgggagagcgucccggcucgcacaguguucgggguuaccaccgugcucacaaugaccacacugucuauuuccgccagaaacagccugccuaaggucgcguaugccacggcuauggauugguucaucgccgugugcuacgcuuuuguuuucuccgcccucaucgaguuugcgaccgugaauuauuucacaaaacggucuugggccugggaaggaaagaaaguccccgaggcucuggaaaugaagaaaaagaccccugccgcucccgccaaaaagacaagcaccacguuuaacauugugggcaccacauaccccaucaaucuugccaaggacaccgaguucuccacaauuagcaaaggggcugcgccuucugccuccagcaccccgacgaucauugcuucucccaaggccacauauguccaagauagcccuaccgaaacaaaaaccuacaacuccgugucuaagguugacaaaaucagccgcaucauuuuucccgugcuguucgccaucuuuaaccucgucuacugggcuaccuaugugaauagagaguccgccauuaagggaaugauccggaagcaguga

SEQ ID NO: 69567 - RNA, 1665 nt, Artificial Sequence
  derived and/or modified sequence opt5 from GABRA4__Homo_sapiens__NP_000800
auggugagcgccaagaaaguccccgcuaucgcccuguccgcgggcguuucuuucgcucuccugagauuucuuugccuggccgugugucucaacgagagcccugggcagaaucaaaaggaagagaaacugugcaccgaaaacuucacacggauucuugacucccugcucgauggauacgacaaucgccugagaccgggcuuugggggacccgugacggaggucaagaccgauaucuaugugacaucuuucggcccuguuagcgacguggaaauggaguacaccauggaugucuuuuuccggcagacauggauugacaaacgccugaaguaugaugggcccaucgagauucucagacugaacaauaugauggugaccaagguuuggacaccugacaccuuuuuccggaacggcaaaaaguccgugucucacaauaugacggcccccaacaaacuuuuucgcaucaugagaaauggaaccauccuguacacaaugcggcucaccauuagcgcugaauguccuaugcgccuggucgauuucccgauggacggccaugccugcccccuuaaguuuggguccuaugcuuacccuaaaagcgagaugaucuauacauggaccaagggacccgaaaagucuguggaggugccuaaagaguccagcucucugguccaguacgaucucauuggccagacgguuuccagcgaaacaaucaagucuauuaccggggaguacaucgugaugacaguguauuuccaccugagacggaaaaugggauacuuuaugauucaaaccuauauccccuguaucaugaccgucauucugucccaggugagcuucuggaucaacaaggaauccguuccggcccgcacaguguucggcauuacgaccguccucacaaugaccacacugucuaucagcgcgagacauucccuuccuaaagugagcuacgccaccgcuauggacugguuuauugccguuugcuucgcuuuuguguucucugcccugaucgaguuugcggccgucaauuauuucacgaacauccagauggaaaaggcuaaacggaagacauccaagcccccucaggaggugcccgccgcucccguccaacgcgagaaacacccugaagccccgcuccagaauaccaacgccaaucugaacaugagaaagcggaccaacgcucuugugcauagcgagucugauguugggaauagaacagaagugggaaaccacagcuccaaaucuagcaccgucgugcaggaguccagcaagggcacaccccgcucuuaccuggcguccagcccuaaucccuuuucucgggccaacgcugccgaaacgauuuccgccgcuagagcccucccuagcgcgucccccaccucuauccgcacaggcuauaugccgcggaaagcuagcguuggguccgccucuaccagacacguguucggaagccgccugcagcggauuaagacaaccgucaauacgaucggcgccaccgggaagcuguccgcuacaccucccccuagcgcucccccucccucuggauccggcaccagcaaaauugacaaguacgccagaauccucuuuccggugacauucggggccuuuaacaugguguacuggguugucuaucugucuaaagacaccauggagaaguccgagagccuuauguga

SEQ ID NO: 69568 - RNA, 1389 nt, Artificial Sequence
  derived and/or modified sequence opt5 from GABRA5__Homo_sapiens__XP_005268315
auggacaacggcauguucagcggguuuaucaugauuaagaaucugcuccuguucugcaucuccaugaaccuuucuagccacuuuggauucucccagaugcccaccucuagcgugaaagaugagacaaaugacaacauuacgaucuuuacccggauucuggauggccuccuggacggguacgauaauagacuucgcccuggacugggcgaaagaaucacacaaguccggaccgacaucuauguuacauccuucgggccggugucugauaccgagauggaauacacaauugacguguuuuuccgccagagcuggaaggaugagagacuccgguuuaaaggacccaugcagcgccugccucugaacaaucuccuggccuccaagaucuggacccccgacacguucuuucacaacggcaaaaagagcauugcucacaauaugaccacaccuaacaagcuccugagacucgaagaugacggcacccugcuuuauacaaugcggcugaccaucucugccgagugucccaugcagcucgaggauuucccuauggacgcgcaugcuugcccgcugaaauuuggguccuacgccuaucccaauagcgaagucguguacguuuggacgaacggaucuacaaaguccguggucguggccgaggacggcagccgccugaaucaauaucaccucauggggcagaccguuggaacagaaaacauuucuaccuccaccggcgaguacacaaucaugacggcucauuuccaccugaaaagaaagauuggguacuucgugauccagaccuaucuuccuuguaucaugacagucauucugagccagguguccuuuuggcucaaucgggagucugugcccgcccgcaccgucuucggaguuacaaccgugcugacgaugacaacccuuagcaucuccgcuagaaacagccugccuaaaguggccuacgcgaccgccauggauugguuuauugcugucugcuaugccuucguguuuucugcucucaucgaguucgccacaguuaacuacuuuaccaagcggggcugggcgugggacggcaagaaagcccuggaagcugccaagauuaaaaagaaacgcgaagugauccugaauaaguccacaaacgcuuucacgaccgggaaaaugagccaucccccgaauaucccuaaggagcaaacacccgccggaaccucuaacacaaccagcgucuccgugaagccuucugaagagaaaacgagcgaguccaagaaaaccuauaauagcauuucuaagaucgauaaaauguccagaauuguuuuucccgugcuuuucggcacauuuaaccuggucuacugggccaccuaucuuaaucgggaacccgugaucaagggggcugcgagcccuaaguga

SEQ ID NO: 69569 - RNA, 1362 nt, Artificial Sequence
  derived and/or modified sequence opt5 from GABRA6__Homo_sapiens__NP_000802
auggccagcucccugcccuggcucugcaucauucuguggcuugagaacgcucugggcaagcucgaaguggaggggaauuucuacucugaaaacgucagcagaauccuggacaaucuucuggagggauaugauaaccggcuccgcccuggcuuugggggagccguuaccgaagugaaaacagacauuuacgugacguccuucggcccggucucugauguggagauggaguauaccauggacguuuucuucagacagacauggaccgaugaacggcugaaguuugggggacccacagagauccugagccucaauaaccugaugguguccaaaauuuggaccccugacacauucuuucgcaauggcaagaaaucuaucgcgcacaacaugaccacgcccaauaaacuuuucagaaucaugcaaaacggcaccauucuguacacaaugcggcucaccaucaaugcugauuguccuaugcgccuggucaacuuucccauggacgggcaugccugcccucuuaaguucggaagcuaugccuacccgaaguccgaaauuaucuauacauggaagaaaggcccccuguacagcguggagguuccugaggaaucuuccagccuccugcaguacgaucugauugggcagaccgugucuuccgagacgaucaagagcaauacaggagaauaugucauuaugaccguguacuuucaccuccagagaaaaaugggcuauuucaugauccaaaucuacacacccuguauuaugaccgugauccugucucaggucuccuuuuggauuaacaaggagagcguuccugcucggaccguguucgggaucacaacggugcuuaccaugacaacccuguccauuucugcccgccauagccuccccaaggucuccuaugcuacagccauggacugguucaucgcggugugcuuugccuucguuuuuagcgcucugaucgaauuugccgcugugaauuacuuuaccaaccuucagacgcagaaagccaagagaaaagcgcaauucgccgcuccgccuacagucaccauuucuaaggccaccgagccccuggaggcugaaaucgugcuccacccugauuccaaauaucaucugaagaaacggauuacaagccugucucuccccaucguuagcuccucugaggccaacaaggugcugacccgcgcccccauucuucagagcacaccugucacgccgcccccucugucccccgcuuuuggaggcaccagcaagaucgaccaguacucuagaauccucuucccuguggcguuugccggcuucaaucuggucuacugggugguuuaucuuuccaaagauacaauggaagugucuagcuccgucgaguga

SEQ ID NO: 69570 - RNA, 1425 nt, Artificial Sequence
  derived and/or modified sequence opt5 from GABRB1__Homo_sapiens__NP_000803
auguggaccgugcagaacagagagagccugggccuccuguccuuccccgucaugaucacaaugguuugcugugcccacucuacgaaugaaccuagcaacauguccuacgugaaggagaccguggaccggcuucugaaaggguaugauauucgccucagaccggacuuuggagggcccccugucgaugugggcaugcggaucgacguugcuucuauugauauggugagcgaagucaauauggacuacacacugaccauguauuuccaacaguccuggaaggauaaacgccuuucuuacagcggaaucccccugaaccucacacuggacaauagaguggccgaucagcuguggguuccugacaccuauuuucucaacgauaagaaauccuucgugcauggcgucacagugaagaaucggaugauucgccugcaccccgacgggaccgugcuuuacggacugagaaucacgaccacagcggcuugcaugauggaucuccggcgcuauccucuggacgagcagaacuguacccuugaaaucgagagcuacggcuacacaaccgacgauauugaguuuuauuggaauggcggggaaggagccgucacgggcguuaacaagaucgagcugccgcaauucucuauuguggacuacaaaaugguguccaagaaagucgaauuuacaaccggggccuaucccagacucagccugucuuuccggcugaagcgcaauaucggauacuuuauucuccagacauauaugccuuccacccugaucaccauucuuagcugggugucuuucuggaucaacuacgaugcuuccgccgcuagaguugcccugggcaucacaacggugcucaccaugacaaccauuagcacacaucugcgggagacccuucccaaaaucccuuaugucaaggcgauugacaucuaccugauggggugcuuuguguucguuuuucucgcccugcuggaguacgcuuucgugaauuauauuuucuuuggaaagggcccccagaaaaagggcgccuccaaacaggaucaaucugcuaacgaaaagaauaaacucgagaugaacaagguccagguggacgcccacgggaacauccugcuuagcacgcuggaaauccgcaaugagacauccggaagcgaaguccucaccucuguguccgauccgaaagcgaccauguacagcuaugacucugccagcauucaguacagaaagccucuguccucucgggaggcuuauggcagagcccuugaucgccaugggguucccagcaagggacggaucagacgccgggcuucccagcugaaagugaagauuccugaccucacagaugucaacagcaucgacaaauggucuagaauguucuuucccauuaccuucucccuguuuaaugugguuuacuggcuguauuacgugcacuga

SEQ ID NO: 69571 - RNA, 1425 nt, Artificial Sequence
  derived and/or modified sequence opt5 from GABRB2__Homo_sapiens__NP_000804
auguggagagugcggaagcgcggcuacuucgggaucuggagcuuuccccugauuaucgccgcugucugcgcccaguccguuaacgacccuucuaauaugagccucgugaaagagaccguggauagacugcuuaagggauaugacauucggcugcgcccggauuucggcgggcccccugucgcggugggaaugaacaucgacauugcuuccaucgauaugguuucugaagugaauauggacuacacacucacgauguauuuucaacaggccuggagagauaaacggcugagcuacaacgucaucccccuuaaucugacccucgacaaccgcguggccgaucagcuguggguuccugacacauauuuccugaaugauaagaaauccuuugugcacggcgucaccgugaagaacagaaugauucggcuccaucccgacgggacagugcuguacggacuucgcaucaccacaaccgcugccuguaugauggaucugagacgguauccucucgacgagcagaauugcacgcuggaaauugagucuuacggcuacaccacagacgauaucgaguucuauuggcgcggcgacgauaacgcugucaccgggguuacaaagauugaacuuccgcaauuuagcaucguggacuacaaacugauuaccaagaaaguggucuucuccacgggaagcuaucccagacucucucuguccuuuaagcugaaacggaauaucggcuacuucauccuccagacauauaugccuagcauucugaucaccauucuuucuuggguguccuuuuggaucaacuacgaugccagcgcggcccgcguugcucuggggauuacaaccgugcucaccaugacaacgaucaauacccaccugagagagacacuucccaagaucccuuaugucaaggccauugacauguaccugaugggauguuucguguuuguuuucauggcucuccuggaauacgcccuggugaacuauaucuucuuuggccgggggccccagagacagaaaaaggcggccgagaaagcugccucugcuaauaacgaaaagaugcgccucgaugucaacaaaauggacccgcaugagaauauucugcuuuccacccuggagaucaagaacgaaauggccacaagcgaggccgugaugggacucggcgauccucgguccaccaugcuggcuuacgacgcgucuagcauucaauauagaaaagccggccuuccccgccacuccuucgggcggaaugcucuggaaagacaugucgcccagaaaaagagccgccuccggagacgcgccucucagcugaagaucacgaucccugaucugacagacgugaacgcuauugaccggugguccagaaucuuuuuccccguuguguuuagcuucuuuaauauugucuacuggcucuauuacgugaacuga

SEQ ID NO: 69572 - RNA, 1422 nt, Artificial Sequence
  derived and/or modified sequence opt5 from GABRB3__Homo_sapiens__NP_000805
auguggggccuggccgggggaagacucuucggcaucuuuagcgcucccgugcuggucgccguugugugcugugcgcaguccgugaacgacccugggaauaugucuuucgucaaggagaccguggauaaacuucugaagggauacgacauucggcuccgcccggauuuuggcgggcccccuguuugcgugggaaugaacaucgacauugcuagcaucgauauggucuccgaagugaauauggacuauacacugacgauguacuuccaacaguauuggagagauaaacggcuugccuacucuggcauuccccugaaccucacccuggacaaucgcguugccgaucagcugugggugccugacacauauuuucucaacgauaagaaauccuucguccacggcgugaccgugaagaauagaaugauccggcugcaucccgacgggacaguccuuuacggacugcgcaucaccacaaccgcugccuguaugauggaucucagacgguauccucuggacgagcagaacugcacgcuugaaauugagagcuacggcuacaccacagacgauaucgaauuuuauuggcgcgggggagacaaggcuguuaccggcguggagagaauugagcugccgcaauucucuaucguggaacaccggcucgucagccgcaaugugguuuuugccacaggggcguaccccagacugucccugagcuuccggcucaaacgcaacauuggauauuuuauccugcagaccuacaugccuucuauucuuaucacgauccuguccugggugagcuucuggauuaauuaugaugccucugcugccagagucgcucucggcaucacaaccgugcugacaaugaccaccauuaacacacaucuucgggagacgcugcccaagaucccuuacguuaaagccauugacauguaucucaugggcuguuuuguguucgucuuccuggcgcugcucgaauacgccuuugugaauuacaucuucuuugggagaggaccccagcgccagaagaaacuggcugagaagaccgccaaggcuaaaaacgaucgguccaagagcgagucuaauagagucgacgcccacggcaacauccuucugacaucccucgaagugcauaacgagaugaaugaaguuagcgggggaauuggcgauacccgcaacuccgccaucucuuucgacaauagcgggauucaauaucggaaacaguccaugccgagagagggacacggccgcuuucugggcgaucggagccuuccucacaagaaaacacaucugagacgccggucuucccagcucaagaucaaaauucccgaccugaccgaugugaacgcuaucgacagauggagccgcaucgucuucccuuuuacguucucucuguuuaaucucguguacuggcuguauuacguuaacuga

SEQ ID NO: 69573 - RNA, 1521 nt, Artificial Sequence
  derived and/or modified sequence opt5 from GABRE__Homo_sapiens__NP_004952
augcugagcaaggugcuccccguccugcuuggcauccugcucauucugcaguccagaguugaggggccucaaaccgaaucuaaaaacgaggccagcucccgggacgugguguacggaccgcagccccagccucuugaaaaucagcugcucucugaggaaacaaagagcacggagaccgagacaggcucccgcgucgggaaacugcccgaggcuucuagaauccugaacaccauucucagcaauuaugaucacaagcugcggccuggaaucggcgaaaaacccacagugguuaccguggaaauuuccgucaacagccuugggccucugucuauccucgacauggaguacacaaucgauauuaucuucucccaaaccugguaugacgagcgccugugcuacaaugauacguuugaaagccuugugcugaacggaaauguugugucucagcucuggauuccggacaccuucuuuagaaacuccaagcggacacaugagcacgaaaucaccaugcccaaucagaugguccgcauuuauaaggauggcaaagugcuguacacaaucagaaugaccauugacgccggcuguagccugcauaugcuccgguucccuauggauucucacuccugcccccugagcuuuuccucuuucagcuauccugagaacgaaaugaucuacaagugggagaauuuuaaacuugagaucaacgaaaagaacuccuggaaacuguuccaguuugacuucacgggggugagcaauaagacagagauuaucaccacacccgucggagauuuuaugguuaugaccauuuucuuuaaugugucucgcagauucggcuacguggcguuccaaaacuaugucccguccagcgugaccacaaugcucucuuggguuagcuuuuggaucaagacggaauccgcuccugcccggaccucucuggggauuacaagcgugcuuaccaugacaacccugggaacguucucccgcaaaaacuuucccagagucagcuacaucacagcccucgacuucuauaucgcuauuuguuuuguguucugcuuuugugcccugcuggaguucgcuguucucaauuuucugaucuacaaccagaccaaggcccaugcgucuccuaaacuucggcacccccgcauuaauuccagagcccacgcucggaccagagcccgcagccgggcuugcgccagacagcaucaggaagcguucgugugucaaaucgucacaaccgagggcucugauggggaggaacgccccuccugcagcgcccagcagccuccgucccccggaucuccugagggcccccggagccuguguuccaagcucgcuugcugugaauggugcaaaagauuuaagaaauauuucugcauggugccugacugugagggcucuacauggcaacaggggcgccugugcauucacgucuaccggcuugacaacuauagcagagugguuuuucccgugacguucuucuuuuucaauguccuguacuggcucgugugucugaaccuguga

SEQ ID NO: 69574 - RNA, 1398 nt, Artificial Sequence
  derived and/or modified sequence opt5 from GABRG1__Homo_sapiens__NP_775807
augggcccccugaaggccuuccucuuuagcccuuuccugcuuagaucccagucucgcggggugcggcuggucuuucuccugcuuacccugcaccucggaaacugcguugacaaagcugaugacgaggaugacgaagaucugacagugaauaagacgugggugcuggccccgaaaauccaugagggcgacauuacccaaauccucaacagccugcuucagggguacgauaauaagcugagacccgacauuggaguccggccuacagugaucgaaaccgauguuuaugugaacuccauuggccccgucgacccuaucaauauggaguacacaaucgauauuaucuucgcgcagaccugguuugacucucgccucaaauucaacagcacaaugaaggugcugaugcuuaauuccaacaugguugggaagauuuggauccccgauaccuuuuucagaaauucucggaaaagcgacgcucacuggauuacgaccccuaaccgccugcucagaaucuggaaugacggacgggugcuguauacacugcgccucaccauuaacgccgaauguuaccugcagcuucauaauuuuccgauggaugagcacuccugcccccuggaguucagcucuuauggcuacccuaagaacgaaaucgaguauaaauggaagaaacccuccgucgaaguggccgacccuaaguacuggagacucuaccaauuugcuuucgugggccugcggaauagcacagagaucacccauacgauuucuggggauuaugucaucaugacaaucuuuuucgaccuuucccgcagaaugggauacuucaccauucagacauauauucccuguauccugaccguugugcucagcugggugucuuuuuggaucaacaaggaugccgucccggcucggaccucccugggcauuacaacggugcugaccaugacaacccucagcacaaucgcccgcaaaucccugccuaagguuucuuacgugaccgcgauggaccuuuucgucagcgugugcuuuauuuucguuuuugccgcucugauggaguaugggacgcuccacuacuucacauccaaccagaaaggaaagaccgccaccaaagauagaaagcugaaaaauaaggcuagcaugacacccggccuucacccugggucuacccugauccccaugaacaauauuuccgugccccaggaagacgauuauggauaccaaugucucgagggcaaggacugcgccagcuuuuucuguugcuuugaagauugucggacaggcucuuggagagaggggcgcauccauauccggauugcgaaaaucgacagcuacuccagaauuuucuuuccuacggccuucgcucuguuuaaccuggucuauugggugggauaccucuaucuguga

SEQ ID NO: 69575 - RNA, 1404 nt, Artificial Sequence
  derived and/or modified sequence opt5 from GABRG2__Homo_sapiens__NP_000807
augagcucccccaacaucuggucuaccggcagcuccguguacucuacaccugucuucagccagaagaugacgguuuggauucugcuccugcuuucccuguauccgggguuuaccucucaaaaauccgacgaugacuacgaggauuaugccuccaauaagacaugggugcucacccccaaagugccugaaggagacgucacagugauccugaacaaucuucuggagggcuacgauaacaagcucagacccgacauugggguuaaaccuacccugauccacacagauauguaugugaauagcauuggacccgucaacgcuaucaauauggaauacaccaucgacauuuucuuugcccagacgugguaugaucggcgccugaaguucaacucuaccaucaaggugcucagacugaauagcaacaugguuggcaaaauuuggaucccugacacauuuuuccggaauagcaagaaagcggaugcucauuggauuaccacaccgaaccgcaugcuuagaaucuggaaugacgggcgggugcuguacacccuccgccugacgauugaugccgagugccagcuucagcugcacaacuuucccauggacgaacauucuuguccucucgaguucuccagcuacggauaucccagagaggaaaucgucuaccaauggaagcggucuuccguggaggugggcgacacacgcagcuggagacuguaucaguuuuccuucgucggccugcggaauaccacagaaguugugaaaaccaccucuggggauuacguggucaugagcguguauuuugaccucucccgcagaaugggauacuucacaauccagacguauauuccuugcacccugaucguugugcuuagcugggucucuuuuuggauuaacaaggaugccgugcccgcucggacaucccugggcaucaccacaguucucaccaugacgacacugagcaccauugcccgcaagucucuuccgaaagugagcuacgucaccgcuauggaccuguucguguccgucuguuucaucuuuguguucucugcccucguugaguacgggacacugcacuauuuugugagcaacagaaagccuuccaaagauaaggacaaaaagaaaaagaaucccgcgccuaccaucgauauucggcccagaagcgccacaauccagaugaacaaugcuacgcaucugcaagagcgcgacgaagaguacggauaugaaugccucgauggcaaggacugugccucuuucuuuugcuguuucgaggauugccggaccggggcuuggagacacggacgcauucacauccggauugccaaaauggacuccuacgcgagaaucuuuuuccccacagccuuuugucuguucaaccuugucuauugggugagcuaccuguaucucuga

SEQ ID NO: 69576 - RNA, 762 nt, Artificial Sequence
  derived and/or modified sequence opt5 from GABRG3__Homo_sapiens__NP_001257802
auggcccccaagcugcuccugcuucugugccucuucagcggccugcacgcuagaucccggaaaguggaggaagacgaguacgaagauucuagcuccaaccagaaguggguccuugccccuaaaucucaagacaccgauguuacacugauccucaauaagcugcugcgcgaguaugacaaaaagcucagaccggauauugggaucaagcccacggugauugacguggauaucuacgucaacagcauuggaccuguguccucuaucaauauggaauaucagaucgacaucuuuuucgcgcagaccuggacagauagccggcugcgcuuuaacuccaccaugaaaauucuuacacugaauagcaacaugguuggccucauuuggauccccgacaccauuuucagaaauucuaagacagcugaggcccauuggaucaccacgccuaaccagcugcuucggauuuggaaugaugggaaaauccuguacacccuccgccugacaaucaacgccgagugucaacugcagcuccacaauuuucccauggacgaacauuccugcccucugauuuucagcucuuauggauacccgaaggaggaaaugaucuauagauggcggaaaaacuccguggaggcugccgaucaaaagagcuggcgccuuuaccaguuugacuucaugggccugagaaauaccacagagauugucaccacgucugcugggcggaaccuccugaaggaagcccagcuuuccaaagcgcgcgaggccuga

SEQ ID NO: 69577 - RNA, 1323 nt, Artificial Sequence
  derived and/or modified sequence opt5 from GABRP__Homo_sapiens__XP_011532807
augaacuacagccugcaccucgccuucgugugccugucccuuuuuaccgagagaauguguauccagggcucucaauucaaugucgaaguugggcggagcgacaagcugucccuccccggauuugagaaccugacagcuggcuauaauaaauuccuucgcccuaacuuugggggagaaccggugcagauugcccugacgcucgauaucgcgucuauuagcuccaucucugagagcaauauggacuacaccgcuacaauuuaucugagacagcgguggauggaucagcgccugguguucgaaggcaacaaguccuuuacccucgacgccagacuggucgaguuccuuugggugcccgauacauacaucguugagagcaaaaagucuuuucugcaugaagugaccgucgggaaucggcucauccgccuguucuccaacggaacagugcuuuaugcccugagaauuaccacgaccguugcuugcaauauggaccucagcaaauacccuauggauacacaaaccuguaagcugcagcuggagucuuggggcuaugacggcaacgauguggaauuuacauggcuccgggggaaugacuccguccgcggacuggagcaccuuagacuggcccaguacaccaucgagcgguacuucacgcucgugacacgcagccagcaagaaaccggcaacuauacaagacuggugcuucaguuugagcugcggcgcaauguccucuacuucauucuggaaaccuauguucccucuaccuuccugguggugcucuccugggucagcuuuuggaucucccuggauucugugccugcuagaacaugcauugggguuacgaccgugcuuagcaugacaacccugaugaucggaucccggacaagccuccccaacaccaauuguuucauuaaggccaucgacgucuaccugggcaucugcuuuucuuucguguuuggggcgcuucuggaguaugccguugcucauuacuccagccuccagcagauggccgcuaaagauagaggaacgacaaaggaaguggaggaggucucuauuaccaacaucauuaacagcuccaucucuagcuucaaacgcaagauuuccuuugccagcaucgaaaucucuuccgacaauguggacuauagcgaucugaccaugaaaacaucugacaaguucaaguuugucuuccgggagaaaaugggcagaauuguggauuacuuuaccauccaaaacccuuccaauguugaccacuacagcaagcuccuguucccgcugauuuuuaugcuugcgaacguguucuauugggccuacuauauguacuucuga

SEQ ID NO: 69578 - RNA, 1899 nt, Artificial Sequence
  derived and/or modified sequence opt5 from GABRQ__Homo_sapiens__NP_061028
augggcaucagagggaugcugcgggccgcugugauucuccugcuuauccgcaccuggcuggccgagggaaacuaccccagcccuauuccgaaguuccacuuugaguucuccucugcgguccccgaaguugugcucaaucuguuuaacugcaaaaauugugcuaacgaagccgugguccagaagauccuugacagagugcugagccgguaugauguucgccucagaccuaauuucggcggggcccccgugccuguccggauuuccaucuacgugacaucuaucgagcaaauuagcgaaaugaacauggacuauacgaucaccauguuuuuccaucagacauggaaagauucccgccuggcuuacuaugagaccacacugaaucucacccuggacuacagaaugcacgagaaacuuuggguucccgauugcuauuuucugaacucuaaggacgccuucgugcaugaugucacaguggaaaaucggguguuucagcuccacccugacggaaccguccgcuacggcauuagacugacgaccacagcugccuguagccuugaucugcauaaguucccgauggacaagcaggcgugcaaccucguuguggaguccuacggguauaccguggaagauaucauucuguuuugggacgauaauggaaacgccauccacaugacagaggagcugcacauuccccaauucaccuuucucggccggacgaucacaagcaaagaagucuacuucuauaccggcucuuacauccgccugauucuuaaguuccaggugcagagagagguuaauuccuaucuggugcaggucuacuggccuacagugcucaccaccaucacaagcuggauuucuuuuuggaugaacuaugacuccagcgcugcccggguuacgaucgggcugaccucuaugcuuauucugacaaccaucgacucccaucuccgcgauaaacugcccaauaucagcuguauuaaggcuaucgacauuuacauccuggugugccucuucuuugucuuccugucccuucuggaauacguguauauuaacuaccucuuuuauucuagaggaccucggagacaaccccgccggcacagacgcccgcggagagucaucgcccgcuaccgguaucaacaggugguugugggcaacguccaggaugggcugaucaauguggaggacggaguuagcucccuuccuauuacacccgcgcaggccccucuggcuagccccgaaucucucggcucccugaccagcacgucugagcaggcccagcuggcuacaagcgagucccucucuccccugaccagccuuuccgggcaagccccucuggccaccggagaaagccucucugaucugccguccacaagcgagcaggcuagacauucuuacggcgugcgcuucaacggcuuucaggcggacgauuccaucauucccaccgaaauccggaauagagucgaggcccacgggcacggagugacacaugaccacgaagauagcaacgagucccugucuagcgacgagcgccauggccacgggccuuccggaaaacccaugcuucaucacggcgaaaagggggugcaggaggcuggaugggaucucgacgacaauaacgauaagucugacugucuggccauuaaagaacaauucaagugcgauacgaauagcaccuggggccugaacgacgaugagcucauggcccacggccaggaaaaagacuccagcucugaguccgaggauagcuguccucccucuccggggugcuccuuuacagaaggauucagcuuugaccuguucaauccugauuauguucccaaggucgacaaauggucucgguuucuuuucccucuggcuuucggccucuuuaacaucguguacuggguguaccauauguauuga

SEQ ID NO: 69579 - RNA, 1389 nt, Artificial Sequence
  derived and/or modified sequence opt5 from GABRR1__Homo_sapiens__NP_001243632
augcuggccgugcccaacaugagauucggcaucuuucuccugugguggggguggguccuugcuaccgagagccggaugcacuggccuggacgcgaaguucaugagauguccaagaaaggcucuccgauucugagacggagccccgacaucacaaaguccccucucacgaaaucugaacagcugcuucgcauugaugaccacgauuucagcaugagacccggguuuggaggcccugccauccccguggggguggacguccaaguggagucccuggauucuauuagcgaaguugacauggauuucaccaugacacucuaccugcggcauuauuggaaggacgagcgccuguccuuuccuagcaccaauaaccucucuaugacauucgauggaagacuggugaaaaagaucugggucccggacauguuuuucgugcacuccaagcggagcuuuauccaugauaccacaaccgacaauguuaugcuucgcgugcagcccgauggcaaaguccuguacucucucagagugacggugaccgcgaugugcaacauggacuucucccgguuuccucuggacacacagaccuguagccuugagauugaaucuuaugcuuacacagaggaugaccugaugcucuauuggaagaaaggcaaugauucccugaagaccgacgaacgcaucagccugucccaguuccucauucaagaguuucacacgacaaccaaacuggccuucuacucuagcacagggugguauaacagacuuuacaucaauuucacccugcggcgccacaucuuuuucuuucuccugcagaccuacuuccccgccacacuuauggucaugcuguccuggguuagcuuuuggauugauagacgggcugugccugccagagugccccucggaauuacgaccguccugacaaugucuaccaucaucacaggcgugaacgcuuccaugccgcgcguuagcuauauuaaggccguggacaucuaccugugggucucuuucguguuuguuuuccucagcgugcuggaguaugcggccgucaauuaccuuaccacggugcaggaacggaaggagcagaaacugagagaaaagcucccuugcacauccgggcugcccccuccccgcaccgcuaugcuugauggaaacuauucugacggcgaggucaaugaucuggacaacuacaugcccgaaaauggggagaaaccugaucggaugauggugcaacucacccuggccagcgagagauccagcccgcagcgcaagucucagcgguccagcuauguuucuaugagaauugacacacaugcuaucgacaaauacucccgcauuaucuuucccgccgcguacauccuguucaaccucauuuauuggagcaucuuuuccuga

SEQ ID NO: 69580 - RNA, 1398 nt, Artificial Sequence
  derived and/or modified sequence opt5 from GABRR2__Homo_sapiens__NP_002034
augcccuacuucaccagacugauccucuuucuguucugccuuauggugcuggucgagagccggaagccuaaacgcaagagauggacaggccagguugaaaugccgaaacccucccaccucuauaagaaaaaccuggacgugacgaagauucggaaggggaaaccucaacagcuucugcgcguggaugagcaugacuuuucuaugagacccgccuucggaggcccugcuauccccgucgggguggauguucagguggaaagccucgacuccauuucugaggucgauauggacuuuaccaugacacuguaccugcggcacuauuggaaggaugaacgccucgccuucagcuccgcgucuaauaaaagcaugaccuuugacggaagacuggugaagaaaaucuggguuccugauguguucuuuguccauuccaagcggagcuucacacacgacaccacaaccgauaacauuaugcuucgcguguuuccggacggccaugugcuguacucuaugagaaucacggucaccgcuauguguaauauggauuucucccacuuuccccucgacagccagacaugcucucuggagcuugaguccuaugccuacaccgacgaagaucugaugcucuauuggaagaacggggacgagagccugaaaacagaugaaaagaucucucugucccaauuccucauucagaaauuccacaccacgagccggcuggccuuuuacuccucuacaggaugguacaaucgccuuuauaucaacuucacccugagacggcauaucuuuuucuuucuccugcagacauacuucccugcuacccuuaugguuaugcugagcuggguguccuuuuggauugaccgcagagccgugcccgcucgggucagccucggcauuaccacagugcugacgaugaccacaaucauuaccggcguuaaugccucuaugccuagaguguccuaugucaaggcgguggauaucuaccuguggguuagcuucguguuugucuuccucucugugcuggaguaugccgcugucaacuaccuuacaaccgugcaggagcgcaaagaacggaagcugagagagaaauuucccuguaugugcgggaugcuccacagcaagacgaugaugcuggacggauccuauucugaaagcgaggccaauucccuugcuggcuacccgcgcagccauauccugacagaagaggagcggcaagauaagauuguugugcaccucgggcugucuggagaagccaacgcggcccgcaaaaagggccugcucaaagggcagaccggauucagaaucuuucagaauacccacgcuauugacaaguacucccggcugaucuucccugccagcuauauuuucuuuaaccuuaucuacuggucugucuucuccuga

SEQ ID NO: 69581 - RNA, 1785 nt, Artificial Sequence
  derived and/or modified sequence opt5 from GAD1__Homo_sapiens__NP_000808
auggccagcuccacccccucuagcuccgcuacaucuagcaacgccggcgcggacccuaauacgaccaaccugagaccgacaaccuacgauacauggugcgggguggcucacggauguacccggaagcucggccugaaaaucugcggguuccuucagcgcacaaauucccuggaggaaaagucuagacucgucagcgccuuuaaagagcggcaauccagcaagaaccugcuuucuugugaaaauuccgaccgcgaugccagauuccggcgcaccgagacggacuuuagcaaccuguucgcuagagaucuccugcccgccaaaaauggagaggaacagaccguucaguuucugcucgaggugguggacauucugcuuaacuauguccggaagacauucgaucgcucuaccaaggugcuggacuuucaucacccucaucagcuccuggaaggcauggagggguucaaucuugaacuguccgaucaccccgagagccucgagcaaauccugguugacugcagagauacacugaaauacggagugcggaccggccauccucgcuuuuucaaccagcucucuacgggccuggacauuaucgggcuugcuggagaauggcugacauccaccgccaauacaaacauguuuaccuaugagauugcgcccgucuucgugcucauggaacagaucacccugaagaaaaugagagagaucguuggcuggagcuccaaggauggggacggaaucuuuucuccuggcggggccauuagcaauauguacuccauuauggcugcccgguauaaauacuucccggaagugaagacaaagggaauggcugccguccccaaacuugugcuguucacgagcgagcagucucacuauuccaucaagaaagcgggcgccgcucucggcuuugggaccgacaacgugauucugaucaaguguaaugagcgcggaaaaauuaucccugccgauuucgaagcuaagauccuggaggccaaacaaaagggcuacguccccuuuuacguuaacgccacagcugggaccacaguguauggagcguucgacccuauucaggaaaucgccgauauuugcgagaaguacaaccucuggcugcacguggacgcugccuggggcgggggacuucugaugagcagaaaacaucggcacaagcucaauggcaucgaaagagccaacucugucaccuggaauccccauaaaaugaugggcgugcugcuucaguguagcgcuauucugguuaaggagaaagggauccuccagggaugcaaccaaaugugugccggcuaucuguuucagccggauaagcaguacgacguguccuaugauacgggggacaaggcgauccaaugcggacgccacgucgauauuuucaaauuuuggcugauguggaaggcuaaaggcacagugggguucgagaaucagaucaacaagugucucgaacuggccgaguaccuuuaugccaaaauuaagaaucgggaagaguuugaaaugguuuucaacggcgagccugagcacaccaaugugugcuuuugguacaucccccagucucugagaggagucccugacagcccccagcgccgggaaaagcuccauaaaguggcucccaagauuaaagcccugaugauggaguccggcaccacaauggucggguaccaaccucagggagauaaggcuaacuucuuuagaauggugaucagcaauccggccgcgacccagucugacaucgacuuccugauugaagagaucgagcgccuuggccaggaucucuga

SEQ ID NO: 69582 - RNA, 1758 nt, Artificial Sequence
  derived and/or modified sequence opt5 from GAD2__Homo_sapiens__NP_001127838
auggccagccccggcuccggguucuggucuuuuggaagcgaggacggcuccggggauucugaaaacccuggaaccgcuagagccuggugccagguggcgcaaaaguucacaggcgggaucggaaauaaacugugugcucuccuguacggcgacgccgagaagccggccgaaagcggcgggucccagcccccucgggcugccgcucgcaaagccgcgugcgccugugaucagaagcccugcucuuguagcaaagucgacguuaacuaugcuuuucuucacgccacggaucugcucccugcuugcgacggagagagacccacccuggccuuccuucaggaugugaugaauauucugcuccaauacguggucaaguccuuugaccggagcacaaaggugaucgauuuccauuauccuaacgaacugcugcaggaguacaauugggagcucgcggaccagccgcagaaccuggaagagauucuuaugcacugucaaaccacacugaaauaugccaucaagaccggccauccccgcuacuuuaaucagcucucuacagggcuggauaugguuggacuugcugccgacuggcugaccuccacggcuaacaccaauauguucacauaugaaauugccccuguguuuguccuccuggaguacgugacccugaaaaagaugagagagaucaucggcuggcccgggggaagcggcgauggcauuuucucuccugggggagccaucuccaacauguacgcuaugaugauugcgcgguuuaaaauguuccccgaaguuaaggagaagggcauggccgcucucccgcgccugaucgccuuuacaagcgaacacucucauuucucccuuaaaaagggggccgcugcccugggaauuggcaccgacagcgugauccucauuaaaugcgacgagagagggaagaugaucccuuccgaucuggaacggcgcauccuugaggcgaaacagaagggauucguccccuuucuggugucugcuacggccggcacaaccguguauggcgccuucgacccucuccuggcugucgccgauauuuguaaaaaguacaagaucuggaugcacguugacgcugccuggggagggggccugcucaugagcagaaaacacaaguggaaacuguccgggguggagcgggcgaauagcgugacauggaacccccauaagaugaugggagucccccuucagugcucugcccugcucgugcgcgaagagggccugaugcaaaauuguaaccagaugcacgcuuccuaucuuuuucagcaagauaaacauuacgaccugagcuaugauaccggggacaaggcccuccagugcggcagacacguugauguguucaagcuguggcugauguggcgggcuaaaggaaccacaggcuuugaagcccacgucgacaagugccucgagcuggcggaauaccuuuauaauauuaucaaaaaccgcgagggguacgagaugguguucgauggaaagccucagcauacgaacguuuguuuuugguacauuccgcccucucugagaacccucgaagacaaugaggaacggaugagcagacuguccaaaguggccccugucaucaaggcucgcaugauggaguauggcacaaccauggugucuuaccagccccugggggacaaggucaacuucuuucggauggugaucagcaauccugccgcuacacaccaagauauugacuuccuuaucgaagagauugagagacucggacaggaucuguga

SEQ ID NO: 69583 - RNA, 483 nt, Artificial Sequence
  derived and/or modified sequence opt5 from GADD45B__Homo_sapiens__NP_056490
augacccuggaggaacucguggccugcgacaacgcugcccagaagaugcaaacagucacggcggcuguugaggaacugcuuguggccgcccagagacaggaucggcugaccgugggcgucuacgagagcgcuaaacucaugaauguggaccccgauuccguugugcugugucuucuggccaucgacgaagaggaggaagaugacauugcucuccagauccacuucacacugauucaaucuuuuugcugugauaacgacaucaauauuguccgcgugagcgggaugcagagacuggcccagcuccugggagagccugcggaaacccagggcacaaccgaggcccgggaucuucauugccugcucguuacaaacccgcacaccgacgcuuggaagucccaugggcugguggaggucgccucuuauugugaagagagccgcggaaauaaccaaugggugcccuacaucucccuucaggaaagauga

SEQ ID NO: 69584 - RNA, 480 nt, Artificial Sequence
  derived and/or modified sequence opt5 from GADD45G__Homo_sapiens__NP_006696
augacccuggaggaagugagaggccaggacacaguccccgagagcacggcccggaugcaaggggcuggaaaggcccuccacgaacugcuucuguccgcgcagcgccagggcugccucaccgcugggguuuacgagucugccaaagugcugaacguggauccugacaaugucacauucugugugcuugccgcuggagaagaggaugagggcgacaucgcccugcagauucauuuuacccucauccaggcuuucugcugugaaaacgauauugacaucguuagagugggggauguccaacggcuggccgcgauugugggagccggcgaggaagcuggcgccccgggggaccugcacugcauccucaucagcaaucccaacgaggaugcuuggaaggacccugcccuggagaaacuuucccuguuuugugaagagucucgcagcguuaaugauugggugcccuccauuacacucccugaauga

SEQ ID NO: 69585 - RNA, 669 nt, Artificial Sequence
  derived and/or modified sequence opt5 from GADD45GIP1__Homo_sapiens__NP_443082
auggccgcuagcgugagacaggcccggucccugcucggcgucgcggcuacccuggcccccgggucucgcggauacagagcccggccuccgccccgcagacggccuggcccccgcuggccugaccccgaggaucuucugacaccuagauggcaacucgggccgcgguaugcugccaagcaguucgcucgcuacggagccgcgagcggcguugugcccgggucccuguggccuucucccgaacagcuuagagagcuggaagccgaggaacgggagugguauccuagccucgcuacgaugcaggagucccugcgcgugaaacaacuggccgaggaacagaagagacgggaacgcgagcagcacaucgcugagugcauggccaaaaugccccagaugauugucaacuggcaacagcagcagagagaaaauugggagaaggcgcaagccgacaaagaacggagagcucgccuccaggccgaggcucaggaacugcuuggauaccaaguggauccgcggucugccagauuucaggagcugcuccaggaccuggagaagaaggaacgcaaacggcuuaaggaggaaaaacagaagcgcaaaaaggaggccagagcugcggcccuggcugccgccguugcucaagauccugccgcgagcggcgcucccuccagcuga

SEQ ID NO: 69586 - RNA, 1566 nt, Artificial Sequence
  derived and/or modified sequence opt5 from GADL1__Homo_sapiens__NP_997242
augagcuccgacucugauagacagugccccguggacggcgauaucgaccaacaggagaugauuccuagcaagaaaaacgccguccugguugaugggguggugcucaauggaccgaccacagacgcuaaggccggcgaaaaauucgucgaggaagcgugucggcugaucauggaggaagugguucuuaaggcuacggaugugaacgagaaagucugcgaguggagacccccugaacagcugaagcagcuccuggaccuugagaugcgcgauuccggggaacccccucacaagcugcucgagcugugucgggacgugauucauuacucuguuaaaaccaaucacccccgcuuuuucaaccaacuguaugccggacucgauuacuauagccugguggccagauuuaugacagaggcucuuaauccuuccgucuacaccuaugaagugucuccgguguuccugcucgucgaggaagccguucugaagaaaaugaucgaguuuauuggcuggaaggaaggggacggaaucuucaaccccggcggcagcguguccaauauguacgcuaugaaccuugcccgguauaaauacugcccugauaucaaggagaaggggcugagcggaucuccccgccucauucuguuuacauccgcggagugucauuacagcaugaaaaaggccgcuucuuuccugggcaucgggaccgaaaaugugugcuuugucgagacagacggaagaggcaaaaugauuccugaggaacucgaaaaacagguguggcaggcccggaaggagggggcugcccccuuccugguuugugcgaccuccggaacgaccgugcuuggcgccuuugacccgcuggaugagaucgcugacauuugcgaacgccacagccucuggcugcaugucgaugccucuuggggcggguccgcucuuaugagcagaaagcaccggaaacugcuccacggaauccaucgcgccgacuccguggccuggaacccucacaagaugcugauggcuggcauucaguguugcgcgcugcucguuaaggauaaaucugaccugcuuaagaaauguuauagcgccaaggcuuccuaccuguuccaacaggauaaauuuuaugacgugagcuacgauacaggggacaagucuauccagugcuccagacggcccgaugccuucaaguucuggaugaccuggaaagcccucggaacacugggccuugaggaacgcgucaauagagcucuggcccucagccgguaucugguggacgagaucaagaaaagagaaggguuuaagcugcucauggagccugaguacgcgaacauuugcuucugguauaucccucccucucugcgcgaaauggaggaaggacccgaguuuugggcuaaacuuaaucuggucgccccggccauuaaggagcggaugaugaagaaaggcagccucaugcugggcuaccagccccauagagggaaggugaacuucuuucgccaaguugugaucuccccucaggucucucgggaagacauggauuuccugcuugacgagauugaucuccugggaaaagacauguga

SEQ ID NO: 69587 - RNA, 351 nt, Artificial Sequence
  derived and/or modified sequence opt5 from GAGE10__Homo_sapiens__NP_001091883
augagcuggagaggccgguccaccuaccgccccagaccucggcgcuauguggagccgcccgaaaugaucgggccuaugcugcccgagcaguucucugacgaagucgagccugccacacccgaagagggagagccugcuacgcaaagacaggauccggccgcggcucaggaaggcgaggacgaaggggccagcgccggacagggccccaagccugaggcugauucccaagagcagguucaccccaaaaccgggugcgaauguggagacggcccugauggccaggagauggggcuccccaacccggaagaggugaagcggccugaagagggagagaaacagucucaaugcuga

SEQ ID NO: 69588 - RNA, 354 nt, Artificial Sequence
  derived and/or modified sequence opt5 from GAGE1__Homo_sapiens__NP_001035753
augagcuggagaggccgguccaccuacuauuggccccgcccuagacgguacgugcagccgcccgagaugaucgggccuaugcgccccgaacaauucucugacgaggucgaaccugccacacccgaggaaggagagccugcuacgcagagacaggacccggccgcggcucaggagggcgaagacgagggggccagcgccggacaaggccccaagccugaagcugauucccaggagcaggggcacccccagaccggaugcgagugugaagacggcccugauggccaagagauggaucccccgaacccugaagagguuaaaacacccgaagagggggagggacagucucagugcuga

SEQ ID NO: 69589 - RNA, 3936 nt, Artificial Sequence
  derived and/or modified sequence opt5 from GAK__Homo_sapiens__NP_005246
augagccugcuccaguccgcccuggacuuccuugcuggccccgggucucugggaggcgccagcgggagagaucaauccgacuuugugggacagaccgucgagcucggcgaacugcggcuucgcguuagacgggugcuggcggaagggggauucgcuuuuguguacgaagcccaggaugucggcucuggccgcgaguaugcccucaagagacugcugagcaacgaagaggagaaaaaucgggcuaucauucaggaagugugcuucaugaagaaacucuccgggcacccuaacaucguucaauuuuguucugccgcuagcauuggaaaggaggaauccgacacaggccaggccgaguuccugcuucugacggagcucugcaaagggcagcugguggaauuucuuaagaagauggagagccgcggaccgcugucuugugauaccguccucaaaaucuucuaccagacaugcagagcggugcaacauaugcaccggcagaagcccccuauuauccaucgcgaccugaaaguugaaaaucugcuccuguccaaccagggcaccaucaagcugugugauuuugggagcgccacaaccauuucucacuaucccgacuacuccuggagcgcucagagacgggcccugguggaggaagagaucacacgcaauaccacgccuauguauagaacccccgagauuaucgaucucuacucuaacuucccuauuggagaaaaacaagacaucugggcucugggcugcauucuuuaucugcucuguuuucggcagcauccguucgaggauggcgccaagcugcgcaucgucaaugggaaguacuccauucccccucacgacacacaguacaccguguuucacagccugaucagagcgaugcuccaagugaaccccgaagaacggcuguccaucgccgaagucguucaucagcuucaggagauugcugccgcuagaaaugugaacccuaaaucucccaucacagagcugcucgaacagaauggaggcuaugggagcgccacccugucccgcggaccgccucccccugugggccccgccgggagcggauacucuggcggccuugcucuggcggaguaugaucaacccuacgggggauuccucgacauucugcggggcgggacggaaagacuguucacaaaccucaaggacaccuccagcaaagucauccagucuguggccaauuaugcuaagggagaucuggacaucagcuacauuacaucccgcaucgccguuaugucuuuuccugccgagggcguggaaagcgcucuuaaaaacaauauugaggauguccggcuguuccucgacuccaagcacccggggcauuaugccguguacaaccugagccccagaaccuaccgcccuucucgguuucacaacagaguuuccgagugcggcugggcggcucgccgggcuccccaccuucauacccuuuauaauaucuguagaaacaugcacgccuggcuccgccaggaucauaaaaaugugugcgucgugcacuguauggacggacgggccgccagcgcugucgccgugugcucuuuccugugcuuuuguagacuguucuccacagcggaagccgcuguuuacauguuuagcaugaagcggugcccucccggcauuuggccgucccauaagcgcuauaucgaguacaugugugauaugguggccgaggagccuaucacgccccacucuaaaccuauucucgucagagcugugguuaugacccccgugccucuguucagcaagcagcgguccgggugcagacccuuuugugaggucuaugugggagacgaacgcguggccucuacaagccaagaguacgauaaaaugcgggacuucaagaucgaagauggcaaagcgguuauuccgcuuggggucaccgugcagggagacgugcugaucgucauuuaucacgccagauccacacucggcgggcgccugcaggcuaagauggccagcaugaagauguuucagauccaauuccauaccggcuuugugccuagaaacgcuacgacaguuaaauucgccaaguacgaccuggaugccugcgacauucaggagaaauaccccgaucuuuuccaggugaaucucgaagucgagguggagccccgggaccgcccuucuagagaagcuccgcccugggagaacuccagcaugcggggacugaauccuaagauccuguuuucuucccgcgaggagcagcaagauauccucagcaaauucggcaagcccgaacugccuagacagcccgggucuaccgcgcaguaugacgccggagcuggcagcccugaggccgagcccaccgauuccgacagcccgccuucuuccagcgccgaugcuucccgguuucuucacacacuggacuggcaagaagagaaggaagccgagaccggggcggaaaacgcuucuagcaaagaguccgagucugcccucauggaagaucgcgacgagagcgaaguuuccgaugagggaggcucucccauuagcuccgaggggcaggaaccuagagccgaccccgagccgccuggccuggcugccggacuggugcagcaggaccuugucuucgaaguggagacacccgcgguucucccugaacccgugccccaagaggauggcgucgaccugcuggggcuccauagcgaggugggagcuggcccugccgugccgccccaggccuguaaggcuccuucuuccaauacggaucugcuuagcugccugcucgggcccccugaagccgcuucucagggacccccugaggaccugcuguccgaagauccgcuucuccuggccagccccgcgccuccccugucuguccaguccaccccucggggcgggcccccggccgcugccgacccuuuuggcccccuccugcccagcuccggaaacaauagccaaccuuguucuaaccccgaucuuuucggcgaguuucugaauagcgacuccguuacagugccuccgucuuuccccagcgcucacuccgccccucccccuucuugcagcgccgauuuucuccaccugggggaccugcccggagaaccguccaaaaugaccgcuucuagcuccaacccugaucuucugggcgggugggcggccuggacagagaccgcugccagcgccguggcucccacgccugccaccgagggaccccucuucucuccuggcggccagcccgcgccgugugggucccaggcuagcuggacaaagucucagaauccugaccccuuugccgaucugggagaccucuccagcggccugcaagggucccccgccggauucccuccgggcggguuuauccccaaaaccgcuacaaccccuaagggaucuagcuccuggcagacgagcagacccccugcccagggcgcgucuuggcccccucaagcuaagccgcccccuaaagccugcacacagccccgcccuaacuacgccuccaacuucagcgucauuggcgcucgggaagagagaggggugcgcgcccccucuuucgcucagaagccgaaaguuagcgaaaaugacuuugaggaucuucuguccaaccagggauucucuagccgguccgacaagaaaggcccuaagaccaucgccgaaaugagaaaacaagaucucgcgaaggacacagauccccugaagcugaaacuucuggacuggauugaggggaaggagcgcaauauccgggcccuccugucuacccuccauaccgugcugugggauggagaaagcagauggacacccgucggcauggcugaccuuguggccccugagcagguuaaaaagcacuaucgccgggcugugcuggccguccaucccgauaaagccgcugggcagccuuacgaacagcacgcgaagaugaucuuuauggagcucaacgacgccugguccgaguucgaaaaucaaggaagcagaccgcuguuuuga

SEQ ID NO: 69590 - RNA, 2058 nt, Artificial Sequence
  derived and/or modified sequence opt5 from GALC__Homo_sapiens__NP_000144
auggccgaguggcugcucagcgcuuccuggcagagacgggccaaggcgaugaccgcugccgccggcucugcugggcgcgccgcugugccccugcuucugugcgcccuccuggcgccuggaggcgccuacguccuugacgauagcgacgggcugggaagagaguucgauggcaucggggcuguuuccggaggcggcgccacaucucggcuccuggugaacuauccggagcccuaccgcagccaaauucuggacuaucucuuuaaaccuaauuucggggcuucccugcacauccuuaagguggaaauuggaggcgaugggcagacgaccgacggaacagagcccucucauaugcacuacgcccuggaugaaaacuauuuuagaggcuacgagugguggcucaugaaagaggcgaagaaacggaauccuaacaucacccugauugggcuucccuggagcuucccuggauggcugggcaagggcuuugacuggccguaugucaaucuccagcugacagccuacuacgugguuaccuggaucgugggggcuaagcgcuaucaugaucuggacaucgauuacauuggaaucuggaacgaaagauccuauaaugccaacuacauuaaaauccuccggaagaugcugaauuaucagggccuucaacgcgucaaaauuaucgcuagcgacaaccugugggagucuauuuccgccagcaugcuccuggaugccgaacuuuucaaggugguugacgugaucggggcucacuaccccggaacacauucugcgaaagacgccaagcugaccggcaagaaacucugguccagcgaggauuuuucuacgcucaauuccgacaugggggcuggauguuggggcagaauccugaaccagaauuauauuaacggcuacaugaccagcacaaucgccuggaaucuggucgccuccuacuaugagcagcugccuuacgggcggugcggacuuaugaccgcucaggaacccuggucuggccacuaugugguggagagcccugucuggguuuccgcccacacaacccaauucacgcagcccgggugguacuaucugaagacagugggacaucucgaaaaaggcgggagcuacguggcgcugaccgauggccuuggaaaccugacaauuaucauugagaccaugucucacaagcauuccaaauguauccgcccguuucucccuuauuucaacgucagccagcaguuugcuaccuucgugcugaagggcucuuuuagcgaaauccccgagcugcaaguuugguacacaaaacucgggaagacguccgagagauuccuguucaagcagcuugacucucuguggcuccuggauagcgacggauccuuuacccugagccuucacgaagaugaacucuucacacugaccacacugaccacgggccggaaagggucuuacccucucccucccaagucccagcccuuuccgagcacauauaaagacgauuucaauguggacuaccccuuuuucucugaagccccuaacuuugccgaucaaaccggagucuucgaguauuuuaccaauauugaagaccccggcgagcaccauuucacacugcgccaggugcuuaaccagagaccuaucaccugggcugccgacgcuuccaauacaauuagcaucauuggggauuacaacuggacgaaucugaccaucaagugcgacguuuauaucgagacacccgauaccggcggaguguuuauugccggccgggucaacaaagggggaauccucauuagauccgcgcgcggcaucuucuuuuggauuuucgccaaugggucuuaccgggugacaggagaccuggcuggcuggaucauuuaugcccuggggagagucgaagugaccgcuaagaagugguacacgcuuacccucacaaucaaaggccacuucaccagcggaaugcugaacgauaagucccuguggacagacaucccgguuaauuuuccuaaaaacggcugggccgcgauugggacccauucuuucgaguuugcccaguucgauaauuuucucguggaagcuacgcgcuga

SEQ ID NO: 69591 - RNA, 372 nt, Artificial Sequence
  derived and/or modified sequence opt5 from GAL__Homo_sapiens__NP_057057
auggccagaggcagcgcucugcuccuggccucccuucugcucgcggcugcccugucugccagcgcugggcuuuggucccccgccaaggagaaacggggauggacccugaacucugcuggcuaccuccuggggccucacgccgugggaaaucaucgcagcuucuccgacaagaacggccugacaucuaaaagagaacuccggccggaggaugacaugaagcccgggagcuuugaucgcuccaucccugaaaauaacauuaugagaacgaucauugaguuccugagcuuucuucaccugaaagaagcgggagcccucgaccggcugcuugaucugcccgcugccgcuucuuccgaggacaucgagcgcagcuga

SEQ ID NO: 69592 - RNA, 1179 nt, Artificial Sequence
  derived and/or modified sequence opt5 from GALK1__Homo_sapiens__NP_000145
auggccgcucugagacagccccaaguggccgagcuccuggcggaagcucggcgcgccuucagagaggaauuuggcgccgagccugaacuugcugucagcgccccggggcggguuaaccugaucggagagcacaccgacuacaaucagggccucgugcugcccauggcucuugagcugaugacagugcucgucggguccccucgcaaggauggacuggugucucugcucacgaccagcgaaggcgccgacgagccccagagacugcaguucccucuucccacagcgcaacggucccuggaaccugggaccccgcgcugggccaacuauguuaaaggagugauucaguacuaucccgcugccccucuccccggcuuuucugcugucgugguuagcuccgugccucugggcgggggacuuucuagcuccgccagccuggaggucgcgacauacaccuuccuccagcagcugugccccgauucuggcacaaucgccgcuagagcccaagugugucagcaggcugagcauuccuuugccgggaugccgugcggaauuauggaccaguucaucagccugaugggccaaaaggggcacgcccuccugauugauugucggucucuugaaaccucccuggugccucucagcgaccccaaacuggcuguccuuaucaccaauucuaacguucgccauucccuggcgagcuccgaguauccugugagacggcgccagugcgaagagguggccagagcucucggaaaggaaucucugcgggagguccagcuggaggaacucgaggccgcccgcgaucuggugagcaaagaaggcuuuagacgggcuagacacguugugggcgagauccgccggacggcccaagcggcugccgcccuuagacgcggggacuaccgggcuuucggaagacugauggucgaaucccaucgcagccuccgggaugacuaugaggugucuugucccgagcuggaucagcuuguugaagccgcucuggccgugcccggcgucuacggguccagaaugacaggaggcggguuuggaggcugcaccgugacacuccuggaggcgagcgccgcuccucacgccaugcgccacauucaggaacauuacggcgggaccgcuacguucuaucugucucaggccgcggacggagccaagguccucugucuguga

SEQ ID NO: 69593 - RNA, 1344 nt, Artificial Sequence
  derived and/or modified sequence opt5 from GALK2__Homo_sapiens__NP_001001556
augcccgugcuguacgacagacuccugaaacuuaaagagauguucaacagcaaguuuggcuccaucccuaaauucuauguccgggccccggggcgcguuaauauuaucggagaacacauugauuacugcggcuauucugugcugcccauggcuguggagcaggacguccucaucgccguggaaccuguuaagaccuacgcgcugcaacuugcuaacacaaauccccuguauccugauuuuagcacguccgccaacaauauucagaucgacaaaaccaagccccucuggcauaacuacuuccugugugggcugaagggaauccaggagcacuuuggccucucuaaucugacagggaugaacugccuuguggauggaaauauuccuccgagcuccggccugucuagcuccagcgcccucgucuguugcgcuggccuggugacccuuacaguucuggggagaaaccucucuaaaguggaacuggccgagaucugugcuaaguccgagcgguauauuggaaccgaaggcgggggaauggaccagagcaucucuuuccuggccgaggaaggcacagcgaaacucauugaguuuagcccccugcgcgccaccgaugucaaacuuccuuccggggcuguguucgugaucgccaauucuugcgucgagaugaacaaggcugccacgucccauuuuaauauuagaguuauggaaugucggcuggcggccaagcuccuggcuaaguacaaaagccuucaaugggacaaggugcugcgccucgaggaagugcaggccaaacugggaaucucccuggaggaaaugcuccuggucaccgaggaugcccuucaccccgagccuuacaaccccgaagagaucugcagaugucugggcauuucucucgaggaacugcggacacagauccuuagcccgaauacccaggacgugcugauuuucaagcucuaucaacgcgcuaaacauguuuacuccgaagccgcuagagugcugcaguuuaagaaaaucugcgaggaggcgccugaaaacaugguccagcugcucggcgagcugaugaaccagagccacaugucuugucgggauauguaugaaugcuccugccccgagcuugaccaacugguggauauuugucgcaaguucggggcccagggaagcagacucacaggcgcuggguggggaggcugcaccguuucuauggugccugccgacaagcugcccagcuuucuggccaauguccacaaggcuuacuaucagcgguccgacgggucucuugcccccgaaaagcaaagccucuucgcgacgaaaccuggaggcggcgcucuggugcugcucgaggccuga

SEQ ID NO: 69594 - RNA, 1029 nt, Artificial Sequence
  derived and/or modified sequence opt5 from GALM__Homo_sapiens__NP_620156
auggccagcgugaccagagcugucuucggcgagcugcccuccgggggaggcacaguugaaaaguuucagcuccaaucugaccugcuucggguggauaucauuagcugggggugcacgaucaccgcccuggaggugaaagaccgccagggacgggcguccgaugucgugcucggcuucgcugaacuggagggguaccuucagaagcagccuuauuuuggagccguuauuggccggguggccaaccgcaucgcuaaaggcacauucaaggucgacgggaaagaauaccaccuggccauuaauaaggagccgaacucucuccauggaggcgugagaggguuugauaagguucuguggacccccagagugcugagcaauggaguccaauucucccgcaucucuccugacggcgaggaaggguaucccggagagcucaaagugugggugacauacacccuggauggcggcgaacuuaucgucaacuauagagcucaggccagccaggcgacaccuguuaaucugaccaaccacuccuacuuuaaucucgccgggcaggcuagccccaacauuaaugaccaugaggugacgaucgaggccgauaccuaucugccuguggacgaaacacuuauuccgaccggagaggucgcucccgugcaaggcacagccuucgaucugcggaagccuguugaacucgggaaacaucugcaggacuuucaccugaacggauucgaucacaauuuuugucucaagggcucuaaagagaagcacuucugcgcgcgcgugcaucacgccgcuuccgggagaguccuggaaguguacaccacgcagcccggaguucaguuuuacacaggcaacuuccuugacggcacccugaaggggaaaaauggagccguguauccuaagcauagcggcuucugucucgagacacaaaacuggcccgacgcugucaaucagccgcgguuuccucccgugcugcuucgcccuggggaggaauacgaucacaccaccugguucaaauuuucugucgccuga

SEQ ID NO: 69595 - RNA, 1569 nt, Artificial Sequence
  derived and/or modified sequence opt5 from GALNS__Homo_sapiens__NP_000503
auggccgcuguggucgccgcgaccagaugguggcagcugcuccugguucuuagcgcugccggcaugggggccuccggagcuccccaaccuccgaacauccugcuccugcuuauggacgauaugggcuggggagaccuggggguguacggcgagcccucucgggaaacaccuaaucucgaucgcauggccgcugaggggcugcuguuccccaacuuuuauagcgccaauccucucugcucccccucuagagcggcccugcuuacgggacggcugccuauucgcaacggcuucuacaccacaaaugcucacgccagaaacgcuuauaccccgcaggaaaucgugggcgggauucccgacagcgagcagcuccugccugaacuucugaagaaagccggauacgucuccaagaucgugggcaaauggcaucucgggcaccggccccaguuucauccucugaagcacggauucgaugagugguuuggcucucccaauugucauuucgggccguaugacaacaaagcgcgcccuaauauucccguuuacagagauugggagauggugggacgguauuacgaagaguuuccuaucaaccugaagacaggcgaagccaaucucacccaaaucuaccugcaggaggcucuugacuucauuaagcgccaggccagacaccaccccuuuuuccuguauugggcugucgaugccacacaugcccccguguacgcuagcaaaccuuuucucggcaccucccagcgggggcgcuauggagacgcgguuagagagaucgaugacagcauuggcaagauccuggaacuucugcaagaucuccacguggccgacaacacguucgucuuuuucaccucugacaauggggcugcccugauuuccgccccggagcagggaggcagcaacgggcccuuccugugcggaaaacagacaaccuuugaaggcggcaugcgggagccugcucucgccugguggcccgggcaugugacagcgggacaggugucucaccaacugggcuccaucauggaucuuuucaccacgagccuggcucucgccgggcugacaccucccucugaccgcgccauugauggacuuaaucugcucccgacccugcugcagggcagacucauggaccggccuaucuuuuacuauagaggggauacacugauggcugccacccuuggccagcacaaggcucauuucuggaccuggacaaacuccugggaaaacuuucgccaaggaaucgacuucugucccggccagaaugucagcgggguuacgacccacaaccuggaggaucauacaaaacucccucugauuuuucaccugggacgggaccccggcgagagauucccucuuuccuuugccucugcggaauaccaggaggcccucagccgcaucaccuccguggugcagcaacaucaggaagcucugguccccgcccagccgcagcugaaugugugcaacugggcuguuaugaauugggccccucccgggugugagaagcucggaaagugccugacacccccugaaagcauuccgaaaaagugucuuuggucucacuga

SEQ ID NO: 69596 - RNA, 1746 nt, Artificial Sequence
  derived and/or modified sequence opt5 from GALNT12__Homo_sapiens__NP_078918
auguggggcagaaccgcccggcgcagaugcccccgggagcugcgcagagggcgggaagcucuccuggugcuucuggcccuccuggcgcuugcuggacugggcagcguccuccgcgcccagagaggggccggagcuggcgccgcugagccugggccgccccggacaccucgccccggaagacgggaaccuguuaugccccgcccuccggugcccgccaacgcgcugggcgccagaggcgaggcugugcggcugcaacuccagggggaagaacugcgccuucaggaggaauccgucagacugcaccagaucaauauuuaccucucugaccggaucagccugcauagacgccuuccugagcgguggaacccccuguguaaggagaaaaaguaugauuacgacaaucucccuagaacguccgugauuaucgccuucuauaacgaggcuuggucuacccugcugcgcacaguuuacagcgugcucgagaccucccccgauauucugcuugaagaggucauccugguggacgauuauucugaccgggaacaccucaaagagagacuggccaaugaacuuagcggacugccgaagguucgccucauccgggcgaacaaaagagagggccuggugcgcgcccggcugcucggggcuuccgccgcuagaggagauguccugacauuucuugacugccauugugagugccacgaaggcuggcuggagccucuccugcaacgcauucaugaagaggaaagcgccguggugugucccgucaucgauguuauugacuggaauaccuucgaguaccuugggaacucuggagagccucagaucggcggcuuugauuggcggcugguguucacauggcacaccgugcccgaaagagagcggauucgcaugcagucccccgucgacgugaucagaagcccuacgauggccgggggacucuuugcuguuucuaagaaguauuucgaauaccugggcuccuacgauaccgggauggagguguggggaggcgaaaaucuggaguuuagcuuccggauuuggcagugcgggggaguccucgagacacacccguguucucaugugggccacguuuuucccaaacaagcgccuuauuccagaaacaaggcccuggcuaauagcgugcgcgccgccgaagucuggauggacgaguucaaagaacuuuacuaucaucggaaccccagagcucgccuggagccuuuuggcgacgugaccgagagaaagcagcuccgggauaaacugcagugcaaggacuucaagugguuucuggaaacagucuaccccgagcuucacgugccggaagaucgcccuggguucuucggaaugcuccagaauaaaggccugaccgacuauuguuuugauuacaaucccccugacgagaaccaaaucguugggcaccaggugauccuguaucucugccauggaaugggccagaaccaauucuuugaauacacgucccagaaggagauuagauacaacacacaccagcccgagggguguaucgccgucgaagcgggcauggauacccugauuaugcaucuuugcgaggaaacagcuccugagaaucagaaauucauccugcaagaagacggaucucucuuucacgagcagagcaagaaaugcgugcaggccgcccggaaggaguccagcgauucuuucguuccccugcugcgcgacuguaccaacuccgaucaucagaaaugguuuuucaaggaaagaaugcuuuga

SEQ ID NO: 69597 - RNA, 1686 nt, Artificial Sequence
  derived and/or modified sequence opt5 from GALNT13__Homo_sapiens__NP_001288556
augagacgguucguguacugcaaggucguucuggccaccagccucaugugggugcugguggacgucuuucuucugcucuauuucuccgaguguaacaaaugcgaugacaagaaagaacgcucucugcuucccgcucugagagccgugaucagccggaaucaggagggcccuggggaaaugggaaaggcgguucucauuccgaaagaugaccaagagaagaugaaggaacuguuuaaaaucaaccaguucaaucugauggcuuccgaucucauugcccugaaccgcucucuucccgacgugagacuggagggcuguaagacaaaagucuacccugaugagcuccccaauacgagcgugguuaucguguuucacaacgaagccugguccacccugcuucggacagucuauucugugauuaaucgcagcccucauuaccugcucuccgaggugauccuggucgacgaugcuagcgaaagagacuuccugaagcucacccuggagaacuauguuaaaaaucuugaggugcccgugaagaucauucggauggaggaacgcucugggcugaucagagcccggcuccgcggagcugccgcguccaagggccaggucauuacauuucuggaugcccacugcgaauguacccuuggguggcuggagccucuccuggcuagaaucaaagaagaccggaagacagugguuugcccgauuaucgaugugauuagcgacgacaccuucgaguacauggccggaucugauaugacguauggcggcuuuaacuggaaacugaauuuccgcugguaccccgucccucagagagagauggaccggagaaagggggaucgcacccuccccgugcggacaccuaccauggcuggaggccuguuuuccaucgacagaaacuacuucgaagagaucgggacauaugaugccggaauggacauuuggggcggggaaaaucuugagaugagcuuucgcaucuggcaauguggaggcucucuggaaauuguuaccugcucccaugugggccacgucuuccggaaagcgacgcccuacacauucccugggggaaccggccaugugaucaacaagaauaacagacgccucgccgaggucuggauggaugaguuuaaagacuucuuuuauauuaucagcccgggggugguuaagguggauuacggagacgucuccgugcggaagacacugagagaaaaccuuaaauguaagcccuucucuugguaucuggagaauaucuacccugauagccagauuccccgccgguauuacucccucggcgaaaucagaaacguugagaccaaucagugccuggacaacauggggcgcaaagaaaaugagaaggugggaauuuuuaacugucacggcaugggcgggaaucaggucuucagcuacaccgcugacaaagagauccggacagaugaccugugccucgaugugucuagacugaacggacccgugauuaugcuuaagugccaccauaugcggggcaaucaacugugggaauaugacgccgaguccugucucagcguuaacaaggucgcugaugggucucagcacccuacgguggaaaccugcaaugacagcacacugcagaaauggcugcuucgcaacuacaccagaauggagaucuuucggaauaucuucggaaacuccacagauuauauucucuga

SEQ ID NO: 69598 - RNA, 1674 nt, Artificial Sequence
  derived and/or modified sequence opt5 from GALNT14__Homo_sapiens__NP_001240755
augagacggcugacccgcagacucgugcugcccgucuucggcguucuuuggaucacagugcugcucuuuuucugggugacgaagcggaaacuggaggucccuaccgggccggaagugcagacacccaagguuuggagccucuuuuucaaaguggccggaauguccccuugggcuccccaagucccugugucucccaccccuccguaccagcgcggccaucugcccacagggggacaccucgccguuugccacuuuccuugucugcugcaggaggcgcaguuccaucuccaaacccagguguuucugcaggucagaugcacacuucugguguauuguaccgaccuucccccuacgagcauuaucauuaccuuccacaacgaagcucgguccacacugcuucgcaccaucagaucugugcugaaucggacacccacccaucucauucgcgagaucauccuggucgaugacuuuagcaacgauccggacgauugcaagcagcugauuaaacucccuaagguuaagugucugagaaauaacgaacggcaaggccuugugcgcuccagaaucagaggggccgacauugcccagggaacgacacugaccuuccucgauucucacugcgaggugaaucgcgacuggcugcagccccuucugcacagagucaaagaggauuacacacgggugguuuguccugugaucgacauuaucaaccucgauaccuuuaccuauauugaaagcgcuuccgagcugagaggcggcuucgacuggagccugcauuuucagugggaacaacucucucccgagcagaaggcccgccggcuggaucccacagagccuaucagaacgccgaucauugcugggggacuuuucgucaucgacaaagccugguucgacuaccugggcaaguaugauauggacauggauauuuggggaggggaaaauuuugagaucuccuuccgcguguggaugugcggcgggagccucgaaauuguucccuguucucgggugggacacgucuuucggaaaaagcauccuuacguguuccccgacggcaacgcgaauaccuauaucaagaacacaaaacgcaccgccgaggucuggauggaugaauacaagcaguacuauuacgcugcccggccuuuugcucuggagagacccuucggcaauguggagucccgccuugaccugcggaaaaaccucagaugccagagcuuuaagugguaucuggaaaauaucuacccggagcugucuauuccuaaagaauccagcauccaaaaggggaacauucgccagcggcagaaaugucucgagucccaaagacagaauaaccaggaaacacccaaccugaaacuuucuccuugcgccaagguuaagggagaggaugccaagagccaggugugggcguucaccuauacgcaacagauccugcaggaggaacucugccuguccgucauuacacuguuucccggcgcuccugugguucuugugcucuguaaaaauggggacgaucggcagcaauggaccaagaccggaagccacaucgagcacaucgccucucaucugugccuggacacagauauguucggcgacgggaccgaaaacggaaaagagauugucgugaaucccugugaauccagccucaugucucagcacugggacauggugagcuccuga

SEQ ID NO: 69599 - RNA, 1920 nt, Artificial Sequence
  derived and/or modified sequence opt5 from GALNT15__Homo_sapiens__NP_473451
augcugcucagaaagcgguaccgccacagacccugccggcugcaguuccuucugcuccugcuuaugcugggcugugugcucaugauggucgccaugcugcauccuccgcaccauacccugcaccaaacaguuacggcucaggccagcaaacauucccccgaggcgcgcuauagacucgacuuuggggaaucucaggauugggugcuggaggcugaagacgagggagaagaguacagcccucuugagggccugcccccuuucaucucccuccgggaagaucagcugcuuguggccgucgcccugccccaagcucgcagaaaccagucucaggggcggcgcggaggcagcuauagacucauuaagcagccucggcgccaagacaaagaggccccgaagagagauuggggagcugacgaagauggggagguguccgaggaagaggaacugacccccuuuucucuggacccucggggccuccaggaggcccugagcgcgcgcaucccccuucagagagcccugccugaaguucggcacccccucugccugcagcaacacccgcaggauucccuuccuacagcuagcgugauucuguguuuccaugacgaggccuggucuacccuccugagaacaguccacuccauccuggauaccgugccccgcgcuuuucucaaagagauuauccugguugacgaucuuagccagcaaggccagcugaagucugcccucuccgaauacguggcgcggcuggagggggucaaacuucugagaagcaauaagcgccucggagccauccgggcuagaaugcugggcgccacacgcgcuaccggggacgugcugguguucauggacgcccauugcgaaugucacccuggauggcucgagccccugcuuucucggauugccggcgauagaucccgcgucguuagccccgugaucgacgugauugauuggaagacguuucaguauuacccuuccaaagaccugcagagagggguccucgauuggaagcuggacuuccacugggaaccgcugcccgagcaugugcggaaagcgcuucaaucuccuaucagccccauucgcuccccuguugugcccggagaggucguggcuauggaucggcacuauuuucagaacaccggcgccuacgacagccucaugucucugagaggcggggaaaaucuggagcucuccuucaaggcuuggcugugcggaggcagcguugaaauccuuccguguucucggguggggcauauuuaccagaaccaggauagccacuccccucuggaccaagaggccacacuccgcaauagaguccggaucgccgaaaccuggcugggaucuuuuaaggagacauucuauaaacauagccccgaggcuuuuucccugagcaaggccgaaaaaccugauugcauggagagacuucagcuccagcgccggcugggcuguagaaccuuccacugguuccuggcgaacguguaccccgaacucuauccuucugagccccgcccguccuuuagcgggaagcugcacaauacgggacuuggccugugcgcugacugucaggccgagggcgacauccucgggugcccuaugguccuggcccccugcucugauuccagacaacagcaguaccugcagcauacaagccggaaagaaauucacuucggaucuccccaacaucuuuguuuugcugugcgccaggagcagguuauccuccaaaacugcaccgaagagggccuggccauucaccagcagcacugggacuuccaggaaaaugggaugaucgugcauauucuguccggaaaguguauggaggcugucgugcaagagaacaauaaagaucucuaucugagaccuugcgacggcaaggcccggcagcaguggcgcuuugaucagaucaacgcgguugacgaaagauga

SEQ ID NO: 69600 - RNA, 1824 nt, Artificial Sequence
  derived and/or modified sequence opt5 from GALNT18__Homo_sapiens__NP_940918
auggugugcaccagaaagacaaaaacgcuggucagcaccuguguuauccucuccggcaugacaaacauuaucugccugcuuuacguggggugggugaccaauuauauugccucugucuacgugcggggacaggagcccgcuccugacaagaaacuggaagaggauaagggcgacacacucaaaaucauugaacgccuggaucaccuugagaacguuaucaagcaacauauccaggaagccccggcgaagcccgaggaggcugaagccgagccuuucaccgacagcucccuguuugcccacugggggcaggaacucucucccgagggaagacggguggcucugaaacaguuccaauauuacggcuauaaugccuaccugagcgaucgccucccucuggacagaccccuuccugaucugcggccguccgggugucgcaaccucucuuuucccgacagccugccugaggucuccauuguguucaucuuuguuaaugaagcucuuagcgugcugcucagaucuauucauuccgccauggagcggacacccccucaucugcugaaggaaaucauucucgucgaugacaacagcucuaaugaggaacugaaagagaaacuuaccgaguauguggauaaagugaacucccagaagcccggauucaucaaggucguucgccacagcaaacaggaaggccugauuagaucucggguguccggcuggcgcgcggccacggcuccgguggucgcccucuuugacgcucacguggaguucaauguugggugggccgaaccugugcugaccagaaucaaggagaaccggaaacgcaucauuagccccuccuuugauaauaucaaguacgacaacuucgaaauugaggaguacccucuugcggcccagggauuugacugggaacuguggugcagauaucucaauccucccaaggcuugguggaagcuggagaacucuacagcccccauccggagcccggcucugauuggcuguuucaucgucgauagacaauacuuucaggaaaucgggcuccuggacgagggaauggaaguguauggcggggagaauguugagcuugggauucgcguguggcagugcggcggcuccgucgaagugcugcccuguagccggaucgcccacauugagagagcccauaaaccuuacaccgaagaucucacagcucacguccgccggaacgcgcugagaguggccgagguuuggauggacgaguucaagucucauguguauauggcuuggaacaucccccaggaagauuccgggauugacaucggagauaucaccgcccgcaaggcccuucggaaacaacugcagugcaagacguucagaugguaccucgucagcguguauccugagaugcgcauguacucugacauuaucgcuuacggcguucugcagaauagccugaaaacagaucucugucuggaccaagggcccgauaccgaaaacgugccgauuauguauaucugccacggaaugacaccucagaaugucuacuauaccuccucucagcagauucacgugggcauccuuagccccaccguggacgacgaugacaaccggugucugguugaugucaauuccagaccucgccucauugagugcagcuacgccaaggcgaaacggaugaagcugcauuggcaauuuucucagggaggacccauccagaacagaaaguccaaacggugccuggaacuucaggagaauagcgaccucgaguucggcuuucaacuggugcugcagaaguguucuggccagcacugguccaucacaaacgugcuccgcagccuggcuuccuga

SEQ ID NO: 69601 - RNA, 1680 nt, Artificial Sequence
  derived and/or modified sequence opt5 from GALNT1__Homo_sapiens__XP_005258296
augagaaaguucgccuacugcaaagugguccuggcuaccagccucaucuggguucugcuugacauguuucugcuccuguauuucuccgaguguaacaagugcgaugagaaaaaggaacggggccuucccgccggggacgugcuggaaccugugcagaaaccgcacgagggacccggcgaaauggggaagccugucgugauucccaaggaggaucaagagaaaaugaaggaaauguuuaaaaucaaucaguucaaccucauggcgucugagaugauugcucugaaucgcagccugccugacguuagacucgaaggauguaagacaaaaguguaccccgauaaccugccuacgaccuccgucgugaucguuuuucauaaugaggccuggucuacacuucugcggaccgugcacagcgucauuaaccgcuccccgagacauaugaucgaggaaaucgugcucguggacgaugccucugagcgggacuuccugaagcgcccccuugaaagcuaugucaagaaacugaagguuccugugcacgugauuagaauggagcagcgguccggccucauccgcgcuagacugaaaggggccgcugucagcaagggacaggugauuacauuucuggaugcccauugcgaauguaccguuggcuggcucgagccccugcuugcgcggaucaaacacgaccgcagaacaguggucugcccuauuaucgaugugauuucugacgauaccuucgaguacauggccggcuccgacaugacguaugggggauuuaauuggaagcugaacuuccggugguaccccguuccgcaacgcgaaauggacagacggaaaggcgauagaacccucccugugcgcacacccaccauggcugggggacuguuuagcaucgaccgggauuauuuccaggagaucggcacauacgacgccgggauggauauuuggggaggcgaaaaucuugagaucucuuuuagaauuuggcaguguggcgggacccuggaaaucgucacgugcucccacgugggacaugucuuccgcaaggcuacaccuuacaccuuccccggcgggacaggacagauuaucaacaagaauaaccggagacucgccgagguguggauggacgaguuuaaaaauuucuuuuauaucauuagccccggcguuaccaagguggauuacggggacaucucuucccgcgucggacugcggcacaaacugcaauguaagccuuucagcugguaucucgaaaacauuuacccggauucccagauccccagacauuauuuuucucugggcgagauucgcaauguggaaaccaaccagugccuugacaacauggcgcggaaagagaaugaaaagguuggcaucuucaacugucacgggaugggaggcaaucagguguuuagcuacacagccaacaaggagaucagaacggaugaccugugccucgacgucuccaaacugaaugggccugugaccaugcuuaagugccaccaucugaaaggaaaccaacucugggaguaugaucccgugaagcugacacugcagcacguuaauagcaaccagugucucgacaaagcuaccgaagaggauucucaagucccuuccauucgcgacugcaauggcagccggucucagcaguggcugcuuagaaacgugacacugcccgaaaucuucuga

SEQ ID NO: 69602 - RNA, 1602 nt, Artificial Sequence
  derived and/or modified sequence opt5 from GALNT2__Homo_sapiens__NP_001278795
auggccgacagagaggauuggaacgaaaucgaccccauuaagaaaaaggaucugcaccauagcaauggcgaggaaaaagcucaguccauggagacccucccuccggggaaggugcgguggcccgacuucaaccaagaagccuacgucggaggcacaaugguucgcucugggcaggauccuuaugcgagaaauaaauuuaaccagguggagagcgacaagcugcggauggaucgcgcuauccccgacacgagacacgaucagugccaacggaagcaguggcgcguggaccuuccugccaccuccgucgugauuacauuccauaaugaggccagaucugcucugcuccggaccguugugagcguccugaaaaagucucccccucaccuuaucaaagaaauuauccugguggaugacuacuccaacgauccggaggacggagcccuccugggcaagaucgaaaaaguucgcgugcugagaaaugaccggcgcgaggggcucaugagaagccggguccgcggagcugaugccgcgcaggccaaggugcugacauuucuugacucccauugugagugcaacgaacacuggcuggagccccuccuggaaagaguggcugaggaucggaccagagucguuagcccuauuaucgacgugauuaauauggauaacuuccaguaugugggcgccucugcugaccuuaagggcggguuugauuggaaucuggucuucaaaugggacuacaugacacccgaacaacgccgguccagacagggaaacccuguggcccccaucaagaccccgaugauugcgggcgggcucuuuguuauggauaaauucuauuuugaggagcugggaaaguacgacaugaugauggauguguggggcggggaaaaucuggagaucagcuuccgcgucuggcaguguggaggcucucucgaaauuaucccuugcucccgggugggccacguuuuuagaaaacagcaucccuauacguucccugggggaagcggcaccguguuugcccgcaacacacggagagcugccgaggucuggauggacgaauacaagaauuucuacuaugcugccgugcccucugcccgcaacguccccuacgggaacauccaaucccggcuggagcuucgcaaaaagcugagcuguaagccuuucaaaugguaucucgagaauguguacccggaacugagaguucccgaccaccaggauauugcuuuuggagcgcuucagcaaggcaccaacugccuggacacacucgggcauuucgccgauggaguggucggcguguaugagugucacaaugcuggcgggaaccaggaaugggcccugaccaaggagaaauccguuaagcacauggaccugugccucacgguggucgaucgggccccuggaucucugaucaaacuucagggcuguagagaaaaugacagccggcagaagugggagcaaauugaggggaacuccaagcugcgccaugugggaagcaaucucugccuggauucuagaacagcuaaauccggcgggcuuagcguggaaguuuguggccccgcccugucucagcaguggaaguuuacccucaaccugcagcaauga

SEQ ID NO: 69603 - RNA, 1902 nt, Artificial Sequence
  derived and/or modified sequence opt5 from GALNT3__Homo_sapiens__NP_004473
auggcccaccugaagagacucgugaaacugcauaucaagcggcacuaccauaaaaaguucuggaaacuuggcgcugucaucuuuuucuuuauuauuguucuggugcucaugcagcgcgaggugagcguccaauauuccaaggaagagucuagaauggaacggaacaugaagaauaaaaacaagaugcuggaccuuaugcuggaggccgugaauaacaucaaagaugcgaugcccaagaugcagauuggggcuccuguucgccagaauaucgacgccggagaaagaccgugccuccagggcuacuauaccgccgcugagcugaaacccgugcuggaucggccuccccaagacagcaacgccccuggggcuuccggaaaggccuucaagacaacgaaucucucugucgaggaacagaaagagaaggaacgcggcgaggcgaaacacuguuuuaacgccuucgcuagcgauagaaucucccugcaucgggaccuugggcccgauacccgcccuccggagugcauugaacagaaguuuaaaagaugucccccucugcccacaaccucugugaucauuguuuuccacaaugaggccuggagcacacuccugcggaccgugcacuccguccuuuacagcucuccugcuauccugcucaaggaaauuauccugguggacgaugccuccguggacgaguaucugcaugauaaacucgacgaauacgucaagcaguuuagcauuguuaagaucgugcgccaaagagagcggaaaggacugaucacagcgcgccuucugggcgccaccguggcuacggccgagacccucacauuccuggaugcucacugcgaauguuuuuauggcuggcuugagccccugcucgccagaauugccgaaaacuacaccgcugucgugucuccggacaucgcguccauugaccugaauacauucgaguuuaacaagccuagccccuacgggucuaaucauaaccggggaaauuucgauuggucccugagcuucggcugggaaucccucccugaccacgagaaacagagacgcaaggaugagaccuaucccaucaaaacgcccacauuugccgggggacuguucucuauuagcaaggaauacuuugaguauaucggcuccuacgacgaagagauggaaaucuggggaggggagaacauugagaugagcuuccggguuuggcagugcggcggccagcuugaaaucaugccuuguucuguggucgggcacguguuuagauccaagagcccgcauucuuuccccaaaggaacccaaguuauugcucgcaaccaggugcggcuggccgaggucuggauggaugaauauaaggagaucuuuuacagacgcaauacagacgccgcuaaaauugugaagcagaaagccuucggcgaucucagcaagcgguuugagaucaagcacagacugcaaugcaaaaacuucaccugguaucuuaauaacaucuacccugaagucuacgugcccgaccugaauccuguuauuuccggguauaucaagucugugggacagccccucugucuggaugucggcgagaacaaucaagggggaaaaccgcugauuauguauaccugccauggccucggcgggaaccaguacuuugaauacagcgcgcagcacgagauccgccauaauauucagaaggaacugugucuucacgcugcccagggacuggugcagcucaaagccugcacauauaagggccacaagacgguugugaccggggagcaaaucugggagauucagaaagaccagcugcuguacaacccuuuccuuaagaugugccucuccgcuaauggagaacaucccagccuggucucuuguaacccuuccgauccccugcagaaauggauccucagccaaaaugacuga

SEQ ID NO: 69604 - RNA, 1737 nt, Artificial Sequence
  derived and/or modified sequence opt5 from GALNT4__Homo_sapiens__NP_003765
auggccgugagauggaccugggcuggcaagagcugccugcuccuggccuuccuuacagucgcguacaucuuuguugagcugcucguguccacguuccacgcuucugccggggccggacgggcucgcgaacugggcagcagacggcuuuccgaccugcagaaaaacaccgaggaucucucucgcccccuguauaagaaaccuccggccgacagcagagcucugggggaauggggaaaggccuccaaacuccaacugaaugaggaugaacuuaagcagcaggaggagcugauugaacgguacgcgaucaacauuuaucucucugaccgcaucagccugcauagacacauugaggauaagcggauguacgaauguaaaucccagaaguuuaauuaucgcacacuucccaccacaagcgugaucaucgccuucuacaacgaggcuuggucuacccugcucagaacaauucauuccguccuggagaccagcccugccgugcugcucaaagaaaucauucugguugacgaucuuucugaccggguguaucugaagacgcaacucgagaccuacaucuccaaucuggaucgcgucagacuuauucggacaaacaaacgcgaaggccuggugagagcucggcucaucggggccaccuuugcgacaggagacguucugaccuuccuggauugccacugugagugcaauagcggcuggcucgaaccccugcuugagagaauuggccgcgacgagacggccguggucuguccugugaucgauacaaucgacuggaacaccuuugaguucuacaugcagauuggggaacccaugaucggaggcuuugacuggcggcugacauuccaguggcauucugugccuaagcaggaaagagaucgccggauuuccagaaucgacccgauucgcagccccaccauggcugggggacucuuugccgucuccaagaaauauuuccaauaccugggcaccuaugauacagggauggagguuuggggaggcgaaaaucuugagcugucuuuucggguguggcagugcggcgggaagcucgagauccacccuuguagccacgugggacaugucuuccccaaaagagcuccuuacgcccgccccaacuuccugcagaauacggcccgggcugcggaaguguggauggacgaguauaaggaacacuuuuacaacagaaauccgccugcccgcaaagaggcuuauggcgauaucuccgaacggaagcugcucagagagcggcugcgcugcaagagcuucgacugguaccuuaaaaacguuuuucccaaucugcaugugccugaggauagacccggguggcacggagccauucggucuagaggcaucuccagcgaaugucucgacuacaacucucccgauaacaauccuaccggggccaaccugagccuguucggaugccacggccagggcgggaaucaauuuuucgaguauacauccaacaaggaaauucgcuuuaauucugucaccgagcuuugugcugaggugccggaacagaaaaacuacguuggaaugcagaauugccccaaggacggcuucccugugcccgccaacaucauuuggcauuuuaaagaggaugggacaaucuuccacccucauagcggacucugccuguccgcguaucggacccccgaaggcagaccggacguccaaaugcgcacgugugacgcucuggauaagaaucagaucuggagcuuugagaaauga

SEQ ID NO: 69605 - RNA, 2823 nt, Artificial Sequence
  derived and/or modified sequence opt5 from GALNT5__Homo_sapiens__NP_055383
augaacagaauccggaaguucuuucgcggcagcgggagagugcuggccuucauuuuugucgcuuccguuaucuggcuccuguucgacauggccgcgcuucggcugucuuuuagcgagauuaauacccgcgugaucaaagaagauauugugagacgggagcgcaucggauucagaguccagcccgaccaaggcaagaucuuuuacuccucuauuaaagaaaugaagccuccgcuccgggggcacggaaaaggcgcuugggggaaggagaacgugcgcaagacagaagagagcguucugaaaguggaggucgaucuugaccagacgcagagagaacggaagaugcagaaugcccugggacgcggcaaagugguuccccucuggcauccugcccaucugcaaacccugcccgugacaccuaacaagcagaaaaccgauggcagagggacaaagcccgaggcuuccucucaccagggaaccccuaagcagacaaccgcccaaggcgcuccgaaaacgagcuucaucgccgcgaaggggacccaggucgugaaaauuuccgugcacaugggacgggucagccucaagcaggaaccccgcaaaucucauuccccuagcucugacacauccaagcuggccgcugagagagaucuuaauguuaccaucagccugucuacagaccggcccaaacagagaucccaagccguggcuaacgagcgcgcccacccugcgagcaccgccgugcccaaguccggcgaagcuauggcccucaauaagacgaaaacacagucuaaggaggucaacgcuaauaaacacaaggccaacaccagccugccguuuccuaaauucacaguuaauuccaaccggcuuagaaagcagagcauuaaugaaacaccccuggggucucucuccaaggaugacggagcccgcggcgcucauggcaaaaagcugaacuuuagcgagucucaccuggugaucauuaccaaagaagaggagcaaaaggcggauccuaaagaagugagcaauuccaagaccaagacgaucuuccccaaaguccucgggaagucucagagcaaacauaucucccggaacagaagcgagaugucuuccagcucucuggcuccccaccgcgugccucuuucccagaccaaccacgcccugacaggaggccucgaaccggccaagauuaauaucaccgccaaagcucccagcacagaguauaaccagucccauauuaaggcccugcuuccugaagacucugggacccaccaaguucugcggaucgaugugacgcucagccccagagacccuaaggcgcccggacaguuuggccgcccggucguggucccucaugggaaagagaaggaggcugaacggagauggaaagagggaaauuucaacguguaccuguccgaccugauucccguugaucgcgccaucgaagacacacggccugccggcugcgcugagcagcucgugcacaauaaccugcccaccaccucugucaucauguguuucguggaugaaguuuggagcacacuucugagauccgugcauagcgucauuaaucggucuccuccccaccucaucaaggagauucugcuuguggacgauuuuuccaccaaagacuaucugaaggauaaccucgacaaauacaugagccaguucccgaaggugcgcauccugagacugaaggagcggcacggccucauuagagcccgccuggcuggggcccaaaaugcgacaggagauguucuuacguuucuggacucucaugucgaaugcaacgugggcuggcucgagccucugcuggaacggguguaucuuucccgcaaaaaggucgccugucccgugaucgagguuaucaaugauaaagacaugagcuacaugaccguggacaacuuccagagagggauuuuugucuggcccaugaauuucggauggagaacaaucccuccggaugugauugcuaagaaccggaucaaagagaccgacacaauucgcugccccguuauggccggcgggcucuuuucuaucgauaagagcuauuucuuugaacugggcaccuacgacccuggacuggauguguggggcggggagaauauggaacucuccuucaaggucuggauguguggaggcgagauugaaaucauccccugcagcagaguggggcacauuuuucggaacgacaacccuuacucuuuccccaaagaucgcaugaagacgguugagagaaaucuggugcgggucgcugagguguggcuugacgaauauaaagagcuguuuuacggacauggcgaucaccucaucgaccaggggcuggaugugggcaaccugacccagcaacgcgaacuuagaaagaaacucaaguguaaguccuucaaaugguaucuggagaaugucuucccugaccugcgggcccccauuguucgcgcgagcggagugcucaucaacguggcccugggcaagugcauuuccaucgaaaauacaaccgucauccuugaggauugugacgggucuaaagagcugcagcaguuuaacuacacauggcucagacugauuaagugcggagaaugguguaucgcuccgauuccugacaaaggcgccgugcggcugcaccccugcgauaauagaaacaaggggcuuaaguggcuccauaaaagcaccuccguuuuccacccugagcuggugaaucauaucgucuuugaaaacaaucagcaacugcucugccuggagggaaacuucucucagaagauucuuaaaguggcugccugugaccccguuaagccguaucagaaauggaaguuugaaaaauacuaugaggccuga

SEQ ID NO: 69606 - RNA, 1869 nt, Artificial Sequence
  derived and/or modified sequence opt5 from GALNT6__Homo_sapiens__XP_006719277
augagacugcuccggcgcagacacaugccccugcggcuugccauggugggcugcgcuuucguccuguuucucuuccugcuucaucgcgacguuagcuccagagaggaagccaccgagaagccuuggcugaaaucucucgugagccggaaggaucacgugcuggaccugaugcucgaagcgaugaacaaucugcgcgauuccaugccgaaacuucagaucagagcucccgaggcccaacagacacuguuuucuauuaaccagagcugucucccuggguucuacacgcccgccgaacugaagccuuuuugggagcggcccccucaggacccgaaugcucccggagccgauggcaaggcuuuccaaaaguccaaguggaccccucuugagacacaggaaaaagaggaaggguauaagaaacauugcuuuaacgccuucgcgucugaccgcaucagccugcagagaucccucggacccgauacccggccucccgagugugucgaccagaaguuucgcagaugcccgccucuggccacaaccagcgugauuaucguuuuccacaaugaggcuuggucuacacugcuccggaccguguacuccguccugcauacgacccccgccauucuucugaaagaaaucauccucguggaugacgcuagcacagaggaacaccugaaggagaaacuugaacaauauguuaaacagcuccaggugguccgcguggugagacaggaggagcggaagggccucauuaccgccagacugcugggggcgucugucgcccaagcugaaguucucacauuucuggaugcccacugugagugcuuccauggauggcuugaaccucugcucgcucgcaucgccgaggacaaaaccgugguggucucccccgauauugugacgaucgaccugaacacauuugaguucgccaagcccguucagcggggcagagugcacagccgcggcaauuucgacuggucucuuaccuuugggugggaaacacugccuccgcaugagaaacagcggagaaaggaugaaaccuaccccauuaaauccccuaccuucgcuggaggccucuuuagcaucuccaagucuuauuucgagcacauugggacauacgacaaccaaauggaaaucuggggaggcgagaaugucgaaaugagcuuucgcguguggcagugugggggacagcuggagaucauucccugcuccguugugggccacgucuuccggacgaaaagcccucauaccuuucccaaaggcacaucugugaucgcgagaaaccagguccgccuggccgagguguggauggauuccuauaagaaaauuuucuaccggagaaaucuccaagcugccaagauggcccaggaaaagagcuuuggggacaucucugagcgccugcagcuucgggaacagcugcacugucauaacuucagcugguaccuccacaauguuuauccggagauguuugugccugaucugacccccacauucuacggagcuauuaagaaccugggcaccaaucaaugccuugacgucggggagaacaacagaggaggcaagccucucaucauguauuccugucaugggcugggaggcaaucaguacuuugaauauacgacacagcgggaucugcgccacaacaucgccaaacagcucugccugcacgugucuaagggcgcgcuugggcugggaagcugccauuucaccggcaaaaauucccaaguucccaaggacgaggaaugggagcucgcucaggaucagcugauuagaaacagcgggucuggaaccugucugacaucccaggacaaaaagccugccauggcccccugcaauccgagcgauccucaccaacuuuggcuguucguguga

SEQ ID NO: 69607 - RNA, 1974 nt, Artificial Sequence
  derived and/or modified sequence opt5 from GALNT7__Homo_sapiens__NP_059119
augagacugaagaucggcuucauucuccggagccugcuuguggucggguccuuucugggacucguugugcuguggucuagccuuacaccccgcccugacgauccgucuccccuguccagaaugcgggaggaccgcgaugugaacgacccuaugcccaauagaggcgggaacggacucgccccuggcgaagaucgguucaaacccgucgugccuuggccgcacguugaggggguggaagucgaccuggagagcauccgcagaauuaauaaggcuaaaaacgaacaggagcaucacgccggaggcgauucccaaaaggacaucaugcagcggcaguaccugaccuuuaaaccccagacguucaccuaucaugauccugugcuccgccccggcauucuggggaauuuugagccuaaggaacccgagccgccuggaguugugggcgggcccggagaaaaggcgaaaccucuuguccugggccccgaguucaagcaagcuauccaggccucuaucaaagaguuuggguucaacaugguggccagcgacaugauuucccucgauagaagcgugaaugaccugcggcaggaagagugcaaguacuggcacuaugaugaaaaccuucugacaucuuccgucguuaucguguuucauaaugagggauggagcacccucaugcgcacagugcacucugucauuaaaagaacaccccggaaguaccuggcugaaaucgugcugauugacgacuucuccaacaaggagcaccucaaagagaagcuggaugaauauaucaaacuuuggaauggccugguuaagguguuucgcaacgagagacgggaaggccucauucaggccagaagcaucggggcucaaaaagccaagcugggacagguccuuaucuaccuggacgcgcauugugagguggccguuaauugguaugcuccucucguggccccgauuucuaaagaucgcaccaucugcaccgucccccugauugacgugaucaacggcaauacguacgaaauuaucccucaagggggaggcgaugaggacggguacgcucggggagccugggauugguccaugcuguggaagagagucccccucaccccucaggagaagcgccugcggaaaacaaagaccgaacccuauagaagcccggcgauggccggcggccuuuucgcuaucgagcgcgaauuuuucuucgagcuggggcucuacgacccuggacugcagauuuggggcggggaaaacuuugagaucuccuauaaaauuuggcaguguggaggcaaacuucuguucgugcccugcucucggguugggcacaucuacagacucgagggcuggcagggaaacccucccccuauuuaugugggcagcucccccacacugaagaauuacguccgcgugguugaaguguggugggaugaguauaaggacuacuuuuacgccagccggccggaaucucaagcucugccuuauggggauaucuccgagcucaagaaauucagagaggaccauaacuguaagagcuuuaaaugguucauggaagagaucgccuacgacauuaccucucacuauccccugcccccuaagaaugucgauuggggagaaauccgcggcuuugagacggccuacugcauugacagcauggggaaaacaaacggaggcuucguggaacuugggccgugucaccggaugggcggaaaucagcuguuuagaaucaacgaggcuaaucagcucaugcaguaugaucaaugccugaccaagggcgcggacggguccaaggugaugauuacacauuguaaccugaaugaguucaaagaauggcaguacuuuaagaaccuucaccgguucacccauauccccucuggaaaaugccucgaucgcagcgagguucugcaccaggucuuuauuuccaauugugacagcucuaagaccacacagaaaugggaaaugaacaauauccauuccguguga

SEQ ID NO: 69608 - RNA, 1914 nt, Artificial Sequence
  derived and/or modified sequence opt5 from GALNT8__Homo_sapiens__NP_059113
augauguucuggagaaagcugcccaaagcccucuuuaucggccugacccuugcuauugccgugaaccugcuccuggucuucagcuccaaggggacacuucagaaucuguuuacgggaggccuccaccgggagcugccucugcaucucaacaaacgcuacggggcgguuaucaagagacugucucaccuugaaguggagcugcaagaccucaaagaaagcaugaagcuggcccuucggcagcaggagaaugugaacuccacccugaagcgcgcuaaagaugaagucagaccgcuccugaaggccauggagacaaaagugaaugagaccaagaaacauaagacacagaugaagcuguucccccacucucaacucuuucggcaguggggagaagaccugagcgaggcucagcagaaagccgcucaagaucuuuuccgcaaguuuggcuauaacgccuaccuguccaaucagcucccucugaacagaaccauucccgacacacgggauuaucgcugccuuagaaaaaccuacccuucucagcugcccagccucuccguuauccugauuuucgugaaugaagcgcugagcaucauccagcgggccauuacgucuaucauuaaccgcaccccuuccagacuccugaaggagaucauucuugucgacgauuuuagcucuaauggggagcugaaagugcaucucgacgaaaagaucaaacuguauaaccaaaaguacccgggacuucugaagauuauccggcaccccgagcgcaaaggccucgcucaggccagaaauacaggcugggaagcugccaccgcggauguuguggccauccuggacgcucacauugaggucaacguggggugggccgaaccuauccuggcucggauucaggaggauagaacagugaucgucucccccguuuucgacaauauucgcuuugauaccuucaagcucgacaaauaugagcuggccguggacggauuuaacugggaacuuuggugucgguacgaugcccugccucaggcuuggaucgaccuccaugaugugacggcgcccgucaagagcccgucuaucaugggcauucuggccgcuaacagacacuuccugggggagaucggaucccuugacggcgggaugcucauuuacggaggcgaaaauguggagcugagccugcgcguuuggcaaugcggcgggaaaguggaaauccucccuuguucccggauugcccaucuggagagacaccacaagcccuaugcccuugaucugacagcugcccucaagcgcaacgcgcugcgggucgcugagaucuggauggacgaacauaaacacaugguguaccuggccuggaauaucccucuucagaacucuggaauugauuucggcgacguuagcuccagaauggcccuccgcgagaagcugaaaugcaagaccuuugauugguaucugaaaaauguguacccccuccugaagccccuucauacaaucgucggguauggacggaugaagaaccugcucgacgaaaaugugugucuggaucagggcccugucccggggaacacccccauuauguacuauugccacgaguucagcucucaaaauguguacuaccaucugaccggagaacuuuauguuggccagcucaucgcugaggccuccgcuagcgacagaugucugacagacccuggcaaagccgagaagcccacgcuggaaccuugcucuaaagcggccaagaaccgccuccacauuuacugggauuuuaaacccgggggagcugugaucaaucgggacaccaagagaugucuggagaugaagaaagaucuucugggcagccacguccucgugcugcagacaugcuccacccagguuugggaaauucaacauacagugcgggacugggggcagaccaacucucaguga

SEQ ID NO: 69609 - RNA, 1812 nt, Artificial Sequence
  derived and/or modified sequence opt5 from GALNT9__Homo_sapiens__NP_001116108
auggccguggcuagaaagauccggacccugcucacagucaacauucugguuuucgugggcaucgugcuuuuuagcgucuacugccgccugcaggggagaucccaagagcucgugcggauuguuucuggagaccgcagagugcggagccgccacgccaaagucggcacgcugggggauagagaagcgauccuucagcggcuggaccaucucgaggaagugguuuauaaucagcugaacggacuggcuaagcccauuggccucguggaggggccuggaggccugggccaagggggacuugccgccacccugcgcgaugacggccaggaagcugaggggaaauacgaggaauauggauacaaugcccagcucuccgauagaaucucucuggaccggagcaucccggauuaucgccccagaaagugucggcagauguccuacgcucaggaccuuccucaagucucugugguguucauuuuugucaacgaggcccugagcguuauccuccgcuccgugcacagcguggucaaucauacacccucucagcugcugaaagaagugauucucguugaugacaacuccgauaauguggagcugaaguucaaccuugaccaguaugucaauaagagauacccuggccuggugaaaaucguucggaacagcagacgcgaggggcucauucgggcgagacugcagggauggaaggccgcuaccgcccccguggucggcuuuuucgaugcucacguggaauuuaauacaggcugggccgagccugcgcuuucucgcauccgggaagacagacgccggauuguccugccggccaucgacaacaucaaauacuccaccuucgaggugcaacaguaugcuaaugccgcucauggguacaacuggggacucuggugcauguauauuaucccuccucaggauuggcuggacagaggcgaugaaagcgcccccauucgcacacccgccaugaucggguguucuuuuguuguggaccgggaguacuucggagauauuggccugcucgaccccgggauggaggucuauggaggcgaaaauguggagcugggcaugagaguuuggcaaugcgggggauccauggaagugcuuccguguagccgcgucgcucacaucgagcggaccagaaagccuuacaacaacgauaucgacuauuacgcgaaacggaaugcccugcgcgcugccgaaguguggauggaugacuuuaagucccacguguacauggccuggaacauucccaugucuaauccuggcguugauuucggggacgucagcgagagacucgcucugcggcagagacuuaagugccgcuccuuuaaaugguaucuggagaacguguaccccgaaaugcggguguauaauaacacgcucaccuacggagaggucagaaauagcaaggccucugcguauugucuggaccagggcgcugaagauggggaccgcgccauccuguaccccugccauggcauguccagccagcucgugagauauucugccgauggacugcuucaacugggcccucucgggagcacagcuuuccugccggacuccaaaugucugguugaugacggaaccggccggaugcccacacuuaagaaaugcgaggauguggcccgcccuacccagagacucugggacuucacgcagucugggcccauugucagccgggcuacaggacgcugucuggaaguggagauguccaaggaugccaacuuuggccugagacucguugugcagcggugcagcgggcaaaaauggaugauccgcaauuggauuaagcacgcgagacauuga

SEQ ID NO: 69610 - RNA, 1806 nt, Artificial Sequence
  derived and/or modified sequence opt5 from GALNTL6__Homo_sapiens__NP_001030017
augaagagaaaacagaagcgguuccugcaaaugacccuccuguuuacaguggcccuuaucuuccugcccaacgucggccucuggagccuguacaaagacaagcaccuuguuaaauccgcugagccuggggaacagcagacguuuccgcugggacucggcgaugggcaguucuauucuuggaccgacggacugcgcagaaaggauuggcaugacuacgagagcauucaaaaggaagccaugcgguccggcaaaggggagcacggaaagcccuauccucugacagaagaggaucaugacgauucugcguaccgcgagaauggcuuuaacaucuucgugagcaauaacauugcucucgaaagaucccugcccgacauccggcacgccaauugcaaacauaagauguaucuugagcgccugccuaacaccucuauuaucauccccuuucacaaugaaggcuggacaagccuccugagaaccauucacuccaucauuaaccggacaccugggagccuuaucgccgagauuauccugguggaugacuucucugagcgcgaacaucucaaagauaagcuggaggaauacauggcuagauuuuccaagguccggauugugcgcaccaaaaagagagagggacugauccggacgcgccuccugggcgccagcauggcuagaggggaaguucuuaccuuccuggacucucacugugaggugaaugucaacuggcucccgccccugcuuaaucagaucgcccugaaccauaaaacaauugugugcccuaugaucgauguuauugaccacaaucacuuuggauaugaggcgcaggccggcgacgcuaugagaggggccuucgauugggaaauguacuacaagcggauccccauuccucccgagcuccagcgcgcugacccguccgauccuuuugaaagccccgugauggccggaggccuguucgcggucgaccggaaaugguucugggagcugggcggguaugauccuggacucgaaaucuggggcggggagcaauacgagaucucuuuuaagguguggauguguggaggcgaaauguucgacgugcccugcuccagagucgggcauauuuaucgcaaauacguucccuauaaggugccuagcggaaccucccuggcccggaaccuuaagagaguggcugagacauggauggaugaauuugccgaguacaucuaucagcgccggccggaauacagacaccugucuaccggcgacauuagcgcucagaaagagcuccgcaagcagcugaaauguaaggauuucaaaugguuuauggccgccgucgcuugggacgugcccaaguacuauccucccguugagccucccccggcggccuggggcgaaauccggaauguggcugccaaccuuugcgucgauuccaagcauggggccacgggaacagagcugagacucgacauuugugugaaagacggcagcgaacgcaccuggucucacgagcaacuguucacauuuggguggcgggaggauaucagaccuggagaaccccugcauacccggaaguucugcuuugacgcuaucucccacaacagcccuguuacccucuacgauugucacggcaugaaagggaaucagcuguggggcuaucgcaaggacagaacacuuuuccaucccgugucuaacagcugcauggauuguaauccugccgagaaaaagauuuuuauggcgcggugcgacccccuguccgaaacgcagcaauggaucuucgagcacauuaacaugaccguccucgaaaaguuuaaucaucacgcuaacucuuga

SEQ ID NO: 69611 - RNA, 150 nt, Artificial Sequence
  derived and/or modified sequence opt5 from GALP__Homo_sapiens__NP_001139018
auggcucccccuagcgugccgcugguccuccugcuuguucugcuccugucccuugccgagacccccgccucugcgccugcucacagaagcuccacauuccccaagugggugacgaaaaccgaacggggccgccagccucugagaucuuga

SEQ ID NO: 69612 - RNA, 1050 nt, Artificial Sequence
  derived and/or modified sequence opt5 from GALR1__Homo_sapiens__NP_001471
auggagcuggccgugggcaaccucagcgaagggaaugcuuccuggcccgagcccccggcccccgaaccuggaccccuguucggcaucggggucgagaacuuuguuacccuugugguguucggacugauuuuugcgcucggcguccugggaaauucucuugugaucacaguucuggcuagaagcaagccugggaaaccccgguccacgaccaaccucuucauucugaaucugucuaucgccgaccucgccuaccugcuguuuugcauuccuuuccaggcuacaguguaugcccuuccgaccuggguccucggcgcuuuuaucuguaaguucauccacuacuuuuucacagugagcaugcugguuuccauuuuuacccuugccgcgaugucuguggaucgcuaugucgccaucgugcauagcagacgguccagcucucugcgcguguccagaaacgcucuccugggcgucgggugcauuugggcccugagcaucgcuauggccucucccguugcguaccaccaaggacucuuccauccucgggccuccaaucagacauuuuguugggaacaguggcccgacccucgccacaaaaaggcuuauguggugugcaccuucgucuucggcuaccugcuuccccugcuccugauuuguuuuugcuaugccaaagugcuuaaccaucugcacaagaagcucaaaaauaugagcaagaaaucugaggcuuccaagaaaaagacggcccagaccguucugguggucgugguuguguucgggaucagcuggcugccgcaccauauuauccaccucugggccgaguuuggagucuucccucugacacccgcuuccuuucuuuucagaaucaccgcgcauugucuggccuacucuaacagcuccgugaauccuauuaucuacgcuuuucucagcgaaaacuuccggaaggccuauaaacaagucuuuaagugccacauucgcaaagauucucaccuguccgacacaaaggagagcaaaucuagaaucgauaccccucccagcacgaauuguacacauguguga

SEQ ID NO: 69613 - RNA, 1164 nt, Artificial Sequence
  derived and/or modified sequence opt5 from GALR2__Homo_sapiens__NP_003848
augaacgugagcggcugccccggggccggaaaugcuucccaggccggcgggggaggcggguggcacccugaggcggucaucguuccgcuccuguucgcucugauuuuucuugugggaaccgugggcaacacacugguccucgccgugcugcuuagaggcgggcaagccguuucuacgaccaaucuguucauccucaaccugggaguggcugaccuguguuuuauucucugcuguguccccuuccaggccacaaucuacacccuggauggcuggguguuugggagccuucugugcaaggcuguucauuuccucauuuuucugacaaugcacgccuccucuuucacccuugcggccgugagccuggaccgguaucucgcuauccgcuacccucugcauuccagagaacugcggacaccccgcaaugcccucgcugccaucggacugauuuggggccuuucucugcucuuuagcgggccuuaucuguccuacuauagacagagccagcuugcgaaccugaccgucugucaccccgccuggucugcuccucggcgcagagccauggauaucugcacguucguguuuuccuaccuccugccggugcugguccucggacugaccuaugcucggacacuucgcuaccuguggagagccguugaccccguggccgcuggcagcggcgcgcggcgcgccaaaagaaaggugacccggaugauucucaucgucgcugcccuguucugucuuugcuggaugccucaucacgcccugauucucugugugugguuugggcaauucccccugacacgcgcuaccuacgcccugagaauccucucucaccugguuuccuaugcgaauagcugcgugaacccuauugucuacgcucuugugucuaaacauuuccggaagggauuuagaacgaucugugccggccugcucgggcgcgcccccggacgggcuuccggcagaguuugcgccgcugcccgcgggacacacagcggauccgugcuggagcgggaaucuagcgaucugcuucauauguccgaggcggccggcgcucucagaccgugcccuggcgccagccagcccuguauccuggaaccuugccccgggcccucuuggcagggaccuaaagcuggcgacuccauucugaccgucgauguggccuga

SEQ ID NO: 69614 - RNA, 1107 nt, Artificial Sequence
  derived and/or modified sequence opt5 from GALR3__Homo_sapiens__XP_011528770
auggccgacgcucagaacaucagccuggauucccccggcucugugggggccgucgcgguuccugugguguucgcucucauuuuucugcuuggaaccgucggcaaugggcuggugcucgccguucugcuucaaccgggacccagcgccuggcaggagccuggcuccacaacggaccuguucauccucaaccuggcuguggccgaucugugcuuuauucucuguugcguccccuuccaggcuaccaucuacacacuggacgccuggcuuuuuggggcgcugguguguaaggccguucaccuccugauuuaucuuaccauguacgcuucuagcuucacacuggccgcuguguccgucgauagauaucucgccgugcggcauccucugcgcucuagagcgcugcggacaccccgcaaugccagagcugccgugggacucgucuggcugcuugcugcccuguuuagcgccccuuaccucuccuauuacggcaccguucgguauggcgcucuggaacuuugcgugccggcgugggaggacgcccgcagacgggcucuggauguggccaccuucgccgcuggguaccuccugcccgucgccgugguuagccuggcguacggacgcacgcucagauuucugugggcugccgugggcccugccggggcugccgcugccgaagcgcggcgcagagccaccggacgggcuggccgcgccaugcuugcugucgccgcgcuguaugcccucuguugggggccccaccaugcucugauccuuugcuucugguacggaagauuugccuucucuccugcuacauaugccugucggcuggccucccacugccucgcuuacgcgaacagcugucugaauccccugguguaugcccucgcuucuagacauuuucgcgcccgguucagacgccuguggccgugcggccggagacgccggcacagagcccgccgggcucuuagacgcguucggccugccuccagcgggcccccuggcugucccggagacgcgagacccucuggccggcugcucgcugggggaggccaggggccugagccgcgcgaaggacccgugcacggcggcgaggccgccagagggccugaguga

SEQ ID NO: 69615 - RNA, 1140 nt, Artificial Sequence
  derived and/or modified sequence opt5 from GALT__Homo_sapiens__NP_000146
augagcagauccggcaccgacccccagcaacggcagcaggccucugaggcugaugccgcggcugccacauuccgcgccaacgaccaccagcauaucagauacaauccucugcaagaugaaugggugcucgucagcgcucaccggaugaagcgcccguggcaggggcagguugagccccagcugcuuaaaacggugccuagacaugacccccugaacccucucugccccggagccauucgggcuaauggcgaagugaacccucaauaugauuccaccuuucuguucgacaaugauuuuccggcccuucagcccgacgcgccuucucccgggccuagcgaucacccccuguuccaggccaaguccgcucgcggagucuguaaagugaugugcuuucauccguggucugacguuacacucccucugaugagcgugcccgagaucagagccgucguggaugcuugggccuccguuaccgaagaacugggcgcgcaguacccuugggugcaaauuuucgagaacaagggggccaugaugggauguagcaauccccacccccacugccaggucugggcuucuuccuuucucccugacaucgcccagcgggaggagcgcagccaacaggcuuauaaaucucagcauggcgaaccgcugcuuauggaguacuccagacaggagcugcuccggaaggaacgccuggugcuuacaagcgagcacuggcuggugcucguccccuucugggccaccuggccuuaucaaacacugcugcuccccagacggcauguucgcagacugccugaacuuacccccgccgagcgggaugaccuggcuucuauuaugaagaaacuccugacgaaguacgacaaccuuuuugaaaccuccuucccguauagcaugggcuggcacggggcgccuacaggauccgaggccggcgcuaauuggaaccacuggcagcugcaugcccacuacuaucccccucuccugagaucugccaccgugcgcaaauuuauggugggguacgagaugcuggcucaggcccagcgggaucucacacccgaacaagcggcugagagacugcgcgcccuuccugaaguccauuaccaccugggacagaaggaccgggagaccgccacgaucgcuuga

SEQ ID NO: 69616 - RNA, 711 nt, Artificial Sequence
  derived and/or modified sequence opt5 from GAMT__Homo_sapiens__NP_000147
augagcgcccccuccgcuaccccuaucuucgccccgggcgagaacugcucucccgcguggggagcugccccugccgcuuacgacgccgcugauacacaccugagaauccucgggaagcccgugauggaacggugggagacgccuuauaugcaugcccuggcggccgcugccagcuccaaaggcgggcgcguccuugaaguuggauuuggcauggcuauugccgcgucuaaggugcaggaggcccccauugacgaacacuggaucauugaguguaaugaugggguguuccaaagacugcgggacugggcuccucgccagacccauaaagucaucccgcucaagggacugugggaggauguggcccccacacuuccugacggccacuuugauggcauccuguacgacaccuauccccucagcgaagagacauggcauacccaccaguucaacuuuauuaaaaaucacgcuuucagacugcugaagccugggggaguucucacauacugcaaccugaccuccuggggcgaacuuaugaagucuaaauauagcgauaucacgauuauguuugaggagacccaggugcccgcccugcucgaagccggguuccggcgcgagaauaucagaacagaagucauggcucuggugccgccugcggacugucgguacuaugccuuuccccaaaugauuaccccucuuguuacaaagggauga

SEQ ID NO: 69617 - RNA, 2544 nt, Artificial Sequence
  derived and/or modified sequence opt5 from GANAB__Homo_sapiens__NP_001265123
augaccagauuccggaucgacgagcuggaaccccgcagaccucgguaccgcgugccggauguccucguugccgaucccccuauugcuagacugagcguguccggccgggacgagaacucuguggaacuuacaauggccgaggggcccuauaagaucauucugacggcgcgcccuuuuagacucgaccugcuugaagaucggagccugcuccuguccgucaaugcucgcggacugcucgaguucgagcaccagagagcuccccgggugucucaaggcagcaaagacccugccgaaggggauggagcccagccggaggaaacaccccgcgacggcgauaagccugaggagacccaggggaaagccgaaaaggacgagcccggagcuugggaagagaccuuuaaaacacauuccgauucuaagccuuacggccccaugagcguuggccuggacuucucccuuccggggauggaacacguguauggaaucccugagcaugccgauaaccugagacucaaggucaccgagggcggggaacccuaccggcuguauaaucuugacguguuucaguacgagcuguauaacccuauggcgcucuacggaagcguucccgugcugcuggcccacaauccccaucgcgaccucggcauuuucuggcugaacgcugccgaaacaugggucgauaucucuuccaauaccgcugggaaaacgcuuuuuggaaagaugauggacuaccugcaaggcagcggcgagaccccucagacagaugugagauggaugucugaaaccgggaucauugacguguuccuccugcuuggaccguccaucagcgaugucuuucggcaguaugccucucugacaggcacccaggcgcugcccccucucuucucccugggguaccaccaaagcagauggaacuaucgcgacgaggccgauguucucgagguggaccagggauuugaugaccacaaucugcccugcgaugugauuuggcuugacaucgaacaugcugacggcaaacgguacuucacgugggauccuuccagauuuccccagccgcgcacaaugcuggagcggcucgccucuaagagacgcaaacuggucgcuauuguggacccucacaucaagguugauagcggguaucgggugcaugaggaacuuagaaaccugggacucuacgucaagacccgcgacggcuccgauuaugaaggcugguguuggcccgggagcgccggauacccugacuucacaaaucccaccaugcgggccuggugggcuaacauguucucuuacgauaauuaugagggcuccgcgccuaaccuguuuguguggaaugacaugaacgagcccagcguuuucaacgggccggaagugaccaugcugaaagaugcccagcacuacggaggcugggagcacagagacguccauaauauuuaugggcucuacgugcacauggcuacagccgauggccugcgccaacggucuggaggcauggaaagaccuuuuguccuugcccgggcuuucuuugccgggagccagcgcuucggagcgguguggacgggcgacaacaccgcugagugggaucaucugaagaucuccauccccaugugccucucucuggggcugguuggacuuagcuuuuguggcgccgacgugggaggcuucuuuaaaaaucccgagccugaacuccuggucagaugguaucagaugggagccuaccaaccguucuuucgggcucacgcccaucuggacacaggcagacgcgagcccuggcuccugccuucccagcacaacgauauuauccgggacgcucuugggcagagauauagccugcuccccuucugguacacccugcuguaccaggcccaccgcgaagggauuccugugaugagaccccuuuggguucaauauccucaggaugugacaaccuuuaauaucgacgaucaguaccuccugggcgacgcgcugcucguccaucccgugucugauuccggggcccacggagugcagguuuaucugccgggccaaggggaggucugguacgacauucagagcuaucagaagcaucacggcccucagacgcuuuaccugcccgugacacucucuuccaucccuguguuccaacggggaggcaccaucgucccccgcuggaugagagugcggcgcagcuccgaaugcaugaaagaugacccgauuacccuguucguugcucugucuccucaggggacagcccagggagagcuuuuucucgaugacggccacaccuucaacuaucagacaagacaagaguuucugcugcggcgcuucagcuuuuccgggaauacgcucgugucuagcuccgcugaucccgaaggacauuucgagaccccuaucuggauugaaagagucgugaucauuggcgccgggaagcccgcggccguugugcugcagacaaaaggcagccccgagucucggcuuuccuuucagcacgacccugaaaccagcguccuggugcuccgcaagccgggaaucaacguugcuucugacugguccauccaucugagauga

SEQ ID NO: 69618 - RNA, 849 nt, Artificial Sequence
  derived and/or modified sequence opt5 from GANC__Homo_sapiens__NP_001288339
auggaggccgcugugaaggaagagaucagccuggaagacgaggccgucgauaaaaacauuuucagagacugcaauaagaucgcguuuuaccggcgccagaaacaauggcucuccaagaaaucuaccuaucaggcucugcuugauagcguuacaacggacgaagauuccaccagauuccagauuaucaacgaggccucuaaggugcggugucaggaccaaagccccacaacccuggaugccuuuaagggcaaagagacaaccgugcaggaagagacacaggaccucuccacccgccagcaccuggcucaaaaggaagccgaggagccugauaaacaggggcagauuacgugggacaucucuaaugucgcuccgaagaccgaaaacuucgaggaucuucuggaacagacacccugcagcgccugucuccaaggauuuaccagagacaauacauccagcucuuucuccgaggaugcgggcaucagccugucuaccuccgugaaacugccucucgccucuagcuccaagcccaacgaaaaugaggcucugccuaaccagcccccuagccagcaaauucggcauaauuaccgccuucuggccuccacgguuucugcugagauggccagaaaccggcagcucaucugggaacuggcgcgccagagcgaggcccaccuugacagaccggugguccugggggaacaggcuuccgcccaacgggagguggcuagcauucucugccgcaagucuguucuggccaucaaucagcuggccgcuacaguggaaggaaccauuuccguccuccagcaguuuaacgagcugcuugaccauccccuggauccuggcagaagcuga

SEQ ID NO: 69619 - RNA, 1794 nt, Artificial Sequence
  derived and/or modified sequence opt5 from GAN__Homo_sapiens__NP_071324
auggccgaaggcagcgcuguguccgacccccagcacgccgcgagacugcuccgggcucugucuagcuuccgcgaagaguccagauuuugcgaugcccaucuuguccuggacggggaagagaucccuguucaaaagaacauucucgccgcugccucuccguacauccggaccaaacugaauuauaaucccccuaaggaugacggaagcacauacaaaauugaacuugagggcaucuccgugauggugaugcgcgagauucuggauuauaucuucucugggcagaucagacucaacgaagacacgauucaggaugucgugcaggcugccgaccugcugcuccugaccgaucuuaagacacuguguugcgaguuucucgaaggauguaucgcggccgagaacugcauuggcauccgggacuucgcucugcacuacugucuucaucacguucauuaucuggccaccgaguaccucgaaacacacuuucgcgaugugagcuccaccgaggaguuccuggaacugagcccccaaaaacucaaggaagucauuucucuggagaaacuuaauguggggaacgagagauauguuuuugaagcugugauccgguggauugcccacgacacagagauccgcaagguccauaugaaggaugugauguccgcgcugugggugagcggacucgacucuuccuaccugagagaacagaugcuuaaugagccucugguccgggaaaucguuaaagagugcagcaacauuccccucucucagccucagcaaggcgaggccaugcuggcuaauuucaagccgcgcggcuacuccgaauguaucgugaccgucgggggagaggaaagagugagccggaaacccacggccgcuaugcgcugcauguguccucuguaugaccccaacagacagcucuggauugagcuggccccucuuuccaugccccggaucaaucacggcgugcugucugccgaaggguuucucuucguuuuuggaggccaggaugagaacaagcagacccugagcuccggggagaaguacgacccggaugcuaauacauggaccgcgcuuccucccaugaacgaagccagacauaauuucggaauuguggagaucgacggcaugcuguauauccucggcggggaagauggagagaaagagcugauuagcauggaaugcuacgacaucuauucuaagacauggaccaaacaaccugaucugacgaugguccgcaagauuggcuguuacgcugccaugaaaaagaaaaucuaugccaugggagggggcuccuacgggaagcucuuugagagcguggaaugcuacgacccccggacacagcaguggaccgcuauuugcccccugaaggagagacgcuucggagccguugcguguggcguggcuauggaacuuuaugucuucggcggggugcggucuagagaggaugcccaaggaagcgagauggucacaugcaaauccgaauuuuaccacgacgaguucaagcgcuggaucuaucugaacgaucagaaccucuguaucccugccucuagcuccuuuguguacggcgcuguuccgauuggggccagcaucuaugugauuggagaccuggacaccggcaccaauuacgauuauguccgggaguucaaaagaucuacagggacguggcaccauaccaagccccugcuuccuuccgaccuccgccggacaggcugcgcugcccugagaaucgcgaacuguaaacuguuucgccuccagcugcagcaaggacuuuuccggauuagagugcacagccccuga

SEQ ID NO: 69620 - RNA, 825 nt, Artificial Sequence
  derived and/or modified sequence opt5 from GAP43__Homo_sapiens__NP_001123536
augaccaagagcugcuccgagcugugucaccccgcccuccauuuccugccuugccuuggcgggcugcggaaaaaccuccagagagcugugcgcccgucucccuacagccugggauuucuuacauucuggaucuccagagucgaaaagaaugacgaugaccagaaaauugagcaagauggcaucaagccugaagacaaagcccacaaggcggcuacgaagauucaggccucuuuucgggggcauaucacccgcaaaaagcugaaaggagagaagaaagaugacguucaggccgcugaagccgaggcuaacaagaaggaugaggcccccguggcggacggcguggagaaaaagggggagggaacaaccacagccgaagcugccccugcuaccggcagcaaacccgaugagccuggcaaggccggggagacaccguccgaagagaaaaagggagaaggcgacgcggccaccgagcaagcugcuccccaggccccugccucuagcgaagagaaagccggguccgcugagacggaaagcgcgaccaaggccucuacagauaauucccccagcucuaaggcugaggacgccccugccaaagaagaacccaagcaggcugaugucccggccgcggugaccgcugccgccgcuacaaccccugccgcugaagacgccgcggccaaagcuacggcccagcccccuacagagaccggagaguccagccaagcugaagagaacauugaagccguugacgagacaaagcccaaagaaucugcgagacaggaugagggcaaggaggaggaacccgaagccgaccaggagcacgcuuga

SEQ ID NO: 69621 - RNA, 882 nt, Artificial Sequence
  derived and/or modified sequence opt5 from GAPDH__Homo_sapiens__NP_001243728
augguguacauguuccaguaugacagcacccacggcaaguuucaugggacagucaaagccgagaacggaaagcugguuaucaauggcaaccccauuacgaucuuccaagaaagagauccuuccaaaauuaaguggggagacgcuggggccgaguacgugguggaaucuaccggcgucuuuacaaccauggagaaagcgggggcucaccuccagggaggcgccaagcgggugaucauuagcgccccguccgcugaugcccccauguucguuaugggcgugaaucaugaaaaguaugacaacucucugaaaaucaucagcaaugcuuccugcacaaccaacugucuugccccucuggcgaaggucauucacgauaauuuugggaucguggagggacucaugacaaccguucaugccauuacggcuacccagaaaacaguggacggccccucugggaagcuguggcgcgauggaagaggcgcccuucagaacaucauuccugcuagcaccggggccgcgaaagccgucggaaaggugauccccgagcugaauggcaagcucacaggcauggcuuuccgggugccuaccgccaacgucuccguuguggaccugacgugccgccuggaaaaaccggcuaaguacgaugacauuaaaaagguggucaaacaagccagcgaggggccccucaagggaauccugggcuauacagaacaccaggugguuucuuccgauuuuaauagcgacacccacucuuccacauucgaugccggggcuggaaucgcgcuuaacgaccauuuugugaaacugauuagcugguacgacaaugaguucggcuauucuaacagagucguggaucucauggcccacauggcuuccaaggaguga

SEQ ID NO: 69622 - RNA, 1227 nt, Artificial Sequence
  derived and/or modified sequence opt5 from GAPDHS__Homo_sapiens__NP_055179
augagcaagagagacaucgugcugaccaacgucacaguugugcagcuccugcggcaacccugcccugugacgcgcgccccgcccccucccgagccuaaagcugaagucgagccccagccucagccggaacccaccccugugagagaggaaauuaagcccccucccccgccucuucccccucaccccgccacacccccuccgaaaaugguuuccguggcgcgggagcugaccgucggcaucaauggguucggacgcauuggcagacucgugcugcgggcuuguauggagaaggggguuaaaguggucgccgugaacgaucccuuuaucgacccugaauacaugguguauauguucaaguacgauucuacacauggacgcuauaagggcagcgucgaguuuagaaaugggcagcuuguuguggacaaccacgaaauuuccguguaccaaugcaaagagcccaagcagaucccuuggcgggccgucggaucucccuaugugguugagagcaccggcguguaccuguccauccaggcugccucugaucauauuagcgcuggcgcccagcgcgucgugaucuccgcgccgagcccugacgcccccauguucguuaugggggugaaugaaaacgauuauaauccuggaucuaugaacauugucuccaaugcuagcuguacaaccaacugccucgcuccccuggccaaagugauccacgagagauuuggcauugucgaagggcugaugacgaccgugcauucuuacacagccacccaaaagacaguugacggaccuucccggaaagcguggcgcgauggcagaggggcccaccagaauaucauucccgcuagcaccggagccgcuaaggccgugacgaaggucaucccggagcucaaaggcaagcugacaggcauggccuuccgggugccuacccccgacguuucuguggucgaucuuacaugucgccuggcucagcccgcgccuuacuccgccaucaaagaagcugugaaggccgccgcuaaagggccgauggccggcauucucgcguauaccgaggacgaggugguuagcaccgauuuucugggagacacacacuccucuaucuucgacgcuaaggccgggauugcccuuaacgauaauuuugucaaacugaucagcugguacgacaacgaauauggauacucccauagagugguggaucuccugcgguauauguucagcagagacaaguga

SEQ ID NO: 69623 - RNA, 654 nt, Artificial Sequence
  derived and/or modified sequence opt5 from GAR1__Homo_sapiens__NP_061856
augagcuucagaggcgggggacggggcggguuuaaccgcggaggcgggggaggcggcuucaauagagggggauccucuaaccacuuucggggcgggggaggcgggggaggcggcgggaauuuccgcggaggcgggagaggaggcuuugggcggggaggcggccgcgggggauucaacaagggccaggaccaagggcccccugagagagugguccugcucggagaauuucugcauccgugcgaggaugacaucguuuguaaaugcaccacagaugaaaauaaggugcccuacuucaacgccccuguguaucuugagaauaaagaacagauuggcaaggucgacgagaucuuugggcagcugcgggauuucuacuuuagcgugaaacucuccgagaacaugaaggcuucuagcuucaagaaacugcagaaguuuuauauugaccccuacaaacuucugccucuccaacgcuuccugcccagaccuccgggcgaaaagggacccccucggggcgggggacgcggcgggagaggaggcgggcggggcggaggcgggcgcggaggcgggagaggaggcggguuccggggcggaagaggcgggggaggcgggggauuucgcggcgggcggggcggaggcuucagagggcgcggacacuga

SEQ ID NO: 69624 - RNA, 2631 nt, Artificial Sequence
  derived and/or modified sequence opt5 from GAREM__Homo_sapiens__NP_001229338
auggaccccgccccuagccugggcugcucccucaaggaugugaaauggucuagcgucgcuguuccgcuggaccuucugguguccaccuacagacucccccagaucgcccggcuggauaacggggaguguguggaaggacuucgcgagaaugacuaucugcucauucacucuugcagacaauggacaacgaucaccgcgcauagccuggaagagggccacuacgucauugggccuaagaucgaaauucccgugcauuaugcuggacaguucaaacugcucgagcaggaucgggacaucaaggagccuguucaguacuuuaacuccguggaagaggucgccaaagccuuccccgaacgcguguauguuauggaggauaucacauuuaaugugaaggucgcuucuggcgaguguaacgaagacaccgagguguacaauauuacacugugcaccggggaugaacuuacacugaugggacaagccgagauccucuaugcuaagaccuucaaagaaaagagcagacugaacacgauuuuuaaaaagaucggcaaacuuaauuccauuagcaagcugggcaaggggaaaaugccuugucucaucugcaugaaccaccggaccaaugagucuauuucccugccguuccaguguaagggacgcuuuagcacaagaucuccccuggagcuccagaugcaggaaggcgagcauaccauccggaacaucguggaaaagacacgccugccugucaauguuaccgugcccuccccucccccgagaaacccuuacgaccuucacuucauucgggaggggcaccgcuacaaguuugugaauauccaaacgaaaacagucgugguuugcugugugcugagaaacaauaagauucuccccaugcauuucccucugcaccuuaccguccccaaauuuagccugcccgaacaucucgugaagggagagucuuggccugagacacugguucaccacuggcugggcaucugccaggaacaguucgauauugacgaguauucccgggccgugcgcgaugucaagaccgacuggaacgaagaguguaaaagcccgaagaaagggagaugcuccggacauaaccacgugcccaauucucucagcuacgcgcgggacgaacugacccaguccuuucauagacuuagcgucugcguguauggcaacaaucugcacggcaacucugagguuaaucuccaugggugucgcgaucugggaggcgacugggccccuuucccccacgauauccuuccuuaccaagacuccggggauagcggaucugacuaucuguuccccgaggcuagcgaagaguccgccggcaucccggggaagucugaacucccuuacgaggagcuguggcuggaagagggaaaacccagccaccagccucucacacggucccugagcgaaaagaacagaugcgaucaguuucgcggcucugugcgguccaagugugcuacgagcccccuuccuauucccggcacccugggggccgcggucaaaucuuccgacacagcccucccgccuccgcccgugccucccaagagcgaggcuguuagagaagagugccgccugcugaaugccccgccugugcccccucgguccgcuaaaccccuuucuaccagcccuuccauucccccgagaacagucaagccugcccgccaacagacccggucucccagcccuacgcucuccuauuacagcucuggacugcauaacaucuccgugacaaaaaccgauaccaaucccagcgagucuacaccgguguccuguuacccuugcaacagaguuaagaccgacagcgucgaucugaagucucccuucggcagcccuuccgccgaagcugugagcucucgccucuccuggcccaaucacuauagcggggcguccgagucucagacacggagcgacuuucugcuugaccccuccagaucuuacagcuauccucggcagaaaacgccgggaacccccaagcgcaacuguccugcccccuucgauuuugacggcugcgaacugcucgcuuccccuacaucucccgugaccgccgaguucagcuccagcgucucuggguguccuaaauccgccagcuacucucuggaauccacagauguuaagagccuggcugccggcgugaccaaacaaucuacguccugcccggcgcuucccccuagagcucccaagcucguggaggagaaggucgccagcgaaaccuccccucugccccugaaaaucgacggagccgaggaagaucccaagagcggcucuccugaccucagcgaggaucaguauuuugugaaaaaggggaugcaggacauuuucuccgcuucuuaccccuuuagcucuccccugcaucuucagcuggccccucggucuuguggagauggcagccccuggcaaccuccggcugaccucuccgggcugucuaucgaagagguuagcaaaucccugagauucaucggacuuagcgaggaugugauuuccuuuuucgucacagaaaagaucgacggcaaucuccuggugcagcugaccgaggaaauucucuccgaggauuuuaaacugagcaaacuucagguuaagaaaaucaugcaguucauuaacggguggcgccccaagaucuga

SEQ ID NO: 69625 - RNA, 2976 nt, Artificial Sequence
  derived and/or modified sequence opt5 from GARNL3__Homo_sapiens__NP_001273708
augaaaagcuccgugucugaggaccugggcugcagaagaggggauuucagccgcaagcacuacggauccgucgaacuccugaucucuagcgacgccgauggcgcuauucagagagccgggcgguuucgcguugagaacggauccucugacgaaaaugcgaccgcccuucccggcacauggagacggacggaugugcaucuggagaacccugaauaucacacccgcugguacuucaaguauuuucucgggcaagugcaucagaauuacaucggaaacgacgcugagaaaagcccguucuuucuguccgucacacuuagcgaucagaauaaccagagagugccccaauaucgggccauucuguggcgcaagaccggcacacagaaaaucugucucccuuacucucccaccaagacacuguccguuaagagcauucugucugcuaugaaucucgacaaauucgagaagggcccuagagaaaucuuucaccccgagauccagaaagaucugcuugugcuggaggaacaggagggguccgucaacuucaaguuuggaguucucuucgccaaagacggccaacugaccgaugacgaaauguuuagcaaugagauugggucugaaccuuuccagaaguuucuuaaccugcucggagauacgaucacccugaagggcuggacaggguaucggggaggccuggacaccaaaaaugacacaaccggcauucauuccguguacacgguguaccaggggcacgagaucauguuccacgucagcacaaugcucccguauuccaaggaaaacaaacagcaaguggagcgcaagagacauauuggaaaugauaucgugaccauugucuuccaggagggcgaagagucuagccccgcuuuuaaaccuuccaugauccggagccacuucacacauaucuuugcccugguucgcuacaaccagcaaaaugacaacuauagacuuaagauuuucucugaagaguccgugccccuguuugggccuccccucccgaccccucccguguucaccgaucaccaggaauuucgggacuuccugcuugucaaacugaucaacggagagaaggcgacacucgagacgccuaccuuugcccagaagagacgccggacacuggauaugcugauuagaagccuccaccaggaccugaugcccgaucuucauaaaaauaugcugaaccgccggucuuucagcgacgugcuccccgaauccccuaagucugcucggaaaaaggaggaagcccgccaagcugaguuuguucggaucggccaggcccugaaacuuaagagcauugugagaggggaugcgccguccagccuggccgcuucuggaaucugcaagaaagaacccugggagccucaguguuucugcuccaauuuuccccacgaggccgucugugcugacccuuggggccaggcccuccuggugagcaccgaugccggcguucugcucguggacgacgaucugcccucugucccgguguucgaccgcacacuuccugucaagcaaaugcaugugcuggaaacccucgaucugcugguucuucgggcugacaaagggaaggaugcgagacucuucguguuucgccuguccgcccugcagaaaggacucgagggcaagcaggcuggaaagagccgguccgacugcagagaaaacaaacuggagaagacgaaagggugucaccuuuacgccaucaauacacaucacucucgggagcugcgcauugucguggccaucagaaacaagcuccugcugauuacccggaaacacaauaagcccagcggcguuaccuccacaucucuucucagcccucuguccgaaagccccguggaggaguuccaguauaucagagaaauuugccugucugauuccccuauggucaugacccucguggacgggcccgcugaagagagcgauaaccugaucuguguggccuaccgccaucaauuugacguugucaaugagucuacaggcgaagcguuccggcuucaccauguggaggcuaacagagugaauuuugucgccgccaucgauguguaugaagacggagaggcuggccugcuccugugcuacaacuacuccuguauuuauaagaaaguuugcccguucaaugggggauccuuucuggugcagccuucugccagcgauuuccaguuuugcuggaaccaggcucccuacgccaucgucugugcguuccccuaucuucucgccuuuacgaccgacuccauggaaauucgccuggugguuaauggcaaccuggugcacacagcugucgugccucaacuccagcugguugccagcagaucugacaucuacuucaccgcuacagccgcggugaacgaggucuccagcgggggauccucuaagggcgccagcgcucggaauagcccgcagacgcccccugggcgcgauacccccguguuuccuucuagccuuggcgagggagaaauucaauccaaaaaccuguauaagaucccccucagaaaucuggugggccggucuauugagcgcccucugaaaagcccccuugucuccaagguuaucaccccgccuacacccaucagcguggggcucgccgcuauuccugugacccacucucugucccugagcagaauggaaaucaaagagauugccucucggacacgcagagaacuccugggacuuuccgacgagggcgggcccaagagcgagggagccccgaaggcuaaaucuaagccucggaaacgccuggaagagucccagggcgggcccaagccuggcgcggucagaagcuccagcucugaucggauccccagcggaucccucgaaucugccagcaccuccgaggcuaaccccgagggccauucugccagcuccgaccaggauccuguggccgacagagaagggucuccgguuagcggauccagccccuuccagcugacggcuuucucugaugaggacauuaucgaucugaaauga

SEQ ID NO: 69626 - RNA, 2220 nt, Artificial Sequence
  derived and/or modified sequence opt5 from GARS__Homo_sapiens__NP_002038
augcccagcccuagaccggugcugcuccggggcgcccgcgcugcccugcuucugcuccugcccccuagacuucuggcgcggcccucccuccugcugcgcagaucucucagcgcugccuccugcccucccaucucucugccugccgcugccagccgguccucuauggacggggcuggagccgaggaaguccuugcgccgcugcgccucgccguuagacagcaaggcgaucuggugcggaaacuuaaggaggacaaggcuccccagguggaugucgacaaagccguggcugaacugaaggcccgcaaaagaguucucgaggcgaaggaacuggcccugcagccuaaggaugacauuguggaucgggcuaaaauggaggacacccucaagcgcagauucuuuuacgaucaggccuucgcuaucuaugggggagucagcggccuguacgacuuugggcccgugggaugugcccuuaaaaacaauauuauccaaacauggcggcagcacuucauucaggaggaacagauccuggagaucgauugcacgaugcucaccccugaacccguucugaagacauccggccauguggacaaauuugccgauuucauggucaaggacgugaagaacggcgaguguuuucgcgcugaccaccuucugaaagcgcaucuccaaaagcugaugagcgauaaaaagugcucuguggagaaaaaguccgaaauggagagcguccuggcccagcucgacaauuaugggcagcaggaacuggcugaucuuuucguuaacuacaaugugaaaucuccgauuaccggaaacgaccuguccccucccgugagcuuuaaucucauguucaagacauuuaucggcccugggggaaacaugcccggcuaucugagacccgagaccgcccaagggauuuuccuuaauuuuaagcggcugcucgaguucaaccagggaaaacugccuuucgccgcugcccagaucggcaauucuuuuagaaacgaaauuuccccgcgcagcggccugauccgggucagagaguucacaauggcggaaauugagcacuuuguggaucccuccgaaaaggaccauccuaaauuccaaaauguugcugaucuccaccuguaccuuuauucugccaaggcccaggugagcgggcaguccgcucgcaaaaugcggcugggagacgccgucgagcagggcgugaucaacaauaccguucucggguacuuuaucggaagaauuuaccuguaucugacgaaggugggcaucagccccgauaaacuucgcuuccggcaacacauggaaaacgagauggcucauuacgccugugacugcugggaugcggagucuaagaccuccuauggguggauugaaaucgucggaugugccgacagaagcugcuacgaccucucuugucacgcucgcgccacaaaggugccucuggucgcugagaaaccccugaaggaaccgaaaaccgugaacguugugcaguuugagccuagcaagggcgccauuggcaaggcguauaaaaaggaugccaaacucgucauggaauaccuggcuaucugcgacgaguguuauaucacagagauggaaaugcuucugaaugagaagggggaguucaccauugaaacggagggaaaaacauuucagcucaccaaggauaugaucaacgugaagcgguuccagaaaacacuguacguugaagaggugguccccaaugugauugaaccuuccuuuggccuggggagaaucauguacaccguguucgagcauaccuuucacguucgcgaaggagacgagcaacggacauucuucucuuuucccgccgucguggcuccuuucaagugcagcgugcuuccccucucccagaaccaggaguuuaugccguucgucaaagaacugagcgaggcccugacgagacacggcgugucucauaagguugaugacuccagcgggucuauuggccggcgcuaugccagaaccgaugaaaucggaguggcuuuuggcgucacaaucgacuucgauaccgugaauaaaacaccucacaccgcgacgcuccgggacagagauuccaugcgccagauucgggccgagaucagcgaacugcccuccauuguucaagaccuugcuaacgggaauaucacaugggccgauguggaggccagauacccccuguuugagggacaggaaaccggcaagaaagagaccauugaagaguga

SEQ ID NO: 69627 - RNA, 1302 nt, Artificial Sequence
  derived and/or modified sequence opt5 from GART__Homo_sapiens__NP_780294
auggccgcuagagugcugaucauuggcagcgggggacgggagcacacccucgccuggaagcuggcgcagucccaucacgucaaacaaguucuuguggcucccggcaacgccgggacagccugcucugaaaagaucagcaauacggcuauuuccaucucugaccauaccgcccuggcucaguucuguaaagagaagaaaauugaauuuguggucgugggaccugaggccccgcucgcggccggcaucguugggaaccugcgcagcgcuggagugcagugcuucggccccacagccgaagcugcccagcuugaguccucuaagagauuugcgaaggaguucauggaucggcacggcaucccuaccgcccaauggaaagccuuuacaaagcccgaagaggccuguagcuucauucuguccgcugacuuuccugcccucgucgugaaagccagcgggcuggcugcgggaaagggcguuaucguggccaaaucuaaggaagaggcuugcaaggccguccaggagauuaugcaggaaaaagccuucggggcugccggagagaccaucgugauugaggaacugcucgauggcgaagagguguccugucugugcuuuacagacgggaagaccgucgcgcccaugccuccggcucaggaucauaaacgccuucuggagggagacggcggccccaauaccgggggaaugggcgccuacuguccugcuccccaaguuagcaacgaucuccugcuuaagaucaaagacacggugcugcagagaacaguggaugggaugcagcaggaaggaaccccuuauacaggcauucucuacgcugggaucaugcugaccaagaauggacccaaaguccuggaguucaacugccgguuuggcgacccggaaugucaagugauccucccucugcuuaagucugaucuguaugagguuauucaguccacgcucgacggccugcuuugcacaagccugcccguguggcucgaaaaucacaccgcccugacagucgugauggcuucuaagggguacccuggagauuauaccaaaggcguugagaucaccggguuccccgaggcccaggcgcugggacucgaaguguuucacgccggcacagcucugaagaacgggaaagucgugacgcauggcggacgcguccuugccgugaccgcuauuagagagaaucugaucuccgcccucgaagaggcgaagaaaggccuggccgcuauuaaguucgaaggggccaucuaccggaaggacguuggauuccgcgcuaucgccuuucuucaacagcccagauga

SEQ ID NO: 69628 - RNA, 1038 nt, Artificial Sequence
  derived and/or modified sequence opt5 from GAS1__Homo_sapiens__NP_002039
augguggccgcucugcucggcgggggaggcgaggccagagggggaaccguccccggcgcguggcugugccuuauggcucugcuccagcugcuugggagcgccccucggggauccggccuggcccacggccgcagacucaucuguuggcaagcucugcugcagugccagggggaaccggaguguucuuacgccuauaaccaguacgcugaagccugcgcgcccguucucgcccaacauggaggcggggacgcuccuggagccgcugccgcggccuuccccgcuagcgccgcuuccuuuucuagccgguggcgcuguccuucccacugcauuucugcccugauccagcuuaaucauacaagacggggccccgcccuggaggauugugacugcgcucaggaugaaaacuguaagagcacgaaacgcgcgauugagccuugccucccgagaaccuccgggggaggcgccggcgggcccggagcuggcggggugaugggauguacagaggcccggcgcagaugcgaccgggauagccgcugcaaucuggcccuuucuagauaucugaccuacuguggcaagguguucaacgggcuccggugcacagacgaaugucgcaccgucaucgaggauaugcuggcuaugccuaaagccgcgcugcucaaugacugcgugugugauggacuggaaagacccauuugcgaguccguuaaggagaacauggcucggcuuuguuuuggcgccgaacugggcaaugggccuggaagcucuggcuccgacgggggacucgaugacuauuacgaugaggacuaugacgaugaacagagaacaggcggggccggcggagagcaaccccuggacgaugacgauggcgugccgcacccuccccgcccugggagcggagcugccgcuucuggcgggcggggagaccuucccuacggccccgggagacgcuccagcggcggaggcgggcggcuggccccuagaggagcguggaccccgcucgccuccauccugcugcuccugcuuggcccccuguucuga

SEQ ID NO: 69629 - RNA, 942 nt, Artificial Sequence
  derived and/or modified sequence opt5 from GAS2__Homo_sapiens__NP_001137302
augugcaccgcccugagccccaaggugagauccggcccugggcucucugacaugcaccaguacagccaauggcuggcuucccggcaugaggccaaccuucugccgaugaaagaagaucucgcgcuguggcuuacaaaucugcucggaaaggagaucacggcugaaaccuucauggagaaacuggacaacggcgcccugcucugucagcuggccgaaacaaugcaggagaaguuuaaagagucuauggaugcuaauaagcccaccaagaaccuuccucugaaaaagauucccugcaaaacaagcgccccuuccgggucuuucuuugcucgcgacaauaccgccaacuuccucagcugguguagagaucugggagucgacgaaacaugccuuuuugaguccgaaggccugguucuccacaagcagccccgggaggugugucugugccugcucgagcuggggcgcaucgcggccagauauggaguggaaccuccgggccuuauuaaacuggagaaggaaaucgagcaagaagagacccucagcgcucccucuccuucccccagcccuucuuccaagagcucuggcaaaaaguccacggggaaucugcuugaugacgccgucaaacggauuagcgaggaucccccguguaagugcccuaacaaauucuguguggaacgccugucccagggaagauaccggguuggcgagaagauccucuuuauccgcaugcugcauaauaaacacgugauggucagaguugggggaggcugggaaaccuucgcuggguaucugcucaagcaugaccccugccggaugcugcagauuucucgcguggauggaaagacaagcccuauccaguccaaaagccccacccuuaaggacaugaaccccgauaauuaccugguggucucugccuccuauaaagcgaagaaagagauuaaguga

SEQ ID NO: 69630 - RNA, 1365 nt, Artificial Sequence
  derived and/or modified sequence opt5 from GAS2L1__Homo_sapiens__NP_001265659
auggccgaccccguggcuggcaucgccgggagcgcggcuaaguccgucagaccuuuccggucuagcgaggccuacguugaagccaugaaagaggaucuggcugaauggcucaacgcccuguauggacuuggccugcccgggggaggcgacggguuucucaccggacuggcuacaggcacgacccuuugccagcacgccaaugcggugacagaggccgcucgcgcccuggcugccgcgagacccgcccggggcguggcuuuccaagcccauuccgucgugccugggucuuuuauggcucgcgauaacguugccaccuucauuggaugguguagaguggaacucggcguccccgaggugcugauguuugagacagaagaccugguucuccggaagaaugagaaaagcgugguccugugccuucuggaaguggcccgcagaggggcucggcucggacugcuugcgccucgccuggugcaguucgagcaggagaucgaaagagagcuccgggccgcucccccugccccgaacgcccccgcugccggcgaagauaccacagagaccgcgccugcucccgggacgccugcccgcggacccagaaugaccccguccgaccugcggaaucuggaugaacucguccgcgagauucugggcagauguacaugcccugaccaguuucccaugaucaagguuucugagggcaaauaccgggugggggauagcucccuucugauuuucgugagaguccuccgcagccacgugaugguucgggugggaggcgggugggacacccuggaacauuaucuugauaagcacgacccuuguagaugcagcuccacagcccaucgcccgccccaaccucgggucuguaccuuuagcccgcagagagugucucccacgacauccccucgccccgcuagcccuguucccggaucugagcggagaggcucccgcccggaaaugaccccugugagccugcgguccacaaaggaggggcccgaaaccccucccucuagcuccucuucuucccucagcguccugggaggcaaaugcggccagccuggggauucuggaagaaccgccaacggccugcccgggccgcgcagccaggcucucuccucuagcuccgacgagggaagcccuugucccggcaugggcgggccccuggacgccccuggaucuccgcuugcgugcacagagcccucccggacgugggccagaggccggauggauacccaaccugaccgcaagcccagcagaaucccuacaccccgggggccuagacgccccucuggaccggcugaacugggcaccuggcacgcccuccacuccgugacaccucgggcugagcccgauagcuggauguga

SEQ ID NO: 69631 - RNA, 2037 nt, Artificial Sequence
  derived and/or modified sequence opt5 from GAS6__Homo_sapiens__NP_000811
auggcccccagccuguccccuggcccggcugcccucagacgggcgccccagcugcuucugcuccugcuugcugccgagugcgcccuggcugcccuccugccugcucgcgaagccacccaauuccugagaccccggcagcgcagagcguuucagguguucgaggaagccaagcaggggcaccucgagcgggaaugcgucgaggagcugugcucucgcgaagaggcuagagaaguuuuugagaacgacccugagacagauuacuucuauccccgguaccuugacuguaucaauaaauauggaagcccuuacacgaagaacuccggcuuugcgaccugcgugcaaaaucugccggaucaguguacacccaacccuugcgaccgcaaagggacccaggcuugucaggaucucaugggaaauuucuuuugccuguguaaggccggcuggggagggagacuuugcgacaaagaugugaacgaauguucucaagagaauggcggcugccugcagauuugccauaacaagcccgggagcuuccacuguuccugccauucuggauuugaacucagcuccgacggccggacaugucaggauaucgacgagugcgcggauagcgaagccuguggggaggcucgcugcaagaaucugccuggaucuuauuccugucugugcgacgagggcuucgccuacagcucucaggaaaaggcuuguagagaugucgacgagugccuccaagggcggugugaacaggugugcguuaacucccccggaagcuauaccugccacugugacggccgcggcgggcugaaacuuucucaggauauggacacaugcgaggauauucugccgugugugccuuuuuccgucgccaaaagcgugaagucccucuaccugggaagaauguucucuggcacccccguuauccggcuuagauuuaaacgccugcaaccuacgcggcucguggccgaguucgacuucagaaccuuugaucccgaggggauucugcuguucgcuggaggccaucaggacagcacauggaucguccucgcgcugcgcgccgggcggcuugagcugcagcucagauacaauggagugggccgcgugaccuccagcggccccgucaucaaccacgggauguggcagacaauuucuguugaagaacuggcucggaaucuugugaucaaggugaacagagaugccgucaugaagauugccguggcuggagaccuguuucaaccugaacgcggccucuaucaccugaaucugaccguugggggaaucccguuccaugagaaagaucucgugcagcccauuaacccucggcuggacggcugcaugagauccuggaacuggcuuaauggggaagauacgacaauccaggagaccgucaaggugaacacacgcaugcaguguuuuagcguuaccgagcggggcucuuucuaccccggaagcggcuuugccuucuauucccuggacuacaugagaaccccucucgacguggggacagaaucuacgugggaggucgaaguggucgcgcacauucggcccgcugccgauaccggagugcuguuugcccugugggcuccggaccuucgcgccguuccucucagcguggcucuggucgauuaucauuccaccaaaaagcugaaaaagcaacucgugguucuggccguggagcacacagcgcuugcccugauggagaucaaagucugcgacggccaggaacacguggugacaguuagccucagagauggggaggcuacccuggaagucgacggaacgcggggccagucugagguguccgccgcucagcugcaagaaagacuugccgugcucgagcgccaucugcggagccccguccugacauucgccgggggccucccugaugugcccguuaccucugccccugugaccgcuuuuuacagaggauguaugacacuggaggucaaucgcagacuucuggaccucgaugaagccgcuuauaagcacuccgacaucaccgcccauagcugucccccgguggagccugccgcugcguga

SEQ ID NO: 69632 - RNA, 1239 nt, Artificial Sequence
  derived and/or modified sequence opt5 from GAS7__Homo_sapiens__NP_001124303
auggugcccccuccgcccggcgaggaaagccagaccgucauccugccucccggguggcaauccuaccucucuccucagggaagacgguauuacguuaacacaacgaccaaugagacaaccugggaacgccccagcuccucuccuggcauuccggccagccccgggucccacagaucuagccugccucccacagugaacggauaucaugcuuccggcaccccugcccaucccccggagacagcgcacaugagcgugcggaagucuaccggggacucccagaaucuuggaucuagcuccccuagcaaaaagcagucuaaagaaaacacgaucaccauuaauugcgucacauucccccacccugauaccaugcccgagcaacagcugcucaagcccacagagugguccuacugugacuauuuuugggcugauaaaaaggacccucagggcaacggcaccguggccggguucgaacugcuucugcagaagcaacucaaaggaaagcagaugcagaaagagaugagcgaauuuauccgcgagagaauuaagaucgaggaagauuacgccaaaaaucuggcuaagcugucccagaacucucucgccagccaagaggaaggcucccugggggaggcuugggcccagguuaagaaaagccuugcggacgaagccgaggugcaucugaaguucucugcuaaacuccacuccgaggucgaaaagccgcugaugaauuuucgggagaacuucaaaaaggauaugaaaaagugcgaccaccauaucgccgaucuucgcaagcagcuggcuagcagauaugccucuguggaaaaagcgcggaaggcccucacggagcgccaaagagaccuggaaaugaaaacacagcagcuggagauuaagcucagcaauaaaaccgaggaagauaucaagaaggcucggcgcaaauccacacaggccggagacgaucugaugagauguguugaccuuuacaaccaagcucagucuaagugguuugaggaaauggugaccaccacacuggagcucgaacggcuggaggucgagcgcguggaaaugauuagacagcaccuuugccaguacacgcaacugcggcaugagaccgacauguucaaucagagcacaguggaacccgucgaucagcuccugagaaaaguugacccugccaaggaucgcgagcugugggugcgggagcacaaaaccggcaacaucagacccguggacauggaaauuuga

SEQ ID NO: 69633 - RNA, 861 nt, Artificial Sequence
  derived and/or modified sequence opt5 from GAS8__Homo_sapiens__NP_001273137
augaagaugcugagagacgagcucgaucugcggcgcaaaaccgaacuucacgagguggaagagagaaagaacggccagauccauacacugaugcaacggcacgaagaggccuucacggacauuaaaaauuacuauaacgauaucacccucaauaaccuggcucuuauuaauagccugaaggagcagauggaagacaugcgcaaaaaggaggaucaucucgaaagagagauggccgaggucuccgggcagaacaagcggcuggcggacccccugcagaaagcucgcgaagagaugucugaaaugcaaaagcagcucgccaauuacgagagagauaaacagauccugcuuugcacaaaggcccggcugaaaguucgcgaaaaggagcucaaggaccugcagugggagcacgaagugcuugagcaaagauuuaccaaagugcagcaggaacgggaugagcuguaucgcaaguucacagcugccauucaggaaguccaacagaaaaccggauuuaagaaccucgugcuggagagaaaacugcaggcucucagcgccgcgguugagaagaaagaagugcaauucaaugagguccuggccgcuuccaaccuugacccugccgcucugacacucgugucucggaagcuggaagauguucuugagagcaaaaauuccaccaucaaggaccugcaguacgaacucgcccagguguguaaggcgcauaacgaucugcugcgcacguaugaggccaaacuccuggcuuuuggcaucccgcuugacaaugucggguucaagccccuggagaccgccgugauuggacagacacucggccaagggccugcuggacuggugggcacccccacauga

SEQ ID NO: 69634 - RNA, 306 nt, Artificial Sequence
  derived and/or modified sequence opt5 from GAST__Homo_sapiens__NP_000796
augcagagacugugcguguacguccucaucuucgcccuggcucuugccgcguuuagcgaggcuuccuggaagccccggucucaacagccugacgccccgcugggcaccggggccaaccgcgaucucgaacugcccuggcuugagcagcagggaccugcuagccaccauagacggcaacugggcccccaggggccuccccaccucguugccgacccuuccaaaaagcagggaccguggcuggaagaggaagaggaggcuuauggcuggauggauuucgggcgcagaucugccgaagacgagaauuga

SEQ ID NO: 69635 - RNA, 1242 nt, Artificial Sequence
  derived and/or modified sequence opt5 from GATA1__Homo_sapiens__NP_002040
auggaguuccccggccuggggagccucggaaccuccgaaccucugccgcaguuuguggaccccgcccuugucucuagcacaccugaguccggcguuuucuuucccucugggccugaaggacuggaugcugccgcgagcuccacggcucccucuaccgccacagccgcugccgcugcccucgcguacuauagagacgccgaggcuuaccggcacagcccuguguuccaaguguauccgcugcuuaacugcauggaaggcauccccgggggauccccuuacgccggcugggcuuauggcaagaccgggcuguaccccgccagcacagucuguccuacccgcgaggauucucccccgcaggcgguggaggaccucgauggaaaaggcuccaccagcuuucuggaaacacugaagacggagagacucucuccugaccugcuuacccuggggcccgcccucccuuccagccugcccguucccaauucugcuuauggaggcccugauuucuccagcacauuuuucuccccgaccgggucuccccuuaacagcgccgcuuacuccagcccuaaacugcggggaacacucccccugccucccugcgaagcccgcgagugugugaauugcggcgccaccgcuacgccgcuguggagacgggaccgcacaggccauuaccucuguaacgcgugcgggcuguaucacaagaugaauggacagaacagaccucuuauucggcccaaaaagcgccugaucgucucuaagagagccggcacccaguguacaaauugccaaaccaccacaacgacccucuggcggcgcaacgcuuccggggauccuguguguaaugccugcggacuguacuauaaacuucaucagguuaacagaccccugacaaugcggaaggacggcauucagacccgcaauagaaaagccagcgggaaggggaaaaagaagcggggcucuagccucggcgggacaggagcugccgagggcccugcgggaggauuuaugguggucgcuggcggguccggcucuggaaacuguggcgaaguggccagcgggcugacccugggacccccgggcacggcccaccucuaccaggggcugggaccugugguccuuuccggccccguuagccaucugaugcccuucccugggccgcuccugggcucucccacaggauccuuuccuaccggccccaugccucccaccacaagcaccacagugguggcuccucuuucuuccuga

SEQ ID NO: 69636 - RNA, 1443 nt, Artificial Sequence
  derived and/or modified sequence opt5 from GATA2__Homo_sapiens__NP_001139133
auggagguggcccccgaacagccuagauggauggcucacccggccguccugaacgcgcaacaucccgacagccaccauccuggccucgcucacaauuacauggagcccgcccagcugcuuccucccgaugaaguugacguguucuuuaaccaucuggauucccaggggaauccuuauuacgccaacccggcucacgcccgggcucgcgugucuuauagccccgcccacgcgagacucaccggaggccagaugugccggccucaucugcuucacucccccgggcugccuuggcucgacggaggcaaggccgcucugucugccgcugccgcgcaucaccacaaucccuggacagucagcccguucuccaaaacgccucugcaucccucugccgcugggggaccuggcggcccccucagcguguaccccggggccggaggcggguccggaggcgggagcggaucuuccguugcuagccugaccccuacagccgcccacucuggcucccaucuuuuuggcuucccgcccaccccucccaaggaggugagcccugaucccucuacaaccggggcugcguccccggccagcuccucugcuggaggcagcgccgcccgcggggaagacaaagauggagucaaguaucaagugucccugacagagagcaugaaaauggagucuggcuccccucucagacccgggcuggcuaccaugggaacgcagccugccacccaccaucccaucccuacauaccccagcuauguuccggcggcugcccacgacuacucuagcggccuuuuucacccuggcggguuccugggaggccccgccuccucuuuuacccccaagcagcggagcaaggcucgcuccuguagcgaagggagagagugcgugaacuguggagccacagcuaccccucucuggcggcgcgauggcacggggcauuaccugugcaaugccuguggccuguaucacaaaaugaacggacagaauagaccgcucauuaagcccaaacggcgccugucugcggccagacgggcuggcacaugcugugccaacugccaaaccacaaccaccacacuuuggcgcagaaaugcuaacggggacccugucuguaaugccugcggacuguacuauaagcuccauaacgugaaucggccccugacgaugaaaaaggaaggcauccagaccagaaaccgcaagauguccaacaaaagcaagaaaucuaagaaaggggcggaguguuucgaggaacuuuccaagugcaugcaggagaaaagcuccccuuuuucugccgcugcccuggcuggacacauggcccccgugggccaccucccucccuucagccauuccgggcacauucugccgacaccuacccccauccauccuucuagcucccugagcuuuggccacccccauccgucuuccauggucacagccaugggauga

SEQ ID NO: 69637 - RNA, 1332 nt, Artificial Sequence
  derived and/or modified sequence opt5 from GATA3__Homo_sapiens__NP_002042
auggaggugaccgccgaccagcccagaugggucagccaccaucacccugcuguucugaacggccaacauccggauacacaccaucccgggcucucccacucuuacauggacgccgcgcaguauccucugcccgaagagguggaugugcuuuucaauaucgacggacagggcaaccacgucccucccuacuaugggaauagcgugcgggcuacgguucagcgcuacccuccgacccaucacggaucccaagugugcagacccccucugcuccauggcucucugcccuggcuugaugggggaaaggcccugggcagccaccacacagccuccccuuggaaccucucucccuuuagcaaaaccuccauucaucacggcagcccggggccucugucugucuaucccccugcuuccucuagcucccugagcggaggccaugccucuccccaccucuucacauuucccccuaccccgcccaaggacguguccccugaucccagccuguccacaccugggucugcuggaagcgcccggcaggacgaaaaagagugucuuaaguaccagguuccccugccggauuccaugaaacucgaaagcucucauucccgcggcagcaugaccgcgcuugggggagccucuagcuccacgcaccacccuaucaccacauaucccccuuacgugcccgaguacucuagcggccuguucccucccuccagccugcucggcgggucuccgaccggauuuggcugcaaguccagaccuaaggcucggagcucuacagggcgcgagugugucaauugcggagccaccuccacgccccuguggagacgggacggcacagggcauuaucuguguaacgcuugcggacucuaccacaaaaugaauggccagaaccgcccccugauuaagccuaaaagacggcuuagcgccgcgcgcagagccggcaccuccugugcuaauugccaaacaaccaccacaacgcuguggcggcgcaacgccaauggggauccgguguguaacgcuugcggacucuauuacaagcugcauaauaucaacagaccccuuaccaugaaaaaggaaggcauucagacacggaauagaaagaugucuagcaaauccaagaaauguaagaaagugcacgacucucuggaggauuucccuaagaacagcuccuuuaaccccgccgcccucagccgccacaugucuucccugagccauaucucuccuuucucccacagcucucauaugcugaccacacccaccccuaugcaucccccgagcucccucagcuuugggccucaccaccccucuuccauggucacggcuaugggauga

SEQ ID NO: 69638 - RNA, 1329 nt, Artificial Sequence
  derived and/or modified sequence opt5 from GATA4__Homo_sapiens__NP_002043
auguaccagagccuggccauggcugccaaccacgggcccccuccgggcgcguaugaggcuggaggccccggggccuucaugcauggagccggcgcugccuccucuccuguguacguccccaccccuagaguucccagcuccgugcucgggcugucuuaucuucaaggaggcggcgcugggagcgccuccggaggcgcgucugggggaagcuccggcggggccgcuagcggagccggcccuggcacacagcaggggucuccgggauggucccaggcuggcgccgacggggcggccuacacgcccccucccgugagcccucgguuuucuuuccccggaaccacaggcucccuggcugccgcugccgccgcugcggccgcucgcgaagccgccgcuuauagcucugggggaggcgccgcgggcgcugggcucgccggaagagagcaauacggccgggccggguuugcuggauccuauagcuccccguacccugccuacauggcugaugucggcgccucuugggcggccgcugccgcugccagcgcggggcccuucgacuccccugugcugcacagccuucccggccgcgccaaucccgcugccagacauccuaaccuggauauguuugacgauuucucugaaggacgggagugcguuaauuguggcgcuauguccaccccgcucuggcgcagagacgggacaggacacuaucugugcaacgccuguggccuguaccauaagaugaaugggaucaaccggccccucauuaaaccucagcgcagacugagcgccucucggcgcgugggacuuagcugcgcuaauugucagaccacaaccacgacccuguggagacggaacgcggaaggcgagcccgucugcaaugccugugggcucuauaugaagcugcacggcgugccucgcccccuugcuaugagaaaagagggaauccagacacggaagagaaaaccgaagaaccugaauaaguccaaaaccccugccgcccccucuggcagcgaaucccucccucccgcuagcggggccucuuccaacagcucuaaugcgacaaccuccagcuccgaggaaaugcgcccuauuaagacggagcccggacugucuagccacuacggccauuccucuagcguuucccaaacauuuagcgugucugcuauguccgggcacggaccgagcauccauccuguccugucugcccucaaacugagcccccagggcuaugccucccccgugucucagagcccucagaccuccagcaagcaagauucuuggaacucccuugugcuggcugacagccacggggauauuaucacagccuga

SEQ ID NO: 69639 - RNA, 1194 nt, Artificial Sequence
  derived and/or modified sequence opt5 from GATA5__Homo_sapiens__XP_006723762
auguaccagagccuggcccucgcugccucccccagacaagcggcuuaugccgacucuggcagcuuccugcacgccccuggggcuggauccccgauguuugugcccccugcccggguccccucuaugcuuagcuaccuguccggcugcgagccuucuccccagccuccggaacucgcugcccgccccgggugggcgcagaccgccacagcugauagcuccgccuucggaccuggcagcccccauccucccgcugcccacccgccuggggcgacggccuuucccuucgcucauucuccuuccggacccggcagcggcgggucugccggaggcagagacggguccgcuuaucagggagcccugcuuccccgggagcaauuugccgcuccucugggccgcccgguugggaccagcuacucugcgacauaucccgccuacguguccccugauguggcucagagcuggaccgccggacccuucgacggcuccguccuccacggccugccugggagacggcccacauuugugucugauuuccuggaagaguuuccgggagaaggccgcgaguguguuaacugcggggcccucagcaccccucuguggagacgggacggaacaggccauuaucuuuguaaugcuugcgggcuguaccacaagaugaacggagugaaucgcccccucgucagaccucagaaacggcuguccagcucucgcagagccggccuuuguugcaccaacugucacacgaccaauacaacccuguggcggcgcaacuccgagggcgaacccgugugcaaugcgugugggcucuacaugaagcugcauggaguuccuagaccccuggcuaugaaaaaggagagcauccagacacggaaaagaaagccgaagaccauugccaaagcccgcggcucuagcggguccacgcggaacgcuucugccagcccuuccgcuguggccagcacagauucuuccgcggccaccagcaaggcuaaacccucucucgccucccccgucugcccuggaccgagcauggcuccccaagccuccggccaggaagacgauucucuggcgccugggcaccuugaguucaaguuugagcccgaagacuucgccuuuccuagcacagcucccuccccucaggccggccugagaggagcucuccgccaggaggccuggugugcccuggcucuugcguga

SEQ ID NO: 69640 - RNA, 1788 nt, Artificial Sequence
  derived and/or modified sequence opt5 from GATA6__Homo_sapiens__NP_005248
auggcccugaccgacggcggguggugccuccccaagagauucggagcugccggcgcggaugcuagcgacucccgggccuuuccugcccgcgagccgucuacacccccuagccccaucuccucuagcuccucuagcuguuccagagggggagaacggggcccugggggagcuagcaacugcggcacgccccagcuggauaccgaggccgcugccggcccuccggcgcgcucucuucugcucuccagcuacgccucucaccccuucggggcuccucauggacccuccgccccuggcguggcugggcccggaggcaaucugagcucuugggaagaccuucugcucuuuacagaucuggaccaagccgcgaccgccuccaaacugcucuggagcuccagaggggcuaagcugucuccguucgccccugagcagcccgaagagauguaucagacacuugcugcccugagcucccagggaccugccgcuuacgauggcgcgcccggcggguuuguccacagcgccgcugccgccgcugccgcggcugccgccgcuucuucccccguuuaugugccuaccacacgggugggaagcaugcucccgggccugcccuaccaucuucaagggucuggaagcggcccugccaaccacgcugggggagccggcgcgcaucccggcuggccucaggccuccgcugacucucccccguaugggagcggaggcggggccgcuggaggcggggccgcgggcccuggaggcgccggguccgcugccgcucacgucagcgcccgcuuccccuacucuccuuccccucccauggccaauggagcugcgagagagcccggcggguaugccgcugccggaagcggcggggccggcggagugucuggcgggggauccagccuggcugccaugggcgggcgggaaccgcaguacuccucucucagcgcggcucgcccucugaacggaaccuaccaccaucaccaucaccaccaucaccaucaccccucccccuauucuccuuacguuggcgccccgcugacgcccgccuggccugcugggcccuuugagaccccugugcuccauagccugcaguccagagccggcgcgccccuuccugucccccggggaccgagcgcugaucugcucgaagaccugucugagucccgcgagugugugaauugcggcagcauucaaacaccucuuuggagacgggaugggaccggacacuaucuguguaacgccugcggccucuacucuaaaaugaaugggcugucccgcccccugaucaagccucagaaaagaguucccagcucucggagacucggacugagcugugccaacugccacacaaccacgacaacccuuuggcgccggaaugcugaaggcgagccgguguguaacgccugcgggcuguauaugaagcuccauggcgucccuagaccccuggcuaugaagaaagaaggcauucagacacgcaagcggaaaccuaagaauaucaacaaauccaagaccuguagcggaaauucuaacaauuccauucccaugacccccacaagcacguccucuaacagcgacgauugcuccaagaacaccucuccuacaacccagccgacagccagcggggcgggagcccccgugaugaccggcgcuggggaguccacgaauccugaaaacucugagcuuaaauacagcggacaagacggccuguauaucggcgugucccucgccagccccgcugaggucacaucuuccguuagaccugacagcuggugcgcccuggcccuggcuuga

SEQ ID NO: 69641 - RNA, 810 nt, Artificial Sequence
  derived and/or modified sequence opt5 from GATAD1__Homo_sapiens__NP_066990
augccccugggccucaagccuaccugcagcguguguaaaacaacguccucuagcauguggaagaaaggggcccagggagagauccugugccaccauuguaccggcagagggggagcuggcuccgggggagccggcucuggcgcggcugggggaacaggcgggagcggaggcgggggauucggcgccgccaccuuugcuuccacaucugccaccccgccccaaagcaacggcgggggaggcgggaagcaguccaaacaggaaauucaccggcgcagcgcuagacuucggaauacaaaguacaagucugccccugcggccgagaaaaaggucuccaccaaaggaaagggccgcagacauaucuucaaacugaagaaccccauuaaggcuccugaaagcguuucuacgaucauuaccgccgaguccaucuuuuauaaagggguguacuaucagaucggagacguggucagcgugauugaugaacaagacggcaagcccuacuaugcucagauccggggcuucauucaggaucaguacugcgagaaaucugccgcgcucacauggcugaucccuacccuuuccagcccgcgcgaccaauuugaucccgccuccuauauuaucgggccugaggaagaccugcccagaaagauggaguaccucgaguucguuugucacgcuccuucugaauacuuuaaaagccgguccagccccuucccgacagugccuacccgccccgagaagggauauauuuggacgcaugucggcccuacacccgccaucaccaucaaagaaucuguggcuaaucaccuguga

SEQ ID NO: 69642 - RNA, 1905 nt, Artificial Sequence
  derived and/or modified sequence opt5 from GATAD2A__Homo_sapiens__NP_001287875
augaccgaggaagccugcagaacacggagccagaagcgcgcucuggagagagaccccacggaagaugacguggaguccaaaaagaucaaaauggaacggggccuccuggccucugaucuuaacaccgacggggauaugcgcgucacaccugagccgggagcgggccccacccaggggcugcucagagcuacagaggccaccgccauggcuaugggacggggcgaagggcugguuggagacggcccuguggauaugcgcacaagccacuccgacaugaagucugagagacggcccccuagccccgaugugauuguccuuuccgacaaugaacagccuucuagcccgcgcgugaacggccugaccacgguugcccucaaagagaccuccacagaggcucugaugaaaagcucucccgaagagagagaacggaugaucaagcagcugaaagaggaacuccgccuggaggaggccaaacuugugcugcucaagaagcugagacagucccaaauucagaaagaagcgaccgcccagaagccuacagggagcgucggaucuaccgugacgacacccccuccccuuguucggggcacccagaauaucccggcugggaagccuucccugcaaacaagcucugcccgcaugcccggauccgugauuccuccuccccucgucagaggcgggcagcaggcuagcuccaaacugggaccccaggccucuagccaaguggugaugccgccccugguccggggcgcgcagcagauccauuccaucagacaacacagcucuaccggcccucccccucuccugcuugcuccccgcgccuccguuccgagcgugcagauucaggggcagcggaucauucaacagggacugaucagaguggccaacgucccuaauaccucucuccuggugaacauuccccagccuacacccgcuagccuuaagggcacgaccgccacauccgcccaggcuaauucuaccccuacaagcguugcguccguggucaccagcgccgagucucccgcuucccgccaagccgccgcuaaacuggcccuccggaagcagcuggaaaagacgcugcucgagaucccgccucccaagcccccugcgccggaaaugaacuuccugcccagcgcugccaauaacgaguuuauuuaccuuguggggcuggaggaaguugugcagaaucuccuggagacacaggccggaagaaugucugcugccaccguccuuucccgcgaaccuuauaugugugcucaaugcaaaaccgauuucacaugucgguggagagaggaaaagagcggcgccaucaugugcgagaacuguaugaccacaaaucagaagaaagcgcugaagguggagcauacgucccgccucaaagccgcuuuugucaaggcccugcagcaggaacaagagaucgaacagcggcugcuccagcaagggaccgcucccgcccaggcgaaagccgagccuacagcugcuccccacccugugcugaagcagguuauuaagcccagacgcaaacuugccuuccggucuggagaggccagagacuggagcaacggcgccgugcugcaggcuuccucucaacucagccggggcuccgcgaccacaccgcgcgggguccugcauaccuuuagcccuucucccaagcugcaaaauuccgccagcgcuacggcccuugugucuagaaccggacggcacuccgaaagaacaguuagcgccggcaaagggucugcuaccagcaacuggaagaaaacaccucucuccaccggaggcacgcuggccuucgugagccccucucuggcgguccacaaguccagcuccgcuguggaucgccagcgggaguaccuccuggacaugaucccgccuagaucuauuccccagagcgccacauggaaguga

SEQ ID NO: 69643 - RNA, 1782 nt, Artificial Sequence
  derived and/or modified sequence opt5 from GATAD2B__Homo_sapiens__XP_006711532
auggacagaaugaccgaggaugcccugcggcucaaccugcuuaagcgcagccuggaccccgcugaugaaagagacgaugugcucgccaaacggcugaagauggagggccacgaagcgauggagcgccuuaaaaugcuggcucuccugaagagaaaagaccuggccaaucucgaagucccucaugagcugccgacaaagcaggauggguccggaguuaagggcuacgaggaaaaacuuaacgggaaucugcggccccacggagacaaccgcacggccggcagaccugggaaggagaauaucaacgaugaacccguggacaugucugcucggcgcagcgagccugagagaggacggcucacccccuccccugauauuaucgugcugucugacaaugaagccagcuccccgcgcucuagcuccagaauggaggaacggcuuaaagcugccaaccuggagauguucaagggcaaaggcauugaggaacgccaacagcucaucaagcagcugagagaugagcugcggcucgaagaggcgagacugguccuucugaagaaacuccgccagagccaacugcagaaggaaaaugugguucagaaaacacccgugguccagaacgccgcuucuauugugcaaccuucccccgcccauguugggcagcagggacuuagcaagcugccuucucggcccggcgcucaggggguggagccgcaaaaucucagaacccugcagggacacuccgucauccgcagcgccacaaacaccacacugccucauaugcucaugucucagcgggugaucgcgcccaauccugcccaacugcagggccagagagggccucccaaacccggacuugugcgcaccacgaccccgaacaugaaucccgcuauuaacuaucagccucaauccagcuccucuguccccugccagcggacaaccagcuccgccaucuacaugaaccuggcuagccacauucagccuggcacaguuaauagagugucuagcccccucccguccccuucugccaugaccgacgccgcuaacagccaggcggccgcuaagcuggcccuucgcaaacaacuggaaaagacgcuccuggagauucccccucccaagccucccgccccgcugcuccacuuucugccuuccgcugccaauucugaguucaucuauauggugggccuugaagaggucgugcagagcguuaucgacucccaggggaaaagcugugcgucucugcuccggguggaacccuuugucugcgcucaguguagaacagauuucacaccccauuggaagcaagagaaaaacggaaagauucugugcgaacaguguaugaccuccaaucagaaaaaggcccugaaggccgagcacaccaaccgccuuaaaaaugcuuuugugaaggcccuccagcaagagcaggaaaucgagcagcggcugcaacagcaggcugcccugagcccuaccacagcgccggccguuucuuccgugagcaaacaggaaacgaucaugagacaucacacccuccggcaagcuccccagccucaguccucucugcagcgcggcauucccacaagcgccagauccaugcuuucuaacuucgcucaagccccucagcugagcguccccgggggacuccugggcaugccuggggugaauaucgcguaccugaacaccggaauuggcggccacaaggggcccucccuugccgaccggcagagagaguaucuccuggauaugaucccgccucgcagcauuucucaguccaucagcggacaaaaauga

SEQ ID NO: 69644 - RNA, 1674 nt, Artificial Sequence
  derived and/or modified sequence opt5 from GATB__Homo_sapiens__NP_004555
auggccgcucccaugcugagauggggcugccgggggcgcagaugggccuucgcgcggguggacggaggcagcugucaccgcagaggggcuccuaccggauccacaucuaaccagauccggggcgagagcuccgucgcccaacagccgcuccauacggcccagaagacccgcaaaggggaacacaagugggcugccguugugggacuggagauucaugcucagaucucuagcaauuccaaacuguuuucuggcagccaagugagauucuccgcgcccccuaacagccuugucuccuuuuucgaugccucucuccccggcacacugccugugcuuaaucggcgcugcguugaagccgcugugaugaccgggcuggcccucaacugucacauuaauaagaaaagccuguuugacagaaagcauuacuucuaugcugaucugcccgccggauaccagaucacacagcagcggcucccuauugcggucaacggcucucugaucuauggggugugcgccggaaagaaacaaucccagguuaucccgaagaccgugcgcauuaaacagauccagcuugagcaagacagcggcaagucucugcacgauaaucucagaucccagacacugauugaccuuaaccgggcuggggucggacugcucgaaguggugcuggagcccgauaugagcuguggcgaggaagccgcuaccgccguccgcgagcugcagcucauccugcaagcccuuggcacgucccaggcuaauauggcggaagggcagcugagaguugacgccaacauuucugugcaccauccuggagagccccucggcgugcggaccgaggucaaaaaucugaacagcaucagauuucuugcuaaggccauugauuacgaaauccagcgccaaaucaaugagcuggaaaacgggggagagauucucaaugaaacacgguccuuccaccauaagcugggcugcaccaugagcaugagagacaaagaggggaagcaggauuaucgcuuuaugccugagcccaaccugccgccucucgugcuguacgacgccacaucucuucccgcuggagccgauccucagcagguuaucaacauugaccaaauccgggaaacccugcccgagcuccccuccgugacgagagaaaaacugguccagcaguauggcaugcuucuggagcacagcuucacacuccugaaugaagugggccugcucgaguuuuuccagaacguuauuaaggagacccgcgcggaaccuaaaaaggugacaucuuggguccugaauaccuuucuuggguaccugaaacaacagaaccucgcugugagcgaguccccggucacccccucugcccuggccgaacugcuugaccuccuggauagccggacaaucuccagcucugcugccaaacagguguucgaggaacuguggaagagagagggaaagacgccuggccagaucguuuccgagaagcaacucgaacugaugcaggaccagggggcucuugagcaacugugucacagcgugauggaagcccauccccaggucgugauggauguuaaaaaucgcaacccucgggcgauuaauaagcucaucggacuggugagaaaagccacccagucucgcgcugaccccgucaugauuaaggagauccuggagaagaaacuuucccucuga

SEQ ID NO: 69645 - RNA, 1272 nt, Artificial Sequence
  derived and/or modified sequence opt5 from GATM__Homo_sapiens__NP_001473
augcugagagugcggugccuccgcggcgggagcagaggagccgaggcuguccacuacaucggcucccggcuggggcgcacccuuacaggauggguucagagaacguuccaaucuacccaggccgcgacagcuagcucccggaacucuugugccgccgacgauaaggcuaccgaaccccugccuaaagacugcccggugagcuccuauaaugagugggauccccucgaagaggugauugucggccgcgccgaaaacgcuugugugccucccuuuacaaucgagguuaaggccaauaccuacgagaaauauuggccuuucuaccagaagcaagggggacauuauuuucccaaagaccaccugaagaaggcgguggccgaaauugaggaaaugugcaacauccuuaaaacagagggcgucaccgugagacggccugauccgauugacuggucucugaaguacaaaacgcccgauuucgagagcaccggccucuauuccgcuaugccucgcgacauccugaucguuguggggaaugaaauuaucgaggcccccauggcuuggagaagccgguuuuucgaauaccgcgccuacagaucuauuaucaaggauuauuuucaucggggagcgaaauggacaaccgccccuaagcccacaauggcugacgagcuguacaaccaggauuauccgauucacuccgucgaagaccgccauaagcucgccgcucagggcaaauucgugaccacggaguuugagccuuguuucgaugccgccgacuuuaucagagcugggcgggacauuuucgcgcagagaagccaggugacaaauuaccugggaaucgaauggaugcgccggcaccuugcccccgauuauagaguccacaucauuucuuuuaaggacccuaaccccaugcauaucgaugcuaccuucaauauuaucggccccgggauuguucuguccaacccugaccgcccgugccaccaaaucgaucucuucaaaaaggccggauggacaaucauuacacccccuacccccaucauuccugacgaucauccccuguggaugagcucuaaauggcuuuccaugaaugugcugaugcucgacgagaagcgggugauggucgaugccaacgaagugccgauccagaaaauguuugagaagcugggcauuaccacgaucaagguuaauaucagaaacgcuaauagccugggcgggggauuccacuguuggaccugcgacgugcgccggagaggcacacuccaguccuaccuggauuga

SEQ ID NO: 69646 - RNA, 2784 nt, Artificial Sequence
  derived and/or modified sequence opt5 from GBA2__Homo_sapiens__NP_065995
augggcacccaggaccccgggaacaugggaacaggcgugccugccagcgagcaaaucuccugcgcuaaggaagauccgcaggucuacugucccgaggaaaccgggggaacgaaagacguucaggugacagauugcaagucuccugaggacagcagacccccuaaagaaaccgauuguugcaaucccgaggacuccggccagcugauggugucuuaugaggggaaggccaugggauaccaagucccuccguucggcuggcggauuugucucgcgcacgaauuuacagagaaacgcaagcccuuccaggcuaacaaugugagccuguccaacaugaucaagcauauuggcauggggcuuagauaucugcaguggugguaccggaaaacccacguugaaaagaaaacaccuuuuaucgauaugauuaauucugugccccuccgccagaucuauggaugcccucugggcgggaucggaggcgggaccauuacgagaggauggcggggccaauucugucgcuggcagcuuaaccccggcauguaccagcauagaaccgucaucgccgaccaguuuacagugugccugcggcgcgaggggcaaaccguuuaucaacaggugcucagccuggagagaccguccguccugcggagcuggaauuggggacucuguggcuacuucgccuuuuaccacgcucuguauccucgcgccuggacaguguaccagcuucccgggcagaacgugacccugacgugcagacagauuacaccuauccucccccaugauuaucaggacucuucccugcccgucggaguuuucgugugggauguggaaaaugagggcgacgaagcucuugaugucagcauuauguuuucuaugcggaacgggcugggaggcggcgacgacgccccugggggacucuggaaugagccguucugucuggaacgcuccggcgagaccgugagagggcugcuccugcaccaccccacacuuccuaaccccuacaccauggcgguugccgcucgggugaccgccgcuacaacggucacccauaucacagccuuugauccugacagcaccggacaacagguguggcaggaucugcuccaggacggccaacuggauucucccacagggcaguccaccccgacgcagaagggcguuggaauugcgggcgccgugugcgucagcuccaaacuuagaccucgcgggcagugccggcuggaguucucucucgcuugggacaugcccagaaucauguuuggagccaagggccaagugcacuaucgccgguacacaagauucuucgggcaggauggagacgcugccccugcccugagccauuaugcucugugucgcuacgcggaaugggaggaacggaucuccgccuggcagagccccguccucgaugacagaucucugccugcuugguacaaguccgcccuuuuuaaugagcuguauuuccucgccgauggcgggaccguguggcuggaaguucuugaggacagccugcccgaggaacucggccgcaacaugugccaucugcggccgacccugagagacuacggacgcuuuggcuaucucgaggggcaggaauaccggauguauaauacauacgaugugcacuucuaugcuucuuuugcccugauuaugcuuuggccuaaacuggagcucagccugcaauacgacauggcgcuggcuacccuuagagaagaucucacacggcgcagauaccugauguccggagucauggcccccgugaagcggagaaacguuaucccccacgacauuggcgauccugacgaugagccguggcugcgcgugaacgccuaucucauccacgacacggcugauuggaaagaccugaaucuuaaguucguccuccagguguaccgggauuauuaccugaccggggaccagaacuuucugaaagauauguggcccgugugucuggccguuauggagucugaaaugaaguucgacaaagaccaugauggacuuauugagaauggcggguaugcugaccaaacauacgauggcugggucaccacaggaccuagcgccuauugcggcgggcucuggcuggcggccguggcugugaugguccagauggccgcucuguguggagcccaggacauccaggauaaguuuuccagcauccucucuagaggccaagaagcguacgagcgccugcuuuggaacgggagauacuauaauuacgacuccagcucucggccccagucccgcagcgugauguccgaucagugcgccggacagugguuccugaaggcuuguggccucggggagggcgacaccgaaguuuuuccuacgcaacacguggucagagcccugcagaccauuuucgagcugaacgugcaggcuuuugccggaggcgccaugggggcuguuaauggaaugcagccccauggcgugccugauaaaucuagcguccaauccgacgaaguguggguugggguggucuauggacuugcggccacaaugauccaggagggccucaccugggaaggcuuccagacagcugaggggugcuaccggaccgugugggagcgccugggacuggccuuccaaacgcccgaagccuauugucagcagagaguguuucggucucucgcuuacaugcgcccgcugagcauuugggccaugcagcuugcgcugcaacagcagcagcacaagaaggcuuccuggccuaaagucaaacaaggcacagggcucagaaccggacccauguucggcccuaaggaggccauggccaaccugagccccgaauga

SEQ ID NO: 69647 - RNA, 1350 nt, Artificial Sequence
  derived and/or modified sequence opt5 from GBA__Homo_sapiens__NP_001165282
auggagcugagcaugggccccauccaggccaaccacaccgggacaggacuccugcuuacgcugcaaccugaacagaaguuccagaaagugaagggcuuugggggagcuaugaccgacgccgcggcucucaauauucuggcccuuuccccgcccgcccagaaccugcuccugaaaucuuacuucagcgaggaaggcaucggguauaauauuaucagagucccuauggcuuccugcgauuuuucuauucggacauacaccuaugccgacacacccgaugacuuccaacugcauaacuuuagccucccugaggaagauaccaagcugaaaaucccccuuauccaccgcgcucugcagcucgcccagagaccuguuucccugcuugcgucuccguggacaagccccaccuggcugaagacgaauggagccgugaacggcaagggcucccucaaagggcagccuggagacauuuaccaucaaaccugggcucgguauuucgugaaguuucuggaugccuacgcugagcacaaacugcaguucugggccgucacagcggagaaugaacccagcgccggccuccugucuggguauccuuuucagugucuuggauucacccccgagcaucagcgcgacuuuaucgcuagagaucugggcccgacacucgccaacuccacccaccacaaugugcggcugcuuaugcuggacgaucaacgccuccugcugccucauugggcuaagguugugcucacggaccccgaagccgccaaauacguccacgggauugcugugcauugguaccuggauuuccuugcgccugccaaggcuacacugggagagacccacagacucuuucccaacacaaugcuguucgccagcgaggccugcguuggcucuaaguucugggaacaguccgugcggcuuggcagcugggaccgcgggaugcaguauucucacuccaucauuaccaaucugcucuaccaugucgugggauggaccgacuggaaccuggcucugaaucccgagggcgggccuaacugggugagaaauuuugucgauagcccgaucauuguugacaucacaaaagauacguucuauaagcaacccauguuuuaccaccucggacauuucuccaaauuuaucccugaaggcucucagcggguggggcugguggccagccagaagaacgaccuugaugcggucgcucugaugcaccccgacggauccgccgugguugugguccucaaccgcagcucuaaagaugugccucugaccauuaaggaccccgccguuggcuuccuggagacaaucuccccgggcuauagcauucauaccuaccuuuggagacggcaguga

SEQ ID NO: 69648 - RNA, 744 nt, Artificial Sequence
  derived and/or modified sequence opt5 from GBAS__Homo_sapiens__NP_001189398
auggccgcuagagugcugcgggcccgcggcgcggcuugggccgggggacuccugcagagagccgcucccugcagccuucugccucggcuccgcaccuggacauccucuagcaacagaucccgggaggacucuuggcuuaagagccuguucguccgcaaaguugauccgagaaaggacgcccacuccaaucugcucgcuaaaaaggaaacgucuaaccuguacaaacugcaauuuaagcgguguugccagcgcuucaccaagaucaauacaacccucgugcugugguggggccuugggacaagaggaauggccagccggaccaaacuggaguuucucgaguuccgcaaggcgagauccgauaugcugcuuagccggaaaaaccagcugcuccuggaguuuucuuucuggaaugaacccgugccucgcuccggccccaacauuuaugagcugagaagcuaccagcuccggccugggacaaugaucgaguggggaaauuauugggccagagcuauucgcuuucggcaagacggcaacgaagccgucggcggguucuuuucucagaucggacagcuguacauggugcaucaccuuugggcuuauagagaucugcagacccgcgaggacauucggaaugccgcguggcauaagcacggcugggaagaacucguuuacuauacggugccccugauccaagagauggaauccagaaucaugauuccucuuaaaaccagcccgcugcaguga

SEQ ID NO: 69649 - RNA, 2109 nt, Artificial Sequence
  derived and/or modified sequence opt5 from GBE1__Homo_sapiens__NP_000149
auggccgcucccaugaccccugccgcgagaccggaggacuacgaagcugcccugaacgccgcucucgccgaugugcccgagcuggcucggcuucuggaaaucgacccuuaucucaagcccuacgccgucgauuuccagcgcagauauaaacaauuuagccagauucugaagaauaucggcgagaacgaagggggaauugacaaauucucccggggcuacgagucuuuugggguucaccgcugcgcggauggaggccuuuauuguaaggagugggccccuggggcugaaggaguguuccugacaggcgacuuuaauggcuggaaccccuucagcuacccuuauaaaaagcucgauuacgggaagugggagcuguacaucccgcccaaacagaauaaguccgugcuggucccucauggaucuaaacucaaggugguuauuacgagcaaauccggcgaaauccuguauagaaucucucccugggccaaguacgugguccgggagggggacaacgugaauuaugauuggauucacugggacccugagcauagcuacgaauuuaagcacucccgccccaaaaagccgagaagccuucggaucuaugagucucauguuggaauuuccagccacgaaggcaaaguggcuucuuacaagcacuucacaugcaacguccugccucgcaucaaagggcucggauauaauuguauucagcugauggccaucauggagcaugcguacuacgccuccuuuggcuaucaaauuaccagcuucuuugcugccucuuccagauacggcacccccgaggaacuucaggagcugguggauacagcucacagcauggggaucaucgugcuccuggacgucguucauucccacgccucuaagaacagcgccgauggacugaauauguucgacggcaccgacuccugcuauuuucacagcgggccucggggaacacaugaucucugggacucucgccuguucgcuuacuccagcugggaagugcuuagauuccugcucucuaacauucggugguggcuggaggaauaucgcuuugauggcuucagauuugacggggugaccagcaugcuuuaccaccaucacggagucggccagggcuucuccggggauuauucugaguacuuuggacuccagguggacgaagaugcgcugacguaccugaugcuggccaaucaucucguucacacccugugucccgacagcaucacaauugcugaggauguguccggcaugcccgcccuuugcagcccuaucucucaagggggaggcggguucgacuaucggcuggccauggcuauuccggauaaauggauccagcuccugaaggaguuuaaggacgaagacuggaacaugggcgauaucgucuacacccuuacaaauagacgcuaucuggagaaauguauugccuacgcggaaucccacgaccaggcucucgugggagauaagagccuggccuucuggcugauggacgccgagauguauaccaacaugucuguucucacgcccuuuacaccugugaucgaucggggcauucagcugcauaaaaugaucagacuuauuacccacgggcugggaggcgaaggguaccucaacuucaugggaaaugaguuuggccaucccgaguggcuggacuucccucgcaaggggaacaaugaauccuaucacuacgcucggagacaauuucaccugacagaugacgaucuucuccgcuacaaauuccugaacaauuucgaccgggauaugaacagacuggaggaacgcuauggcuggcucgccgcuccccaggccuacgucagcgagaagcaugagggaaauaagaucaucgcguuugaacgggccggccugcuuuucauuuuuaacuuccacccguccaaaucuuauaccgacuacagaguggggaccgcucugccuggaaaguuuaaaaucguccucgauagcgacgccgcugaguauggcgggcaucagcgccuggaccacuccacagauuucuuuucugaagccuucgagcauaauggacggcccuacagccugcuuguguauauuccuuccagaguugcgcucauccugcaaaacguggaccugcccaauuga

SEQ ID NO: 69650 - RNA, 5580 nt, Artificial Sequence
  derived and/or modified sequence opt5 from GBF1__Homo_sapiens__NP_004184
augguggacaagaacaucuacauuauccagggcgaaauuaauaucgucguuggggccauuaagagaaacgcucggugguccacccacacaccccuggaugaagaacgcgacccucuccugcauuccuucggacaccuuaaggaagugcucaauucuaucacggagcucagcgaaaucgagccgaacguguuucugagacccuuccuugaggucauucgguccgaagauaccacaggcccuaucaccgggcuggcccucacaucugugaauaaauuucugagcuaugcgcugauugaccccacccaugagggaacagcugaaggcauggagaacauggccgaugccguuacccacgcucgcuucguggggacggacccugccuccgaugaggucgugcucaugaagauccugcaaguucuuagaacccugcuccugacacccgugggagcucaucuuaccaaugaaucugucugcgagauuaugcagagcuguuuucggaucugcuucgaaaugcgccuguccgagcuccugagaaaaagcgccgaacacacacugguggacauggugcagcuccuguuuacccggcuuccucaguucaaggaggagccgaagaacuacgucggcacgaauaugaaaaagcugaaaaugcgcgcgggcgggaugucugauuccagcaaguggaaaaagcaaaagagaucuccccggccuccccgccacaugacaaaaguuaccccuggauccgaacuccccacaccgaacggcaccacccugagcucuaaucuuacagggggaaugccuuuuauugacgugcccacgccuaucuccagcgccuccucugaggcugccagcgcuguggucucccccagcaccgauucuggccuggaguucuccagccagacaaccucuaaggaggaccucacagaucuggaacagcccgggagcccuggauauuccaccgccacggagccgggcucuagcgagcugggcgugcccgaacagccugaccuccaagaggggacacauguugaaaaaucccagagcgcgucuguggaguccauccccgaaguccuggaggaguguaccagcccugccgaccacucugauuccgcuagcgugcaugacauggauuacguuaaccccagaggagugcgguuuacccaguccucucagaaggaaggcacagcccuugucccguaugggcugccuugcauucgcgaacuguucagauuucugaucagccuuaccaauccccacgaccggcacaacuccgaagugaugauucauaugggacugcaccuccugacagucgcucuggagucugccccuguggcccaaugucagacgcuccugggccuuaucaaagaugagaugugcagacaucuguuccagcuccugagcauugaacgccugaaucuuuacgcugcgucccuccggguuuguuuccugcuguuugagagcaugagagaacaccucaaguuccaaauggagauguauaucaaaaagcugauggaaaucauuaccguggagaaccccaagaugccuuacgagaugaaagaaauggcccuugaggcuaucguccagcuguggcgcauucccucuuuugugacagaacucuacaucaacuaugacugcgauuacuauuguuccaaucuguucgaggaacugaccaaacuucucagcaaaaacgccuuuccgguuucugggcagcuguacacaacccaucugcucucccuggacgcccuucugacggugauugauagcaccgaggcucacugccaggccaagguccucaauucucugacacaacaggagaaaaaggaaaccgcgcggccuagcugugagaucguggacggaacaagagaggcuuccaacaccgagcgcacggccagcgauggcaaggccgugggcauggcuucugacauccccgggcugcaccuucccggaggcgggcggcucccuccggaacauggaaaauccggcugcagcgaccuggaggaggccguugauuccggggcugacaagaaauucgccagaaagcccccucgcuuuucuugccugcuccccgauccucgggaacugauugagaucaaaaauaagaagaaacuucugauuacaggcaccgaacaguucaaccagaagcccaaaaagggaauccaauuucuccaggagaaaggccugcugacaauuccuauggacaauaccgaggucgcgcaguggcuuagagaaaacccccgccucgauaagaagaugaucggggaguucgugagcgaccggaaaaauauugaucugcuggaauccuuugugucuaccuucagcuuucagggacucagacuggacgaggcccuucggcuguaucucgaggcuuuccgccugccgggcgaggccccugucauccaaagacugcuugaggcuuucacagaacgguggaugaacuguaaugggucccccuuugccaacucugaugcgugcuucagccuggccuacgcugugaucaugcucaauacggaccagcacaaccauaauguuagaaagcagaacgccccuaugacccuggaggaauuucgcaaaaaccucaagggagugaauggcgggaaagauuucgagcaggacauucuggaagauauguaucacgcuaucaagaacgaggagauugucaugcccgaggaacagacaggccuugugcgggaaaauuacguuuggaacgugcugcuccacagaggagccaccccggagggcaucuuucugcgcgucccuacagccuccuacgaccuggaccuuuucaccaugacgugggggcccacaauugcugcgcugagcuauguguuugauaaaucucucgaagagaccaucauccagaaggccauuuccggauucagaaagugugcuaugaucagcgcccauuacggccugucugacguuuuugauaaucucauuaucucccugugcaaauucaccgcccuuagcucugaguccauugaaaaccugccuagcguguuuggguccaaucccaaggcucacaucgccgcgaaaacagucuuccaucucgcucaccggcauggagacauccugcgcgagggcuggaagaacauuauggaagccaugcugcagcuuuuuagagcccaacugcuccccaaagcuaugaucgagguggaggauuucguggacccuaaugggaagauuagccugcagcgggaagagaccccgucuaaccgcggcgaaagcacaguccucuccuucguuucuuggcugacgcuuagcggacccgagcaguccucugugagaggcccuagcaccgaaaaucaggaggccaagcggguggcgcuggaguguaucaaacaaugcgaucccgaaaagaugauuacagaguccaaauuucugcagcucgaaucucugcaggagcuuaugaaggcucuggucagcgugaccccugacgaagagacauaugaugaggaagacgccgccuucugucucgagaugcugcuccgcaucguucuggaaaacagagaucggguggggugcgucuggcagaccgugcgcgaccaccuuuaccaccuguguguucaagcucaggauuuuugcuuccugguggagagagccgucgugggacuccugcggcuugcuaucagacugcuccgccgggaagagauuuccgcccagguucugcucagccugagaauccuucugcugaugaaacccucugugcucucccgcgucagccaucagguggcguauggccugcacgagcuucugaagacgaaugccgcuaacauucauucuggggacgacugggccacccucuuuacacugcucgaauguaucggauccggcgugaagccuccggcugcccugcaagccaccgcucgggcggaugcccccgacgcuggggcccagagcgauuccgagcuuccuucuuaccaccagaaugacgucagccuggauagaggcuauacauccgacagcgaaguuuacaccgaucauggacgccccggcaaaauucaccggucugccacagacgcugauguggugaacuccggguggcuggucgugggaaaggacgauguugacaacagcaaaccuggccccucuagaccggggccuagcccccucaucaaucaauacucccugaccgugggacuugaccugggcccccacgauacgaagucucuccugaaaugcgucgagagccuguccuucauugugcgcgacgccgcgcauaucacaccugauaacuuugagcucugcguuaagacccuucggaucuucguggaggcuucucugaauggcggguguaagagccaggagaaaagaggaaagucccacaaauaugacagcaagggcaaccgguuuaaaaagaaaucuaaggaaggguccaugcugcgcagaccccggaccagcucccagcaugccucucgcggaggccagagcgaugacgaugaggacgaaggggucccugccuccuaccacacagugucucuccaagucagccaggaucugcuugaccugaugcacacccuccauacgagagcugccuccauuuauagcucuugggcggaggagcagcggcaccuggaaacaggaggccagaagaucgaggcugauuccagaacccugugggcccauugcugguguccgcuccuucaaggcauugccugccuguguugcgacgcucgccggcaagugagaaugcaggcccugacauaccuccagcgcgcucugcuuguucacgaucugcaaaaacucgacgcccuggaaugggagagcuguuucaauaaggugcuguuuccccuccuuaccaaacugcuggaaaacaucucuccugcggacgucgggggaauggaggagacacggaugagagccuccacccuccugagcaagguguuccuucagcaucugucuccccuccugagccuguccacguucgcugcccucuggcuuaccauucuggauuuuauggacaaauauaugcacgcuggcucuagcgaucugcucuccgaagccaucccugagagccugaagaauaugcuucugguuauggacacagccgaaaucuuccacuccgcugaugcgcgcgggggaggccccucugcccucugggagauuaccugggaacggaucgacugcuuucugccgcaucugagagaugaacuguucaagcagacagugauucaggacccuaugcccauggagccucaagggcagaaaccccuugcuagcgcccaccugaccuccgccgcuggagauacgcgcacaccuggccaucccccgccucccgaaauccccucugagcugggcgccugugacuuugaaaagccugagagcccgagagcggcuuccucuagcucccccgggagcccugucgccucuucccccagccggcucucuccuacccccgauggaccuccgccccuggcccagccuccccuuauucugcaaccucucgcuagcccccuccaggugggcgugccgccuaugacacugcccaucauccucaaccccgcccuuauugaggcgaccagcccuguuccccugcuggccaccccucgcccgacagaccccaucccuacgucugaagucaauuga

SEQ ID NO: 69651 - RNA, 885 nt, Artificial Sequence
  derived and/or modified sequence opt5 from GBGT1__Homo_sapiens__NP_001269558
augcacagacggcgccuggcccucggccugggguucugccuucuggcuggaaccagccucuccgugcugugggucuaccuugagaacuggcugcccguuucuuaugugccuuacuaucucccgugucccgaaaucuuuaauaugaagcugcauuacaaaagagagaagccucugcagcccguggucuggagccaauauccucagcccaaacuccuggaacaccggccuacacagcuucugacgcucaccccguggcuggcccccauuguguccgagggcacauucaacccugaacuucugcagcauaucuaccaaccccucaaucugaccauugggguuacaguguuugcggucggaaacccuucuuggagccagccccgcuccucuagcugcgugggcaccggguguacaaccacguccagccugaccacacuccagccguucccuggaucuagauggguucccaccggcuuuuccgcuccuagccccucucgggugacacccaccggccgcagacacccuugcgccggguggcggccguccgccagcacgcugcuucgcggacugacaggcagauggaccacaucuuccgcucucauguggaccugguguuucgggacccggggagcccugcgccccugggagacaugguggcuuccuuuuacgcaggcuaccacacccuucccugccagcuccucucccaugagcgcgggcgucuuuccgcugccucucuggcaaaccgccaaggggacauccaucauggugggacagagcucuggcggcagauggcccggguauaugucccugcugggagcugccaccuggccuagcuggcggacgcgccccauggcuucuuggcucccuggcgggagaaaagccacauga

SEQ ID NO: 69652 - RNA, 1092 nt, Artificial Sequence
  derived and/or modified sequence opt5 from GBX1__Homo_sapiens__NP_001092304
augcagagagccggcgggggaagcgcucccggcgggaacggaggcgggggaggcggcgggccuggaaccgccuucuccaucgacucucugauuggcccgcccccuccccggagcgggcaccuccuguacacaggauauccuauguuuaugcccuaccgcccucuugugcugccgcaagcgcucgcucccgccccucugcccgccggccuuccuccccuggcuccgcucgccuccuucgcugggagacugacgaauaccuuuugcgccggacugggccaggcggucccuucuaugguugcccucacaaccgcucugcccagcuucgccgagccucccgaugcuuuuuauggcccccaggaacuugccgcggccgcugccgcugccgccgcuacagcggcccggaacaauccugagcccgggggacgcagaccggaaggcgggcuggaggcugacgaacuccugccugcccgggagaagguggccgagcccccucccccgccucccccucauuucuccgaaaccuuucccucucuuccugcugagggaaaaguguacagcuccgaugaagagaagcuggaggccagcgcgggcgaccccgcugggucugaacaggaggaagagggauccggcggcgauagcgaagacgauggguuccucgacucuuccgccggaggcccgggggcccugcugggaccuaaacccaagcucaaaggcagccuggggacaggcgcugaggagggagcccccgucaccgcuggcgugacggccccugggggaaagucucgcagacggcgcaccgcguuuacauccgaacaacuucuggagcucgaaaaggaguuccacuguaaaaaguaucugagccuuaccgaaagaucccagaucgcccaugcucugaaacucucugagguucaggugaagauuugguuucagaaccggcgcgccaaauggaagagaaucaaggcuggcaaugucagcucccggagcggggagccggugcgcaaccccaaaauuguugugccuauccccguccacgugaauagauucgccgugcggucucaacaucagcagauggaacagggagcgagaccuuga

SEQ ID NO: 69653 - RNA, 1047 nt, Artificial Sequence
  derived and/or modified sequence opt5 from GBX2__Homo_sapiens__NP_001476
augagcgccgcuuuucccccuucccugaugaugaugcagagaccgcucggcucuagcaccgccuucuccaucgacucucugauugggagcccuccccaacccuccccuggacacuucguguacacaggcuaucccauguuuaugccuuaccggccggucguucuucccccucccccucccccgccucccgcgcugccucaggcugcccuccagcccgcccugcccccugcucauccgcaccaucagauccccucucuuccuacgggguucugcagcucccuggcccaaggaauggcucucaccagcacacugauggccacccugcccggcggguuuucugcguccccucagcaccaggaggccgcugccgcucgcaaguucgcgccccagccgcucccuggaggcggcaacuuugauaaagccgaagcccugcaagcugacgccgaggaugggaagggauuccuugcuaaagaaggcagccugcucgccuuuucugccgcugagacagugcaggcgucccuggugggggccgucagaggacagggcaaggacgaaagcaaaguggaggaugaccccaaggggaaggaggaaucuuucucccuugagagcgauguugacuauuccucugaugacaaucugaccggacaggcugcccauaaagaagaggauccuggccacgcccucgaggaaacacccccuagcuccggcgcugccgggagcaccacgucuaccggaaagaaccggcgcagacggacagcguuuaccuccgagcaacugcuggaacucgagaaagaguuccacuguaagaaauaccugagccuuacagaacgcucucagauugcucaugcccugaagcucagcgaggugcaggucaagaucugguuucaaaauagacgggccaaauggaagcgcgugaaagcuggcaacgccaauuccaagaccggggaacccucuagaaacccgaaaauuguugugccuauccccguccacgugagccgguucgcuauccgcucccagcaucagcagcuggagcaagccagacccuga

SEQ ID NO: 69654 - RNA, 654 nt, Artificial Sequence
  derived and/or modified sequence opt5 from GCA__Homo_sapiens__NP_036330
auggccuaccccggcuaugggggaggcuucgggaacuuuagcauccaggugccuggaaugcaaaugggccagccgguccccgagaccgggccugcuauucugcucgacggauacuccggccccgccuauucugauacauacagcuccgcgggcgacucuguuuauacguacuucagcgcuguggccgggcaggauggagaaguggacgccgaggaacugcagagaugccuuacccaauccggcaucaaugggacauauucuccuuuuagccuggagaccugucggauuaugaucgcuaugcucgaucgcgaccacacaggaaagaugggcuucaacgccuuuaaagaacugugggcugcccuuaaugcguggaaggagaacuucaugaccgucgaucaggacggguccggaacaguggagcaucacgaacugagacaggccauuggccucaugggcuaccggcugagcccccagacccugacgaccaucguuaaacgcuacucuaagaaugggagaaucuuuuucgaugacuauguggcuugcugugucaaacuccgggcccugacagacuuuuuccgcaagagagaucaucuucaacagggauccgcuaacuuuauuuacgaugacuuccugcagggcaccauggccaucuga

SEQ ID NO: 69655 - RNA, 2328 nt, Artificial Sequence
  derived and/or modified sequence opt5 from GCC1__Homo_sapiens__NP_078799
auggagaaguucggcaugaacuuugggggaggccccagcaagaaggaccugcucgaaaccaucgagacacagaaaaagcaacugcuucaguaccaggccagacugaaagaugugguccgggcuuauaagucccuccugaaggaaaaagaggcccuugaagcgucuauuaagguucugagcgugucccacgaggcugacguggggcucgccggaguccagcugccuggccugacguucccggauucuguggacgaucgcugcagcacccauuccgaggacucuacagggaccgccacaagccucgauaccgcugccucccugacaagcaccaaaggagaauuuggcguugaggacgauagacccgcucggggcccucccccucccaagucugaagaggccuccuggagcgagucugggguguccucuagcuccggagacggcccuuucgccgggggagaagucgauaaacgccuucaccaacugaagacgcagcucgcgacccugacaagcucccuugcuaccgugacacaggagaagucuagaauggaagccagcuaccuggcugacaaaaagaaaaugaagcaggaucucgaggacgccuccaauaaagcggaagaggagcgggcccgccuggaaggcgagcugaaggggcuccaagaacagaucgcugagaccaaagccagacugauuacgcagcagcaugaccgggcucaagaacagagcgaucacgcccuuaugcugcgcgagcuccagaagcugcuucaagaggaaagaacacagcggcaggaccuggagcuccgccuggaagagaccagagaagcccuggcuggacgggcguaugccgcugagcagauggagggcuuugaacuccaaacaaagcagcugacccgcgagguugaagaacuuaaaucugagcugcaggccaucagagaugaaaagaaccagccggacccccggcuccaagagcugcaggaagaggccgcuagacuuaaaucccauuuccaggcccagcugcaacaggaaaugcgcaagaccgcgcucgcugaggaucagcugcggcagcaaagccagguggaggaacagagagucgccgcccuggagaaucaaauuucugaagugagcgagcuccugggcacauacgaaaaagcuaagcagaaggaccagcuugccauccagaaacugaaggagcgcauccuccaacuggaucuggagaacaaaacgcuugcucucgccgcguccucucggagcccucuggacucccacggggaagagagcucucuggaugugaauguccucaaggacaaaauggaaaagcugaagagacuucugcagguugccgcucgcaaaucccaggugacccucgauguggagaagcugugugaccuggaaauuaugcccagcucugaggccgcugacggagagaaagccacagcgcuuuauuaccagcaagaacucaagcagcugaaagaggaauuugagcgguauaagaugagagcccaggucgugcugaaguccaaaaacaccaaggauggcaaucucgggaaagagcuggaagcugcccaggagcaacuugcugaacugaaggagaaauacaucagccuccgccuguccugcgaggagcuggagcaccagcaucagcaagaagccgacgauuggaagcaggagcuugcccggcuccagcagcugcacagacaagaacuggagcgcugucagcucgacuuccgggauagaacacugaaacuugaagaggagcugcauaagcagcgggaccgcgcucucgcgguucugaccgaaaaggaucuggagcuugaacagcucagaucuguggcccuggcuagcggacugccuggccggagaucccccgucgggggaggcggcccgggggacccugccgauacgucuagcuccgacagccucacacaagcccugcagcuugcugccgcgaacgagcccaccuuuuuccuguacgcugaacagcucgcccgcaaagagguggagauuaccucucugcggaagcagaaacacagacuggaaguugaggugcaccaacuucaggaucgccugcucgaagagggagagagacaucgggaagaggucgccgcucugcagucccacaucgaaaagaauauucgcgaccagagcagagagggcgccaaccucgaauaucugaaaaauaucauuuaccgguuucuuacacugccugauucucucgggcgccaacagacccugacagcgauccugacgauccuucauuucucccccgaggagaaacaggugauuaugagacugcccaccagcgcuucuugguggccuagcggaaagcgguga

SEQ ID NO: 69656 - RNA, 1317 nt, Artificial Sequence
  derived and/or modified sequence opt5 from GCDH__Homo_sapiens__NP_000150
auggcccugagaggcgugagcguccggcuccugucccgcgggcccggacuucacguucugagaaccugggugucuagcgcugcccagacagagaagggcgggcggacgcaaucccagcucgcgaaaucuagccgcccugaguucgacuggcaggauccgcuggugcuugaagaacagcugaccacagacgagauccucauuagagauaccuuucggacauacugccaagaacgccugaugcccagaauccugcucgcuaaccggaaugaggucuuccaucgcgagauuaucuccgaaaugggagagcugggcgugcuugggccuaccauuaagggauauggcugugccggcguuucuagcguggccuacgggcugcucgcuagagaacuggagcgggucgacuccggauaucgcagcgccaugucugugcaguccagccuuguuaugcaccccaucuacgcuuauggcucugaggaacagagacagaaauaccugccucaacucgccaagggggagcugcugggaugcuuuggccucacagaacccaacuccgggagcgauccuucuuccauggagacccgggcgcauuauaauagcuccaacaaaucuuacacgcugaauggaaccaagacauggaucaccaacagcccgauggccgaccuuuucguggucugggcucgcugugaagauggcugcauuagaggcuuucugcucgagaaggggaugcggggacuguccgcccccagaauccagggcaaauucagccuucgcgcuucugccacagggaugauuaucauggacggaguggaggugccugaagagaauguccugcccggcgcguccagccucgggggaccuuuuggcugucugaacaaugcccgguacggcauugcuuggggaguucugggagccucugaguucugccuccacaccgcuagacaguaugcccuggaucgcaugcaguuuggcgugccccuugcccggaaccaacugauccagaagaaacucgcugacaugcugacggaaauuacacuugggcugcaugcgugucuccagcugggaagacugaaggaucaagacaaagccgcuccggaaauggugagccuccugaagcgcaauaacugcggcaaggcccuugauaucgcccggcaggcuagagacaugcucgggggcaauggaaucuccgacgaguaccacgucauucgccacgccaugaaccuggaggcggugaauaccuaugaaggcacacaugauauccacgcucugauucuggggcgggccaucaccgggauucaggccuucaccgcuucuaaauga

SEQ ID NO: 69657 - RNA, 2346 nt, Artificial Sequence
  derived and/or modified sequence opt5 from GCFC2__Homo_sapiens__NP_003194
auggcccacagacccaagcggaccuuccgccagagagcugccgacagcuccgauucugacggcgcggaggaaagcccugcugagccgggggcccccagagaacugccugugcccggauccgccgaggaggaaccucccucuggcgggggacgcgcucaagucgccggccucccucauagaguucgggggccgcgcggaagaggccgggugugggcuagcucccgcagagccacaaaagcggcuccccgggcugaugagggcucugaaagccgcacgcuggacguguccaccgaugaggaagacaagauccaccauagcucugaguccaaagaugaccaggggcuuagcucugauuccucuagcucccugggagagaaggaacucagcuccacagucaaaauuccugacgccgcuuuuauccaggccgcgagacggaagcgcgagcuggccagagcucaggaugacuacauuucucuugaugugcaacacaccagcuccaucagcggcaugaagcgggaaucugaggacgaccccgaauccgagccugaugaccaugagaaacggauucccuucacacugcgcccgcagacccuccggcagagaauggccgaagagagcaucucucgcaacgaagagacaagcgaagagucccaggaggaugaaaagcaagacaccugggagcagcagcagaugcggaaagcuguuaagaucauugaagagagagauaucgaccugucuugcgggaauggaagcuccaaagugaagaaguuugauacgagcauuucuuucccucccgucaaccuggaaaucauuaaaaagcaacucaauacccgccugacacuucugcaggagacccaccggucccaccucagagaguaugaaaaauacgugcaggacguuaagagcucuaaauccacaauccaaaaccuggagagcuccucuaaucaggcccuuaacuguaaguuuuauaaaagcaugaagauuuacguggaaaaucugaucgauugccucaacgagaagaucauuaauauccaggagauugaauccucuaugcaugcccugcugcucaaacaggcuaugaccuucaugaagcgccggcaagacgagcugaaacacgaaagcacguaucuucagcagcuguccagaaaggaugagacaagcaccucuggcaacuuuuccgucgacgagaaaacacaguggauccucgaagagauugaaagccgccggaccaagagacggcaagcgcgcgugcugucugggaauuguaaccaucaggagggaaccuccagcgacgaugaacuuccuucugccgagaugaucgacuuccaaaagagccagggcgauauccugcagaaacagaagaaaguguuugaagagguccaggacgauuucugcaauauucagaacauccuccugaaguuucaacaguggagagagaaauuccccgacuccuacuaugaagccuuuauuagccuguguauccccaagcuccugaauccucuuauucggguucagcugaucgauuggaacccgcucaagcuggagucuacaggccuuaaagaaaugcccugguucaaguccguggaggaguucauggacagcuccguggaagauucuaaaaaggagagcuccucugacaaaaagguccugagcgccaucauuaacaagacgaucauuccuagacucaccgauuuuguggaguuccugugggacccccuguccacaucucaaaccacaagccucaucacccacugccgcguuauucuggaagaacacuccacgugugagaaugaggugagcaaaucucggcaggaucuucugaaguccaucgucagcagaaugaaaaaggccguggaagacgacguuuuuauuccucucuaccccaaaucugcuguggagaacaagacauccccgcauagcaaauuccaggaacgccaguuuuggucugggcugaagcuguucagaaauauccuucucuggaacggacugcugaccgaugacacccuccaagagcugggccuugggaagcugcucaaucgguaccugaucauugcccugcuuaacgcgacaccuggacccgaugucgugaaaaagugcaaucaggucgcugccugucucccugaaaaaugguuugagaacuccgccaugcgcaccagcaucccccagcuggagaauuucauucaguuucugcuccaauccgcucacaagcugagcagaucugaguuccgggacgaaguggaagagaucauucuuauccugguuaaaaucaaggcccucaaccaggcugagagcuuuauuggcgaacaucaccuggaucaucugaagucccuuaucaaagaggacuga

SEQ ID NO: 69658 - RNA, 543 nt, Artificial Sequence
  derived and/or modified sequence opt5 from GCG__Homo_sapiens__NP_002045
augaaaagcaucuacuucguggccggccuguuugucaugcucguucagggguccuggcaaagaucucugcaggacaccgaggaaaagagccgguccuucucugcuagccaggccgauccccuuuccgacccugaucagaugaacgaggacaagcgccacucucaaggaacauuuacgagcgauuauuccaaauaccuggacagcagacgggcgcaggauuucgugcaguggcucaugaauaccaagcgcaacagaaauaacauugcuaaacggcaugacgaauuugagcgccacgccgaaggcacauucaccucugauguguccagcuaucuggaggggcaggccgcuaaggaguuuaucgccuggcuugucaagggaagaggccggcgcgacuucccggaagagguggcuauuguugaggaacuggggagacggcaugccgauggaucuuuuuccgacgagaugaauacaauccucgauaaccuggcggcccgcgacuucauuaauuggcugauccaaaccaaaaucacagacagaaaguga

SEQ ID NO: 69659 - RNA, 1434 nt, Artificial Sequence
  derived and/or modified sequence opt5 from GCGR__Homo_sapiens__XP_006722340
augcccccuugccagccgcaaagaccccugcuccugcuucugcuccugcuugccugucagccucaggugcccagcgcucaggucauggacuuccuguuugagaaguggaaacucuacggcgaucaaugccaccauaaccugucccugcucccucccccuaccgaacugguuuguaaucggacauucgacaaguauucuugcuggccggauacgcccgccaacaccacagcgaauaucagcuguccuugguaccuucccuggcaccauaaagugcagcaccgcuuuguguucaagagaugcgggccugacggacaguggguccggggcccccgcgggcagccguggagagaugcuucccaaugucagauggacggagaggaaauugaggugcagaaagaaguugccaagauguauucuagcuuucaggugauguacaccgucggcuauucccugucucucggggcccugcuucuggcucucgccauccugggaggccugagcaagcuccauugcacacggaacgcuauucacgccaaucuguucgcguccuuugugcuuaaagccagcucuguucuggugaucgauggccuccugcgcaccagauacucccaaaagauuggggacgaucuuagcgucucuacauggcuguccgacggagcuguggccggcugucggguggcugccgucuucaugcaguaugggaucguugcgaacuacugcuggcuccugguggagggacuguaccuccacaaucugcuuggccuggccacccucccugagcgcagcuuuuucucucuguaucuugggaucggauggggcgcucccaugcuguuuguggucccuugggccgugguuaaaugucucuucgaaaacgugcagugcuggacguccaaugauaacaugggcuuuugguggauucugagauuccccgucuuccuggcuauccucauuaacuuuuucaucuuugugcggauuguucaacugcuuguggccaagcugcgcgccagacagaugcaucacaccgacuacaaauuccggcucgcuaagagcacacugacccugaucccccuucucgggguccaugagguggucuuugcguucgugacagaugaacacgcccagggaacccugcgcuccgcuaagcuguuuuucgaccucuuucugucuagcuuccagggccuucugguugccgugcucuauugcuuucugaauaaagagguccaauccgagcugagacggagauggcaccgcuggcggcuugggaaggugcucugggaagagagaaauacgagcaaccaucgcgccucuuccagcccuggacacggcccgcccucuaaagaacugcaguucgggcggggaggcggcagccaggacuccucugcugagacaccucuggccgggggacuccccagacuggcggaaagcccuuuuuga

SEQ ID NO: 69660 - RNA, 753 nt, Artificial Sequence
  derived and/or modified sequence opt5 from GCH1__Homo_sapiens__NP_001019195
auggagaagggccccgugagagccccugcugaaaaaccgcgcggggcccggugcagcaauggauuccccgagagagacccuccccggccuggccccucccgcccugcggaaaagccgcccagaccugaggcuaaaucugcccaacccgccgauggguggaagggagaacggccucgcagcgaggaggacaaugaacugaaccuccccaaucuggcugccgcuuacuccucuauccuuagcucccugggcgagaacccgcaaagacaggggcuccugaaaaccccuuggcgggccgcgucugccaugcaguuuuucacaaagggauaucaggaaacgauuagcgauguccuuaaugacgcuaucuuugaugaggaccacgaugagaugguuauugugaaggacaucgauauguucuccaugugugaacaucaccuggugcccuuugucggcaaagugcauauuggcuaccucccuaacaagcaaguucuggggcugagcaaacucgcccgcaucguggagaucuauucuagacggcugcagguccaggaacgccuuaccaagcagauugcuguggccaucacagaggcgcugagacccgccggaguuggcguggucguggaagcuacccacaugugcauggugaugcgcgggguccagaaaaugaacuccaagacaguuaccagcacaaugcucggaguguuccgggaggaccccaagaccagagaggaauuucugacgcuuauucggucuuga

SEQ ID NO: 69661 - RNA, 255 nt, Artificial Sequence
  derived and/or modified sequence opt5 from GCHFR__Homo_sapiens__NP_005249
augcccuaccugcucaucagcacccagauuagaauggaggugggcccuacaauggucggggacgaacaauccgauccggagcugaugcagcaccuuggagccucuaagcggcgcgcucugggcaacaauuucuaugaauacuauguugacgaucccccuagaaucgugcucgacaaacuggagcggcgcggguuuagagugcuuagcaugacgggagucggccagacccugguguggugccuccauaaggaauga

SEQ ID NO: 69662 - RNA, 1425 nt, Artificial Sequence
  derived and/or modified sequence opt5 from GC__Homo_sapiens__NP_000574
augaagagagugcugguccuccugcuugccguugcuuucggccacgcccuggagcgggggcgcgacuacgaaaagaacaaggugugcaaagaguuuagccaucucggaaaggaagauuucaccucccugucucuugugcuguauagcagaaaauuucccuccggcacauucgagcaggucucucaacucgugaaggaaguugugagccugacggaggcguguugcgcugagggggccgacccugauuguuacgacacccggacauccgcccugucugcuaagagcugcgaauccaauagcccguuucccguccacccuggaaccgccgaguguugcacaaaagaaggccucgagcgcaagcuguguauggcugcccuuaaacaucagccccaggaguucccuaccuauguggaacccacaaacgaugagaucugcgaagcguuuagaaaggacccuaaagaguacgccaaucaguucaugugggaauauucuaccaacuacgggcaagcuccgcugucccuccugguuagcuauacgaagucuuaccuuuccauggugggaagcuguugcaccucugccucccccacagucuguuuucugaaggagcggcuccagcugaaacaccugagccuccugaccacacuuuccaaucgcgugugcucucaguacgcugccuauggcgagaagaaaagcagacuguccaaccucauuaagcuggcgcagaaagugccuaccgccgaucuugaagacguccugccccucgcugaggauaucacgaauauucugagcaagugcugugaaucugccuccgaggacugcauggcuaaagaacugccugagcauacaguuaagcucugugauaaccugagcaccaaaaauucuaaauucgaggacugcugucaagaaaagacagccauggauguguuugugugcaccuacuucaugcccgccgcucagcuuccggagcugccugacgucgaacuccccaccaacaaagacgugugugauccuggcaauacaaagguuauggacaaauauacguuugagcugagccggcgcacccaccuucccgaaguguuccuguccaagguccucgagcccacacugaagucucugggggagugcugugauguggaagacagcaccacaugcuucaacgcgaaaggaccucuccugaagaaagagcuuuccagcuuuaucgauaagggccaggaacugugugccgacuacucugagaauaccuucacggaguauaaaaagaagcucgcugaaagacugaaagccaagcugccggaugccacacccaccgagcuugcuaaacucguuaacaagcacuccgacuuugccagcaauugcugcucuauuaacuccccuccccuguacugugauagcgaaaucgacgcggagcugaaaaacauccucuga

SEQ ID NO: 69663 - RNA, 1398 nt, Artificial Sequence
  derived and/or modified sequence opt5 from GCK__Homo_sapiens__NP_000153
augcuggacgauagagcccggauggaggcugccaagaaagaaaagguggagcagauccucgcggaguuccaacugcaggaagaagaccuuaaaaaggucaugcgcagaaugcagaaagagauggaucggggccugcgccucgagacccacgaagaggcuagcguuaagaugcugcccacauacgugagauccacgccugaagggucugaggugggagacuuucuuagccuggaucucggcgggaccaacuuccgggucaugcuggugaagguuggagagggcgaagaggggcagugguccgugaaaacaaagcaucaaauguauucuauuccggaagacgccaugaccggaacagccgagaugcuguuugauuacaucagcgaaugcauuuccgacuuccucgauaaacaccagaugaagcauaaaaagcugccccuuggcuuuaccuucucuuuuccuguccgccacgaggacaucgauaagggcauucugcucaauuggacaaaaggguucaaggcuagcggagccgagggcaacaaugugguugggcugcuuagagacgcuaucaaacggcgcggagauuuugaaauggacguggucgccauggugaacgacaccguggcgacgaugaucuccuguuauuacgaggaucaucagugcgaagucggcaugauuguugggaccggauguaaugccugcuauauggaggaaaugcagaacguggagcugguggagggcgacgaaggcagaaugugugucaauacagaguggggagcuuucggggauagcggcgaacucgacgaguuucugcuggaauacgaucggcucguggacgagucuuccgccaaccccgggcaacagcuguaugagaaacuuaucggaggcaaauacaugggggaacugguucgccucgugcugcuuagacuggucgaugagaaucuccuguuccacggagaagcuagcgagcagcugcggacccgcggcgccuuugagacaagauucgugucucagguugaauccgacaccggcgaucggaagcaaauuuacaacauccucagcacgcuggggcuuagaccuucuacaaccgacugcgauauugugcgccgggcgugugaguccgucagcacaagagccgcucacaugugcuccgccggacuggcuggcgugaucaaucgcaugcgggaaucuagaagcgaggacgucaugcgcauuaccguggggguugacggauccguguauaaacuccaucccagcuucaaggaacgguuucacgccucugucagacgccugaccccuuccugugagaucacauucaucgagagcgaagagggcucugggcggggcgccgcucuugugagcgcgguugccugcaagaaggcuuguaugcugggacaguga

SEQ ID NO: 69664 - RNA, 1878 nt, Artificial Sequence
  derived and/or modified sequence opt5 from GCKR__Homo_sapiens__NP_001477
augcccggcaccaagagauuccagcacgugaucgagacaccugaaccggggaaaugggagcugagcggauacgaagccgcuguccccauuacggagaaguccaacccucucacccaagaccuggauaaagccgacgcggaaaauaucguucggcuucugggccagugcgaugcugagauuuuucaggaggaagggcaggcccucucuacauaucaacgccuguacagcgaguccauccuuaccacaaugguccagguggccggaaaggugcaggaagugcugaaagagcccgacggcgggcucguugugcugucuggaggcggcaccagcgggagaauggcuuuccugauguccgucucuuuuaaccagcucaugaagggacugggccaaaagccucuuuauacauaccugauugccgggggagaucggagcgugguugcuucccgcgagggcaccgaagacagcgcccuccaugggaucgaggaacugaaaaagguggcggccggcaaaaagagagucaucgugauuggaaucucugugggccuuuccgcucccuucgucgccgggcagauggauuguugcaugaauaacacggcuguuuuucugccugugcucgugggauucaauccggucagcauggcccggaacgaccccauugaggauuggucuuccaccuuucgccagguggcggaaagaaugcagaaaaugcaagagaagcagaaggccuucguucugaauccugcuaucggccccgaggggcugagcggaucuucccggaugaaaggcgggagcgccacaaagauucuccuggaaacccuucugcucgcugcccacaaaacaguggaccagggaaucgccgcuucccaacgcugucugcuugagauucugagaaccuuugaacgggcgcaucaggucacguauucucagagcccuaagaucgccacacucaugaaauccgugagcaccucucuggagaagaaaggccacguuuaccuggugggcuggcagacacucgggaucauugcuaucauggauggagucgaaugcauucauaccuucggcgccgacuuucgcgaugugagaggguuccugaucggagaccacuccgacauguuuaaccaaaaggccgagcuuaccaaucagggcccccaguucacauucagccaggaggauuuucugacgucuauucucccgagccugaccgaaaucgacacagucguguucaucuuuacccuugaugacaaccugacagagguucaaaccauuguggaacaggucaaggagaaaacgaaucacauccaggcucucgcccauuccacaguggggcagacccugcugauuccucucaagaaacuguuccccucuaucauuagcaucaccuggccucuucuguuuuucgaauaugagggcaacuuuauccaaaaguuccagcgggagcucuccacaaaauggguucugaauaccgugagcacaggagcgcacguccugcuuggcaagauucuccagaaccauaugcuggaucugcgcaucucuaauuccaagcucuuuuggagagcucuggccaugcuucagcgguucagcgggcaaucuaaagccagauguauugaaucccugcuccgcgcuauccacuuuccccagccccugagcgacgauauucgggccgcuccuaucuccugccacguucagguggcccaugagaaggaacaagugauuccgaucgcgcugcuuucucuccuguucagauguagcaucacggaggcccaggcucaccuggccgcugcccccuccgucugcgaggcggugcgcucugcccucgcuggaccuggccagaaacggaccgccgacccccuggaaauucuugagccugaugugcaguga

SEQ ID NO: 69665 - RNA, 1914 nt, Artificial Sequence
  derived and/or modified sequence opt5 from GCLC__Homo_sapiens__NP_001489
augggccugcucagccaggggucuccccuguccugggaggaaaccaagagacacgccgaccaugugcggcgccacggaauccuucaauuccugcauauuuaccacgcugucaaagauagacauaaggacguucucaaauggggcgaugagguggaauauaugcuggugagcuuugaccacgagaacaagaaaguccggcuugugcuguccggggaaaagguucucgagacacugcaggagaagggagaacgcacgaauccuaaccacccgacccuguggagacccgaguacggcucuuauaugaucgaagggacaccuggacagcccuacggcggcaccaugagcgaguucaauacaguggaggccaacaugcggaaacgcagaaaggaagcgaccuccauucucgaggaaaaucaggcucugugcacaaucaccucuuuuccucggcuugggugucccggauucacgcugccugaggucaaaccgaaccccguggaaggcggggccagcaagucccucuuuuucccugaugaggccauuaauaaacauccccgcuuuagcacccugacaagaaacauccggcaccgcagaggagagaagguugugaucaaugucccuauuuucaaggacaaaaacacccccucuccguuuaucgaaacauucaccgaggaugacgaggcuucccgggccagcaagccugaucauauuuauauggacgcuaugggcuuugggaugggaaauugcugucuucaagugacguuccaggccugcucuaucuccgaggcgcgcuaccuguaugaucagcucgccacaauuugucccaucgugauggcucugagcgccgcuucuccuuuuuacagaggcuacgucuccgacauugauugccgguggggcguuaucagcgccuccguggacgacagaacccgcgaagaacgggggcuggagccccucaaaaacaauaacuauagaaucucuaagagccgcuacgauuccauugacagcuaucugucuaaauguggagaaaaguacaaugauaucgaccuuacaauugauaaagagaucuaugaacagcugcuccaagagggcauugaccaucugcuugcgcagcacguggcccaccuguucauccgggauccccucacccuguucgaagagaagauccaccuggacgaugcuaacgaguccgaccauuuugaaaacauucagagcaccaauuggcagacaaugagauucaagccuccgcccccuaacucugauaucggguggcgcgucgaguuucggcccauggaagugcaacucacggacuucgagaauagcgccuacguuguguuugucgugcugcuuaccagaguuauucuguccuauaaacucgacuuccugaucccucuuucuaagguggaugagaacaugaaagucgcucagaagcgcgacgccgugcugcagggaauguuuuacuuccggaaagauauuugcaagggcgggaaugccgucguggacggauguggcaaggcucaaaacagcacagaacucgcggccgaggaauacacccugauguccaucgauacaaucauuaauggcaaagaggggguuuuucccggacugaucccgauucucaacagcuaucuggaaaauauggagguggacgucgauaccagaugcucuauccuuaacuaccugaagcucauuaaaaagcgcgcuuccggcgagcugaugacgguggcccgguggaugagagaguucaucgccaaucacccugacuauaaacaggauagcguuauuacagacgaaaugaacuacucucugauccuuaaguguaaucagaucgcuaacgaacucugcgagugccccgaacugcugggguccgccuuucggaaggugaaauauagcggauccaagaccgauucuagcaauuga

SEQ ID NO: 69666 - RNA, 1311 nt, Artificial Sequence
  derived and/or modified sequence opt5 from GCM1__Homo_sapiens__NP_003634
auggagcccgacgauuucgacagcgaagauaaggagauccuguccugggacauuaacgaugugaaacucccucagaaugucaagaaaaccgacugguuucaagaauggccggauucuuacgccaagcacaucuauagcuccgaggacaaaaacgcucagagacaucugucuagcugggccaugcggaauacaaacaaucacaacucccgcauucuuaagaagucuugccugggcguuguggugugugggagagauugccucgcggaagagggacggaaaaucuaccugcgccccgcuauuugugacaaggccagacagaaacagcaacggaagcgcugcccuaauugugauggcccccuuaaacugaucccuugcagagggcauggaggcuuccccgucacgaacuuuuggcggcacgacgggcgcuucaucuuuuuccagagcaagggagagcaugaucacccuaagccggaaaccaaacucgaggccgaagcuagacgggccaugaagaaagugaauacagcucccuccagcguuucucugucccugaagggcagcaccgagacacgcucucucccuggcgagacccagucccaggggagccugccccuuacauggucuuuucaagaaggagugcagcugccuggcuccuauagcgggcaccucauugccaacacgccccagcaaaauucccugaacgacuguuucucuuuuagcaaauccuacggacuuggcgggaucaccgaccugaccgaucagacaagcaccgucgacccgaugaagcucuaugagaaaagaaagcugucuuccagccggacauacucuagcggagaucugcucccucccuccgcgucuggcguguauagcgaccauggcgaucugcaggccugguccaagaaugcugcccuugggcgcaaccaccuggcugacaauugcuacagcaacuacccuuucccccucaccucuuggcccuguuccuuuagcccuucucagaacuccagcgaaccguucuaucaacagcugccccuugagccucccgccgcgaaaacgggaugcccuccccuguggccgaauccugccggcaaccucuacgaagagaagguucauguggauuuuaauuccuauguccagucucccgcuuaccacagcccucaggaggaccccuuccuguucacauaugccucccacccucaucaacaguacucucugcccagcaaauccagcaagugggauuuugaagaggaaaugaccuaucucgggcuggaccacuguaacaaugauaugcuucugaaccucugcccgcugagauga

SEQ ID NO: 69667 - RNA, 1521 nt, Artificial Sequence
  derived and/or modified sequence opt5 from GCM2__Homo_sapiens__XP_011513293
augcccgccgcugccgugcaggaggcggucggcguuugcagcuacgggaugcaacuguccugggacaucaacgauccucagaugccgcaggaacucgcucuguucgaccaguuuagagaguggcccgauggauaugugcgguucauuuacucuagcgacgaaaagaaagcccaacgccaccuuuccggcugggccaugagaaauaccaacaaucauaacgggcacauccugaagaaaucuugucucggaguggucgugugcacacaggcuuguacgcugccugauggcagccggcuucagcugcgccccgccauuugcgacaaggcuagacucaaacagcaaaagaaggccuguccuaauugccauuccgcgcuggagcugauccccugucgggggcacucuggauauccuguuaccaacuuuuggcgccucgauggcaaugccauuuucuuucaggcuaaaggcgugcaugaccacccgagacccgaaagcaaguccgagacagaggcccggcgcagcgcuaucaaaagacagauggccucuuucuaccagccucaaaagaaacggauccgcgaauccgaggcggaagagaaccaggauagcucugggcacuuuuccaauauucccccucuggagaaccccgaagacuucgauaucgucaccgagaccagcuuuccgauuccuggacagcccugcccuucuuuccccaaguccgacguguauaaggccacaugugaucuugcuacauuucaaggcgacaaaaugcccccuuuccagaaguacagcuccccgagaaucuaucugccccggccucccugcucuuacgaacucgccaauccuggguacaccaacagcucccccuauccgacgcuguacaaagacagcaccucuauuccuaaugauacagacuggguucaucuuaacacccugcaguguaaugugaacuccuauagcucuuacgagcgcagcuuugauuucacaaacaagcagcacggauggaaacccgcucucggcaagccuucccuggucgaaagaaccaaucaugggcaauuccaggccauggccacgcggcccuauuacaacccugagcugcccugcagauaucucacaaccccgccucccggagcucccgcgcugcagacagugaucaccaccacaacgaaagugucuuaccaggccuaccaaccuccggcuaugaaguauagcgacuccguccgcgagguuaagagccuuucuuccugcaauuacgcccccgaagauaccggcaugagcguguauccugagcccuggggcccucccgugacagucacccgggccgcuucuccuuccgggcccccgccuaugaaaauugccggagacuguagagcgauccgccccacaguggcuaucccucacgaacccguuagcucccggaccgaugaggccgaaacgugggacgugugccugucuggccucgggagcgccgucuccuacucugauagagugggaccguuuuucacauauaacaaugaggacuuuuga

SEQ ID NO: 69668 - RNA, 8016 nt, Artificial Sequence
  derived and/or modified sequence opt5 from GCN1L1__Homo_sapiens__NP_006827
auggccgcugacacccagguguccgagacacugaagagauucgccggcaaggucacgaccgccuccguuaaggaacggcgcgagauccucucugaacuggggaagugcguggcuggaaaggaucuucccgagggcgccgugaaagggcuguguaagcucuuuugccugacccuucacagauaccgggacgccgcuagccgcagagcccugcaagcugccauucagcagcucgcggaagcccagccugaggcuaccgccaagaaccugcugcauucccuccaaucuagcggaaucggcuccaaagcugggguccccucuaagagcuccggaagcgccgcgcugcuugcccugacauggaccugucuccuggugcggauuguuuuccccucucgcgcuaaaagacagggcgauaucuggaauaaacuuguggagguccagugccugcuccugcuggaagugcucggcgggucccacaaacaugccguugacggagcugugaagaagcugacaaaacuuuggaaggagaacccuggccuggucgaacaguaucucagcgccauucugucucuugagcccaaucaaaacuacgccgggaugcugggacuccuggugcaguuuuguaccucccacaaagagauggauguggucagccagcauaagucugcucugcucgacuucuauaugaaaaauauccugauguccaagguuaaaccucccaaguaccuucuggauagcugcgcgccucuccugcgguaucuuucccacucugaauuuaaggaccugauccuccccacgauucagaaaagccugcugcgcucccccgagaacgugaucgaaaccauuagcucucuccuggccuccgugacacuugaucugagccaauacgcuauggacaucgucaagggccucgccgggcaccugaaaucuaauagcccuagacugauggaugaggccgugcuugcucuccggaaccuggcccgccaguguuccgacucuagcgcgauggaaucccugaccaagcaucucuucgcuauucugggaggcagcgagggcaaacuuacaguuguggcccagaagaugucuguccuguccgggaucggaagcgugucucaccauguuguguccggccccagcucccaaguccucaaugggauuguggccgagcuguuuaucccuuuccugcagcaggaaguccacgagggaacccuugugcacgcuguuucugugcucgcccuguggugcaacagauuuacgauggaaguccccaagaaacugacagagugguucaagaaggcuuuuagccucaagaccuccacaucugccgugcggcaugcguaucugcaguguaugcuugccagcuaccgcggcgauacccugcuccaagcucuggaccugcuuccgcuccugauccagaccguugaaaaagccgcuucccagagcacacaggugccuacgauuaccgagggggucgccgcggcccugcuccugcuuaagcugucuguggcugacucccaagccgaggcuaagcucagcucuuucuggcagcugaucguggaugagaagaagcagguuuuuacauccgagaaauuccuggucauggccagcgaagacgcccuuugcaccgugcuccaccugacagagagacuguuccucgaucauccccaccggcugaccggaaauaaggugcagcaauaccauagagcucuugucgcggugcugcucucucgcacguggcacguucggagacaggcccagcagacagugcgcaaacugcugagcucccuuggcggcuuuaagcuggcucacgggcuccuggaagaacucaagaccguccugagcucucauaaagugcuuccucuggaggcccucguuaccgacgccggagaagugacagaggcuggcaaggccuaugugccgccccgggugcugcaagaagcgcuguguguuauuuccggggugccuggacuuaaaggcgaugucaccgacacagagcagcuggcucaggagaugcucaucauuagccaccauccgucccugguggccgugcaaucugggcucuggcccgcccugcuugcuagaaugaagaucgauccugaagccuucaucacgcgccaccuggaccagauuaucccccggaugaccacacagagcccucucaaccaguccucuaugaaugcgaugggcagccuguccguccugucucccgauagaguucuuccgcaacugauuagcaccaucacagcuuccgugcagaacccugcccuccgccuggugacccgggaggaauuugccauuaugcagacgcccgcuggagagcucuacgacaaaagcaucauccagucugcccaacaggauuccauuaagaaagcuaauaugaagagagaaaacaaggccuauagcuucaaagagcagaucauugagcuggaacuuaaggaggaaaucaaaaagaaaaagggcauuaaggaggaaguccagcugaccucuaaacaaaaggagaugcugcaggcgcagcucgaccgcgaggcccaagugcggagacggcugcaggaacuugacggggagcuggaagcugcccucggacugcucgauaucauucuggcuaaaaacccuuccggccuuacacaguacauccccguucugguggacagcuuucugccucuccugaagucuccccuugccgccccgcgcaucaaaaauccuuuccugucccucgcugcgugcgucaugcccagcagacugaaggcccucgggacccuggugucccacguuacacuucggcugcugaagcccgagugcgugcucgauaaaagcuggugucaggaagaacugucugucgcugugaagagagccguuaugcuucugcauacccacacgauuacaagccgcgugggaaaaggcgagccuggggccgcuccgcucuccgcccccgcguuuucucuggucuucccuuuucucaagauggugcugaccgaaaugccccaucacagcgaggaagaggaggaauggauggcucaaauccuucagauucugacagugcaggcccagcugcgggccuccccuaacacacccccuggcagagucgacgagaauggacccgaacuccugccgcgcguugcuaugcuuagacugcucaccugggugaucggcacagggucuccucggcugcaagugcuggccagcgauacgcucaccacacuuugcgcguccucuagcggagacgauggcugugcuuucgccgagcaggaagaggucgacgugcugcugugcgcccuccagucccccugugcuagcguucgcgagaccgugcugagagggcuuauggaacugcauaugguccucccugcccccgauacagacgagaaaaacggacugaaucugcuccggcgccuuugggugguuaaguuugauaaggaagaggaaauuagaaaacuggcugagcggcuguggucuaugaugggccucgaccugcagccggaucuuugcucccugcucaucgacgacgugaucuaucacgaggccgcgguccgccaagccggggcugaagcccugagccaggcuguggccagauaccagcggcaggccgcugaggucaugggccgccugauggaaauuuaucaagagaagcucuacagaccucccccugugcuugaugcgcugggacggguuaucucugaaagcccgcccgaccagugggaggccagauguggccuggcucucgcccugaacaaacuuagccaguaccuggauuccucucaagugaagccucucuuccaguuuuucgucccggacgcccugaaugaucgccaccccgacgugcggaaaugcaugcuggaugcugcccucgcgacccuuaacacgcaugggaaggagaauguuaacagccugcugccuguguucgaagaguuucucaaaaaugcucccaacgacgccuccuaugaugccgucagacagagcguggugguucugaugggaucucuugcuaagcaccuggacaaguccgauccuaaagucaagcccauuguggccaaacucaucgcggcccugagcacaccuucucagcaagugcaggaaagcgucgcuuccugucugccgccccucgugccugccauuaaggaggacgcuggcgggaugauccagcgccuuaugcagcaacugcuggagucugauaaauacgccgaacggaagggagcugccuauggccucgcggggcugguuaagggccuuggaauccugagccucaaacagcaggagaugauggccgcucugaccgacgccauucaggacaagaaaaauuucagacgccgggaaggcgcucuguuugccuucgagaugcucugcaccaugcuugggaagcuguuugaacccuacgugguccaugugcugccucaccuccugcuuuguuucggagauggcaaccaauauguuagagaggccgcugacgauugcgcgaaagccgugauguccaaucugucugcucauggggucaagcucgugcugcccagccugcucgccgcccuugaggaagaguccuggcgcacaaaggcuggaagcguugaacugcugggcgccauggcguacugcgccccgaaacagcucucuuccugucugccuaacaucgugcccaaacuuaccgagguccugacagacagccacgugaaagugcagaaggcuggccaacaggcccuccggcagauuggguccgucaucagaaaccccgaaauucuggcuaucgccccuguucugcucgaugcgcuuacggaccccucucggaaaacccagaagugccugcaaacacugcucgauaccaaguuugugcacuucaucgacgccccuagccuggcucuuauuaugccgaucgugcagcgcgccuuucaggauagauccacagacacccggaaaauggcugcccagauuaucggaaauauguauucucugacggaucaaaaggaccucgcucccuaccugccuagcgucacccccggccugaaagccucccuccuugacccugugcccgagguucgcacagugagcgcgaaggcccugggggcuauggucaaaggaaugggcgagucuuguuucgaagaucugcucccguggcugauggagacccuuacauacgaacaguccagcguggacagaucuggggccgcucagggacuggccgagguuauggccggccucggcguggaaaagcuggagaagcugaugccugagauugucgcgaccgcuuccaaaguggauaucgcgccccauguccgggacggguauauuaugauguuuaacuaccucccuaucacauucggagauaaguuuacccccuaugugggcccuaucauucccugcauccugaaagcucuugccgacgaaaaugaguucguuagagauacggcccugcgcgcugggcagcgggugauuagcauguacgccgaaacagcgaucgcccuccugcuuccgcaacuggagcagggacucuucgacgaucuguggcgcauuagauuuucuagcgugcagcugcucggcgaccugcuuuuccacaucuccggggucaccggaaagaugaccacagagaccgcuucugaagaugacaacuuuggcacggcccagagcaauaaagcuaucauuacagcccugggcguugagcggagaaaccgcgugcucgcggggcuguauaugggacgguccgauacccaacuuguggucagacaggccagccugcauguguggaagaucguuguguccaauacaccucgcacccucagagaaauucugcccacacuguucggccuccugcuuggguuucuggcuucuaccugugccgacaaacggacgaucgcugcccgcacccucggagaccuggucagaaaacuuggcgagaagauucugcccgaaaucaucccuauucucgaggaggggcugcggagccagaaauccgaugaacgccaaggagugugcaucggccugucugagauuaugaaaagcacauccagagacgcuguccucuacuucucugaaagccuggugccgaccgcccggaaggcgcuuugugauccccuggaggaaguuagagaggccgcugccaagacauuugagcagcuccacuccaccaucggccaccaggcucuggaagacauucuuccuuuccugcucaaacagcuggaugacgaggaagugagcgaguuugcccuggaugggcucaagcaagucauggccaucaagucucgcgugguucugcccuaucuugugccuaaacugacgacacccccugucaacacccgggugcucgcguuccuguccagcguggcuggagacgcccuuacaagacaucugggcguuauucucccggccgucaugcuggcucugaaggaaaaacucgggacccccgaugagcagcuggagauggccaauugccaggcugugauccuuucuguggaagacgauaccggacaccgcaucauuaucgaggaccugcucgaagccacacgguccccugaggucggcaugagacaggcggccgcuauuauccugaacauuuacuguagccggucuaaggccgauuacacgucccaucuucgcagccugguuuccgggcucaucagacuguuuaaugacagcucucccguggugcuggaggaaagcugggacgcucucaacgccaucaccaaaaagcuggaugcgggaaaucaacuugcccugauugaggaacuccacaaggagauccggcugauuggcaacgaauccaaaggcgagcaugucccuggguucugccuucccaagaaaggagugacaucuauccugccgguucuccgcgagggcgugcugaccgggagcccugaacagaaggaggaagcugccaaagcucugggacuugucauuagacugacauccgccgacgcucuccggcccucugugguuagcaucaccggcccccugauccgcauucucggggauagauucuccuggaaugugaaggccgcgcugcuugagacgcugucucugcuccuggccaaggucggaaucgcucuuaaaccuuuucugccccagcuccagacaaccuucaccaaggcccugcaagacagcaaccggggcgugcgccucaaagccgcugaugcccugggcaagcugauuuccauccacauuaaaguggacccucuuuuuacagaacugcucaacgggaucagagcgauggaggauccgggaguccgggacaccaugcugcaggcucuuagauucguuauucagggcgccggggccaagguggaugcugugauccgcaaaaauaucgucagccugcuccugucuaugcucggacacgacgaggauaacacacggauuuccagcgccggcugucugggggaacugugcgcuuuucuuacggaggaggagcugucugccgugcuccaacagugccugcuugcggacguuuccggaaucgacuggauggugagacauggccgcagccuggcccucuccgucgcugugaauguugcccccggccggcugugugcugggagauauucuagcgaugugcaggaaaugauucuguccagcgccaccgcggaccgcaucccuauugccgucucuggagugcggggcaugggguuccucaugagacaccauaucgagacaggaggcgggcagcugcccgcuaaacuuuccagccuguuuguuaagugccuccaaaacccuucuagcgauauccgccugguggccgagaaaaugauuuggugggcuaauaaggacccccuuccgccucuggauccccaggccaucaaaccuauucucaaggcccugcuggacaacaccaaagauaagaauacagucgugcgggcuuacuccgaccaggcgaucgucaaccuccugaagaugagacagggcgaagagguguuccaaucucuuagcaaaauucuggauguugccucccucgaagugcugaaugaggucaaccgccggucucuuaagaaacuggcuagccaggccgacuccaccgagcaggucgaugacacgauccucaccuga

SEQ ID NO: 69669 - RNA, 1287 nt, Artificial Sequence
  derived and/or modified sequence opt5 from GCNT1__Homo_sapiens__XP_006717115
augcugagaacccuccugcggcgcagacuuuucagcuaccccacaaaguauuacuuuauggugcugguccucucccugaucacguucucuguucuucggauucaccagaaaccugaguuugugagcgugcgccaucuggaacucgccggcgagaacccguccucugacaucaauugcaccaagguccugcaaggggaugugaacgaaauucagaaaguuaagcuggagauccucacagugaaauucaagaagagaccccgguggaccccugacgauuauauuaauaugacaagcgacuguuccucuuuuaucaaacgcagaaaguacaucgucgaaccccugagcaaagaggaggcugaguucccuauugccuauuccaucgugguucaccauaagauugaaaugcuugaucggcugcuccgcgcgaucuacaugccccagaacuuuuauugcauucacguggacaccaaaagcgaagauucuuaccuggcugccgucaugggaaucgccuccuguuucagcaauguguuuguggcuucuagacuugaguccgucguuuacgccagcuggucucgggugcaggcugaccugaacugcaugaaggaucucuaugccauguccgcgaauuggaaguaccugauuaaccuguguggcauggacuucccuaucaaaacaaaucucgagaucgugcgcaagcugaaacuucugaugggggaaaacaaucucgagaccgaaagaaugccgagccauaaggaggaacgguggaaaaagcgcuaugaggucgugaacggaaaacugacgaauaccggcacaguuaagaugcuucccccucuggagacaccccucuuuuccgggucugccuacuucguggucagcagagaauaugugggauacguucugcaaaacgagaagauucagaaacugauggaaugggcucaggauaccuauuccccugacgaguaccucugggccaccauccagcggauucccgaagugccgggcagccugccugcuucucacaaguacgaucuuuccgacaugcaagccgucgcgagauuugugaaauggcaguauuucgagggcgacgucagcaagggggcccccuacccucccugcgauggagugcacguucgcucuguguguaucuucggcgcuggggaccugaauuggaugcuccggaaacaucaccuguuugccaacaaguucgaugucgacguggaucuuuuugcuauucagugccuggacgagcaucucagacacaaggcccuggaaacgcugaaacacuga

SEQ ID NO: 69670 - RNA, 1203 nt, Artificial Sequence
  derived and/or modified sequence opt5 from GCNT2__Homo_sapiens__NP_001482
augccccugagcaugagauaccucuucaucauuuccgugucuagcgucaucauuuuuaucguuuucuccguguuuaacuucggcggggacccuucuuuucagcggcugaauauuagcgauccgcuucgccugacccaagugugcacauccuucaucaacggaaagacgagauuucucuggaaaaauaagcugaugauccacgagaaaucuagcuguaaggaauaucuuacccagucccauuacauuacagcuccccugagcaaagaggaagccgacuucccucucgccuauaucauggucauucaccaucacuuugauaccuucgcgcggcuguuucgcgcuaucuacaugccccagaacauuuauugcgugcauguugacgagaaggccacaaccgaguucaaggaugccguggaacagcugcucucuuguuuuccuaaugcuuuccuggccuccaaaauggagcccgucguguacggcgggaucagcagacuucaagcugaccugaacugcauucgggaucucucugccuucgaaguuuccuggaaguaugugaucaauacauguggacaggacuuuccucugaaaaccaacaaggagaucguccaguaccuuaaaggcuucaaggggaagaauauuacgccgggagugcugcccccugcgcacgccaucggccgcaccaaauacgugcaccaggaacaucucggcaaggagcugagcuaugucauuagaacaaccgcucugaaacccccucccccgcacaaccucacaaucuacuuugggucugccuauguugcucugucccgggaguucgccaauuuugugcuucaugauccucgcgcgguggaccugcuccaauggagcaaggauaccuucucccccgacgaacacuuuugggucacgcugaaccggauuccuggagugcccggcucuaugcccaaugccagcuggacagggaaccuuagagcuaucaaaugguccgauauggaggaccgccacggaggcugccaugggcacuacguucauggaaucuguauuuauggcaauggcgaccugaaguggcucgugaacagcccuucucuguucgccaacaaauuugaacugaauaccuacccgcucacagucgagugccuggaacuuagacaccgggagcgcacccugaaccaguccgagaccgcuauccagcccagcugguauuucuga

SEQ ID NO: 69671 - RNA, 1317 nt, Artificial Sequence
  derived and/or modified sequence opt5 from GCNT3__Homo_sapiens__NP_004742
auggugcaguggaagagacugugccaacuccacuaccugugggcccuuggcuguuauaugcugcucgcuaccgucgcccugaaacuuagcuuccggcugaagugcgacuccgaucaucucgggcuggagucucgcgaaagccagucccaguacuguagaaacauccuguauaauuuucucaaacugcccgcgaagcggucuauuaacugcagcggaguuacacgcggcgaccaggaggcugugcuucaagccauccugaauaaccucgaagugaaaaagaagagagagccuuucacggauacccacuaccugucccuuacacgggacugugaacauuuuaaagccgagcgcaaguucauucaguuuccgcugucuaaagaggaagucgaguuccccaucgcuuauagcauggugauucacgaaaagaucgagaauuuugagagacuccugcgggccguuuacgcuccucagaacaucuauugcgugcaugucgaugaaaaaucccccgagaccuucaaggaagccgugaaggcgauuaucagcuguuuuccuaauguuuucauugccucuaaacuggugcgcgucguguacgcuuccuggagcagagugcaggccgaccucaacugcauggaggaucugcuucaaucuuccguccccuggaaguacuuucugaauacaugugggaccgacuucccuaucaaaagcaacgcugaaaugguucaggcccucaagaugcugaauggacggaacucuauggaguccgaggugccgcccaaacacaaggaaacacgcuggaaauaucacuuugagguggucagagauacccuucaucugacgaauaagaagaaagacccucccccuuacaaccucaccauguucacaggcaaugcguauauuguggccagccgggauuucguucagcacgugcugaagaaccccaaaucccagcaacugaucgaaugggucaaggacaccuacucuccggaugagcaucucugggcuacacugcagcgcgccagauggaugccugggagcgugcccaaccacccuaaauaugacauuuccgacaugaccagcaucgcucggcuuguuaaguggcagggacacgaaggcgauaucgacaagggcgcccccuacgcccccugcucugggauucaucaaagagcuaucuguguguauggagcgggcgaucugaauuggaugcuccagaaccaccaucugcuugccaauaaauuugacccuaaggucgaugacaacgcucugcagugccucgaggaguaccugcgcuacaaagccauuuaugggacggaacuguga

SEQ ID NO: 69672 - RNA, 1293 nt, Artificial Sequence
  derived and/or modified sequence opt5 from GCNT7__Homo_sapiens__NP_542182
augagccagcugagagccaccaaguccggccucgugguccgggcuguuaucugcauuuucaucuuucuguaccuucgcaaccccacacccgccgagucugaagaggaaccggcgcaacccgaggugguggaauguggguucuauccugacgagcugugcagcgcucucuuugagggaaaaggcgccgccccucagauugcuaaguucuguaaaacgccucacaaguccgaaauccaugcccaucugcacacccccgggaauugcucuagaauuagccggggacuucacuuuaucacacgcccucuguccgcugaggaaggcgauuucucucucgccuacaucauuaccauccauaaagagcuggcgauguuuguccagcugcucagagccauuuaugugccgcagaacguuuacuguauccacguggacgagaaggcucccaugaaguauaaaacagccguccaaacccuggugaauugcuucgaaaacguuuuuauuagcuccaagacagagaaaguggcuuacgccggguucacccggcuucaggcggauaucaauuguaugaagguccuggugcacagcaaauuucaguggaacuaugugauuaaucucugcggacaggacuucccuaucaagacgaaccgcgaaaucauucauuacaucagaucuaagugguccgauaaaaauauuacccccggcgucauccaaccucugcacauuaagagcaaaacaucucagucccaucuugaguuuguucccaagggcagcaucuacgccccgccuaacaaucgguucaaagacaagcccccucacaaccugaccaucuauuucgggucugcuuacuaugugcucacacgcaaauuuguggaguucauucugaccgauauccacgccaaggacaugcugcagugguccaaggauauuagaagccccgaacagcauuacugggucacgcucaaucggcugaaagacgcucccggagccacaccuaacgccggcugggaggggaaugugcgcgcuaucaagagaaaauccgaagagggaaacguucacgauggcuguaaggggcgguauguggaagacauuugcgucuacggaccgggcgaucuucccuggcugauccaaucuccuagccucuuugcgaacaaauucgagcccuccaccgacccucuggugguuacaugucuugaacgcagacaucggcuccaggugcugagacaggccgagguccccaucgagccgcacuggcauuuucaacagcagagccacuucaauaugcgccugaaccgguga

SEQ ID NO: 69673 - RNA, 1653 nt, Artificial Sequence
  derived and/or modified sequence opt5 from GCOM1__Homo_sapiens__NP_001018100
augcugagaagcaccuccacagugacgcuccugucuggcggggccgcucggacccccggagccccuagccgcagagcgaacgucugccggcuucgccugacaguuccgcccgaguccccugugcccgaacagugugagaagaaaaucgaaagaaaggagcaacuccuggaccuuucuaauggcgaaccuacccggaaacugccccaggggguggucuacggagugguucgcagaagcgaucagaaccagcaaaaggagaugguggucuauggcugguccacaucucagcucaaagaggaaaugaauuacauuaaggacgugcgggcuacccuggagaagguucgcaaaagaauguauggggauuacgacgaaaugcggcagaagauccgccagcugacacaagagcucagcgugucccacgcccagcaggaguaucuggaaaaccauauucagacccaaagcucugcccuugauagauucaaugcuaugaacuccgcccuggcuagcgacucuaucggacuccagaaaacgcuggucgaugugacccuugaaaauuccaacauuaaggaccagauccggaaucugcaacagacauacgaggccagcauggauaaacuccgcgagaagcagagacagcuggaaguggcgcaagucgagaaccagcugcucaagaugaaaguugagucuucccaggaagccaaugcugaggugaugcgggaaaugaccaagaaacuguauagccaguacgaggaaaaacuucaagaggagcagagaaagcacuccgccgaaaaggaggcucugcucgaagagacaaacucuuuucugaaagccaucgaagaggcgaauaagaagaugcaggccgcugagauuagccuugaagagaaagaccagcgcaucggcgaacuggaucggcucauugagagaauggagaaggaacgccaucaacugcagcugcagcuccuggagcacgaaaccgagauguccggcgaacuuacggacagcgauaaagagcgguaccagcaacuggaggaagccucugcuucccucagagagcgcauccggcaucuggacgacauggugcacugccagcagaagaaagucaagcaaaugguggaagagauugaaagccuuaagaaaaagcugcagcagaaacagcuccugauccugcaacuccuggagaagauuucuuuccuugagggggaaaacaaugagcugcagagcagacucgauuaucugacagaaacccaggccaaaacagagguugaaacccgcgagaucggagugggcugugaccugcuuccucggcucccguuuagacagaacgauuccucuagccacugccaaaaguccgggagccccaucucuuccgaggaacgccggagacgggacaagcagcaucuggaugacauuaccgccgcucgccugcucccucugcaccauaugcccacacagcuucugagcaucgaggaaucucucgcgcugcagaaacaacagaagcagaacuacgaggagaugcaagccaaacuggcugcccagaaacuugccgaaagacucaauauuaagaugcgguccuauaacccugagggagaaagcuccggcagauaccgcgagguccgggaugaagacgaugacuggucuagcgaugaguucuga

SEQ ID NO: 69674 - RNA, 543 nt, Artificial Sequence
  derived and/or modified sequence opt5 from GCSAM__Homo_sapiens__NP_001177188
augggcaacagccugcucagagaaaauuccuuccggcgccagcaaaacacccaggaaaugcccuggaaugugagaaugcagucuccuaagcagcggacaagccgcugcugggaccaccauaucgccgagggguguuuuugccugccguggaaaaagauucuuaucuucgagaaaagacaagauucccagaacgagaaugaacggaugucuagcacgcccauucaggacaacgucgaucagaccuacuccgaggagcuguguuauacacucaucaaucaccgcguucugugcaccagaccuucuggaaacagcgcugaagaguacuaugaaaaugugcccuguaaggccgagcggccucgcgagucccuuggcgggacagaaaccgaguacagccugcuccauaugcccucuacagacccuagacacgcgcgguccccggaagaugaguaugaacugcugaugccccaucgcauuagcucucacuuucuccaacagccuagaccccugauggcuccuuccgagacccaguucagccaccuuuga

SEQ ID NO: 69675 - RNA, 348 nt, Artificial Sequence
  derived and/or modified sequence opt5 from GCSAML__Homo_sapiens__NP_001268764
augggcaacuaccugcucagaaagcugcggcaggagaugaccacauucgaacgcaaacuucaagaccaggauaagaaaagccaggagguguccucuacgagcaaucaggaaaacgagaauggguccggaucugaagaggucugcuauaccguuaucaaccacauuccccaucaaagaagcucccugucuagcaaugacgauggcuacgagaacaucgacucccucacacggaaggugcgccaguuuagagaacggagcgagaccgaauaugcccugcuucgcacaucuguguccagaccuuguagcugcacccacgagcaugauuacgaggucguguucccgcacuga

SEQ ID NO: 69676 - RNA, 522 nt, Artificial Sequence
  derived and/or modified sequence opt5 from GCSH__Homo_sapiens__NP_004474
auggcccugagagugguccggagcguucgcgcucuccugugcacccuuagagccgugcccuccccugcggcuccgugucccccucggcccuggcagcugggcgugggggccguccgcacacucagaacgggaccugcccugcuuucugugcggaaguucaccgagaaacacgaauggguuacaaccgagaacggcaucgggacagugggaauuagcaauuuugcucaagaagcccugggcgacgucguguacugcucccuccccgagguugggaccaagcugaacaaacaggaugaguucggagcucuggaaucugugaaggccgcgagcgagcucuauuccccucugucuggcgaagucacagagaucaaugaagcccuugcugagaacccgggccuggugaauaaaagcuguuacgaggacggguggcucauuaagaugacccuguccaaccccagcgaacuugaugagcugaugucugaagaggccuaugaaaaguacaucaaauccauugaggaguga

SEQ ID NO: 69677 - RNA, 1416 nt, Artificial Sequence
  derived and/or modified sequence opt5 from GDA__Homo_sapiens__NP_001229434
augugcgccgcucagaugcccccucuggcccacaucuucagaggcaccuuugugcacagcacauggacguguccgauggagguccuccgggaccaucugcuugggguuuccgauucuggaaagauuguguuccuggaagaggcgagccaacaggaaaaacucgcuaaggaguggugcuuuaaacccugugaaauccgcgagcugucccaccacgaguucuuuaugccuggccuuguggacacccauauucacgccucucaguacagcuucgccggguccucuaucgaucugccccuccuggaauggcugacaaaguauaccuuuccugcugagcacagauuccagaacauugacuuugccgaagaggucuacacacgggugguucgcagaacccucaaaaauggaacaaccacggcuugcuauuucgccaccauccauacagauagcucccugcuucuggcggacaucaccgauaaguuuggccaacgggccuucguggggaaggucuguauggaccucaacgauacauuucccgaguacaaagaaaccacggaggaaagcauuaaggagacagaacgcuucgugucugagaugcugcagaaaaauuauuccagaguuaagccuaucgugaccccgcgguucagccuuucuugcuccgagacacugaugggagaacucggcaacauugcuaaaacccgcgaccugcacauccagagccauauuucugagaauagagaugaagucgaggccgugaagaaccuguaccccuccuauaagaauuacaccagcguguacgacaaaaacaaucuccugacaaacaagacggucauggcucacggcuguuaucuuuccgccgaggaacugaauguuuuucacgagcgcggggcgucuaucgcccauugcccuaacagcaaucucucccugagcucuggauuccuuaacgugcuggaagugcucaaacacgaggucaagauuggccuggggaccgauguggcuggaggcuacuccuauagcaugcuggacgccauccggagagcuguuauggugucuaauauccuccugauuaacaaagucaacgaaaagagccuuacacugaaagagguguuucggcucgccacccuugggggaucccaggcccugggccuggacggcgaaaucgggaauuucgagguuggaaaggaguuugaugcuauucucaucaaccccaaggcgucugacagcccuauugaucuguucuacggcgacuuuuucggggauaucuccgaagccgugauccaaaaauuucuguaucucggagacgaucgcaauauugaggaagucuacgugggcgggaagcaggucgugcccuucucuagcuccguuaaagagacaauccaucugccggcuagcucuccucaucccccucccuuucccuga

SEQ ID NO: 69678 - RNA, 873 nt, Artificial Sequence
  derived and/or modified sequence opt5 from GDAP1__Homo_sapiens__NP_001035808
augagacugaacagcaccggcgaggugcccguccucauccacggggaaaauauuaucugcgaggccacacagauuaucgacuaccuggaacaaacguuccuugaugagcggaccccucgccugaugccggacaaggaauccauguauuaccccagaguucagcauuaucgggagcuccuggauucucuuccuauggacgcuuacacacacggauguauucugcaucccgagcucaccguggauagcaugaucccugccuaugcgacaacccgcaucagaucccagauuggcaacacagaaucugagcugaaaaagcuggcugaagagaaucccgaccuccaggaggccuacaucgccaaacaaaagcggcugaaaagcaaacuucuggaucacgacaacgugaaguaucucaagaagauucuggaugaacuugagaaaguccuggaccagguggaaaccgagcuccagcgcagaaaugaagagacgccugaggaagggcagcaaccguggcugugcggagaguccuuuacccuggcugauguuucucucgccgugacacugcaucggcuuaaguuccugggcuuugcucgcagaaacugggggaauggaaaacggcccaaccucgaaaccuacuacgagcgcguccugaagagaaagacauucaauaaagugcuuggccacguuaacaauauccugauuagcgccgugcucccuaccgcguuucgggucgccaagaaacgcgcucccaaggugcugggcacgacacugguggucgggcuccuggccggaguuggcuauuucgcuuuuaugcuuuucagaaaacggcugggguccaugauccucgccuuuagaccucgccccaacuacuucuga

SEQ ID NO: 69679 - RNA, 996 nt, Artificial Sequence
  derived and/or modified sequence opt5 from GDE1__Homo_sapiens__NP_057725
auguggcugugggaggaccagggcgggcuccugggacccuucagcuuucuucugcucgugcugcuucuggucaccagauccccuguuaacgccugccuccugacaggcucucuguucgugcuccugcggguguuuagcuucgaaccgguccccuccugucgcgcccuucaagugcugaagccuagagaucggaucucugcuauugcgcaccgcgggggaagccaugacgcucccgagaauacgcucgccgccaucagacaggcugccaaaaacggcgcuaccgggguugaacuggauauugaguuuacauccgacggaaucccugugcuuaugcacgauaauaccgucgaccggacaaccgauggcacaggccgccugugcgaccucaccuucgaacagauuagaaagcugaaccccgccgcgaaucaucggcugcgcaacgauuuuccugacgagaaaaucccgacgcucagagaggccguggcugaaugucugaaucacaaccuuaccaucuucuuugauguuaaggggcaugcccacaaagcuacagaggcccugaagaagauguacauggaguucccccagcucuauaauaacucuguggucugcagcuuucugccugaagugauuuacaaaaugcggcaaaccgaccgcgaugugaucacagcgcuuacccacagacccuggucccugagccauacgggagacggcaagccucgguaugacacauucuggaaacacuuuauuuucgucaugauggauauccuccuggacuggucuaugcauaauauucugugguaccucugugggaucuccgccuuccugaugcagaaggauuuuguuagccccgcuuaucuuaaaaaguggucugccaagggcauucagguggugggauggaccgucaacacauucgacgagaaauccuacuaugaaagccaccuggggucuuccuacaucaccgauagcaugguggaggacugcgaaccgcacuuuuga

SEQ ID NO: 69680 - RNA, 1437 nt, Artificial Sequence
  derived and/or modified sequence opt5 from GDF10__Homo_sapiens__NP_004953
auggcccacgugcccgcuagaaccagcccuggcccggggccccagcugcuccugcuucugcucccucuguuccuucugcuccugcgggacgucgccggaucccaucgcgcgcccgcuuggucugcccugccugccgcugccgacggccuccaaggggacagagaucugcagcggcaccccggagacgcugccgcgacacuuggcccuagcgcccaggauaugguugcugugcauaugcaccgccuguacgagaaguauuccagacagggggcccggccgggaggcggcaacacggugcgcucuuuuagagcucggcucgaagucguggaccaaaaagccguuuacuucuuuaaucugaccagcaugcaggauuccgagaugauccuuacagcgaccuuccauuuuuauucugaacccccucgcuggcccagagcccuggaggugcucugcaagccucgggcuaaaaacgccagcgggcgcccccugccgcugggaccucccacaagacagcaccuccuguuccggucccuuagccagaauaccgcuacacaaggccugcuccgcggggccauggcccuggcuccuccucccagaggacuuuggcaggcgaaggacauuucucccaucgucaaagccgcucggagagauggcgaacugcuccuguccgcccagcuggacagcgaggagcgcgauccgggggugccccggccuucucccuacgccccuuauauucucguuuacgcuaacgaccuggccaucuccgaacccaauagcguggcggucacccuucagagauaugauccguuuccugcuggagaccccgagccucgcgccgcccccaacaauucugcugacccucgggugagacgcgccgcucaagccacgggcccccugcaggauaacgaacucccgggccuggacgagcggccucccagagcgcacgcccagcauuuccacaagcaucaacuuuggcccuccccuuuucgcgcucugaagccgcggcccgggagaaaagaucgccggaagaaaggacaggagguguucauggccgcuagccagguccucgacuuugaugaaaagaccaugcagaaagccagacggaagcaaugggacgagccucgcguuuguuccagacgguaccugaagguggauuucgcggacauuggcuggaaugaauggaucaucucucccaaaucuuuugaugccuacuauugcgcuggggccugugaguucccuaugcccaagauugugagaccuuccaaccacgcuacaauccagagcauuguccgcgccgugggaaucauucccggcaucccggaaccuugcuguguucccgacaaaaugaauagccuggggguccucuuccuggaugagaaccggaauguggugcuuaagguuuacccuaacauguccguggauaccugcgccuguagauga

SEQ ID NO: 69681 - RNA, 1224 nt, Artificial Sequence
  derived and/or modified sequence opt5 from GDF11__Homo_sapiens__XP_006719257
auggugcuggccgcuccccuccugcuuggcuuccugcuccuggcccuugagcugagaccucgcggggaagcggcugagggaccggccgccgcugccgcugccgcggccgcugccgcugccgcgggcgucgggggagaacggagcuccagacccgccccuucuguugcucccgagccugacggcugccccguguguguguggcggcagcacagccgcgaacucagacuggaguccaucaagucucaaauucugagcaaacuccggcugaaggaggccccuaacaucucccgcgaagucgugaaacagcuucugccgaaggcucccccucuccagcagauucuggaucuucaugacuuucaaggggaugcccugcagcccgaggacuuccucgaagaggaugaguaccacgccaccacagaaacgguuaucucuauggcucaggagaccgacccugcggugcagacagauggaagcccccugugcugucauuuucacuucuccccgaaagucauguuuaccaaggugcugaaggcccaacucuggguuuaucugagaccugugccccggccugcuacagucuaccuucagauucugcgccucaaaccccugaccggcgaaggcacagccgggggaggcgggggaggcagacggcauauccgcaucagaagccuuaagauugagcugcacucucgguccgggcacuggcagagcaucgacuucaaacaggugcuccauucuugguuucgccaaccccaguccaauuggggaauugaaaucaacgccuucgauccuagcggcaccgaccuggcugugacgucucugggcccgggggccgagggacuccaccccuuuauggagcugagaguccuugaaaauaccaagcgguccagacgcaaccugggccucgauugcgacgagcauagcuccgaaucucgguguugcagauauccucugacaguugauuucgaggcguuugggugggacuggauuaucgcucccaaacgcuacaaggccaauuauuguagcggacagugcgaauacauguucaugcaaaaguauccucacacccaccuugugcagcaggccaacccccggggcuccgcugggccguguugcacaccuaccaaaaugagccccauuaauaugcuguacuuuaacgacaagcagcaaaucaucuacggaaaaauuccuggcaugguggucgauagauguggcugcucuuga

SEQ ID NO: 69682 - RNA, 927 nt, Artificial Sequence
  derived and/or modified sequence opt5 from GDF15__Homo_sapiens__NP_004855
augcccggccaggagcugagaaccgugaacgggagccaaaugcuccugguccuucugguucucuccuggcugccucacggaggcgcccuuucucuggcugaagccagccgggcguccuucccggggcccucugagcuccauagcgaagacucccgcuuuagagagcugcggaagcgcuacgaagaucugcucacaagacugcgggcuaaucagucuugggaggacagcaacacggaucuugugccugcccccgccgugcgcauccugaccccugaggucagacucggauccggcgggcaucugcaccuucggauuagccgcgcugcccugcccgaaggacucccugaggcuucuagacugcaccgggcccuguuccgccucuccccgacagcgagcagaucuugggacgugacccggccccugcgcagacagcuuucccuggcccggccucaggcucccgcccuccaucugagacuuagcccucccccgucucaauccgaucagcugcucgcugaaagcuccucugcccgcccucagcuggagcugcaccuccggccccaggcggccagaggccgccggagagcucgcgcccggaauggcgaccacugcccucuggggcccggaagauguugccgccuucauacaguucgggcuagccuggaggaucucggcugggccgacugggugcugucccccagagaaguccaagugaccauguguaucggggccugcccuagccaguuucgcgcugcgaacaugcacgcccagauuaaaacaucucuucaucggcugaagccggauaccguucccgcuccuuguugcgugcccgccuccuauaauccuaugguccucauccagaaaacggacaccggagugagccugcaaacauacgaugaccugcucgccaaggauugucacugcauuuga

SEQ ID NO: 69683 - RNA, 1119 nt, Artificial Sequence
  derived and/or modified sequence opt5 from GDF1__Homo_sapiens__NP_001483
augcccccuccgcagcaaggccccugcgggcaccaucugcuccugcuucuggcccuccugcuuccuagccugccccucaccagagcuccugugcccccuggaccggccgcggcucugcugcaggcccucggccugcgggacgagccccagggggccccucgccuuagacccgucccucccguuauguggcggcuguuccgcagacgggauccgcaggaaacacgcuccggaucuagacggacgagcccuggcgugacccuccaacccugucacguggaggaacugggggucgcuggaaacaucgugcgccauauuccugacagaggcgcccccacacgggcuuccgagcccgccucugcggccggccacugcccugaauggaccguuguguuugaucuuagcgcugucgagccggccgagcgccccuccagagcucggcuggaacuccgcuucgccgcggccgcugccgcugccccugaagggggaugggagcugucuguggcccaggcuggccagggggcgggagccgaccccggcccuguucugcucagacagcuggugcccgcucuugggccgccuguccgggccgagcugcucggagccgcuugggccagaaaugcgagcuggccccgcucccugcggcuugcucuggcccucagaccucgcgcccccgcugccugugcucggcuggccgaggcgagccugcuccuggugacacuugauccuagacugugccauccccucgcccgcccgcggagagacgcugaaccugugcugggcggcgggcccggaggcgccugucgcgcucggagacuuuacgucucuuuucgcgagguuggguggcaccggugggugaucgcccccagaggauuccuggcgaacuauugccaaggccagugugcccucccuguggcucuguccgggagcggaggcccgcccgcccugaaucacgcuguccuccgggcccugaugcaugccgcugcgccuggcgccgcugaucuucccugcugugugccugcccgccugucucccauuuccguucucuuuuucgacaacagcgauaaugugguccugagacaguacgaagacauggugguugaugagugcgggugucgguga

SEQ ID NO: 69684 - RNA, 1290 nt, Artificial Sequence
  derived and/or modified sequence opt5 from GDF2__Homo_sapiens__NP_057288
augugccccggcgcccuguggguggcucucccucugcuuagccugcucgccgggucccugcagggaaagccgcuucaaucuuggggcagagggagcgcgggaggcaacgcucacucuccccugggggucccuggaggcggccuccccgagcauaccuucaaucugaaaauguuucuggaaaacguuaagguggacuuccuccggucccugaaucuuagcggggugccuucccaggauaaaacacgcgucgagcccccucaguacaugaucgaccuguauaacagauacacgucugauaagagcaccacaccggccuccaauauugugcggagcuuuucuauggaagacgccaucuccauuaccgcuacagaggauuuccccuuucagaaacacauccuccuguucaacauuagcaucccucgccaugaacaaaucaccagagccgagcuucggcuguauguuucuugucagaaucacguggaccccucccaugaucucaagggaagcgucgugauuuacgacguucuggauggcacagacgcuugggauucugccaccgagacgaagaccuuucuggugucccaggacauccaggaugaagggugggagacacucgaagucagcuccgcggugaaacgcugggugagaucugacagcaccaaguccaaaaacaagcuggaggucacaguugagagccaccggaaaggaugcgacacccuugauauuucugugccucccggcucccgcaaucugccguucuuuguggucuucagcaacgaccacucuagcgggacgaaggaaacaagacucgagcugcgggaaaugaucucccaugagcaagaaucugugcuuaagaaacugagcaaggauggauccaccgaggccggcgagagcucucacgaagaggacacagauggccauguugcugccggguccacccucgcucgcagaaaacggagcgccggagcgggcucucacugucagaagaccucccugcgcgugaauuuugaagacauugggugggauagcuggaucauugccccuaaagaguaugaggcuuacgaaugcaagggaggcuguuucuuuccccuggccgacgaugucacaccuacgaaacacgcuaucgugcagacccucguucaucugaaguuccccacaaagguggggaaagccugcuguguccccaccaaacuuuccccuaucucugugcuguauaaggacgauaugggagucccgacacucaaguaccacuacgagggcaugagcguggccgaaugcggcuguagauga

SEQ ID NO: 69685 - RNA, 1095 nt, Artificial Sequence
  derived and/or modified sequence opt5 from GDF3__Homo_sapiens__NP_065685
augcugagauuccuccccgaccuggccuuuagcuuccuucugauccucgcucugggccaggccgugcaauuucaggaguacgucuuccuucaguuucuggggcucgauaaggcgccuuccccgcagaaauuccaacccguuccuuauauucugaagaaaaucuuucaggaccgggaagcugccgccaccacaggagugucucgcgaucugugcuacgugaaggagcucggcgucagagggaacgugcugcgguuccuucccgaccagggauuuuuccuguauccuaaaaagauuagccaggcuuccucuugucuccaaaagcugcuuuacuuuaaucugagcgccaucaaagaacgcgagcagcucacgcuggcucagcugggccucgaucuggggcccaacuccuauuacaaucuuggaccugaacuggagcucgcccuguuccuuguucaggagccgcacguguggggccaaaccacacccaagccuggcaaaauguuuguccugagaucugugcccuggccucagggggcgguucauuucaaccuccuggacguggccaaggauuggaaugacaacccccggaaaaauuucggacuguuucucgaaauucuggucaaggaggaucgcgacagcggcgugaacuuccagccggaagauaccugcgcuagacuucgguguucccugcacgccagccuccugguggucacacuuaauccugaccaaugccaucccucucgcaagagacgggcugccaucccuguucccaaacuguccuguaagaaccucugccaccgccaucagcuguuuaucaauuucagagaucugggguggcacaaauggauuaucgcgcccaagggauuuauggccaacuauugucacggcgagugcccuuucagccucaccauuucucuuaauuccagcaacuacgcuuuuaugcaggcccugaugcaugcuguggacccggagaucccccaggccguguguauuccuacaaaacugucucccaucuccaugcucuaccaagacaauaacgauaacgucauucugcggcacuaugaagacauggugguugaugagugcggguguggauga

SEQ ID NO: 69686 - RNA, 1506 nt, Artificial Sequence
  derived and/or modified sequence opt5 from GDF5__Homo_sapiens__NP_001306067
augagacugcccaagcuccugaccuuccuucugugguaccucgccuggcuggaccuugaguuuaucugcacagugcugggcgcuccugaucucgggcagcggccgcaaggaacgcgccccggccuggccaaagcggaagcuaaggagagaccuccccuggcccggaacgucuuccgcccugggggacacagcuauggcgggggagccaccaaugcuaacgccagagcuaaaggcggcacagggcagaccggaggccucacacagcccaagaaagacgaaccuaagaagcugccgccccggccugggggacccgagccuaaacccggccauccgccucagacccgccaagccacagcgagaaccguuacgcccaaggggcagcuuccuggaggcaaagccccucccaaggcuggcuccgugcccucuagcuuucugcucaaaaaggcccgggaaccggggcccccucgcgagcccaaggagccuuucagacccccgccuauuacaccccacgaauacaugcugucccuuuaucggacccugucugaugcugaccgcaaaggaggcaauagcuccgugaagcucgaggccgggcuggcgaacaccaucacaucuuuuauugauaaaggacaggacgauagaggcccugucgugcggaagcagcgcuacguuuucgacaucagcgcccuggaaaaagaugggcuccugggagcugagcuucggauucugcggaagaaacccuccgacaccgccaagccugcugcccccggcggcgggagagccgcucaacucaagcugagcucuuguccguccggacgccagccugcggcccuucuggaugugcggagcguccccggccucgacgggucuggaugggagguguuugauaucuggaaacuguucagaaauuuuaagaacuccgcucagcugugccucgaacuggaggccugggaacgcggccgggccguugaccuuagagggcugggcuucgaccgcgcugccagacaggugcaugagaaagcgcucuuucuggucuucggaagaacgaagaaacgcgaucuguuuuucaaugaaaucaaggcucggagcggccaagacgauaagacaguguaugaguaccuuuucucucagagacgcaaacggagagcuccccucgccacccggcaggggaagcgcccuuccaaaaaccugaaggccagauguagccggaaagcccugcacgugaauuuuaaggacaugggaugggaugacuggauuaucgcuccgcucgaguaugaagccuuccauugcgagggccugugugaauuuccccuuagaucccaccuggagccuacaaaccacgcggucauucaaacccucaugaacucuauggaucccgaaagcaccccucccacaugcuguguuccuacgcgccugucccccaucagcauucuguucaucgacucugccaauaaugugguguacaagcaguacgaggauauggucguggaguccugcgggugucgguga

SEQ ID NO: 69687 - RNA, 1368 nt, Artificial Sequence
  derived and/or modified sequence opt5 from GDF6__Homo_sapiens__NP_001001557
auggacacccccagagugcugcucagcgccgucuuccugaucuccuuucuuugggaucugccuggcuuccagcaggcuucuauuagcuccucuagcuccucugccgagcucgggagcacaaagggaaugcggucccgcaaagaaggcaagaugcaaagagcgccgcgggacagcgaugcugggcgcgagggacaggaaccccagccuagaccccaagacgagccucgggcccagcagccccgcgcccaggaaccuccgggcagagggccccggguugugccucacgaguacaugcugucuaucuaucgcacguacuccauugcugagaaacuuggaaucaacgccagcuuuuuccaaucuuccaagagcgcuaauaccauuacaucuuuuguggauagaggccuggacgaucucucccauacaccccugcggcgccagaaauaucuguucgacgucagcaugcucuccgauaaggaggaacuggugggcgccgaacuuagacuguuucggcaggcgccuucugcccccugggggccgccugcuggaccccuccacguucagcuguucccuugccuuagcccccugcuccuggacgcccgcacccuggauccccaaggcgcuccuccggccgggugggagguguuugacgucuggcagggacucagacaucagcccuggaagcaacugugucuugagcugcgggcggccuggggcgaacucgaugcuggggaggccgaagcuagagcccgcggaccucagcagcccccucccccggaccugcggucccuuggcuucggcagacgcgugcggccuccccaggagagagcccugcucguuguguuuacccgcagccaacggaaaaaccuguucgcugaaaugagagagcagcuggggucugcggaggccgcuggaccuggcgccggggccgaaggauccuggcccccucccagcggcgcuccggacgcccgcccuuggcuccccucucccgggcggagacgccggagaacagcguuugcuagccggcacggaaagcgccauggcaaaaaguccagacugcggugcucuaaaaagccucuucacgucaauuucaaggagcugggcugggaugacuggaucaucgccccgcucgaauacgaggccuaucacugugaaggggugugcgauuucccccugagaagccaucuugagccuaccaaccacgcuauuauccagacgcugaugaacuccauggaccccggaagcaccccucccucuuguugcgugccuacaaaacucacccccauuuccauccuguacauugaugccggcaauaaugucguuuauaagcaguacgaggacauggugguggaaagcugugggugccgcuga

SEQ ID NO: 69688 - RNA, 1353 nt, Artificial Sequence
  derived and/or modified sequence opt5 from GDF7__Homo_sapiens__NP_878248
auggaccugagcgccgcugccgcgcucugccuguggcuucuguccgcuuguagaccccgggauggccucgaggccgccgcugugcugcgcgccgcuggggccggaccugucagaucuccgggcgggggaggcgggggaggcggcgggggacggacccuugcgcaggccgcuggcgccgcugccguucccgcggccgcugugccucgcgccagagcugcccggcgcgccgcugggagcggauucagaaacggcuccguggucccccaccauuuuaugaugucucuguaccggagccucgcggggcgcgccccugcuggagccgccgcuguguccgccucuggccacggcagagcggacacaaucacgggguucaccgaucaagcuacacaggacgaaagcgccgccgagaccggacaguccuuucuguucgauguuagcucucugaaugacgcugaugaaguggucggcgccgagcuccgggugcugcgcagagggucccccgaaagcggaccuggcucuuggacauccccgccccuucugcuccugucuaccugcccuggggcugcccgggcgccccgccuucuguauagcagagccgcugagccucucguuggacagcggugggaggccuuugacguggcugaugccaugagacgccaucggagagaaccccgcccgccucgggcguucugucugcugcucagagccgucgcuggccccgugccuuccccucuggcccuucgccggcugggcuuuggguggcccggaggcgggggaagcgcugccgaggaaagagccgugcucgucguuuccucucgcacacaacggaaggagagccuguucagagagauucgcgcucaggcgcgggcccuuggcgcugcccuggccuccgaaccccucccggaccccgggaccggcacggcuagcccuagagccgugaucggaggccggcgcagacggagaaccgcgcuggcugggacacgcaccgcccagggaucuggcgggggagccggccgggggcacggcagacgcggaagaucccggugcagccgcaaaccccugcauguggauuuuaaggagcucggcugggacgauuggauuaucgcuccucuggacuacgaagccuaucacugugaggggcuuugcgacuucccccugagaucucaccucgaaccgacaaaccaugcgauuauccagacccugcuuaauagcauggcuccugaugccgcccccgcuuccuguugcgucccugcccggcugucucccaucagcauucucuacaucgacgcugccaacaaugugguuuauaaacaauacgaggauaugguggucgaggcguguggaugccgcuga

SEQ ID NO: 69689 - RNA, 1365 nt, Artificial Sequence
  derived and/or modified sequence opt5 from GDF9__Homo_sapiens__XP_011541610
auggccagacccaacaaguuccugcucugguuuugcuguuucgcuuggcugugcuuuccuaucagccuuggcucccaggccucugggggagaggcgcaaauugcugccagcgccgaacuggaguccggcgcuaugccguggucucuccugcagcacaucgacgaacgggaucgcgccgggcuucugcccgcucucuucaaagugcugagcgucggaagaggcggguccccucggcugcagcccgacucucgcgcccuccauuacaugaagaaacuguauaagaccuacgcgacaaaagagggcauuccuaagagcaauagaucccaccuuuauaacacgguucggcuguuuacccccuguacacgccauaagcaggccccuggagaucaagugaccggcauccucccgagcguggaacugcuuuucaaucuggacagaauuacaaccgucgagcaccuccugaaaucugugcugcucuacaacaucaauaacuccguuagcuuuucuuccgcugugaagugcgucuguaaucugaugaucaaagagcccaagucuagcucccggacacuugggcgcgccccuuauagcuucaccuuuaacucccaguucgaauuuggcaaaaagcauaaguggauucagaucgaugugacgucucugcuccagccccugguugcuagcaauaaaagauccauucacaugagcaucaacuuuaccugcaugaaggaccaacuugagcacccuucugcccagaauggacuguucaacaugacacucgugucccccagccugauucuguaccucaaugauaccucugcgcaggccuaucauagcugguacucccugcacuacaaacggcgcccgucucaggggccugaccaagaaagaagccuuuccgcuuaucccgucggagaggaggccgcugaagauggccggagcucucaucaccgccacagacgggggcaggagacaguguccagcgaacugaagaaaccucucggacccgccucuuucaaccuguccgaguacuucagacaguuucuucugccccaaaaugaaugugagcuccaugacuuccgccugagcuuuucccagcugaagugggauaacuggaucguggccccucaccgguauaacccgagauacugcaaaggcgacuguccccgcgcugucggccaucgguaugggucuccuguucacaccauggugcagaauauuaucuacgagaagcucgauagcuccgugcccagaccuucuugcguccccgcgaaguauagcccgcuguccgugcuuacgaucgaaccugacggaagcauugccuacaaagaguacgaagacaugaucgcuacaaaguguaccugccgcuga

SEQ ID NO: 69690 - RNA, 1344 nt, Artificial Sequence
  derived and/or modified sequence opt5 from GDI1__Homo_sapiens__NP_001484
auggacgaggaauacgaugugaucguccugggcaccgggcucacagagugcauucugagcggaaucauguccguuaacggcaagaaagugcuucacauggacagaaaucccuauuacgggggagaaucuagcuccauuacgccucuggaggaacucuauaagcgguuccagcugcuugagggcccgcccgagucuauggggcgcggaagagauuggaacguggaccugaucccuaaauuucucauggccaauggccaacuggucaagaugcugcucuacaccgaagugacacgguaucuggauuucaaaguuguggagggcagcuuugucuacaaagggggaaagauuuauaaggugcccuccaccgaaacagaggcucuugccucuaaccugaugggcauguucgagaagcgcagauuucggaaauuccucguuuuuguggcgaauuucgacgaaaacgauccuaagaccuuugagggggucgacccccagacaaccagcaugcgcgauguguacagaaaauucgaccugggacaggaugugaucgacuuuacgggccaugcucuugcccuguaccggaccgaugacuaucucgaccagccuugucuggaaacagucaaucgcaucaagcuguacuccgagagccucgccagauaugggaagucuccguaccuguauccccuuuacggacugggcgaacucccucaaggcuucgcucggcuguccgccauuuaugggggaaccuacaugcuuaacaaacccguugaugacaucauuauggagaauggcaagguggugggggucaaaagcgagggagaaguggcucgcugcaagcagcugaucugugauccuucuuacauucccgacagaguucggaaagccggccaggugauccgcauuaucugcauccucucccacccgauuaagaacacaaaugaugcgaacagcugucagaucauuaucccucaaaaucaggucaacagaaaaucugacauuuaugugugcaugaucuccuacgcccauaauguugcugcccaggggaaguauaucgcuauugccagcaccacgguggagacaaccgaucccgaaaaggaggucgaaccugcgcuggagcugcucgagcccaucgaccagaaauuuguggccauuuccgaucuguacgaacccaucgacgauggaugugagucucaagucuucugcagcuguuccuaugacgcuacaacccacuucgaaaccacaugcaacgacauuaaggauaucuacaaacggauggccggcacggcuuuugacuucgagaacaugaagagaaaacagaaugauguguuuggcgaagccgagcaguga

SEQ ID NO: 69691 - RNA, 1203 nt, Artificial Sequence
  derived and/or modified sequence opt5 from GDI2__Homo_sapiens__NP_001108628
augaacgaggaauacgacgugaucguccugggcaccgggcucacagagugcauucugagcggaaucauguccguuaauggcaagaaagugcuucacauggauagaaaccccuauuacgggggagaaucugccagcauuacgccucuggaggaccucuauaagcgguucaaaaucccgggcucucccccugaauccauggggcgcggaagagauuggaauguggaccugauucccaaguuucuuauggcuaacggccugaugggccucuucgagaaacggcgcuuuagaaaguuccuggucuacguggccaauuuugaugagaaggacccucggaccuucgaagggaucgaucccaaaaagacaaccaugcgcgacguuuauaaaaaguuugaucugggacaggacgugaucgauuucacaggccaugcgcucgcucuguacagaaccgacgauuaucuugaccaaccuuguuacgagacaauuaaccggaucaaacuguacagcgaaucccucgcccgcuaugggaagucuccguaccuguauccccuuuacggacugggcgagcucccucagggguuugccagacugagcgcuauuuauggaggcaccuacaugcugaauaagcccaucgaggaaauuaucguccagaacggcaaagugauugggguuaaguccgagggagaaaucgcccggugcaaacagcucaucugugacccuagcuaugugaaggaucgcgucgagaaagugggccaagugauuagagucaucugcauucugucucaccccaucaagaauacgaacgacgcuaauuccugucagauuaucaucccgcagaaccagguuaaucggaaaagcgauauuuacgugugcaugaucucuuucgcccauaacguggcggcccaagggaaguacauugcuaucgucuccaccacaguggaaaccaaggagccugagaaagaaauucgccccgcccuugagcugcucgaaccuaucgagcagaaguuuguuagcaucucugaccugcuugugcccaaagaucugggaacagaaucccagauuuucaucagcagaaccuaugacgcuacgacacacuuugagaccacaugugaugacauuaagaauaucuacaaacggaugaccggcuccgaguucgauuucgaagagaugaagagaaagaaaaacgacauuuauggggaagauuga

SEQ ID NO: 69692 - RNA, 687 nt, Artificial Sequence
  derived and/or modified sequence opt5 from GDNF__Homo_sapiens__NP_001177397
augcagagccugcccaacuccaauggcgccgcugccgggagagacuucaagaugaaacucugggauguggucgcgguuugccuggugcuucugcacaccgcuucugccuuuccucucccggccggaaagcggcccccugaggcucccgccgaagaccgcagccugggcagacggcgcgcuccuuucgcccuuuccucugauagcaacaugcccgaggacuacccugaucaauuugacgaugugauggacuucauccaggcgacaauuaaaagacugaagcgguccccggauaaacagauggccguccucccccgcagagaacggaaucgccaggcugccgcugccaacccugaaaauucuagagggaagggacggcgcggccaaagagggaagaaccggggaugugugcugacggcgauccaucugaauguuaccgaccucggccugggcuaugagacaaaagaggagcuuauuuuucgcuacugcagcggguccugugaugccgcugaaaccacauaugacaagauccugaaaaaccucagcagaaaucggagacuggugucugauaaggucggacaggccugcugucgccccauugcuuucgacgacgaucuuuccuuucuggacgauaaccucguguaccacauccugcggaaacauagcgccaagagaugcggcuguaucuga

SEQ ID NO: 69693 - RNA, 957 nt, Artificial Sequence
  derived and/or modified sequence opt5 from GDPD3__Homo_sapiens__NP_077283
augagccugcuccuguacuaugcccuucccgcucugggcuccuacgccaugcucucuaucuucuuucugagacggccucaccuucugcauaccccgcgcgcgcccacauuccggauuagacucggggcucaccgcggaggcagcggggagcugcuggaaaacacgauggaggccauggaaaauuccauggcccagagaucugaccuccuggagcuugauugccaacugacccgggaccgcguggucguugugagccaugaugaaaaccucuguagacaguccggacugaaucgggacgugggcucucuugauuuugaggaccugccucucuauaaggagaaacuggaagucuacuucagccccgggcacuuugcucauggauccgaucgcagaauggugcggcuggaggaccucuuccagcgcuuuccuagaacacccaugagcguugaaaucaagggcaaaaacgaggagcugauucgggaaaucgccggccuugugcgcagauaugaucggaaugagauuaccaucugggcuucugaaaaguccagcgucaugaaaaagugcaaggccgcgaacccugagaugccgcugucuuucacaaucuccagaggguuuugggugcuccugagcuacuaucuuggacugcuccccuucauuccuauccccgaaaaauuuuucuuuuguuuccugccuaauauuaucaaccgcaccuacuuccccuuuucuugcuccugucugaaucagcuccuggccguugugagcaaguggcuuauuaugcggaaaucccugaucagacaccucgaggagcgcggcguccaagugguguucuggugccugaacgaagagucugacuuugaagcugccuucagcgucggggcuacaggaguuauuaccgauuacccgacggcccuucggcacuaucuggacaaucauggcccugcggccagaaccuccuga

SEQ ID NO: 69694 - RNA, 1818 nt, Artificial Sequence
  derived and/or modified sequence opt5 from GDPD5__Homo_sapiens__NP_110419
auggugagacaccagccccugcaauacuaugagccucagcucugccugagcugucuuaccggcaucuacgggugccgguggaagcgcuaucagagaucccaugacgauacaacgccgugggaacggcugugguuccuccugcuuaccuuuacauucggacugacccucacauggcuguacuuuuggugggagguccacaacgacuaugaugaguucaauugguaccuguauaaccgcaugggcuacuggucugacuggcccguuccuauucucgugaccacagccgcugccuuugcguacaucgcugggcugcuugugcuggcccucugucauauugccgucggacagcaaaugaaucugcacuggcuucauaaaaucggccuggugguuauucucgcuagcaccguggucgccauguccgcuguggcccagcugugggaagaugaaugggagguucugcucaucucucugcaggggacggcgcccuuccuucacgugggagccgucgcugccgugaccaugcugagcuggaucguggcuggccaguuugccagagcggagcggacauccucucaagucaccauucucugcacauucuuuaccguuguguucgcccuguaucuugcuccucugacgaucagcucccccuguauuauggaaaagaaagaccucggcccuaagccggcccugaucgggcaccgcggagcucccaugcuggccccugagcauacacucaugagcuuuagaaaagcccuggaacagaaacuuuacggccugcaggcugauauuaccaucucucucgacggggugcccuuccugaugcacgauacaacccuucggcgcaccacaaacgucgaggaggaauuuccugagcuggcgagacggcccgccuccaugcucaauuggacgacccugcagcgccugaacgcuggacaaugguuccucaagacagacccguucuggaccgccagcucucuguccccuagcgaucauagagaagcccagaaucagucuauuugcucccuugcugagcugcucgaacuggccaagggcaacgcgacacugcuucucaaucugcgggaucccccucgcgagcaccccuauagaagcuccuuuaucaacgugacccuggaggcuguucuccacucuggguucccccaacaucaggugauguggcugccuagccggcagagaccgcuuguccgcaagguggcccccggauuucagcaaacguccggcagcaaagaagccguugcuucucugcggagaggccacauccagcgccucaaucugcgguacacacagguguccagacaggagcugcgcgacuaugccagcuggaaccuuucugucaaucucuacaccgugaacgcuccuuggcuguucagccugcucuggugugccgggguccccuccgugaccucugacaauagccaugcgcugucccaaguuccuagcccccuuuggauuaugccgccugacgaauauugccugaugugggugacagccgaucucgucucuuuuacccugaucgugggaauuuucguucugcagaaguggcggcuuggcgggaucagauccuacaaccccgagcagauuaugcucagcgcugccgugcgccggacaucuagagacgucuccaucaugaaagaaaagcugaucuuuagcgagauuuccgauggaguggaggugucugacguucugagcgucuguuccgauaacucuuacgacacguaugcuaauagcaccgccacaccugugggcccccgcgggggaggcucccacaccaagacacucaucgaacggagcggcagauga

SEQ ID NO: 69695 - RNA, 891 nt, Artificial Sequence
  derived and/or modified sequence opt5 from GEM__Homo_sapiens__NP_859053
augacccugaacaaugugacaaugagacagggcacggucgggaugcaaccccagcagcagcgguggagcaucccugccgacggacgccaccucaugguucaaaaggagccgcaucaguacucccacagaaaccggcauucugcuacccccgaagaucacugccgcagaagcugguccucugacagcacagauuccgugauuucuagcgaguccggcaauaccuauuaccgggugguccugaucggggaacagggagugggcaaaagcacacuugccaacauuuucgcggggguucaugacucuauggauuccgacugugaggugcugggagaagauaccuaugagcgcacacucauggucgacggcgagagcgcuaccaucauucugcuugauaugugggaaaauaagggcgagaacgaauggcugcacgaccacugcaugcaagugggggaugccuaccucaucguuuauucuaucacggacagagccuccuuugagaaagcuagcgagcugcggauucagcugcgcagagcccggcagaccgaagauaucccuauuauccucgugggaaauaagucugaccugguccgcuguagagagguguccgugagcgaaggccgggcuugcgccgucguuuucgacuguaaauuuauugagacauccgcggccgugcagcauaacgugaaggaacuuuucgaggggaucguccgccaggugagacugcggagagauucuaaggagaaaaaugaacgccggcucgcuuaccaaaagagaaaagagagcaugccccgcaaggcccggagauuuuggggaaaaauuguugcuaagaacaauaagaacauggccuucaaacugaaguccaaaagcugccacgaccuuucugugcuguga

SEQ ID NO: 69696 - RNA, 798 nt, Artificial Sequence
  derived and/or modified sequence opt5 from GEMIN2__Homo_sapiens__NP_001009182
augagacgggccgagcuggcuggccucaagaccauggccugggugcccgcggaaagcgcugucgaggaacugaugccucgccuucugccgguugagcccugcgaccucacagaaggguucgauccuuccgugcccccuagaacgccccaggaguaccugcggcgcgugcaaaucgaggccgcccaguguccugacgucgugguugcucagauugauccgaaaaagcugaaaagaaagcagucugugaacaucagccuuuccggaugccaacccgccccugaaggcuauucucccacccuccaguggcagcagcaacaggucgcucaguuuagcacagugcggcagaauguuaacaaacaccgcucccauuggaagucucaacagcuggacagcaaugugaccaugccuaaguccgaggaugaagagggguggaaaaaguucugucugggagagaaacucugcgccgacggcgcggucgggcccgccacaaacgaaagcccgggaauugauuacgugcaggcuaccgugacaucuguccuggaguaucuuuccaauugguuuggcgaaagagacuucaccccugagcugggccgguggcucuacgcccugcuugcuugucuggaaaagccccuccugccugaggcccacagccugauccgccaacucgcgagacggugcucugagguucgccugcuuguggauuccaaagacgaugaaagagugcccgcccugaaccuccugauuugucuugucagccgguauuuugaccagcgcgaucuggcugacgagcccucuuga

SEQ ID NO: 69697 - RNA, 3177 nt, Artificial Sequence
  derived and/or modified sequence opt5 from GEMIN4__Homo_sapiens__NP_056536
auggaccugggcccccucaacaucugcgaggaaaugaccauucugcacgggggauuccuucuggccgagcagcucuuucauccuaaggcucuggccgaacuuacaaaaagcgauugggagagagugggccggccgaucgucgaagcgcugcgcgagauuuccucugcugccgcccacagccaacccuucgcuuggaagaaaaaggcccucaucauuaucugggcuaaaguucugcagccucaucccgugacgccuuccgacaccgagacaagauggcaggaagaucuguuuuucucuguggggaauaugauccccaccauuaaccacacaauccucuuugagcugcuuaagagccuggaagccuccggacucuucauucagcugcuuauggcgcugccuaccacaaucugucaugccgagcucgagcgguuucuggaacacgucaccguggacacgucugcugaggauguugccuucuuucuggacguguggugggaagucaugaagcacaaaggccauccgcaagauccccuccugagccaguucuccgcuauggcccacaaguaccuuccugcgcuggacgaguuuccccauccucccaaacgccucagaagcgauccggacgccugcccuaccaugccccugcuugcuaugcugcuccgggggcugacacagauucagucucgcauccugggaccuggcagaaaguguugcgcccucgcuaaucuggccgauaugcuuaccguguucgcccugacagaagacgauccccaagagguuuccgcuaccguguaucucgacaaacuggcgacggucauuagcguguggaacucugacacacagaaucccuaccaccagcaggcccuugcugagaaggugaaggaagccgagcgggaugucucccugaccagccucgccaaacugccuucugaaacaaucuuuguuggcugugaguuccugcaccaucuccugcgcgaauggggagaggagcuucaagcugugcugagauccagccagggaaccuccuaugacucuuaccggcucugcgauagccugaccuccuucagccagaacgccacacuguaucuuaaucgcacgucucucuccaaggaagacagacaaguggucagcgagcuggcggaaugugugcgggauuuucugcgcaaaaccucuacaguucucaagaacagagcucuggaggacaucaccgccagcauugccauggcugugauccagcagaaaauggaucggcacauggaagucugcuacauuuucgccuccgagaagaaaugggcuuuuucugacgaguggguggccugucuuggcagcaauagagcgcuguuccgccagccggaucucguucugcggcugcuugaaacagugaucgacgucuccaccgccgauagagcuauucccgagagccaaauccgccaggugauccaucucauucuggaaugcuaugccgaccugucucucccugggaagaacaagguccuggcuggaauccuucgguccuggggcagaaaagggcugagcgagaagcuccuggccuacguggagggauuucaggaagaccugaauacgacauucaaccagcuuacccaaucugcguccgagcagggccucgccaaagcuguugccagcguggcucgccuggucauugugcaccccgaaguuaccgugaagaaaauguguucccuggccgucgugaaucucggcacacauaaguuucuggcccagauccuuaccgcuuucccugcgcugcgguuuguggaggaacaggggcccaacucuagcgccacauucaugguuuccugccucaaggagacggucuggaugaaauuuucuaccccgaaggaggaaaaacaauuccuggagcugcuuaauugccucaugagcccugugaagccccaggggauuccuguggcugcccugcuggaacccgaugagguccucaaagaauuugugcugccuuuccuuagacuggacguugaggagguggaucucucccugcgcaucuucauccagacacuggaagccaacgcuugucgggaggaauacuggcuucagaccugcagccccuuuccgcugcuguucucucugugucaacuccuggacagauuuuccaaguauuggcagcuuccuaaggagaaacgcugccugagccucgaucggaaggaccuggccauucacauccuggaacuucugugugagauugucucugcgaacgcugagacauucucccccgauguguggaucaaaagccucucuuggcugcacagaaagcucgaacagcuggacuggaccguuggccuucggcugaaauccuuuuucgaggggcauuuuaagugcgaagugcccgccacccucuucgagauuuguaagcugagcgaggaugaauggacgagccaagcccacccuggauacggcgcugggacaggacugcuugccuggauggagugcuguugcgucucuuccggcaucagcgaacgcaugcugucccuccuggugguugacgugggcaauccggaggaagucagacucuuuucuaaaggguuccugguggcgcuugugcaggucaugcccugguguagcccucaggaguggcagcggcugcaucaacugaccagacgccuccuggagaagcagcuucugcacguucccuauucccucgaauacauucaguuugugccucugcucaaccugaaacccuucgcucaggagcuucaacugucugugcuguuucuccggacauuccaguuccugugcagccacuccugcagagauuggcuuccucuggaaggauggaaucaugucgugaagcuccuguguggcucucucacccgccugcuugacagcguuagagccauccaggccgcugggcccugggugcagggaccggagcaagaucugacgcaggaagcccuguuugucuauacacagguguucugccacgcucuccauaucauggccaugcugcacccugagguuugugagccccuuuacgugcuggcgcucgaaacccugacaugcuaugagacccucuccaaaaccaacccuagcgucucuucccugcuucaacgggcccaugaacagcgcuuucucaagagcauugcugagggcaucgggcccgaagagagacggcagacacugcuccagaaaaugucuuccuucuga

SEQ ID NO: 69698 - RNA, 504 nt, Artificial Sequence
  derived and/or modified sequence opt5 from GEMIN6__Homo_sapiens__NP_079051
augagcgaguggaugaagaaaggcccccuggaauggcaggacuacaucuauaaggaggugagagucaccgccuccgagaaaaacgaauacaagggguggguucucacaacggauccugugucugcuaauauugugcuggucaacuuccuugaagacggaagcauguccgugaccggcaucauggggcacgccguucaaacaguggagaccaugaaugagggagaucaucggguccgcgaaaaacugaugcaccucuuuacaucuggcgacugcaaggcguauagcccggaggaucuggaagagagaaagaacucccuuaaaaaguggcuggagaaaaaucauauucccaucaccgaacagggggacgcuccucggacacucuguguggccggaguucugaccauugaucccccuuacggccccgagaacugcucuagcuccaaugaaaucauccugagccgcgugcaggaccucauugagggccaccugacggccucucaguga

SEQ ID NO: 69699 - RNA, 2727 nt, Artificial Sequence
  derived and/or modified sequence opt5 from GEN1__Homo_sapiens__NP_872431
augggcgugaacgaccuguggcagauccucgagcccgucaagcaacacauuccucugagaaaucuugggggaaaaaccaucgccguugaucugagccucugggugugcgaagcucagacagugaagaaaaugaugggcuccgucaugaagccgcaucugcggaaccuuuucuuucgcauuucuuaccugacgcagauggacgugaaacucguuuucgugauggagggggaacccccuaagcugaaggccgaugucaucagcaaaagaaaucagucccgguauggaucuagcggcaaguccuggucucaaaagaccgggcgcagccacuuuaaguccgugcugagagagugucuccauaugcuggaaugccuuggcauucccuggguucaggcggcuggagaggccgaggccaugugugcuuaccugaacgccggcgggcacguggacggaugccucacaaaugauggcgacaccuuccuguauggggcucagacagucuaccggaacuuuaccaugaauacaaaagauccucauguggacuguuauaccaugagcucuaucaaguccaagcugggacuggaucgcgacgcccucgugggccuggcgauccugcucgggugcgauuaccugcccaaaggagucccuggcguuggcaaggaacaggcccuuaaacugauucaaauccucaaggggcagagccugcuucagagauucaaccgguggaaugagacgucuuguaacuccagcccgcagcugcucgugaccaaaaagcuggcucacugcucuguguguucccaccccggaagcccuaaagaccaugaacgcaauggcugcagacuguguaaguccgauaaguauugcgagccccacgacuacgaguacugcuguccuugcgaauggcaucggacagagcacgaccgccaacucaacgaagucgagaauaacauuaaaaagaaagccuguugcugugaaggguuucccuuccacgaggugauccaggaguuucugcuuaauaaggauaaacugguuaaggugauuagauaucagcggccggaccuccugcuuuuccaacgcuuuacccuggaaaagauggaguggccuaaccauuacgcuugcgaaaaacuccugguccugcucacacacuaugauaugaucgagagaaagcugggaucucggaacagcaaucagcuucagcccauuagaaucgugaaaacccgcauccggaacggcguucauuguuucgaaauugagugggagaagccugaacacuacgccauggaggacaaacagcauggggaauuugcgcugcucacgaucgaggaagagucccuguucgaggccgcuuaucccgaaauuguggccgucuaccaaaagcagaagcuggagaucaaaggaaagaaacagaagagaauuaaacccaaggaaaauaaccuuccugagccggaugaggugaugagcuuccagucucacaugacacucaagccuaccugcgaaaucuuucacaaacaaaauuccaagcugaacagcggcaucucucccgaccccacacugccucaggagagcauuuccgcuucucucaauagccugcuucugcccaaaaacaccccgugucucaaugcccaggaacaguucauguccagccugcgcccucuggccauccaacagauuaaggcugucucuaaaucccuuaucagcgagucuucccagcccaacaccagcucccauaauauuucugugaucgcggaucuccaccugagcacaaucgacugggaaggcacguccuuuucuaacagcccugccauucagcggaauaccuucucccaugaucugaaaagcgagguugagucugaacucuccgcuauccccgacggguuugagaacauuccugaacaacugagcugcgagucugaaagauauacagccaauaucaaaaaggugcuugaugaggacuccgacggaauuagccccgaggaacaccuucucucuggcaucaccgaucugugucugcaggaccuuccgcucaaggagcgcauuuucacaaaacugagcuacccucaggauaaccugcaacccgacgucaaccucaagacccuguccauccuuagcgugaaagaaucuugcaucgccaauuccgggagcgauugcacgucccaccugucuaaggaccuccccggcauuccucugcagaacgagagccgggauuccaaaauccugaagggagaccagcuucuccaggaagauuacaagguuaauacaucugugccguauagcgucuccaacaccguggugaaaaccuguaauguuagacccccuaacacagcucuggaccauucucgcaaggucgauaugcaaaccacacggaaaauucugaugaagaaaagcgugugccucgacagacacuccagcgaugagcagucugcccccguguuugggaaggcgaaguacacgacccagcgcaugaaacauuccagccagaagcacaauucuucccauuucaaagagagcggccacaacaagcugucuuccccuaaaauccacauuaaggaaacagagcaauguguccggagcuaugaaaccgcugagaaugaggaauccugcuuucccgacagcacaaagucuagccuuuccucucugcagugucauaaaaaggagaacaauagcggaaccugccucgacuccccucugccccugagacagcggcuuaaacugcgcuuccagucuacguga

SEQ ID NO: 69700 - RNA, 984 nt, Artificial Sequence
  derived and/or modified sequence opt5 from GET4__Homo_sapiens__NP_057033
auggccgcugccgcggcuauggccgagcaggaaagcgccagaaacggcgggcggaaucgcggaggcgugcaaagagucgaggggaagcugcgggcuuccguugaaaaaggagacuacuaugaggcccaccagauguaccgcacccucuucuuuagauauaugucucagagcaagcauacagaagcucgggagcugauguacuccggcgcccuucuguucuuuucucacgggcagcaaaacagcgcggccgaucucuccaugcuggugcuugagucucuggaaaaagcugagguggaagucgccgacgagcuccuggagaaucuggcuaagguguucagccucauggaucccaacuccccugaacgcguuacguuugugagcagagcccugaaauggucuuccggaggcagcggcaaacuugggcauccgcggcugcaccagcuccuggcgcuuacccuguggaaggagcagaauuauugcgaaucucgcuaccauuuccuccacuccgccgacggagagggcugugcuaacaugcuggucgaauauagcacaucuagaggguuucgguccgagguggauauguucguugcccaggcugugcugcaauuucucugccugaagaauaagagcuccgccucugucguguucaccacauacacccagaaacaccccagcaucgaggacggaccucccuuuguggaaccucuucugaacuucauuugguuucuccugcuugccgucgauggcgggaagcugacaguuuucaccgugcucugugagcaguaccagcccucccugcgcagagacccuauguauaaugaauaccuggaucggaucggacaacucuucuuuggcgugccgcccaaacagacgagcucuuauggcgggcugcuuggaaaccugcucaccucccugaugggcagcucugagcaggaagacggggaggagagcccuuccgauggaucucccauugaacuugacuga

SEQ ID NO: 69701 - RNA, 1296 nt, Artificial Sequence
  derived and/or modified sequence opt5 from GFAP__Homo_sapiens__NP_001124491
auggagagacggcgcaucaccagcgccgcuagacgguccuacgugucuagcggcgaaaugauggucgggggacuggcccccggccgcagacuggggccuggaacccggcugucccuugcgcgcaugccgcccccucugcccacgagaguugacuucucucucgcuggcgcccugaacgccggguuuaaggagacccgggcuagcgaacgcgccgagaugauggaacuuaaugauagauucgcuuccuauauugagaaagugcgguuucuggagcagcaaaacaaggcccucgcggccgaacugaaucagcugcgcgcuaaagagccuacaaagcucgccgacguguaccaggcugaacugagagagcuucggcugcgccucgaucagcugaccgccaacucugcgagacuugaggucgaacgggacaaucuggcccaagaucucgcuacagugagacagaaacugcaggacgagaccaaccugcgccucgaagccgagaauaaccuggcugccuaucggcaggaagccgaugaggcuacacuugcgagacuggaccucgagcgcaagaucgaaagccuggaggaagagauucgguuccuuagaaagauccacgaagaggagguucgcgaacugcaagagcagcucgcccggcaacaggugcaugucgaacuggauguggcuaaacccgaccugaccgccgcccucaaggagauuagaacgcaguacgaagcuauggccuccagcaauaugcacgaggcggaggaaugguaucgcucuaaauuugcugaucugaccgacgccgccgcucggaacgccgagcuucugagacaggcuaagcaugaagccaaugauuaccgccggcagcuccaaucccugacaugcgaccuugagagccugagaggaaccaacgagucucucgaacggcagaugcgcgagcaggaagagagacacguucgggaagcggccuccuaucaggaggcucuggccagacuggaggaagagggccaaagccucaaagacgaaauggcucgccaucugcaggaguaccaggaucuucugaaugugaagcucgcccuggacaucgaaaucgcgacauaccggaagcugcuugagggcgaggaaaacagaauuaccaucccuguccagacguucucuaaucuccaaauucgcgggggaaaauccacaaaggauggcgagaaccacaaagugaccagauaucucaagagccugacaauccgggugauuccgauccaggcccaccagauugucaacgggacacccccugcucgcggauga

SEQ ID NO: 69702 - RNA, 618 nt, Artificial Sequence
  derived and/or modified sequence opt5 from GFER__Homo_sapiens__NP_005253
auggccgcucccggcgagagagggcgguuccacggaggcaaccuguuuuuccucccugggggagcccgcagcgaaaugauggacgaucuggcgaccgacgcuagaggccgcggggccggacggagagaugccgcugccuccgcuucuacaccggcccaggcgcccacgagcgacuccccuguggccgaggaugcuucucggcgcagacccugccgggccugugucgacuuuaagaccuggaugcgcacacaacagaaaagagauaccaaguuccgggaagacugcccucccgaucgcgaggaacuuggcagacauagcugggcuguucugcacacacucgccgcguacuauccugaccugccgacccccgagcagcagcaagauauggcccaguuuauccaucuuuucuccaaauuuuacccuugugaggaaugcgcugaggaccugcggaagcgccucuguagaaaucaccccgauacacggaccagagccugcuucacgcaguggcugugucaucugcacaacgaagugaaucgcaaacucggcaagccugacuuugacugcucuaagguggaugagcgguggagagacggguggaaagauggaagcugugacuga

SEQ ID NO: 69703 - RNA, 855 nt, Artificial Sequence
  derived and/or modified sequence opt5 from GFI1B__Homo_sapiens__NP_001128503
augcccagauccuuccuggugaaguccaaaaaggcccacaccuaccaucagccucggguccaagaggacgaaccgcucuggcccccugcucugacacccguuccucgcgaucaggcccccucuaacagcccugugcuuuccacgcuguuuccgaaucagugccucgacuggaccaaccugaaaagagagcccgaacuugagcaggaucaaaaucuggcgcggauggcuccugcccccgaaggcccuaucgugcucucucgcccccaggacggggauagcccgcuguccgacucuccucccuucuauaagccuagcuuuuccugggauacacuggccaccacauacggacacagcuauagacaggcucccucuaccaugcaguccgccuuccucgagcauagcgucucucuguacggcagcccccuugugccuagcacagagccggcucuggacuuuucucuccgguauucccccgggauggaugccuaccacuguguuaaaugcaacaaggaacgcagcuucgaguguagaaugugcggaaaggcguuuaaacgguccucuacccugagcacgcaucuucugauucacuccgacacccgcccuuaucccugucaauucugcggcaagagauuucaccagaaaagcgauaugaagaaacauacauacauccacaccggggaaaagccucauaagugucaggugugcggaaaagccuucucucaguccagcaaucucauuacacacucucggaagcacaccggcuuuaaacccuucagcugugagcugugcacgaagggcuuucaacgcaaagucgaccugagacggcaucgcgagucccagcacaaccucaaguga

SEQ ID NO: 69704 - RNA, 1269 nt, Artificial Sequence
  derived and/or modified sequence opt5 from GFI1__Homo_sapiens__XP_011539548
augccccgcagcuuccuggugaaguccaaaaaggcccacucuuaccaucagccucggagcccgggccccgacuauucccuccgccuggagaacgucccugcucccucuagagccgauagcaccuccaaugcugggggagcgaaagccgaaccucgggaccgccuuucucccgagagccaacugacagaagccccugauagagcuuccgccagcccggacucuugcgagggcuccguuugugaacggagcucugaguuugaggauuucuggagacccccuucccccagcgcuucuccugccuccgaaaagagcaugugccccucccucgacgaggcgcagccguuuccucugcccuucaaaccuuacucuuggagcgggcuugccggauccgaucugagacaccucgugcagagcuaucggcccuguggcgcucuggaacgcggggccggacugggccucuuuugcgagcccgcuccugagccgggccaucccgccgcgcuguacgggccuaagagagccgcuggaggcgccggggcuggagcccccggcucuuguuccgccggggcuggagcgacggccggcccuggccuugggcuguauggagacuucggcagcgcugccgccgggcucuacgaacggcccaccgcugccgcgggacugcuuuauccggagcgcggccacgggcugcaugcugauaagggagccggcgugaaagucgaaucugagcuccugugcacaagacugcuccugggcgggggaagcuacaaguguaucaaaugcuccaagguguuuucuaccccucacggccuugaaguucacgugcggcgcagccauuccgggacaagacccuucgccugugagaugugcggaaaaaccuuuggccacgcugucagccuggagcagcauaaggccgugcacucucaagaacgguccuucgacuguaagauuugcgggaaaucuuuuaagagaagcuccacacucagcacccaucugcuuauccacuccgauacgcgcccuuaccccugccaguauuguggcaaacgguuccaccagaagucugacaugaaaaagcauaccuuuauucacacaggagagaaaccucauaagugccagguuuguggcaaggcuuucagccaauccucuaaccugaucacccacagcagaaaacacacaggguucaagcccuuuggaugcgaucucuguggcaaaggguuccagcgcaagguggaccugcggagacaucgcgaaacccagcacggacugaaauga

SEQ ID NO: 69705 - RNA, 2256 nt, Artificial Sequence
  derived and/or modified sequence opt5 from GFM1__Homo_sapiens__NP_079272
augagacugcucggcgccgcugccguggcggcucuggggcggggacgcgcccccgccagccuuggcuggcagagaaagcaagucaacuggaaggcuugccggugguccucuagcgggguuaucccuaaugagaaaauucgcaacaucggaauuuccgcccacaucgacucuggcaaaaccacacugacggaaagagugcucuacuauaccgggcggauugcuaagaugcaugaggugaaaggaaaggauggcgucggcgccgugauggacagcauggaacuggagcgccagagagggaucacaauccaguccgcggccaccuacacaauguggaaggauguuaauauuaacaucauugacaccccgggacacguggauuucacaaucgaagucgagcgggcccuucgcgugcuggacggcgcuguucucgugcugugugcugucgggggagugcagugccaaaccaugacggugaauagacagaugaaacgguauaacguccccuuucugaccuucauuaauaagcucgaucgcaugggcucuaacccugccagagcgcugcagcagaugcggagcaaacuuaaucauaacgccgcuuuuaugcaaauccccauggggcuggagggaaauuucaagggcauuguugaccucaucgaagaacgcgccaucuacuuugauggcgacuucgggcagauugugagauauggagaaaucccugcugagcugcgggccgccgcuacagaucacagacaggagcuuauugaauguguggcgaacuccgacgagcagcugggcgaaauguuucucgaggagaaaauccccagcauuucugaucugaagcuggccauccgccgggcuacccucaagagauccuucacaccugucuuucuggggagcgcccuuaaaaauaagggagugcaaccgcugcucgacgccguucuggaguaccuucccaacccuucugaggugcagaauuaugcuauccugaacaaagaagacgauuccaaggagaaaaccaagauucucaugaacagcucucgcgacaauucccaucccuucgucggccuggccuuuaaacuggaaguggggcgguucggacagcucacguacguuagaagcuaccaaggcgagcugaagaagggcgauacaaucuauaacacccgcacacggaaaaaggugagacuucagcgccuggcgcggaugcacgcugacaugauggaagaugucgaggagguguacgccggggacauuugcgcccucuuuggaaucgauugugcuuccggcgacaccuucaccgauaaagccaauucugggcugagcauggaauccauucacgucccugaccccgugaucagcaucgcuaugaagccgucuaacaaaaaugaucuugagaaguucuccaagggaauuggcagauuuacacgcgaagacccuacguucaaaguuuauuuugacaccgagaacaaggaaacagugaucagcgggaugggcgagcugcaucucgagauuuacgcccagcggcuggaaagagaguauggaugccccuguaucaccggcaaaccuaaggucgcguuccgggaaacaauuaccgcccccgugcccuuugauuucacgcacaaaaagcagucugggggagcuggccaauacgggaagguuaucggagugcuggagccucucgacccggaggauuauacaaaacuggaauuuagcgacgagaccuucggcuccaauauucccaagcaguuugucccugccguggaaaaaggguuccuugaugcuugcgagaagggcccccugucuggacauaaacucagcggccugcgcuuugugcugcaggacggggcccaccacaugguugauuccaacgaaaucagcuucaucagagcgggagagggcgcccuuaagcaggcucucgccaaugcuacccuguguauucuggagccuaucauggccgucgaagugguggcccccaacgaguuucaagggcaggucauugcuggaaucaaucggagacauggcgugauuacagggcaggacggcguugaagauuacuucacccucuacgcggacgugccgcugaacgauauguucggauauucuacagagcuucgcuccugcacggaaggcaagggggaguacaccauggaguauagccgguaccagccuugucugcccucuacacaagaagacgucaucaauaaauaucucgaggccaccggacagcugccugugaagaaaggcaaggcuaaaaacuga

SEQ ID NO: 69706 - RNA, 2100 nt, Artificial Sequence
  derived and/or modified sequence opt5 from GFPT1__Homo_sapiens__NP_001231639
augugcggcaucuucgccuaccugaacuaucacgugcccagaacccggcgcgagauucucgaaacacugaucaaggggcuucagagacuggaguaccggggauaugacagcgcuggcgucggguuugauggaggcaaugacaaagauugggaagccaacgcguguaagauucaacucaucaaaaagaaagggaagguuaaggcucuggacgaggaagugcauaaacagcaggauauggaccuugauauugaguucgacgugcaccugggaaucgcccauacgcgcugggccacccacggcgagccuuccccggucaauucucauccccagagaagcgauaagaacaaugaauuuaucgugauucacaacggcaucauuacaaauuacaaagaccucaagaaauuccuggaguccaagggguaugauuuugaaucugagaccgacacagagaccaucgcuaagcugguuaaauacauguaugauaaccgggaaagccaagacacauccuucaccacgcucguggagcgcgucauucagcagcuggaaggagccuuugcucuuguguucaagucuguucacuuuccuggccaggccguggggaccagacggggaagcccccugcucaucggcguccgcuccgagcauaaacugagcacagaccacauuccuauccuuuacagaaccgcgcggacacaaaucgggucuaaguucacccgcuggggaucccagggcgaaagaggcaaagauaagaaagggagcugcaaucugucucggguggacuccacgacaugucucuuucccguggaggagaaggccgucgaauacuauuucgcuagcgaugccucugcuguuauugagcauaccaaccgcgugaucuuucuggaagacgaugacguggccgcggucguggauggaagacuguccauucaccggaucaagagaacagccggcgaccacccugggcgcgcuguucagacccuccagauggagcugcaacagauuaugaaaggaaauuucagcuccuucaugcagaaggaaaucuuugagcaaccggagucuguggucaacaccaugcggggcagagugaauuucgaugacuacacaguuaaccuugggggacugaaagaucauaucaaggaaauucagcgcugccggagacucauccugauugccuguggcacgagcuaucacgcuggcguggccacccgccagguccuugaggaacugacagagcuccccgugauggucgaacuggccuccgacuuucuggaccggaauaccccuguguucagagaugacguuugcuuuuuccucagccagucuggggagacagcugauacccugaugggacuucgcuacuguaaagagcggggcgcgcugacgguggggaucacaaacaccgucggauccagcauuucuagagaaaccgacugcggcgugcauaucaacgccgggcccgagaucggcguugcuagcacaaaggccuauaccucccaauuugugucucucgucauguucgcccugaugaugugugaugaccgcauuagcaugcaggaacggagaaaggagaucaugcuuggacugaaacggcucccugaucugauuaaggaggugcuguccauggacgaugaaauccagaaacucgcuacagagcuguaccaccaaaagagcgugcuuauuaugggccgcggguaucauuacgccacgugccuggaaggagcgcucaaaaucaaggagauuaccuacaugcacucugaaggcauccuggcuggggagcugaagcacggaccccuugcccucguugacaaacugaugccggucaucaugauuaucaugagagaucauacauaugccaagugucagaaugcucugcaacaggugguggcccggcagggcagaccugucgugauuugcgacaaagaggauaccgaaacaaucaagaacaccaaacgcacgauuaagguuccccacuccguggacugccuccaggggauccugagcgucaucccucuucagcugcucgcuuuucaucuggccgugcugcggggcuacgacguugauuuccccagaaaucuugcgaagucugugaccgucgaguga

SEQ ID NO: 69707 - RNA, 2049 nt, Artificial Sequence
  derived and/or modified sequence opt5 from GFPT2__Homo_sapiens__NP_005101
augugcggcaucuucgccuacaugaacuauagagugccccggacccgcaaggagauuuuugaaacacugaucaaagggcuccagagacuggaguaccggggauaugacagcgcuggcgucgccauugaugggaauaaccacgaaguuaaggagcgccauauccaacuugugaaaaagagaggaaaagugaaggcgcuggacgaagaacucuacaagcaggauuccauggaccugaaagucgaguucgaaacgcacuuuggcauugcucauacccggugggccacacacggggugccuucugccguuaauagccauccgcagcgcuccgauaagggaaacgaguucguggucauccacaauggcaucauuaccaacuauaaagaccuuagaaaguuucuggaaucuaaaggcuacgaguucgagagcgaaacagauaccgagacaaucgcuaagcucauuaaguauguguuugacaaucgggaaaccgaggauaucacguucuccacccugguugaacgcgugauucagcaacuggagggggccuuugcucucgucuucaaaucugugcacuaccccggagaggccguggcgacaagacggggcagcccucugcuuaucgggguccgcuccaaguacaaacugagcaccgaacagauucccauccucuauagaacauguacccuggagaacguuaagaauaucugcaaaacgcggaugaagcgccuugacucuuccgccugucugcaugcugugggagauaaagccguggaauuuuucuuugcuagcgacgccucugcgauuaucgagcacacaaacagagucauuuuccucgaagaugacgacaucgccgcuguggccgauggcaagcuguccauucaucggguuaagagaagcgcuucugacgauccuucccgcgccauccagacccugcagauggagcuccaacagaucaugaaagggaauuucagcgccuuuaugcagaaggagauuuucgaacagcccgaguccguguuuaacacaaugcggggaagagucaauuucgaaaccaacaccgugcugcuuggcggccugaaagaccaccucaaggagauccgccggugcagacgccugauuguuaucggguguggaacaucuuaccacgcugcgguggccacgcggcaaguccuugaggagcugaccgagcucccugugauggucgaacuggcuagcgauuuucuggacagaaauacaccgguguuccgcgaugacguuugcuuuuucauuucccagagcggcgagaccgccgauacacuccuggcccuucgguauuguaaagacagaggggcucugaccgugggagucacgaacacagugggaucuuccaucagccgcgaaaccgauugcgggguucauaucaacgccggacccgagauuggcguggcgucuaccaaggcuuacacaagccaguuuaucucccucgucauguucggccugaugaugucugaggaccggauuagccuucaaaauagacggcaggaaaucauucgcgggcugagaucccucccugagcugaucaaggaagugcugagccucgaggagaaaauucacgaccuggcccuugaacuguauacccagcggucucuccuggugaugggaagaggcuacaacuaugccacaugucuggagggggcucuuaagaucaaagaaaucacguacaugcauuccgagggcauucucgccggcgaacugaagcacgggccccuggcucucaucgauaaacagaugccuguuauuauggucaucaugaaggaccccugcuuugccaagugucaaaaugcgcugcaacaggugaccgcccgccagggccggccgauuauccuuugcagcaaagaugacacagagucuuccaaguucgcuuacaaaaccaucgaacugccucauacaguggauugccuccagggcauucugagcgucaucccccugcagcuucucuccuuucaccuggccgugcugagaggauaugacguugauuucccucgcaaccucgcuaagucugugaccgucgaguga

SEQ ID NO: 69708 - RNA, 1383 nt, Artificial Sequence
  derived and/or modified sequence opt5 from GFRA1__Homo_sapiens__NP_001138925
auguuccuggccacccucuacuuugcucugccccuucuggaccuccugcuuagcgccgagguguccggcggggauagacuggacugcgucaaggcgucugaucagugucucaaagaacaaagcugcuccacaaaguaucggacgcugcgccaguguguugcuggaaaagagaccaacuucucucuggccagcggccucgaagccaaggacgagugcagauccgcuauggaagcccugaaacagaagucucuuuacaauugucggugcaagcgcgggaugaaaaaggagaaaaacugucugagaaucuauuggagcauguaccagucccuccaaggaaaugaucugcuugaggacagcccuuaugaaccggugaacucucggcuguccgauauuuuucgcgugguccccuucaucagcguggagcacauuccuaagggcaauaacugccucgacgcugccaaagcguguaaucuggaugacaucugcaagaaguacagaucugccuauauuacacccuguaccacauccguuagcaacgaugugugcaaucggcgcaaaugccauaaggcucugagacaguuuuucgacaaagucccugccaagcacucuuacgggaugcucuuuuguuccugccgggauaucgcuuguaccgaacgcagacggcagacaaucgugcccguuugcagcuacgaggagcgcgaaaaaccuaacugucugaaucuucaggacuccugcaagaccaacuauauuuguagaucucggcuggccgacuucuuuacgaauugccaaccggagagcagauccgugagcucuugucucaaagaaaacuacgcggauugccugcuugccuauuccggacugaucggcaccgucaugacacccaauuacauugacagcucuagccucuccguggcuccuuggugugauugcucuaacagcggcaacgaccuggaggaaugccugaaguuccucaacuuuuucaaggauaauaccugucugaaaaaugccauccaggcuuuugggaacggauccgacgugacagucuggcagcccgccuucccuguucagaccacgacagccaccacaaccaccgcgcuucgcgugaagaauaaaccccugggcccggcugggagcgagaacgagauuccuacacaugugcuucccccuugcgccaaucugcaagcucagaagcucaaaucuaacgucuccggaaauacgcaccuguguaucagcaacggcaauuaugaaaaggaggggcucggagccucuucccauauuaccacaaagagcauggccgcuccucccuccugcggccugucuccccugcucgugcugguugugaccgcccuuagcacacugcucucccugaccgaaacgucuuga

SEQ ID NO: 69709 - RNA, 996 nt, Artificial Sequence
  derived and/or modified sequence opt5 from GFRA2__Homo_sapiens__NP_001158511
augauccuggccaacguguucugccucuuuuucuuucugggcaccggggcugaccccgucguuagcgccaaguccaaucacugucuugaugcggcuaaagccugcaaccugaaugacaacuguaagaaacucagaucuagcuacauuuccaucugcaaucgggagauuucuccuacagaacgcuguaacagacggaagugccauaaagcccugcgccaguucuuugauagagugccgagcgaguauacguaccggaugcuuuucuguuccugccaagaccaggcuugugccgaacgcagacggcagaccauccugcccucuugcagcuaugaggauaaggaaaagccuaauugucucgaccugcgcggagugugcagaacagaucaccugugccggucccgccucgcugacuuucaugccaacuguagagcgagcuaccagaccgucacaucuugccccgccgauaauuaucaagccugucugggcuccuacgccgggaugauuggauucgacaugaccccuaacuauguggauagcucucccacaggcaucguuguguccccuuggugcagcugucgggggucuggaaauauggaggaggaaugcgagaaauuucuucgcgacuucaccgaaaacccgugucugagaaaugcuauccaggccuuuggcaacggcacggaugucaaugugucccccaaggggccuagcuuccaggcgacccaggcuccccggguugagaaaacaccuucccuccccgacgaccugucugauagcaccucccuuggaacaagcgugauuaccacgugcacaucuguccaagagcagggccugaaggcuaacaacuccaaagaacucagcauguguuuuaccgagcugacaaccaauaucauuccggggucuaacaaggugaucaagccuaauagcggacccuccagagcccgcccuucugcugcccugaccgugcucagcguccugaugcuuaaacuggcccucuga

SEQ ID NO: 69710 - RNA, 1203 nt, Artificial Sequence
  derived and/or modified sequence opt5 from GFRA3__Homo_sapiens__NP_001487
auggugagaccccugaacccucggccgcugcccccugucguucucaugcuucugcuccugcuucccccuagcccccugccucucgccgcuggcgacccgcugcccaccgagucccgccugaugaacucuugccuccaggccagacggaagugucaagcggauccuacaugcagcgcugccuaccaccaucuggacuccuguacgucuagcaucuccacaccccuuccuucugaggaacccagcgugccggccgauugccuggaagcugcccagcagcuccgcaauuccagccugauuggguguaugugccacagacggaugaaaaaucagguggcuugucuugacaucuauuggaccguccaucgcgccagaucucugggaaacuacgagcucgauguguccccuuaugaagacaccguuacaagcaagcccuggaaaaugaaucugucuaagcugaacaugcucaaaccugauuccgaccugugccuuaaguucgcgaugcuguguacccucaaugauaagugcgaccggcugcgcaaagccuacggcgaggcuuguagcgggccccacugccaaagacaugugugccuucggcagcugcucacauuuuucgagaaggccgcugaaccccacgcccagggacugcugcucuguccuugcgcgccgaacgaucgcggcuguggggagagacggcgcaauaccauugcccccaacugcgcucugccucccgucgccccuaauugucuugaacugagacggcucugcuuuucugacccccuguguagaucccgccuuguggauuuccagacgcacugccauccgauggacauccugggaaccugugcuacagagcaaagccggugccucagagccuaucugggccugauuggcaccgccaugacaccuaacuuuguuuccaaugugaacaccucugucgcucucagcuguacgugccgcggguccggaaaucugcaggaggaaugcgagaugcuugaaggcuucuuuagccacaaccccugucugacagaggcgaucgccgcuaaaaugcgguuccauucucagcucuuuucccaggacuggccucaccccaccuucgccgugauggcccaccaaaacgaaaauccugcugugagaccccagccgugggucccuagccuguuuucuugcacacugccccuuauccuccugcugagccucugguga

SEQ ID NO: 69711 - RNA, 810 nt, Artificial Sequence
  derived and/or modified sequence opt5 from GFRA4__Homo_sapiens__NP_071422
auggugagaugccugggccccgcccuccugcuucugcuccugcuugggagcgcuuccucugucggaggcaaccgguguguugacgccgcggaggcuugcaccgccgaugcccgcugucagagacugcggagcgaauacguggcucaaugccucgggcgcgccgcucagggaggcuguccuagagcccggugccgcagagcgcugcggcgcuucuuugccagagggccgcccgcucugacacacgcccuccuguucuguccuugcgcuggacccgccugugcggagcggcgcagacagacguuugugccuuccugcgccuucucuggccccggcccugcuccgcccagcugucuugaaccucugaauuuuugcgagcggucccgcgucugcagaccccggcuccuggccuuccaggugucuuguaccccugcucccagcgccccggacgggugccuucuggaucaaggagccagaugucuccgcgcuuaugcgggccugguugggacagccgugaccccuaacuacgucgacaauguguccgcucggguugcccccuggugcgauuguggagccagcggcaacagacgcgaagacugcgaggcuuuucgggggcuguucacaagaaaucgcugucucgauggagccauccaggcguuugcuucuggcuggccucccgugcugcuugaccagcugaacccccagggcgauccugagcauucccuccugcaagucagcucuaccgggcgggcccuugaaagacgcucccugcucagcauucugccggugcuggcccuccccgcucugcuuuga

SEQ ID NO: 69712 - RNA, 1659 nt, Artificial Sequence
  derived and/or modified sequence opt5 from GGA1__Homo_sapiens__NP_001001560
auggagcccgccauggaaccugagacccuggaagcuagaaucaaccgggccacaaauccgcucaacaaggagcuggacugggcgagcauuaauggcuucugcgaacagcuuaacgaggauuuugaggggcccccucuggcuacgcgccuccuggcccacaaaauccaaagcccccaggaaugggaggccauucaggcucuuaccgugcuggaaacauguaugaagucuugcggaaaaagauuccaugacgaggucggcaaguuucgguuccucaaugagcugaucaaaguugugagcccuaaguaccuggggucccgcaccucugaaaaggugaaaaacaagauucucgagcugcuuuauagcuggacagucggacugcccgaagaggugaaaaucgccgaagccuaccagaugcucaagaaacaaggcaucguuaaguccgauccuaagcugccggacgauaccacauuuccccuuccucccccuagacccaaaaaugugauuuucgaggacgaggaaaagucuaaaaugcuggcccggcuccucaagagcucccacccggaggaucugcgcgcggccaacaaacugaucaaggaaaugguccaggaggaccagaaaagaauggaaaagauuagcaagcgggugaaugcuaucgaggagguuaacaauaacgugaaacugcuuaccgaaauggucaugucucauucccaagggggagccgcugccggcagcucugaggaucugaugaaggaacucuaucagcgcugugagagaaugcggccuacgcuguuucgccuugcguccgacaccgaagauaaugacgaggcccugggccucagcgaucccacaccucccucugggcccucccuggacggaaccggcuggaacagcuuccaguccucugacgcuacagagccuccggcccccgcucuggcccaggccccuagcauggaauccagacccccugcucagaccagccuccccgcgucuuccgggcuggaugaccuugaucugcucggaaaaacgcugcuucaacagagccugccgccugagucucagcaagugcggugggaaaagcagcagcccacaccucgccucacccugagagaccugcagaauaaaagcuccucuugcagcucccccuccucuuccgccacaagccuccugcacaccgugucuccugagcccccgcggccuccccaacagcccgucccuaccgagcuuucccuggcuagcauuacaguuccgcucgaauccaucaagcccucuaacauucugccugugacgguguacgaucagcauggcuuuagaauccuguuccacuuugcccgcgacccccuuccugggcggagcgauguccucgugguuguggucuccaugcugucuaccgcuccccagccuaucagaaacauuguguuccaaagcgcuguucccaaggugaugaaagucaagcugcagccgccuuccggaacagagcuccccgccuuuaauccuaucgugcaccccagcgcgauuacccagguccugcuucuggcuaacccgcagaaagaaaaggugcgccuccgguauaaacugacauucaccaugggcgaccaaacguacaaugagaugggcgauguugaccaguucccucccccugaaacaugggggucucuguga

SEQ ID NO: 69713 - RNA, 1779 nt, Artificial Sequence
  derived and/or modified sequence opt5 from GGA3__Homo_sapiens__NP_001166175
auggcccugcccgaggaagcuaagaucaaagacgccuaccacaugcucaagagacagggcauugugcaaagcgauccuccgauccccgucgaccggacccugauuccuagcccgccuccccgcccuaaaaacccgguuuucgaugacgaggaaaagucuaaacuucuggcgaagcuccucaagagcaaaaaucccgaugaccuucaggaggcuaacaagcugaucaaauccauggugaaggaagaugaggcccggauucagaaagugacaaagagacuccauacgcuggaggaagucaauaacaaugugcgccugcucucugagaugcugcuucacuauagccaggaagacuccucugauggggacagagagcugaugaaggagcucuuugaucaaugcgaaaacaaacggcgcacccuguucaaacuugccagcgagacagaagacaaugauaacucccugggagacauccuccaggcuagcgacaaucugucuagaguuaucaacuccuacaagaccauuaucgagggccaggugauuaauggggaagucgccacacugacccucccugauagcgagggaaacucucaguguuccaaucaaggcacacugaucgaccuugcugagcuggauaccacgaacagccucucuuccgugcuggcccccgcgccuacacccccgagcuccgggauuccuauccuucccccuccuccccaggccucuggacccccgcggagccgcuccagcucucaggcugaagccacccugggccccuccagcaccucuaaugcucucagcuggcuggacgaggaacugcucugccugggccuugccgauccugcgcccaacguuccucccaaggaguccgccgggaacucucaguggcaucugcuccaaagagaacagagcgaccuggacuuuuucuccccgcggccuggaacagcugccuguggcgcuagcgaugcuccccuucugcagccuucugcccccuccuccucuuccagccaagccccucugcccccgccuuuucccgcgcccguggucccugccuccgugccggcucccucugccgggagcucccuguucucuaccggaguggccccugcucuggcccccaaagucgagccugcgguucccggccaccaugggcucgcucugggaaauagcgcccuucaccaccuggaugcccucgaccagcugcuggaggaagcuaaggugacguccggccuugugaaaccuacaaccagcccccucauuccgacaaccaccccugcccgcccccugcugccuuuuucuacaggccccgggagcccccucuuccagccucuguccuuucagucucaaggaagcccucccaagggccccgagcuuucccuggcuucuauccaugucccccucgaaagcaucaagccuuccagcgcccugccggugacggcguaugauaaaaacggguuccggauucuguuucacuucgccaaggagugucccccuggaagacccgacguucuuguggucgugguuucuaugcucaauaccgcuccucugcccgugaaauccaucguccugcaggccgcugugccuaagagcaugaaagucaagcuccagccgcccuccggcacagaacugucuccuuuuagccccauucagccucccgccgcgaucacccaagugaugcuucuggccaacccgcucaagaaacagguucuguccuuccuggggaaggcuugccuucagccuuggggacaggccauucuccugacaaccucuugccuggcuuga

SEQ ID NO: 69714 - RNA, 462 nt, Artificial Sequence
  derived and/or modified sequence opt5 from GGACT__Homo_sapiens__NP_149101
auggcccugguguucgucuacggcacccucaagagagggcagcccaaccaccggguucugcgcgacggagcucauggcagcgccgcguuuagagcucgggggcgcacacuugagccuuauccgcuggugaucgccggagaacacaauauucccuggcuccugcaucuuccuggcuccgggagacugguggagggagaagucuacgccguggaugagcggaugcuccgcuuccuggacgauuuugaaucuugccccgcucuguaucaaagaacgguucuccgggugcagcugcuugaggaccgcgccccuggcgcugaggaacccccugccccgaccgcgguccaguguuucguguacagcagagccacauuucccccugagugggcucagcugccccaccaugauuccuaugacucugaaggcccucacgggcuccgguacaacccccgcgagaauagauga

SEQ ID NO: 69715 - RNA, 501 nt, Artificial Sequence
  derived and/or modified sequence opt5 from GGCT__Homo_sapiens__NP_001186744
auggccaacagcggcugcaaggacgugaccgggcccgaugaggaauccuuccuguacuuugcuuauggaucuaaucuccugacagagagaauccaccuucggaacccuagcgccgcguucuuuugugucgcucgccugcaagacuucaaacucgauuuuggcaauucccaagggaagacgucucagaccuggcauggaggcauugccacaaucuuccagagcccgggggacgaaguuuggggagugguguggaaaaugaacaaguccaaucugaacucucuugaugaguggcggaaaaagagacacaccgccuuucagaaucaaggcaaccaucccugcaagcacaaaacacgcaugugggacagagauccuaagauucccguccagaaucugagccucgcucuguguuggcaggcccaguccggccaugggaccugcaaccggcuguucgcuugggugcagaaaaagaugguuugucgcuggagcaucaaaagaucuuga

SEQ ID NO: 69716 - RNA, 2277 nt, Artificial Sequence
  derived and/or modified sequence opt5 from GGCX__Homo_sapiens__NP_000812
auggccgugagcgcuggcuccgccagaaccucucccagcuccgacaagguccagaaagauaaggcggagcugaucucugggccucggcaagacagccgcauuggaaaacuccugggcuucgaauggacagaucuuuccucuuggagacggcugguuacgcuccugaaccgcccgaccgaccccgcuagccuugccguguuuagauuccuguuuggguuccucauggugcuggauaucccucaggagcggggacuguccagccucgaccgcaaguaccuggauggccuugacgucugcagauuuccccugcucgaugcccugcggccucuuccccuggacuggauguaucucguguacacaauuauguuccugggggcucugggaaugaugcucggccuguguuaucgcaucucuugcguucuuuuucugcucccuuacugguauguguuccugcuugauaaaaccuccuggaauaaccacagcuaccuguauggccuccuggccuuucagcugacauucauggacgcuaaucauuacuggucugucgaugggcuccugaacgcccacagacggaaugcgcaugugccgcuuuggaacuacgccguucugcgcggacagauuuuuaucguguauuucaucgcuggcgucaagaagcucgacgccgacuggguggaaggguacuccauggaguaucugagcagacacuggcuguuuucucccuucaaacuucuccuguccgaggaacugaccagccuccuggugguccauuggggaggccuucugcucgaucuguccgcuggguuccugcuuuucuuugacguuucucggagcauuggacucuuuuucguguccuacuuucacuguaugaauagccaacuguucucuaucggcauguuuuccuaugugaugcuggccagcucuccucucuucugcagccccgaguggccucgcaagcuggucuccuacugucccagacggcuucagcagcugcucccgcugaaagcggccccucagcccucugugagcugcguuuauaagagaucccgcggcaaaagcgggcaaaagccuggacugcggcaccagcuuggcgcugccuuuacacuccuguaccugcucgaacagcuguuccuucccuacucucauuuucugacccagggguauaacaauuggacgaacggacucuacggcuauuccugggauaugauggugcacagcagaucucaucaacacgucaagauuaccuaccgcgacgggcggacaggagagcugggcuaucugaaucccggcguguucacccaguccagacgcuggaaagaucacgcugacaugcuuaagcaguacgccacaugucucagccggcugcugccuaaauauaacguuaccgaaccgcaaaucuacuuugauauuuggguguccaucaaugacagauuccagcagcgcauuuucgauccccgggucgacaucgugcaggccgcuuggucuccuuuucaaagaacgagcuggguccagccccuccugauggaucuuuccccuuggcgcgcgaagcugcaggagaucaaaucuagccucgacaaccauacagaggugguuuucauugccgacuuucccgggcugcaccuggaaaauuucguguccgaggaucuuggaaacaccagcauccagcuccugcaaggcgaagucacaguggagcugguugcugaacagaagaaccagacccuccgggagggggagaaaaugcagcugccggccggagaauaccauaagguguauaccacaucuccuucccccagcugcuacauguaugucuacgugaauacgaccgagcuugcccuggaacaagaccucgcuuaucugcaggagcugaaggaaaaaguggagaacggcucugagacagggccucuucccccugaacugcagccccuccuggagggcgaaguuaagggaggcccggagccuacaccccucguccagaccuuucugagacggcaacagcgccuucaggaaauugagagacggagaaauacccccuuccacgagcgcuuuuuccgguuucugcucagaaaacuguacguguuccgcagauccuuucugaugacguguaucagccuucggaaccugauucucgggcgcccuucucuggaacaacucgcccaggaggugacauaugcgaaucugagaccguucgaagcugucggagagcuuaaccccagcaauaccgauuccagccauucuaacccucccgaguccaauccugaccccgugcacagcgaauuuuga

SEQ ID NO: 69717 - RNA, 957 nt, Artificial Sequence
  derived and/or modified sequence opt5 from GGH__Homo_sapiens__NP_003869
auggccagccccggcugccugcucugugugcuggggcuucugcucugcggagcugccucccuggagcuuucuagaccucacggcgacaccgcgaagaaaccgaucauugggauccugaugcagaagugucggaacaaagucaugaagaauuacggacgcuauuacauugcugccagcuauguuaaauaccucgaauccgccggcgcuagaguggugcccguccggcuggaucugacagagaaggacuaugaaauccucuucaagucuauuaacgggauccuguuuccuggaggcagcguggaucuucgcagauccgacuacgccaaaguugcuaagaucuucuauaaucugucuauucagagcuuugaugacggcgauuacuuccccgugugggggacgugccucggauuugaggaacugucccuucugaucagcggcgagugucuccugaccgccacagacaccgucgauguggcgaugccucugaacuucacagggggacaacuccauucucggauguuucagaauuuccccaccgagcugcuucugucccucgccguugaaccucugacagcuaacuuucacaaauggagccuuucugugaagaauuucaccaugaacgagaaacugaagaaguuuuucaauguccucacgaccaacacagacggcaaaauugaauuuaucuccaccauggagggguacaaguauccgguguacggagugcaguggcaucccgagaaagccccuuaugaauggaagaaucuggauggcauuagccacgcucccaacgccgucaaaacagcguucuaccuggccgaguucuuuguuaaugaagcucgcaagaacaaucaucacuucaaaucugaguccgaagaggagaaggcccucaucuaucaauuuagcccuauuuacaccggcaacaucuccucuuuccagcagugcuauaucuuugacuga

SEQ ID NO: 69718 - RNA, 2094 nt, Artificial Sequence
  derived and/or modified sequence opt5 from GGNBP2__Homo_sapiens__NP_079111
auggccagacugguggcugucugccgggacggcgaggaagaguuccccuuugaacgcagacagaucccucucuacauugaugacacccugacaaugguuauggaguucccggauaacgugcuuaaucuggacgggcaccaaaacaauggagcccagcucaagcaguuuauccagcggcauggcaugcugaaacaacaggaucuuagcauugcgaugguggucacgucccgcgaagugcugucugcucucagccagcugguucccuguguggggugcagacgguccgucgagcgccuguucucucagcucguggagagcggaaacccugcccuggaaccccuuaccguuggcccuaagggggugcuguccgucacaagaucuuguaugaccgacgccaaaaagcucuauacacuguuuuacgugcacggaagcaaacuuaaugauaugaucgacgcuauucccaaguccaagaaaaacaagcggugccaacugcauagccucgauacccacaaaccuaagccgcugggcggcuguuggauggacgugugggagcugaugucucaggaaugccgcgaugaggucguucucaucgacuccagcugucugcuugagacacuggaaaccuaucucagaaaacaucgguucugcacggauuguaagaauaaggugcugcgcgccuacaacauccuuauuggggagcuggacugcucuaaagaaaagggauauugugcugcccucuacgagggccugagaugcugcccccacgaacggcacauccauguguguugcgagaccgacuuuauugcgcaucugcucgggcgcgccgagccugaauuugcuggaggcagacgggagagacacgccaaaacaaucgauauugcucaggaagagguccugaccugucuugggauccaccuguaugaacgccuccaccggauuuggcagaagcugagagccgaggagcaaacauggcagaugcuuuucuaccugggaguggacgcgcuccgcaaauccuucgaaaugaccguugagaaggugcagggcaucagccggcuggaacaacugugcgaggaauuuucugaggaggaaagaguccgcgagcucaaacaggaaaagaagcggcagaaaagaaagaaucgccggaaaaacaagugugugugcgauauccccacgccucugcagacagccgacgagaaagagguuucccaagaaaaggagaccgauuucauugaaaauagcuccuguaaggcuugcggcucuacagaggacgggaacaccuguguggaagucaucgugaccaaugagaacacaagcugcacgugucccuccagcggaaaucuucugggcucuccgaaaauuaagaaagggcucuccccucauugcaacggaagcgauugcggcuacucuagcuccauggaggggucugaaaccggaagcagagagggcuccgacgucgccuguacagaaggcaucugcaaccacgaugagcauggggacgauagcugugugcaccauugcgaagacaaggaggacgauggagacucuuguguugagugcugggcuaauuccgaagagaacgauaccaaaggcaagaauaagaaaaagaaaaagaaaagcaagauucugaagugugacgaacacauccagaaacuggggucuugcaucacagaucccggaaaccgcgagaccuccggcaauacgaugcacacaguguuucaucgggacaagaccaaagauacccacccugaaagcuguugcuccucugagaaagggggccagccccuucccugguucgagcauagaaagaacgucccucaguucgccgaaccgacagagacccucuuuggacccgacagcggcaagggggccaaaucccugguggaacugcucgaugagucugaguguacaagcgacgaagagauuuucaucucccaagaugaaauucagagcuuuauggcuaauaaccagucuuucuauuccaaucgggagcaguaccgccaacaccugaaggaaaaguuuaacaaauauugcagacuuaaugaccacaagcggccuaucugcagcggauggcugacgaccgcgggcgccaacuga

SEQ ID NO: 69719 - RNA, 1959 nt, Artificial Sequence
  derived and/or modified sequence opt5 from GGN__Homo_sapiens__NP_689870
augggcaaccugcagagcgagcccuccgccgggggaggcucuagaaaggugcaaccuagcgaccgggcuccggauucccgcagaaccucucucgucgaacccgagaugacaagccaggccaugcggcugacgcgcgggcuuggaguuugguucccuggcuccgcgacacccccugggcugauggugcccagagaaccucaggcuucuccgagcacccucccccugacccuugagcggccuucccccgugaugccucccccggaagaggccgccgcugucagcgccccucccccugcucccgccggaacacugcuccccggcccuucuaaauggcagaagccggcgggcacccccgugccucgcaucagacggcugcuggaggccucccaccgcgggcaaggagaucccccuagccucagaccccugaaaccgccucccccuccccggcagcuuucuguuaaggacacagugccucgcgcucccucccaguuuccgccuccccuggaaaccuggaaacccccuccgccccucccuagcgagagacagcccgccgaccggcgcauuacgccugcucuggccacccccgcgucuccucccacagaaucccaagccggcccgagaaaucaggggcagaccgcuggacgggccagaggcggggcuccuccccaugccggagagggcgagauggcccagccugcugauagcgaauccggccuuucucugcucugcaagaucacauucaagagccgccccucccuggcgccgccugccgcuucuagcucccuggccgccaaagcuagccucgggggaggcgggggaggcgggcuguuugccgcgucuggagcuauuagcuacgccgagguccuuaagcaaggcccccugccucccggcgccgcucggccccucggggaaguguccagaggagcccaggaggcugaaggcggggacggagauggcgagggguguucuggcccuccgagcgcccccgcgucccaggcccgcgcucugccucccccucccuauaccacguucccuggaagcaaaccgaaguuugacuggguuucugcccccgauggcccugagcggcacuucagauuuaacggggcuggaggcgggaucggagcgccccgccggagagccgccgcucuuuccggcccuugggggucucccccgccuccucccgaacaaauucauagcgcccccggcccccgccggccugcuccggcccugcucgcucccccuacauucaucuuucccgccccuaccaauggagagcccaugagaccgggcccucccgggcugcaggaacugccuccccucccucccccgacaccuccucccacccugcagcccccggcgcuucagcccaccccucugcccguggccccuccccucacaccuggacugggccacaaagaguccgcucuugccccgacggccgcucccgcccugccucccgcgcucgcugccgaccaagccccugcucccagcccggccccugcgcccaccgucgcugaacccuccccucccgugucugccccugccccggcugccgcucccaucaagacacgcacccggagaaacaaggggagccgggccgcgcgcggagccacaagaaaagauggccugcauggggacggcccucgggagagagcuaccgccacggugcccgauuccucuggaggcgggggaggcgggagcggagcuucccagacaggcgccgccaauacccgcgcugcgcggcacuggcugccuuuccagguccucaacagcugccccuguaagugcuacugucaccaucagccgagacaccgcagacugccucggaauguuucugccuggcuuuccaccagcacaaaccaucugggggagcccccuuggguggcuaccauuaaacucucuggcucccugguggccaagcuggaacacuaugaccuucaagccacacacagcaauuga

SEQ ID NO: 69720 - RNA, 903 nt, Artificial Sequence
  derived and/or modified sequence opt5 from GGPS1__Homo_sapiens__NP_001032354
auggagaagacccaggaaacagugcaaagaauccugcucgagcccuacaaauaucugcuucagcugccuggcaagcagguccggacgaaacucagccaggccuucaaccacuggcugaagguuccggaagacaaacuucaaauuaucauugaggugaccgaaaugcugcauaaugcuucccuccugaucgaugacauugaggauaacucuaagcugcgcagaggguuucccguggcccacagcaucuacggaaucccuuccgucauuaauucugcgaacuauguguacuuccucggccuggagaagguucuuacacuggaccaucccgaugcugugaaacucuuuacccggcagcugcuugaacugcaccaggggcagggacucgacaucuauuggcgcgauaauuacacaugcccuaccgaggaagaguauaaggccaugguccugcagaaaacaggcgggcuguucggacucgccgugggccugaugcaacuuuuuagcgacuacaaggaggaucugaaaccccuccugaacacccuuggccuguucuuucagauuagagacgauuacgcuaaucuccauuccaaggaauauucugagaacaagagcuucugugaagaccugacggaggggaaauuuuccuucccuaccauccacgccauuuggagccggccggaaucuacacagguucaaaauauccugcgccagagaaccgagaacauugauaucaagaaauacugcgugcacuaucucgaggacgucggauccuuugaauacacacggaauacccugaaggagcuugaagcuaaagccuauaagcagaucgacgcgcgcggcgggaaccccgagcugguggcccucgugaaacaucugagcaagauguucaaggaagagaaugaguga

SEQ ID NO: 69721 - RNA, 1710 nt, Artificial Sequence
  derived and/or modified sequence opt5 from GGT1__Homo_sapiens__NP_038347
augaagaaaaagcuggugguccucggccugcuugccguugugcuggugcucgucaucguggggcugugccuuuggcugcccagcgcuuccaaagagccugacaaccacguuuacaccagagccgcgguggcugccgaugccaagcaguguucuaaaauuggacgggacgcucuccgcgauggcgggagcgccgucgacgcugccaucgcggcccugcugugcgugggacucaugaaugcucauuccaugggcauugggggaggccuguuccuuacaaucuauaacucuacgaccagaaaggccgaaguuauuaaugcucgggagguggccccgcgccuggcguuugccacaauguucaacagcuccgaacaaucucagaagggcgggcucagcgucgcugugcccggagagaucagaggcuacgaacuggcccaccagcggcaugggcgccuuccuugggcuagacuguuucagcccuccauccaacucgcccggcagggauucccugugggcaaagggcuggccgcugcgcuggagaauaagcgcaccgucauugagcagcagcccguucucugugaaguguuuugcagagaucggaaagugcugcgcgagggagaaagacuuacacugccucaacucgccgacaccuaugagacacuggcuaucgagggcgcccaggccuucuacaacggcagccuuaccgcucagauugucaaggauauccaggccgcgggaggaauugugacggcugaagaccugaauaacuaucgggccgagcucaucgaacacccgcugaauauuucucugggcgauguugugcucuacaugcccuccgccccucugagcgggcccguccuugcucugauccucaacauccugaaaggauauaauuuuucucgcgaguccguggaaagcccugagcaaaagggccuuaccuaccauagaauuguugaggccuuccgguuugcuuacgccaagagaacacugcucggggaccccaaauucguggaugucaccgaagugguccgcaacaugacaucugaguuuuucgcggcccagcugcgggcucagaucuccgacgauaccacgcacccgauuagcuauuacaagccugaauuuuauacacccgacgacggaggcaccgcccaccuguccgugguugcugaggauggcucugccgugagcgcgacauccaccaucaaucucuacuucgggagcaaagucagaucuccuguguccgggauucuguucaacaaugaaauggacgauuuuagcucucccagcaucaccaacgaguucggcguucccccuuccccggccaacuuuauccaacccgggaagcagccucuuucuagcaugugucccacaauuauggugggacaggacggccagguccgcaugguggugggggcugccggcggaacgcaaaucaccacagcuaccgcccuggccauuaucuauaaucucugguucggcuacgauguuaaacgggcugucgaggaaccuagacugcauaaccagcugcuucccaaugugacaaccguggagcgcaacauugaccaggcggucacggccgcucucgaaacacggcaccaucacacccagaucgccuccaccuuuaucgccgugguucaagcuauugugagaacagccgggggaugggcggcugccagcgauucucgcaagggcggggagccggccggauauuga

SEQ ID NO: 69722 - RNA, 678 nt, Artificial Sequence
  derived and/or modified sequence opt5 from GGT2__Homo_sapiens__XP_011528923
augaccagcgaguucuuugccgcucagcugagaucccaaaucucugaccacacaacgcaucccauuagcuacuauaagccugaguucuacaccccggaugacggcgggacagcccaccucuccguggucgcggaggauggaucugcuguuagcgccaccuccacaaucaaccuguauuuuggcucuaaagugugcagccccguguccgggauucuuuucaauaacgaauggaccacaagcgcccugccugcuuuuaccaaugaguucggagcucccccuucucccgccaacuuuauccagccuggcaagcagccgcuccuguccaugugucuuacgauuauggucgggcaggacggacaagugcggaugguugugggcgccgcgggcgggacccagaucacaaccgauacagcccuggcuaucauuuacaaucucugguucggauaugacgucaaacgcgccguggaagaacccagacugcauaacaagcugcucccuaauguuaccacgguggagcggaacaucgaucaggcugucacagccgcgcuggaaacccgccaccaucacacacagauugccagcaccuuuaucgcuguggugcaagccauugucagaaccgcuggcgggugggccgccgcuucugacucccggaaaggaggcgagcccgcgggguacuga

SEQ ID NO: 69723 - RNA, 1764 nt, Artificial Sequence
  derived and/or modified sequence opt5 from GGT5__Homo_sapiens__NP_001093251
auggccagaggcuacggggcuaccgugagccugguccuccugggacuuggccuggcccucgcgguuaucgugcuggcugugguccuuucccggcaccaggcccccugcgggccucaagccuucgcucaugccgcuguggccgcggacucuaagguuuguagcgauauuggacgcgccauccugcagcagcagggcuccccgguggacgcuacaauugccgcucucgucugcacgucugugguuaacccccaaagcauggggcugggaggcggcgugaucuuuaccauuuauaaugucacaaccgggaaaguggaggugaucaacgccagagaaacagucccugcgucccacgcccccucucugcucgaucagugugcucaggcccugccucuuggaaccggcgcucaguggaucgggguucccggagagcugcggggcuacgccgaagcccaucgcagacacgggcggcucccuugggcucaacuguuccagccgacaauugcgcuucugcgcggaggccaugugguggcccccguccucagcagauuucugcacaauuccauccugcggccuagccuccaggcuucuacccugcgccagcuuuucuuuaacggcacggagccccugagaccucaagacccccucccguggccugcccuggccaccacacuugaaaccguggcuacagaggggguugagguguucuauaccggacggcugggccagaugcucgucgaagauauugccaaggaggggucccagcugacgcugcaagaccucgcgaaauuucagcccgaagugguugaugcucuggaggugccucuuggagacuacacacuguauucucccccucccccggccggcggggccauccucagcuucauucugaauguccuucgcggauuuaacuucuccaccgagagcauggcuagacccgaaggccgggugaaugucuaccaccaucugguggagacacucaaguuugccaaaggccagcgcuggagacugggggauccucggucucaccccaagcugcagaacgcuuccagagaccuccugggagaaacccuugcccaacugauccgccagcagauugauggcagaggggaccaucagcucagccacuauucccuggcggaggccuggggacacggcaccgggacaucucauguuagcgugcugggcgaagauggauccgcugucgccgcuacgagcaccaucaauacaccuuucggcgccaugguguacucuccccggaccgggaucauucuuaacaaugagcuccuggaccugugcgagcgcuguccgcggggauccggcacaaccccuagccccgcgguuucuggggacagagugggaggcgccccugggcgcugcuggcccccuguccccggcgaacggagcccguccucuauggugccuagcauccucauuaacaaggcucaaggauccaaacuggugaucggcggggccggaggcgagcuuauuaucagcgcuguugcccaggccaucaugucuaagcuguggcucggguuugaucugagagcugcgauugccgcucccauccugcacgucaauuccaaaggauguguggaauacgagcccaacuucagccaggaagugcagcgcggccuucaagaccgggggcagaaucagacgcagagaccuuucuuucucaacgucgugcaagccguuucucaggagggcgccugcguguaugcugucuccgaucugcgcaagagcggagaggccgcgggcuacuga

SEQ ID NO: 69724 - RNA, 678 nt, Artificial Sequence
  derived and/or modified sequence opt5 from GGTLC1__Homo_sapiens__XP_005260922
augaccagcgaguucuuuuccgcccagcugagagcucaaaucucugacgauacaacgcaccccauuagcuacuauaagccugaguucuacaugccggacgauggcgggaccgcccaucucuccguggucgcggaggacggaucugcuguuagcgccacauccaccaucaaccuguauuuuggcucuaaagugcggagccccguguccgggauucuucugaauaacgaaauggaugacuucagcucuacauccaucaccaaugaguuuggagucccucccagcccugccaacuucauucagcccggcaagcagccucucucuuccaugugcccgacaaucaugguggggcaggauggacaaguucgcaugguggucggcgcugccggcgggacccagaucacgauggcuaccgcccuggcgauuaucuacaaucuuugguuuggauaugacgugaaaugggccguugaagaacccagacugcacaaccagcuccugccuaaugugacaaccgucgagcggaacauugaucaggaagugacagcugcccuggagacccgccaucaccauacgcaaaucacaagcaccuucauugcugugguccaggccaucguuagaauggcgggcgggugggccgcugccucugacucccggaagggaggcgaacccgcuggguacuga

SEQ ID NO: 69725 - RNA, 654 nt, Artificial Sequence
  derived and/or modified sequence opt5 from GH1__Homo_sapiens__NP_000506
auggccaccggcagcagaacaucccugcuccuggcuuucgggcuucugugccuccccuggcugcaggagggaucugccuuuccuacgaucccgcuuagccggcuguucgacaacgcgaugcuccgcgcucacagacugcaucaacuggccuuugauaccuaccaggaguucgaagaagccuauauucccaaggagcagaaauacuccuuucuccagaauccucaaacaucucuguguuucagcgaauccauccccaccccuucuaaccgggaggagacacagcaaaagagcaaucuugaacugcuccgcauuucccugcuucugauccagagcuggcucgagcccgugcaguuucugagaucugucuucgcuaacucccugguuuauggcgccagcgacucuaauguguacgaucuccugaaagaccuugaagaggggauucagacccugaugggacggcucgaggauggcuccccucgcacagggcagaucuuuaagcagaccuauagcaaauucgacacgaacucucacaaugaugacgcucugcuuaagaacuacggacugcucuauugcuuuagaaaggauauggacaaaguggaaaccuuccugcggaucguccaaugucgcuccguggagggcagcugcggcuuuuga

SEQ ID NO: 69726 - RNA, 654 nt, Artificial Sequence
  derived and/or modified sequence opt5 from GH2__Homo_sapiens__NP_002050
auggccgcuggcagcagaaccucccugcuccuggccuucgggcuucugugccucucuuggcugcaggagggaagcgcguuucccacaaucccucuuucccggcuguucgacaacgcuaugcuccgcgccagacggcuguaccaacuggccuaugauacguaccaggaauuugaggaggcuuauauucucaaggaacagaaauacucuuuccugcagaauccgcaaaccagccuuuguuuuuccgaaucuauccccacaccuagcaaccgcgugaagacccagcagaaauccaaucuggagcuccugagaauuagccuucugcucauccagucuuggcuggagcccguccaacugcuccgguccguuuucgccaacagccugguguauggcgcuucugacuccaauguguaccgccaccuuaaggaucuggaagaggggauucagacacucauguggagacuggaagacggaagcccucggaccggccagaucuuuaaccagucuuauuccaaauucgauacaaagagccauaaugacgaugcccuucugaagaacuacgggcuccuguacugcuuucgcaaagacauggauaaggucgagaccuuccugagaaucgugcaaugucgguccguugagggaucuugcggcuuuuga

SEQ ID NO: 69727 - RNA, 1038 nt, Artificial Sequence
  derived and/or modified sequence opt5 from GHITM__Homo_sapiens__NP_055209
augcuggccgcuagacucgugugccugcggacccuucccagccgcgucuuccacccugccuuuacaaaggcguccccgguugugaaaaacucuaucacgaagaaucaguggcugcucacccccagcagagaguacgcuacaaaaacccggauuggcauccgcagagggcggacaggacaagaacugaaggaggccgcccuugaaccuuccauggagaaaauuuucaagaucgaccagaugggccgcugguuuguggcugggggagccgcugucggccugggggcccucuguuauuacggacugggccugucuaacgaaauuggcgcgaucgagaaggccgugaucuggccccaguauguuaaagaucggauucauagcaccuacauguaucucgcuggguccaucggacugacagcccuuucugcuauugccaucagcagaaccccugugcugaugaauuucaugaugcgcggcuccugggucacgauuggggugaccuuugcggccaugguuggagcuggcaugcucgugagaagcauccccuacgaccagucuccugggccgaagcaccuggccuggcuucugcauuccggagucaugggcgcugugguggcuccccucacaauucugggcgggccucugcucauccgggccgccugguauaccgcgggaaucgucggcgggcugagcacaguugccaugugcgcucccucugagaaauuccuuaacaugggagccccucugggcguggggcucggacugguguuugucuccagccuuggcucuauguuccugcccccgaccacgguggccggcgcuacacucuacuccguugccauguacgggggacuggugcuguuuagcauguuccuccuguaugauacccaaaaggucauuaaacgcgcggaaguguccccuauguacggcguucagaaguaugaccccaucaauucuaugcuuagcauuuacauggauacacugaacaucuuuaugagaguggcuaccaugcucgccaccgggggaaaucggaagaaauga

SEQ ID NO: 69728 - RNA, 327 nt, Artificial Sequence
  derived and/or modified sequence opt5 from GHRH__Homo_sapiens__XP_011527089
augccccuguggguguucuuuuucgucauccucacgcugagcaacuccucucacugcagcccuccgcccccucuuacacugagaaugcggcgcuacgccgacgcuauuuuuaccaauuccuauagaaagguucucggccagcugucugcccggaaacuucugcaagauaucaugagccgccagcagggggaguccaaccaggaaagaggagcgcgggcucgccucggcagacaaguggacucuaugugggccgagcagaagcagauggaacuggagagcauucugguggcccuccugcagaaacauucccggaauagccaaggguga

SEQ ID NO: 69729 - RNA, 1938 nt, Artificial Sequence
  derived and/or modified sequence opt5 from GHR__Homo_sapiens__NP_001229328
augaacuggggccccaccgggauggaccuguggcagcuccugcuuacacuggcccucgcuggaagcuccgaugccuucucuggcagcgaggcgacggcugccauccuguccagagccccuuggucucuucaaagcgugaauccggggcugaagaccaacuccucuaaagaacccaaguuuacaaaaugccggagcccugagcgcgaaaccuucuccugucacuggacagacgagguccaucacggaaccaagaaucucggccccauucagcuguuuuacacaagacggaacacccaggaauggacgcaggaguggaaagagugcccugauuauguuagcgcuggggaaaauucuuguuacuucaacuccagcuuuaccucuaucuggauucccuauugcaucaagcugacauccaauggaggcaccguggacgagaaguguuucagcguggaugaaauuguccaaccugacccgcccaucgcccucaacuggacacugcuuaaugugucucugaccggcauccaugcugauauucagguucgcugggaggccccuagaaacgcggacauccagaaaggguggauggugcucgaguacgaacugcaguauaaggaggucaaugaaacgaaauggaagaugauggaucccauucuuacaaccuccgugccuguuuacagccugaaaguggacaaggaguaugaaguccgggugcgcuccaagcaaagaaacucuggaaauuacggcgaguuuagcgaggugcucuacgucacacugccccagaugucccaguuuaccugcgaagaggauuucuauuucccguggcugcucaucauuaucuuugggauuuucggacugaccguuaugcuuuuuguguuccuguucagcaaacagcaacggaucaagaugcucauccugccucccgugccuguccccaaaauuaagggcaucgaccccgaucuucugaaagaagggaagcucgaggaagugaacacaauucuggccauccacgacucuuacaaaccugaguuucauuccgacgauagcuggguugaguucauugaacuggacaucgaugagccggacgaaaagacggaggaaucugauaccgaccgccuccugagcuccgaucacgagaagucucacagcaaucuuggagugaaagacggcgauuccggcagaacaagcuguugcgagcccgacauccuggaaaccgauuuuaacgcuaacgacauucaugaggggacaucugaagucgcccagccucagcggcucaagggagaggcugaccugcuuugucuggaucagaaaaaucaaaacaauucccccuaucacgacgccugcccugcgacccagcagcccagcgugauccaagccgagaagaacaaaccgcagccucuccccacggaaggcgcugagucuacacaucaggccgcucacauucagcuguccaauccuagcucccugucuaacaucgauuucuacgcccaaguuagcgacauuacccccgccggguccgugguccucucuccuggacagaagaauaaggcuggcaugagccagugugauaugcaccccgaaauggugucccugugccaggagaacuuucuuauggacaaugcguauuucugcgaagccgaugcuaaaaaguguaucccggucgccccucauaucaaaguggagagccacauucaacccucucugaaccaggaggacaucuacauuaccacagaaucccucaccacagccgcugggcgccccggaacgggcgagcauguuccuggcagcgaaaugccggugcccgauuauaccucuauccacauuguccaguccccucaggggcugauccugaaugccacagcgcuuccccucccugacaaggaguuucugagcucuugcggauacgugagcaccgaucaacugaacaaaauuaugcccuga

SEQ ID NO: 69730 - RNA, 1272 nt, Artificial Sequence
  derived and/or modified sequence opt5 from GHRHR__Homo_sapiens__NP_000814
auggacagacggauguggggcgcccacguguucugcguccugagcccccucccuaccguucuggggcauaugcacccggagugugauuuuaucacacagcuucgcgaagacgaguccgcuugccugcaagccgcggaagagaugcccaacacgacccucggauguccugcuacaugggauggccugcuuugcuggcccaccgccgggucuggagaaugggugacacugccuugucccgacuucuuuagccauuucuccucugagagcggcgccgugaagagagauugcaccauuacagggugguccgagccuuuuccgcccuacccugucgcuugucccgugccucucgaacugcuggccgaggaagagucuuauuucagcaccguuaaaaucauuuacacggugggacacuccaucagcauugucgcucucuuuguggccaucaccauccugguugcgcuucggcgccugcauugccccagaaauuaugugcacacacagcuuuucaccacauuuauucugaaggccggcgcugucuuccuuaaagacgccgcucuguuucacucugaugacaccgaucauuguuccuucagcacggugcucugcaaggugucugucgccgcgucccacuuugccacaaugaccaacuucagcuggcugcuggcugaggccguuuaccucaauugucugcuugcuucuacauccccgagcucccggcgcgccuucugguggcuggugcucgccggcugggggcugccugugcuuuuuaccggaaccugggucucuugcaaacuggcuuucgaagacaucgcgugcugggaucucgacgauacaagccccuauugguggauuaucaagggcccuauugugcuguccguuggggugaacuuuggacuguuccucaauaucauuagaauccugguccggaagcucgagcccgcccagggcagccugcauacgcagucucaauacuggcgccucuccaaaagcacccuguuucuuaucccccuguucgggauucacuauaucauuuuuaacuuccucccugacaaugcuggacugggcaucagacugccgcucgaacugggccuugggucuuuucagggauucauuguggccauccuguacuguuuucucaaccaggagguucggacagaaaucagccgcaaguggcacggccaugaccccgagcugcugccugccuggagaacccgggcuaaauggacaacccccucccgcucugccgcgaaggugcuuacgagcaugugcuga

SEQ ID NO: 69731 - RNA, 318 nt, Artificial Sequence
  derived and/or modified sequence opt5 from GHRL__Homo_sapiens__NP_001128416
auguuuaccugcugguggagcuaccugagauccacacucgccgcugugcccggcgaggccucucggguccagcaacgcaaggaaagcaaaaagccuccggcgaaacugcagcccagagcucuugccggguggcugcggccugaggacggaggccaggccgaaggggcugaggaugaacucgagguucgcuucaacgcccccuucgacgugggaaucaagcuguccggcgugcaguaucaacagcacucucaggcucuugggaaauuucugcaggauauucucugggaggaagccaaggaggcgccugccgacaaguga

SEQ ID NO: 69732 - RNA, 870 nt, Artificial Sequence
  derived and/or modified sequence opt5 from GHSR__Homo_sapiens__NP_004113
auguggaacgccacccccagcgaggaaccuggcuucaaucugacacucgcugaccuggauugggacgccuccccggggaacgauucucuuggagacgagcugcuccagcuguuucccgcgccucuucuggcuggcgugacggcuaccugcgucgcccucuucguuguggggaucgccggaaaucugcugacaaugcucguggucagcagauuucgggaacugcgcaccacaaccaaccuuuaccuguccucuauggccuucagcgaucuccugauuuuucuuuguaugccccuggaccucgugagacuguggcaauaucggccuuggaauuucggcgaucugcucugcaagcuguuucaguucguuuccgagucuuguacauacgcuaccgugcuuacgaucaccgcccugagcgucgaacgcuauuuugcgauuugcuucccccucagagccaaagugguugugacaaaggggcgggucaaacuggugaucuuugugauuugggcugucgccuucuguuccgcuggaccuaucuuuguucuugugggcguggagcacgagaacggcaccgacccgugggauacaaaugaaugccgccccaccgaguucgccgucagaagcgggcugcucacggugaugguuugggugucuuccaucuucuuuuuccugccugucuuuugucugacagugcucuacagccugauuggacggaaacuuuggcgcagacggcgcggcgacgcgguugugggggccucucugagagaucagaaccauaagcagaccgucaagaugcucggaggcucccaacgggcucugcgccuuagccuggccgggcccauccucucucugugccugcucccuucccuguga

SEQ ID NO: 69733 - RNA, 687 nt, Artificial Sequence
  derived and/or modified sequence opt5 from GID8__Homo_sapiens__NP_060366
augagcuacgccgagaagcccgacgaaaucaccaaagaugaguggauggaaaagcugaacaaucuccacgugcagagagcugacaugaaccggcugauuaugaauuaucuugucacagagggcuucaaagaagccgcggagaaguuucgcauggaguccgggaucgaaccuucuguugaucuggagacgcucgacgaaagaauuaaaauccgggagaugauucugaagggacaaauccaggaggcuaucgcccuuauuaacagccugcauccggaacuccuggauaccaaucgcuaccuguauuuccaccuccagcagcaacaucugaucgagcuuauuagacagcgggaaacagaggccgcucuggaauuugcccagacccagcucgcugagcaaggcgaggaaucccgcgagugccugacagaaauggagagaacccuugcccugcucgcguucgacucucccgaagagagcccuuuuggggaucugcugcacacaaugcagcggcagaaggugugguccgaggugaaccaggccguccucgacuacgaaaaucgcgagucuacccccaaacuggcuaaacuucugaagcuccugcuuugggcccaaaacgaacuggaucagaagaaagugaaguauccuaagaugacggaccucagcaaaggaguuaucgaggaacccaaguga

SEQ ID NO: 69734 - RNA, 1254 nt, Artificial Sequence
  derived and/or modified sequence opt5 from GIF__Homo_sapiens__NP_005133
auggccugguucgcucuguaccuccugagccuucugugggccaccgcgggcacauccacgcagacccaaucuagcugcuccgugcccucugcucaggagccucucgucaacgggauccagguucugauggaaaauagcgugacauccucugccuauccgaaccccagcauucuuaucgccaugaaucuggcuggagccuacaaccucaaggcucagaaacugcugaccuaucaacucauguccagcgacaauaacgaucugacaauuggccagcuugggcugaccaucauggcccucacaucuuccuguagagacccuggagauaaggugagcauucugcagcggcagauggagaauugggcgcccucuuccccuaacgccgaagcuagcgccuuuuacggccccucucuugcuauccuggcccucugccagaaaaauuccgaggcgacccugccuaucgccguccgcuucgcuaagacgcugcucgccaacagcuccccguuuaauguggacaccggggcuauggccacacuggcccuuaccuguauguauaacaaaauucccguuggaucugaagagggcuacagaagccuguucggccaggugcucaaggauaucgucgagaagauuuccaugaaaaucaaggacaaugggauuaucggagauauuuauagcacaggccuggcuaugcaggcgcuuucugugaccccugaacccuccaaaaaggaguggaacugcaaaaagacgacagacaugauccugaaugaaaucaagcaggggaaauuucacaacccuaugagcauugcccaaauccuccccucucugaagggaaaaaccuaccuggauguuccgcaagugacauguagcccugaccaugagguccagcccacccucccuuccaaccccggccccgggccuaccucugcuagcaauauuacagugaucuacacgauuaacaaucaacugcggggaguggagcuucuguucaacgaaaccaucaaugucuccguuaagagcggcucugugcuccuggugguccuugaggaagcccagcgcaaaaacccgauguuuaaguucgagacaaccaugacauccuggggccuggugguuagcucuaucaauaacauugccgaaaaugugaaccacaaaaccuauuggcaguuucucuccggggucacgccccugaaugagggaguggcugauuacaucccuuucaaccaugagcacauuacagccaauuuuacccaguauuga

SEQ ID NO: 69735 - RNA, 3108 nt, Artificial Sequence
  derived and/or modified sequence opt5 from GIGYF1__Homo_sapiens__XP_005250589
auggccgcugagacccugaacuucggccccgaauggcucagagcccugagcgggggaggcuccguggcgucuccuccgcccagcccugcuaugcccaaguacaaacuugccgacuaucgguacgggcgcgaggaaaugcuggcccucuaugucaaggagaauaaaguuccugaagaacugcaggauaaggaguuugcugccgugcuucaagacgaaccccugcagccucucgcucuggagccgcugacagaagaggagcagagaaacuucucccucucugugaauagcgucgccgugcugcggcuuaugggaaaaggcgcggggcccccucuggccggaacgucccgcggcagaggcucuacccggagccgcgggagaggacggggcgauuccugcuuuuaccagcgcagcaucgaagagggggacggagcuuucggcagaucuccccgggaaauucaacgcucccagagcugggaugacagaggggagcggcgcuuugaaaagucugccagacgggauggagcuagauguggcuucgaggagggcggggccggaccucgcaaggaacacgcgcgguccgacagcgagaacuggagaucucuccgcgaagaacaggaagaggaggaagagggcuccuggcggcugggggccggacccagacgcgauggcgaccgguggagaagcgcuuccccggaugggggaccucgcucugccggcuggcgggaacauggcgagagacgccggaaauuugaguucgaccuuagaggggaucggggaggcugcggggaggaggaaggacgcggcgggggcggaagcucccaccugagacgguguagagcucccgagggcuuugaagaggacaaggacgggcucccugaguggugccuggaugacgaagaugaggaaaugggaacauucgacgccagcggcgccuuucugccccucaaaaaggggcccaaagagccuaucccggaggagcaggagcuggauuuccaaggacuugaagaggaagaggaacccucugagggccuggaggaagaggggccugaagcuggcggaaaggagcucacaccccugccuccccaggaagagaaguccagcucuccgagcccucuucccacccugggcccucucugggggaccaauggagacggcgaugagacagcggaaaaagagcccccugccgcugaagacgauauucgcgggauccagcugucccccggaguuggcucuagcgccgggccgccuggcgaccuggaggaugacgagggacucaagcaucugcagcaagaagccgagaaacuuguggcuucccugcaggacagcucucucgaagaggaacaguuuaccgccgcgaugcaaacgcagggccugcggcacuccgcugccgccaccgcccuuccccugagccauggggcugcuagaaagugguucuauaaagauccccagggagagauucagggcccuuucacaacccaagagauggccgaaugguuucaggcgggguacuucucuaugucccuccuggucaagcgcggaugugacgagggcuuucagccgcugggggaagugaucaaaauguggggcagaguucccuucgccccuggacccagcccucccccucuccugggcaacauggaucaggagcggcuuaagaagcaacaggaacuggcugccgcugcccucuaucagcagcugcaacaccagcaguuucugcagcuuguguccucucgccaacucccccagugcgcgcugagagagaaagccgcucugggggaccucacaccgccucccccucccccgccucagcaacagcagcagcaacugaccgccuuccuucagcagcugcaggcucucaagcccccucggggaggcgaucaaaaucugcugcccacgaugagccgcucccuuucuguccccgacagcgggagacucugggaugugcacacauccgccagcucucaguccggaggcgaggccagccugugggacaucccuauuaacucuuccacccagggcccgauccuggaacagcuccaacugcagcauaaauuucaggagcggcgcgaaguggagcuuagagcuaagcgggaagaggaggaacgcaaaagacgggaggaaaagagacgccaacagcagcaggaggagcaaaagcggagacaggaagaggaggaacuguuccgccggaaacacgucagacagcaggaacuccugcugaagcugcuccaacagcagcaggcgguucccgugccucccgccccuagcucucccccuccgcugugggcugggcuggccaaacaaggacucagcaugaagacacugcuugagcugcagcucgagggcgaacgccagcugcauaaacagcccccuccccgggagccugccagagcucaagcccccaaucaccgcgugcagcuugggggacuuggcaccgcgccgcucaaccagugggucuccgaagcugggccucuguggggaggccccgauaagagcggcgggggaucuuccggccuggggcucugggaggacacccccaagagcggaggcucccuggugcgggggcuuggacugaaaaauucuagaagcuccccuucucucagcgauuccuacucucaccugagcggccggcccauucgcaagaaaacagaagaggaggaaaagcugcuuaaacugcuccaaggcaucccuagaccgcaggacggguuuacgcaguggugugagcagaugcugcauacccucuccgccacaggaagccuggauguucccauggccguggcuauucuuaaggaagucgagucuccuuacgacgugcacgacuauauccgguccugccugggcgauacccucgaagccaaggaguucgcgaaacaauuucuggagcgcagagcuaagcagaaagccagccagcagcggcaacagcagcaggaagccuggcugucuuccgcuagccuucaaacagccuuccaggcuaaccauucuaccaagcuggggcccggagagggcuccaaagccaagagacgcgcgcucaugcugcacagcgacccuuccauucucggguacagccugcauggaucuagcggcgaaaucgaguccguugaugacuauuga

SEQ ID NO: 69736 - RNA, 3900 nt, Artificial Sequence
  derived and/or modified sequence opt5 from GIGYF2__Homo_sapiens__NP_001096616
auggccgcugagacccagacacugaacuucggccccgaauggcucagagcccugagcuccgggggaucuaucacgagcccuccgcuuucccccgcgcugccuaaguacaaacucgcugacuaucgguacggccgcgaggaaaugcuggcccuuuuucugaaggauaauaaaauucccucugaccuccuggauaaggaguuccugccuauccuccaagaagaaccccugccuccgcuugcccuggugcccuuuaccgaggaggagcagagaaacuucagcauguccgucaauucugcugccguucuccggcugacagggcgcggaggcgggggaaccguggugggcgcuccuagaggccggagcuccagccgcgggagaggacggggccgcggggaaugcggauuuuaucagagaucuuucgacgaggucgagggcguguuugggcggggaggcggccgcgaaaugcacagaucccagagcugggaggaacggggagaucgcagauucgagaaacccggacggaaggacguuggcagaccuaacuuugaagaagggggacccacaucugugggccgcaagcaugaguucauucgguccgaaagcgagaauuggagaaucuuucgcgaggagcaaaacggggaagaugaggacggaggcuggcggcuugccggcucuagacgcgauggggagcgguggagaccgcacuccccugacggaccccgcagcgcgggcuggcgggaacauauggagagacgccggagauucgaauuugauuuccgggaccgcgaugacgagagaggguaccggagaguccgcuccggaucuggcagcauugacgaugaccgggauucccugccugaauggugucucgaggacgccgaggaagagauggggaccuucgauagcucuggcgcuuuucugucccugaaaaaggugcagaaagaacccauccccgaggagcaggaaauggacuucagaccuguugaugagggagaagagugcagcgacucugaaggcagccacaaugaggaggccaaggaaccggauaaaacaaacaagaaggagggggaaaagaccgaccgcgugggagucgaggcuuccgaagagacgccccagaccucuagcuccagcgccagaccuggcacacccucugaucaucaaucccaggaggcgagccaguuugaacggaaggacgagccuaaaaccgaacagacagagaaggccgaagaggagacccgcauggaaaauucucuccccgcuaaagugccguccagaggggacgagaugguggccgauguccaacagccucugagccagauccccuccgacacggcuucuccucuucugauucuucccccucccguuccgaacccuagccccacacugcggcccguggaaaccccuguggucggagccccgggcaugggguccgugucuacagagcccgaugacgaggaaggccuuaagcaccuggagcaacaggccgagaaaaugguugcuuaucuccaggauagcgcgcuggacgaugaacgccuggccuccaagcuccaggaacacagagcuaagggagugagcaucccucugaugcaugaggccaugcaaaaaugguacuauaaggacccccagggcgagauucaggggccuuucaauaaccaggaaauggccgagugguuucaagcuggauacuucaccaugucucuucuggucaaacgggccugugaugaauccuuucagccccucggcgacaucaugaagaugugggggcgcgugccuuucagccccggaccggcgccucccccucacaugggcgagcuggaucaggaaagacuuacccggcagcaagagcugacagcucucuaccagaugcagcaucugcaguaucaacaguuucugauucagcaacaguacgcccagguucucgcccagcaacagaaagcugcccugucuucccagcagcaacagcagcuugcucugcuccugcagcaauuccagacgcugaagaugcgcaucagcgaccagaauauuauccccucugugaccagaagcgucuccgugccggauacagggagcaucugggagcuucaaccuaccgccucucagcccacagucugggaaggcggauccgugugggaccucccucuggacaccacgacacccggccccgcgcuggagcagcuccagcaacuggaaaaggccaaagcugccaaacuugagcaggaacggagagaggcugagaugcgcgccaaacgggaagaggaagagagaaagcgccaggaggaacugcggagacagcaagaggaaauucuccgccggcagcaggaggaagagagaaaacgccgggaggaagaggaacuggcgagacggaagcaggaggaagcccugcgcagacaacgggagcaggagaucgcucuccgcagacagcgggaagaggaagagagacagcaacaggaagaggcccuccgccggcuggaggaaagacgccgggaggaagaggagagacgcaagcaggaggaacugcuccggaaacaagaagaggaagcugccaagugggccagagaggaggaagaggcucagcgcagacuggaagagaaccggcuucgcauggaagaggaggcggccagacugcggcacgaagaggaggaacgcaaaagaaaggaacucgagguucagcggcagaaagagcugaugagacaacgccagcagcagcaagaagcucugcggagacuucagcagcagcaacagcagcaacagcucgcccagaugaagcugccuagcuccucuaccugggggcagcaaagcaauaccacagccugccagucccaggcuacccugucucucgccgagauucagaagcuggaagaggagcgcgaacggcaacuuagagaggaacagcggcgccagcagagagagcugaugaaagcgcuccaacagcagcagcaacagcagcaacagaagcugagcggauggggcaacguguccaaaccgucugggacaaccaagagccugcuugaaauccagcaggaggaggcucggcaaaugcagaaacagcagcaacagcagcagcaacaccagcagcccaaccgcgccagaaauaacacgcauuccaaucuccacacaagcauuggaaacucugucuggggcuccaucaauaccgggccucccaaccaaugggccagcgaucuggugucuuccaucuggagcaaugcugacacaaagaacucuaauaugggcuuuugggaugacgccguuaaagaagugggaccucggaacuccaccaauaagaacaagaauaacgcgagccuguccaaaagcgucggcgugucuaaucgccagaacaagaaaguggaggaagaggaaaagcuccugaaacuuuuccaggggguuaacaaggcucaggauggauuuacgcaauggugugagcagaugcugcaugcccucaauaccgccaacaaucuggacguccccacauucgugagcuuccugaaggagguggaauccccuuaugagguccacgauuacauuagagcuuaucuuggcgacaccucugaagccaaagaguuugcuaagcaguuccuggaacggcgcgccaaacagaaggcgaaccaacagagacagcagcaacagcucccgcagcaacagcagcagcaacccccucagcagcccccucagcaaccccagcagcaggauagcgugugggggaugaaucauuccacacugcacucuguuuuucaaaccaaccagagcaauaaccagcaguccaauuucgaggccgugcaaucugggaaaaagaagaaaaagcagaaaaugguccgggcugacccgagccuccugggcuuuuccgugaacgccagcucugagagacuuaauaugggcgaaaucgagacgcuggaugacuacuga

SEQ ID NO: 69737 - RNA, 924 nt, Artificial Sequence
  derived and/or modified sequence opt5 from GIMAP5__Homo_sapiens__NP_060854
augggcggguuccagagaggaaaguacggcaccauggccgaggggcggagcgaagacaaccuguccgcuacacccccugcccuccgcaucauucuggugggaaaaacgggcugcgggaagucugcgaccggaaauagcauccuuggccagccggucuuugaguccaaacugagagcucagucuguuacacggaccugucaggugaagacaggcaccuggaacgggcgcaaagugcucgucguggauacacccagcauuuucgaaucccaggccgacacccaagagcuguauaagaauaucggagauugcuaccuucugucugccccuggcccccacguucuccugcuggugauucagcucgggagauuuacggcucaggacaccgucgccauccggaaggugaaagaaguuuucggaacaggcgcuaugcgccauguggucauccuguuuacccacaaggaggaucuugggggacaggcccuggacgauuauguggcgaacacagacaauuguagccucaaagaucuggugagagagugcgaacggcgcuacugugccuucaacaauuggggcuccgucgaggaacaaagacagcagcaggcugagcuucuggccguuauugagcggcucggccgcgaaagagaggggagcuuucauucuaacgaccuguuccuggaugcucaacuccugcagcggaccggagccggcgcgugccaggaagacuaucgccaauaccaggccaagguggaguggcaaguggaaaaacacaagcaggagcuuagagagaaugaauccaacugggcuuauaaggcccugcuccgggucaaacaucugaugcuucugcacuacgagaucuuuguguuccuccugcuguguagcauucucuuuuucaucauuuuucuguucaucuuccacuacauuuga

SEQ ID NO: 69738 - RNA, 903 nt, Artificial Sequence
  derived and/or modified sequence opt5 from GIMAP7__Homo_sapiens__NP_694968
auggccgagagcgaagacagaucccugcggaucgugcucgucggcaagaccgggucuggaaaaagcgcuacagccaacacgauucugggcgaggaaaucuucgauucccgcauugcggcucaggccguuaccaagaauugccaaaaagccucuagagaguggcaggggcgggaccuucuggugguggauacacccggacucuuugacaccaaggaaagccuggauacaaccuguaaagagaucucccgcugcauuaucucuagcuguccuggcccgcacgcuaucguccuugugcugcuccuggggagauacacagaggaagaacagaagaccguugcccugauuaaggcuguguucggaaaauccgccaugaagcauauggucauccucuuuacgcggaaagaggagcuggagggccagagcuuccacgacuuuauugcggaugccgacgugggccuuaagucuaucguuaaagaaugcgggaaccgcuguugcgcuuucuccaauagcaagaagaccucuaaagccgagaaggaaucccaagugcaggagcuggucgaacucauugagaaaauggugcaguguaacgagggagcuuauuuuagcgaugacaucuacaaggauacagaagagagacugaaacagcgggaagaggugcuucgcaagauuuauaccgaccaacugaaugaagagaucaaacucgucgaggaagauaagcauaagucugaggaagagaaagaaaaggagaucaaacugcugaagcucaaauacgacgagaagauuaagaacaucagagaagaggccgaacggaauauuuucaaagacguuuuuaaccgcaucuggaagaugcuguccgagauuuggcacagauuccuuagcaaaugcaaguuuuauuccucuuga

SEQ ID NO: 69739 - RNA, 1998 nt, Artificial Sequence
  derived and/or modified sequence opt5 from GIMAP8__Homo_sapiens__XP_005250007
augagcgagcaguccugccaaaugucugaacugagacuccugcuucugggcaagugucggagcgggaaauccgccaccggaaacgcuauccucggcaagcacguguucaaaucuaaguuuagcgaccagacagucauuaaaaugugccagcgcgaguccuggguucugagagaacggaaggugguggucaucgauacgcccgaccuuuucucuagcauugccugugcggaggauaagcagcgcaauauccaacauugccuggaacucuccgcuccuagccugcacgcccugcuccuggugauugccaucgggcauuuuaccagagaggacgaggaaacagcuaaaggaauccagcagguuuucggcgccgaggcucggcgccacauuaucauuguguuuaccagaaaggaugaccuuggggaugaccugcuccaggauuucaucgagaaaaacaagccgcugaaacaacuuguccaggacuacgagggacgguauuguauuuuuaauaacaagacaaauucuaaggaugagcagaucacccaggugcuggaacuccugcgcaaaguugagucccuggugaacacaaauggcggccccuaccaugucaacuucaagaccgaagggagcagauuucaagacugcgugaaugaggccgcgucucaggaaggagauaaaccucagggcccccgggagcgccaacuccaguccacggggccugagcagaaccccggaaccagcgaacugacagugcuucuggucggcaagagaggggccggaaaaucugcugccggcaauuccauucucggccggcaggcuuuccaaaccggguuuagcgagcaguccguuacacagucuuuccugagcgaaucccgcagcuggagaaagaaaaaggugucuaucaucgacgccccugacauuuccagccuuaagaacaucgauucugaggugcggaaacacauuuguaccggaccgcacgcguuucugcucgucacgccccugggcuucuauacaaagaaugacgaagccgugcugagcaccauccagaacaauuucggggagaaauuuuucgaguacaugauuauccuccugacaagaaaggaagaucuuggagaccaagaucuggacaccuuucuccgcaacuccaacaaagcucuguauggccuuauccagaagugcaagaaucgguacucugccuucaacuauagagcuaccggggaggaagaacagcgccaggccgaugaacugcucgagaaaauugagagcaugguucaucaaaauggaaacaagcacuguguguuucgggaaaaagagacacugaauaucguccuggugggcagauccggcacgggaaagagcgccaccgggaacucuauucucggcucccugguuuucacaagccgccuucgggcucagccugugaccaaaacaucucaguccgggagacgcaccugggacggacaggaagucguggucguggauacgcccagcuuuaaucaaaugcuggacguugagaaggauccuucccggcucgaggaagaggugaagagaugccugucuuguugcgaaaaaggcgacacauucuuuguccugguguuccagcuugggcgcuuuaccgaggaagacaagaccgcgguugccaaacucgaggcuaucuucggcgccgauuuuacaaaguacgccauuaugcuguucacccggaaagaggaccugggagcuggcaaccucgaagauuucaugaagaauagcgacaacaaggcccugagacggaucuuuaaaaagugcgggcgcagagugugugcguucaauaacaaagagacaggacaggcucaagaaacgcaggucaaggcccuucugaccaaagugaaugaucuccggaaggaguccggcuggucuggguacccccauacacaggaaaacgugagcaaacugaucaagaauguucaggagaugucccaagccgagaagcugcuuaaaaaccucauuggaauccugcaguga

SEQ ID NO: 69740 - RNA, 1569 nt, Artificial Sequence
  derived and/or modified sequence opt5 from GIN1__Homo_sapiens__NP_060146
auggugagaagcggcaagaacggggaccugcaccucaaacagaucgccuacuauaagcggaccggagaguaccauuccacaacgcugcccucugaacgcagcggcauuagacgggcugccaaaaaguucgucuuuaaagagaagaaacuuuucuauguugggaaagaucgcaagcaaaauagacuggugaucguguccgaagaggaaaagaagaaaguccuccgggagugccacgagaacgacucuggagcgcaucacggcauuagccgcacccugacacuuguggaauccaauuacuauuggaccucuguuacaaacgaugugaagcagugggucuacgcuugucagcauugccagguggccaagaauaccguuaucguggccccuaaacaacaucugcucaaggucgagaacccguggagccuggugacaguggaccugauggggcccuuucacaccuccaauagaagccacgucuaugcuauuaucaugacggaucucuucaccaaauggaucguuauucugccucuuugugacgugucugccuccgaagugagcaaggcuaucauuaacaucuuuuuccuguacggacccccucagaaaauuaucauggaucagcgggacgaguuuauucagcaaaucaauaucgagcucuaccgccuguucggcauuaagcagaucgucauuucucacacauccggcaccgugaaccccacagaaagcaccccuaauacgaucaaagccuuucuuucuaagcauugcgcggaucacccgaacaauugggacgaucaccuguccgccguuagcuucgcuuuuaacgugacacaucucgagcccaccaagaauacaccuuauuuccagauguuuuccagaaaccccuacaugccugaaaccucugacagccugcacgaggucgauggggacaacaccuccauguucgccaaaauucuggacgcuaucaaggaagccgauaaaaucauggagaauaagacaacgagccucggacagauggagaacaauaaccuggacgaacuuaauaaaucuaagauuaucgugaagaaaaagcccaaacaacugaacccguuccaucucaagguuggccacgaggugcugcggcagcgcaaaaauugguggaaggaugggagauuucaguccgaaugggucggaccuugugugauugacuauaucaccgagagcggcugcgcgguccuucgggauaacacaggggugcgccugaagagacccauuaaaaugucucaucucaagccuuacauccgggaaagcuccgagcaagagucucuguaucugcuccagggaagcguuguggccgaccacgauuacaucggccugcccgaaauucccaucggcgcuuaucaggccaauauucuugucgaggacgcuaccaucgggauuguggauaacgaacugcucacauccagcaaagacagagagcugcuugaauaccgcaauaccaagaucucuccucugauugaugaccacuccagccucgagaaacagacguucucucugcuggacuccagcaaccaaguucucgaguaccuguccuga

SEQ ID NO: 69741 - RNA, 591 nt, Artificial Sequence
  derived and/or modified sequence opt5 from GINS1__Homo_sapiens__NP_066545
auguucugcgagaaggccauggaacugaucagagagcuccaccgggcucccgaaggccagcugccugccuuuaacgaggacgggcuucgccaagugcuggaagagaugaaagcgcucuacgagcagaaucagagcgaugucaacgaagcuaaguccggaggcagaucugaccugauuccgaccaucaaauuccggcauuguagccuucugcgcaauagacggugcacaguugccuaucucuacgaucgccugcugcggauuagagcccuccgcugggaguauggguccgugcugcccaacgcucuuagauuucacauggccgcugaagagauggagugguucaauaacuacaagcggucucuggccacguauaugcgcagccucggaggcgacgaagggcuggauaucacccaggacaugaaaccucccaagucccuuuacauugaggugagaugucugaaggauuauggagaauuugaggucgacgauggcacaucugugcuccugaaaaagaauagccaacauuuccugccucgguggaaaugcgaacagcucauccgccagggcguucuggagcacauccuuuccuga

SEQ ID NO: 69742 - RNA, 558 nt, Artificial Sequence
  derived and/or modified sequence opt5 from GINS2__Homo_sapiens__NP_057179
auggacgccgcugagguggaguuccuggccgaaaaggaacucgucaccaucauucccaacuuuagccuggauaaaaucuaccuuauuggcggggaccugggaccuuucaauccgggccuccccguugaggugccucuguggcuugcgaucaaccugaagcagagacaaaaaugccggcuccugcccccugaauggauggauguggagaagcuggagaaaaugcgcgaccacgaaagaaaggaggaaacauuuacgcccaugccuuccccguauuacauggagcucaccaagcugcuucugaaucaugcuucugauaacauucccaaagccgacgagauccggacacucgucaaggauaugugggacacccgcaucgccaaacugagagugagcgcugauuccuucguucggcagcaggaagcccacgcuaaacuugacaaucugacacucauggagauuaacaccucugggacauuucugacccaggcccugaaucauauguauaagcuccgcacgaaccugcaaccucuugaaagcacccagucccaggauuucuga

SEQ ID NO: 69743 - RNA, 1002 nt, Artificial Sequence
  derived and/or modified sequence opt5 from GIPC1__Homo_sapiens__NP_005707
augccccugggccucgggagacggaagaaagccccuccgcugguggagaacgaagaggcugaacccggacgcggcgggcuuggagucggcgagccugggccccugggaggcggcgggagcggaggcccucagauggggcugcccccuccgcccccugcccucagaccccggcuuguuuuccacacccaacuggcgcauggauccccuacaggccgcaucgaaggguuuacgaaugugaaggagcucuacggaaaaauugcugaggccuucagacugcccaccgccgaagugauguuuugcacacugaacacccacaaggucgacauggauaaacuccugggcggccagaucgggcuugaggacuucauuuuugcucaugugaagggacagcggaaggaaguugagguguucaaaucugaggaugcccugggccucacaaucaccgacaauggggcuggauaugccuuuauuaagcgcaucaaagaaggcagcgucaucgaucacauucaucugaucuccgugggggacaugauugaggcgaucaacggacagucucuucugggcuguagacacuacgaaguugcccggcuccugaaggagcugccgcgcggcagaacauucacccucaaacugacggaaccucggaaggcuuuugauaugauuagccaacgcuccgccgggggaagacccggcucugggccucagcuuggaaccggccgggggacacugcgccucagaagccggggccccgcuaccguggaggaccugcccuccgccuucgaggaaaaggcgaucgagaaagucgaugaccuucuggaaagcuauaugggaauuagagauacagagcucgccgcuaccaugguggaacugggcaaggacaaacgcaauccugaugagcuggccgaggcucucgacgaacggcugggggacuuugccuucccggaugaguuuguguucgacgucuggggagccaucggcgaugcuaagguugggagauacuga

SEQ ID NO: 69744 - RNA, 939 nt, Artificial Sequence
  derived and/or modified sequence opt5 from GIPC3__Homo_sapiens__NP_573568
auggaaggcgccgcugccagagaagcgcgggggaccgagacaccccgcgcuagcgccccuccgcccgccccuuccgaacccccugcugcccccagagcucggccucgccugguguucagaacgcagcucgcccacggaucuccgaccggcaagaucgagggguuuacaaacguccgggaacuguacgcgaaaauugccgaggcuuucggaaucgcccccaccgagauucuuuucugcacacugaauagccauaagguugacaugcaaaaacuccugggcgggcagaucggacuugaagauuucauuuuugcucacgugcgcggcgagaccaaggaaguggaggucacaaaaaccgaggacgcccugggccucacgaucaccgauaacggggcgggauaugccuucaucaagagaauuaaggaaggcuccaucauuaaucggaucgaggcuguguguguuggggacucuauugaagccaucaacgaucauagcauugugggaugccgccacuacgaggucgcuaaaaugcugagagaacugccuaagucccagcccuuuacacuccggcuggugcagccuaaacgcgccuucgacaugaucggccaaagaucucggagcuccaagugucccguugaggccaaagugaccagcgggcgcgagacacuuagacugcggucuggaggcgcugcgaccgucgaagaggccccguccgaauuugaggaagaggcuagcagaaagguggaugaccuccuggagucuuauaugggcauccgcgauccugaacuugccuccacgaugguggagacaagcaagaaaaccgccucugcucaggaauuugcccggugccuggacuccguccucggggaguuugcguuccccgaugaauuuguuguggaggugugggcugccauuggagaggccagagaggcuuguggcuga

SEQ ID NO: 69745 - RNA, 462 nt, Artificial Sequence
  derived and/or modified sequence opt5 from GIP__Homo_sapiens__NP_004114
augguggccaccaagacauucgcucugcuccugcuuagccuguuucucgccgucggccugggggagaaaaaggaaggacacuucuccgcgcuucccucucugccuguuggcagccaugcuaaaguguccucuccgcagcccagagggccucgguacgccgagggaacguuuaucagcgacuauuccauugccauggauaagauccaccaacaggacuucgugaacuggcuccuggcucagaaaggcaagaagaaugauuggaaacauaacauuacccagcgcgaagccagagcucuggagcucgccucucaagcgaaucggaaggaagaggaggccgucgaaccccagagcuccccugcuaaaaaccccagcgacgaggaucugcuucgcgaccugcucauccaggaacugcuugccugccugcucgaucagacaaaucuguguagacugcggucucgcuga

SEQ ID NO: 69746 - RNA, 1401 nt, Artificial Sequence
  derived and/or modified sequence opt5 from GIPR__Homo_sapiens__NP_000155
augaccacaagccccauccugcagcuccugcuuagacugucccucugcggccugcuucugcaacgggccgagacggggucuaagggacagaccgcuggcgaacucuaccagcgcugggagagauaucggcgcgaaugucaggagacacuggccgcggcugaaccuccgagcgggcuggccugcaacggauccuucgacauguacguguguugggauuaugccgcucccaaugccaccgcuagagccucuugcccuugguaccuccccuggcaccaucacgucgcggccggcuuuguucugcggcaaugugggagcgacggacaguggggccuuuggcgcgaucauacacagugcgagaacccugagaaaaaugaggcuuuccuggaccagagacucauucuggagcggcuucaagugauguauaccgugggcuacucccugucucucgccacacugcugcucgcucugcuuauccugagccucuuucgcagacugcacuguacccggaacuauauucauaucaaucuuuucacguccuuuaugcugcgcgccgcggccauucucagcagagaucggcugcugccccgcccugggccguaccucggagaccaggcucuggcccuuuggaaccaggcucuggccgccugcagaaccgcucagaucgucacacaauacugugugggcgcgaauuauaccuggcuccugguugaagggguguaccuucacucucugcucguccuggugggaggcuccgaggaggggcacuuccgguauuaccugcuccugggauggggcgcccccgcucuuuuuguuaucccuugggugauugucagauaucuguacgaaaacacacagugcugggagcgcaaugaagugaaggccaucugguggauuauccggacccccauucucaugacgauccugauuaacuuccugaucuuuauccgcauucuuggcauccuccugagcaaacugagaacacggcagaugagaugucgcgauuaucggcucagacuggcccgcucuacccuuacacuggugccucuccuggggguccaugagguuguguucgcucccgugaccgaagaacaagcccggggagcgcugagauuugcuaaacuuggcuucgagauuuuucucuccagcuuccagggguuccuggucucugugcuguacugcuuuaucaauaaggaaguucaguccgagauucgccggggauggcaccauugcagacuccggcgcagccugggcgaggaacagagacaacuuccggaacgggccuucagagcccugccuuccgggucuggacccggcgaggugccuaccagccgcggccucuccagcgggacacugcccggacccggcaacgaggcuucucgggaacuggaguccuacuguuga

SEQ ID NO: 69747 - RNA, 2313 nt, Artificial Sequence
  derived and/or modified sequence opt5 from GIT1__Homo_sapiens__NP_001078923
augagcagaaagggcccccgggccgaggugugcgcugacuguuccgccccugauccggggugggcgucuaucagccgcggaguccugguuugcgacgaauguugcuccgugcacagaucucucggccggcauauuagcaucgugaaacaucugcgccacuccgcuuggcccccuacccuucugcagaugguccacacacucgccucuaacggggccaauagcauuugggagcauucccugcuugaucccgcucaagugcagagcggaagacggaaggccaacccucaggacaaaguucaccccaucaagucugaguucauucgcgcuaaauaccagaugcuggccuuugugcacaagcucccuuguagagaugacgauggcgucacggcgaaggaccuguccaaacaacugcauagcucugugcggaccgggaaucucgaaacaugccugcgccuucugucccucggagcccaggcuaacuucuuucacccggaaaagggcaccacaccccugcauguugccgcuaaagccggccagacccuucaggcggagcugcucguggucuauggggccgauccuggaagccccgacgugaauggcagaacaccuaucgauuacgcucggcaagccgggcaccacgagcuggcugaacgccugguggagugucaguaugaacucaccgacagacuggccuucuaccuuugcggacggaagcccgaucauaaaaacggccacuauaucauuccgcagauggccgaccgcucuagacagaaguguaugucccaaagccuggaccucuccgagcuggcuaaggcggccaaaaagaaacuucaggcucugucuaaucggcucuuugaggaacuggccauggaugucuacgacgagguugauagacgcgaaaacgacgccguguggcuggcuacgcagaaucauagcacccucgugacagagcgguccgccgucccuuuccugcccgugaacccugaauauagcgcgaccagaaaucaagggcgccagaaacuugcucgguuuaacgccagagaguucgccacacugaucauugauauccucucugaggcuaagcgccggcagcagggaaagucccugagcucucccaccgacaaucuugaacugagccucagaucccaaucugaucuggacgaucagcacgacuacgauagcguugccuccgacgaggacacggaucaggaaccccugcgcagcacaggcgcuacccggucuaacagagcccgcuccauggacagcucugaucucuccgacggcgcggugacacugcaggaguaccuugaacugaaaaaggcccucgcuaccagcgaggccaagguccaacagcugaugaaaguuaauuccucucugagcgaugagcuucggagacuccagcgggaaauucauaagcugcaggcugagaaccugcaacuccgccagccuccggggcccgugccuacacccccucugcccuccgaaagagccgagcacaccccgauggcgccuggaggcucuacgcaccggagagaccgccaggccuuuagcauguaugaacccggguccgcucuuaaaccuuucggagggcccccuggcgaugagcugaccacacggcuccagcccuuucauagcaccgagcuggaagacgaugccaucuacucugugcacgucccggcuggacuguaucgcauuagaaagggcguguccgccagcgccgucccuuucacacccucuagcccccuucucuccugcucucaagagggcagcagacauaccuccaaacugagccggcacgggucuggagcugacuccgauuacgaaaacacgcagagcggcgacccucugcucgggcuggagggaaagcgcuuucuugagcugggcaaggaagaggauuuccacccggaacucgagucccuggacggggaccuggaucccggccuuccuucuacagaagacgugauccucaaaaccgagcagguuaccaagaauauccaagagcugcugagagcggcccaggaguucaaacaugauagcuuugugcccuguuccgaaaagauucaccucgcugucacagaaauggccucucuguucccuaaacggcccgcccuugagccugugcgcagcucccugagacuccugaacgcuucugccuaucggcugcagagcgaaugccgcaagaccguucccccggagccuggagcgcccguggacuuucagcuucucacacaacaggucauccagugcgcuuacgauauugccaaggccgcuaaacagcuggugacgaucaccacaagagagaagaaacaauga

SEQ ID NO: 69748 - RNA, 2046 nt, Artificial Sequence
  derived and/or modified sequence opt5 from GIT2__Homo_sapiens__NP_001128685
augagcaagagacugcgguccucugaggugugcgccgacuguagcggccccgauccuuccugggcuucugucaaccgcgggaccuuccucugcgacgaauguugcagcguucacagaucccugggacggcauaucucucaggugcgccaccuuaaacauacaccguggcccccuacgcugcuccaaaugguggagacccuguacaauaacggcgccaauagcauuugggaacacucccuucuggaucccgcgagcaucaugucugggagacggaaggcuaacccucaggacaaaguccaucccaauaaggccgaguuuauucgcgccaaauaucagaugcucgcuuucgugcacagacugccuugucgggaugacgauuccguuacagccaaggaccugagcaagcagcuccacucuuccgugcgcaccggaaaccuggaaacaugccuuagacugcucagccugggcgcucaagccaacuuuuuccauccggagaaagggaauacaccccuucacgucgcgucuaaggccggacagauccugcaggcugagcuccuggccguguacggcgcugauccuggcacccaggacuccagcgggaaaacccccguugauuaugcccggcaaggaggccaucacgaacuggcggagcgccucguggaaauucaguacgagcugacggacagacuugccuuuuaucugugugggcggaagccugaucacaaaaauggacagcauuucaucaucccccagauggcugaccgcagacucucccuggaccuuucugagcuggccaaggcugccaagaaaaagcuccaaagccuguccaaccaccuguuugaggaacucgccauggaugucuacgacgaaguggaucggagagagaccgacgcuguguggcuggcgacacagaaucauagcgcccuugucaccgaaacaaccguugugccguuccugccugugaaccccgaguauucuuccacgcgcaaucagggccggcaaaaacucgcuagauuuaacgcccacgaguucgccacacuggucauugauauccuuagcgacgcuaagcgccggcagcaggggucuagccuguccggaucuaaagauaauguggaacucauucugaagaccaucaacaaccagcauagcguugagucccaagacaaugaucagccugacuacgauagcguggccucugacgaagacacagaucuggagaccaccgcguccaaaacaaacagacagaagcuccagacgcugcaaagcgaaaauucuaaccuucgcaagcaggcuaccacaaaugucuaccaggugcagaccggcuccgaguauacagacaccagcaaccacuccucucugaaacggagacccagcgcccgcggcucccggcccaugucuauguacgagacggggagcggacaaaagccuuaucucccgaugggcgaagccuccagacccgaggaaagccgcaugcggcugcagccuuuucccgcucacgccucuagacuggagaaacaaaauuccacaccugaaagcgauuacgacaacacccccaaugauauggagccggacgggaugggaucuucccggaagggccgccagagaagcaugguuuggccuggggauggacuugugcccgacaccgcugagccucaugucgcccccucuccuacacuccccagcaccgaagaugugauucggaaaacagagcagaucacgaagaacauucaggaacugcugagagcggcccaggagaauaagcacgacuccuauaucccgugcagcgagcgcauccaugucgcugugaccgaaauggccgcucucuucccuaaaaagcccaaaucugauaugguucggacaucccugagacuucugaccagcuccgccuaccgccuccaaucugaguguaagaaaacacugcccggcgacccuggcagcccgaccgaugugcagcuggucacgcaacaggugauucagugcgcguaugacaucgccaaggcugccaagcagcuuguuaccauuacaaccaaagaaaacaauaacuga

SEQ ID NO: 69749 - RNA, 1149 nt, Artificial Sequence
  derived and/or modified sequence opt5 from GJA1__Homo_sapiens__NP_000156
augggcgacuggagcgcccuggggaagcuccuggauaaagugcaggcuuacuccaccgccggaggcaaggucuggcuuucuguucuguucaucuuucggauucuccugcuugggacagcgguggagagcgcuuggggagacgaacaauccgccuucagaugcaacacgcagcagcccggcugugagaaugugugcuaugauaaaucuuuuccuaucagccacguccgcuucugggugcugcagauuaucuuuguuuccgugccgacccuccuguaccuggcccaugucuucuaugugaugagaaaggaagagaaacucaacaagaaggaagaggagcugaaaguugcucaaacagacggggugaaugucgauaugcaccuuaagcagauugaaaucaaaaaguuuaaauacggaaucgaggaacauggcaaggugaagaugcggggcgggcugcuccgcaccuauauuaucucuauucuguucaaaagcaucuuugagguggccuuccuucugauucagugguacaucuauggauuuucccucagcgcugucuacacauguaagagagaccccugcccucaccagguugauuguuuccugucucggcccaccgagaaaacaauuuuuaucaucuucaugcugguggugucccucgucagccuggcccuuaacauuaucgaacuguucuacguguuuuucaagggcguuaaagaccgcgugaaggggaaaucugauccuuaucaugcgaccuccggagcccucagccccgcuaaggacugcggcucucaaaaguacgccuauuuuaauggguguuccagcccuacggcuccgcugucccccaugucuccucccggauacaaacuugucaccggcgauagaaacaauagcuccugccggaacuauaauaagcaggccagcgagcagaacugggcgaauuacucugccgaacagaaccgcaugggccaagcuggguccacaauuagcaauucucacgcccagccuuucgacuuucccgaugacaaccagaauagcaaaaagcuggcugccggacacgagcuccaaccgcuggccaucguggaccagagaccuuccucucgggcuagcucccgcgcgagcucuagaccccggccugaugaccuggaaauuuga

SEQ ID NO: 69750 - RNA, 1308 nt, Artificial Sequence
  derived and/or modified sequence opt5 from GJA3__Homo_sapiens__NP_068773
augggcgacuggagcuuccuggggagacuccuggagaacgcccaggaacacuccaccgugaucggaaaggucuggcuuacaguucuguuuauuuuccggauccucgugcugggcgcugccgcggaggauguguggggcgacgaacaaucugauuuuacgugcaauacccagcagcccggaugugagaacgucugcuacgaccgcgcuuucccuauuagccauaucagauuuugggcccuucagauuaucuucguguccacaccgacccugaucuaucucggccacguucugcauauugugcggauggaagagaaaaagaaagagcgcgaagaggaagaacaacugaagagagagucucccagcccuaaagaacccccucaggauaaucccuccucucgggacgaucgcgggagaguccggauggccggagcucuccugcgcacauacguguuuaacaucauuuucaagacccuuuuugagguuggcuucaucgccggccaguauuuucuguacggguucgaacucaagccucuguauagaugugaccgguggccgugccccaauacaguggauuguuuuauuagccgcccuaccgagaaaacgaucuucauuaucuucaugcuugcugucgccugcgcgucccugcuccugaacaugcuggaaaucuaccaccucggauggaagaaacugaagcagggcgugaccagcagacuugggcccgacgccucugaggcuccucugggaacagccgaucccccgccucugcccccuuccagccggccucccgcuguggccauuggcuuucccccguauuacgcgcauaccgccgcuccccucgggcaagcccgcgcugucggauacccuggcgcucccccucccgccgccgacuucaaacuucuggcgcucacagaggccagaggcaaggggcagucugcuaagcuguauaauggacaccaccaucugcucaugaccgaacagaacugggccaaucaggccgcugagcggcaaccgccugcccugaaagcguaccccgcugccuccacgccugccgcucccagcccuguugggucuuccagcccgccccuugcccacgaagcugaggccggggcggccccucugcuccuggauggauccggcucuagccuugaaggguccgcucuggccggaacacccgaggaggaggagcaggcugugaccacagccgcgcagaugcaucaacccccucucccgcugggcgaccccggcagagccagcaaggcuucucgcgccuccagcgggcgggcuagaccugaagaccuggccaucuga

SEQ ID NO: 69751 - RNA, 1284 nt, Artificial Sequence
  derived and/or modified sequence opt5 from GJA8__Homo_sapiens__XP_011507719
augggcgacuggagcuuccuggggaacauccucgaggaagugaaugagcacuccaccgucauuggaagaguuuggcugacagugcuuuuuaucuuccggauucugauccucggcacggccgcugaauuuguguggggcgaugagcagucugacuucgucugcaacacccaacagcccggaugugaaaaugugugcuacgaugaggccuuuccuauuagccauauccgccuguggguucuucagaucauuuucguguccacaccgucucugauguaugucggccacgcggugcauuacguuagaauggaggaaaaacggaaaagccgcgaggcugaagaacucgggcagcaagccggaaccaacggcggccccgaccagggguccgugaagaaaucuagcggauccaagggcaccaaaaaguuuagacuggaggggacacugcuccggacauauaucugucacauuaucuucaagacccuguuugaagucggauucauugugggccauuacuuucuuuauggguuccgcauccugccucucuacagaugcagccgguggcccuguccuaauguggucgauugcuuuguuucucgccccacggagaaaaccauuuucauccuguucaugcuuuccguggccagcgugucucuguuucucaacgucauggaacugggacaccugggccucaagggcaucagauccgcucugaaacggccuguggagcagccgcuuggggaaauucccgaaaagagccugcacucuaucgccguuuccagcauucagaaagcuaagggauaucaacuccuggaggaagagaagaucgugucccauuacuucccucuuacagaagucggcaugguggagaccucuccccugccugccaaacccuuuaaucaguucgaagagaagauuagcacagggccgcucggagaccugucccgcggcuaccaggagacccugccuagcuaugcgcagguuggggcccaagaaguggagggagaagggcccccugcugaggaaggcgccgagcccgaggucggggagaaaaaggaggaagcugagagacucacgacagaggaacaggagaaaguggccguccccgaaggagagaagguggaaaccccuggcguugauaaagagggggagaaggaggagccgcagucugaaaagguguccaaacaaggacugcccgcggagaagacaccuagccuuugucccgaacugaccaccgacgaugcccggccucucucucgccugagcaaggcuuccucuagagcccgguga

SEQ ID NO: 69752 - RNA, 852 nt, Artificial Sequence
  derived and/or modified sequence opt5 from GJB1__Homo_sapiens__NP_000157
augaacuggaccggccuguacacacuccugagcggggugaauagacacuccacggccaucggacgggucuggcuuucuguuauuuucaucuuucgcauuauggugcugguggucgcugccgagagcguguggggcgacgaaaaguccucuuucaucugcaacacccuccagcccggguguaauagcguuugcuaugaucaauuuuucccuauuucccaugugagacuguggucucuucagcugauccucgucagcacaccggcgcugcugguggcuaugcacguugcccaucagcagcacaucgagaaaaagaugcuccggcuggaaggacauggcgacccccuucaccuggaggaagugaaacgccacaagguccauauuuccgggacccucugguggacauacgugaucagcguggucuuuagacugcuuuucgaggccguuuuuauguauguguucuaccugcucuauccuggauacgcuauggugcggcuggucaaaugugauguguaucccugcccuaacaccguugacuguuuugugucucgccccacagagaagaccgucuucacgguguuuaugcuggccgcuuccggcauuugcaucauucucaauguugccgaaguggucuaccugaucauuagagcgugugcccggcgcgcucaaagacggagcaacccuccgucucgcaagggcuccggguucggacacagacuuagccccgaguacaaacagaaugaaaucaacaagcugcucucugagcaggauggcucccugaaagacauccuucggcgcagcccugggaccggagccggccuggcugagaaguccgauagaugcucugccuguuga

SEQ ID NO: 69753 - RNA, 681 nt, Artificial Sequence
  derived and/or modified sequence opt5 from GJB2__Homo_sapiens__NP_003995
auggacuggggcacccugcagacaauccucgggggagugaacaagcacagcacguccauuggcaaaaucuggcugaccguccuuuucauuuuuagaaucaugauucugguuguggccgcuaaggagguguggggagaugaacaagccgacuucgucugcaauacacuccagcccggguguaaaaacgugugcuacgaucauuauuuuccuaucucucacauccggcugugggcgcuucagcugauuuucguuagcaccccggcucuccugguggccaugcaugucgccuaccgcagacacgagaagaaacggaaguuuaucaagggcgaaauuaaauccgaguucaaggacaucgaagagauuaaaacacagaaggugcgcaucgaggggucucugugguggaccuauacaagcuccaucuuuuucagaguuauuuuugaagcugccuucauguacguguuuuaugucauguacgauggauucucuaugcaacggcucgugaaauguaaugcuuggcccugcccuaacaccguggacuguuuugucagccgccccacggagaagaccguuuucacaguguucaugaucgccguguccggcauuugcauccugcuuaaugucaccgaacuguguuaucuccugauuagauacugcagcggcaagucuaaaaagccuguguga

SEQ ID NO: 69754 - RNA, 786 nt, Artificial Sequence
  derived and/or modified sequence opt5 from GJB6__Homo_sapiens__NP_001103691
auggacuggggcacccugcacacauucaucgggggagugaacaagcauagcacguccauuggcaaagucuggaucaccguuauuuuuaucuucagagugaugauucucguggucgccgcucaggagguguggggagaugaacaagaggacuuuguuugcaauacacugcagcccggguguaagaacgugugcuacgaucacuucuuuccugucucucauauccggcuuugggcccugcagcucaucuucgugagcaccccggcgcugcuuguugcuaugcacguggccuauuaccgccaugaaacaaccagaaaauuucggcgcggcgagaagagaaaugacuucaaagauauugaagacaucaagaagcagaaaguccggauugaggggucccugugguggacauauaccucuagcaucuuuuuccgcauuaucuuugaggccgcuuucauguacguguuuuauuuccucuacaacggauaucaucugcccugggugcugaaguguggcauugauccuugccccaaucucgucgacuguuucaucuccagaccuacggagaaaaccguuuuuacaaucuucaugauuucugccagcgugaucugcaugcugcuuaacguggcugaacuguguuaccuccugcuuaaggucugcuuucggcgcuccaaaagagcccaaacccagaagaaucaccccaaccacgcgcugaaggaaagcaaacagaaugagaugaacgagcucauuucugauuccggccagaaugccaucacaggguucccuagcuga

SEQ ID NO: 69755 - RNA, 1191 nt, Artificial Sequence
  derived and/or modified sequence opt5 from GJC1__Homo_sapiens__NP_001073852
augagcugguccuuccugaccagacuccuggaggaaauccacaaccauucuacauuugugggcaagauuuggcuuacgguccugaucguuuuccggauugugcucaccgccgucgggggagagagcaucuacuaugacgaacaguccaaauuugugugcaauacagagcaacccggcugugaaaacgugugcuacgaugcuuucgccccucugucucacguucgcuuuuggguguuccagauuauccuugucgcgaccccgagcgugauguaucugggguacgcuauccauaagauugccaaaauggagcacggagaggccgacaagaaagcugccagauccaagcccuaugcuaugcgguggaagcagcaucgcgcccucgaagagacagaagaggauaaugaggaagacccuaugauguaccccgagauggaacuggagucugauaaagaaaacaaggagcagagccaaccuaaacccaagcacgacggcagacggcgcaucagagaggaugggcugaugaaaauuuauguucuccagcugcuugcgcggaccguguuugaagucggauuccugaucggccaguacuuucucuacggcuuccaggugcacccuuuuuauguguguucccgccugccgugcccccauaagauugacuguuucaucagcagaccuacagagaagaccauuuuucuucugaucauguacggggucacgggacucugccugcugcucaauaucugggaaaugcugcaccuuggcuucgggaccauucgggauucucugaacuccaaacgcagagagcucgaagaccccggagccuauaauuacccuuucacauggaacacccccagcgcuccgccuggcuauaauaucgccguuaagcccgaucaaauucaguacacagagcugucuaacgcuaaaaucgccuauaagcagaauaaagcgaacaccgcccaggagcaacaguacgggucccaugaagagaaucuuccugcugaccuggaagcccuccagcgggagauucgcauggcucaagaaagacuggaucuggccgugcaggccuacagccaccagaacaauccccacggaccccgggagaagaaagcuaaggugggcucuaaggcgggcuccaacaaaagcacggccuccucuaagagcggggacggaaaaacauccgucuggaucuga

SEQ ID NO: 69756 - RNA, 1320 nt, Artificial Sequence
  derived and/or modified sequence opt5 from GJC2__Homo_sapiens__NP_065168
augaccaacaugagcugguccuuccugacaagacuccuggaggaaauccacaaucauucuacguuugugggcaaggucuggcuuaccguucuggugguguuccggauuguccucacagccguugggggagaggcuaucuacagcgacgaacaggccaaauuuaccugcaacacacgccaacccggcugugauaaugugugcuaugacgcguucgcuccucugucccacgugagauuuugggucuuccagauugugguuaucucuaccccgagcgugauguaccuuggguaugccguccaucggcuggcccgcgcuuccgagcaggaaagacggcgcgcccucagacggcgccccggaccuagacgggcuccccgcgcccaucugccucccccucacgcgggcuggccggagcccgccgaucugggggaggaggaaccuaugcucggacugggcgaagaggaggaagaggaagagacaggcgcugccgaaggggcuggagaggaggccgaagaggcgggcgccgaagaggcuuguaccaaggccgugggggcugacggaaaagccgccggcacgcccgggccuaccggacagcacgauggcagacggcgcauucaaagagaaggccuuaugcggguguacgucgcucagcugguugcgagagccgcuuuugagguggccuuccucguggggcaguaucugcuuuacggauuugagguccgccccuucuuuccgugcucucggcagccuuguccccacgugguugacugcuucgugagcagaccuacagaaaagaccgucuuucugcucgugauguauguuguguccugucugugccugcuccugaaccuuugugagauggcccaucugggccucgggagcgcucaagaugccguccgcggacggagaggcccucccgcgucugcucccgccccggcuccccgcccucccccuugcgccuuccccgccgcugccgcggggcuggccuguccgccugacuacucccuugugguccgggcugccgaaagagcucgcgcccacgaucagaaucuggcgaaccucgcccugcaggcucugcgggacggagccgcugccggcgauagagaccgcgauagcucucccugcgugggccucccugccgcuucccgggggcccccuagagcgggagcccccgcuagccggacaggcucugccaccuccgccgggacgguuggagagcagggccgcccggggacacaugaaagaccuggcgcuaaaccccgggccggaagcgagaagggcuccgcgucuagcagagacgggaagaccacaguguggaucuga

SEQ ID NO: 69757 - RNA, 840 nt, Artificial Sequence
  derived and/or modified sequence opt5 from GJC3__Homo_sapiens__NP_853516
augugcggcagauuccugcggcgccuccuggccgaggaaagcagacgguccacccccguggggcgccuucugcucccuguccugcuuggauuuagacugguucuccuggcugccucuggcccggggguguacggagacgagcagagcgaguucgugugucacacacaacagcccggcugcaaggcggcuuguuuugaugccuuccauccucugagcccccuccgguuuugggucuuccaggugauccugguugccgugccuucugcucuuuauaugggguuuacgcuguaccacgucauuuggcauugggaacucagcggaaaaggcaaggaagaggagacccugauccagggccgcgaagggaacacagacgugcccggagccggcucccuuagacugcucugggcuuauguugcccaacugggggcgcggcuggugcucgagggagccgcucugggccuucaguaccaccuguauggguuccagaugccuucuagcuuugccugccgcagagaaccgugucucggauccauuaccugcaaucugagccggcccucugagaaaacaaucuuccuuaagaccauguuuggcgucuccggcuucugucugcucuuuacauuccuggagcuggugcuccuggggcuuggacgcugguggagaaccuggaaacauaaguccucuuccagcaaguacuuccugacgucugaauccacccggcgccacaaaaaggcuacagauagccucccuguggucgagaccaaagaacaguuucaagaggccguucccggcagaucccuggcgcaggaaaagcagcggccuguggggcccagagacgccuga

SEQ ID NO: 69758 - RNA, 966 nt, Artificial Sequence
  derived and/or modified sequence opt5 from GJD2__Homo_sapiens__NP_065711
augggcgaguggaccauccuggaaagacuccuggaggccgcugugcagcaacacagcacaaugauugggcggauccuucugacggucguugugauuuuccgcauccucauuguggccaucgucggagaaaccguguacgacgaugagcagacaauguuuguuugcaacacccugcagcccggcuguaaucaggcgugcuaugacagagcuuucccuaucucccauauucgguacuggguguuucaaaucauuauggucuguacaccgucucuuugcuucaucaccuauagcgugcaccaguccgccaagcagcgcgaaagacgguacucuacaguuuuucuggcccucgaucgcgaucccccugagagcauugggggacccggcgggaccggaggcggcggguccggaggcgggaaaagagaggacaagaaacugcagaacgcuaucgugaauggaguccugcaaaacacggaaaauaccucuaaggagacagaaccugacugucucgaggugaaagagcugacaccccauccuagcggccuucggaccgccuccaagagcaagcugcgcagacaggaagggauuucucgguucuauaucauccagguggucuuucgcaacgcucucgagauuggauuccugguuggccaguacuuucuuuauggcuucuccgugccggggcuguacgaaugcaauagauaccccuguaucaaagagguggaaugcuaugucagccggccuaccgagaagacgguguuucucguuuucauguuugccgugucuggaauuugugucgugcugaaccuggcggagcucaaucaccugggcuggcgcaaaaucaaacuugccguuagaggggcucaagccaagcggaaguccauuuacgaaaucagaaacaaggaucugccccgcgugagcgucccuaauuucggacggacacagucuuccgacagcgcuuauguguga

SEQ ID NO: 69759 - RNA, 885 nt, Artificial Sequence
  derived and/or modified sequence opt5 from GJD3__Homo_sapiens__NP_689343
augggcgagugggccuuccuggggagccuccuggacgcugugcagcuucaaucuccccuggucggaagacucuggcugguugugaugcuuaucuuucggauucuggugcucgccaccgucggcggggcgguguucgaagaugagcaggaagaguuuguuugcaacacacugcagccuggaugucgccagacgugcuacgacagagcuuucccggugucccacuaucgguuuuggcuguuccauauccuccugcuuagcgcucccccuguccuguuugugguuuacuccaugcaccgcgccggcaaggaagccgggggagccgaggcugccgcgcaaugugcccccggccucccugaggcucagugcgcccccugugcucugagagcccggcgcgcgagacggugcuaucuucugucuguggcccuccgccugcuggcugaacucaccuuccugggcgggcaggcccuucuguacggauuuagagucgcuccucauuucgccugugccggcccgcccugcccucacacaguggauuguuuugugagccggcccaccgagaaaacagucuucguucucuuuuauuucgcuguggggcugcuuuccgcgcugcucucuguggccgaacugggacaucugcucuggaagggccgcccuagagcuggggagcgggacaaucgcugcaacagagcccacgaggaagcccagaaacugcuucccccgccucccccucccccucccccgcccgcucugccuagccggagacccggaccugagcccugugccccgccugcguacgcucaccccgccccugccucccuccgcgaaugcggcagcggccgggggaaggcuucucccgccaccggaagacgcgaucuggcuauuuga

SEQ ID NO: 69760 - RNA, 1575 nt, Artificial Sequence
  derived and/or modified sequence opt5 from GK__Homo_sapiens__NP_000158
auggccgcuagcaagaaagccgugcugggcccccucgucggggcgguugaccagggaaccuccucuacaagauuccugguguuuaacagcaagacggcugagcuucugucccaccaucaaguggaaaucaaacaggaguucccucgggaaggcugggucgagcaggauccgaaggaaauucuccacucuguguacgagugcaucgagaaaaccugugaaaagcuggggcagcuuaauauugacaucagcaacauuaaggccaucggaguuuccaaucaacgcgagacaaccguggucugggauaaaaucacaggcgaaccccuguauaacgccgugguuuggcucgaccugagaacccagucuacaguggagagccuguccaagcggauuccugggaauaacaauuuugucaaaagcaagaccggacucccccugucuacguacuucuccgcugugaaacuucgcuggcugcucgauaacgugagaaagguccagaaggccguugaggaaaaacgggcucuguuuggcaccaucgacagcuggcuuauuuggucucugacaggcggggugaauggaggcgugcauugcaccgaugucacaaacgccucccgcaccaugcuuuucaauauccacagccuggagugggacaagcagcugugugaauuuuucgggauuccuauggagauccuccccaacgugagaucuuccagcgaaauuuauggacugaugaaagcgggcgcccuugaggggguuccuaucuccggaugccugggcgaucaaucugcugcccucgugggccagauguguuuucagaucgggcaggcuaagaauacguacggaacaggcugcuuccugcuuuguaacaccgggcauaaaugcgucuuuagcgaccacggacugcucacaaccguggccuauaagcugggccgggauaaaccgguuuacuaugcgcuggagggguccguggccauugcuggagccgucauccgcuggcucagagacaaucugggcauuaucaagaccagcgaagagauugaaaagcucgcuaaagaggugggcacaucuuacggguguuacuucguccccgccuuuuccggacuguaugccccuuacugggaacccagcgcucggggcaucaucugcgggcucacgcaauucaccaacaagugucacauugcguucgccgcucuggaggccgugugcuuucagacacgcgagauccuugaugccaugaacagagacugcggcauuccucugucucaucuccagguugacggagggaugaccagcaauaaaauccugaugcaacugcaggcugauauucucuauauccccguggucaagccguccaugccugaaacaaccgcccugggcgcggcuauggccgccggagcugccgagggcguggggguuuggucucuugaacccgaggaccugagcgcugugacgauggaacgguucgagccucagaucaacgccgaggaauccgagauucgcuacagcacauggaaaaaggcggucaugaagucuaugggaugggugaccacccagucccccgaaagcggcauccccuga

SEQ ID NO: 69761 - RNA, 600 nt, Artificial Sequence
  derived and/or modified sequence opt5 from GKN1__Homo_sapiens__NP_062563
augcuggccuacagcuccgugcacugcuucagagaggacaagaugaaauuuaccaucgucuucgcuggccuccuggggguuuuucuugcccccgcgcuggcuaacuauaauauuaacgugaaugaugacaacaauaacgccggaucuggccagcaaagcguguccgucaauaacgaacauaauguggccaacguugauaauaacaaugggugggacucuuggaacagcaucugggauuacggaaauggcuucgcugccacacggcucuuucagaagaaaacguguauugugcacaagaugaacaaagaggucaugccuuccauccagucucuggacgcucuugugaaggaaaagaaacugcaggggaagggaccgggcgggcccccucccaaaggccucauguauagcguuaacccuaauaagguggaugaccuguccaaauucggaaagaacauugccaauaugugccgcggcauccccaccuacauggcggaggaaaugcaagaggccagccuguuuuucuauucugggacauguuacaccacauccguccucuggaucguggauauuagcuuuugcggagacaccguggagaacuga

SEQ ID NO: 69762 - RNA, 555 nt, Artificial Sequence
  derived and/or modified sequence opt5 from GKN2__Homo_sapiens__NP_872342
augaagauccugguggccuuccucgucguucugaccauuuuuggcauccagagccacggguacgagguguucaacauuaucucccccucuaauaacggaggcaaugugcaagaaacagucacgauugacaacgagaaaaauaccgcuaucaucaacauucaugccgggagcugcuccucuacaaccaucuuugauuauaagcacggauacauugcgagcagagugcuuucccggcgcgcuuguuucauccugaaaauggaccaucagaauauuccuccgcucaacaaucugcagugguauaucuacgaaaagcaggcccuugauaacauguuuucuagcaaauauacauggguuaaguacaauccccuggagucccucauuaaggacguggauugguuccugcugggcagcccuaucgaaaaacucugcaagcacaucccccuguauaaaggggaggucguggagaacacccauaauguuggagccggcggcugugcuaaggccgggcuucugggcauucucggaaucucuauuugcgcugacauccacguguga

SEQ ID NO: 69763 - RNA, 1290 nt, Artificial Sequence
  derived and/or modified sequence opt5 from GLA__Homo_sapiens__NP_000160
augcagcugagaaaccccgagcuccaccugggcugcgcccuugcucugcgguuccucgcccuggugagcugggacaucccuggggcgcgcgcucuugauaauggacuggccagaaccccgacaaugggcuggcuccauugggaacgguuuauguguaaccuggacugccaagaggaacccgauuccuguauuucugagaagcuguucauggaaauggccgagcucauggucagcgagggguggaaagacgcuggauacgaauaucugugcaucgaugacuguuggauggccccucagcgcgauuccgagggcagacuucaggcugacccccagcgguuuccucacgggauucgccaacuggccaauuacguucauucuaagggacucaaacugggcaucuaugcggaugugggcaacaagacgugcgccggguuccccgggagcuuuggcuacuaugacauugaugcucagaccuucgccgacuggggaguggaucuucugaaauuugacggauguuacugcgacucccucgaaaaucuggcugauggcuauaagcacaugucucuggcccucaacagaacagggcggagcaucgucuacuccugugaguggccucuguacauguggccguuccagaagcccaauuauaccgagauccgccaguacugcaaccauuggagaaauuuugcggacauugaugacagcuggaaaucuaucaaguccauucuugauuggaccagcuucaaccaagaacggaucguggacguugccggaccuggcggcuggaaugaucccgacaugcuggugauugggaacuuuggacucucuuggaaucagcaggucacacagauggcucugugggccaucauggcugccccucuuuucauguccaacgaucugcgccacauuagcccccaagccaaagcucuccugcaggacaaggaugugaucgcgaucaaucaggacccgcugggcaaacaaggguaucagcucagacagggagacaacuuugagguuugggaacggccucugucuggccuugccugggcuguggccaugauuaaccgccaggagaucgggggacccagauccuacacaauugccgucgcuagccugggcaagggcguggccuguaauccugcgugcuucaucacccaacuccugcccgugaagcggaaacuuggguucuaugaauggacguccagacugcgcucucacauuaaccccaccggaacaguccuccugcagcuggagaauaccaugcagaugagccucaaggaucugcuuuga

SEQ ID NO: 69764 - RNA, 2034 nt, Artificial Sequence
  derived and/or modified sequence opt5 from GLB1__Homo_sapiens__NP_000395
augcccggcuuccuggugagaauccucccucugcuucugguccuccugcuucuggggccgacccggggacuccgcaacgccacacagagaauguuugagauugacuacagccgggauuccuuccugaaggacggccaacccuuucgcuauaucucugggagcauucacuacuccagaguuccucgguucuauuggaaagaucgccugcucaagaugaaaauggcuggacugaaugccauccagacguacgugcccuggaacuuucaugaaccuuggcccggccaguaucaguucucugaggaccacgauguggaauacuuucuuagacuggcgcaugagcucgggcugcuugucauucugcggccuggaccguauaucugcgcugaaugggagaugggcggccuccccgccuggcugcuggagaaggaaagcauccuccugcgcuccucugacccugauuaccuugccgcuguggacaaauggcuggggguucuccugcccaagaugaagccucuucuguaccaaaauggaggccccgugauuaccguccagguggagaacgaauaugggagcuacuucgccugugauuuugacuaucucagauuccugcagaaacgguuucgccaccaucugggagaugacguuguccucuucacaaccgauggcgcucacaagacauuucugaaaugcggggcccuucagggacuguacaccacaguggacuucggcaccggcuccaauaucacggacgcguuccucagccaaagaaagugugagccgaaagggccucugauuaacucugaguuuuauaccggauggcuugaucacuggggccagccccauuccacaaucaagaccgaagccguggcuagcucucuguacgacauucucgcccgcggggcuuccgugaaucuguauauguucaucggaggcacaaacuuugccuacuggaauggggcgaacagcccuuacgccgcucagcccaccucuuaugauuacgacgcuccccuguccgaggcuggagaucucacggaaaaguauuucgcccugcggaauauuauccagaaauuugagaaggucccugaaggcccgauucccccuagcacacccaaauucgccuacggcaagguuacccuugagaaacugaagacagugggggcugcgcucgacauccugugcccuuccggacccaucaaaucucuguauccgcuuaccuuuauucaagugaagcagcacuacggcuucguccucuauagaaccacacugccucaggauuguagcaaccccgccccucuguccagcccccucaauggggugcaugaccgggcuuacguugccguggauggaaucccucaaggcguccuggagagaaacaaugugauuacgcuuaacaucaccgggaaggccggcgcuacacuggaccuccugguugaaaacaugggacgcgugaauuacggcgccuauaucaacgauuuuaaagggcuggucucuaaucuuacccucuccagcaacauucugacagacuggaccaucuucccccuggacacggaggaugcggugcggucucaccucggaggcugggggcacagagacagcggacaucacgaugaagccugggcccauaauuccucuaacuacacacugccggccuuuuauaugggcaauuucagcauuccuuccgggauccccgaccuuccccaggauaccuuuauucaguucccuggcuggaccaagggacaggucuggaucaacggcuucaaucuggggcgcuacuggccggcucggggaccccaacucacacuguuugugccucagcacauccugaugaccagcgcccccaacacaauuacgguucuugagcucgaaugggcuccuuguucuuccgacgaucccgagcugugcgccgugaccuucgucgacagaccugugaucggcagcucuguuacauaugaucaucccuccaaaccgguggagaagcgccugaugccucccccuccccagaaaaauaaggacagcuggcucgaucacgucuga

SEQ ID NO: 69765 - RNA, 1644 nt, Artificial Sequence
  derived and/or modified sequence opt5 from GLCCI1__Homo_sapiens__NP_612435
augagcaccgccuccucuagcuccucuagcuccucuagccagacaccccacccuccgucccaaagaaugcggcgcagcgcugccggcucucccccugcgguggcugccgccggguccggaaacggcgcugggggaggcgggggagucggcugcgcccccgcugccggcgcggggagacugcuccagccuauccgggccacgguucccuaccagcugcuucgcggaagccagcauucuccuaccagaccgcccguggcugccgcugccgcgucccugggcagccucccugggcccggagccgcucggggcccuucucccuccagcccgacaccucccgccgcugccgccccugcugagcaagcgccccgcgccaaggggagaccccggcgcuccccugaaucucacagacggagcuccagcccggagcgcagaucucccggauccccugugugucgggcugacaaagccaagagccagcagguccgcaccucuagcacaauuagacggaccuccucucuggauacaaucaccggccccuaucuuacgggccaguggccuagagacccccaugugcacuacccgagcugcaugaaagauaaggccacccaaacaccuuccuguugggcugaagagggggccgaaaaacgcagccaucagcggucugcguccuggggaagcgcugaccagcugaaggagcagauugccaagcucagacaacagcugcagcgcucuaaacaauccagccggcacuccaaggagaaagauagacagucuccccugcacggcaaucauaucaccauuagccacacacaggccaccgggucccgcucuguuccuaugccccucagcaacaucuccgugccuaagagcucugucucccgggugcccugcaauguugaaggaaucagcccggagcuggaaaaaguguucauuaaggagaacaauggcaaggaggaagucucuaaaccucuugacauccccgaugggagacgcgcuccccugccugcccauuaucgguccagcucuacgagaagcauugacacacagaccccguccgugcaagagcgcucuagcuccuguagcucccacucucccugcgugagcccuuuuugucccccugaaucccaggauggaucucccugcagcacagaggaccuccuguacgaucgggacaaggauuccggcucuagcuccccucuucccaaauaugcuagcucuccgaagccuaacaauuccuacauguucaaaagagaacccccugagggcugugagcgggucaagguuuuugaagagauggccagccgccagcccaucucugcgccgcuguucuccugcccugacaaaaacaaggugaauuuuauucccaccgggagcgccuucuguccugugaagcuccugggaccccugcuccccgcuucugaccugaugcuuaaaaacuccccuaauagcggccaguccagcgcccuggcuacccucacagucgaacaacugucuagcagaguguccuuuacgucucuuagcgaugacaccuccacagccgggucuauggaggcgagcguucagcagccgucccagcaacagcagcugcuccaggaacugcaaggagaggaucacaucucugcccagaacuaugugauuaucuga

SEQ ID NO: 69766 - RNA, 1854 nt, Artificial Sequence
  derived and/or modified sequence opt5 from GLCE__Homo_sapiens__XP_005254355
augagaugccuggccgcucgggugaacuacaagacccucaucauuaucugugcccuguucacacuugucacgguucugcucuggaauaaaugcagcuccgacaaggcgauucaguuuccccgcagaucuagcuccggcuuccggguggauggguuugagaaacgcgcugccgccucugaaagcaacaauuauaugaaccacguggcuaagcaacaguccgaggaagccuucccucaggagcagcaaaaagcuccgcccgucgugggaggcuuuaauucuaacguugggagcaaggugcugggacuuaaguacgaagagaucgacugucugauuaaugaugagcauaccaucaaaggcagacgggaagggaacgaggucuuccucccuuuuacauggguggaaaaguauuucgacguuuacggaaaagugguccaguaugauggcuacgaccgcuuugaguucucccacagcuauucuaagguguacgcccagagagcgcccuaccauccugauggcguguuuauguccuucgagggguauaaugucgaaguucgggaccgcgugaaaugcaucagcggaguggagggcgucccccugucuacccagugggggccucaaggauacuuuuauccgauucagaucgcccaguacggccugucccacuauagcaagaaccucacagaaaagcccccucauauugagguguacgaaaccgcugaggauagagacaaaaauaagcccaacgauuggacaguuccuaaaggguguuucauggccaauguggcugacaagucucgguucaccaacgucaaacaguuuaucgcccccgagacguccgaaggagugagccugcaacuuggcaauaccaaggauuucauuaucuccuuugaccugaaauuccucacaaacggcucuguuagcgugguccuggagaccacagaaaagaaccagcuuuuuaccauucacuauguguccaaugcgcagcugaucgccuucaaggagcgcgacaucuacuacgggauuggaccgagaacgagcuggucuacagucacccgggaucucgugacagaccugcgcaaaggcguugggcuguccaacaccaaggcugugaaaccuaccaagaucaugcccaaaaaggucgugagacucauugccaagggaaaaggcuuucuggauaauaucacaauuagcacgaccgcucacauggccgccuucuuugcugcgucugacuggcuuguucggaaccaagaugaaaaagggggauggccuaucauggugacaagaaagcugggcgagggcuucaagagccucgagcccgggugguauuccgccauggcucagggacaggccaucucuacccugguccgcgccuaccuucugacaaaagaccauauuuuucucaauagcgcucugcgggccaccgcgcccuauaaguuccuguccgaacagcacggcgugaaggcuguguuuaugaacaaacaugauugguacgaggaauauccuacgacaccgagcucuuucguucucaauggguucauguacucccugaucggacuuuaugaccugaaggagaccgccggcgaaaaacucgggaaggaggccagaagccuguacgagcgcggcauggaaucucuuaaagcuaugcugccccucuacgauaccggauccggcacaauuuaugaccugcggcacuuuaugcuggggaucgccccuaaccucgcuagaugggauuaccacaccacacauauuaaucaacugcagcuucugagcacgaucgacgagucccccgucuucaaggaauuugugaagcgcuggaaaucuuaucucaagggaagccgggccaaacacaacuga

SEQ ID NO: 69767 - RNA, 3063 nt, Artificial Sequence
  derived and/or modified sequence opt5 from GLDC__Homo_sapiens__NP_000161
augcagagcugcgccagagcuuggggccugcggcucgggcgcggagugggcgggggaagacggcuggccggcggguccggacccuguugggcgccucgcucuagagacagcuccucuggcggcggggauagcgcugccgccggagcuucccggcuucuggagcgccuccugccgagacacgacgauuucgcccggcgccauaucggccccggggacaaggaucaaagagaaaugcuucagacccugggacucgcuucuauugacgagcugaucgagaaaacagucccugccaacauucggcugaagcgcccccucaaaauggaggauccuguuugcgaaaaugagauccuggcgacgcuucacgccauuagcuccaagaaccagaucuggagaagcuacaucggcaugggguauuacaauuguucugugccccagaccauucugcggaaccuccuggaaaauuccggauggaucacacaauauaccccuuaccagccggaagugagccagggccgccuugagucucugcucaacuaucagacaauggucugcgacauuaccggccuggauauggcuaaugccucccugcucgacgaagggacagcugccgcggaggcccugcaacuuuguuacagacauaacaaacggagaaaguuucugguggauccccgcugccacccucagaccaucgcuguugugcagacgcgggccaaguauaccggaguccucacagagcugaaacuucccugugaaauggacuucagcggcaaggaugugucugggguucuguuucaguacccugacaccgagggaaaaguggaagacuucacagagcucgucgaaagagcucaucaauccggcagccuggccugcugugccaccgaucugcucgcucugugcauucuucggcccccgggggaguuuggaguggacaucgcgcugggcuccucucagcgcuucggcgugccucucggguacggaggcccccacgccgccuuuuucgcugucagagagagccugguucgcaugaugccugggcggauggugggagugacgagagaugccacaggcaaggaagucuaucgccuugcucugcagacccgggagcaacacauuagacgcgacaaagccacauccaauaucuguaccgcgcaggcucuccuggccaacauggccgcuauguuugccaucuaccaugggagccacggccuggaacauauugcucggagagugcacaaugccacccucauccugucugagggacuuaagcgggcgggccaccagcugcagcaugaucucuucuuugacacacugaagauucaaugcgggugcuccguuaaagaagugcugggacgcgccgcucagagacagaucaacuuccggcuuuuugaggauggcacgcucgggauuagccuggacgagaccgucaaugaaaaggaucuggacgaucuccuguggaucuucggaugugagucuagcgccgaacuuguggcugaguccaugggcgaagagugcagagggauccccggcucuguuuucaaacgcacaagccccuuucugacccaccagguguucaacuccuaucauagcgagacaaauauuguccgguacaugaagaaacucgaaaacaaggacaucucucuggugcacuccaugauuccucugggaagcuguaccaugaaacuuaacucuuccagcgagcucgccccgaucacguggaaggaauuugcgaauauucaucccuucgucccucuggaccaagcccagggcuaucagcagcuguuuagagagcucgagaaggaucugugcgaacuuacaggguacgaccaaguguguuuccagcccaacuccggagcucagggcgaguaugccgggcuggcuaccauccgcgccuaccucaaucagaaaggagaaggccacagaaccguuugccugaucccuaagucugcccacgggacaaaccccgcuagcgcgcauauggccggcaugaaaauucaaccgguggaggucgauaaguacggaaauaucgacgcugugcaccugaaagccaugguugauaagcauaaggaaaaccuugccgcuauuaugaucaccuauccuuccacaaauggcguguuugaggagaacauuucugacgucugugaucucauccaccagcacgggggacagguguaccuggacggcgccaauaugaacgcgcaaguggggauuugccggcccggagauuucggcagcgacguuucccaucugaaucuccacaaaacguuuuguaucccucaugggggcggaggccccgggaugggaccuaucggcgucaagaaacaccuggcucccuuccuuccgaaccauccugugauuagccugaagcgcaaugaagaugccugccccguggggaccgucucugccgcucccuggggauccagcucuauccucccuauuuccugggccuauaucaaaaugaugggcggcaaggggcugaagcaggcgacagagaccgcuauucugaacgccaauuacauggccaaaagacuugaaacacacuaucggauccucuuucgcggagcuagaggcuacguggggcacgaguucauccuggacacccggccguuuaagaaaagcgccaacauugaagcuguugauguggccaagcgccugcaggacuauggauuccaugcgcccacgaugucuuggccugucgccggcacccucaugguggagcccacagagagcgaagacaaagcugagcuggauagauucugugacgccaugaucuccauucggcaggaaaucgcugauauugaggaagggcgcaucgacccuagaguuaacccccuuaagaugagcccucacucucugaccugcgugacauccagccauugggaucggcccuacuccagagaggucgccgccuuuccgcucccuuucgugaagcccgagaauaaauuuuggccuaccaucgcucgcauugacgauaucuacggagaccaacaccugguuugcacgugucccccgauggaaguguaugagucuccuuucagcgaacagaagcgggcguccucuuga

SEQ ID NO: 69768 - RNA, 1656 nt, Artificial Sequence
  derived and/or modified sequence opt5 from GLDN__Homo_sapiens__NP_861454
auggccagaggcgcugaagggggacggggcgacgccggguggggacugcgcggcgcgcucgcugccguggcccugcuuagcgcucugaacgccgcugggaccgucuucgcccucugccaguggagaggacuguccucugcgcuucgggcccuggaggcucaacgcggcagagagcagcgggaagauagcgcccuccgcuccuuucuggcugagcugucuagagcgccccggggcgccagcgccccuccgcaggaccccgcuuccucugcccgcaauaagagaagccacuccggggaaccugcuccccauauccgggccgagagccacgauaugcucaugaugaugacauacucuaugguuccuauucgcgugaugguggaccuguguaacuccacgaaaggaaucugccuuaccggccccagcgggccuccgggacccccuggcgccgggggacugcccggccauaauggccucgaugggcagccuggaccccaaggcccgaagggggagaaaggagcuaacggcaagagagggaaaauggggauuccuggcgcggccggcaaucccggggaacggggagagaagggcgaccacggggaacugggacuucagggcaacgaggggccucccggccagaagggagagaaaggcgauaagggggacgucucuaaugaugugcugcucgcuggagccaaaggcgaccaggggcccccuggaccgcccggcccucccgggccucccggcccgccuggacccccuggcucccgcagagccaaggggccccggcaaccuagcauguucaacggacagugucccggcgaaacaugcgcuaucccgaaugaugacacccugguugggaaagccgaugagaaggcgucugaacaucacuccccucaggcugagagcaugauuacauccaucggaaaccccgugcagguccugaaggugaccgaaacauuuggcaccuggaucagagagucugccaauaaaagcgacgaccgcauuuggguuacggagcacuucuccgggaucauggugaaggaauuuaaagaucaacccagccuccugaacggcucuuauaccuucauucaucuuccuuacuauuuucacggauguggccaugucguguacaauaacucccuguauuaccacaagggaggaagcaauacacucgugcgguucgaguuuggccaggaaaccucucagacacugaaacuugagaacgcccuguauuucgacagaaaguaccucuuugcuaacagcaaaaccuacuucaaucuggccgucgaugaaaaggggcuguggaucauuuaugcuuccucuguugacggaagcuccauccucguggcccaacuggaugagcgcacguuuagcgugguccagcacgugaacacaaccuacccgaagucuaaagcgggcaaugccuucauugcucgggggauccuuuauguuacagacaccaaggauaugagagugaccuucgccuuugaccugcucggcggaaaacagaucaacgcuaauuucgaucugcgcacaucccagagcguccuugccaugcuggcguacaacaugcgggaccaacaucucuauucuugggaggauggccaccugaugcuguaccccgugcaguuucucuccacgacccugaaucaguga

SEQ ID NO: 69769 - RNA, 2097 nt, Artificial Sequence
  derived and/or modified sequence opt5 from GLE1__Homo_sapiens__NP_001003722
augcccagcgagggcagaugcugggaaacccugaaggcccuccgguccucugacaaagggcgccuguguuacuauagagauuggcuucugcggcgcgaggacgugcucgaagagugcaugagccugccuaagcuguccucuuacagcggaugggucguugaacacgugcugccgcauaugcaggagaaccaaccccucuccgagacaucuccuagcuccacgagcgcuucugcccuggaucagcccuccuucgugccuaaaagccccgacgcgucuuccgcuuuuagcccugccucuccggccacccccaauggcacaaaggggaaagaugaaucccagcacaccgagagcaugguccugcaguccucuagaggaaucaagguggaaggcuguguucggauguaugagcucgugcaucgcaugaaggggacagagggacugagacuuuggcaagaggaacaggaacggaaaguccaggcucugagcgagauggccuccgaacagcucaagcgcuucgacgaguggaaagagcugaagcaacacaaagaauuucaggaucuuagagaggugauggaaaagagcucucgggaggcucugggccaucaggaaaagcucaaagccgagcaccgccacagagcgaagauucugaaccugaaacuccgggaggccgaacagcaacgcguuaagcaggcugagcaggaaagacugcggaaagaggaaggccaaaucagacuucgcgcccuguacgcucuccaggaggagaugcugcagcuuucccagcaacuggacgccagcgaacagcauaaggcgcuccugaaaguggaucuggccgcuuuccagacccgggggaaucagcucugcucucugauuagcggaaucauuagagccuccucugagagcuccuauccuacagcugaaagccaagccgaggccgagcgcgcgcuucgggaaaugagagaccugcucaugaaccugggccaggagaucacccgcgcuugugaagauaagcggagacaggacgaggaagaggcccaggucaagcugcaagaggcucagaugcagcaggggcccgaagcccacaaagagccucccgccccgucucaaggaccuggcgggaagcagaaugaagaucuucaggugaaagugcaagacaucacgaugcagugguaccagcagcuccaagacgcuuccaugcagugcguccugaccuuugagggacugacaaacagcaaggauucucaggccaaaaagauuaagauggaccuccagaaagcggcuaccauccccguuucccaaauuagcacaaucgccggcuccaagcugaaagaaauuuucgauaagauccauucucuucugagcggcaaaccugugcaguccgggggacgcucugugagcgucacccucaauccccagggccuggacuuugugcaguauaagcuggccgagaaguucguuaaacaaggggaggaagagguggcuucccaccacgaagccgcuuuucccauugccgucguggcgagcggaaucugggagcuucauccucggguuggcgaucucauccuggcccaccuucauaagaaauguccguacucugugcccuucuacccuacguuuaaggaagggauggcucucgaggacuaucagagaaugcugggauaccaggucaaagauuccaagguggagcaacaggacaacuuccuuaagcgcaugagcggcaugauucggcuguaugccgcuaucauucagcucagauggcccuacggcaaucggcaggaaauccacccucaugggcugaaccacggauggcgcuggcuggcccaaauucuuaauauggagccccucucugaugucacagcgacccugcuguuugacuuccucgaagugugcggcaacgcccugaugaaacaguaucagguucaguucuggaagaugcuuauccugaucaaagaggauuacuuuccgagaauugaggcuaucacauccagcgggcaaaugggaucuuucauucggcucaagcaguuucuggaaaaaugucugcagcacaaggacaucccugugcccaaaggcuuccuuaccagcuccuuuuggagaagcuga

SEQ ID NO: 69770 - RNA, 3579 nt, Artificial Sequence
  derived and/or modified sequence opt5 from GLG1__Homo_sapiens__NP_001139138
auggccgcuugcggcagagugcggcgcauguucagacugagcgccgcgcuccaccuucuucugcucuuugcugccggggccgagaagcugcccggacagggcguccauucccaagggcagggaccuggcgcuaacuucguuucuuuuguggggcaggccggaggcggcgggccggcuggacagcaacuuccccagcugccucagagcucccagcuccaacagcagcagcaacagcagcaacagcagcagcaaccccagccuccccagccuccguuccccgccggcgggccucccgcgcggcgcggaggcgccggggcuggaggcggcuggaaacuggccgaagaggaaucuuguagagaggacgugacccgggucugcccuaagcacacauggagcaauaaccuggcugugcucgaaugucugcaggauguucgcgagcuucuguggaauuacaaacucaaccugacgaccgaccccaaguuugaguccguggccagagaagucugcaaaucuacaaucaccgagauuaaggaaugugcggaugagccgguggggaagggauauaugguuagcugccuuguggaccaucggggcaauaucacagaguaccaaugucaccaguauauuaccaaaaugacagccaucauuuucuccgauuaccgccugaucugcggguuuauggacgauuguaagaacgacaucaauauucucaaaugcggaagcaucagacugggcgaaaaggaugcucauucucagggggaggucguguccugucuggaaaaaggacucgugaaggaggccgaagaacgggagccuaagauucaggucagcgaacugugcaaaaaggcuauccuucgcguugccgagcugucuuccgacgauuuccaccucgacagacaccuguauuuugccugccgggaugaccgcgaaagauucugugagaacacccaagcuggcgaaggccggguguacaaaugccuuuuuaaucauaaguucgaggagagcaugucugaaaaauguagagaggcgcugacgacccgccagaagcucauugcccaggacuauaaaguguccuacagccuggcuaaguccugcaagucugaucugaaaaaguaccgguguaacgucgaaaaucuccccagaagccgcgaggcccggcuguccuaucuucugaugugccucgaaagcgccgugcacagagggcgccagguuucuuccgagugucaaggagagaugcuggacuaccggagaaugcuuauggaagauuuuagccugucuccugagaucauucucagcugccgcggcgaaaucgagcaucacuguuccgggcugcaccggaaaggaagaacacugcauugccucaugaaggugguccgcggcgagaaagggaaccugggcaugaauugucagcaggcucugcaaacccugauccaggaaacagaccccggagccgauuaucggauugacagagcgcucaacgaggcuugcgaaucugugauccagaccgccugcaagcacauucggagcggcgaucccaugauccuguccugucugauggagcaucuuuacacggaaaagaugguugaggacugcgagcaccgccuccuggaacugcaguauuucauuagcagagauuggaaacucgacccugugcuguaccggaagugucaaggggaugccucuagacuuugccauacacacggauggaaugagaccuccgaguucaugccgcagggcgcugucuuuagcugucuguaucgccacgccuaccggacagaggaacaggggagacgccucucuagagagugccgggcugaggugcagcgcauccugcaucaaagagccauggacgucaaacuggaccccgcgcuucaggauaagugucucaucgaccugggaaaauggugcuccgaaaagaccgagaccggccaggaacuggagugucuccaggaucaccuggacgaucuugugguugaaugccgggacauuguggggaaccugacagagcucgagagcgaagauauccaaauugaggcccugcugaugcgcgcuugugaaccuaucauucagaacuucugccaugacgucgccgauaaucagaucgacuccggcgaucuuauggagugccucauccaaaacaagcaccagaaagacaugaaugagaagugugcuauuggagugacgcacuuucagcugguucagaugaaagauuucagauuuucuuacaaguucaaaauggccugcaaggaagacgugcugaagcucugucccaacaucaaaaagaaagucgacguggugauuugccugagcaccacaguucggaaugauacccuucaagaggcgaaggaacaucgcgucucccugaaauguagacggcagcuccgcguggaggaacuggagaugacagaggacaucagacuggaaccugaucuuuaugaggccugcaagucugacauuaaaaacuuuuguagcgcugugcaguacggcaaugcccagaucauugaaugccucaaggagaacaagaaacaacuguccacccggugucaccagaaggucuucaaacugcaggaaacggagaugauggaucccgagcucgacuauacacugaugagagugugcaagcagaugaucaaacgcuuuuguccggaagcugauagcaagaccaugcuucaaugccugaagcagaauaaaaacucugagcucauggacccuaagugcaaacagaugaucaccaagcggcagauuacacaaaauaccgauuacagacugaaccccaugcugcgcaaagccuguaaggccgacaucccuaaguucugccaugggauucuuacaaaagcuaaggaugacuccgaacuggagggacagguuaucagcugucucaaacugcgguaugcggaucagagacucucuuccgacugcgaagaccaaauucgcaucaucauucaggagagcgcccuggauuaccggcuugacccccagcugcagcuccacuguucugaugagaucagcucccugugcgcugaagaggccgccgcucaagaacagacgggccagguggaggagugucugaaggucaaucuucugaaaauuaagaccgaacucugcaagaaagaggugcugaacaugcucaaggaaagcaaagccgacaucuuuguugauccugugcugcauacagcgugugcucuugacauuaagcaccacugcgccgccaucacccccgggagaggacgccagaugucuugucugauggaggcucucgaagauaaacgggucagacugcaaccggagugcaagaaacggcugaaugaccgcaucgagaugugguccuaugccgcgaagguggcuccugccgauggcuucagcgaccuugccaugcagguuaugacaucccccucuaagaacuacauucugagcgugaucuccgggucuauuugcauccucuuucugauuggccucauguguggaagaaucaccaaacgggucacgcgcgaacugaaggauagacuucaguaccggagcgagaccauggcuuauaaaggccugguguggucccaggacgugacagggucucccgccuga

SEQ ID NO: 69771 - RNA, 3198 nt, Artificial Sequence
  derived and/or modified sequence opt5 from GLI1__Homo_sapiens__NP_001161081
auguucaacagcaugacacccccuccgaucuccucuuacggcgaacccugcugucugagaccucuccccagccagggggccccuuccgugggaaccgaagucaagcugacgaaaaagcgggcucuuucuauuagcccccuguccgacgccucucucgaucugcaaaccguuauccgcacaagcccuuccagccuuguggcguuuauuaauucuagaugcaccuccccgggcgggagcuauggacaccugucuaucggcacaaugucccccagccucggguucccugcucagaugaaccaucagaaaggacccucuccuuccuuuggcgugcagcccuguggcccgcacgacagcgcccgcgggggaaugauuccucauccccaaucccggggcccuuucccuaccugccagcugaagucugagcuggauaugcucgucgggaaauguagagaggagccccuggaaggagacaugagcucccccaauagcacaggcauccaggauccgcuucuggggaugcucgacggacgggaggaucuggagcgcgaagagaagagagaacccgagucuguguacgagaccgacugccggugggauggcuguucccaggaauuugacagccaagagcagcuuguucaccauaucaacucugaacacauucacggcgagcgcaaggaguucgugugccauuggggcggauguagcagagaacugcggccuuuuaaagcccaguauaugcucgucgugcacaugcgcagacauacgggcgagaagccccacaaaugcaccuucgaagggugucggaaguccuacucucgccuggagaaucugaaaacacaccucagaagccauaccggagaaaagccuuauaugugcgagcacgaaggcugcuccaaggcuuuuagcaacgccucugaucgggcuaaacaucagaauagaacacacuccaacgagaagcccuacguuuguaaacugccggggugcaccaagcgcuauacggacccuagcucucuucggaaacaugugaagacaguccacggacccgaugcccacgugaccaaaagacaucgcggcgacggcccucugccccgggcgccuuccaucagcacaguggagcccaagagagaacgcgaagggggaccgauucgggaagaguccagacucaccgucccugaaggcgccaugaagccccaacccucuccuggggcucagagcuccuguucuagcgaccacuccccggccggaagcgcugccaauaccgauucuggcguugagaugacagggaacgcgggcggauccacggaggaccugagcucucuugaugaaggccccugcaucgccgggaccggacuguccacacuccgccggcuggagaaucugagacucgaccagcugcaucaacuucgcccuauuggcacccgggggcugaaacuccccagccugucucacacaggaaccacggugagcagacgggugggcccucccgucucccuugaacgcagaucuagcuccagcuccucuaucagcuccgcuuacacagugucucggagaagcucccuggccucuccuuuucccccggggagcccucccgagaacggcgcuuccagccucccuggacugaugcccgcccagcacuaccugcuccgcgcccgguaugcuucugcgagaggcgggggaaccuccccgaccgccgcuagcucucuggaucgcauuggcgggcuuccuaugcccccuuggagaucccgggccgaguaccccggauauaaucccaacgccggcguuacacgcagagcuagcgacccugcccaggcggcugaucggccggcccccgcccgcgugcagagauucaagucucugggguguguccauaccccucccacaguggcuggcggaggccaaaauuucgacccuuaccuccccacguccguuuauagcccucagccgcccuccaucaccgaaaacgccgcuauggaugcccgggggcugcaggaggaaccugaggugggaacaagcauggucggcucugggcugaaccccuacauggacuuuccucccaccgauacacuuggauauggcgggccggaaggcgcggccgcugagccuuacggagcccgcggccccgggagccucccccugggaccugggcccccuaccaauuacgggccgaaccccugcccucagcaggcuuccuaucccgacccuacgcaagagaccuggggagaguuccccucucacagcggccuguacccgggcccuaaagcccucgggggaacauauucccagugucccagacuggaacauuacggccaggugcaagucaagccugaacaggggugccccgugggaucugacagcaccggccuugcgccuugucugaaugcccaccccuccgaggggccgccucauccccagccccucuucucucacuauccucagccgagcccuccccaauaccugcaguccggacccuauacacagccucccccugauuaccugccgagcgaaccccggccuugccuugacuuugauucucccacccacuccacgggccaacucaaagcucagcugguuuguaacuacgugcagagccagcaagagcugcucugggagggcgggggacgcgaagacgccccugcucaggagcccucuuaucaguccccgaaguuccugggcgggagccaggucuccccuucuagagccaaggcccccgugaauacauacggacccggcuuugggccuaaccuucccaaucauaaaagcggauccuauccuaccccgagccccugccacgaaaacuucguugugggcgcuaaucgggcgucucauagagccgcugccccuccccgccugcucccuccccugccgacaugcuacggcccucugaaggucgggggaaccaaccccuccuguggccacccugagguggggcggcuuggaggcgggcccgcccucuauccucccccggaaggacaagugugcaauccucuggauagccuggaccucgauaacacccagcuggacuuuguugcuauccuugaugagccccagggccugucucccccuccgagccaugaccagagaggcuccucugggcacacacccccucccagcggaccucccaauauggccgucggcaacauguccgugcuccugcgcucucugccuggggagacggaguuccuuaauagcuccgcguga

SEQ ID NO: 69772 - RNA, 4761 nt, Artificial Sequence
  derived and/or modified sequence opt5 from GLI2__Homo_sapiens__NP_005261
auggagaccagcgccuccgcuacagccucugaaaagcaggaggcgaaaagcggcauccuggaagcugccggguuccccgacccuggaaagaaagccuccccgcucguggucgcugccgcugccgcggccgcuguugccgcucaaggcgugccccagcaccuucuuccucccuuucaugccccucugcccauugauaugagacaccaggaggggcgguaccauuaugaaccucacucugugcauggaguccacggcccgcccgcgcucagcggguccccugugaucucugacauuagccugauccgccuuagcccccacccugccggacccggcgaguccccguucaacgcuccucaucccuacguuaauccucacauggagcauuaucugagaucugugcacuccagccccacgcucucuaugauuuccgccgcucggggccugagccccgccgaugucgcccaggaacaccugaaggagcgcgggcucuuuggacugccugcuccgggcaccacacccucugacuacuaucaucaaaugacccuuguggcggggcacccugcccccuacggagaucugcucaugcaguccggcggggcugccagcgccccucaucugcacgacuaucuuaaccccguugauguguccagauucucuagcccgcgggucacaccucgccuguccagaaaacgggcucucagcaucucuccccuguccgacgccagccuggaucuccagcgcaugaucagaaccucuccuaauagccugguggcguacauuaacaauucccggucuagcuccgcugccagcggaucuuacggccaucuuuccgccggcgcucugagccccgccuuuacauucccucaccccaucaacccgguggcuuaucagcaaauucucucucagcagcgcgggcugggauccgccuuuggccacaccccuccccuuauccagcccagcccuacguuccuggcgcaacagccgauggcccucaccuccauuaaugcuacacccacccagcugucuagcuccucuaacugccugagcgacacaaaucaaaacaagcaguccagcgaaucugccgucuccagcaccguuaauccuguggcuauccauaagagaucuaaagugaagacggagcccgaggggcuccggccugccagcccccuggcgcuuacacagggacaggucuccggccacgggucuuguggaugcgcccugccucucagccaagaacagcuggcugaucuuaaagaggaccuggaucgcgacgacuguaagcaggaagccgaggugguuauuuacgaaaccaacugccauugggaggauuguacaaaagaguaugacacccaggaacaacucgugcaccacaucaauaacgagcauauccacggcgaaaagaaggaguuugucugcagauggcaggcuuguacccgggaacagaaacccuucaaggcccaguacaugcuggugguucauaugagacgccacacaggcgagaaaccgcauaagugcacguuugagggguguuccaaagccuauagccggcuggaaaaucucaagacccaccugagaucucacacaggagagaaaccuuacgugugcgaacaugagggcuguaacaaggcuuucuccaacgcgagcgaucgcgccaagcaccaaaaucggacccauuccaacgaaaaacccuauauuugcaagaucccugggugcacaaaaagauacaccgaccccucuagccuucgcaagcacgucaaaacggugcauggaccggaugcucacgucacaaagaagcagcggaaugacgugcaccugagaaccccucuccugaaagagaacggcgauuccgaggccgggaccgaacccggcggaccugagucuacagaagccagcuccaccucucaggcuguugaggacugucugcaugugcgcgccauuaagacagagagcuccggccuuugccagagcucucccggggcgcaauccagcuguucuuccgaacccagcccucucggaucugcuccgaauaacgauuccggcgucgagaugcccgggacgggaccuggcagccugggggaccugaccgcccucgaugacacacccccuggcgccgacaccuccgcucuggccgcgcccagcgcuggaggccuucagcugcggaaacacaugacaaccaugcauagauuugaacagcucaagaaagagaagcugaagucucugaaagauagcugcuccugggccgggccuacgccgcacacccgcaauacaaagcugcccccucuccccggaucuggcagcauccuggaaaacuucuccgggucuggaggcgggggcccugccggacugcuccccaauccgcggcugagcgagcuuuccgcuucugaggugaccaugcugagccaacuccaggaaagacgggacuccagcacaucuaccguuuccagcgccuacacggugucucgcagauccagcggcauuuccccuuauuucucuagccggagauccagcgaggcuucuccccugggggccggacgcccccacaacgcguccagcgccgauucuuacgacccuaucagcacagaugcuucccggagaucuagcgaagccucccaguguucuggcgggagcggacugcuuaaucucacccccgcucagcaauauucccugcgcgccaaauacgccgcugcgacaggcgggccuccgcccaccccucugcccggccucgagagaaugagccugcggacccgccuugcccugcucgacgcuccugaaagaacacugcccgccggaugcccgcggccucugggcccccgcagagggucugauggaccuacguauggccaugggcacgccggagcugcccccgcguuuccucaugaggcucccggcggcggggcccggcgcgccuccgacccggucagacggccugaugcucuuagccucccccgcgugcagagauuccacuccacccauaacgugaaucccggaccucugccgcccugugccgaccggagaggccugcgccuccagucucacccuagcacagaugggggacuggcgcggggcgcuuacucccccagaccucccucuaucagcgagaacguugccauggaagccgucgcugccgggguggacggagcuggcccugaggccgaucuuggccugccggaagacgaccucgugcugcccgaugacgucgugcaguauauuaaggcgcacgccuccggggcucuggaugagggaaccggccaaguuuacccuacagaaagcaccggguuuucugacaauccccgccuuccuucccccggacugcauggccagcggagaaugguggccgcugauagcaacgucgggccgucugccccuaugcucggaggcugccagcugggcuucggggcccccuccagccucaacaaaaauaacaugcccgugcaguggaaugagguuucuagcggaacgguggacgcucuggcgucccaagucaagccucccccuuuuccgcagggcaaccuugccgugguucagcaaaagcccgcuuucgggcaguacccuggauauucuccccagggccugcaggccagcccugggggacucgauuccacacaaccccaccuucagccgcgcagcggcgccccuucccagggcaucccccgggugaauuacaugcagcaacugagacagccugucgcugggucucagugucccggaaugaccaccacaaugagcccucaugccugcuauggccaggugcacccccaacuuuccccgucuaccauuagcggggcgcugaaccaguuuccucaguccuguucuaauaugcccgcuaaacccggacaccucggccauccucagcaaacagagguggccccggaccccacgaccauggggaaccgccaccgggaacugggagucccugauagcgcccucgcuggcguucccccuccccauccugugcaguccuacccccagcaaagccaccaucuggccgcgucuaugucccaggagggcuaucaccaggugccgagccuucugccugccagacagcccggguucauggaaccucaaacaggacccaugggcgucgcuaccgccggguuuggacucgugcagccgcggccuccccuggagcccucuccuacaggccgccacagagggguucgggcugugcagcagcaacuggccuacgcucgcgccaccggacaugcgauggccgcuaugcccuccagccaggagacggccgaagcugucccuaagggcgccaugggcaauauggggucugugccgccccagccucccccucaggacgccggaggcgcucccgaucacuccaugcuuuauuacuacgggcaaauccauauguaugagcaggacggaggccuggaaaaccucgggagcugccagguuaugagaucccaaccuccgcagccccaggcgugccaggauagcauucaaccucagccccugccuucucccggagugaaucaggucagcuccaccguggacucucagcuccuggaggccccgcaaaucgacuucgaugcuaucauggacgauggcgaccacagcucccuguuuucuggcgcccugagcccuucccugcuccacucucugagccagaacuccagccggcuuacaacccccagaaauucucugacacuccccuccauuccugccgggaucagcaacauggcuguuggagauaugucuuccaugcugaccagccucgccgaagaguccaaauuccugaauaugaugacauga

SEQ ID NO: 69773 - RNA, 4743 nt, Artificial Sequence
  derived and/or modified sequence opt5 from GLI3__Homo_sapiens__XP_011513575
auggaggcccagagccacuccucuaccacaacggaaaagaaaaagguggagaacagcaucgucaaaugcuccaccagaacagacguuucugaaaaggcuguggccagcuccaccacaucuaaugaggaugaaagccccggccaaaccuaccaucgggagcgcagaaacgcgauuacaaugcagccucagaaugugcaggggcuguccaaagucagcgaggaaccgucuaccuccagcgacgagcgggcuucucucaucaagaaggaaauucacggaucccugccccauguggccgagccuagcguucccuaucgcggcacgguguucgccauggauccuagaaacggguacauggagccccacuaucauccuccgcaccuuuuucccgcuuuccacccucccgucccuaucgacgcccggcaucacgaaggacgcuaccauuaugaucccucuccgauuccuccccugcacaugaccuccgcucucagcuccucuccuacauaccccgaccugcccuuuaucagaaucagcccucaccggaauccgaccgccgcguccgagagccccuucucuccuccccauccuuauauuaaccccuacauggauuacauccgcucccuucacagcucuccgagccuguccaugauuucugccacaagaggccucagcccuaccgacgcuccccaugccgggguguccccugcugaauauuaccaccaaauggcccugcugacgggacagcggagccccuaugcggauaucauuccuucugccgcuacagccggcaccggcgcuauccauauggaguaccuccacgccauggacuccacacgcuuuagcucucccagacuguccgcccggccgagccgcaaaagaacccuuuccauuucuccucugagcgaucacuccuucgaccuccagaccaugauccggacaucucccaauagccugguuacgauccuuaacaauuccagauccucuuccagcgcuucuggguccuauggacaucugagcgcgucugccauuagccccgcucucuccuuuaccuacagcucugccccugugucccugcacaugcaucagcaaauccugagccgccagcagucccucggcucugccuucgggcacagcccgccccugauucacccugcucccacauuuccuacccagcggcccaucccuggcauucccacaguccuuaacccggugcaaguguccucuggaccuagcgaauccucucagaauaagcccaccagcgaguccgccgucagcucuacgggggauccuaugcauaacaaaagauccaagaucaaacccgacgaggaccugccgagcccuggagcgcgcggccagcaagaacagcccgagggcacaacccucguuaaggaagagggggauaaggacgaaucuaaacaggagccugaggugaucuaugaaaccaauugucacugggagggaugcgcucgggaguucgauacacaggaacaacuggugcaucacauuaacaaugaccauauccacggcgaaaagaaagaguuugucuguagauggcuugauugcucccgcgagcagaagcccuucaaagcccaguacaugcuggugguucacaugcggagacauaccggggaaaagccccacaaauguacauuugagggaugcacgaaggccuacagccgccucgaaaaccugaagacccaucugcggucucacacaggcgagaaaccuuaugugugugagcaugaagggugcaacaaggcuuucuccaaugccagcgacagagcuaaacaccagaaccgcacccacuccaaugagaagccguacgucuguaaaauucccggaugcacaaagcgguauaccgauccuagcucucucagaaagcaugugaaaacgguucacggccccgaagcccaugugaccaagaaacaacggggcgacauccacccuagacccccuccgccccgcgauagcgggucccacucucagagccgguccccuggaagacccacacagggcgcgcugggggagcagcaagaccuuucuaacaccacaagcaagcgcgaagagugucugcaggucaaaaccgugaaggccgagaagccuaugacgucccagcccucuccgggaggccagagcuccugcagcucucaacaguccccuauuagcaauuacucuaacuccgggcucgaacugccccuuacagauggcggaagcaucggcgaccuguccgcuaucgacgagacccccauuauggauucuacaaucagcaccgccaccacagcucucgcccugcaggcgcggagaaauccugccgggacgaaauggauggaacaugucaagcuggagcgccucaaacaagugaacggaauguuccccagacugaauccuauucuuccgcccaaggcuccugccguuagcccccugaucggcaacgggacccagagcaauaacacaugcucucucggaggcccuaugacccugcugcccgggcgguccgaccuuagcggcguggaugucacaaugcucaauaugcugaaccgcagagacucuagcgcuuccaccauuucuagcgccuaucuguccucucggcgcagcuccggaaucagcccguguuuuucuuccagacggagcuccgaagccucucaggcugagggccgcccucagaaugugagcguugcggauuccuacgaccccauuucuacggaugccagcagacgguccagcgaggcuucucaauccgacgggcucccuagccugcuuucucugacacccgcccagcaguaucgccucaaagccaaguacgcugccgcgaccggaggcccucccccgaccccucugcccaacauggaaagaaugucccugaagacacggcuugcucuccugggggaugcccuggagcccggaguggcccucccuccgguccacgcucccagacgcugcagcgacggcggggcccauggcuacggacggagacaucugcagccucacgaugcgcccggccacggggugcgccgggcuucugacccugugagaaccggaagcgaaggccuugcccugccccgcguuccucgguucuccucucucagcuccuguaacccgcccgccauggcuacaagcgccgagaaaagaucccugguccugcaaaauuauacgcgcccugaagggggacagucucggaacuuucacagcucccccugcccucccucuaucaccgagaaugugacacuugagagccucaccauggaugcugacgccaaccugaaugacgaagauuuccugccggacgaugugguccaguaccucaacucccagaaucaagcgggcuaugagcagcauuuuccuucugcccugcccgacgauagcaaggugccccacgggccuggcgacuucgaugcucccggacuuccugacucccaugccggccagcaauuucacgcucuggaacagccgugucccgaggggagcaaaacagaucucccuauccaguggaacgagguuucuuccggaagcgccgaccugucuuccagcaagcugaaaugcggccccagaccugccgugccccagacccgggcuuucggguuuuguaauggaauggucgugcacccgcaaaacccucuucgcucuggccccgcgggcggguaccagacgcucggagaaaauuccaacccuuauggcgggcccgagcaucugaugcugcacaauagcccuggauccggcaccagcgggaacgccuuccaugaacagcccugcaaggcuccgcaguacggaaauugucucaacagacaaccuguugcccccggcgcccuggauggcgcuugcggggccggcauucaggcgucuaaacuuaagagcacacccaugcagggauccgggggacagcugaacuuuggccucccuguggcuccgaaugagucugccgggagcauggucaacggaaugcaaaaucaggaccccgugggccagggcuaucuggcccaccagcugcuuggggauuccaugcaacauccuggagcuggccggcccgggcagcagaugcugggacaaaucucugccaccagccacauuaacaucuaccagggcccugaauccugucuccccggggcgcacggaaugggcucucagccuagcucccuggcuguugugcgcggcuaccagcccugcgccagcuucgggggaucuagacggcaagccaugccgagagacucccucgcucugcagagcggccagcuuucugacacaucccagaccugccgcgucaaugggauuaagauggagaugaaaggacaaccucauccccuguguagcaaccuccagaauuauuccggccaguuuuacgaucagacagugggguucucucaacaggacaccaaggccggcagcuucuccaucagcgaugcuucuugccugcugcagggaacguccgccaaaaacagcgagcuucugucuccuggcgcgaaucaagugacaagcaccgucgacucccucgauucucacgaccuggaagggguucagaucgauuuugacgccauuaucgaugacggagaucauagcucccucaugucuggcgcucugagccccuccauuauccagaaccuuagccacucuuccagccggcugaccacaccgagagccucccucccuuuccccgcucugucuaugagcaccacgaauauggccauuggggacauguccucucugcuuacaagccuggccgaggaauccaaguuucucgcugugaugcaguga

SEQ ID NO: 69774 - RNA, 801 nt, Artificial Sequence
  derived and/or modified sequence opt5 from GLIPR1__Homo_sapiens__NP_006842
augagagugacccuggccacaaucgcuuggauggucagcuucguuuccaacuacucucacacggccaauauucuccccgacaucgagaacgaagauuuuauuaaggacugcgugcggauccauaauaaauuccgcagcgaggugaagccuaccgcguccgauaugcuguauaugacaugggacccggcucuugcccagauugccaaggcuugggccucuaacugucaauuuagccacaauaccagacugaaacccccucauaaacuccaccccaacuucacaucccugggcgaaaauaucuggaccgggucugucccuaucuuuagcguguccagcgcuauuacaaacugguacgaugagauccaggacuaugauuucaagacccggauuugcaagaaaguuuguggacauuacacccagguggucugggccgacucuuauaaggugggcugcgcgguucaguuuugucccaaaguguccggguucgaugcccuuagcaauggagcucacuuuaucugcaacuacggcccugggggaaauuauccgacguggcccuacaagcgcggcgccacauguucugcuugcccuaacaaugacaaaugucuggauaaccucugcgucaauagacaacgggaccaggugaagcgcuacuauuccguggucuaccccggcuggccuauuuaucccagaaaccgguacaccagccuguuccugaucguuaacucugugauucucauccuguccgugaucauuacaauccuuguccagcacaaguauccgaaucuggugcuccuggauuga

SEQ ID NO: 69775 - RNA, 387 nt, Artificial Sequence
  derived and/or modified sequence opt5 from GLIPR2__Homo_sapiens__NP_001273939
augggcaagagcgccuccaaacaguuccacaacgaggugcugaaggcucauaaugaauacagacaaaaacacgggguucccccucucaagcugugcaaaaaccuuaaucgggaggcccagcaguauucugaagcgcuggcuagcacccgcauccucaagcauuccccggagucuagcagaggacaguguggcgaaaaccuggccugggccuccuacgaccaaacagggcacuuuacggcuauggucuggaagaauaccaaaaagaugggagugggcaaagccucugcuagcgauggguccagcuucguggucgcccgguauuuucccgcgggaaacgugguuaaugagggcuucuuugaggaaaacgugcuuccucccaagaaauga

SEQ ID NO: 69776 - RNA, 1575 nt, Artificial Sequence
  derived and/or modified sequence opt5 from GLIS2__Homo_sapiens__NP_001305847
augcacagccuggacgagccccucgaucugaagcuguccaucaccaaacugagagccgcucgggaaaagcgcgagagaacacucggcgugguccggccucgcgcccugcauagagaacuugggcugguugacgauucuccgacgcccggaagcccuggcucucccccuuccggguuccuccugaacagcaaauuucccgagaagguggaaggacgguucuccgcggcuccucugguggaccucucucugagcccgcccuccggccuugauagcccuaaugggucuuccagccugucucccgagcgccagggaaacggcgaccucccucccgucccguccgccagcgauuuucaaccucugagauaccuugacggcgugcccucuuccuuccaguuuuuccugccucucgggagcggaggcgcccugcaccuucccgcuuccucuuuucucacacccccuaaagauaagugccugagcccggaccuuccccugccuaagcagcucguuugucggugggccaaaugcaaucagcuguucgagcuucugcaagaucucguggaccaugucaacgauuaucacgugaagcccgaaaaagacgcuggguacuguugccauugggagggaugugcccgccacggcagaggguuuaaugcgcgguauaagaugcugauucacauccgcacccauaccaacgaaaaaccucacagaugccccacauguuccaagagcuucucucggcuggagaaucucaagauucauaaccgcucccacaccggagagaaaccguacguuugcccuuaugaaggcuguaauaagagauacagcaacucuagcgaccgguuuaaacacacaagaacccauuauguggauaagcccuacuacugcaaaaugccuggcugucacaagcgcuauacggaccccuccucucugcggaaacauaucaaggcccacgggcauuucgucagccacgagcagcaggaacuucugcagcucagaccucccccgaagccuccccugcccgcuccugauggaggcccguacguguccggggcccaaauuaucauccccaauccugcugcccuuuuuggaggccccgggcugccuggacucccccugccucuggcgcccggcccgcucgaccugagcgcccuugcuugcggcaacgggggaggcucugggggaggcgggggcaugggaccuggccugcccgggccugugcucccccugaaucuggccaaaaacccgcuucucccuucccccuucggagcuggcgggcugggacugccugucguuagccuccuggccggcgccgcugggggcaaggcggagggagaaaaaggccgcgggucugugcccacccgggcccuuggaauggagggccacaagacaccccuggagagaaccgaauccagcugcucccgcccuucuccggaugggcucccccugcugccuggaacagugcuugaccucagcaccggcgucaauuccgcugccucuagccccgaggcccuggcuccugggugggugguuauucccccuggcuccgugcugcucaaaccggccgucgugaacuga

SEQ ID NO: 69777 - RNA, 1719 nt, Artificial Sequence
  derived and/or modified sequence opt5 from GLIS3__Homo_sapiens__XP_006716794
augaacggcagaagcugcuccaugucucugcaccggaccagcgggacaccccagggaccucgcaugguguccggccaucacaucccggccauuagagcucauucugggacgcccggaccuagccccuguggcuccaccucuagcccuacaauggccucccucgcgaauaaccugcaccuuaagaugcccagcgggggaggcauggcuccucaaaauaacgucgccgagucucggauccaucugccggcccucagcccccgcagacagaugcugaccaauggcaaaccucgguuccagguuacacaggcugggggaauguccggcucucacacccuuaagcccaaacaacaggaauuuggguccccuuuucccccgaacccuggaaagggcgcccugggguucggaccccagugcaaaagcauuggcaagggcucuuguaauaaccucguggugacauccagcccuaugaugguccagcgccuggggcugaucuccccucccgcuucucaagugagcaccgccugcaaucagauuucccccagccuccagagagcgaugaacgccgcuaaucugaacaucccgcccucugacacgcggucccuuaucagccgcgagucucuggccagcaccacacucucccugaccgaaucucagagcgcuuccagcaugaagcaagaguggucucagggauacagagcccuuccuucccugagcaaucacggcucucagaacgggcucgaucugggagaccugcucucccugcccccuggcacaagcauguccucuaauagcguuuccaacucucuucccagcuaucuguucgggaccgaauccagccauucuccguacccuagcccccggcacuccucuacgcgcucccauagcgcgagaucuaaaaagcgggcccucagccuguccccucuuagcgauggaauuggcaucgacuuuaacacaauuauccgcaccucucccacaucccugguggcuuauauuaauggcagcagagccuccccugcuaaccucucuccccaaccggaggucuacgggcacuuccugggagugcggggcagcuguaucccucagcccagacccguuccugggucccagaaaggagugcuggucgccccgggcgggcucgcccugcccgcuuauggcgaggauggagcgcuugaacacgagcgcaugcagcaacuggaacauggcgggcuccagccuggacuggugaaucacauggugguccagcauggccuucccgggccugacucucagagcgccggacuguuuaagaccgagcggcucgaggaguuccccggcuccaccguugaucugccucccgcuccgccucugcccccucugcccccgccucccgggccucccccucccuaccacgcccaugcccaucuccaccacccggaacuuggcccccacgcucaacagcuggcccucccucaggcgacacuggacgaugacggagaaauggauggcauugggggaaaacauugcuguagauggaucgacugcucugcucuguaugaucagcaagaggaacuugugcgccacaucgagaaggugcacauugaccagcggaagggcgaggacuuuacguguuucugggccgggugccccagacgcuacaaaccuuuuaacgcccgguacaagcuccugauccauaugagaguccacagcggagaaaaacccaauaaguguaccgcugccuga

SEQ ID NO: 69778 - RNA, 1785 nt, Artificial Sequence
  derived and/or modified sequence opt5 from GLMN__Homo_sapiens__XP_011538848
auggccguggaggaacugcagagcaucauuaagagaugccaaauccucgaggaacaggacuucaaagaggaagauuuuggccuguuccagcuugcugggcagcgguguauugaggagggacacaccgaccaacugcucgaaaucauucagaacgagaagaauaaagucaucaucaagaacaugggcuggaaucugguugggcccguggugcgcugccuucuguguaaagauaaggaagacuccaagagaaaagucuacuuucucauuuucgaucugcuggugaagcucugcaaccccaaagagcugcuucugggacuccuggagcuuaucgaagaaccgucuggcaagcagauuagccaguccauccugcuccugcugcaaccccuccagacaguuauucagaaacugcauaauaaggccuauucuaucgggcuugcgcugagcacgcucuggaaccagcugucccuucugccugugcccuacucuaaggaacaaauucagauggacgauuauggacucugucagugcuguaaagcucugaucgaguuuaccaagccuuucgucgaagaggugaucgacaauaaagagaacagccuggaaaaugagaagcucaaagaugaacugcuuaaguuuugcuucaaaucccugaaguguccccuccugacagcccaauuuuucgagcagagcgaagagggcggcaacgacccuuuucgguacuucgccucugagauuaucggguuucuuuccgcuauuggacacccguuccccaagaugaucuucaaucauggccgcaaaaagagaaccuggaacuaucuggaauuugaggaagaggaaaauaaacagcucgccgauagcauggcuucucuggccuaccugguuuucgugcaggggauucacaucgaccaacucccuaugguccugagcccccuuuaucugcuccaguuuaacaugggacauaucgagguguuccugcagcggacagaggaauccgugauuucuaagggccuggagcuucucgaaaauucccugcugcgcaucgaggauaacagccuccuguaccaguaccuugagauuaaauccuuucugaccgucccucaagggcucguuaaggugaugacacugugccccaucgaaacccugagaaagaaaucucuugcgaugcuccagcuguauauuaacaagcuggacagccagggaaaauacacccucuuccggugucugcuuaauacguccaaccacagcggcguggaggccuuuaucauccagaauauuaagaaccaaaucgacaugucucugaaacgcacaagaaauaacaagugguucaccggcccgcagcucauuucccugcuggaucuuguccucuuucugccugaaggggcugagacagaccugcuccagaauagcgaucggaucauggccucucugaaccuucugcgcuaucucgugauuaaggacaaugaaaacgauaaucagaccggacuguggacggagcugggcaacaucgagaauaacuuccuuaaaccccuccacauugggcugaauaugagcaaggcucauuacgaagccgagaucaaaaacucccaagaagcgcagaagucuaaagaccugugcagcaucacaguuuccggagaggaaauuccuaacaugccucccgagaugcagcucaaggugcugcacagcgcccuuuuuaccuucgaucugaucgagucuguccucgcuagaguggaggagcugauugaaaucaagacaaaauccaccagcgaggaaaauauuggcaucaaguga

SEQ ID NO: 69779 - RNA, 555 nt, Artificial Sequence
  derived and/or modified sequence opt5 from GLO1__Homo_sapiens__NP_006699
auggccgagccccagccuccgagcggcgggcugaccgacgaagcugcccucuccugcuguucugaugcggaccccagcacaaaggauuuccugcuucaacagacgaugcugagagugaaagacccuaagaaaucccucgauuuuuacacccggguccugggaaugacacuuauccagaagugcgacuuccccauuaugaaauuuucucuguauuuccucgcuuacgaggauaagaacgacaucccuaaggaaaaagaugagaagauugccugggcccugagccgcaaagcuacccuggaacucacacacaauuggggcaccgaggacgaugagacacaguccuaucauaacggaaauucugaccccagaggguuuggccacaucgggauugccguuccugauguguacagcgcuuguaagcgguucgaggaacugggagugaaauuugucaagaagccggacgacggcaaaaugaagggccuugccuucauccaagaucccgacggguauuggaucgaaauucugaacccuaauaaaauggcgacccucauguga

SEQ ID NO: 69780 - RNA, 897 nt, Artificial Sequence
  derived and/or modified sequence opt5 from GLOD4__Homo_sapiens__NP_057164
auggccgcuagacgggcccugcacuucguguuuaaggucggcaaccgcuuccagaccgcgagauuuuaccgggacguucucgggaugaaagugcugcgccaugaggaguucgaagaaggaugcaaggcugccuguaauggccccuaugaugggaaauggagcaagacaauggugggauuuggcccugaggacgaucacuucgucgccgaacuuacguacaacuauggggugggagacuacaaacugggcaaugauuuuaugggcaucacccucgcuuccucucaagccguuagcaacgcuagaaagcuggaguggccgcuuacagagguggccgaaggggucuucgagaccgaagcgcccggaggcuauaaguuuuaccugcagaaucggucccucccucagucugaccccgugcugaaaguuacacuggccgugagcgaucuccagaagucccugaacuauuggugcaaucuucuggggaugaaaauuuacgagaaggacgaggaaaaacaacgcgcucuccugggauacgccgauaaccaguguaaacuugagcugcagggcgucaaagggggaguggaccaugcugccgcguucggcagaaucgccuuuucuugcccucagaaggaacuccccgaucuggaggaccugaugaagcgggaaaaucaaaagauucucaccccucuggugagccuugauacaccgggcaaggcuaccguccagguugugauccuggccgaccccgacgggcacgagauuuguuucgugggagaugaggcuuuucgcgaacucuccaaaauggacccugagggcagcaagcugcuugaugacgccauggccgcugauaaaucugacgaaugguucgcgaagcauaacaagcccaaagccuccggguga

SEQ ID NO: 69781 - RNA, 1392 nt, Artificial Sequence
  derived and/or modified sequence opt5 from GLP1R__Homo_sapiens__NP_002053
auggccggcgcucccgggccucugagacucgcccugcuucugcucggaauggugggccgggcggggccgcgcccccagggagcuaccgucagccugugggagacaguucaaaaguggagagaauaccggcgccagugccagagaucccuuacggaggacccucccccugccaccgaucuguucuguaaccggacauuugacgaauaugccugcuggcccgauggcgagccugggucuuucgugaaugugagcuguccgugguaccuccccugggcuuccucugucccucagggacacguguaucgcuuuugcaccgccgaaggccuguggcugcaaaaagacaacagcucccuccccuggagagaucugucugagugugaggaaagcaagcggggcgagcgcuccagcccugaggaacagcuucuguuccucuacaucauuuauacaguuggguacgcucugucuuuuuccgcccuugugaucgcgagcgccauucugcucggauucagacaucugcacugcacccggaauuauauccaucugaaccucuuugcuucuuucauucugcgcgcccuuuccgucuuuaucaaagacgcugcccugaaguggauguacagcacagcggcccagcagcaccaaugggauggccuccugucuuaccaggacucccuuagcuguagacugguguuccuccugaugcaguauugcguugcugccaauuacuauuggcugcucguggagggggucuaccuguauacccuucuggcuuuuuccgugcucucugaacaguggaucuuccggcuguacgugagcauuggauggggcgucccccuucuguuuguugugccgugggggaucgugaaauaucucuacgaggaugaaggauguuggacgcgcaacuccaauaugaacuacuggcugauuaucagacugccuauucucuucgccaucggcgucaauuuccugauuuuugugcggguuaucugcaucguggucagcaagcugaaggccaaccugauguguaaaaccgacauuaagugcagacucgcuaaaucuacacugacccugaucccccuucucggcacacaugaggugauuuucgcguuuguuauggaugaacacgcccgcgggacccugcgguucaucaagcuguuuacggagcucuccuucaccagcuuucaaggacugaugguggcuauucuuuauugcuucgucaauaacgaggugcagcuggaauuuagaaaaucuugggagcgcuggcggcucgaacaccuucauauccagagagacagcuccaugaagccucugaagugucccacaucuagccuuuccagcggcgccacagccgggucuuccauguacaccgcuaccugccaagccagcuguucuuga

SEQ ID NO: 69782 - RNA, 1662 nt, Artificial Sequence
  derived and/or modified sequence opt5 from GLP2R__Homo_sapiens__NP_004237
augaagcugggcagcuccagagccgggcccggacggggcucugcugggcuccugccuggagugcacgagcuuccgaugggcauccccgccccuugggggaccagcccccuguccuuccaucgcaaaugcucucucugggcgccuggaagacccuuucugacacuuguccugcucguuagcauuaaacaggugacgggcucccugcuggaagagaccacacggaagugggcucaauacaagcaggccugucuccgcgaccugcuuaaagaaccuucuggcaucuucugcaacgggaccuuugaucaguauguguguuggccgcacagcucccccggaaaugucagcgugccuugccccucuuaccugccuuggugguccgaggaaagcucuggcagagccuaucggcauugucucgcucaggggacauggcaaaccauugagaacgccacagacaucuggcaggaugacuccgagugcagcgaaaaucacucuuucaagcagaacguugaucgcuacgcucugcuuuccacccugcagcucauguauacggugggauacagcuuuucccugauuucucuguuccucgcccugacccuucugcucuuucugagaaaacuucauuguacacggaauuauauccacaugaaccuguucgcgagcuuuauccuccgcacccuggccguccuggugaaggacguuguguucuacaauuccuacagcaagagacccgauaacgagaauggcuggaugucuuaucucuccgaaaugagcacaucuugccggagcguccaagugcugcuucacuacuuugugggggcuaacuaucuguggcuccuggucgagggacuuuaccugcauacccuccuggagccgacgguucugccugaacgcagacucuggccccgguaucugcuucugggcugggccuucccugugcucuuugugguccccuggggcuucgcucgcgcccaccuggagaauacaggguguuggaccacaaacggaaauaaaaagauuugguggaucauuagaggccccaugaugcugugcgugaccguuaacuucuuuaucuuccuuaaaauucucaagcugcugaucuccaagcucaaagcgcaucagauguguuuucgggacuacaaguauagacuggccaaaucuacccuugugcugauuccucuccuggggguccacgaaauccuguucagcuuuaucacagaugaccagguggagggauucgcuaaacuuauucgccucuuuauccagcugacgcuguccagcuuccacggcuuucucguugcccugcaauacggguucgcuaauggagaagugaaggccgagcuucggaaguacugggucagauuucugcucgcccgccauucuggcugccgggcuugcgugcugggcaaagauuucagauuucuggggaaguguccgaagaaacuuuccgagggagacggcgcggaaaagcuccgcaaacugcagcccagccugaacucugggcggcuccugcaccuugccaugagaggacugggcgagcucggggcucagccucaacaggaucaugcccgcuggccccggggcuccagccuguccgaaugcucugagggagacgucaccauggccaacacaauggaagagauucuggaggaaagcgagaucuga

SEQ ID NO: 69783 - RNA, 1350 nt, Artificial Sequence
  derived and/or modified sequence opt5 from GLRA1__Homo_sapiens__NP_000162
auguacagcuucaacacccugagacucuaucugugggagacaaucguguuuuucucccuugccgcuucuaaggaagccgaggcggcucggagcgcccccaaaccuauguccccgucugacuuucuggauaagcucaugggccgcacgagcggguacgacgcccggauuagacccaauuucaaaggaccucccgucaacguuuccugcaauaucuuuauuaacucuuucggcagcaucgcugaaaccacaauggauuaucgcgugaauauuuuucugagacagcaauggaacgacccucggcuugccuacaaugaguaucccgaugacucccuggaucucgacccuagcaugcuggauucuaucuggaagccggaccuguucuuugcuaacgaaaaaggggcccacuuccaugagaucaccacagauaauaagcuccugcgcauuuccagaaacggaaaugugcuuuacagcauccggauuacccugacacucgcgugucccauggaccugaagaacuuuccuauggauguccagaccugcaucaugcagcuugagucuuucggcuauacgaugaaugaccugauuuuugaauggcaggagcaaggggccgugcagguugcugacggacucacccugccccaguucauccugaaagaagagaaggaucuccgcuacuguacaaaacacuacaacaccggcaaguucacaugcauugaggccagauuucaucuggaacggcagaugggcuauuaccuuauccaaauguauaucccuucccugcucauugugauccugagcuggauuucuuucuggaucaauauggacgcugcccccgcgcgcgucgggcuuggaauuaccacggugcugacaaugaccacacaguccagcggcuccagagccucucucccgaaaguuagcuacgugaaggcuaucgauaucuggauggccgucugucugcuguuuguguucuccgcucuccuggaguaugccgccgugaacuuugucagccggcagcacaaggaacuucugcgcuucagacggaaaagacgccaucacaaggaggacgaagcuggggagggacgguuuaacuucucugcguacggcauggggccugccugccuccaggcuaaagauggaauuuccguuaagggcgccaauaacagcaauaccaccaaucccccucccgcccccucuaaaagcccugaggaaaugagaaagcuguuuauccaacgcgcuaaaaagauugacaagaucucccggauuggcuucccgauggccuuucuuaucuucaacauguuuuauuggaucauuuacaaaaucgugagacgcgaggaugugcacaaccaguga

SEQ ID NO: 69784 - RNA, 1359 nt, Artificial Sequence
  derived and/or modified sequence opt5 from GLRA2__Homo_sapiens__NP_001112357
augaacagacagcuggugaauauccucaccgcccuguucgcuuucuuccuugagacaaaccacuuucggacggccuucugcaaggaccaugauagccgcuccggcaaacaacccucucagacccugagcccuuccgacuuucucgauaagcugauggggagaacaucuggauacgacgcgcggauucgcccgaauuucaaagggcccccugucaacguuaccuguaauaucuuuauuaacagcuucggcuccgugacagaaaccacaauggauuauagagugaauaucuuucuucggcagcaguggaacgacucucgccuggcuuacagcgaguaucccgaugacucccucgaucuggacccuagcaugcuggauucuauuuggaagcccgaccucuucuuugccaaugaaaaaggagccaacuuccacgaugucaccacggacaauaagcugcuuagaaucuccaagaacggcaaagugcuguacagcauccggcucacccugacacuuucuugcccuauggaccugaagaauuuuccgauggauguucaaaccuguacaaugcagcucgaguccuucggguauaccaugaacgaccugauuuucgaauggcugagcgauggacccgugcaggucgcugagggccucacgcugccucaguuuauccuuaaagaggaaaaggagcugggcuacugcacaaaacauuauaauaccgggaaguucacauguauugaagugaaguuucaccucgagcgccaaaugggauacuaccugauccagauguauauucccucucuucugaucguuauucucuccugggugagcuucuggaucaacauggacgccgcuccugccagagucgcgcugggcaucaccaccgugcugacaaugacgacccaguccucugggagccgggccucccuccccaaagugagcuacgucaaggcuauugauaucuggauggccguuugccugcuuuuuguguucgcugcccugcucgaguaugcggccgugaacuuugucucucgccagcauaaagaauuucugagacuucggcgcagacaaaagcggcagaauaaagaggaagacgugacaagagagucccgcuuuaacuucagcggauacggcauggggcacugucugcagguuaaggauggaaccgcugugaaagccacaccggcuaauccucucccccaaccucccaaggacggcgaugccauuaagaaaaaguuugucgaccgggccaaaagaaucgauaccauuucucgcgcugcguucccccuggccuuucugaucuucaacaucuucuauuggauuacguacaagaucauucggcacgaagacgugcauaaaaaguga

SEQ ID NO: 69785 - RNA, 1350 nt, Artificial Sequence
  derived and/or modified sequence opt5 from GLRA3__Homo_sapiens__NP_001036008
auggcccacgugagacauuuccggacccuggucagcggcuuuuacuucugggaggcugcccuccugcuuucccugguugcgacaaaggaaacggacucugcucgcagcagauccgcccccaugucuccuagcgauuuucucgacaaacugauggggcggaccuccggauaugaugcccgcaucagaccgaacuucaaggggcccccugugaaugugacaugcaacauuuuuaucaauucuuucggcagcauugcugagaccacaauggacuaccgggucaacaucuuucuucgccagaaauggaaugaucccagacuggccuauuccgaauacccugacgauagccucgaccuggaucccucuaugcuggacuccauuuggaagccugaucucuucuuugcuaacgagaaaggagccaauuuccacgaagugaccacagacaacaagcugcuucggaucuuuaagaauggcaacguucuguauagcauccgccucacccugacgcuuucuuguccgauggaucugaaaaauuuccccauggacgugcaaaccugcauuaugcagcucgaguccuuuggguacacaaugaacgaccugaucuucgaguggcaggaugaagcgccuguccagguggccgagggacugacccucccccaauuccugcuuaaggaagagaaagaccugagauauuguacaaagcauuacaauaccggcaaauuuacgugcauugagguucgguuccaccucgaacgccagaugggcuacuaucugauccagauguacauuccuagccuucugaucgugauucucucuugggucuccuuuuggaucaacauggaugcugcccccgcuagaguggcccuggggaucacaaccgugcugacaaugaccacccagagcuccggaucucgggcgagccucccgaaggucuccuauguuaaggccauugacaucuggauggcugugugucugcuuuucguguuuagcgcccugcucgaguacgcugccgucaauuucgugucucgccaacauaaagaacugcuuagauuucggagaaagcgcaaaaacaaggaugacgagguucgggaauccagauucagcuuuacagccuauggcauggggccuugccugcaggcuaaagauggaaugacgcccaagggcccuaaccaccccgugcaggucaugcccaaaucuccugacgagaugcgcaagguguucauugaucgggcgaagaaaaucgacaccauuagcagagccuguuuuccgcucgcuuuccugaucuuuaauaucuucuacuggguuauuuauaagauccugcgccacgaggauauucaucagcaacaggacuga

SEQ ID NO: 69786 - RNA, 1494 nt, Artificial Sequence
  derived and/or modified sequence opt5 from GLRB__Homo_sapiens__NP_001159532
augaaguuccugcucaccacagccuuucugauccuuauuagccuguggguggaggaggcuuacuccaaagaaaagucuagcaaaaagggcaaagggaagaagaaacaguaucucugccccucccaacagucugccgaagaccuggcgagagucccugcuaacagcacguccaauauccuuaaccggcugcucguuucuuacgauccgcgcauuagacccaauuucaagggaaucccuguggacguggucgugaacauuuuuaucaauagcuucggcuccauccaggagaccacaauggauuaucggguuaacauuuuucugcgccagaaauggaaugaccccagacugaagcucccuagcgauuuccgggggucugacgcccugaccguggaucccacaauguacaaaugucuuuggaagccugaccuguuuuucgccaacgaaaaguccgcuaauuuucacgaugucacccaagagaacauccuccuguucauuuuucgcgacggagaugugcuuguuagcaugagacugucuaucacacucuccugcccgcuggaccugacccucuuccccauggauacgcagcgguguaaaaugcagcuggagagcuuuggcuauaccacagacgaccuucgcuucauuuggcagucuggggauccugugcaacuggaaaagaucgcccucccccaguucgacauuaaaaaggaggauaucgaauacggaaauugcaccaaauauuacaagggcacaggcuacuauaccugugucgaggugaucuuuacgcugagacgccaggugggguucuacaugaugggagucuaugcuccuacacuucugauuguugugcucuccuggcugagcuuuuggaucaaccccgacgccuccgcggcccgggugccgcugggcauuuucucuguccucagccuggcuuccgagugcaccacacuugccgcugaacugccuaaagugagcuacguuaaggcccucgauguguggcugaucgcgugucuucuguuuggguucgccucucucgucgaguaugcugugguucaggugaugcugaauaaccccaagagagucgaagccgagaaagcucggauugccaaggccgaacaagcugacggaaaaggcgggaauguggcgaagaaaaacaccgucaacggaaccggcacaccugugcauaucuccacgcugcagguuggcgagacccgcugcaagaagguguguacaagcaaaucugaucucagaagcaaugacuuuuccaucgucgggucucugccccgggauuucgagcuuagcaacuacgacugcuauggaaagcccauugaagugaauaacggccuggggaaaucccaggccaagaauaacaaaaagccuccgcccgcuaagccuguuauccccaccgccgccaaaagaauugaucucuacgcucgcgcccuguuuccuuucuguuuucuguucuuuaaugugaucuacuggagcauuuaucuuuga

SEQ ID NO: 69787 - RNA, 498 nt, Artificial Sequence
  derived and/or modified sequence opt5 from GLRX2__Homo_sapiens__NP_057150
augaaccccagagacaaacaggugagccgguucuccccucugaaggaugucuacaccuggguugcccucgcuggcauccaacgcucugggagcccgggaagaacacgguccgccgcgcgcagaauggagucuaauacgagcuccucucuggaaaaccuugcuaccgcccccgugaaucagauucaggagacaaucagcgacaacugcguggucaucuuuuccaagaccagcuguucuuauugcacaauggccaaaaagcuguuccacgauaugaaugugaacuacaaaguuguggaacucgaccugcuugaguauggcaaucaguuucaagaugcucuguacaagaugaccggggaacggacagucccucgcauuuucgugaacggaaccuuuauuggcggggccacggacacccauagacuccacaaggagggaaaacugcugccccucguucaucaguguuaucugaagaaauccaagcggaaagaguuccaguga

SEQ ID NO: 69788 - RNA, 1008 nt, Artificial Sequence
  derived and/or modified sequence opt5 from GLRX3__Homo_sapiens__NP_006532
auggccgcuggcgccgcggaggcugccguggccgcugucgaagagguugggagcgccggacaguucgaggaacugcucagacugaaggcuaaaucccuucugguggugcacuuuugggcccccugggcgccucaaugcgcccagaugaacgaagucauggcugagcucgccaaggagcugccccaggugucuuucguuaaacuugaagcugagggcgugccggaagucagcgagaaguacgagaucuccucugugccuaccuuucuguucuuuaaaaauagccagaagauugaccggcucgauggggcccaugcgcccgaacugacaaagaaaguucaacgccacgccuccucuggcagcuuccugccuuccgcuaacgagcaucucaaggaagaccugaaucuuagacugaaaaagcucacgcacgccgcucccuguaugcuguuuaugaaaggaaccccucaggagccgcggugcggguucagcaagcagaugguggaaauccuucauaagcacaacauucaguuuucuuccuucgauaucuuuagcgacgaggagguccgccaaggacugaaagccuauucuuccuggcccacauacccucagcucuaugugagcggcgaacugauuggcgggcuggauaucaucaaggagcucgaagccucugaggaacuggacaccauuugucccaaagcuccuaagcuggaggagagacugaaagugcucacaaauaaggcguccgucaugcuguucaugaaaggaaacaagcaggaagccaagugcggcuuuagcaaacagauccuugagauucuuaauuccaccgggguugaauacgagacauucgauauccucgaagacgaggaggugcggcaaggacugaaggcuuauucuaacuggcccaccuacccgcagcuguaugugaaaggcgaacucgucgggggacuggauauugugaaggagcuuaaagaaaauggcgagcugcucccuauccugcgcggcgagaacuga

SEQ ID NO: 69789 - RNA, 474 nt, Artificial Sequence
  derived and/or modified sequence opt5 from GLRX5__Homo_sapiens__NP_057501
augagcggcucccuggggagagccgcugccgcgcuccugcgguggggacgcggcgcugggggaggcgggcuuuggggacccggcgugagagccgccggcucuggggcuggaggcgggggaagcgccgagcagcuggacgcucucgucaagaaagauaagguugugguguuccugaaaggcaccccugaacaaccgcagugcggguuuuccaacgccgucgugcagauccuucggcugcacggaguucgcgacuacgcggccuauaaugugcucgaugaccccgagcugagacagggcauuaaggauuacucuaacuggccuacaaucccccaagucuaucugaauggcgaguucguugggggaugugacauucuccugcagaugcaucagaacggcgaucuuguggaagaacugaaaaagcucgggauccacagcgcucugcuugacgagaagaaagaucaggacuccaaguga

SEQ ID NO: 69790 - RNA, 321 nt, Artificial Sequence
  derived and/or modified sequence opt5 from GLRX__Homo_sapiens__NP_001230588
auggcccaggaguucgugaacugcaagauccaacccggcaaagucguuguguuuauuaagccuaccuguccguacugcagacgggcucaggaaauccugagccagcuccccauuaaacaggggcugcuugaguucguggacaucacagccacgaaucacaccaacgaaauucaagauuaucugcagcagcucacaggagcgcgcaccgucccuagaguguuuaucggcaaggacuguaucgggggaugcuccgaucugguuucucuucagcaaagcggcgagcugcucacacggcugaaacagauuggggcucugcaguga

SEQ ID NO: 69791 - RNA, 1809 nt, Artificial Sequence
  derived and/or modified sequence opt5 from GLS2__Homo_sapiens__NP_037399
augagaagcaugaaggcccugcagaaagcucucucccgggccggcucucacugcgggcgcggaggcugggggcaucccagcagauccccucugcuuggaggcggggugcggcaccaucugucugaggcggcugcccaaggacgcgaaaccccgcacagccaucagccccagcaccaggaccacgauuccucugagagcggcaugcucuccagacugggcgaccuucuguucuacacaaucgccgaagggcaagagcggauuccuauccauaaguuuacgaccgcucucaaagccacaggacugcagaccagcgauccccgccugagagacuguaugucugaaaugcaccgggucguucaggaguccagcucuggcgggcuccuggaucgcgaccuuuucagaaagugcguguccagcaacauugugcugcucacacaggcuuuucggaaaaaguucgucaucccugauuuugaggaguucaccggacauguggaccgcauuuuugaagauguuaaggaacugacaggcgggaaaguggccgcguauaucccccaacuugccaagucuaauccugaccuguggggagucucccucuguaccguggauggccagagacacagcguuggccacacgaaaaucccguucugccugcaguccugugugaagccccugaccuacgcuauuucuaucagcacacucgggaccgacuauguccauaaauuugugggaaaggagccuuccggccugcgguacaacaaacuuagccugaaugaggaagggauuccccacaacccuauggugaaugccggagcuaucgucguuucuucccucauuaagauggauugcaacaaggccgagaaauucgacuuugugcugcaguaucuuaauaagauggcgggcaacgaauacaugggguucagcaaugccacauuucaaucugagaaagaaaccggagaccgcaacuaugcuaucggcuacuaccugaaggagaaaaaguguuuccccaagggcguggauaugauggccgcucucgaccuguauuuccagcugugcagcgucgaggugacgugugaauccgggucuguuauggccgccacacucgcuaauggaggcauuugcccgaucaccggggagagcgugcuguccgcggaagccgucagaaacacacuuagccugaugcauucuuguggaauguacgauuuuuccggccaguucgcuuuucacguggggcucccugccaaaagcgccguuucuggcgcuauccugcuugugguccccaaugugaugggaaugaugugccuguccccuccccucgacaagcugggcaacagccaucgggggaccuccuucugccaaaaacuggucucucucuuuaauuuccacaacuaugauaaccugagacacugugcccgcaaacuugacccccggagagagggagcggaaauucgcaauaagaccgugguuaaccugcucuuugcugccuacagcggcgauguguccgcccugcggagauucgcucugucugccauggacauggagcagaaggauuaugacagccgcacagcccuucaugucgcugcggccgaggggcacaucgaagugguuaaguuucucauugaggcuugcaaagugaauccuuucgccaaggaucgguggggaaacaucccgcuggacgacgcuguccaguuuaaucaucuggaaguggugaaacuccugcaggauuaccaagacuccuauacgcuuagcgagacccaggccgaagcggccgcugaggcccugucuaaggagaaccucgaauccaugguuuga

SEQ ID NO: 69792 - RNA, 1797 nt, Artificial Sequence
  derived and/or modified sequence opt5 from GLS__Homo_sapiens__NP_001243239
augaugagacugcggggcagcgggaugcuccgcgaccugcuucugagaucccccgccggagugucugcuacccuccggcgcgcccagccucuggucacacuuugcagacggccgcgcggcgggggaagacccgcggcuggcccugccgccgcugcccggcugcaccccugguggggaggaggcggcuggccugcugagccccucgcccgcgggcugagcuccucuccuagcgaaauccugcaagagcucggaaagggcuccacgcauccgcagcccgggguuucuccucccgcggccccugcugcccccggaccgaaagauggcccuggggaaaccgacgcuuucggaaacagcgagggcaaggaacugguggccuccggcgagaauaaaauuaagcaggggcuucugcccagccucgaggaucugcuguuuuacacaaucgcggaaggacaggagaaaauuccugugcacaaguucaucaccgcccuuaagucuacaggccucagaaccuccgacccccggcugaaagaauguauggauaugcugcgccucacacugcaaaccacgagcgacggggucaugcuugauaaggaccuguuuaaaaagugcgugcagucuaacauuguucuccugacccaggcuuucagacggaaauuugugauccccgauuucauguccuuuacaagccauaucgacgagcuuuaugagucugccaagaagcaguccggaggcaaagucgcugauuacauuccucaacuggccaaguucagcccggaccucuggggaguguccguuuguaccguggaugggcagcgccacucuacaggcgacaccaaaguccccuuuugccugcagagcugugugaagccucugaaauaugccaucgcugugaaugaccucggcacggaauacguccauagauauguugggaaggagcccuccggacugcgguucaacaaacuuuuucugaaugaagaugacaagccucacaaccccauggugaaugcgggcgccauuguggucacaagccucaucaagcagggggugaacaaugcugagaaauucgauuacguuaugcaauuucugaacaagauggccggaaaugaauaugugggcuucucuaacgccaccuuccaguccgagagagagagcggggaccgcaauuuugcuauuggcuacuaccuuaaagaaaagaaaugcuucccggagggaacagauauggucggcauccuggacuuuuauuuccagcucuguucuauugaagugaccugcgagagcgccuccguuauggcggcuacccuggccaacgggggauuuuguccuaucacaggcgaacgggugcugucucccgaggccgucagaaauacgcucagccugaugcacuccugcgggauguacgauuucagcggacaauuugcuuuccaugugggccuuccugccaagucuggggucgcuggcggaauccugcucgugguucccaacgugaugggcaugauguguugguccccuccccuggacaagauggggaacagcgucaaagggauucacuuuugccaugaucuggugucucuuugcaauuuccacaacuaugacaaucuccgccacuuugccaagaaacuggauccgcggagagagggcggggaccagcgccauuccuucggaccucuggacuacgaaagccuccagcaggagcuggcgcuuaaggaaaccguuuggaaaaaggugucccccgagucuaacgaagauaucagcacaaccgucguguaucggauggagucccugggcgagaagucuuga

SEQ ID NO: 69793 - RNA, 801 nt, Artificial Sequence
  derived and/or modified sequence opt5 from GLT1D1__Homo_sapiens__NP_653270
augagacuccuguuccuggccgugcuucggccccacaccggcaacgcugucacagcccagcgcguuagagcgcaucuggaggcugccgggcacgugugcgugcucaaggacgccuuugauuucgaaagccgguccgagaucgcuaaucugauucuugccgaaaacugugaggcugcccuggcgcuccaucuguaccgcggaggcagacugcuccaagggcaccggaucccuuuuggagucauuuucggcgggacggacgugaaugaagaugccaaccaggcugagaaaaauaccguuaugggacgcgugcuggaggaagccagauuugcugucgccuucacagagucuaugaaggaaauggcgcaggcccaguggguggacccgguuuuuacccgggaggugaaagcuaaggucaaacgcgccgcuggcgugagacuuaucggcgagaugccccaagaagaucugcaugccguggucaagaacugcuucgccguugugaauagcuccgugucugaggggaugagcgcugcgauucucgaagccauggaccuggaggucccugugcuugcucggaacauccccggaaaugccgccguugugaagcacgaagucacaggccugcucuuuuccaacccucaggaguucgugcaccuggcuaaacgccugguuucugaucccgcccucgagaaggaaaucguggucaaugggagagaguaugugcggauguaccauagcuggcaggucgaacgcgacaccuaucagcaacugauuagaaaacuugagggauccacagaagauuga

SEQ ID NO: 69794 - RNA, 831 nt, Artificial Sequence
  derived and/or modified sequence opt5 from GLT6D1__Homo_sapiens__XP_011516939
augaacagcaagagaaugcugcuccuggugcuuuucgccuuuucccugaugcucgucgagcgguacuuccgcaaucaccagguugaggaacugagacuuucugacugguuucauccccggaaacgcccugaugugaucaccaagacagacuggcuggcuccggugcucugggaaggcacguucgauagacggguccuggagaaacacuaucgcagacggaacauuaccguggggcuggccguuuuugcgacaggacgcuucgcugaagaguaccucagacccuuucugcauagcgccaauaagcacuucaugaccggcuaucgggugaucuuuuacauuauggucgacgccuucuuuaaacuuccugauaucgagcccuccccucugcgcacauucaaggcuuuuaagguggggaccgaaagaugguggcucgacggaccccugguucaugugaaaucucuuggcgagcacauugccagccacauccaagaugaagucgacuuccuguucuccauggcugccaaccagguguuucagaaugaguucgggguggagacacucggaccucuggucgcgcagcugcaugccuggugguauuuucggaacaccaagaauuucccguacgaacgcagacccacgucugcugccugcaucccuuuuggccaaggcgauuucuauuacgggaaccucaugguuggaggcacaccccacaauauucuggacuuuaucaaagaguaccuuaacggggugauucaugauaucaagaauggacugaacagcaccuaugaaaaacaccucaauaaguacuucuaucugaacaagccuaccuga

SEQ ID NO: 69795 - RNA, 1116 nt, Artificial Sequence
  derived and/or modified sequence opt5 from GLT8D1__Homo_sapiens__NP_001010983
augagcuucagaaaggugaacaucauuauccugguccucgccguugcucuguuucuucuggugcuccaccauaauuuccugucccuuucuagccugcuccggaacgaggugaccgacuccggcauugucgggccccagccuaucgauuuugugccgaaugcccugcgccacgcgguugacggaagacaagaagagauucccguggucaucgcugccucugaagaucggcugggcggggccaucgcugccauuaacagcauccagcauaauacacgcuccaacgugauuuucuacaucguuacgcucaauaacaccgcugaccaccugagaucuuggcuuaauagcgauucccugaaaagcauucgguauaagaucgugaacuuugacccuaaacuccuggagggaaaggucaaagaagaucccgaccagggcgagucuaugaagccucuuacauucgcccgcuuuuaccugcccauucucgugccuuccgcgaagaaagccaucuauauggaugacgaugugaucguccagggggacauucuggcucuguacaauaccgcccucaagccgggacaugcugccgcguucagcgaggauugcgacucugccuccacaaaaguugugaucagaggcgcuggcaaccaauauaauuacauuggguaucuggacuacaagaaagaacggauccgcaaacuuagcaugaaggccucuaccuguuccuuuaaccccggaguguucgucgcuaaucugacagaguggaagagacagaacauuaccaaccagcucgaaaaguggaugaaacugaauguggaggagggccuuuacagccggacgcuggccggguccaucaccacaccuccccuccugaucguguuuuaucagcaacacucuaccauugauccuauguggaacguucgccaccugggaagcuccgccggcaagagauacagcccccaguucgucaaagcugcgaagcuccugcauuggaaugggcaccuuaaaccguggggacggacagccucuuauaccgacgugugggaaaagugguacaucccugaucccacgggcaaguuuaaccugauucgcagauauacagagaucuccaauauuaaauga

SEQ ID NO: 69796 - RNA, 4683 nt, Artificial Sequence
  derived and/or modified sequence opt5 from GLTSCR1__Homo_sapiens__XP_005258890
auggacgaugaggacggcagaugccugcucgaugugaucugugacccccaggcccugaacgauuuccuucacgggagcgaaaagcuggacuccgaugaccuccuggauaauccuggagaggcucaaucugccuuuuacgaaggcccggggcuucauguccaggaggcgagcggaaaccaccugaaucccgaaccuaaccagcccgcuccuuccguugaccucgauuuccuggaggacgauauucugggcucucccgccaccgggggaggcggcgggggaagcggcggggccgaccagccuugcgacauccuccaacagucccugcaggaggcuaauauuacagaacagacgcuugaggccgaagcugagcuggaucucggaccguuucaacugcccacccuucagccugccgacggcggggcgggacccacaggcgccggcggggcugccgcuguggccgcgggaccucaggcccuguuccccggcucuaccgaucuccuggggcugcagggaccgccuacagugcucacccaucaagcucuggugcccccucaggacgucguuaacaaagcccuuagcgugcagcccuuucugcaacccgucggccucgggaaugugacacugcagccuaucccgggacuucagggccugcccaacggcuccccugggggagcuaccgccgccacgcucggccuggcucccauucagguuguggggcaaccugucauggcgcugaauacccccacaagccagcuccuggccaaacaggugccggugucuggauaucuugcuuccgccgccggcccuagcgagcccgucacccuggcuucugccgggguuuccccucagggcgcgggacucgugauccaaaagaaccugagcgcugccguggccacaacccuuaauggcaacucugucuucgggggagcuggcgccgcuuccgcccccacggggacaccuagcggacagccccuggcgguggccccgggccucggguccucuccucugguucccgcucccaaugugauccugcaccggaccccuacaccgauucagcccaagccugccggcguccugcccccuaaacucuaccagcuuacccccaagccuuuugcucccgccggagcgacccugacaauccaaggcgaaccgggggcccucccucagcagcccaaggcuccucagaaccugacguucauggccgcuggaaaagccggccaaaaugugguucugagcggguuucccgccccggcccuucaggcgaacguguucaagcagccucccgccaccacaaccggagcugccccuccccaacccccuggcgcccucuccaaaccgaugagcguccaucugcugaaccaggggucuuccauugugauccccgcucagcacaugcucccuggccagaaucaauuucugcuucccggagccccugcgguccagcugccccagcagcucagcgcucugccugccaacgugggcgggcaaauucuggccgcugccgcgccgcacacaggaggccagcuuaucgcuaaucccauucucaccaaccagaaucuggccgggccucugucucucggacccguucuggccccucauagcggcgcucacuccgcccauauccuuucugcugcccccauccagguggggcaaccggcgcuguuccagaugccugucagccucgccgcuggcucccugcccacgcagagccaacccgccccugcuggacccgccgccacaaccgugcugcagggcguuacccuuccuccgucugcuguggcgaugcucaacacacccgaugggcugguccagccugccacccccgcugccgccacaggagaggcugccccugugcugacggugcagcccgcgccgcaagcuccucccgccguuuccaccccucucccccugggccuucagcagccucaggcccaacagcccccgcaggcuccuacaccccaggccgcggcucccccucaagccaccacaccgcagcccagcccugggcuggccucuucccccgaaaagauuguccucggacagccucccagcgcuaccccuacggccauccugacccaggacucccugcaaauguuucuuccgcaggagcgcucucagcaaccccucagcgcugaaggcccucaccuguccgugcccgccucugugauugucagcgcgccucccccggcccaggauccugcucccgccacacccguggcuaaaggcgccgggcugggaccucaggcccccgacucccaggcuagcccugcgccggccccucaaauccccgcugccgcuccccucaagggcccugggcccucuuccagcccgucucugccucaccaggcuccccuuggagauuccccucaucugcccagcccucaccccaccagaccgccuucucggccucccagccgcccccaguccguuagcagaccgcccucugagccuccccuccauccuugucccccuccccaggccccgccuacacugcccggcauuuucgugauccaaaaucagcugggggucccucccccggcguccaacccugcucccaccgcccccggaccuccccagccuccgcuucggccccagagccaaccucccgagggcccucugcccccugccccgcaccucccucccuccucuacgagcuccgcuguggccucuagcuccgaaacaucuagccgccugcccgcgccuacccccuccgacuuccagcuccaguuuccgccuagccaaggcccccauaagucucccacaccucccccuacccugcaccuuguuccggagcccgccgcuccucccccucccccgccuagaaccuuccagauggugacaacgcccuuuccugcccugccccagccgaaagcucuccuggaacgguuccaccaggucccuuccgggaucauucugcaaaauaaggccggaggcgcucccgccgcgccccagaccagcacaucucuugggccucugaccucccccgccgcuagcgugcucguuucuggacaggccccuuccggcacaccgaccgcucccagccaugccccugcccccgcuccuauggcggccacggggcugcccccucuccugccggcugagaacaaagccuuugccuccaaucuucccacacugaacguggcuaaggccgcgagcucuggaccuggcaaacccagcggccuccaguaugaauccaagcugucugggcugaaaaagccucccacccuucaaccgagcaaggaggccugcuuccuggagcaccuccauaaacaccagggauccguccugcacccugauuacaagaccgcuuuucccucuuucgaagacgcccuccaucgccugcuucccuaucacguguaccagggcgcucugccuagccccuccgacuaucauaaaguggaugaggaauuugagacagucucuacccagcugcucaagagaacacaagccaugcugaauaaauaccggcuucugcuccuggaagagagccgcagaguuuccccuagcgcggagauggugaugaucgaccggauguucauucaggaagagaagacgacccucgcccuggauaagcagcuugcuaaagaaaagccggacgaguacgugucuuccagccgcucucuggggcugcccaucgccgcuuccagcgagggacacagacucccuggccaugggccccuguccucuagcgccccuggagcuuccacacagcccccgccucaccuucccaccaaacuggucauucggcacggcggcgccgggggaagcccuucugugacaugggcgagagccuccagcucucucagcuccucuagcuccucuagcuccgcugccagcucucuggaugcugacgaagauggccccaugccuucccgcaaccggcccccgaucaagaccuaugaggccagaagccgcaucgggcucaaacugaagauuaagcaagaagccggacuuuccaaaguugugcauaauacggcgcuggaccccguccaccagccucccccuccgcccgcuacccugaagguggccgagccucccccucggcccccucccccgccucccccuacaggccagaugaacgggaccguugaucaucccccgccugcugcccccgaaagaaaaccccucggaacagccccucacuguccccgccugccucuucggaagaccuacagagagaacgugggcggcccgggggcucccgagggaaccccugccggccgcgcgagagggggaucucccgccccucugcccgcuaaagucgacgaagccacaagcggccucauccgggagcuggcugccguggaagaugagcucuaucaacgcaugcugaaggggccgccucccgaaccugcggccuccgcugcccagggaacgggcgaccccgauugggaggcuccuggccuucccccggccaagcggagaaaaucugagagccccgacguugaccaggcuuccuuuagcucugauuccccucaggacgauacacugaccgaacaucugcaaagcgccauugacucuauccucaaucugcagcaggcgcccgggcggaccccugcccccuccuacccucacgcugccagcgcuggaacaccggccucucccccuccccuucaccgcccugaggccuaucccccgagcucccauaacggcgggcugggagcgagaacccucacgcgguga

SEQ ID NO: 69797 - RNA, 1437 nt, Artificial Sequence
  derived and/or modified sequence opt5 from GLTSCR2__Homo_sapiens__NP_056525
auggccgcuggcgggagcggagugggcgggaagagauccucuaaaagcgacgccgauuccggauuccugggccuccggcccaccucugucgacccugcgcugcgcagacggcgcagagggccgcggaacaagaaacgcggauggagacggcuugcucaggagccccugggccucgaaguugaucaauuucuggaggacgugcgccuucaggaaagaacaagcggcgggcugcucuccgaggccccuaaugaaaagcuguucuuuguggauacgggaucuaaagagaagggccugaccaagaaacggacaaagguccagaaaaagagccuccugcuuaaaaagccccugcgcguggaccucauccuggagaacaccuccaagguuccugcccccaaagaugugcuugcucaccaggucccuaaugccaagaaacugagacggaaggaacaacucugggagaaacuggcuaagcagggggaacugccgcgcgaggugagacgggcccaggcgagacuccugaaccccagcgccacacgcgcuaaaccuggaccccaggacaccguugagcggccuuucuacgaucuuugggccucugacaauccccuggauagaccgcucgugggccaagacgaauuuuuccuggagcagacaaagaagaaaggggucaagcgcccugcucggcuucauaccaaacccucccaggccccugcgguggaaguggcccccgcuggagccagcuauaaccccucuuuugaggaucaccagacgcugcucuccgcugcccaugaagucgagcugcaaagacagaaggaggccgaaaaacuggagcgccagcucgcucugccugcgaccgaacaagccgcuacacaggagagcaccuuccaggaacuuugcgagggccugcucgaggaaucugacggcgagggggaaccgggacagggcgaggggcccgaagccggagacgccgagguuuguccuacacccgcucggcuggccaccacggagaagaagacagaacaacagagacgccgggagaaagcggugcacagacuucgcgugcagcaggcugcccugcgggccgcuagacuccggcaucaagaacuguuucgccugagaggcauuaaggcccaggucgcucuccggcuggccgagcuugcgagacgccagcggagacgccaggccagacgggaggcugaagccgauaaaccucgcagacuggggcggcucaaguaccaagcucccgacaucgaugugcagcuguccagcgagcugaccgacucccuucgcacacucaaaccggaaggaaauauucugagagaucgguucaagucuuuucagcgcagaaacaugaucgagccucgggaacgcgccaaguucaaaagaaaguauaaaguuaagcugguggagaaacgggcguuuagagagauucagcucuga

SEQ ID NO: 69798 - RNA, 1677 nt, Artificial Sequence
  derived and/or modified sequence opt5 from GLUD1__Homo_sapiens__NP_005262
auguacagauaucugggcgaggcccuccugcuuagccgggcugggcccgccgcgcugggauccgcuucugccgacagcgccgcucuccugggcugggcccgcgggcagccugcugccgcgccgcaacccggacuugcccuggcugccagacggcacuacuccgaagcuguggccgaucgcgaggacgauccuaacuucuuuaagauggucgaaggcuucuuugacagaggggcgucuaucguugaggauaaacucguggaagaccugcggacccgcgagagcgaggaacagaagagaaaucgggugcgcggcauucugagaaucauuaaacccugcaaccauguccucucccugucuuucccuauccggcgcgaugacggaagcugggaggugauugaaggcuauagagcccagcacucccagcaucggacacccuguaaagggggaauccgcuacagcacggauguuucuguggacgaggucaaagcucuugccucccugaugaccuauaagugcgcugugguugaugugccuuuuggcggggccaaggccggagucaaaaucaauccgaagaacuacacagacaaugagcucgaaaagauuaccagacgguucacaauggagcuggcuaagaaaggcuuuaucgggcccggaauugaugugccugcgcccgacaugagcaccggcgaaagagagaugucuuggaucgccgacacauaugcuuccaccauuggccacuacgauaucaacgcccaugccugugugacggggaagccuauuagccaaggaggcauccacgggcgcaucucugcuaccggacggggcgucuuccacgggauugaaaauuuuaucaacgaggccuccuacaugagcauucuuggaaugacacccggcuucggcgacaagaccuuuguugugcagggguucggaaaugugggccugcauuccaugagauaucuccaccgcuuuggggcgaaaugcaucgcugucggagagucugauggcagcauuuggaacccggacgggaucgauccuaaggaacuggaggacuucaaacugcagcauggcuccauccucggauuccccaaggccaaaccuuacgaaggcagcauucuggaggccgauugugacauccuuauucccgcugccucugaaaagcagcugacaaaauccaaugcuccccgggugaaggccaagaucauugcggagggggccaacggaccuaccacgccggaggcugauaaaaucuuucucgaaagaaauaucaugguuauucccgaccuguaucuuaacgccggcggggugacagucagcuacuucgaguggcugaagaaucucaaccacgugucuuauggacgccugaccuuuaaauacgaacgggauagcaacuaucaucugcucauguccguucaagagucucuggaaagaaaguucggcaaacacgggggcacaaucccuauugugcccaccgcugaguuucaggaccgcaucagcggagccuccgagaaggacauuguccacagcggccuugcguacaccauggaacggucugccagacagaucaugcgcacagcuaugaaguacaaucuggggcucgaucugcggacggccgcuuaugugaacgccauugagaaagucuucaagguguacaaugaagccggaguuaccuuuacauga

SEQ ID NO: 69799 - RNA, 1677 nt, Artificial Sequence
  derived and/or modified sequence opt5 from GLUD2__Homo_sapiens__NP_036216
auguacagauaucuggccaaggcucuccugcccagccgggccggcccugcggcucuuggguccgccgccaaccacucugcugcccugcucggacgcggcagagggcagccggcugccgcgagccaacccggacuggcccuugcugcccggcgccauuacuccgagcugguggcugacagagaagaugacccuaauuucuuuaaaauggucgagggcuucuuugaucggggagccucuaucguugaagacaagcucgugaaagaucugcgcacccaggagagcgaagaacagaagagaaaccgggugcgcgggauucugagaaucauuaaacccugcaaucacguccucucccugucuuucccuauccggcgcgacgauggcagcugggaggugauugaaggcuauagagcgcagcauucccaacaccggacacccuguaaagggggaauccgcuacagcacggacguuucuguggaugaggucaaggcccuugcuucccugaugaccuauaagugcgccgugguugacgugccuuuuggcggggcuaaggccggagucaaaaucaacccgaagaauuacacagaaaacgagcucgagaaaauuaccagacgguucacaauggaacuggccaagaagggcuuuaucgggcccggaguggaugugccugcucccgacaugaauaccggcgagagagaaaugagcuggauugcggauacauaugccucuaccaucggccauuacgacauuaacgcucacgccugugucacggggaaaccuaucucccagggaggcauucacgggcgcaucagcgccaccggacggggcguuuuccaugggaucgagaauuuuauuaacgaggcuucuuacauguccauccuuggaaugacacccggcuucagagacaagaccuuuguggugcagggcuucgggaaugucggacugcacagcaugcgcuaucuccaucgguuuggcgccaaaugcauugcggugggggaguccgauggaucuaucuggaacccggacggcauugauccuaaggagcuggaagacuucaaacugcagcacgggagcauccucggcuuccccaaggcuaaaccuuacgagggauccauccuggaaguugauugugacauucuuauccccgccgccacagagaagcaacugaccaagagcaaugcucccagagugaaagccaagauuaucgcugaaggcgccaacgggccuacgacaccggaggcggauaaaauuuuucucgagcgcaauauccuggucauccccgaccuuuaucugaacgccggaggcgugaccguuucuuacuucgaauggcucaagaaccugaaucacguguccuaugggcggcugacauuuaaauacgagagagauagcaacuaucaucuccugcuuucuguccaggaaagccuggagcgcaaguucggaaagcacggcgggaccauuccuaucgugcccaccgcugaauuucaggacuccauuucuggcgccagcgagaaagauaucguccauuccgcucucgccuacacaauggagcggagcgcgagacagauuaugcacacggccaugaaguacaaucugggacuugaccugcgcaccgcugccuaugugaacgcuaucgaaaaaguuuucaagguguacucugaggccggcgucacauuuaccuga

SEQ ID NO: 69800 - RNA, 1122 nt, Artificial Sequence
  derived and/or modified sequence opt5 from GLUL__Homo_sapiens__XP_006711341
augaccacaagcgccuccucucaccugaacaagggcaucaaacagguguacaugagccucccccaaggggagaagguccaggcuauguauauuuggaucgacggaacgggcgaagggcugagaugcaaaacccggacacuugauuccgagccuaaguguguugaggaacugccggaauggaauuucgacggaucuagcacccuccaguccgagggcucuaacagcgauauguaccuggugcccgccgcgauguuucgcgacccuuucagaaaagaucccaauaaacuugugcugugcgaggucuuuaaguauaaccggcgcccugcugaaacaaaucucagacauaccuguaagcggauuauggacaugguguccaaccagcaccccugguucgggauggagcaagaauacacacugaugggaaccgauggccauccuuuuggcuggccgagcaauggguuccccggaccucagggccccuauuacugcgggguuggagccgaccgcgccuauggcagagauaucguggaggcucacuaccgggccugucuguacgcuggggucaagauugccggaacgaacgcggaggugaugccugcccagugggaauuucagaucggccccugcgagggcaucucuaugggggaccaucucuggguugcucgcuucauucugcacagagugugugaagauuuuggagucaucgccaccuucgacccgaaaccuauucccggcaauuggaacggggcuggaugccacacaaauuuuuccaccaaggccaugcgggaggaaaacggccuuaaauauaucgaggaggcgauugaaaagcugagcaagcgccaucaauaccacaucagagccuaugauccuaaagggggacucgacaaugcucggcgccugacaggcuuccaugagaccucuaacauuaaugacuuuuccgccggcguggcuaacagaagcgccucuauccggauccccagaacgguggggcaggaaaagaaaggauacuucgaggaucgccggcccuccgccaacugugacccuuucagcgucacagaagcucuuauuagaaccugccugcucaaugagacaggcgaugagccguuucaguauaagaacuga

SEQ ID NO: 69801 - RNA, 492 nt, Artificial Sequence
  derived and/or modified sequence opt5 from GLYAT__Homo_sapiens__NP_005829
augaugcugccccuccagggcgcccaaaugcugcagaugcuugaaaagagccugagaaaaucccucccugcuucucugaagguguacgggaccgucuuccacaucaaccauggaaauccguuuaaccuuaaagccguuguggacaaguggcccgauuucaauacaguggucgugugcccucaggagcaggacaugacggaugaccuggaucacuauaccaacacauaccaaauuuauagcaaagacccccagaauugucaggaguuucucggcuccccugaacugaucaacuggaagcagcaucugcaaauucagucuagccagcccucccucaaugaggcgauccagaaccuggcugccauuaagucuuucaaaguuaagcaaacccagcggauccuuuacauggccgcugaaacagccaaagagcugaccccuuuucuccuuaagagcaaaauccuguccccgaaugggggaaagcccaaggcuauguga

SEQ ID NO: 69802 - RNA, 867 nt, Artificial Sequence
  derived and/or modified sequence opt5 from GLYATL3__Homo_sapiens__NP_001010904
augcuggugcucaacugcagcaccaagcugcuuauccuggagaaaaugcucaaguccuguuuccccgaaucucugaaagucuacggcgccguuaugaauauuaacagagggaauccuuuucagaaggagguggugcuugacagcuggccggauuucaaagcugucaucacacggcgccaaagagaagccgagacggacaaccuggaucacuauaccaaugcguacgcuguguuuuauaaggacguucgggccuaccgccagcuccuggaagagugcgauguguucaacugggaccaggucuuucagauucaaggacugcaguccgagcucuaugaugugucuaaggccguugcuaauagcaaacagcugaacaucaaacuuacauccuucaaggccgugcauuuuucucccgucagcucccugccugacaccagcuuccucaagggccccucuccuagacugacauaccuuuccguggcuaaugccgaucugcucaaccggaccuggagccgcgggggaaaugaacagugucugagauauauugcgaaccugaucucuugcuuucccuccguguguguccgggacgagaaaggcaauccuguuagcuggucuaucacagaucaauucgccaccaugugccacggguacacgcucccggaacaucgcagaaagggauacucccggcugguggcucuuacccuggcccgcaagcuccagagcagaggcuuucccucccagggcaacgugcuggacgauaauacagcuucuauuagccuucugaaaucccuccacgccgaguuccugccuugucgguuucaucgccugauccucacccccgcgacauucagcgggcugccucaccuuuga

SEQ ID NO: 69803 - RNA, 705 nt, Artificial Sequence
  derived and/or modified sequence opt5 from GLYCTK__Homo_sapiens__NP_001138423
auggccgcugcccuccaggugcugcccagacuggcgcgggcuccucuucacccgcugcucuggcgcggcagcgucgccagacuggccuccucuauggcucuugccgagcaagcucggcagcuguucgaaagcgccguuggggcggugcuccccggaccuaugcugcaucgcgcccugucccucgaccccggcgggagacagcugaaggugcgggaucgcaacuuucagcuuagacaaaaucuguaccucgucggauucggcaaagcugugcuggggauggccgcugccgcggaggaacuucugggacagcaccucguucagggcgugaucucugucccuaagggcauucgggccgcuauggagcgcgccgggaaacaggaaaugcugcugaagccccauagcagagugcaaguuuuugagggagcugaggacaaccucccugaucgggacgcccugcgcgccgcucuugcgauccagcagcuggccgaaggccucaccgcugaugaccugcuucuggugcucauuuccgggggagagccgcaccccgucagaugcggcgggggaccuuguggcggcgauugccaguggccccaucgggggcaauucccucagugugcccgccugcccgccuauccgcagucucugagaccucccugcagcccugcuacauuuugugaagacugcgccguguccggacggcucuga

SEQ ID NO: 69804 - RNA, 582 nt, Artificial Sequence
  derived and/or modified sequence opt5 from GM2A__Homo_sapiens__NP_000396
augcagagccugaugcaagcuccccuccugaucgcccuuggccugcuccuggccgcgccugcucaggcccaccuuaagaaaccgucccagcugucuagcuucuccugggacaacugcgaugaggggaaggaccccgccgugauuagaucucucacccuggaaccugaucccaucauugucccuggaaauguuacacugagcgugaugggcuccacgucugugccccucagcuccccucugaaagucgaccuugugcuggagaaggaaguugcugggcucuggaucaaaauuccguguaccgauuacaucggaagcugcacauuugagcauuucugugacgugcuggauaugcuuauccccaccggcgaaccuugccccgagccucugcggacauaugggcuccccugucacugcccguuuaaggagggaaccuacucucugccuaaguccgaguucgucgugcccgaccuggaacucccuagcuggcugacaaccggcaacuaucgcauugaaucuguucuuuccagcucuggcaaaagacugggguguaucaagauugccgcuucccucaaaggaaucuga

SEQ ID NO: 69805 - RNA, 1548 nt, Artificial Sequence
  derived and/or modified sequence opt5 from GMCL1__Homo_sapiens__NP_848526
augggcagccuguccucuagagugcuccggcagccccgcccugcccuggcucaacaggcccagggggcgagagcuggaggcagcgcccggcgcccggacaccggggaugacgccgcuggacacggcuucugcuacugugccgggucccauaagagaaaacggucuagcggauccuuuugcuauugucaccccgauucugagacagacgaagaugaggaagagggcgacgaacagcaacgccuucugaacacgccuagacggaagaaacucaagagcaccuccaaauacaucuaucagacacuguuccuuaauggcgagaacagcgauauuaagaucugcgcucugggggaggaauggucucuccauaagauuuaccugugucaguccggauauuuuagcucuauguucuccggcagcuggaaagagucuuccaugaauaucauugaacuggagauccccgaccagaacaucgaugucgaggcccuccaaguugcguuugggagccuguaccgcgacgaugugcuuauuaagccuuccagaguggucgccauccuggcugccgcuugccuccugcagcuugacggacugauucagcaguguggcgaaaccaugaaagagacagugaauguuaagaccgugugcggguauuacacaucugccggaaccuacggccucgauagcgucaaaaagaagugucuggaauggcugcucaacaaucugaugacgcaccaaaacguggagcuuuucaaagaacuguccaucaauguuaugaagcagcucauuggcagcucuaaccuguuugugaugcaggucgagauggacaucuauaccgcgcuuaaaaaguggauguuccugcaacucgugcccuccuggaaugggagccugaaacagcugcucacagagaccgacgugugguuuucuaagcagcggaaagauuucgaaggaauggccuuucuggagacagaacagggcaagccuuucgucagcguuuuucgccaucuuagacugcaauacauuaucuccgaccucgcuucugcccggaucauugagcaggaugcuguggugccgagcgaauggcuguccagcgucuauaagcagcagugguucgccaugcuucgcgccgagcaagacucugagguggggccccaggaaaucaacaaagaggaacuggagggaaauuccaugagaugcggccggaagcucgcuaaagauggggaauacuguuggagauggaccggauucaacuuuggcuucgaccugcugguuacguauacaaaucgcuacauuaucuuuaagcggaacacccucaaccagccuugcagcggcucugugucccugcagcccagacgcagcauugcguuccggcuuagacuggccuccuuugauucuagcgggaaacucaucugcucccgcacaaccggauaucaaauccugacccuggagaaggaccaggagcaggucgugaugaaucuugauucucggcuccugauuuucccucuguacaucuguugcaacuuucucuacauuagccccgaaaagaaaaauuga

SEQ ID NO: 69806 - RNA, 1029 nt, Artificial Sequence
  derived and/or modified sequence opt5 from GMDS__Homo_sapiens__NP_001240775
augugcaagauggacggcagcuaccuggccgaguuccuccuggaaaaaggguaugaggugcacggaaucgucagacgguccucuagcuuuaacaccggccgcauugaacaucuuuacaagaauccccaggcucacaucgaggggaacaugaaacugcauuauggagaucucacagacuccacgugucugguuaagauuaucaaugaagugaaaccuaccgagauuuacaaccuuggcgcccaaucucacgugaagaucagcuucgaucuggcggaguauacagcugacgucgauggggugggaacccucagacugcuggacgccguuaagacaugcggccucaucaauuccgugaaauuuuaccaggccucuaccagcgaacuguauggcaagguccaggagauuccgcagaaagaaacaacccccuucuacccucggucccccuacggggcugccaaacuuuaugcuuacuggaucgugguuaacuuucgcgaggccuauaaucuguucgcggugaacggcauucucuuuaaucaugagagcccuagacggggagccaacuucgucacgcgcaagaucucuagauccguggcuaagauuuaccuggggcaacuugaauguuuuagccugggaaaucucgaugccaagcgggacuggggccacgcuaaagauuauguggaggccauguggcugaugcugcagaacgacgaacccgaggauuucgucaucgcgaccggggaaguucacucugugcgcgaguuuguggagaaguccuuccuccauauuggaaaaacaaucgucugggaaggcaagaaugagaacgaagugggcagaugcaaagagaccgggaagguucacgugacagucgaccugaaauacuaucggccuaccgaaguggauuuucuucagggagacuguacgaaggccaagcagaaacugaauuggaagccgcgcguugcuuucgacgagcucgugagagagaugguccaugccgauguggaacugaugcggacaaaccccaacgcuuga

SEQ ID NO: 69807 - RNA, 429 nt, Artificial Sequence
  derived and/or modified sequence opt5 from GMFB__Homo_sapiens__NP_004115
augagcgagucccugguggucugcgacguugccgaagaucucguggagaagcugagaaaauuccgguuucgcaaggaaaccaacaaugcugccaucauuaugaaaaucgacaaggauaaaagacuugugguccuggacgaggaacucgagggcauuucucccgaugagcugaaggacgaacuuccugagcggcagccgcgcuucaucguguacagcuauaaguaccaacacgaugacgggagaguuuccuauccccuguguuuuauuuucucuagcccugugggaugcaaacccgaacagcagaugauguacgcgggcuccaagaacaaacucguccagacagcugagcugacgaagguguuugagauccggaauaccgaagaucugacagaggaauggcuccgcgagaaacugggguucuuucauuga

SEQ ID NO: 69808 - RNA, 429 nt, Artificial Sequence
  derived and/or modified sequence opt5 from GMFG__Homo_sapiens__NP_004868
augucugacucccugguggucugcgagguugaucccgaacucaccgagaagcugagaaaauuccgguuucgcaaggaaacagacaacgccgcuaucauuaugaaaguggauaaggacagacagauggugguccuugaggaagaguuccaaaauaucucuccugaggaacugaaaauggagcucccggaacggcagccccgcuuugugguuuacagcuauaaguacgugcacgaugacggcagagucuccuauccucuguguuucaucuuuucuagccccguggggugcaagccugagcagcagaugauguacgccggauccaaaaaccggcuuguucaaacggcggagcugaccaagguguucgaaauucgcacaaccgaugaccucacagaggcuuggcugcaggaaaaacugagcuuuuucagauga

SEQ ID NO: 69809 - RNA, 2826 nt, Artificial Sequence
  derived and/or modified sequence opt5 from GMIP__Homo_sapiens__NP_001275927
auggacgccgcugagcccggccugccuccggggcccgaaggaagaaagcgguacagcgauaucuuccgcucccucgacaaccuggagauuucucuuggcaaugugacccuggaaaugcucgccggggauccucugcuuagcgaggaccccgaaccugauaaaacacccacggcgaccgucacaaacgaggcuuccugcuggucuggaccuagcccggagggccccguuccucugaccggggaggaacucgaccugagacugauccggacaaagggaggcguggaugccgcccucgaauaugcuaaaaccuggucccgcuacgccaaggagcugcuugcuuggacagagaaaagagccucuuaugaacuggaguuugccaagagcaccaugaagauugcggaagcuggcaaaguguccauccagcaacagagccacaugccccuccaguacauuuauacgcuguuccuugagcaugaccugucucucgggacccuggccauggaaacagucgcucagcaaaagcgggauuacuaucagccucuggccgcgaaacgcaccgagaucgagaaguggagaaaagaauuuaaggagcaguggaugaaggaacagaaacggaugaaugaggccgugcaagcucuccgcagagcccagcugcaguacguucagcgguccgaagaccuucgcgcuagaagccaaggaucucccgaggauuccgccccgcaggccagcccuggccccucuaagcagcaagagcggcgcagacgguccagagaagaggcucaggcgaaagcccaggaagcugaggcccuguaccaggccugugugcgcgaagcuaacgcccggcaacaggaccucgagaucgcgaagcagagaauugucagccacgugcgcaaacugguuuuccagggggaugaggugcuucggagagucacacugucccucuuuggacugcgcggcgcucaagccgaacgggggccuagagccuucgcugcccuggcugagugcugugcccccuuugaacccggacagcgcuaucaggaguucgugcgggcgcucagaccugaggccccgcccccucccccucccgcuuuuucuuuccaggaauuucugccgagccuuaauuccagcccucuggacauccgcaagaaacucucuggcccccugccuccccggcuugacgagaacuccgccgaaccuggccccugggaggauccggggaccggauggagauggcaaggcccuacgcccgggagcgacguggauucugucggaggcgggagcgaaucccggucucuggacagccccacauccagcccugaucucggagacggccuggagaauggccuggggucuccguucggaaaguggacccucuccagcgcugcccagacacaucagcugcgcagacuucggggccccgcgaagugcagagagugugaagccuuuaugguuucugggaccgagugcgaagaguguuuccugaccugccacaaacgcugucucgaaacacugcugauucuuugcggacaucggagacucccugcucgcacgccccuguucggcguggauuuucugcagcucccuagagacuuccccgaggaggugccuuuugucgugaccaaguguacagccgaaaucgagcaccgggcucuggauguucaagggauuuaccgcguguccggcagcagaguccggguggaacgccuuugccaggccuucgagaacggcagagcccugguugaacucuccggaaauucuccccacgacgugagcuccguccugaaacgguuucugcaggagcuuaccgagccggugaucccuuuccaucucuaugaugcuuuuauuucucuggcgaagacacugcacgccgaccccggggacgauccuggaacccccagcccguccccugaagucauccgcagccucaaaacgcugcuugugcaacugcccgacucuaacuacaauacacucagacaucugguugcucaccuguuccggguggccgcccgcuuuauggagaacaagauguccgcuaauaaccuuggcaucgucuucgggccuacccuccugagaccucccgauggaccccgggccgcgagcgcuauuccggugaccugccugcucgacucuggccaccaggcccagcugguugaauuucuuaucgugcauuaugagcagauuuucgggauggaugagcugccccaagccacagaaccucccccucaggacuccagccccgcuccuggcccgcucaccacaucuagccagcccccucccccucaccuggaucccgacucccagccgccuguccuggccagcgaucccggacccgacccucaacaucacucuacgcuugagcagcaucccaccgcgacaccuaccgaaaucccgacaccccaguccgaucagagagaggacguggcugaagauaccaaggacggcgggggagaggugagcucccaaggcccugaggacucucuccuggggacgcagagccgcggacacuuuucccggcagcccguuaaauacccuagaggcgggguccgccccgugacccaccaacugucuagccucgcccugguggccuccaaacuuugugaagagacaccgauuaccucugucccucggggcagccugagaggacgcggccccuccccugcugccgcuagccccgaagggucuccucuccggagaacaccccugccgaagcauuucgagaucacccaggaaacggcccgccugcuuuccaagcuggauagcgaggcggugccucgggccacaugcugucccgacguucagcccgaggaagcugaggaucaccucuga

SEQ ID NO: 69810 - RNA, 510 nt, Artificial Sequence
  derived and/or modified sequence opt5 from GML__Homo_sapiens__XP_011515271
auggagcccggcagcagacugcuccgggaagugaugcugcuuuucgcccugcuccuggcuauggagcuuccucuggucgccgcguccgcuaccaugcgcgcccaguggacauacucucucagaugccacgacugugccguuaucaacgauuuuaauugcccgaacauucgggugugucccuaucauauccgcagaugcaugacgauuagcauccggauuaauucccgcgaacugcugguguacaagaacuguaccaauaacugcacauucgucuaugcugccgagcaaccucccgaagcuccugggaaaaucuuuaagaccaauucuuucuacuggguguguugcuguaacagcaugguuugcaaugccggaggccccacaaaccucgagagagacaugcugccugaugaggugaccgaagaggaacuuccggaggggacaguccggcugggaguguccaaacuccugcuuucuuuugcgagcaucauuguuuccaauauccugcccuga

SEQ ID NO: 69811 - RNA, 630 nt, Artificial Sequence
  derived and/or modified sequence opt5 from GMNN__Homo_sapiens__XP_005249216
augaaccccagcaugaagcagaaacaagaggaaaucaaggagaauauuaaaaacuccucugugccuagacggacccugaagaugauccagccgagcgccuccggcucucucgucgggcgcgaaaaugagcugagcgcuggacuuuccaaaagaaagcaccggaacgaccaucugacaucuacgaccagcucccccggcguuauugugccugaaagcucugagaauaagaaccucgggggagugacacaggaguccuucgaucugaugaucaaagaaaaucccagcucucaguacuggaaggaggucgccgaaaaacgcagaaaggcgcuuuaugaggcucugaaagagaacgaaaagcuccacaaggagauugaacaaaaagacaaugagaucgcccggcugaagaaagaaaacaaggagcuggccgagguggcugaacauguucaguacauggccgagcucaucgaacgccugaauggcgagccucuugauaacuuugaaucccuggacaaucaggaguucgauagcgaggaagagaccguggaagacucucucgucgaggauuccgaaauugggacaugcgcugagggaaccgugagcuccucuacagacgccaaacccuguaucuga

SEQ ID NO: 69812 - RNA, 1263 nt, Artificial Sequence
  derived and/or modified sequence opt5 from GMPPA__Homo_sapiens__NP_995319
augcugaaggccgugauccucauuggcgggccccagaaaggaaccagauucagaccucugagcuuugaggucccgaagccccuuuucccuguugcuggcgugcccaugauccaacaccauauugaagccugcgcccaggugccugggaugcaggagauccugcucauuggauuuuaccagcccgacgaaccucugacacaauuccuugaggcugcccagcaggaauuuaaccugccgguccgcuaucuccaggaguucgcgccccugggcaccgggggaggccuguaccacuuuagagaucaaauccucgcuggcuccccugaggccuucuuugugcugaaugcugacguuuguucugauuucccccuuagcgccaugcuggaagcgcaucggcgccagagacacccuuuucuccugcuugggaccacagccaaccggacccagucccugaauuauggaugcaucguggagaacccccagacacaugaaguccuccacuacguggagaaaccgucuaccuucauuagcgacaucauuaauuguggcaucuaucuguuuuccccugaggcucugaagccccuccgcgauguuuuccaaagaaaccagcaggacgggcaacuggaagauucuccuggacuuuggcccggcgccgggacaauucggcuggagcaggacguguucagcgcucucgccggacagggccagaucuacguccaccugaccgauggcauuuggucccaaaucaaaagcgcggggucugcccuuuaugcuucccgccuguaccucagcagauaccaggacacgcaucccgaacggcuggccaagcacaccccuggaggcccguggauccgcgggaauguguauauucaucccacagcuaagguggccccuucugccguccugggacccaacguuuccaucggcaaaggggugaccgugggagagggcgucagacuccgggaaagcauugugcugcacggcgcuacacuucaggagcacacgugcguucugcauucuaucgugggguggggauccacggucggccgcugggcgagaguggaggggacaccuagcgaucccaauccgaacgacccucgggccagaauggauuccgaaucucucuuuaaggacggaaaacugcuucccgcuauuaccauccugggcugucgcguucggaucccugccgaggugcucauucugaauagcaucguccugccccacaaggaacucucccggagcuucacaaaccagauuauccuguga

SEQ ID NO: 69813 - RNA, 1164 nt, Artificial Sequence
  derived and/or modified sequence opt5 from GMPPB__Homo_sapiens__NP_037466
augaaggcccugauccucgugggcggguacggaaccagacugcggccccuuacacugagcacgccuaaaccgcucgucgacuucugcaacaagcccauucugcuucaccagguugaggcucuggccgcggcuggcguggaucaugugauccucgccgucuccuauaugucucaagugcuggaaaaagagaugaaggcccaggaacagcgccuggggauuagaaucagcaugucccacgaggaggaaccucucggaaccgcuggcccccuggcccuugcucgggaccugcucucugagacagccgaucccuuuuucguucugaauagcgacgugauuugugauuuuccuuuccaggcgaugguccaauuucaucgccaccaugggcaggaaggauccauccuugugaccaaaguugaggaaccuucuaaguacggcguggucgugugcgaggccgacacaggcagaauccaccgguucguggagaagccgcaggucuuuguuagcaacaaaauuaaugcugggauguauauccugucccccgccgugcuccgccggauucagcugcaaccuaccagcaucgaaaaggagguguuccccauuauggcuaaagaaggacagcuguacgccauggagcuccagggcuuuuggauggauaucgggcagccuaaggacuuccugacaggaaugugucuuuuucugcaaucucucagacagaaacagcccgaacgccugugcuccggcccggggauugucggaaacgugcuuguugauccuagcgcgagaaucggccaaaauuguucuaucggccccaacgugucccuggggccuggagucgugguugaggacggcgugugcauucggcgcuguaccguccucagagaugcccggauccgcagccacucuuggcuggaguccugcauugugggguggagaugucgggucggacagugggugagccugugggcuggccucgggggagaaagaggcggcgagugcgccugucugcccgacaaggcuuauccccuucuggaaguucgcauggagaaugugacgguccucggggaagaugugaucguuaacgacgagcuguaccuuaauggagccuccgugcugccucauaagucuauuggcgagagcgucccggaaccccggaucaucauguga

SEQ ID NO: 69814 - RNA, 1047 nt, Artificial Sequence
  derived and/or modified sequence opt5 from GMPR2__Homo_sapiens__NP_001002000
augccccacaucgacaacgaugugaagcuggacuucaaagauguccuccugagaccuaagcggagcacccuuaaaucccgcucugagguugaccugacacggagcuuuuccuucagaaauucuaagcagacguacagcggcgugccgauuaucgccgcuaacauggauaccguggggacauuugaaauggccaaaguccucugcaaguucucccuguuuaccgcggugcauaagcacuauucucuuguucaauggcaggaguucgcuggacagaaucccgacugucuggaacaucucgccgccagcuccggcacagggagcucugauuuugagcagcuggaacaaauucuggaggcuaucccucaggugaaauacauuugccucgacgucgccaacggauauuccgagcacuucguggaauuuguuaaggaugugcgcaaaagauucccccagcauaccaucauggcuggcaaugucgugacaggggagaugguggaggaacugauccuuagcggagccgacauuaucaaggucggcauuggcccugggucuguuuguaccacgcggaaaaagaccggagugggcuacccccagcuguccgcggugauggagugcgccgaugcugcccacgggcucaagggacacaucauuagcgacggcggguguucuugcccuggagaugucgcuaaagccuuuggcgcgggcgccgacuucgugaugcuugggggaaugcuggcuggccauuccgaaagcgggggagagcugaucgaacgcgacggcaagaaauauaagcucuuuuacgggauguccucugagauggccaugaaaaaguaugcuggaggcguugccgaauacagagccagcgagggcaaaacaguggaggucccguucaagggggauguggaacacaccauucgggacauccugggaggcauccgcuccacauguaccuacguuggggcugcgaagcugaaagagcucagcagacggacgacauucauucgcgugacccaacaggucaaccccaucuuuucugaagccugcuga

SEQ ID NO: 69815 - RNA, 1038 nt, Artificial Sequence
  derived and/or modified sequence opt5 from GMPR__Homo_sapiens__NP_006868
augcccagaaucgacgccgaucugaagcucgacuucaaagaugugcugcuucggccuaagcgcagcucccugaaaucuagagcugaggucgaccucgaacggaccuuuacauuccgcaacagcaagcagacguacuccggcauuccgaucauuguugccaauauggauaccguggggacauuugagauggcggcugugaugucucaacacagcauguucaccgccauccauaaacacuauucccuggacgauuggaaacuuuuugccacaaaccaucccgaaugccugcagaaugucgcugugucuagcggauccggccagaacgaccucgagaagaugaccagcauucuggaagccguuccucaggugaaguucaucugucuggaugucgcuaauggguacucugagcacuuuguggaguucguuaagcucgugagagccaaauuucccgaacauacaaucauggcgggaaacgucgugaccggcgagaugguggaggaacugauucuuuccggggccgacaucauuaaggucggaguuggcccuggcagcgugugcacgacccggacaaaaaccggggugggauauccccaacugucugcugucaucgagugugccgauuccgcucacggccucaaggggcacauuaucagcgacggaggcugcacauguccuggggauguggccaaggcguucggagccggcgcugacuuuguuaugcugggcgggauguucucuggacauaccgaaugcgccggcgagguguuugaacgcaaugggagaaaacuuaagcuguucuacggaauguccagcgacacggcuaugaacaaacacgccggcggggucgccgaguaucgggcuuccgaaggaaagacaguggagguuccguacaaaggcgauguggagaauaccauucucgacauccugggcgggcugcgcucuacauguaccuaugucggagcggccaagcucaaagaacugagcagacgggcuaccuucauccgcgugacacagcagcauaacacggucuuuuccuga

SEQ ID NO: 69816 - RNA, 2082 nt, Artificial Sequence
  derived and/or modified sequence opt5 from GMPS__Homo_sapiens__NP_003866
auggcccugugcaacggcgacagcaagcucgagaaugcugggggagaucugaaagacggccaccaucacuacgaaggggccguggucauccuugaugcgggagcucaguauggcaagguuauugacagacgggugcgcgagcuguucgugcaauccgaaaucuuuccccucgagaccccugccuucgccauuaaagaacagggguuuagagcuaucauuaucucuggaggcccgaacagcgucuacgccgaggaugcucccugguucgacccugccaucuuuacaauuggcaagcccgugcuggggaucuguuauggaaugcagaugaugaauaaaguuuucggcgggacggugcauaagaaguccguccgggaggauggaguguuuaacauuucuguugacaauaccugcagccuuuuccgcggccugcagaaagaagaggugguccuccugacacacggggauuccguggacaagguggcggauggauuuaaagucguugccagaucuggcaacaucguggcuggcauugccaaugaaagcaagaaacuguacggggcucaauuccauccugaggugggacucaccgagaacggcaaggucauccugaagaauuuucuuuaugacauugccggguguuccggaacauucaccgugcagaaccgggaacuggagugcauccgcgaaaucaaagagagaguuggcacaagcaaggugcucguccugcuuucugggggaguggauuccaccguuuguacggcgcugcucaaucgggcccugaaccaggaacaggugauugcuguccacaucgacaauggcuuuaugcgcaaaagagagagccaaucuguggaggaagcccugaagaaacucggcauucaggucaaggugaucaacgcugcccacuccuucuacaaugggaccacaacccugcccauuagcgacgaggaucggacaccucgcaaaagaaucucuaagacccuuaacaugacgacauccccggaagagaagcggaaaaucauuggagacaccuucguuaagaucgccaacgaagugauuggcgagaugaaucugaaacccgaggaagucuuucucgcucaggggacacugcgcccugaucuuaucgagagcgcgucccugguggccucuggaaaggcugaacucauuaaaacccaucacaacgacaccgagcugaucagaaagcugcgggaagagggcaagguuaucgagccccucaaagauuuccauaaggacgaagugcgcauucuggggagagagcuuggccugccugaggaacucgucagccggcaccccuuuccgggaccuggccuggccaucagagugauuugcgccgaggaacccuauaucuguaaagauuucccugagacaaauaacauucuuaagaucguggcugacuuuuccgccagcguuaaaaagccccacacgcugcuccagcgcgucaaggcgugcaccacagaagaggaucaagaaaaacugaugcagauuaccucucugcauucccucaaugcuuuccugcuucccaucaagacagugggggugcagggagacugucggagcuacucuuacgucugcggcaucagcuccaaagaugagccugacugggagucucugauuuuucucgccagacugaucccgcgcaugugucacaacgugaaucggguuguguauauuuucgggcccccugucaaggaacccccuaccgacgugacgcccacauuucugaccaccggaguucuuagcacacucagacaagccgauuucgaggcucauaacauccugcgcgaauccggcuacgccgggaaaauuagccagaugccggugauccugaccccucuccacuuugaccgggauccccugcagaagcagccuucuugccaaagauccgucgugauccgcacauucauuacgagcgacuuuaugaccggcauccccgcuacaccuggaaaugagauucccguugaagugguccuuaagauggugaccgagaucaaaaagauuccgggcaucucucggaucauguaugaucugacauccaaaccucccgggaccacggagugggaauga

SEQ ID NO: 69817 - RNA, 1080 nt, Artificial Sequence
  derived and/or modified sequence opt5 from GNA11__Homo_sapiens__NP_002058
augacccuggagagcaugauggccugcugucucuccgacgaagugaaggagucuaaaagaaucaacgcugaaauugagaagcagcugcggcgcgauaaaagagacgcccggcgcgaacuuaagcugcuccugcuuggcacaggggagagcggaaaauccacguucaucaagcaaaugagaauuauccacggcgcgggguacucugaggaagauaagcggggauuuaccaaacuggucuaucagaauauuuucacagcuaugcaggccaugauccgcgccauggagacccucaagauccuguacaaauaugaacagaacaaggcuaaugcccugcucauuagagagguugacguggagaaagugacaaccuuugaacaucaauacgucagcgcuaucaagacacugugggaggaucccggcauucaggaaugcuaugaccggcgcagagaguaccagcuuuccgauucugccaaguauuaccugaccgacguggaucggaucgcgacgcucggguaccugccuacccagcaagacguucuucgcgugagagucccgacaaccggaauuaucgaauaucccuucgaucuggagaacauuaucuuucggaugguggacguuggcggccagcgcagcgagagacggaaauggauccacuguuucgaaaaugugacauccauuauguuucucgucgcccugagcgaguacgaucaggugcugguggaaucugacaacgagaauagaauggaagaguccaaggcucucuuccgcaccaucauuacguauccuugguuucagaacagcucugucauccuguuccuuaauaaaaaggaccugcucgaggauaaaauucuguacucccaucuuguugacuauuuucccgaguucgaugggccucaacgggacgcccaggcugccagagaauuuauccugaagauguucguggaucucaaccccgacagcgauaaaaucauuuacucucacuucacaugcgcgaccgacacagaaaauauccgcuuuguguucgccgcugucaaggauaccauucugcagcugaaccucaaggaguauaaucugguguga

SEQ ID NO: 69818 - RNA, 918 nt, Artificial Sequence
  derived and/or modified sequence opt5 from GNA12__Homo_sapiens__NP_001269369
auggcccccagagcuggccugggggccggaccucuccugcuucggagccgcgcggacugggugugcggcgggugggaggcugcccuguccgccccgcccccuuucuguaccgcuugggucgaaagaacaggacucguucacuuucugcgggagggcgggcauggagccugcuucccccuugcucugcuccacccuggcucuguggugagcuuucagaugaucuacccccugauuguccugccucucugugccuccuggcauuggggccugauccgcaaggggauugugcuuuucuggggagaaucuguuaaauauuuucuggauaaccucgacagaaucggccaacugaauuacuucccgagcaagcaggauauucuucuggcgcggaaagccacgaaggggaucguggagcacgacuuugucaucaaaaagauucccuucaagaugguggauguuggaggccagcgcucccagagacaaaaaugguuucagugcuucgacgggaucaccucuauucucuuuauggugagcuccagcgaauaugaucagguccugauggaggaccggcgcacaaacagacugguggagucuaugaauaucuucgaaaccauugugaacaauaagcucuuuuucaacgucuccaucauucuguuccuuaauaaaauggaucugcucguugagaaggugaaaacagugagcaucaagaagcauuuuccugacuuccggggagauccccaccgccuggaagacguccagagauaccuugugcaauguuuugaucggaaacgcagaaaccggucuaagccucuguuccaccauuuuaccacagcuaucgacaccgagaauguuagauucguguuucacgccgucaaagacacgauucuccaggagaaccugaaggauaucaugcugcaguga

SEQ ID NO: 69819 - RNA, 849 nt, Artificial Sequence
  derived and/or modified sequence opt5 from GNA13__Homo_sapiens__NP_001269354
augagagugcuggucgacgcccgggagaagcuccacauccccuggggcgauaacagcaaucagcaacauggggacaaaaugauguccuucgauacccgcgcuccuauggccgcgcagggaaugguugaaacaagaguguuucugcaguaccuuccggcuauucgggcccugugggccgacucuggcauccagaacgcuuaugaucgcagacgggaguuccaacucggggaaagcgugaaguacuuucuggacaaucuugauaaacugggagagcccgacuauauuccuucccagcaggauauccuccuggcccgcagacccacgaagggcauucacgaauacgacuucgagaucaaaaacgucccuuuuaagaugguggauguugggggacagcggucugagcgcaagagaugguucgaaugcuuugacagcgugaccuccauccuguuccucgucucuagcuccgaguuugaucaagugcugauggaagaccggcuuacaaaucgccugaccgagagccucaacauuuucgagacaaucguuaauaacagaguguuuucuaaugucuccauuauccuguuccuuaacaaaaccgaccugcucgaagagaaggugcagauugugagcaucaaagauuauuuucuggaguucgaaggcgacccccauugucugcgggauguccagaaguuccucguugaaugcuuucgcaauaaaagacgggaccagcaacagaagccucuguaccaccauuucacaaccgcuauuaacacggagaauaucagacuuguguuucgcgaugugaaggacaccauccugcacgauaaccucaaacagcugaugcuucaauga

SEQ ID NO: 69820 - RNA, 1068 nt, Artificial Sequence
  derived and/or modified sequence opt5 from GNA14__Homo_sapiens__NP_004288
auggccggcugcuguugccugagcgcugaggaaaaggagucccagagaaucucugccgaaauugagcggcaacuccgcagagacaaaaaggaugcgcggcgcgaacugaaacuucugcuccuggggaccggagagagcggcaaguccacauucaucaaacagaugagaauuauccacgggucuggauacagcgacgaggaucggaagggcuuuacgaaacuuguguaucagaacauuuucaccgcuaugcaggccaugauccgcgccauggacacacugagaauccaauacgucugugaacagaauaaggagaacgcucagauuauccgggaaguugagguggauaagguguccaugcucucucgcgagcaggucgaagccauuaaacaacuguggcaggaccccgggauccaggagugcuaugauagacggcgcgaauaccagcugagcgacuccgcuaaguauuaccucaccgauauugacagaaucgccacaccuagcuuugugccgacccaacaggauguucugcgggugcgcguccccacaaccggaauuaucgaguauccuuucgaccuugaaaauaucauuuuuagaaugguggauguuggcggccagcggucugagagacgcaaauggauccauuguuucgaguccgugacgagcauuaucuuucuggucgcgcucucugaauacgaccaagugcuggccgagugcgacaacgaaaaucggauggaggaauccaaggcucuuuucaagaccauuaucacauaccccugguuucugaacagcucugugauccucuuccugaauaaaaaggaucugcucgaggagaaaauuauguauucccaccugaucagcuacuuuccugaauauaccgggcccaagcaggacgucagagccgcucgcgauuucauucuuaaacuguaccaggaccagaacccugauaaggagaaaguuaucuauucccauuuuacaugugccaccgacacggauaauauucgguucguguucgcggccgugaaggacacaauccuccaacugaaccuuagagaauuuaaucuggucuga

SEQ ID NO: 69821 - RNA, 1125 nt, Artificial Sequence
  derived and/or modified sequence opt5 from GNA15__Homo_sapiens__NP_002059
auggccagaagccugaccuggcggugcugucccuggugccucacagaggacgaaaaggcugccgcgcgcguggaucaggagaucaaccggauucugcuugaacagaaaaagcaagacagaggcgagcugaaacuccugcuucuggggccuggagaauccggcaagucuacguucaucaaacagaugcgcauuauccacggggcuggauacagcgaggaggaaagaaagggcuuucggccgcucgucuaucagaauauuuucguuuccaugcgcgccaugaucgaggccauggaaagacugcaaauccccuuuucucggccugagagcaagcaucacgcuucccuggugaugucucaggaucccuacaaagugaccacauucgagaagcgcuaugccgcugccaugcaguggcucuggagagacgcggggauucgggccuguuacgaacgcagacgggaguuucaucugcuugauagcgcugucuauuaccugucccaccucgaacgcaucaccgaggaaggauaugugccuacagcccaggacguucugagaagccggaugcccaccacaggcauuaacgaguacugcuucucugugcagaaaaccaaucuuagaaucgucgaugugggcgggcaaaaguccgagcgcaaaaaguggauucauuguuuugaaaacguuaucgcucugauuuaccucgccagccugucugaguaugaccagugccuggaagagaauaaccaggaaaaucggaugaaggagucccucgcgcuguucggaacgauccuugagcugccuugguuuaaaagcaccucugugauccucuuccugaacaagacagauauucuugaagagaaaaucccgaccucccaccuggccacauacuuucccagcuuccaaggcccuaagcaggacgcugaagccgcuaaaagauuuauucucgauauguauacccgcauguacacggggugugucgacggacccgagggcuccaagaaaggggcccggucuagacgccuguucagccacuauacaugcgccaccgauacacagaauauccggaagguguucaaggacgugagagacuccguccuggcucgcuaccucgaugaaauuaaccugcuuuga

SEQ ID NO: 69822 - RNA, 909 nt, Artificial Sequence
  derived and/or modified sequence opt5 from GNAI1__Homo_sapiens__NP_001243343
augaagaucauucacgaggccggcuacagcgaagaggaaugcaaacaguauaaggcuguggucuacuccaacaccauccaaucuauuaucgccauuaucagagcgauggggcggcugaaaaucgacuucggagauagcgcucgcgccgacgaugccagacagcucuuuguucuggcuggcgccgcugaggaaggguucaugacagccgagcuugcgggagugauuaagcggcuguggaaagacuccggcgugcaggccuguuuuaaucgcucuagagaguaucagcucaacgauagcgcugccuacuaucugaaugaccuugaucggaucgcucaacccaacuacauuccuacgcagcaggacguccugcgcaccagagugaagacaaccgggaucguugaaacacauuucaccuuuaaggaucuccacuucaaaauguuugacgugggaggccagcgguccgagcgcaagaaauggauucauugcuucgaaggcgucacagccaucaucuuuuguguggcgcugucugauuaugaccugguucucgccgaggaugaggaaaugaauagaaugcacgagagcaugaagcuguucgacuccauuugcaacaauaaaugguuuaccgacacgagcaucauucuuuuccugaacaagaaggaucucuuugaagagaaaaucaagaaaucuccgcugaccauuuguuaccccgaauacgcuggguccaauacauaugaggaggccgcugccuacauccaaugccaguucgaagaccuuaacaagcggaaagauaccaaggagauuuauacacauuucaccugugccacggacaccaaaaaugugcaguuugucuucgaugcugugacagacgugaucaucaagaacaaucugaaggauugcggacucuuuuga

SEQ ID NO: 69823 - RNA, 957 nt, Artificial Sequence
  derived and/or modified sequence opt5 from GNAI2__Homo_sapiens__NP_001159897
augagaggcgccggggagagcggaaaguccaccaucgugaaacagaugaagauuauccacgaagacggcuacucugaggaagagugccggcaauaucgcgcugucguuuacagcaacacaauucaguccaucauggccauugugaaagcgauggggaaucugcagaucgauuucgcugaccccucuagagccgaugacgcccggcagcucuuugcucugagcuguacggccgaggaacaaggagugcuuccugaugaccuguccggcgucauccgcagacucugggcugaucauggggugcaggccugcuucggacggucucgcgaguaucagcugaacgacagcgcggccuacuaucuuaaugaucuggaaagaauugcucaguccgacuacaucccgacccaacaggauguucuccggacacgcgugaagaccacaggcauugucgagacccacuuuacauucaaagaccugcauuuuaagauguucgaugugggcgggcagagaagcgaacggaagaaauggauccacuguuuugagggaguuaccgccauuaucuucugcguggcucugucugccuaugaccucguccuggcggaggacgaagagaugaaccgcaugcaugaauccaugaaacuuuuugauagcauuuguaauaacaaaugguucacggacaccucuaucauccuguuucucaauaagaaagaucuguucgaggaaaagauuacacacagcccccuuaccaucugcuuuccugaguacacaggcgccaacaaguacgacgaggcugccuccuauauucagucuaaauucgaagaucugaauaagagaaaagacaccaaggagaucuacacgcacuucacaugugcuaccgauacaaagaacgugcaauuuguguucgacgccgucaccgauguuauuaucaagaauaaccucaaagacugcgggcuguuuuga

SEQ ID NO: 69824 - RNA, 525 nt, Artificial Sequence
  derived and/or modified sequence opt5 from GNAL__Homo_sapiens__NP_001248373
auguucgacgugggcgggcagagagaugagcggcgcaaguggauccaaugcuuuaacgacgucaccgccauuaucuacguugcugccuguagcuccuauaauauggugauuagagaagauaacaauacaaaccggcugcgcgagucucucgaccuguucgaaagcaucuggaauaacagauggcuucggacgauuuccaucauccuguuucucaauaaacaggauaugcuggcggagaaggugcuugcuggaaaaucuaagauugaagacuacuuccccgaguaugccaacuacaccgucccugaggaugccacaccggacgcuggcgaagaucccaaagugacccgcgccaaguuuuucaucagagaccuguuucuccggauuagcacagcuaccggggauggaaagcacuauugcuacccucauuucacaugugccguugacaccgagaauauccgcagaguguuuaacgauugccgggacauuauccagcgcaugcaccugaaacaguaugaacugcucuga

SEQ ID NO: 69825 - RNA, 1065 nt, Artificial Sequence
  derived and/or modified sequence opt5 from GNAO1__Homo_sapiens__NP_066268
augggcugcacccugagcgccgaggaaagagcugcccucgagcgguccaaggcgaucgaaaagaaccugaaggaggacgggauuucugcugccaaagaugugaaacuucugcuccugggagccggcgaaagcgggaaauccacaaucgucaagcagaugaagauuauccacgaggacggauucucuggcgaggauguuaaacaauacaagcccgugguguauagcaauacgauucagucccuugcugccaucguccgcgcuauggacacccuggggaucgaauacggagauaaagagagaaaggccgacgcgaaaauggugugugauguugugucucggauggaagacacagagccuuuuagcgccgagcuccuguccgcuaugaugcgccuguggggcgauagcggcauucaggaaugcuucaacagaucucgggaguaucagcucaaugacuccgccaaguacuaucuggauagccuugaccgcaucggggcugccgauuaccaaccgaccgaacaggacauucugagaacacgggucaagaccacaggaaucguggagacccauuuuacguucaaaaaccuccacuuucgccuguucgacguuggcgggcagagaucugaacggaagaaauggauucauuguuuugaggaugugaccgcgaucauuuucugcgucgcccuuuccggauaugaccaggugcugcacgaggaugaaacaaccaaucgcaugcaugagagccucaugcuguuugacucuaucuguaacaauaaguucuuuaucgauacauccauuauccuguuccucaacaaaaaggaccuguuuggcgaaaagauuaaaaagagcccccuuaccaucugcuucccugaguacacggggcccaauacauacgaagaugcugccgcuuauauucaagcccaguucgaguccaaaaacagaucuccuaauaaggagaucuacugucacaugaccugcgccacagacaccaacaauauccagguggucuuugaugcuguuaccgacauuaucauugcgaacaaucugcggggauguggccucuauuga

SEQ ID NO: 69826 - RNA, 1080 nt, Artificial Sequence
  derived and/or modified sequence opt5 from GNAQ__Homo_sapiens__NP_002063
augacccuggagagcaucauggccugcugucucuccgaagaggcuaaggaagccagacggauuaacgacgagaucgaacgccagcugagacgggauaaacgcgacgcgagacgggagcuuaagcugcuccugcuuggcacaggggagucuggaaaaagcacguucauuaagcaaaugcgcaucauucacggcuccggguacucugaugaagacaaaagaggauuuaccaagcugguguaucagaauaucuucacagcuaugcaggccaugauccgggccauggauacccucaagauucccuacaaauaugagcauaacaaggcucacgcccagcugguccgcgaaguugacguggagaaagugagcgcuuuugagaauccuuacgucgaugccaucaagucccuguggaacgacccgggcauucaagaaugcuaugauagacggcgcgaguaccagcucucugacagcacaaaauauuaccugaaugaucuugacagaguggcggaucccgccuaccugccuacccagcaggacguucuccgggugcgcguccccacaaccgggaucauugaauauccuuucgaccugcaauccgugaucuuuagaaugguugaugugggaggccagcggagcgagagacgcaaguggauucauuguuucgaaaacgucacgucuaucauguuucuuguggcucuguccgaguacgaccaggugcucgucgagagcgauaaugaaaaccggauggaggaaucuaaggcccuguucagaaccaucauuacauaucccugguuucaaaauuccagcguuauccuguuccucaacaaaaaggaccugcuugaggagaaaauuauguacucucaccugguggauuauuuuccugaauacgacggcccgcagcgcgaugcucaggccgcgcgggaguucauccucaagauguuuguggaccugaaucccgauuccgacaaaauuaucuauagccauuuuaccugcgccacagauaccgaaaacaucagauucgucuucgcugccgugaaggacacgauucuucagcugaaucucaaagaguacaaccugguuuga

SEQ ID NO: 69827 - RNA, 1185 nt, Artificial Sequence
  derived and/or modified sequence opt5 from GNAS__Homo_sapiens__NP_000507
augggcugccuggggaacagcaagaccgaggaccagagaaaugaagagaaagcccaacgggaagcuaacaagaaaaucgagaagcagcuccagaaagauaaacagguguaccgcgccacacacagacugcuucugcucggagcgggcgaauccgggaagucuacgauugucaagcaaaugcggauccugcauguuaauggauucaacggcgaagggggagaggaggacccccaggcugcccgcagcaauuccgauggcgagaaggccaccaaagugcaggacauuaagaacaaucuuaaagaagcuaucgagacaauuguggccgcuaugucuaaccuggucccuccgguggagcucgccaaucccgaaaaccaguuuagaguugauuauauccugagcgugaugaaugucccugacuucgauuuucccccugaguucuacgaacacgcgaaggcccugugggaggacgaaggcgugcgggcuuguuaugagcgcuccaacgaguaccaacucaucgauugcgcccaguauuuucuggacaagauugauguuaucaaacaggcugacuacgugcccucugaucaggaccuucugagaugucggguccucaccagcgggauuuucgaaacaaaguuucaaguggacaaagugaauuuccauauguuugaugucggaggccagcgcgacgagagacggaaguggauccagugcuucaacgauguuaccgccauuaucuuugugguggcguccagcucuuauaauauggucauucgcgaagacaaccaaacaaacagacugcaggaggcccuuaaucuguucaaauccaucuggaacaaucgguggcuccgcaccaucagcgugauucuguuucugaacaagcaggaucuccuggcugaaaaaguucuugccgggaagucuaagaucgaggacuacuucccugaguucgcuagauacacgaccccggaagaugccacacccgagccuggagaagacccccgggugaccagagccaaauauuuuauucgcgaugaguuccugcggaucuccacagcuagcggcgacgggagacacuacuguuauccucauuuuaccugcgcggucgauacggaaaauauucgccggguguucaacgacuguagagacaucauccagcgcaugcaccuccggcaauacgagcugcuuuga

SEQ ID NO: 69828 - RNA, 1053 nt, Artificial Sequence
  derived and/or modified sequence opt5 from GNAT1__Homo_sapiens__NP_653082
augggcgccggggcuagcgccgaggaaaagcacuccagagagcuggaaaagaagcucaaagaggacgcggaaaaggaugcucggaccgugaaacugcuucugcucggagccggcgagucugggaaaagcacaaucgucaagcagaugaaaauuauccaucaagacggauacucccuggaggaaugccuugaguucauugccaucauuuauggcaacacgcugcagucuauccucgcuaucguucgcgccaugaccacacugaauauucaguacggggauagcgcuagacaggacgaugcccggaagcugaugcacauggcggacaccaucgaagagggaacaaugcccaaagagauguccgauauuauccaacgccucuggaaggacucuggcauucaggccuguuuugaaagagcuagcgaguaucagcugaacgauuccgccggcuacuaucuuagcgaccuggaacggcucgugaccccuggguacgugccgacagagcaggauguccugcgcucuagagugaaaaccacgggaaucauugaaacccaauucuccuuuaaggaccuuaauuuccggauguuugauguuggcgggcagcgcagcgagagaaagaaauggauccauugcuucgagggagugacauguaucauuuuuaucgcugcccugucugcguaugacaugguccucguggaagacgaugagguuaaccggaugcacgaaucccugcaucuguucaauagcauuugcaaccaccgcuacuuugccaccacaucuaucguccucuuccugaauaagaaagacguguuuuucgagaagauuaaaaaggcucaccuuuccaucuguuuucccgauuacgacggcccuaacaccuaugaagaugccgggaauuacaucaaagugcaguuccuggagcucaacaugagacgggacgugaaggagauuuauagccauaugacgugcgcuacagauacccagaaugucaaguucguuuuugacgccgugacagauaucauuaucaaagaaaaccugaaggacuguggacuuuucuga

SEQ ID NO: 69829 - RNA, 1065 nt, Artificial Sequence
  derived and/or modified sequence opt5 from GNAT3__Homo_sapiens__NP_001095856
augggcagcgggaucuccucugagagcaaggaauccgccaaaagaucuaaggagcuggagaaaaagcuccaggaagacgcugaacgggaugcccgcaccgugaaacugcuucugcucggagcgggcgagagcgggaaguccacaauugucaagcaaaugaaaaucauucacaagaacggauacucugagcaggaaugcauggaguucaaagcuguuaucuauagcaauacgcugcaguccauucuugccaucgugaaggccaugaccacacugggcaucgacuacgugaaccccagaagcgcugaagaucagcggcaacucuaugccauggcuaauacccuggaggacgggggaaugacaccucagcuggccgaggucauuaaacgccucuggagagauccgggcauccaggcguguuuugaacgggccucugaguaccagcugaacgacuccgcugccuauuaccuuaaugaucuggaccgcauuaccgcuagcggcuaugugcccaacgaacaagauguucuccauucuagagugaagacaaccgggaucauugagacgcaguucuccuuuaaggaccugcacuuccggauguuugaugucggaggccagcgcagcgaacggaaaaaguggauccauugcuucgagggggugaccuguauuaucuuuugcgccgcgcuuucugccuacgacaugguucugguggaggaugaagaggucaauagaaugcacgaaucccuccaucuguucaacagcaucuguaaucacaaauacuuuuccacaaccucuauugugcuguuccucaacaagaaagacaucuuucaggagaaggugacaaaaguccaccugagcauuugcuucccugaauauaccggacccaauacguuugaggacgcuggcaacuacaucaagaaucaauuccuugaucugaaccucaagaaagaggacaaggaaauuuauucccauaugacaugugccaccgauacacagaauguuaaauucguguuugacgcugugaccgauaucaucauuaaggagaaccugaaagacugcgggcuuuucuga

SEQ ID NO: 69830 - RNA, 1068 nt, Artificial Sequence
  derived and/or modified sequence opt5 from GNAZ__Homo_sapiens__NP_002064
augggcugcagacagagcuccgaggaaaaggaggccgcucggcgcucuagacggaucgaccgccaccugagaagcgaaucccaacggcagcgcagagagauuaaacuccugcuucuggggaccucuaacagcggaaaguccacaaucgugaaacagaugaagauuauccauucuggcggguucaaucucgaagccuguaaagaguacaagccccugauuaucuauaacgcgaucgauagccuuacgcggauuauccgcgcucuggccgcccucagaauugacuuucacaauccugaucgggcuuacgacgccguccagcuguucgcucugaccggaccggccgaguccaagggcgaaaucacacccgagcuccuggggguuaugcgcagacuuugggcggauccuggagcccaggcuugcuuuagccggucuuccgaauaucaucuggaggacaacgccgcuuacuaucucaaugaucuggagcgcauugccgcggccgacuacauccccaccguggaagauauucuuagaagccgggacaugacaaccggcaucguggagaacaaauucacauuuaaggaacugaccuucaaaauggucgaugugggcgggcaaagaucugagcgcaagaaauggauccacuguuuugaaggaguuacggcuauuaucuucugcguggagcucuccggcuaugaccugaagcuguacgaggauaaucagaccagccggauggccgaaucucucagacuguuugacuccauuuguaacaauaacugguucaucaauacaagccuuauucuguuucucaacaagaaagaccugcuugcugagaagauccgccggaucccucugaccauuugcuuccccgaauacaaagggcagaauacauaugaggaagccgccgucuacauccaaagacaguuugaggaucucaaccgcaauaaggagaccaaagaaauuuauucccauuucacgugugcuacagacaccucuaacauccaguucguguuugaugcgguuacagacgugauuauccagaacaaucugaaguacaucggacugugcuga

SEQ ID NO: 69831 - RNA, 984 nt, Artificial Sequence
  derived and/or modified sequence opt5 from GNB1L__Homo_sapiens__NP_443730
augaccgcccccugcccuccgcccccucccgacccucaguucgugcugagaggcacacaaagccccguccacgcucuccauuuuugugagggggcccaggcgcagggacggccucugcuuuucuccggcucucagagcgggcugguucacaucuggucccuccaaacgcgcagagcugugaccacacuggauggacauggcgggcagugcgugaccuggcuucagacacugccgcagggacggcaacuccugucucagggccgcgaccugaagcucugucugugggaucuugccgaaggcagaagcgccgucguggacuccguuugccuggagucugugggguuuugucggagcuccauucucgcuggaggccagccccgcuggacccuggccgucccugggagaggaagcgaugaagugcagauccuugagaugcccucuaaaacauccguuugcgcucugaagccuaaagccgacgcgaagcucggcaugcccaugugucugcggcuguggcaagccgauugcagcucucgcccgcuccugcuugcuggguacgaagacggauccgugguccugugggaugugagcgagcagaaaguguguucuagaauugccugccacgaggaaccugucauggaccucgauuucgacucccagaaggcucggggcaucagcggcuccgccgggaaggcgcuggccguuuggucucuugauuggcaacaggcucuccaggugcgcggaacccaugagcugacgaaccccggcauugccgaagugaccaucagaccugaccggaaaauccuggcuacagccgggugggaccaccgcauuagagucuuucacuggcggaccaugcagccccuggccgugcucgcuuuccauagcgcggccguucaauguguggcuuuuacagccgauggacugcuugccgcuggcuccaaggaccagagaaucagccuguggucucucuauccccgcgccuga

SEQ ID NO: 69832 - RNA, 954 nt, Artificial Sequence
  derived and/or modified sequence opt5 from GNB2L1__Homo_sapiens__NP_006089
augaccgagcagaugacacugagaggcacgcucaaggggcacaacggaugggugacccagaucgccacaacaccccaguucccugacaugauucugagcgcuucccgggauaaaaccaucauuauguggaaacuuacccgcgacgaaacaaauuacggcaucccgcagagagcccugcgggggcauucucacuuugucagcgauguugugauuuccucugacggacaguucgcgcucagcggcuccugggaugggacccugcgccuuugggaccugacgaccggaacaaccacaagacgguuugugggccauaccaaggauguccucucuguggcuuucagcuccgacaaccgccaaaucguuagcggcucuagagauaagacgaucaaacuguggaauacacugggggugugcaaguauaccguccaggacgagucccacagcgaaugggugucuuguguucgguuuucccccaacagcucuaauccuauuaucguguccugcggaugggauaagcucgucaaaguguggaaccuggccaauuguaaacuuaagacaaaccauauuggccacaccggguaccugaauaccgugacagucagccccgacggaucccucugcgccucuggcgggaaggauggacaggcuaugcugugggaccuuaacgagggcaaacaccuguauacgcucgacggcggggauaucauuaaugcccuguguuucagcccuaaccgcuacuggcugugcgcugccaccggacccuccaucaagauuugggaccucgaaggcaagaucaucguugaugagcugaaacaggaggugauuagcacaucuuccaaggcggaaccuccgcaauguaccagccuugccuggucugcugacgggcagacacuguuugccggauauaccgauaaucucgugagagucuggcaagugacgaucggcacacgguga

SEQ ID NO: 69833 - RNA, 1023 nt, Artificial Sequence
  derived and/or modified sequence opt5 from GNB3__Homo_sapiens__NP_002066
augggcgagauggaacagcugagacaagaggccgaacagcucaagaaacagaucgcugacgcccggaaggcgugcgcugaugugacccuggccgagcuugucagcgggcuggaaguugugggacgcgugcagaugagaacacggcgcacgcucagaggccaccuggccaaaauuuacgcuaugcauugggccaccgacuccaagcuccuggucucugcuagccaagaugggaaacucaucgugugggacuccuauacaaccaacaagguucacgccauuccccugcggucuagcugggugaugacaugugcguacgccccuuccggaaauuucgucgcuugcggcgggcuggauaacauguguucuaucuauaaucucaagagccgcgagggaaacgugaaaguuuccagagagcugagcgcccauaccggcuaccuuucuugcugucgguuucuggacgauaauaacauugugacauccagcggcgacaccacgugcgcucucugggauaucgaaaccgggcagcagaagacagucuucgugggacacaccggcgacuguaugucucuggccguguccccggauuuuaaucuuuucaucagcggggcgugcgacgccucugcuaaacugugggauguccgcgagggaacauguagacagaccuuuacgggccaugaauccgacauuaacgccaucugcuucuuucccaauggggaggcuauuuguacaggaagcgacgaugccuccugccggcuuuucgaccugcgcgccgaucaagagcugaucugcuuuucucacgaaagcauuaucuguggcauuaccuccguugcuuucagccucucuggcagacugcuuuuugcgggguaugacgauuucaacugcaaugugugggacuccaugaaaagcgagcgggugggaauccugucuggccacgauaaccgcgucagcugucucggggugacagccgacggaauggcuguugccaccggcuccugggauucuuuucugaagaucuggaauuga

SEQ ID NO: 69834 - RNA, 1023 nt, Artificial Sequence
  derived and/or modified sequence opt5 from GNB4__Homo_sapiens__XP_006713784
augagcgagcuggaacagcucagacaagaggccgaacagcugcggaaccagauccaggacgcucgcaaggccugcaaugaugcgacccuugugcaaauuacauccaacauggacucugucggcagaauccagaugcggacgcgcagaacccugcgggggcaccucgcuaaaauuuacgccaugcauuggggauaugauagccgccugcuuguuuccgccucucaggacggcaagcugaucauuugggauagcuacacaaccaauaaaaugcacgcuaucccccucagauccucuugggugaugacaugugccuaugcuccuagcgggaacuacguggccugcggaggccuggacaauaucuguuccauuuauaaccugaagacccgggaggggaauguccgcgugagcagagaacucccgggacauacaggcuaccugucuugcugucgguuccuugaugacucccagaucguuaccagcucuggcgauacgaccugcgcgcugugggacauugagacagcccaacagaccacaaccuuuacggggcacuccggagaugugaugagccucucucugucccccgacaugcgcacauucgucagcggcgcuugugaugccuccucuaaacuuugggacaucagagacgggaugugccggcagagcuuuaccggacauguguccgauauuaacgcuguuagcuucuuuccuaauggcuaugccuucgcgacagggucugacgaugccaccugucgccuguuugaccucagagcugaucaggagcugcugcucuacucccacgacaacaucauuugcggaaucaccagcguggccuucucuaagagcggccggcugcuucuggcuggcuacgaugacuuuaauuguaacgucugggauacacucaagggggacagagccggagugcuggccggccacgauaaucgcguguccugccuuggggucacggacgacggaauggcuguugcgaccggcucuugggauagcuuccugcggaucuggaacuga

SEQ ID NO: 69835 - RNA, 1062 nt, Artificial Sequence
  derived and/or modified sequence opt5 from GNB5__Homo_sapiens__NP_006569
auggccaccgagggccugcacgaaaacgagacacucgcuagccugaaguccgaagccgagucucuuaaagggaagcuggaagaggagagagcgaaacuccaugacguggaacugcaccaggucgcugagcggguugaagcccuuggacaauucgugaugaagacgcgcagaacccugaaaggccaugggaauaaggugcucugcauggauugguguaaggacaaacggcgcaucgucagcuccucucaggauggaaaggugauuguuugggacagcuuuacaaccaacaaagagcacgccgugacaaugcccugcaccugggucauggcuugugccuacgcuccuuccggcugcgccaucgcgugugggggacuggauaauaagugcucuguguauccgcugacauucgacaaaaacgagaauauggccgcuaagaagaaaagcguugccaugcauaccaacuaccucuccgcuuguagcuuuaccaauucugauaugcagauucugacggccuccggcgacggcacaugcgcgcuuugggauguggaaagcgggcagcugcuccaaucuuuccacggacacggcgccgacguccugugucuugaucuggcucccuccgagaccgggaacacauuugugagcggaggcugcgacaagaaagccauggugugggauaugagaucugggcaguguguccaggcuuucgaaacccaugaguccgacaucaauagcguucgguauuacccuuccggagacgccuuugccucuggcagcgaugacgcuacgugccgccucuaugaucugagagcggaccgggaaguggccauuuacuccaaggagagcaucaucuucggcgcuucuuccguggauuuuagccugucugggcgccuccuguucgccggauauaacgacuacacaauuaaugucugggaugugcuuaaaggcagcagaguuuccauccuguuugggcacgagaaccgggugucuacccuccgcgucagccccgacggaacagccuucugcuccggcagcugggaucauacccugagagugugggcuuga

SEQ ID NO: 69836 - RNA, 2262 nt, Artificial Sequence
  derived and/or modified sequence opt5 from GNE__Homo_sapiens__NP_001121699
auggagaccuacggcuaucugcagagagaaagcugcuuccaagggccccacgagcucuacuuuaagaaccuguccaaacggaauaagcagaucauggaaaagaacggaaauaaccgcaagcugagagugugugucgccacaugcaaucgggcugacuauucuaaacuggccccuauuauguucggcaucaagacggagccggaauuuuucgagcucgauguuguggugcuggggagccaucuuauugacgauuacggaaacaccuaucgcaugaucgagcaggacgauuuugacauuaauacaagacugcacaccaucguccggggcgaagaugaggcggcuaugguggaauccguugggcucgcccuggugaagcugcccgacguccucaaccgccugaaaccugauaucaugauugugcauggagacagauucgaugcccuugcucuggccacaucugcugcccucaugaauauccggauucugcacaucgagggcggcgagguuagcgggaccauugacgauuccauccgccaugcgauuacaaaacuugcccacuaccacguguguugcaccagaucugcugaacagcaucugaucagcaugugugaggaccacgaccggauccuccuggccggaugccccuccuaugauaaacugcucagcgcuaagaacaaagacuacaugucuauuauccgcauguggcugggcgaugacgucaaguccaaggauuacauuguggcccuucaacauccugugacgaccgacaucaaacacagcauuaagauguuugaacugacacucgaugcgcugaucucuuucaauaaaagaacccuuguccuguuucccaacaucgacgccggguccaaggagaugguucgggugaugcgcaaaaagggaauugaacaccauccuaauuucagagcugugaaacacgucccguuugaucaguucauccagcucguggcccaugcuggcuguaugauugggaacagcucuugcggaguucgggaggugggcgccuuuggcacacccgucaucaaucuggggaccagacagauuggacgcgagacgggcgaaaacgugcugcacguucgggacgccgauacacaagacaagauccuccaggcucugcaucuucaguucgggaagcaguauccuuguuccaaaaucuacggagacggcaacgcggugccccgcauucugaaguuccucaaaagcaucgaucugcaagagccucuucagaagaaauuuugcuuucccccggucaaggaaaauauuucccaggacaucgaucacauucuggagacccucucugcccuggcuguggaccuugggggaacaaaccucagagucgccaucgugagcaugaagggcgaaauuguuaaaaaguauacccaauucaauccuaaaaccuacgaggagcggaucaaccugauccuucagauguguguggaagccgcugccgaggcggucaagcugaauugccgcauucucggcguggggaucuccacaggaggcagaguuaacccccgggaagggauugugcugcacagcacgaaacugauccaggaguggaacucugucgaucuuagaaccccucucuccgacacacugcaucugcccguguggguggauaaugacggaaauugcgcugcccucgccgaacgcaaguucggccaggggaagggccuggagaacuuuguuacccuuauuacaggaaccggcaucgggggaggcaucauucaccaacaugagcugauccacgggagcucuuucugugcugccgaacucggacaccuggucgugagccuggauggccccgacugcuccugugggucucauggcugcauugaggcuuaugccagcggaauggcgcuucagcgggaagccaaaaagcuccacgaugaggaccugcugcucguggagggcauguccgucccuaaagaugaagcugugggggcccugcaucuuauccaggcugccaagcugggaaaugcgaaagcccagagcauucucagaacggcuggcacagcccuggggcugggaguugugaacauccuucacaccaugaauccgucucucgucauccuguccggcgugcuggcuagccauuacauucacaucguuaaggacgugauucgccaacaggcccucucuuccguccaggacguggauguuguggucagcgaccugguggaucccgcccuucugggggcugcguccauggugcucgacuauaccacacggagaaucuacuga

SEQ ID NO: 69837 - RNA, 207 nt, Artificial Sequence
  derived and/or modified sequence opt5 from GNG10__Homo_sapiens__NP_001017998
augagcuccggcgccucugcuagcgcccugcagagacucguggagcaacugaaacuugaagcgggggucgagcggaucaagguuucccaggcugccgccgaacugcagcaguacugcaugcaaaacgcuuguaaggacgcccuccuggugggagugcccgcuggcucuaauccuuuccgcgagccgagaagcugcgcccuucuguga

SEQ ID NO: 69838 - RNA, 222 nt, Artificial Sequence
  derived and/or modified sequence opt5 from GNG11__Homo_sapiens__NP_004117
augcccgcccugcacaucgaggaccucccugaaaaggagaaacugaagauggaaguggagcagcuuagaaaagaagucaagcugcaacggcagcagguuagcaaaugcuccgaggagauuaagaacuacaucgaggaacgcucuggcgaagauccgcucgugaaggggauucccgaggacaaaaauccuuucaaggagaaaggaagcugugugaucuccuga

SEQ ID NO: 69839 - RNA, 216 nt, Artificial Sequence
  derived and/or modified sequence opt5 from GNG2__Homo_sapiens__XP_011535148
auggccagcaacaauaccgcuuccaucgcccaggcgagaaagcugguggaacaacucaaaauggaagcuaacauugaccggaucaaggucucuaaagccgccgcugaucugauggccuacugcgaggcucacgccaaggaagacccccuucugacaccuguuccggcgagcgagaaucccuuccgcgagaaaaaguuuuucugugccauucucuga

SEQ ID NO: 69840 - RNA, 228 nt, Artificial Sequence
  derived and/or modified sequence opt5 from GNG4__Homo_sapiens__NP_004476
augaaggagggcaugagcaacaauuccaccacaucuaucagccaggccagaaaagcuguggaacaacugaagauggaggccugcauggaccgggucaaaguuucccaggcggcugccgaucuccuggccuacugugaagcucacgugcgcgaggacccccuuauuaucccugugccggccucugaaaaccccuucagagagaagaaauuuuucugcacgauucuguga

SEQ ID NO: 69841 - RNA, 207 nt, Artificial Sequence
  derived and/or modified sequence opt5 from GNG7__Homo_sapiens__NP_443079
augagcgccaccaacaauaucgcucaggccagaaagcugguggagcaacuccggauugaagcgggcaucgagcgcauuaaagucuccaaggcugccucugaccugaugagcuacugcgaacagcacgccagaaacgauccccuucugguuggggugccugcuuccgagaauccguucaaagacaagaaacccuguaucauucucuga

SEQ ID NO: 69842 - RNA, 213 nt, Artificial Sequence
  derived and/or modified sequence opt5 from GNG8__Homo_sapiens__NP_150283
augagcaacaauauggccaagaucgcugaggccagaaaaaccguggaacagcugaagcucgaggucaacauugaccggaugaaaguuucccaagcggcugccgaacugcuugccuucugcgagacacacgcuaaggaugacccccuggugacgccugugccggccgcugaaaaucccuuucgcgauaaaagacucuucuguguccugcuuuga

SEQ ID NO: 69843 - RNA, 225 nt, Artificial Sequence
  derived and/or modified sequence opt5 from GNGT1__Homo_sapiens__NP_068774
augcccgugaucaacauugaggaccugaccgaaaaggauaaacucaagauggaggucgaccagcugaaaaaggaaguuacacuugagagaaugcuggugagcaaaugcugugaagaggugcgggauuacgucgaggaacgcuccggcgaggacccucucgugaaggggaucccggaagauaagaaucccuucaaagagcugaagggaggcugcguuauuucuuga

SEQ ID NO: 69844 - RNA, 210 nt, Artificial Sequence
  derived and/or modified sequence opt5 from GNGT2__Homo_sapiens__XP_006721882
auggcccaggaccugagcgagaaggaucuccugaaaauggaaguggagcaacuuaagaaagaagucaagaacaccagaauccccauuuccaaagcuggcaaggagaucaaggaauacguugaggcccaggcggggaaugacccuuuccugaaaggcauuccggaggauaagaaccccuuuaaagaaaagggagggugccucaucucuuga

SEQ ID NO: 69845 - RNA, 1824 nt, Artificial Sequence
  derived and/or modified sequence opt5 from GNL1__Homo_sapiens__NP_005266
augcccagaaagaaaccuuucagcgugaagcagaaaaagaaacaacugcaggacaagcgggagcgcaagagaggccuccaggaugggcugcgguccucuagcaacucccgcucuggaagcagagaacggcgcgaggaacagaccgacacauccgauggcgagucugucacgcaccauaucagacggcuuaaucaacagccgagccaggggcugggaccccgcggcuacgacccuaacagauaucggcuccacuuugaacgcgauuccagagaggagguugaacggcgcaaaagagccgcucgggaacaggugcugcaacccgugagcgccgagcuucuggagcucgacauuagagaggucuaccagccugggucugugcuggauuucccccgccggccuccgugguccuaugaaaugagcaaggagcagcugaugucucaggaagagagauccuuucaagacuaccucggaaaaauccauggcgcguauagcucugaaaagcuguccuacuucgagcacaaucuugagaccuggcgccagcuguggcggguucucgaaaugagcgauauugugcugcuuaucacagacauuagacaucccgucgugaacuuuccucccgcucuguaugaguacguuaccggcgaacucgggcuggcccuggugcucguccugaauaaaguggaucuugccccucccgcucugguggucgccuggaagcacuacuuccaccagcauuauccgcaacuccacguugugcuguuuacauccuucccucgcgacccccggaccccucaggaucccucuagcgugcuuaagaaauccagacgccggggaagaggcuggacacgcgcucuggggcccgagcagcuccugcgggccugcgaagcgaucaccgucggaaagguggaccugagcucuuggagagagaaaaucgcccgggacguugcuggcgccacgugggggaacggauccggcgaggaagaggaagaggaagauggcccugcugugcucgucgagcagcaaaccgacagcgccauggagccgacagggcccacccaggaacgcuacaaggauggagugguuacaauuggcugugugggguuuccuaaugucggaaaaucuagccugaucaacggccuuguggggagaaaggucguguccguuucucggacccccggacauacgagauauuuccagacauacuuucugaccccuagcgugaaacucugcgacugucccggccugauuuucccgucccuucugccucgccagcuccaaguccuggcgggcaucuaucccauugcccagauccaggagccuuacacagcugugggguaucuggccagccggauucccguucaggcucuccugcaccuuagacacccugaagccgaggaucccucugccgagcauccguggugcgcuugggacaucugugaagcgugggccgagaagcgcggauacaagaccgcuaaagccgccagaaaugauguguaccgggcugccaacucccugcuccgccuggcggucgacggcagacugagccuuugcuuucacccucccggguauucugaacaaaagggaaccugggagucccaucccgaaacaacggagcucguggugcugcagggccggguugggccugcuggcgaugaggaagaggaagaggaagaggagcugagcuccucuugugaagaggaaggagaggaagaccgcgaugccgacgaggagggcgaaggggacgaggaaaccccgacaagcgcccccggauccucucucgcuggcagaaauccuuacgcccugcuuggggaggaugagugcuga

SEQ ID NO: 69846 - RNA, 1650 nt, Artificial Sequence
  derived and/or modified sequence opt5 from GNL3__Homo_sapiens__NP_055181
augaagagacccaaacugaagaaagccagcaagcggaugaccugccacaaacgcuacaagauccagaagaaagugagagagcaucaccggaagcuccgcaaagaagcuaagaaaagaggccauaagaagccucggaaagacccggggguccccaacuccgccccuuucaaggaggcgcugcuucgcgaagcugagcugagaaaacaacggcucgaagaacugaagcagcagcagaaacuugaucgccaaaaggagcuggagaaaaagagaaagcucgagacaaaucccgacauuaaaccuucuaacguugaacccauggagaaggaguuuggacuguguaaaacggaaaauaaggccaaaagcggcaagcagaacuccaagaaacuguauugccaggagcucaagaaagugaucgaagccucugaugugguccuggaggugcuugacgcucgggauccucuggggugucgcugcccgcagguugaagaggccauugugcaaagcggacagaagaaacucguccugauccuuaauaaguccgaccuggugcccaaggagaaccucgaaucuuggcugaauuaccugaaaaaggagcucccuaccguuguguucagagcuagcacaaaacccaaggauaaaggcaagauuaccaagcgggucaaagccaagaaaaacgcggccccuuuucgcuccgaaguguguuucgggaaggagggacuguggaaacuucugggcggcuuucaggaaacaugcagcaaggcuaucagagugggggucaucggauuccccaauguuggcaaaucuuccauuaucaacagccucaagcaggagcaaauguguaaugugggggugucuaugggacugacccgguccaugcaggucgugccgcuugacaagcagauuacaaucauugauagcccuucuuuuaucguuagcccccugaacuccuccucugcccucgcucugagaagcccugccuccauugagguggucaaacccauggaagcggccagcgcuauccugucucaagccgacgcucgccaggugguucucaaguauaccgugcccggcuacagaaauucccuggaguucuuuacgguccuugcccagcggcgcgggaugcaccagaaaggaggcaucccuaacguggaaggcgccgcuaagcugcucuggagcgaguggaccggggcgucucuggccuauuacugccauccgcccacaagcuggaccccucccccuuauuucaaugaauccauugucguggauaugaaaucuggauuuaaccuugaggagcuggaaaagaacaaugcucaaagcauccgggccauuaagggcccccaccucgccaacuccauccuguuccagagcucugggcugacaaauggaauuaucgaggaaaaagacauccacgaggagcucccgaagagaaaagaacgcaagcaggaggaacgggaggaugacaaagacuccgaucaggaaaccguugacgaggagguggaugaaaacagcucuggcauguuugcugccgaggaaacgggggaggcgcuguccgaagagacaaccgcuggagagcaaagcacaagauccuucauucuugacaagaucauugaagaggaugacgccuacgauuucucuaccgacuacgucuga

SEQ ID NO: 69847 - RNA, 1749 nt, Artificial Sequence
  derived and/or modified sequence opt5 from GNL3L__Homo_sapiens__NP_061940
augaugaagcugagacacaaaaacaagaaacccggcgaggggagcaagggacauaaaaagaucuccuggccuuacccgcagcccgccaagcaaaauggcaaaaaggcuaccucuaaagugccuagcgcuccccacuucguccauccuaacgaccacgcgaaucgggaagcugagcucaagaaaaaguggguugaagagaugcgcgaaaagcagcaggccgccagagagcaggagcggcaaaaacgcagaacaauugaauccuauugccaggaugugcugcggcgccaggaggaauuugagcauaaggaggaagugcuucaggagcugaacauguucccccaacucgacgaugaagcuacgagaaaagccuacuauaaggaguuucggaaagucguggaauacucugacguuauccuggaggugcuugaugcucgcgacccucugggguguagaugcuuccagauggaggaagccguccuccgggcgcagggaaauaagaaacuggugcugguucucaacaagauugaucuggugccgaaggaggucguggaaaaauggcuugacuaucugcgcaaugagcuccccaccguggccuuuaaggcuagcacacagcaccaagucaaaaaccugaauagauguuccguuccuguggaucaggccucugaaagccuucugaaguccaaagccugcuucggcgccgagaaccucaugcgggugcuggggaauuacugucgccugggagaggucagaacccacauccgggugggcguugugggccuccccaacgucggaaagagcucucugauuaauucccuuaagagaagccgcgcgugcucugugggggccguuccuggcaucacaaaauuuaugcaggaaguguaucuggacaaguucauccggcuccuggaugcucccgggauugucccgggaccuaacuccgaggugggcaccauccuuagaaauuguguccaugugcaaaaacuggccgaccccguuacaccuguggaaaccauucuccagcgcugcaaccuggaggaaaucagcaacuacuacggggucucuggauuucagacgaccgagcacuuccugacagcuguggcccaucggcucggcaagaaaaagaagggcgggcuguauucccaggagcaagccgcuaaagcgguucuugccgauugggugagcggaaagauuuccuuuuacaucccuccgcccgcuacccacacacugcccacccaccucucugccgaaauugucaaagagaugacggaaguguucgacaucgaggacacagagcaggccaaugaagauaccauggagugucuggcuacaggcgaaagcgacgagcuucugggggauaccgacccccucgaaauggagaucaagcugcugcauuccccuaugaccaaaauugccgaugcgaucgagaacaagacaacgguguauaagauuggagaccucaccggcuacugcacaaaucccaacagacaccagauggggugggcuaaacgcaauguugaucaucggccuaagagcaacucuauggucgacguguguuccguggauagacgcagcguccugcagcggaucauggaaaccgacccccuucaacagggacaggcccuggccucugcucucaaaaauaagaaaaagaugcagaaaagagccgauaagauugcuagcaagcuguccgacucuaugaugagcgcccuggaccuuuccggcaacgcggaugacggcgugggggauuga

SEQ ID NO: 69848 - RNA, 519 nt, Artificial Sequence
  derived and/or modified sequence opt5 from GNLY__Homo_sapiens__NP_001289687
auggccaccugggcucugcuccugcuugccgcgaugcugcucggcaaccccgggcuggaggugagcgucuccccuaagggcaaaaauacaucuggaagagaaagcggguucggaugggcuaucuggauggagggccuuguguuuucccggcugucuccggaauacuaugaccucgcccgcgcccaccugagagaugaggaaaagagcugccccugucuggcucaggaggggccucaaggagaccuccugacgaaaacccaggagcuuggccgggauuaccgcacaugccugaccauuguucagaagcucaaaaagaugguggacaagcccacacagagauccgucucuaacgccgcuacccgggugugucgcacaggcagaagccgguggcgcgauguuugcagaaauuucaugcggcgcuaucaauccagagugacccaggggcuggucgccggagaaacggcgcagcagaucugugaggaccuucggcugugcauuccuagcaccggcccccucuga

SEQ ID NO: 69849 - RNA, 888 nt, Artificial Sequence
  derived and/or modified sequence opt5 from GNMT__Homo_sapiens__NP_061833
augguggacagcgucuacagaacccggucccugggcguugccgcugaggggcuccccgaucaguaugccgacggagaagcggcucgcguguggcaacuguacaucggcgauacaagaucucggacggccgaguauaaggccuggcuucuggggcuccugcgccagcacggaugccagagagugcuugacgucgcuuguggcaccgggguggauagcauuaugcugguugaagagggauucuccgugacaucugucgacgccagcgauaaaaugcucaaguacgcucugaaagaacgguggaaccgcagacaugagccugccuuugacaagugggugaucgaggaagcgaauuggaugacccuggauaaagacguuccgcaguccgccgagggcggcuucgaugcugugauuugccucgggaacucuuuugcccaucugcccgacuguaagggagaucaaagcgaacaccggcuugcucugaagaauaucgccuccaugguccgcgcgggcgggcuccuggugauugaccacagaaacuaugaccauauccuuagcacaggaugcgccccucccggcaaaaauaucuacuauaagucugaucugaccaaagacgugacaaccuccguccucauuguuaacaauaaggcucacauggugacgcuggauuacaccgugcaggucccuggggccggacaggacggcagccccggccugucuaaauuccggcucuccuacuauccucacugucuggcuagcuuuacagagcuucugcaggccgccuucgggggaaagugccaacauucugugcucggcgauuuuaagccguacaaacccgggcagaccuauaucccuuguuacuucauucacguucugaagcgcacagacuga

SEQ ID NO: 69850 - RNA, 2043 nt, Artificial Sequence
  derived and/or modified sequence opt5 from GNPAT__Homo_sapiens__NP_055051
auggagagcuccucuagcuccaacucuuacuucagcgugggccccaccuccccuucugccgucguucugcucuauagcaaggaacugaaaaagugggacgaguuugaagauauccuugaggaaagacggcacguguccgaccugaaauucgcuaugaagugcuacacaccgcucguguauaaagggauuacgcccuguaagccuaucgauauuaagugcagcguccuuaauucugaggagauccauuacgugauuaaacagcuguccaaggaaagccugcaaucuguugacgugcuccgcgaggaagucuccgagauccuggaugagaugagccacaaacugagacucggagccauccgguuuugugcguucacccugucuaagguguuuaaacagauuuucuccaagguuugcgugaacgaagagggcauccagaaacuucagcgcgcuauucaagaacaucccgucgugcugcucccuagccacagauccuauaucgacuuucugaugcuuucuuuccugcucuacaauuaugaucugcccgugccugucauugccgccgggauggacuuucugggaaugaaaaugguuggcgagcuccugcggaugagcggggcuuucuuuaugcgcagaacauucggaggcaacaaacuuuacugggccguguuuuccgaauacgugaaaaccaugcugcggaauggcuaugcuccggucgaguucuuccucgaggggacacgcagcagaucugccaagacccugacacccaaauuuggacuucugaacaucgugauggaaccuuucuuuaagcgggagguuuucgauaccuaccucgugcccauuuccaucagcuaugacaaaauccuggaagagacgcuguacgucuaugaacuccugggcgugccuaagcccaaggagucuaccacagggcuucugaaagcgcgcaagauucucagcgagaauuuuggauccauccauguuuacuucggcgauccggugucucugagaagccuugccgcugggcggaugucccgcagcucuuauaaccuggucccuagauacauuccccagaaacaguccgaagacaugcacgccuuugugaccgaggucgcuuacaagauggaacuccugcagaucgagaauauggugcugagcccuuggacacucauuguugccgugcugcuucaaaaccggcccucuauggauuucgacgcgcuggucgaaaagacccucuggcugaagggacugacgcaggccuuuggcggcuuccuuaucuggcccgacaauaagccugcugaggaggugguuccggccuccauccuccugcacagcaacauugcuucccuggugaaagaucaggucauccucaagguggacucuggggauagcgaagugguugacggacugaugcuucagcauauuacacugcucauguguuccgccuauagaaaucaacugcugaacaucuuuguccgccccucucuuguggccguggcucuccagaugaccccuggcuuccggaaagaggaugucuacagcugcuuuagauuccugcgcgacguguucgcggaugaauuuauuuuccugcccgggaauacacucaaggacuuugaggagggauguuaucugcuuugcaaauccgaagccauccagguuaccaccaaggauauccuggugacagagaagggcaacacgguccucgaguuccugguggggcuguuuaaaccuuucguugagagcuaccaaauuaucuguaaguaucuucucucugaagaggaggaccacuuuuccgaagaacaguaccuggcugccgugcggaaauucaccagccagcugcucgaucagggaacaucucaaugcuaugacguccuguccagcgacgugcagaagaacgcccuugcugccuguguuagacugggcguggucgaaaagaagaagauuaauaacaauugcaucuuuaacgugaaugagcccgcgaccacaaaacucgaagagaugcugggcugcaagaccccgauugggaaaccugcuacggccaagcuguga

SEQ ID NO: 69851 - RNA, 957 nt, Artificial Sequence
  derived and/or modified sequence opt5 from GNPDA1__Homo_sapiens__XP_005268405
augagcuccuucuggucugacuaccuguuucccuucgugcucuggggcaagcugaaaacccagagagggagccaauccaaggauaaaaugaaacuuaucauucuggagcacuauucucaggccagcgaaugggcugccaaauacauccggaaccgcauuauccaguuuaauccuggaccggagaaguauuucacacucggccugcccacgggguccaccccucuuggaugcuacaagaaacugauugaauauuacaagaacggcgaccucucuuuuaaauaugucaagacauucaauauggaugaguacguugggcugcccagagaccauccugaaagcuaccacuccuuuauguggaacaauuucuuuaaacauaucgauauccaccccgagaacacccauauucuggacggaaaugcgguggaucuccaggcugagugugacgccuucgaagagaagaucaaggccgcuggcggcauugaacuguuugucgggggaaucggcccugaugggcacauugccuucaacgagccgggaagcucucuugugucccggacacgcgugaaaacccuggcuauggacacaauccucgccaaugcgagauuuuucgauggcgagcugaccaagguucccacgauggcccuuaccgugggggucggaacagugauggacgcucgggaaguuaugauucugaucaccggcgcccacaaggcuuucgcccucuauaaggcgaucgaggaaggcgugaaccauauguggacagucagcgccuuucaacagcacccucgcaccguguucgugugcgaugaggacgcuacgcuggaacugaaagucaagacaguuaaauacuuuaaggggcucaugcuggugcauaauaaacuuguggacccccuguauucuauuaaggagaaggagaccgaaaaaucccagagcucuaagaaaccuuacuccgauuga

SEQ ID NO: 69852 - RNA, 729 nt, Artificial Sequence
  derived and/or modified sequence opt5 from GNPDA2__Homo_sapiens__NP_001257809
augagacuggugauccucgacaacuacgaucuggccagcgagugggcugccaaguauauuugcaaucggaucauucaguucaaacccggccaagaccgcuacuuuacccuugggcugccuacaggacucccgagaaaccaccccgaauccuaucauucuuacauguggaauaacuucuuuaagcacaucgauauugacccuaauaacgcgcauauccuggauggcaaugcugccgaccuucaggccgagugugaugcuuucgaaaacaaaaucaaggaggccgggggaauugaccuguuugucggcgggaucggacccgauggccacauugcuuucaaugaaccuggcagcucccucguuucucggacgcgccugaaaacccuggccauggacacaauccucgcgaacgccaaguauuuugauggggaccugagcaaggugcccaccauggcucuuacagugggagucggcaccgugauggaugccagagagguuaugauucugaucacaggggcucauaaagccuucgcgcucuacaaggccauugaggaaggagugaaucacauguggaccgucuccgcuuuucagcagcacccucggacgaucuucgugugcgacgaggacgccacccuggaacuucgcguuaaaacagugaaguauuuuaaaggccugaugcauguccacaacaagcucguggauccgcuguucucuaugaaggacgggaauuga

SEQ ID NO: 69853 - RNA, 3771 nt, Artificial Sequence
  derived and/or modified sequence opt5 from GNPTAB__Homo_sapiens__NP_077288
augcuguucaagcuccugcagagacaaaccuacacaugccuuagccaccgguauggccuguacguguguuuucucggggucguugugacgaucguguccgccuuccaguuuggagaggucgugcuggaauggucucgcgaccaguaucauguucuuuucgauagcuacagagacaacauugcuggcaaauccuuucagaaucggcugugccuccccaugccuaucgauguggucuauaccugggugaacgggacagaccuggagcugcucaaggaacugcaacagguucgcgagcagauggaagaggagcagaaagccaugagagaaauucuuggaaagaauaccacagagccgaccaaaaagucugaaaagcaacuggagugucuccugacacacugcaucaaagugcccaugcuuguccuggauccugcgcuccccgcuaacauuacccugaaggaccugccuagccucuaccccuccuuccauucugccagcgauaucuuuaauguggccaaaccuaagaacccguccacgaaugugagcgucguuguguucgacucuaccaaagauguggaggacgcucacuccggccugcuuaaggggaacagccggcagacagucuggcgcggauaucugaccacagauaaggaagugcccggccucguucugaugcaggaccuugccuuucugucuggcuucccucccaccuuuaaagagacgaaucagcucaagacaaaacugccugaaaaccuguccagcaaggugaaacuccugcaacuuuacucugaggcuuccgucgcccugcucaagcugaauaaccccaaagauuuccaggaacuuaauaagcagaccaagaaaaacaugacaaucgacgggaaggagcugaccauuagcccggcguaccuccugugggaccuguccgccaucucucaaagcaaacaggaugaggacauuuccgcuagcagauuugaagauaaugaggaacuccgguauucucugcgcuccaucgagagacaugccccuugggugcggaacauuuucaucguuaccaacggacagauucccagcuggcuuaaucuggacaacccucgcgugacaaucgucacgcaccaggauguguucagaaaucucucucaucugcccaccuuuagcucccccgcuaucgaaucucacauucaccggaucgagggccugagccaaaaguucauuuaccuuaacgacgaugucauguuugggaaagacguguggccugaugacuucuauucccauagcaagggacagaagguuuaccucacauggccggugcccaauugugccgagggcugcccugggucuuggaucaaagauggauauugugacaaggcgugcaacaauuccgccugugacugggauggcggcgacugcagcgggaacucuggaggcucccgcuacauugcugggggaggcgggaccggaagcaucggcgucggccagcccuggcaguuugggggaggcaucaauuccgugucuuauuguaaccaagggugcgccaauagcuggcuggcugauaaauucugcgaccaggccuguaacguucuguccugcggauuugaugccggcgacugugggcaggaucacuuccacgaacucuacaaggugauucugcuuccuaaucagacacauuacaucauucccaaaggcgagugccugccguauuuuucuuucgcugaagucgcgaagagaggaguggagggcgccuacagcgacaacccuaucauucggcacgcuuccaucgccaauaaguggaaaaccauccaucucauuaugcacagcgggaugaacgccacgacaauccauuuuaaccugaccuuccaaaauaccaacgaugaagaguuuaagaugcagauuacaguggagguugacaccagagaaggacccaaacuuaauucuacagcucagaagggcuaugagaaccuggucuccccuaucacgcuccugcccgaagccgagauucuguucgaggauaucccuaaagaaaagcgcuuccccaaguuuaaacggcacgacgugaauagcaccagacgcgcgcaggaggaagugaagauuccgcucgucaacaucucucugcuuccuaaagaugcucaacugucccucaauacacuggaccugcagcuugagcacggggacaucacccucaagggauacaaccugagcaaaucugcccugcuccggagcuuccugaugaacucccagcaugccaagauuaaaaaucaagcuaucauuacagaugaaaccaaugacagccuuguggcuccccaggagaagcagguucacaagucuauccugcccaacucccucggcgugagcgagagacugcagcgccugacguuuccugcugucuccgugaaaguuaaugggcaugaucaaggccagaacccgccccuugaccucgaaaccacagcccgguucagaguggagacccacacacagaagaccauuggaggcaaugucacgaaagaaaagccucccucucugaucgugccucuggagagccagaugacaaaagaaaagaagaucaccgggaaagagaaggagaacucccgcauggaagagaacgcggaaaaucacauuggaguuacagaggugcuccugggccggaaacuucaacauuauaccgauucuuaccugggguuucuccccugggaaaagaaaaaguauuuccaggaccugcuggaugaggaggaaagccuuaagacccagcuggccuacuuuacagacuccaaaaacacgggaagacagcucaaggauaccuucgcugacucucugcgcuacgucaauaaaauccucaacagcaaguuuggcuucacaucccggaaagugccugcccacaugccccauaugauugauagaaucgugaugcaagagcugcaggacauguuuccggaagaguucgauaagaccagcuuucacaagguccggcauucugaggacaugcaguucgcuuucuccuauuuuuacuaucuuaugagcgccguucaaccucugaauauuucucagguguucgacgaaguggauacagaccaguccgggguccucagcgaucgcgagaucagaacccuggcgacgcggauccacgaacugccccuuucucugcaggaccucacaggccuggagcacaugcucauuaacuguuccaaaaugcugccugccgauaucacccaacuuaauaacauucccccgacccaggaaagcuacuaugacccuaaucugcccccugugacaaagucccucguuaccaacugcaaacccgugacagauaagauccauaaagccuacaaggacaaaaauaaguauagauuugagauuaugggagaggaagagaucgccuucaagaugauccgcacgaacgucagccacgugguuggccagcuggaugacauucggaaaaaucccagaaaguuugugugucugaacgauaauaucgaccauaaccacaaagacgcucagaccgucaaggccgugcuucgcgauuucuacgaaucuauguuuccuauuccgagccaauucgagcugcccagagaauaccggaaccgcuuucuccauaugcacgagcugcaggaguggagagccuaucgggacaaacucaaguucuggacacacugcguucuggcuacccuuaucauguuuacaauuuucuccuucuuugcggaacagcugaucgcccugaagcgcaaaauuuucccuagacggcgcauccauaaggaggcuucucccaauagaauccggguguga

SEQ ID NO: 69854 - RNA, 918 nt, Artificial Sequence
  derived and/or modified sequence opt5 from GNPTG__Homo_sapiens__NP_115909
auggccgcuggccuggccagacuccugcuucugcucgggcugagcgcgggaggccccgcuccugccggggccgcuaagaugaaaguggucgaggaaccgaacgccuucggaguuaauaaccccuuucuuccucaggcuucccggcugcaagccaagcgcgaccccucuccugugagcggccccgugcaccucuucagacuguccgggaaaugcuuuucucuggucgagagcaccuacaaguaugaguucuguccuuuucauaaugugacacagcacgaacagacguuccgguggaacgcguacuccggaauccucggcauuuggcaugaaugggagaucgccaauaacaccuuuacaggcauguggaugcgcgauggggacgcuugcagaucucggagccgccaguccaaaguugagcuggccuguggaaagagcaauagacuugcucacgugucugaaccguccacaugcgucuaugcccugaccuucgagacaccccucgugugucauccucacgcgcugcuuguuuaccccacccugccugaagcccuccaacggcagugggaucagguggagcaggaccuggcugaugagcugauuacgccccaaggccacgaaaagcuccugcgcacccuuuuugaggacgccggguaucugaaaaccccggaagagaacgaaccuacacagcucgagggaggccccgauagccugggguucgagacccuugaaaauugcagaaaggcucauaaagagcugucuaaggaaaucaaacggcucaagggacugcugacacagcacggcauuccuuacacccgccccacggagacauccaaccucgaacaucugggccacgagacccccagagccaagagcccugagcagcuucgcggggacccgggacugcggggcucucucuga

SEQ ID NO: 69855 - RNA, 291 nt, Artificial Sequence
  derived and/or modified sequence opt5 from GNRH1__Homo_sapiens__NP_000816
augugccugagaaugaagcccauccagaaacuccuggccggccuuauucugcucaccugguguguggaggggugcagcucccaacacuggucuuacggacugcggccuggcgggaagcgcgacgcugaaaaccuuaucgauagcuuccaggagauugucaaagaaguuggacagcuggccgagacacagagauuugaauguacgacccaucaaccgcggucuccccuccgcgaccugaagggcgcgcuggagucccucaucgaggaagagacagggcagaaaaagauuuga

SEQ ID NO: 69856 - RNA, 342 nt, Artificial Sequence
  derived and/or modified sequence opt5 from GNRH2__Homo_sapiens__NP_847901
auggccagcuccagacggggccugcuccugcuucugcuccugaccgcucaccuugggcccucugaggcccagcauuggagccacggaugguacccuggcgggaagcgcgcgcuguccucugcucaagacccgcagaacgcccucagacccccugccggaagccccgugcagacagcucauggccugccuuccgaugcccuggcuccccucgacgauucuaugccuugggaagggcggacgaccgcccaguggagccugcaccgcaaaagacaucuugcgcggacacugcucaccgccgcucgcgagccgagacccgccccucccuccagcaauaaggucuga

SEQ ID NO: 69857 - RNA, 987 nt, Artificial Sequence
  derived and/or modified sequence opt5 from GNRHR__Homo_sapiens__NP_000397
auggccaacagcgcuucccccgagcagaaucaaaaccacugcucugccaucaauaacagcauuccucugaugcagggcaaucucccgacccugacacuuuccgggaagaucagagugacggucaccuucuuucuguuccuccugucugcgacauuuaacgcuagcuuccuucugaaacuccagaaguggacccagaaaaaggaaaaaggaaagaagcugucccggaugaaacugcuccugaagcaucuuacacuggccaaucuccuggagacccuuauuguuaugccccuggacggcauguggaacaucacagugcaaugguacgccggggaacuccuguguaaagugcugucuuaucucaagcuguuuagcauguacgcuccugccuucaugauggucgugauuucccuugaucgcagccuggcuaucaccagaccccucgcccugaaaucuaauuccaagguuggacagagcauggugggccuugcguggauccugucuuccgucuuugccgggccucagcucuauauuuuccggaugauccaccuggcugacagcucuggacagacgaagguguuuucccaaugcguuacccauuguagcuucucccagugguggcaccaggccuuuuacaacuucuuuacauucucuugccuguucauuaucccccucuuuauuaugcugaucuguaaugcuaaaauuaucuucacccuuacacgcgugcugcaucaggauccucacgagcuccaacugaaccagagcaagaauaacaucccgagagcccggcuuaaaacccugaagaugacggucgcguuugccacauccuucaccgugugcuggacacccuauuacgugcucggcauuugguauugguuugacccugaaaugcugaaucgccugagcgaucccgucaaccacuucuuuuuccucuuugcuuuccugaacccuuguuuugacccccuuaucuacggcuacuucucucuguga

SEQ ID NO: 69858 - RNA, 1659 nt, Artificial Sequence
  derived and/or modified sequence opt5 from GNS__Homo_sapiens__NP_002067
augagacugcucccccuggccccuggccggcuucgcagagggagcccgcggcaucugcccuccugcucuccugcucuccugcuucuggugcucggaggcugucugggggucuucggaguugccgcgggcacccgcagacccaacguggugcugcuccugacagacgaucaggacgagguccuugggggaaugacgccucugaagaaaaccaaggcucucaucggcgaaaugggcaugacauuuagcuccgccuacgugcccucugcccugugcuguccuagccgggcuuccauucuuaccgggaaauauccgcacaaucaccauguugugaacaauacacuggagggaaacugcucuagcaaguccuggcaaaagauccaggaacccaauaccuucccugccauucuccgcagcauguguggcuaccagacauuuuucgcugggaaguaucugaacgaguacggagcccccgaugcgggcgggcuggaacacgucccucucggauggucuuauugguacgcccuggagaaaaauuccaaauauuacaacuacacccuuagcaucaauggcaaggcuagaaaacauggcgagaacuauucuguggacuaccugacggauguucucgccaaugugucccuggacuuucuugauuauaagagcaacuucgaacccuuuuucaugaugauugcuaccccggccccucacucucccuggacagcggccccucaguaccaaaaagccuuucagaaugucuucgcuccccggaacaagaauuuuaacauccacgggaccaacaagcauuggcugauccgccaggcuaaaacacccaugaccaauuccagcauucaguuccucgacaacgccuuuagaaagcgguggcaaacgcugcuguccguggaugaccucguggagaaacuggucaagcgccuugaguucacaggagaacugaauaacaccuauaucuucuacacaucugauaauggcuaucacaccgggcaguuuagccucccuauugacaaaagacagcuguacgaguucgauaucaagguuccgcuucuggugcggggacccggcauuaaaccuaaccagaccuccaagaugcucguggccaauaucgaccuggggcccacaauucuggacaucgcuggauacgaucucaacaagacgcaaauggacggcaugagccugcuuccuauccugcgcggcgcgucuaaucucaccuggagauccgauguccugguggaauaucagggggagggacggaacguuacagacccgaccugccccagccugucuccuggcgugagccaguguuuucccgauugcgucugugaagacgccuacaauaacacauaugcuugcgugagaaccauguccgcccuuuggaaucuccaauacugugaguucgaugaccaggaaguuuuuguggaggucuauaaccugacggccgauccugaccagauuacaaauaucgcuaaaaccauugaucccgagcugcucgggaagaugaacuaccgccugaugaugcuucagucuugcagcggaccuaccugccggacacccggcguguucgacccgggguauagauuugacccucgccugauguucuccaaccggggcagcgucagaacccgccgguuuucuaaacaucuccuguga

SEQ ID NO: 69859 - RNA, 2304 nt, Artificial Sequence
  derived and/or modified sequence opt5 from GOLGA1__Homo_sapiens__NP_002068
auguucgccaagcugaaaaagaaaaucgcugaggaaaccgccguggcgcagagacccggcggggcuacacggauuccucgcagcgucuccaaggagucuguugccagcaugggagccgacuccggcgaugacuuugcuucugaugggagcuccucuagagaagaccucagcucccaacugcuucggcgcaacgagcagaucagaaaacuggaagcccggcucagcgauuacgcugagcaagugcgcaaucugcagaagauuaaggagaaacuugaaaucgcccuggagaagcaccaagacucuuccaugagaaaauuccaggaacagaacgagacguuucaggcgaaucgggccaagauggcugagggacucgcccuggcucuggcccgcaaagaucaagaauggagcgagaagauggaccagcucgaaaaggagaaaaacauucugaccgcgcagcuucaggaaaugaagaaucaaucuaugaaccuguuccagagacgggaugagauggacgagcucgaaggcuuucagcaacaggagcuguccaaaaucaagcauaugcuucugaaaaaggaagagagccucgggaaaauggaacaggagcuggaggcccgcacaagagaacugucucggacccaggaggaacucaugaacuccaaucaaaugagcuccgaucugucucagaagcuggaggaacugcagcgccacuauagcacacucgaggagcagagagaccaugugaucgcuuccaagaccggagccgaaagcaaaauuacagcucuggagcaaaaggaacaggagcuucaggcccugauccagcaacucucuauugaucugcagaaagucaccgccgagacgcaggaaaaggaggacgugaucacccaccuucaggaaaaaguugcuucccucgagaagcggcuggaacaaaaucuuagcggcgaggagcaugugcaggaacugcucaaggagaaaacacuggcggaacagaaccuugaggacaccagacaacagcugcucgccgcucgcucuagccaggccaaggccauuaauacacuggaaacccgggucagagagcuggagcagacgcuccaggcuuccgaggagcagcugcagcagucuaaaggcaucguggccgcgcaagaaacacagauucaggagcuugcugccgccaaccaggaaagcucccacguucaacagcaggcucuggcccucgagcaacaguuccuggagcgcacccaggcucuggaagcccagaucguggcgcuugagcggacaagagccgcugaucaaaccaccgccgaacaggggaugcgccagcucgagcaggagaaugcugcccugaaggaaugccggaacgaguacgaaagaagccugcaaaaucaccaguuugagcucaaaaagcugaaggaagaguggucucagcgcgagaucgucuccguggcgauggcccaggcucuugaagaggugcggaaacaaagagaagaguuccagcagcaggccgcuaaccugacagccauuaucgacgaaaaggagcaaaaccuccgcgagaaaacggaaguccugcugcagaaggagcaggaaauucuucaacucgagcggggacauaauagcgcccugcugcagauccaccagcuccaggcugaacuggaggcgcuuagaacccugaaagccgaggaagcugccguuguggccgagcaagaagaucuccugcggcugcgcggcccgcuucaggcugaggcccucucugugaacgagucccaugucacaagcagagcgaugcaggaccccguguuucagcugccuaccgcugggcggacacccaauggagaaguuggcgccauggaucugacccaacuccagaaggagaagcaggaccuggaacagcaacuucuggagaaaaacaagacgauuaaacagaugcagcaaagaaugcucgaacugcgcaagacacugcagaaagagcuuaagauccggccugauaaugaacucuucgaagugagagagaaacccgggccugaaauggccaacauggcuccguccgucaccaauaacaccgaccugacagaugcccgcgagaucaauuuugaauaucugaagcacgugguucucaaguucaugucuuguagagagagcgaggcguuucaccugauuaaagcuguguccguccuucugaacuucucucaggaagaggaaaauaugcucaaggagacccuggaauacaaaaugagcugguucggauccaagcccgccccuaaaggcagcauccggcccucuauuuccaacccucgcauccccuggagcuga

SEQ ID NO: 69860 - RNA, 3009 nt, Artificial Sequence
  derived and/or modified sequence opt5 from GOLGA2__Homo_sapiens__NP_004477
auguggccccagccuagacugccgccccggccugccaugagcgaggaaacccgccaauccaagcucgcugccgcgaaaaagaaacugagagaguaccagcagcggaacucucccggcgugccuacaggggcuaagaaaaagaagaaaaucaagaauggaagcaaccccgaaacgaccacauccggcgggugccacucuccugaggacaccccgaaagauaaugccgccacacuucagcccagcgacgauaccguccugccuggaggcguucccuccccuggggcuucucucacaagcauggccgcuucccaaaaccaugacgccgauaaugugcccaaccugauggacgaaaccaagacguucagcucuaccgagucccuucgccagcugagccagcagcucaauggacuggugugugagucugcgacaugcgucaacggcgaaggcccggccuccagcgcuaaucugaaagaucucgagucuagauaucaacagcuggccguggcucuugacuccagcuacguuaccaacaagcagcugaauauuacaaucgaaaagcucaaacagcaaaaccaggagauuaccgaucagcuggaggaagagaagaaagaaugucaccaaaagcagggggcccuucgggagcagcuccaggugcauauccaaacgauuggaauccuggucuccgaaaaagcggagcugcagacagcccuggcucacacccagcaugccgcucgccagaaggagggcgaaucugaggaccucgccagcagacugcaauauucccggcgcagagugggggaacuugagcgggcccugagcgcuguuucuacacagcagaaaaaggcggaucgcuacaauaaggaacucaccaaagagagagacgcccugcggcuugagcuguauaagaacacccaguccaaugaagaucucaaacaagaaaagagcgaacuggaggaaaaacugcgcgugcucgucacagagaaggcuggaaugcagcugaaccuugaggaacugcagaagaaacucgagaugacggaacugcuucugcagcaauuuucuagcagaugcgaggccccugacgccaaccagcagcuccaacaggcuauggaggaacgggcccagcuggaggcgcaccugggccaggugauggaauccgugagacaacuccagauggagcgcgacaaguacgcugaaaaucugaaaggggagucugccauguggcggcagagaaugcagcaaaugagcgagcagguccacacccuucgcgaagagaaggaauguuccaugagccggguucaggagcuggaaacaucucucgccgagcugagaaaccagauggcugagcccccuccucccgaaccuccggccggacccuccgagguggaacaacagcugcaggcugaggccgaacaucuucgcaaagagcucgagggccuggcgggccaacugcaggcccaggugcaggauaaugaagggcucagccggcugaacagagagcaagaagaacgccuucuggagcucgaacgggcugccgagcuguggggagaacaggcugaggccagacgccagauccuggaaaccaugcagaaugaccggacaaccauuucuagagcgcuuucccaaaaccgggagcucaaggagcagcuggccgaacugcagagcggcuucgucaagcucacgaaugagaacauggaaaucacauccgcucugcagucugagcaacacgugaaacgcgaacuugggaagaaacugggagagcuccaggagaagcugagcgaacugaaagagaccguugaacuuaagucccaggaggcccagucucuccaacagcagagagaucaauaucugggccaucugcagcaguacguggcugccuaccagcaacucaccagcgaaaaggagguccugcacaaucagcuucugcuccagacacagcugguggaccaacugcagcagcaggaggcccaagggaaagcuguugcggaaauggcccggcaggagcuucaggaaacccaagagagacucgaggcugccacacagcagaaccagcaacugcgcgcccagcugucccucauggcucacccuggagaaggcgauggccuggaccgggaggaagaggaagaugaggaggaagaggaagaggaagccguggcggucccccagccuaugcccagcauuccggaggaccuugagucuagagaagcuaugguggccuuuuucaauuccgccgucgcuagcgccgaggaggagcaggcgcgccugagagggcaacucaaggaacagcgggugcgcugcagacggcuggcucaucugcuugccucugcccagaaagagccugaggcugccgcucccgccccuggaacgggcggggauuccguuuguggagaaacccaccgcgcgcugcagggcgccauggagaagcuccaaagcagauuuauggaacugaugcaggagaaagcugaccucaaggagcggguggaggagcuggaacaucgcugcauccagcuuucuggggagacagauaccauuggcgaauauaucgcccuguaccagagccaaagagcuguccucaaagagcggcaccgcgagaaggaagaguauauuuccagacuggcccaggacaaggaagagaugaaagugaagcugcuugaacugcaggagcucguucugcggcucgugggagacagaaacgaguggcauggccgcuuccuggccgcugcgcaaaaucccgccgaugaaccuacaagcggggcucccgccccgcaggagcuuggagccgcuaaccagcagggcgaccugugugaagucucucucgccggguccguggagccugcgcaaggagaagcucgggagggcagccccagagauaaucccaccgcccagcagaucaugcagcugcugcgcgagaugcaaaacccucgggaaagaccggggcuuggcuccaaccccugcauccccuuuuucuaccgcgccgacgagaaugaugaagugaaaauuacgguuaucuga

SEQ ID NO: 69861 - RNA, 3405 nt, Artificial Sequence
  derived and/or modified sequence opt5 from GOLGA3__Homo_sapiens__NP_001166028
auggacggcgccagcgcugagcaggaugggcugcaagaagacagaucccacucuggacccagcucccucccugaggccccgcugaagcccccuggcccccuugugccucccgaucagcaggacaaaguccagugcgcggaaguuaaccgggcuucuaccgagggggaaagcccugauggaccgggccaagggggacugugucagaauggccccacaccucccuucccugaucccccguccucucucgacccuacgaccagccccgugggcccugacgccucccccgggguggccggauuucaugauaaccugcgcaagagccagggcacaucugcugagggguccgucagaaaagaggcccuucagagccugcggcucucucugcccaugcaagaaacccagcugugcuccacagacagcccucucccgcuggagaaggaagaacaggugcgccuucaggcuagaaaauggcuggaggaacaacucaagcaguaccggguuaagcgccagcaagagagaucuucccagcccgccaccaaaacacggcuguucagcacccuugauccugaacugaugcucaaucccgagaaccugccucgcgcguccacgcuggccaugaccaaggaauauucuuuucucagaacaagcgugccccggggaccgaaagucggcucccuggggcuuccugcucacccccgcgagaagaaaaccagcaagucuuccaagaucagaagccuggccgacuaccggacagaggauucuaaugcuggaaacagcggcggcaaugugccugcccccgacuccaccaaagggucucucaagcagaaccgcagcuccgcggccagcguugugucugaaauuucccugagcccugacacggaugacagacuugagaauacaucucuggcuggagauuccgucagcgaaguggacggcaacgauuccgacucuagcuccuauucuagcgccuccacccgggggacauacggaauccucagcaaaaccgugggcacccaggauacacccuauauggucaaugggcaagagauuccggcugacacgcugggacaguucccuucuaucaaggauguucugcaggccgccgcugcggaacaucaggaccaaggccaggaggugaacggcgaggugagaucccgccgggauagcauuuguucuuccgucagccucgaaucuagcgccgcugagacccaggaagagaugcuucaggugcugaaagaaaagaugagacuggaggggcaacucgaggcccugucccuugaagccagccaggcucugaaagagaaggccgaacuccaggcgcagcuggcugcccugucuacaaagcuccaagcccagguugagugcucccacagcucccagcaacgccaggacucucugagcuccgagguggacacccuuaaacagucuuguugggaucuggaacgggcuaugacagaccuccagaauaugcuggaggccaagaacgcuagccuggccuccucuaauaacgaucuucaagucgcggaggagcaguaccagagacucauggccaaaguggaagacaugcagcgcagcaugcuguccaaggauaacaccguucaugaccugcggcaacagaugacggcucuccagagccagcugcaacaggugcagcuugagagaacaacccugaccucuaaacucaaggccucccaagcugagaucagcucucugcaguccguccgccagugguaucagcaacagcuggcccuugcgcaggaagcccgggugagacuccagggagagauggcucacauccaagucggccagaugacacaggccgggcugcuggaacaccucaagcuggagaaugugagccuuucucagcaacugaccgaaacacagcaucgcuccaugaaagagaagggacggauugcugcccagcuccagggcaucgaggccgauaugcuggaccaagaagcugcguuuaugcagauucaggaggccaaaacgaugguugaagaggaucugcaaagacggcuugaagaguucgagggggaacgcgagagacuccagcggauggcugacagcgccgccucccuggaacagcagcuggagcaagugaagcucacccugcuucagagagaucagcagcuggaggcucuccaacaggaacaccuggaccugaugaaacagcuuacacucacccaggaggcccugcaaagccgcgaacagucucuggaugcgcuccagacacauuacgacgagcugcaagcucggcuuggcgaacugcagggagaggccgccagcagagaggacaccaucugccuccugcagaacgaaaagauuauccuggaggcugcccuucaggcggcuaaguccggcaaagaggaacuggaucgcggggccagacggcucgaagagggaacggaggaaaccucugagacacuggaaaagcuccgcgaggaacuggccauuaaaagcggccaagucgagcaccuucagcaggagaccgcugcccugaagaaacagaugcaaaagaucaaggaacaguuucuccagcagaaagugaugguugaggcuuacagacgggacgccacauccaaggaucaacugaucucugaacugaaagcgacccgcaagagacuugacagcgagcugaaagagcuccggcaggaacugaugcaagugcacggggagaagcgcacggccgaagcugagcucuccagacugcaucgggaagucgcccaggugcgccagcacauggcugaucuugagggacaucugcagucugcccagaaagagagagacgaaauggagacacaccuccaaagccugcaguucgauaaggaacagaugguggccguuaccgaggcuaaugaagcgcugaagaaacagauugaggagcuucaacaggaagcccggaaggcuaucacagagcagaaacagaagaugagacgccugggcuccgaccucaccagcgcccaaaaagaaaugaagaccaagcauaaagccuaugagaacgcugucgggauucugucucggagacuccaggaagcccuggcggcuaaggaggccgccgaugcugagcuuggccagcugcgcgcccagggaggcuccagcgacucuucccuggcgcuccacgaacggauccaagcucuggaggccgaacuucaggccgugagccacuccaaaacacugcucgagaaggagcugcaggaagugauugcucucacgucucaagagcuggaagagagcagagaaaaaguccuugagcuggaggaugaagugcgccccgggcaucugcucuggcggcagagaggagccggccacguuucccccgggcaugcugccacccgcgagacacggagaaccaagcugcaccgggugccuagcgucgcgacauuuggaguggccaccuucuga

SEQ ID NO: 69862 - RNA, 6732 nt, Artificial Sequence
  derived and/or modified sequence opt5 from GOLGA4__Homo_sapiens__NP_001166184
auguucaagaaacugaagcagaaaaucagcgaggaacaacagcagcuccagcaagcccuggcucccgcccaggcguccucuaacagcuccaccccuacaagaaugcggucucgcacgagcuccuuuaccgagcagcuugacgaaggcacaccgaauagagagaacgcuucuacccacgccagcaagucccccgauagcgugaaugggucugaaccuuccauuccccagagcggagacacacaaucuuucgcccagaaacugcagcuccgggucccuuccguugagagccuguuucgcucucccaucaaggagucccuuuucagaagcuccucuaaggaaagccuggugcggaccuccagccgcgagucucucaacagacuggaucuggacuccagcacagcuucuuuugauccuccgagcgacauggauuccgaagccgaggaccucgugggcaauucugauagccugaacaaagagcagcuuauucaacggcugcgcagaauggaacggucccucagcucuuaccgcgggaaguauuccgagcuggucaccgcuuaccagaugcuucagagagaaaaaaagaaacugcaaggaauccucagccagucucaggacaagucccugcggcgcauugccgagcugagagaagagcuccagauggaucaacaggcgaagaaacaucugcaggaggaauucgacgccagccuugaggaaaaggaucaguauaucuccgugcugcaaacgcagguuucucuccugaaacagcggcuuagaaauggccccaugaacguggacguccugaagccucucccccagcuggagccucaagcugaaguguuuaccaaagaggagaaucccgaaagcgacggggagccgguuguggaagauggaacauccgucaagacccuggagacacuccagcagcgcgugaaacggcaggaaaaccugcuuaagagaugcaaggagaccauccaaucucacaaagagcaguguacgcugcucacaagcgaaaaggaggcccugcaggaacaacuugacgagcgccugcaggagcucgaaaaaauuaaggaucugcauauggcugagaaaaccaagcugaucacacagcuccgggacgccaagaaucugauugaacagcuugagcaagauaaaggcauggugaucgcggaaaccaagagacagaugcacgagacccuggagaugaaagaagaggaaauugcccagcuccgcucccggaucaagcagaugacaacgcaaggcgaggaacugagagagcagaaagagaagagcgaacgcgcugccuucgaggaacuggagaaggcucuuucuaccgcccagaaaacagaagaggcccggagaaagcucaaagcugagauggacgaacagauuaagaccaucgagaaaacauccgaagaggagcgcaucagccugcaacaggaacugucucgggucaagcaggagguuguggaugugaugaagaaauccagcgaagagcaaauugcgaagcuccagaaacugcaugaaaaggagcuugccagaaaagagcaggaacugaccaagaaacuccagacgcgggagcgcgaauuucaagagcagaugaaggucgcucuggaaaagucucagagcgaguaccugaaaaucucccaggagaaggaacaacaggagagccuugcccucgaagagcuggaacugcagaaaaaggccauucucacagagucugagaacaaacugagagaccuucagcaagaagcugagaccuaucggaccagaauccuggaacucgaguccagccuggagaagucccugcaggaaaauaagaaccagucuaaagaucuugccgugcaccucgaggcggaaaagaauaaacacaacaaggagauuacaguuaugguggaaaaacauaagaccgagcuggagagccugaagcaccagcaagacgcucucuggacagaaaaacugcagguccuuaagcagcaauaccagacggagauggaaaaacugcgcgagaagugcgaacaggagaaagagacccuccugaaggauaaggaaaucaucuuccaggcccauauugaggaaaugaacgagaaaacacuggaaaagcuugacgugaaacaaaccgagcucgagucccugucuagcgaacuguccgagguucucaaggcccggcacaaacuggaagaggagcuuucugugcugaaggaccagacagauaaaaugaagcaggaacucgaggcuaagauggacgaacagaaaaaucaccaucaacagcaggucgauagcaucauuaaggagcacgaaguguccauccagagaaccgagaaagcccugaaggaccaaauuaaccagcuggagcuucugcucaaagaacgcgauaagcaucugaaggagcaccaggcucaugucgaaaaucucgaggccgacaucaaaagaagcgaaggggagcugcaacaggcgucugccaagcuugauguguuucaguccuaucagagcgcuacgcacgagcaaaccaaagccuacgaagagcagcuggcucagcuccagcaaaagcugcuggaccuugaaacagagcggauccugcucaccaaacagguugccgaaguggaggcgcagaagaaggaugucuguacagagcuggacgcccacaaaauucaggugcaagaucucaugcagcagcuggaaaagcagaacucugagauggaacaaaaaguuaagucccuuacccagguguacgagagcaaacuggaggacggaaauaaggaacaggagcaaacgaagcagauccucgucgaaaaagagaacaugauucugcagaugcgcgaaggccagaagaaagagaucgagauucugacacaaaagcuuucugcuaaagaagauuccauccauauucugaaugaggaauaugagaccaaguucaagaaccaggaaaaaaagauggagaaagugaagcagaaagccaaggagaugcaggaaacacucaaaaagaagcugcucgaccaagaggcuaaacugaagaaagaacuugagaauaccgcccuggaacugagccagaaggagaaacaguuuaacgccaagaugcucgagauggcucaggcgaauuccgccgggaucagcgacgcugugucuagacuggaaaccaaccaaaaggagcagaucgaaagccuuacagagguucaccggcgcgagcugaaugaugucauuuccaucugggaaaaaaagcucaaccagcaagccgaggaacugcaggagauucaugaaauccagcuccaggagaaagagcaagaaguggccgagcugaagcagaaaauucuucuguucggaugcgaaaaggaggaaaugaauaaggagaucacguggcugaaagaggaaggcgugaagcaggacaccacacucaacgagcugcaggaacaacuuaaacagaagucugcucacgucaacagccuggcccaggaugagaccaaacucaaggcgcaccuggaaaagcucgagguggaccugaauaaaucccuuaaggagaacacauuccugcaggaacaacugguugagcucaaaaugcuggcugaagaggauaagagaaaagugucugagcuuaccagcaagcugaaaacgacagacgaagaguuucagucccucaagucuagccaugaaaaguccaauaaaagccuggaggauaagucucucgaauucaaaaagcuguccgaggagcuugccauccagcuggacauuuguugcaaaaagaccgaagcccugcucgaggcuaagaccaacgaacugaucaauauuagcucuuccaaaacaaacgccauccuuagccggauuucccacugucaacaucgcaccacaaaggucaaagaggcgcugcucaucaagacgugcaccgugucugaacuggaggcucagcugagacagcucacagaggaacagaauacccuuaacaucagcuuucaacaggccacacaccagcuggaggaaaaagagaaucagauuaaguccaugaaggccgauaucgaaagccugguuaccgagaaagaggcucuccaaaaggaagggggaaaccagcagcaggccgcuucugagaaagaauccuguauuacgcaacugaagaaagagcuuagcgagaauaucaacgccgugacccugaugaaggaagagcucaaggaaaaaaaggucgagauuucuagccuguccaaacagcugacagaccucaaugugcagcuucagaacucuaucagccuguccgaaaaggaggcggccaucucuagccugcggaaacaauacgaugaggaaaagugcgagcuccuggaccagguucaggaucuuuccuucaaaguggacacccugagcaaggaaaagauuucugcucucgagcaagucgacgauugguccaauaaauuuagcgaauggaagaaaaaggcccagucccgcuucacacagcaucagaacaccgugaaagagcugcaaauccagcuggagcucaagucuaaggaagcuuaugagaaagacgaacagauuaaccuucugaaggaggaacuggaucagcaaaauaaaagauuugacugucucaagggcgagauggaggaugacaaaagcaagauggaaaagaaagaguccaaccuggaaacagagcuuaagucucagaccgcccggaucauggagcuggaagaucacauuacgcagaaaacaaucgagauugaaagccucaaugaggugcugaagaacuacaaucagcaaaaagacaucgaacacaaggagcugguccagaagcuccagcauuuccaagagcuuggcgaagagaaagauaacagaguuaaggaagccgaggaaaaaauccugacccuggagaaucagguguauuccaugaaggcugagcucgaaaccaaaaagaaggagcuggaacacgugaaccuuagcgucaaaucuaaggaggaagagcugaaagcgcucgaggaccgccuggaauccgagagcgccgcuaagcuggccgaacucaaacggaaggccgagcagaaaauugcugccaucaagaagcagcuucugucucaaauggaggaaaaagaggaacaguacaagaaagggacagagucccaucugagcgaacucaauaccaagcugcaggagagagagcgcgaagugcacauucuugaggaaaaacugaagucuguugagagcucccagucugaaacgcucaucgugccucggagcgcgaagaacgucgcugccuauacagagcaagaggaagccgauucccagggaugcgugcagaaaaccuacgaggaaaagauuagcguucugcagagaaaucugacagagaaagaaaagcuccuucaacgcgugggccaggagaaagaggaaaccgucuccucucauuuugagaugcggugccaguaccaggaaagacugaucaagcuggagcacgcugaggccaagcaacacgaagaccagagcaugaucgggcaucuccaggaggaacuggaggaaaaaaacaagaaauauucccuuauuguggcgcaacacguugagaaggagggaggcaaaaauaacauccaggcuaagcagaaucuggaaaacguguucgacgauguccagaagacacuccaagagaaagaacugaccugucagauucuggagcagaagaucaaagaacucgacucuugccuugugcgccagaaggaggugcaucgggucgagauggaagagcugacgagcaaauacgaaaagcugcaagcccuccagcagauggaugggagaaacaaacccaccgagcugcuugaagagaauacagaggaaaaguccaagucucaccugguucagccuaaacuccugagcaacauggaggcccaacacaaugaccuggaauuuaagcucgcuggagccgagcgggagaaacagaagcuuggcaaagaaauugugcgccugcagaaggaucugagaaugcuccggaaggagcaucaacaggaacuggagauccuuaaaaaggaauaugaccaggagcgcgaggaaaaaaucaagcaggagcaagaagaucuggagcucaaacacaacuccacccugaagcagcugaugagagaauucaauacacagcucgcucagaaggagcaagagcuugaaaugaccauuaaagagacgaucaacaaggcccaggaaguggaggcggaacugcuggagagccaucaggaggaaacaaaucagcuccugaaaaagauugccgagaaagacgaugaccuuaagcggaccgcuaagagauacgaagagauccuggaugcccgcgaggaagagaugacagcuaaaguccgggaccuccaaacccagcuggaagagcugcagaagaaauaucaacagaagcucgaacaggaggagaaccccggcaaugauaacacccagcuggcccaaaaaacaacgcuuauuucugacuccaagcugaaagaacaggaguuuagagaacagauccacaaucucgaggaccgccugaagaaguacgaaaaaaacguguaugccaccacaguugggacccccuacaagggaggcaaucuuuaccauacagaugugagccuguucggggagccuaccgaguucgaauaucuccggaaaguccuguuugaguacaugaugggaagagaaacgaagacaauggcuaaagugauuaccaccguucugaaguucccggacgaucagacacaaaagauccucgagcgcgaagacgcgcggcugaugucuuggcuuagauccagcucuuga

SEQ ID NO: 69863 - RNA, 2196 nt, Artificial Sequence
  derived and/or modified sequence opt5 from GOLGA5__Homo_sapiens__NP_005104
augagcugguucguggaccuggccggcaaggcugaggaucuccugaacagagucgaccagggggccgcgaccgcucuuucccggaaagauaaugccucuaacaucuacagcaagaauacagacuauacggaacugcaccaacagaacaccgaucucauuuaccagacaggacccaaauccaccuauaucucuagcgccgcugacaauauucgcaaccagaaggccacaauccuggcuggcaccgccaauguuaaagugggguccagaacaccuguggaggcgucucauccggucgaaaacgccagcgugccccggccuuccagccacuuuguucgcagaaagaagucugagcccgaugacgaacuucuguucgauuuucucaauuccagccaaaaagagccuaccggacggguggagauucgcaaggaaaaaggcaagacgcccgucuuccagucuucccagaccagcucuguguccagcguuaacccuuccgugacaaccaucaaaacaaucgaggaaaauucuuuugggagccagacccaugaggcugccuccaacagcgacucuucccacgagggacaagaagagagcucuaaggaaaaugucagcuccaacgcugccugcccggaucauacgcccacaccuaaugacgauggcaagucucacgagcugagcaaccugagacucgaaaaccagcugcuucggaaugaggugcagucccugaaccaggagauggcgagccuccugcaacgcucuaaagaaacccaggaggaacuuaauaaggccagagcucggguggagaaauggaacgccgaccacuccaagagcgaccgcaugacaagaggccugcgggcucaggucgaugaccucaccgaagccguugccgcuaaagauucucaacuggcggugcugaaggugcgccuccaggaggccgaccagcugcuuuccaccagaacagaggcucuggaagcccuccagagcgagaaaucccggauuaugcaagaucagucugaagggaauagccugcagaaccaggcccuucaaacgcugcaggagagacuccaugaagcugacgccacccugaagcgcgagcaggaguccuacaagcagaugcaaucugaguucgcggcucggcugaauaaagucgaaauggaaagacagaaccucgccgaggccaucacacuggcugagcgcaaguauagcgaugaaaagaagcggguggacgagcuucagcagcaaguuaaacuguacaagcucaaucuggaauccagcaagcaggagcuuauugauuauaaacagaaggccaccagaauccugcaaucuaaagaaaagcucauuaacucccugaaagagggaagcggcuuugaggggcuggacucuuccacagcuagcucuauggaacucgaggaacugcgccacgagaaggaaaugcagcgggaggagauccagaaacuuaugggacagauucaucaacugagaagcgaacuccaggauauggaggcccaacaggugaaugaagcggaguccgcccgcgaacagcugcaggaccugcacgaccagaucgcuggccagaaagccagcaagcaagagcuugagaccgaacucgagcggcugaaacaggaguuccacuacaucgaagaggaucuguacagaacgaagaacacacuccagucucgcauuaaagaccgggaugaagagauccaaaagcugagaaaucagcuuaccaacaagacccuguccaauagcucccagucugaacucgagaaccggcugcaucagcugacagaaacccuuauucaaaaacagacaaugcucgagagccuguccacggagaagaacucucuggucuuucagcucgaacgccuggagcagcaaaugaauagcgcuuccgggucuagcuccaacggaagcucuaucaauauguccggcauugacaacggcgaagggaccagacuucggaaugugcccguucuguucaacgauacagagaccaaucucgccggaauguauggcaaagugagaaaggcggccagcucuaucgaccaguuuuccauccgccuggggauuuuccugcggagauacccuaucgcucgcgucuuugugauuaucuauauggcccuucuccaccugugggucaugauugugcugcucacauacacccccgaaaugcaucacgaucagccguauggaaaauga

SEQ ID NO: 69864 - RNA, 1812 nt, Artificial Sequence
  derived and/or modified sequence opt5 from GOLGA8B__Homo_sapiens__NP_001018861
auggccgaggaaaccggccagagcaagcuggcugccgcgaaaaagaaauucaaggaguacuggcaaagaaaccggcccggggugccugcugccgccaaacgcaauacaaaggcuaacggauccucuccggaaacggccgcuagcggcgggugccacuccucugaggccagcuccucugcgagcuccagccuccaugccagacagucucccugucaggaacaggcugccguccuuaauucccggagcaucaagauuucucgccugaacgacaccaucaaaucccugaagcaacagaaaaagcagguugagcaccagcucgaggaagagaaaaaggcuaauaacgaaaagcaaaaagccgagagagagcuggaaggacagauucagcggcuuaauacagagaagaaaaagcugaacaccgaucucuaucauaugaaacacagccugcgcuacuuugaagaggaaucuaaggaccuggcgggcagacuccagcgguccagccaacgcaucggggagcuggaguggucccuuugcgccguggcugccacacagaaaaagaagccugauggauucucuagcagauccaaagcucugcucaagcggcagcuggaacaaagcauucgcgagcagauccuucugaaaggccaugugacccagcucaaggaaucucugaaagagguccagcuggaaagagaccaauaugccgagcagaucaagggcgagcgggcccaguggcagcaacgcaugagaaagaugucccaggaaguguguacacucaaagaggaaaagaaacacgauacccaccggguugaggaacuggagagaagccuuucucgccugaagaaucagauggcugagccccucccucccgacgcgccugccgugagcuccgaagucgagcugcaggaucuucggaaagaacuggagagaguggcuggggagcuccaagcccagguugaaaacaaucagugcauuucucugcugaaccgcggacagaaggagcggcucagagaacaagaggaacgccugcaggagcagcaagagcggcuuagagaacgcgagaagcggcugcagcagcucgccgaaccgcagagcgaccuggaggaacuuaaacaugagaauaaguccgcucugcaacucgagcaacaggugaaagaacugcaggagaagcugggccaggucauggaaacgcucaccagcgccgagaaagaacccgaggcggcugugccugccucugggacaggaggcgaguccagcgggcugauggaucuucuggaagagaaggccgaccucagagaacacguggagaagcuggagcugggauuuauccaguaccgccgggaaagaugucaucagaaaguccaccggcuucucaccgagcccggcgauucugcuaaggacgccuccccuggcgggggacaccaucaggcuggccccgggcaaggaggcgaagagggggaagccgcgggagccgcuggcgauggcguugccgcuugcgggagcuauuccgagggacacggcaaauuccuggccgcggcccgcaacccggcugccgagccuucucccggggcuccugcuccccaggaacugggagccgccgacaagcauggcgaccucugugaggcgagccugacaaauuccguggaacccgcccagggggaggcuagagaaggcucuagccaagauaacccuaccgcccagccggugcuucagcugcucggagagaugcaggaccaccaagagcaucccggccugggguccaacugcugugucccuugcuuuuguugggccuggcugccccggagacgccgguga

SEQ ID NO: 69865 - RNA, 9810 nt, Artificial Sequence
  derived and/or modified sequence opt5 from GOLGB1__Homo_sapiens__NP_001243415
augcugagcagacucuccggccuggcuaacguggugcuucacgagcugucuggggacgaugacaccgaucagaauaugcgggcuccccucgacccugaacugcaccaggagagcgauauggaguucaacaauacaacgcaggaggacguucaggaacgccuugccuacgcggagcagcuggugguggagcucaaggauaucauuagacagaaagacguccagcugcagcagaaggaugaagcucugcaagaggaacggaaagccgccgacaacaagaucaaaaagcucaagcugcacgcuaaagccaaacuuaccucccugaauaaauauauugaggagaugaaggcucagggaggcacagugcucccgaccgaaccccagucugaggaacagcugagcaaacaugauaaguccucuacagaggaagagauggagaucgaaaagauuaaacacaaacuucaagagaaagaggaacugaucagcacccuccaggcccagcugacacaagcgcaggccgaacagccugcucaguccagcaccgagauggaggaauuuguuaugaugaagcaacagcugcaggagaaagaagaguucaucucuacgcuccaggcccaacugucccagacccaggcugaacaggccgcgcaacuuagcucuaugcaacaggugguccgcgagaaggacgccagauuugagacacaggugcggcugcaugaagaugagcuccugcaacuuguuacccaggcugacguggaaacagagaugcagcaaaaacugcgcguccuccagagaaagcuggaggaacacgaggaaucccugguggggcgggcccagguggucgaccuccugcagcaagagcuuaccgcugccgaacagcgcaaccagauucugagccagcaacuccagcagauggaggccgagcacaauacgcugagaaacacaguugaaaccgagcgggaagagucuaagauccuucuggagaagauggagcucgagguggcugaacgcaagcuguccuuccauaaucugcaggaggaaaugcaccaucuccuggagcaauuugaacaggcgggacaggcccaagcugagcuugagagcagauacuccgcccuggaacagaaacacaaggccgagauggaagagaaaacaucucacauucucagccugcagaagaccggccaggagcugcaauccgcuugcgaugcccuuaaggaccagaacagcaaacuccugcaggauaagaaugaacaggcggugcaaucugcucagaccauccagcagcuggaggaccaacuccagcagaaauccaaggaaauuagccaguuccugaaccggcuuccccugcaacagcaugagacagccucucagacgagcuuuccugaugucuauaaugaagggacccaagccgugacagaggagaacaucgcuucccuccagaaacgcguuguggaacuggagaaugaaaagggagcccugcuucucucuagcauugagcuggaagaacugaaggcugagaacgaaaaacucuccagccagaucacccugcuugaggcccagaacagaacaggcgaagcggaccgggaggucucugaaaucuccauuguggauaucgccaauaagagauccucuagcgcugaggagagcggccaagacguucuggaaaacaccuucucccagaaacacaaggagcucucugugcugcugcuugaaaugaaagaggcccaggaggaaauugcuuuucucaagcugcagcugcaagggaagcgcgccgaggaagcggaucaugagguccucgaccagaaagaaaugaagcagauggagggagagggcaucgcccccauuaaaaugaagguguuccuggaagauacggggcaggacuuuccucuuaugccgaaugaggaaagcucccugcccgcugucgagaaagaacaagccucuacagagcaccagagccggaccuccgaggaaaucagccucaacgacgcuggaguggagcugaagucuaccaaacaggauggcgacaagucccugagcgccguuccugauaucgggcaaugucaucaggacgaacuugagagacucaagucucagauucuggaacuggagcucaauuuccacaaagcccaggagaucuacgaaaagaaccuggaugagaaagcuaaggaaauuuccaaucuuaaccaacugaucgaggaguuuaaaaagaaugcggacaacaauagcucugccuucacagcucucagcgaagaaagagaucagcugcugucccaggugaaggaacuuagcauggucaccgagcugcgggcccaggugaaacaacucgaaaugaaccuggccgaggcugagagacagcgccggcucgacuaugaaucucagacagcccacgauaaucugcuuacggagcagauucauucccugagcaucgaagcgaaguccaaagacguuaagaucgaggugcuccaaaacgaacuggaugacguccagcugcaguucucugagcagagcacccuuauuagaucccugcaaucucagcuccagaauaaagagagcgaagugcuggagggagcugaacgcgugcggcacaucuccucuaagguugaggaacucagccaagcccugucccagaaggagcuugagauuacaaaaauggaucagcugcuccuggaaaagaaaagagacgucgagacccugcagcaaacaaucgaagagaaggaccaacaggugaccgagauuagcuuuucuaugacggagaagauggugcagcuuaacgaggaaaaguucucccugggcgucgagaucaagacccucaaagaacaacugaaccuccugagccgcgccgaggaggcuaagaaagaacagguggaggaagauaaugagguuucuuccggccuuaagcagaacuacgacgaaaugagccccgccgggcagauuucuaaagaggagcugcaacaugaauuugaucugcucaagaaagagaaugaacagcggaagagaaagcugcaggcggcucuuaucaaccggaaagagcugcuccaacgcguguccagacuggaagaggagcucgccaaucugaaggacgaaagcaaaaaggagaucccucuuuccgaaacagagcggggagaggucgaagaggauaaagaaaacaaggaguauagcgaaaagugcgugaccucuaaaugucaggagauugagaucuaccugaagcagacaauuagcgaaaaagagguugaacugcagcacaucagaaaggaccucgaggaaaaacuggccgcugaggagcaauuccaggcccuugugaagcagaugaaucagacccugcaagauaagacgaaccagauugaccuccugcaggcugaaaucuccgagaaucaggccaucauucaaaaacucaucacaucuaacaccgaugcgagcgacggcgauuccgucgcccuggugaaggaaacaguugugauuucucccccgugcaccgggagcuccgagcacuggaaaccugaacuugaggagaagauccuggcucuggaaaaagagaaggaacagcuccagaagaaacugcaagaggcccuuaccucucgcaaggcuauucugaaaaaggcccaggagaaagaacggcaucucagagaggaacugaagcagcagaaggacgauuacaaucgccuccaagagcaguuugacgaacagagcaaagagaacgagaauaucggagaccagcugagacaacuucagauccagguccgggaauccauugauggcaagcugcccagcacagaccagcaagagucuuguuccagcacgccugggcuggaagaaccccucuucaaagccaccgaacagcaccauacacagcccgugcuggagucuaaccuuugcccugauuggccgucccacagcgaggacgcuuccgcgcugcagggaggcaccucuguggcccaaaucaaggcucagcucaaagaaauugaggccgaaaaggucgagcuggaacugaaaguuagcuccacaaccagcgagcucacgaagaagucugaggaaguguuucagcuucaagagcagaucaauaaacagggccuggaaauugagucccugaagacagugagccaugaggccgaaguccacgcugagucucuccagcaaaaacuggaaagcucccagcuucagaucgccgggcuggagcaccuccgcgaacugcagcccaagcuggaugagcuccaaaaacuuaucucuaagaaggaggaagacgugagcuaucuguccggacagcugucugagaaagaagcggcucucaccaagauucagaccgagaucauugaacaggaggaucugaucaaagcccuucauacacaacuggagaugcaggccaaggaacacgacgagagaauuaaacagcuccaaguugaacugugugagaugaagcagaagccugaagagaucggcgaggaaagccgggcuaaacagcagauucaacgcaagcugcaggccgcgcucaucuccagaaaagaggcucuuaaggaaaacaaaagccugcaggaggagcugucucucgcccgggggaccaucgaacgccugacaaagucccuugccgauguggagagccaggucuccgcucaaaacaaggaaaaagacacggugcugggaagacucgcccugcugcaggaggaacgggauaagcucauuaccgagauggaccgcucucuucuggagaaucagagccuguccucuagcugcgaaucccucaaacuggcucuugagggccugacagaagacaaggagaaacucguuaaggaaaucgagagccugaaaucuuccaagauugccgagagcaccgaauggcaggagaagcauaaagaacugcaaaaggaguacgaaauccuccuucagucuuaugagaacguguccaaugaggcggaacgcauucagcacgucguggaggccguucggcaggaaaaacaagagcuguacgggaagcugagaagcacagaggcuaacaaaaaggaaaccgagaagcagcuccaggaagccgagcaagaaauggaggagaugaaagaaaagaugcgcaaauucgcuaagucuaaacagcagaagauccuggagcuugaagaggaaaaugaucggcugagagccgaggugcaucccgccggcgacacggcuaaggaguguauggaaacccuccugagcuccaacgcgucuaugaaagaggaacuggagcgcgucaagauggaauaugagacacucagcaaaaaguuucagucccuuaugagcgagaaagauucccugucugaagaggugcaagaccugaagcaccagaucgaaggaaaugugagcaagcaggccaaccucgaggcuaccgagaaacacgauaaucagacaaacgucaccgaagagggcacacaauccauuccuggggaaaccgaggaacaggacucucugagcauguccacgcggcccacaugcucugagagcguuccguccgccaagagcgccaauccugcugugucuaaagauuucuccagccaugacgagaucaacaauuaccuucagcagauugaucaacugaaggaaagaaucgccggacucgaggaagagaaacagaagaacaaagaauuuucucagacccuggagaaugagaagaacacccugcucucccaaauuagcacaaaggacggcgaacuuaaaaugcugcaggaggaagugaccaagaugaaccugcucaaucagcagauccaagaggaacugucucgcgucacgaaacuuaaggagacagcggaggaagagaaagaugaccuggaagaacggcucaugaaccagcuggcugagcugaauggguccaucggaaacuauugucaggaugugaccgacgcccagauuaagaaugaacuccuugagagcgaaaugaagaaccugaaaaagugcguuuccgagcuggaagaggagaaacaacagcucgugaaggagaagacaaaggucgagagcgaaaucagaaaggaguaccuggagaagauucagggcgcccagaaggagcccgggaauaaaucucacgcuaaggagcuucaagaacugcucaaagagaagcagcaggaagugaagcaacugcagaaagacugcauccgcuaccaggagaagauuagcgcccuggaacggaccguuaaagcgcucgaguucgugcagacagagucccaaaaggaucuugaaaucaccaaagagaaccuggcccaggcugucgaacauagaaagaaggcccaggcugagcuggccucuuuuaaagugcuccuggacgauacgcagagcgaggcugcccggguccuugcggacaaucugaagcucaaaaaggaacugcaauccaacaaagagucugucaagagccagaugaaacagaaggaugaagaccuggagcgcagacucgaacaggccgaggagaagcaccugaaagaaaagaaaaauaugcaagagaaacuugaugcucugcggcgcgaaaaaguucaccucgaggaaaccauuggcgagauccaggugacacugaacaagaaggacaaagagguccagcagcuucaagaaaaucuggauuccaccgugacacagcucgccgcuuucaccaagucuaugagcucccugcaggacgauagagaccggguuaucgaugaggccaaaaagugggaaagaaaauucagcgacgccauucaaucuaaggaggaagagauccgccugaaggaggacaacuguuccgugcucaaagaucagcugcggcagaugagcauucauauggaagaacuuaagaucaauauuucuagacuggaacacgacaaacagaucugggaguccaaggcucaaacggagguccagcuccagcagaaagugugcgauacacugcaaggagaaaacaaggagcuucugagccagcucgaagagacccgccaucuguaucacuccucucagaaugaacuggcgaagcucgagagcgagcugaaaucccuuaaggaccagcugacagaucucagcaacucucuggaaaaauguaaggagcaaaaaggcaaccuugaagggaucauucggcagcaggaggccgacauccaaaauuccaaguuuagcuacgaacagcuggagaccgaucuccaggcuucuagagagcugaccagccgccugcaugaagagauuaacaugaaagaacagaagaucauuucccuccugucuggaaaggaggaagccauccaaguggccaucgcugagcuucggcagcagcacgacaaagagauuaaggaacuggagaaucuccugagccaggaagaggaggaaaacaucguucuugaggaagagaauaaaaaggccgucgauaaaacaaaccaacugauggaaacgcucaagaccauuaagaaagagaauauccagcagaaggcgcagcuggacuccuucgugaaaucuaugagcucccugcaaaacgauagagaccgcauugugggcgacuaucagcagcucgaggaaagacaccugagcaucauucuugagaaggaucagcugauccaagaagccgcugccgagaauaacaaacucaaggaagagauccgggggcugcgcucucauauggacgaucuuaauuccgagaacgcuaagcuggacgccgaacucauucaguacagagaggaucugaaucaggucaucacaauuaaagacagccaacagaagcagcugcucgaagugcagcugcaacagaacaaagagcuugaaaauaaguaugcgaaacuggaggagaagcucaaggaauccgaggaagccaacgaggaucugcggcgcucuuuuaacgcccuucaggaggaaaaacaggaccugagcaaggagaucgaaucccucaaaguuucuauuagccaacugaccagacaggugacagcccugcaggaggaaggaacccucggccuguaccacgcucagcuuaaggucaaagaggaggaagugcaucggcuguccgcccucuucuccucuagccaaaagagaaucgcugagcuggaagaggaacuuguuugcgugcagaaagaggccgcgaagaaggucggggagaucgaagauaaacugaagaaagagcucaagcaucugcaccaugacgccggcauuaugcgcaaugaaacggagacagcugaagaacggguggccgagcuggcuagagaucuuguugaaauggagcagaaacugcucauggugaccaaggaaaacaagggacugaccgcccaaauccagagcuuuggccgcucuauguccagccuccaaaauucucgggaccacgccaacgaggagcuggaugaacuuaaaagaaaguaugacgcgucccugaaagagcuggcucagcucaaggaacaggggcugcuuaaucgggagcgcgacgcccugcucagcgaaacagcuuucucuaugaacagcaccgaggaaaauagccugagccaucucgaaaaacugaaccagcagcugcuuuccaaggaugagcagcugcuccaccugucuagccaacuugaagacuccuacaaucagguccagucuuuuagcaaggccauggccucccugcagaacgagagagaucaucucuggaaugaacuggagaaauuccggaagucugaggaaggaaaacaacgcagcgcugcccagccuuccacaagccccgcggaggugcagucucucaagaaagccauguccagccugcagaacgacagagaucggcugcuuaaggaacugaagaaucuccaacagcaguaccugcaaauuaaccaggagaucacggaacuucacccucugaaagcucagcuccaggaguaucaagacaagaccaaagccuuucagauuaugcaggaggaacugcgccaggagaaucugucuuggcaacacgaacuccaucagcugagaauggagaaguccagcugggagauccacgaacggcgcaugaaagagcaguaccuuauggcuaucucugauaaggaccagcaacugucccaucuccagaaccugauuagagaacuucgguccucuuccagccagacacaaccccugaaggugcaguaucagagacaggccagcccggagaccuccgcgucuccugauggcagccaaaaccucgucuacgaaacagagcugcugcgcacccagcucaaugacucccugaaagagauccaccagaaggaacuucggauucagcaacugaacucuaauuucagccagcuccuggaggagaagaacacgcuuuccauccagcugugugauaccucucagagccucagagagaaucaacagcacuauggggaccugcugaaccauugcgccguucucgaaaaacaggugcaagagcugcaggcuguguccaaagagaagggaccccuuaauauugacgucgcccccggcgcuccucaggagaaaaacggggugcaccgcaagagcgauccggaggaacugcgggagccccagcaaucuuuuuccgaggcccagcagcagcucuguaauacaagacaagaaguuaacgagcugcgcaaacuucuggaagaggaacgggaccagagaguggcugccgagaaugcgcucagcgucgccgaggaacagauccgccggcuggagcauucugaaugggauuccagcagaaccccuauuaucggcuccugcggaacacaggagcaagcucugcucaucgaccugaccucuaacagcugucgccggacaagauccggcgugggguggaaacgcguucuuagaucucugugccacagccggacgcgcgugccccuccuggccgcuauuuacuuccuuaugauccauguccugcucauucuguguuuuaccggacaccuguga

SEQ ID NO: 69866 - RNA, 1206 nt, Artificial Sequence
  derived and/or modified sequence opt5 from GOLM1__Homo_sapiens__NP_808800
augaugggccuggggaacggaagacggagcaugaagucucccccucucgugcuggccgcucuugucgccugcaucauuguucugggcuucaauuacuggaucgcguccagccgcuccguggaccuccagaccagaauuauggagcuggaagggcgggugcgcagagcugccgccgagcggggagcugucgaacuuaaaaagaacgaguuucaaggcgaacuggagaaacagcgcgagcagcucgauaagauccagucuagccacaauuuccaacuggaauccgugaacaaacuguaucaggacgagaaggccguucucgugaauaacauuacaacgggggaaagacugauccggguccuucaggaucagcugaagacccuccaacgcaauuacggaagacugcagcaggacgugcuucaguuucagaaaaaccaaacaaaucuggagcggaaguucucuuaugaucucagccaguguaucaaccaaaugaaagagguuaaggaacagugcgaggaacgcauugaggaagugaccaaaaagggcaaugaggcugucgccuccagagaccugagcgagaacaaugaucagcggcagcaacugcaggcgcucucugaaccgcagccccgccugcaggccgcuggccuuccucauacagaggugccccaagggaagggaaacgugcugggcaauuccaaaagccagaccccugcccccucuuccgaagucguucucgacagcaagagacagguggagaaagaagagacaaacgagauccagguggucaacgaggagccucaacgggauagacugccgcaggaacccgggcgcgaacaggugguugaagaccggccugugggaggcagaggguuuggaggcgcuggcgagcuugggcagacgccccaaguccaggccgcgcugucugugucccaggagaauccugaaauggagggacccgaacgcgaucaacucguuauuccggacggccaggaggaggaacaggaggccgcuggggaaggacggaaccagcaaaagcugagaggcgaggaugacuacaauauggacgaaaacgaggccgagagcgaaaccgauaaacaggcugcccuggccgggaaugaccgcaacaucgauguguucaaugucgaggaccagaagcgggauaccauuaaccuccuggaccagagagaaaaacgcaaucacacacuuuga

SEQ ID NO: 69867 - RNA, 897 nt, Artificial Sequence
  derived and/or modified sequence opt5 from GOLPH3__Homo_sapiens__NP_071413
augaccagccugacacagagauccucuggccucgugcaacggcgcacggaggccagcagaaacgcugccgacaaggaacgggcggcugggggaggcgccggguccucugaggaugacgcccagagccgcagagaugaacaggacgaugacgauaaaggagacuccaaggagacccggcugacacuuauggaagagguccugcuccugggccuuaaagaucgcgagggguacaccucuuucuggaaugacugcaucagcuccggacugagaggcuguaugcucauugaacuggcucugcggggccgccuccagcuggaggccugcgggaugagacgcaagagccuucugacacggaaaguuaucuguaagucugaugcucccaccggagacgugcuccuggaugaagcccuuaagcacgugaaagagacacaaccuccggagaccguccagaacuggauugaacugcucuccggcgagacguggaauccccugaagcugcauuaucagcucagaaacgugcgggaacgccuggcgaaaaaucuuguugagaagggggugcugaccacagaaaaacagaacuuucuccuguucgacaugaccacacacccucuuaccaauaacaauaucaagcaaagacugauuaagaaaguccaggaggccgugcucgacaaguggguuaacgauccccaucggauggacagacgccugcuggcucucaucuaccuggcccacgcuagcgaugugcuugagaaugccuuugcgccucugcucgacgaacaguaugaucuggccacgaaacgggucagacagcuucuggaccucgaucccgagguggaaugccugaaggcuaacacaaaugaggugcugugggccgucguugcugccuucaccaaauga

SEQ ID NO: 69868 - RNA, 399 nt, Artificial Sequence
  derived and/or modified sequence opt5 from GOLT1A__Homo_sapiens__NP_940849
augaucagcauuaccgaguggcagaagaucggcguggggauuacaggauucggcaucuuuuucauucuguuugggacgcuccuguacuucgacuccguccuucuggccuuuggaaaccuccuguuccuuaccggccugucucucaucaucgggcugagaaaaacauuuugguucuuuuuccaacggcacaagcugaaaggaaccagcuuucuccugggcggcguugugauugugcuucugcgcuggccccuccuggggauguuccuugaaacauauggauuuuucucccuguucaagggcuuuuucccugucgcuuuuggguuccucggaaaugugugcaacaucccguuucugggcgcccuguucagacggcuccaggggaccucuagcaugguuuga

SEQ ID NO: 69869 - RNA, 417 nt, Artificial Sequence
  derived and/or modified sequence opt5 from GOLT1B__Homo_sapiens__NP_057156
augaucagccugaccgacacacagaagauuggcauggggcucacgggauucggcguguuuuuccuguuuuucgggaugauccuguuuuucgauaaagcccuucucgcuauuggaaacguccuguuuguugccggccuugcguucgugaucgggcuggagagaaccuuucgguucuuuuuccaaaagcacaaaaugaaggcuacaggauuuuuccucggcggcguguucgucgugcugauuggguggccccugaucggaaugaucuuugaaauuuacggcuucuuucuccuguuccgcggguuuuucccuguuguggucggauuuaucagacgggugccgguucuuggcucccugcucaaucugcccgggauucgcucuuucguggacaaagucggagagagcaacaauaugguguga

SEQ ID NO: 69870 - RNA, 6723 nt, Artificial Sequence
  derived and/or modified sequence opt5 from GON4L__Homo_sapiens__NP_001269787
augcugcccugcaagaaaagacggaccacagugacggagagccuccagcacaagggcaaucaagaagagaauaacgucgaccuggaauccgccguuaaaccugagucugaucaggugaaggaccuuagcuccgugucucugagcugggauccgucccacgggagagucgcuggauucgaagugcagucucuccaggacgccggcaaucaacuggggauggaggauaccagccuuuccagcggaaugcugacccagaacaccaauguucccauccucgagggcguggacgucgcgauuucucaggggaucacacugccuucccuggagagcuuucacccccucaacauucauaucggaaaaggcaagcugcacgcuaccggcucuaagagagggaaaaagaugacacuucggccuggacccgugacccaggaggaucgcugugaccaucugacgcucaaagaaccuuucuccggcgagccgagcgaggaaguuaaggaggaagggggaaaaccccaaaugaacucugagggcgaaauuccuucccugcccagcgggucccagucugccaagccugugagccagcccagaaaguccacccagccggaugucugcgccagcccucaagagaaaccccuucggacacuguuucaccagccugaggaagagaucgaagacggaggccucuucauccccauggaggaacaggauaacgaggagucugaaaagcgccgcaaaaagaagaaaggcaccaaacggaaacgcgacgggagaggacaagagggcacacuggcuuacgaucugaagcucgacgacaugcuggaucggacccuugaagacggggccaaacagcacaaucugacggcugugaacgugcgcaauauucuccaugaggucaucacaaacgaacacguuguggccaugaugaaggccgccauuuccgagaccgaggauaugcccauguuugaaccuaaaaugacaagaagcaagcugaaagagguggucgaaaagggagugguuaucccgaccuggaauauuucucccaucaagaaagcuaacgagauuaagccuccccaguucguggacauccaucuugaggaagaugacagcuccgaugaggaauaucagccugacgaugaggaagaggacgagaccgccgaagagucucugcucgaaagcgaugucgaguccacagcuagcucuccccggggcgccaaaaagucccgccugagacaaagcucugaaaugacggagaccgacgaggaauccgggauccugagcgaggcggaaaaagugacaaccccggccauucggcacaucuccgcugagguugugccuaugggacccccucccccucccaagccgaagcagacaagagacucuaccuuuauggaaaaacuccacgccgucgaugaggagcuggcuagcuccccuguguguauggacucuuuccagcccauggaugacagccuuauugccuuucgcacgcgguccaagaugccccugaaagaugucccucucggccagcuggaagccgagcuucaagcuccggacaucacacccgauauguacgacccuaauaccgcggaugacgaagauuggaagauguggcugggcgggcucaugaacgacgaugugggaaacgaggacgaggccgacgaugacgaugaccccgaauauaauuuccuggaggaucuggacgaaccugauaccgaggacuuuagaacagaucgcgcuguucggauuaccaaaaaggaagugaacgagcucauggaggaacuguucgagacauuucaggacgaaaugggcuucagcaauauggaggaugacgggcccgaagaggaggaaugcgucgccgagccuagacccaacuucaauacgccgcaggcccuucgcuuugaagaaccucuggcuaaccuccugaaugaacagcaucggaccgugaaggagcuguucgagcaacuuaaaaugaagaaaucuuccgccaagcagcuccaggaaguugagaaagugaagccccagagcgaaaaaguccaccaaacacugauccuggauccugcgcagagaaagcgccuccagcaacagaugcagcagcaugugcaacugcuuacccagauccaucugcucgcuacauguaaccccaaucugaacccggaggccaccacgacccggauuuuucugaaggagcuuggaacauucgcccagucuuccaucgcucuccaucaccaguacaauccuaaauuucaaacccuguuccagcccugcaaccugaugggcgccaugcagcucauugaagacuuuagcacacacgugucuaucgacuguagcccucauaagaccguuaaaaagacggcuaaugaguuccccugccugcccaaacaggucgccuggauucuugcgacauccaagguguuuauguauccugaacugcucccgguguguagccugaaggccaaaaacccccaagauaagaucgucuucaccaaagcugaggacaaucugcuugcccucgggcugaagcacuuugaaggcacagaguucccuaacccccugaucucuaaauaccuccugaccugcaagaccgcucaucagcuuacagugagaauuaagaaccugaauaugaaccgcgccccugauaauaucauuaaauuuuauaagaaaacgaagcagcuccccguucugggaaaauguugcgaggaaauccaaccucaccaguggaagccgcccauugagcgggaagaacacagacugccuuucuggcuuaaggcgucccuccccagcauccaggaggaacugcggcauauggccgacggcgcucgcgagguggggaacaugaccggaacaaccgaaauuaauuccgauagaucucuggagaaagacaaccucgaacugggcagcgagucccgguacccucuucugcuccccaagggggucgugcugaaacugaagccgguugccacaagauucccucgcaaggcuuggcggcagaagagaucuagcgugcuuaaaccccugcucauccaacccuccccuucucugcagcccagcuuuaauccuggaaagaccccggcccgcuccacgcacagcgaagcgcccccuucuaagaugguccucagaaucccccauccuauucagcccgcuacagugcugcagaccguuccgggcgugccuccccuuggggucuccggcggagagagcuucgagucuccugcggcccugcccgcugugccucccgaagcccggaccuccuuuccgcucagcgagucucaaacacugcuguccagcgccccugugcccaaagucaugcuucccucccuggcuccuagcaaguuccgcaaaccguacguuagacggcgccccucuaagagacggggcgugaaagccagcccuugcaugaagcccgcgccugugauccaccaucccgcuuccgucauuuuuaccgugccugccacaacgguuaagaucgugucucucgggggaggcuguaacaugauucagccggucaaugccgcuguggcccagagcccccagaccaucccuaucacaacccugcucguuaaccccacauccuucccuugcccccugaaucaaucucuuguggcgagcuccgucucuccgcugauugugagcgggaacuccguuaaucucccuauccccagcacccccgaagauaaagcucacgugaacgucgacauugccugugccguggcugauggagagaaugccuuucagggccuggagccuaagcuggaaccccaggagcuuucuccucuguccgcuacgguguucccgaaagucgaacacagccccgggccuccccucgccgacgcggagugccaggaaggccugucugagaacuccgccugucgcuggaccguugugaagacagaggaaggaagacaagcucucgagccucugccccagggcauccaggaaagccuuaacaauccgaccccuggggaucuggaggaaauugugaaaauggagcccgaggaagcccgggaggaaaucuccggaucuccugagcgcgacaucugcgacgauauuaaggucgaacaugcuguggagcuggacacaggcgcccccagcgaggaacucuccagcgccggggagguuaccaagcaaacagugcugcagaaagaagaggagagaucucagccuaccaagacgcccuccagcucucaggaaccgccugaugagggaacaagcggcaccgacgucaacaaaggguccucuaagaaugcucuuagcuccauggaucccgaagugcggcugucuuccccucccggcaaaccggaggacuccagcucuguugauggacaauccgugggcacccccgucgggccugaaacaggaggcgagaagaacgggcccgaggaagaggaagaggaagacuuugaugaccucacccaggaugaggaggacgaaaugagcuccgcgucugaggaaagcgugcuguccgucccugagcuccaggaaacgauggagaagcugacauggcuugccucugagagacgcaugagccaggaaggagaguccgaagaggagaauagccaagaagagaacucugaacccgaggaagaggaggaagaggaagcugagggcauggaaucccugcagaaagaggaugagaugaccgacgaagccgugggcgacagcgccgagaagccucccacauucgcuucuccggaaaccgccccugagguugaaacaucccggacacccccuggggagagcaucaaagcggcuggaaagggcagaaauaaccaccgcgcccggaauaaaagagggucucgcgcccgggcuagcaaggauacguccaagcugcuccugcuuuaugacgaggauauucuggaaagagacccccuccgcgagcagaaagaucuggccuuugcgcaggcuuaccucacccgggugagagaagcccugcaacauaucccgggaaaguaugaggacuuccuucaggucauuuacgaguuugaaucuagcacacagcggcgcaccgccguggaucuguauaaaucccugcaaauccuccugcaggacuggccucagcuucugaaggauuucgcugccuuccuccugcccgagcaggcucucgccuguggccuguuugaagaacagcaggcguucgagaaaagcagaaaguuucuucggcagcuggagaucugcuucgccgagaaccccucccaccaucagaaaauuaucaagguucugcaagggugugcugacugccucccucaggaaauuacagagcugaagacccagauguggcagcuucugaaaggacacgaucaccuccaagacgaauuuucuaucuucuuugaucaucugcgccccgccgcuagcagaaugggcgacuucgaggaaauuaauuggacggaggagaaggaauacgaguuugacggcuucgaagagguggcccugccugaugucgaagaggaggaggagccgcccaaaaucccuacagccuccaagaacaaacggaagaaggaaauuggggugcagaaucacgacaaagagaccgaguggcccgauggagcuaaggacugugcgugcucuugccaugaaggcgggccugauagcaaacucaagaaauccaagagacgcucuuguagccacugcuccagcaaggugugugacucuaaauccuauaagagcaaagagccccacgaacuuguuggaucuuccccucaucgggaggccagcccgaugcccggcgcuaaggaagccgggcagggaaaagauaugauggaggaggaagccccugaggaaagagagucuacagaagcuacccagucccgcaccguccggacaacgagaaagggcgagaugcccgugagcggccuggccgugggguccacccugccuagcccccgcgaggucacagugaccgaacggcuccugcuugacggaccgccuccccacucucccgagacaccucaauuucccccuaccacgggcgcgguucuguacacagugaagagaaaccaggucgggccggaagugcgcagcugccccaaagcuagcccuagacuccagaaggagcgggaaggacaaaaagccguuucugagagcgaggcccugaugcuggugugggaugcuuccgaaaccgagaagcuccccggcaccgucgaaccucccgccucuuuccuuagcccgguguccucuaaaacacgcgacgcggggagacggcauguuagcggaaagccugauacccaggagcgcuggcugcccuccagcagagcccgggugaaaacaagagaccgcacguguccuguccacgagucucccuccggcaucgacaccagcgaaacaucuccgaaggcuccucggggcgggcuggccaaggauuccggaacccaggcuaaaggccccgagggggaacagcaacccaaggccgcugaggccacagugugcgcgaauaacagcaaaguguccucuaccggagaaaaggucguucucuggacgagagaggccgaccgcgugauccugaccaugugucaggagcagggcgcucagccucaaacauucaacauuaucagccagcagcuugggaauaaaacccccgccgaagugucccaucgguuuagagagcugaugcaacucuuccacacagcuugcgaagccagcucugaggaugaagacgaugccaccuccacaagcaacgcugaccaacugucugaucacggagaccugcucagcgaggaggaacuugaugaguga

SEQ ID NO: 69871 - RNA, 1365 nt, Artificial Sequence
  derived and/or modified sequence opt5 from GOPC__Homo_sapiens__NP_001017408
augagcgccggcgggcccugcccugcugccgcgggaggcgggccgggaggcgcuuccuguucugugggggcccccggaggcgucagcauguucagauggcuggagguucucgaaaaggaguuugacaaagccuucguggauguggaccugcuucugggcgaaaucgauccugaccaggcugauauuaccuacgaggggcggcaaaagaugacaucccucucuagcugcuuugcccagcugugucacaaagcucaguccgucucucagaucaaccauaaacuugaagcccaacugguggaccucaagagcgagcugacggagacccaggcggaaaagguugugcuggagaaggaaguccacgaucagcuccugcagcuucauuccauucaacugcagcuccacgccaaaacaggacagagcgcugacucuggcaccaucaaggccaaacuggagcgcgagcuugaagcuaauaagaaagagaagaugaaggaagcccagcuggaggcggaagugaaacuccugagaaaggagaacgaggcccugcggcgccauauugcuguucuccaagccgaaguguauggggcuagacuggccgccaaauaccuugauaaggagcuggcuggacggguccagcagauccaacuccugggccgcgacaugaaagggcccgcgcacgauaaacuuuggaaucagcuggaagccgagauccaccuccauagacacaagacagugauucgggcuugccgcggaagaaacgaccugaagcggccuaugcaggcucccccuggccaugaucaggacucccugaagaaaagccaaggcguggggccgauccgcaagguccuccugcuuaaagaagaccacgagggacugggcauuucuaucaccgggggaaaggagcacggcguucccauucucaucuccgaaauucauccugggcagcccgccgauagauguggaggccugcacgugggcgacgccauccuugccgugaauggggucaaccugcgggauacaaaacauaaggaggcggugaccauccucagccagcagcgcggagaaauugaguucgaaguuguguaugucgcuccugagguggacucugaugacgagaauguugaauacgaggaugaauccggccacagauaucggcuguaccuggacgagcucgaagggggaggcaaccccggggccagcugcaaggauacguccggcgagaucaaagugcugcaaggauuuaauaagaaagccgucaccgacacacaugagaacggcgaucuugggaccgcuucugaaacaccgcuggacgacggagccagcaagcucgaugaccugcacacccuguaucacaaaaaguccuacuga

SEQ ID NO: 69872 - RNA, 741 nt, Artificial Sequence
  derived and/or modified sequence opt5 from GORAB__Homo_sapiens__NP_001139511
augagcugggccgcugugcuggccgucgcggcugccagauucggacacuuuugggggugccgguggcccggaccuauggcccagggcugggcuggguucuccgaggaggagcuccgcagacugaagcaaaccaaagacccguuugaaccccagcggcgccuuccugccaagaaaucuagacagcagcugcaacgggagaaggcucucguugaacagagccagaaacugggacuucaggauggcuccacaucucugcuccccgagcaacugcugagcgccccuaagcagcgcgugaacgugcagaagcccccuuucuccucuccgacgcuccccagccauuuuacccugacauccccugucggggacggacagccccaaggcaucgagagccagccuaaagaacuuggccuggaaaauucucacgaugggcauaacaauguggaaauucugcccccgaagccugacuguaaacucgagaagaaaaagguugagcuucaggaaaaguccagaugggaggugcugcaacaggaacagcggcucauggaggagaaaaacaagcgcaaaaaggcgcugcuggccaaagcuaucgccgaaagaagcaagcggacccaggcugagacaaugaaacucaagcgcauucaaaaggaacugcaggcccuugaugacauggucucugcggauaucggcauucugagaaaucggaucgaccaggccucccucgauuacagcuaugcucgcuga

SEQ ID NO: 69873 - RNA, 1323 nt, Artificial Sequence
  derived and/or modified sequence opt5 from GORASP1__Homo_sapiens__NP_114105
augggccugggggugagcgccgagcagcccgcuggaggcgccgaaggguuccaccuccauggaguccaagagaacuccccugcgcagcaggcuggccuggaaccguacuuugacuucaucauuaccaucgggcacucuagacuuaauaaggagaacgauacacugaaagcccuccugaaggccaauguugaaaaacccgugaaacuugagguguuuaacaugaagacgaugcggguccgcgagguggaaguugugccuagcaauauguggggaggccagggccugcucggggcuuccgucagauucugcucuuuucggcgcgccagcgagcaaguguggcauguucuggacguggaacccuccucuccugcugcccuggcgggacucagacccuauaccgauuacgucgugggcagcgaccagauucugcaggaguccgaggauuucuuuacacuuaucgaaagccacgaggggaagccucugaagcucaugguguauaacucuaaauccgacagcugucgggaagucaccguuacaccgaaugccgcuuggggaggcgaggggucucugggaugcggcauuggcuacggguaucuucaucgcauccccacccagccucccuccuaccacaagaaaccucccggaacaccgccucccagcgcccugccucucggcgcucccccucccgaugcccugccgcccgggccuacccccgaagacucuccuucccuggagacgggaagcagacaauccgauuauauggaggcgcuccugcaggcccccggcucuagcauggaagacccgcuuccugggcccggauccccuagccacucugcucccgauccugacggccugccccauuucauggagaccccgcuccagccucccccucccgugcagcgggugauggauccgggcuuucuggacgucuccgggaucagccuucuggacaacucuaaugccagcguguggcccucccucccuucuagcacagaacugaccacaaccgcuguuuccacgagcggacccgaggauauuuguucuuccucuagcucccacgaacgcggcggggaggccacauggagcggauccgaguucgaagugucuuuucuggacagcccuggcgcccaagcucaggcggaucaucucccccagcugacccuuccugacucccugacaucugccgcuagccccgaggaugggcucuccgccgaacugcuugaggcccaagcugaagaggagccggccagcaccgaaggccuggacaccggaacagaggcggaaggccucgauucucaggcucagaucuccacgaccgaguga

SEQ ID NO: 69874 - RNA, 1359 nt, Artificial Sequence
  derived and/or modified sequence opt5 from GORASP2__Homo_sapiens__NP_056345
augggcagcucccagucuguggagauccccgggggaggcaccgaaggguaccacguccugagaguucaagagaacagcccuggacaucgggccggccucgaaccguucuuugacuucauuguguccaucaaugggucucgccugaacaaggauaaugacacacuuaaagaucugcucaaggcuaacguggagaaacccgucaagaugcugauuuauagcuccaaaacgcuugaacugagagagaccucugugacaccuagcaaucucuggggaggccagggccugcuggggguuuccauccgguuuugcagcuucgacggagccaacgagaauguguggcacguccucgaaguggagucuaacucccccgcggcucuggccggccuucgcccucauagcgauuacauuaucggggccgacaccguuaugaaugaaucugaggaucuguuuucccucaucgagacacacgaagcuaagccccugaaacuuuauguguacaacaccgacacagauaauuguagagaggucauuaucaccccuaacagcgccuggggaggcgaagggucucugggaugcggcauuggcuauggguaccuccaucggaucccgacgcgccccuucgaggaaggaaagaagauuucccugccuggccagauggcugggacccccaucacaccucugaaagacggauuuaccgaggugcagcucagcuccgugaaucccccgucucugagcccucccggcacaaccgggauugagcaaucccuuacgggacugagcaucucuuccacaccucccgccgucagcucuguucucagcaccggcgugcccacagugccucugcuuccgccccaggucaaccagucccugaccucugugccucccaugaauccugcgaccacacuccccggccugaugccgcugccugccgggcuccccaaccugccuaaccuuaaucugaaccuccccgcuccucacaucaugcccggaguuggccugccggaacuugugaauccugggcugccuccccuccccagcaugccgcccagaaaccugccuggaauugcuccccugccucuccccuccgaguuccugccuagcuuuccccuugucccggaaucuuccagcgccgccucuuccggcgagcugcucagcucccugccucccacgucuaaugcgccuagcgaucccgccaccacaaccgcuaaggccgacgcugccuccucucugacaguggauguuaccccgccuacggccaaagcucccacaaccguggaagaccgggucggggacagcaccccuguguccgagaagcccgucagcgcggccguggaugcuaacgccucugagucccccuga

SEQ ID NO: 69875 - RNA, 747 nt, Artificial Sequence
  derived and/or modified sequence opt5 from GOSR1__Homo_sapiens__NP_001007026
auggccgcuggcaccagcuccuacugggaggaccugagaaagcaggcccggcaacucgaaaacgagcuggaucuuaaacuggugucuuucagcaagcucugcacauccuauucucacagcuccacgcgcgacgggagacgggauucuagcgacaccacaccccugcuuaauggauccagccaggaucgcauguuugaaaccauggcgaucgagauugaacagcugcucgcuagacugacaggcgucaacgacaaaauggccgaguacaccaauucugccgggguuccuucccugaacgcugcccucaugcauacacugcagcggcaccgcgauauccuucaagacuauacccaugaguuccacaagacgaaagcuaauuuuauggccauuagagaacgggagaaccugaugggaagcgugcgcaaggauaucgaaucuuacaaguccggcagcggggugaauaacagacggaccgaacucuuccugaaagagcaugaccaccuucgcaauucugauagacugauugaggagacaaucuccaucgcgauggccaccaaggaaaacaugacaagccagcggggaaugcucaaauccauucacucuaagaugaauacccuggcuaaccgcuuuccggccgucaauagccugauccagagaauuaaccuccggaaaagacgcgacucccugauccuuggcggcgugauugggaucuguacgauucugcuccugcuuuaugcuuuccauuga

SEQ ID NO: 69876 - RNA, 588 nt, Artificial Sequence
  derived and/or modified sequence opt5 from GOSR2__Homo_sapiens__NP_001012529
auggacccccuguuccagcaaacccacaagcaagugcaugagauccagagcugcaugggcagacucgaaacagccgauaaacaguccguccacauuguugagaacgaaauccaggcuucuauugaccagaucuuuagccggcuggagcgccuugaaauucuguccucuaaggagccuccgaauaaaagacagaacgcccggcuccgcguggaucagcugaaguacgacgugcaacaucuucagacggcgcugagaaauuuccagcaccggcgccaugcuagagagcagcaagaacggcagcgcgaggaacuccugagcagaaccuuuacaaccaacgauuccgacacaaccauccccauggaugagucucugcaguucaauagcucccuccaaaaaguccacaacgggauggacgaucugauccuugacggacacaauauucuggauggccuccggacacagcgccugacccuuaagguggggagccugcucggagacagagagaaggccucuuguuuuucccugauccagcaguucagcaacugcguuuauauucugaucacguguccucaaauugugaucuuuuga

SEQ ID NO: 69877 - RNA, 1242 nt, Artificial Sequence
  derived and/or modified sequence opt5 from GOT1__Homo_sapiens__NP_002070
auggccccuccuagcguguucgcugaggucccgcaggcccaacccguucugguguuuaagcucaccgcggacuucagagaagauccugacccccggaaagugaaccugggcgucggggcuuaccgcacagaugacugccacccuugggugcuucccguugugaagaaagucgagcagaagaucgccaaugauaacucccugaaucaugaauaucucccuauucugggacuugccgaguuuagaucuugugcuagccggcuggcccucggcgacgauuccccggcucugaaagaaaagcgcguugggggagugcagucucugggcgggacgggagcccucagaaucggcgcggacuuccuggcccggugguacaacggcaccaauaacaagaauacacccguguaugucagcuccccuaccugggagaaccacaaugcuguguuuucugccgcuggguucaaagauauucgcagcuacagauauugggacgccgagaagcggggacuugaucugcagggcuuucucaacgaccuggaaaaugcgcccgaguucuccaucgugguccuucaugccugcgcucacaacccuacagggauugaucccaccccggaacaauggaaacagaucgccagcguuaugaagcaucgcuuucuguuccccuuuuucgacucugcuuaccagggauuugccuccggcaaucucgagagagacgccugggcuauccgguauuucgugagcgagggguucgaauuuuucugugcgcagucuuuuuccaaaaacuucggacuguacaaugagcgcgugggcaaccugacagucgugggcaaggaacccgagagcauucuccaaguucugucucagauggaaaagaucgugagaauuaccugguccaacccucccgcccagggggcucggaucgucgccagcacgcuuuccaaucccgagcuguuugaggaauggaccggaaacgugaaaacaauggccgaucgcauucucaccaugagaucugagcugcgggcuagacuugaagcccugaagacaccuggcaccuggaaucacaucacggaccagauugggauguucagcuuuacaggacucaacccgaaacaaguugaguaccuggugaaugaaaagcacaucuaucugcuccccuccggccgcaucaacgucagcgggcugaccaccaaaaaucuugauuacguggcgacaucuauucaugaggcugucaccaagauccaguga

SEQ ID NO: 69878 - RNA, 1164 nt, Artificial Sequence
  derived and/or modified sequence opt5 from GOT2__Homo_sapiens__NP_001273149
auggcccugcuccacagcggcagagugcugcccgggaucgcugccgcguuccauccuggacuugcugccgccgcuuccgcccgggcuucuagcugguggacccacgucgagaugggcccgcccgacccuauucuggggguuacagaagccuuuaagcgcgauacgaacuccaaaaagaugaaucucggagugggcgcguacagagacgauaacgggaaacccuaugugcugccuucuguccggaaguucgugaccguucagacaaucagcggaaccggcgcccuucgcauuggcgcuuccuuucugcaaagauucuuuaaauucucucgggacguguuucuccccaagccuacaugggggaaucauaccccgaucuuccgcgaugccggaaugcagcugcagggcuacagauauuacgaccccaagacaugcggguuugauuucaccggagcugucgaggacauuagcaaaaucccugaacaguccgugcugcuccugcacgccugugcgcauaaccccacgggcguugauccucggcccgagcaauggaaggaaaucgccaccguggucaaaaagcgcaaucuuuuugcuuucuuugacauggccuaucagggguucgcuagcggagauggcgacaaagaugccugggccgugagacacuucauugagcagggcaucaacgugugccugugucagucuuacgcuaagaauauggggcucuauggagagcgggucggcgcguuuacaaugguuugcaaggacgccgacgaagcuaaacgcguggagucccaacugaagauucuuaucagaccgauguacagcaacccuccccugaauggggcccggauugccgcugccauccucaacaccccugaucugcgcaaacaguggcugcaggaagugaaggucauggcggacagaauuaucggaaugcggacacagcucgugucuaaucugaaaaaggagggcuccacccacaacuggcaacauaucacggaucagauugggauguucuguuuuacaggacuuaaacccgagcagguugaaagacugaucaaggaguucagcauuuacaugaccaaggacggccgcaucucuguggcuggcgucacauccagcaaugugggguaucucgcccacgccauucaucaaguuaccaaauga

SEQ ID NO: 69879 - RNA, 1959 nt, Artificial Sequence
  derived and/or modified sequence opt5 from GP1BA__Homo_sapiens__NP_000164
augccccugcuccugcuucugcuccugcuuccuagcccgcugcacccccauccuaucugcgagguguccaaggucgccucucaccucgaaguuaacugugacaaaagaaaucugaccgcucugcccccugaucuccccaaggacacaacgauucugcaucuuagcgagaaccugcucuacaccuucucccuggccacacuuaugccuuauacccggcugacacagcucaaucuggaucgcugcgaacugaccaaacuccaaguggacggcacacugccggugcuugggacccuggaucucucucacaaccagcugcagagccuuccccugcucggacagacgcugccugcgcugaccguccucgacguguccuuuaauagacugacaucucuuccccugggcgcucuccgggggcugggagagcuucaagaacuguaccucaagggcaacgagcugaaaacccugccucccgggcuccugacaccgaccccuaaacuugagaagcugagccucgccaauaacaaucugacggaacugcccgccggacuucucaacggccuggagaaucuggauacacuccugcuucaggaaaacucccuguauaccaucccuaagggcuucuuugggagccaucuccugcccuucgcuuuucugcacggaaaucccuggcuuuguaacugcgagauucucuacuuccgcagauggcugcaggacaaugccgagaacguuuauguguggaagcagggcgucgaugugaaagcuaugacaucuaacguugccuccgugcaaugugacaauagcgauaaguuuccugucuacaaauauccggggaagggaugccccacccugggcgacgaaggggauaccgaccucuacgacuacuauccugaggaagauacagagggagacaaggugcgggcgacgcgcaccguggucaaauuccccacaaaggcccacaccacaccuuggggccuguuuuacucuugguccaccgcuagccuugauucucagaugcccuccagccugcauccgacgcaggaauccacaaaagagcagaccaccuucccucccagauggacaccuaacuuuacccuccacauggagucuaucacauucagcaagacgcccaaauccaccacagaaccuacccccagcccgacaaccucugagccuguucccgaacccgccccuaauaugacgacccuggagccgacacccuccccuaccacacccgaaccuaccagcgagcccgcuccuucucccacgacaccggagccuaccagcgaacccgccccuucccccacaaccccggagccuaccucugaacccgcgccuagccccacaacgcccgagccuaccccgauucccacaaucgccaccuccccuacaauccuggugagcgcuaccucucuuauuacgcccaaguccacauuucucaccaccacaaaaccugugagccugcuggaaucuaccaagaagacaauccccgagcucgaccaaccuccgaaacugcggggcguccuucaggggcaucuggaguccagccgcaacgaucccuuccuccacccugacuucuguugccugcugccccuuggauuuuaugugcucggccuguucuggcugcucuuugccuccguugugcugauucuucugcucucuugggucgggcacgugaagccucaggcucuggauagcggacaaggcgccgcccugacgaccgcuacacagaccacacaucuugaacugcagagagggcggcagguuaccgugccccgcgcguggcuccuguuccucagaggaucccugccgacguuucggucuagccuuuuccuguggguccgcccuaauggcagagugggcccccucgucgccgggcggagacccuccgcucugagccaaggacgcggccaggaccugcuuucuaccguguccauccgguacagcgggcacucucuguga

SEQ ID NO: 69880 - RNA, 621 nt, Artificial Sequence
  derived and/or modified sequence opt5 from GP1BB__Homo_sapiens__NP_000398
augggcagcgggcccagaggagcccugucccuccugcuucugcuccuggcuccuccgucucggcccgccgcgggcugcccugcucccuguagcugcgccgggacccuuguggacuguggacgcagaggccugacaugggccucccucccuacggcuuuccccgucgauaccacagagcugguucugaccgggaacaaucucacagcccugccuccgggacuucuggacgcucuccccgcccugcggaccgcgcaccuuggcgccaacccuuggcgcugcgauuguagacuggugccccuccgggcuuggcuggccggccgcccugaaagagcucccuaccgggaccugcgcugcguggccccgccugcgcucagagggcggcugcuucccuaucuggccgaggaugaacuccgcgcugccugugcuccuggaccccugugcuggggcgcccuugccgcucagcuggcgcuccuggggcugggacuccugcaugcccuucugcucguccugcuucuguguagacuccggcgccugagagcucgggccagagcccgcgcugccgcgcggcugucucucacagacccccugguggcugagagagccggcaccgaugaaagcuga

SEQ ID NO: 69881 - RNA, 1614 nt, Artificial Sequence
  derived and/or modified sequence opt5 from GP2__Homo_sapiens__NP_001007241
augccccaccugauggagagaauggugggcagcgggcuccuguggcuugcccuggucuccugcauccucacccaggcuucugccguucaacggggauacggcaacccuauugaagcgagcuccuaugggcuggaccuugauuguggagcuccgggcacacccgaggcccaugugugcuucgacccuugucagaauuacacgcugcucgaugaacccuuucgcucuaccgagaacagcgccgggucccagggaugcgacaagaauaugucuggcugguauagauucgugggcgaagggggaguccggaugagcgagacaugugugcagguucaccgcugccaaaccgaugcuccuauguggcugaacggcacacaucccgcccugggggacggaaucaccaaucacacagcuugugcccauugguccggcaacugcuguuuuuggaaaaccgaggugcucgucaaggcgugcccugggggauaccacguguauagacuggaaggcacgccgugguguaaucuucgguacugcaccguuccccgcgauccuagcacaguggaggacaaaugcgaaaaggccuguagacccgaggaggaaugccuggcucucaacucuaccuggggcuguuucugccggcaggaucuuaauuccagcgacguccacucucugcagccucagcuggauugugggccccgcgagauuaaagugaagguggacaagugccuccugggaggccuggggcucggagaagaggucaucgccuaucugagagauccgaacuguuccagcauucuucaaacagaggaacggaauuggguuucugugaccuccccugugcaggcuagcgccugccgcaacauccuggagagaaaucagacgcaugcgaucuacaaaaacacacucucccuggucaaugacuuuauuauccgggacaccauucuuaacaucaacuuccagugugccuacccccuggauaugaaggugucucuccaagcugcccugcagccuauuguuagcucccugaaugugagcgucgacggcaacggggaauuuaucgugcgcauggcucucuuccaggaucaaaauuauacaaaccccuacgagggagacgccguugaacugucuguggaguccguccuuuaugugggcgccauucuggaacagggcgauaccagcagauuuaaucucguccugcggaacugcuacgcuacccccacagaggacaaagcggaucuugugaaguauuucaucaucagaaauucuuguagcaaccagcgcgacuccacgauucacguugaggaaaaugggcagucuagcgagucccgguuuagcgugcaaauguucauguuugccggacauuacgaucuggucuuccuccacugcgaaauccaccugugcgacucucugaacgagcagugucagccuuccugcagcagaucucaggugcgcuccgaaguuccggcuauugaucucgcccgggugcuggaccuuggccccaucaccagacgcggggcccaaagcccuggagucaugaauggcacacccuccaccgcuggguuccugguggccuggccuauggugcuccugacaguucugcuugcguggcucuuuuga

SEQ ID NO: 69882 - RNA, 1683 nt, Artificial Sequence
  derived and/or modified sequence opt5 from GP5__Homo_sapiens__NP_004479
augcugagaggcacccuccugugcgccgugcuugggcugcuccgggcucagcccuucccuuguccgcccgccugcaagugugucuuucgcgacgcggcucaaugcagcggaggcgauguugccagaaucuccgcccuggggcuuccuacaaaccugacgcacauucuccuguucggaaugggccgcggggugcugcagucucagagcuuuuccggaaugaccgugcuccagcggcugaugaucucugacagccauauuuccgcugucgcccccggcacauucucugaucuuaucaaacugaagacccucagacugagccggaauaaaauuacacaccuuccuggcgcucugcucgacaagauggugcugcuggagcaacucuuucuggaucauaacgcccuucgcgggaucgaccagaauauguuccagaaacugguuaaccuccaggaacuggcgcuuaaucaaaaccagcuggauuuucuccccgccucccuguucaccaaucuggagaaccucaagcugcuugaccugagcggaaauaaccucacacaucugccuaagggccuucugggggcucaggccaaacucgaaagacugcugcuccacucuaaucggcuggugucccuugauagcggacugcucaacucucugggcgcucugaccgagcuucaguuucaccgcaaucacaucagauccauugccccgggggcguucgaccggcuccccaaccugagcucucugacgcucucccgcaaucaucuggccuuucuuccuagcgcucuguuccuccacucccauaaccugacccugcuuacacucuuugaaaacccccuggccgagcugccuggaguccucuucggcgagaugggcgggcugcaagaacuuuggcugaauagaacccagcuccggacacugcccgcugccgccuuccgcaaccugucuagacuucgguaccucggagugacccugagcccgagacuguccgcucucccucagggcgcguuucaagggcugggagagcuucagguucuggcccuccacagcaauggccugacggcucugcccgaugggcuucuccgcggacugggcaagcugagacaggugucucuccggcgcaaccggcugagagcccuuccucgcgcccuguuccggaaucucuccagccuggaaucuguccagcuggaccacaaccaacuugagacacugcccggcgauguguuuggggcucuccccagacugaccgaggugcuccugggacauaauagcuggcgcugugacugcggccuugggccuuuccugggauggcuccggcagcaccugggccuggucgggggcgaggaaccgcccagaugugccggaccuggcgcgcaugcugggcuuccccugugggcccucccuggaggcgacgccgaaugccccgggccgcgcggaccucccccucggcccgcugccgauuccucuagcgaggcuccuguucaccccgcccuggcgccgaacuccagcgaaccuugggugugggcccagcccgugacaaccggcaaagggcaggaccauucucccuuuuggggcuucuauuuucuccugcuugcuguccaagccaugaucaccgugauuaucguuuucgcuaugauuaagaucggacagcuguuuagaaaacucauucgggagcgcgcccugggcuga

SEQ ID NO: 69883 - RNA, 1863 nt, Artificial Sequence
  derived and/or modified sequence opt5 from GP6__Homo_sapiens__NP_001077368
augagccccuccccuaccgcccuguucugccucggccugugucuugggagagugccggcucagucuggaccccugccuaagcccagccuccaagcccugccuuccucucuugucccccuggagaaaccuguuacacuccggugccagggcccgcccgggguggaccuguaccgccuggaaaagcucagcuccucuagauaucaggaucaggcggugcuguuuaucccugcuaugaaacggagccuugccggacgcuacagauguuccuaucaaaacggcagccuguggucucuccccuccgaccagcuggagcuugucgccacggggguguucgcuaagccuagccugucugcccagcccggaccggcuguuuccagcggcggcgaugugacccuccagugccaaacacgguacggguuugaccaguucgcccuguauaaagaaggagauccugcgcccuacaagaauccugagcgcugguauagagccucuuuucccauuaucaccgucacagcugcccacuccggcaccuaccgguguuacagcuucuccucucgcgaccccuaucuguggagcgcuccuuccgauccgcucgaacuggugguuacagggaccagcgugacgcccucuagacuuccuaccgagcccccuucccccgucgccgaguuuagcgaagcgacagccgagcugaccgugucuuucacaaacgaaguguuuaccacggagacaagccgguccauuaccgcuucuccgaaggagagcgacuccccugccggagaaagcugucccccuguccuccaucagggccagcccgggccugauaugccccgcggaugcgacccgaauaacccuggcggcguuucugggagaggacuggcucaacccgaggaagcccccgccgcucagggccaggggugcgcggaggccgcuuccgccccuccggcucccccugccgaucccgaaaucaaacggggaagcggcuggcgcccuacaggguguucucaacccagagugauguucaugaccgccgagccucaggcgcgguccuaccccagagagggaagcuggcacggccgccggcuuaaggacuggagagugugguccgucgaagcuggcgggcagcgccugcagcucuggaaacggggacaugccgccucuagcuggugcuccauuagagagccguuuggccaaugucugucugugugccugccucucugccugcgcgcucccagcaucugggaugggcggaaucuuuggagaccucaucccccgccuuguacccuguggaugacaugguaucccggauggacgaccuacuggccucucuccagcacaucucugaucugggcccccgacggcucccuucgcuuccccgcucugcggguugacagcgugccuucuuccguccagaacccgcccgugcucccuuuugggccccugugcagcugucugguuuucccuagaaauucucacccccacagcauuucccacugcggccucaccaaccugcuuagcucucugcgcacaggacucgccggcucccuggggaugagcuucaucuuucuguccgugaaacuugcgcgguguccucucccguucacccuggaaaauaagauuucucugugcaacauggucaagccccaucucuaucagcagaauaagaaaacgcaaaagcuggccagauguggaggcgcuagccuuuacucccagcagcugcgggggcuccgcugggagaacggacugucucugggcgggagaggcugcagcgaacuucggucccaccauuguacacucgccagagugaccaaaccugauuuugucucuaagaauaccggaaugaacaugagcaucacacugauuuga

SEQ ID NO: 69884 - RNA, 534 nt, Artificial Sequence
  derived and/or modified sequence opt5 from GP9__Homo_sapiens__NP_000165
augcccgccuggggcgcucuguuccuccugugggccaccgcggaggcuacaaaggacugcccuagcccguguacgugcagagcccuugaaaccauggggcuguggguggauugucggggacacggccucacagcccugcccgcccuuccugcucgcaccagacaucugcuccuggcuaacaauucccugcagucuguucccccuggggccuuugaccaccucccccaacugcagacacuugaugucacccagaacccuuggcauugcgacuguagccugacauaccuccggcuguggcuugaggaucgcaccccggaagcgcugcuccaggugagaugcgccucccccucucuggcugcccacggaccucugggccggcucacgggguaucaacugggaagcuguggcuggcagcuucaggcuuccugggugcgccccggcguccugugggacguggcccucguugcgguggccgcucuggggcuugcccugcucgcuggacugcugugcgccaccacagaggcccucgauuga

SEQ ID NO: 69885 - RNA, 960 nt, Artificial Sequence
  derived and/or modified sequence opt5 from GPA33__Homo_sapiens__NP_005805
auggugggcaagauguggcccguccuguggacccucugcgccguuagagugacaguggacgcuaucagcgucgagacgccucaggaugugcugcgggccucccaagggaaaucuguuacccuuccguguacauaccacaccagcacauccucucgcgaaggacugauucagugggacaagcuccugcuuacccauacagagagaguggucaucuggcccuucagcaacaaaaauuauauucacggcgaacuguacaagaaccggguguccaucucuaauaacgcggagcagagcgaugcuuccauuaccaucgaccagcucacgauggccgauaaugggaccuaugaaugcagcguuucucugauguccgaccuggagggaaacacaaaaagccgcgugagacuccugguccuugugccucccucuaagccugaguguggcaucgaaggggagaccauuaucggaaauaacauucaacugacaugccaguccaaggaaggcagccccaccccucaguacucuuggaaacgguauaauauccucaaccaggagcaaccgcuggcccagcccgcuuccggccagccugugagccuuaagaauauuuccacggauacaucuggguacuauaucuguaccagcuccaacgaggaaggaacacaguuuugcaauauuaccgucgccguucgcagccccucuaugaacguggcucuguacgugggcaucgccgucggggugguugcggcccucaucauuaucggaauuaucauuuacuguugcuguugcagaggcaaagacgauaauaccgaggacaaggaagaugcucggccuaaccgcgaggccuaugaggaacccccggagcaacugagagaacugucccgggagcgcgaagaggaagacgauuacagacaggaggagcagcggagcacagggcgcgaaucuccugaccaucucgaccaauga

SEQ ID NO: 69886 - RNA, 1866 nt, Artificial Sequence
  derived and/or modified sequence opt5 from GPAA1__Homo_sapiens__NP_003792
augggccugcucagcgaccccgugagacggcgcgcccuggcuagacuuguccugcggcucaacgccccucugugcguucuuuccuacguggcggggaucgcuugguuccuggcccucguguuuccgccccugacccagcgcacauauaugucugagaaugccaugggaagcacgauggucgaagaacaauucgcuggcggggauagagcccgggcuuuugcccgcgacuucgcggcccacagaaagaaauccggagcucugccuguggccuggcucgaacggaccaugcgcucuguuggccuggagguguacacacagagcuuuuccagaaagcuccccuucccugaugaaacccaugagcgguauauggucucugggacaaacguguacggcauucugcgcgcucccagagccgcgagcaccgagucccucguucugacagugccuuguggaagcgacucuaccaauucccaggccgucggccuucugcucgcucuggccgcucacuuucgggggcagaucuauugggccaaagauauuguguuccuggugacggaacaugaccuccugggaaccgaggccuggcuugaggcuuaccacgaugucaacguuacaggcaugcaaagcucuccgcugcaggggcgcgcgggagccauccaggcugccguggcccucgagcuguccagcgacguggucaccucucuugauguggcuguugagggccugaaugggcagcuccccaaccuggaccugcucaaucuguuucaaacauucugccagaagggaggccuucuguguacccuccagggcaaacugcagccugaagauuggacgucccuugacgggccccugcaaggacuccagacacugcugcucauggugcugagacaggccagcggccggccucaugggucccacggacuuuuucugagauaucgcgucgaggcgcucacccugcggggcauuaacucuuucagacaauacaaguacgaucugguggcuguugggaaggcccuugaaggaauguuucgcaaacucaaucaccuucuggagcggcuccaucagagcuucuuccuguaucuucugcccggccucuccagauuugugagcaucggccuguacaugccggccgucggguuccugcuucucgugcugggacugaaggcucucgaacuguggaugcagcuucacgaggccggcauggggcuggaggaaccuggaggcgcucccgggccuucugucccccuucccccuucccagggcgugggacuggccagccugguugcgccgcuucucaucucucaagccaugggccuggcucuguaugugcuccccguccuggggcagcauguggccacacagcacuuuccuguugcugaggccgaagcggugguccuuacccugcucgccauuuacgcugccggacuggcucugccccacaacacccaucgcguggugagcacacaggccccugaccggggcuggauggcccuuaaacucguugcucugaucuaucuggcgcuccaacuggggugcauugcccuuacgaauuucucccugggauuucuccuggcuaccacaaugguccccaccgccgcccuggcuaagccgcacggcccuagaacacuuuacgccgcgcugcucgugcugaccucucccgcugccacgcuccuggggagccuuuuccuguggcgcgagcuccaggaagccccucugucccuggcugagggcuggcagcuuuuucuggccgcgcucgcucagggagugcuggagcaucacacauauggcgcccuccuguucccccuucugagccucgggcuguacccuuguuggcugcuguuuuggaacguccuguucuggaaauga

SEQ ID NO: 69887 - RNA, 1023 nt, Artificial Sequence
  derived and/or modified sequence opt5 from GPALPP1__Homo_sapiens__NP_061029
auggccagagaccugaucggccccgcucucccuccgggguucaaggcccggggaaccgcggaggaugaagagagagaccccagcccuguggcuggccccgcccugccucccaacuacaaauccucuagcuccgauucuagcgacuccgaugaagacucuagcucccuuuaugaggaagggaaucaggagagcgaggaagaugacucuggaccuacagccagaaagcaacggaaaaaccaggaugacgaugacgaugacgacgauggcuuuuucgggccggcucugcccccuggauuuaagaaacaggacgauuccccuccccgccccauuaucggcccggcccucccucccggcuucauuaagagcacgcagaagucugacaaagggagagaugacccuggacaacaggagaccgauuccagcgaagacgaggauaucauuggccccaugcccgcuaaggggccugucaauuacaacguuacaaccgaguuugaaaaacgggcccagcgcaugaaggagaaacugacaaagggagacgaugacucuuccaagccgaucgugagagaaagcuggaugaccgagcuucccccugaaaugaaagacuucggccuggggccccggacauuuaagcgcagagcggaugacaccuccggagaucggucuaucuggacggacaccccugccgaucgcgagagaaaagcuaaggagacacaggaagcccggaaaagcuccagcaagaaagacgaggaacacauucucucuggccgcgauaagagacuggcugagcaaguguccagcuauaaugaaucuaagcggagcgagucccugauggacauccaucacaaaaagcucaaaucuaaggccgcggaggauaaaaacaagccccaggaacgcauuccguucgaccgcgauaaggaccugaaagucaaucgguuugaugaggcccagaagaaagcucuuaucaagaaaagcagagaacugaacacccgcuucucccauggcaaggggaauauguuucucuga

SEQ ID NO: 69888 - RNA, 2487 nt, Artificial Sequence
  derived and/or modified sequence opt5 from GPAM__Homo_sapiens__XP_005270055
auggacgagagcgcccugacccucggcacaaucgauguguccuaccugccccacucuagcgaauauuccgucgggagaugcaagcauacgucugaggaauggggagaguguggcuuccggccuaccauuuuucgcagcgcuacacuuaaauggaaggaaucccugaugucuagaaaacggccguucguugggcgcugcuguuacagcugcacaccccaguccugggacaaguuuuucaacccuagcauccccucucucggacugagaaaugugauuuauaucaacgagacccacacccggcaucgcggcuggcuugccagacggcuguccuacgugcucuuuauucaagagcgcgauguccacaaagggauguucgcgacaaaugugaccgaaaacguucugaauagcucuagagugcaggaggcuaucgccgaagucgccgcugagcugaacccugacggauccgcccagcagcaaagcaaggcugugaauaagguuaaaaagaaagccaagcggauccuccaggagaugguggcgacggucucucccgccaugauucgccugaccggcugggugcuucugaaacucuuuaacuccuucuuuuggaauauccagauucauaagggccagcuggaaauggugaaggcugccacagagaccaaccuuccucuccuguuccugccgguccacagaagccacaucgauuaucugcuccugacauuuauucuuuucugucauaauaucaaagcucccuacauugccuccgggaacaaucugaacaucccuaucuuuucuacccucauucacaagcugggaggcuucuucauccggcgcagacuugacgaaacgcccgaugggcggaaagacguucuguauagagcgcuccugcauggacacauuguggagcugcuccgccaacagcaguuucuggaaaucuuccuugagggcacacggagcagauccgggaagaccagcugcgcccgcgcuggacugcucucuguggucguggauacacuguccaccaauguuauuccugacauccuuaucauucccgugggcaucagcuacgaucggauuaucgagggccacuacaacggggaacagcugggaaaaccgaagaaaaacgagucucucuggagcgucgccagaggcgugauucgcaugcugcggaagaauuauggguguguuagaguggacuuugcucaaccuuucucccugaaggaauaccucgagucucagagccagaaacccgucuccgcccugcuuagccuggaacaagcccuccugccugcuauccugcccucucgccccuccgaugcggccgacgagggacgggacaccagcaucaacgagucuagaaaugcuacagaugaaucccuucgccggagacucauugccaaccuggccgagcauauccuguuuacggcuagcaaguccugcgccauuaugucuacccacaucguggcgugucuccugcuuuaucggcaucgccagggcauugaccugagcacacucgucgaagauuucuuugugaugaaagaggaaguucuggcuagagacuucgaucugggguuuuccggaaauucugaggacguggucaugcacgccauccagcuucucggcaacugcgugaccauuacacauaccagccggaaugaugaguucuuuaucacgccuuccacaaccguuccgagcguguucgaacugaacuuuuacucuaauggcguccugcacguguucaucauggaggccauuaucgcuuguucccucuaugccgugcugaacaagagagggcuuggaggccccaccagcacaccucccaaucugauuucucaggaacaacucguucgcaaagcugccucccugugcuaccugcuuagcaacgaggggaccaucucucucccuugccagacauucuaucaggucugucacgagacggugggaaaguuuauucaguacggcauccugaccguggcggaacaugacgaucaagaggacaucagccccucccuggccgaacagcagugggauaagaaacucccggagccucugagcuggcggucugacgaagaggacgaggauuccgacuucggggaggaacagagagauugcuaccuuaaggucagccaauccaaagaacaccagcaguuuauuacauuccugcagcgccuccugggcccccugcuugaggcuuauucuagcgccgcuaucuuugugcauaauuucuccggaccuguucccgaaccugaguaccuccaaaagcugcacaaauaucugauuaccagaacagagcggaacguggccgucuacgcggaaucugccaccuauugucucgugaagaaugcuguuaagauguuuaaagacaucggcguguucaaggagacgaaacagaagcgcgucagcgugcuggaacuuuccucuaccuuucugccccagugcaacagacaaaaacuccuggaguacauucugagcuucguugugcuuuga

SEQ ID NO: 69889 - RNA, 1071 nt, Artificial Sequence
  derived and/or modified sequence opt5 from GPANK1__Homo_sapiens__NP_149417
augagcagaccccugcucaucaccuucacgccugccacagacccguccgaucuguggaaggacggccagcaacagccccagccugagaaacccgaaucuacccuugauggggcugccgcgcgggcuuuuuacgaggcccugauuggagacgaaagcuccgccccugauucucagcgcagccaaacagagcccgcuagagaacggaagcgcaaaaagagacggaucaugaaagccccugcugccgaggcgguggccgagggcgcuuccgggcgccacggacagggcagaucucucgaagccgaggacaagaugacccaccggauucugcgcgcugcccaggaaggggaucuuccggagcugagacggcuccuggagccccacgaagcgggaggcgccggcgggaacaucaaugcucgcgacgccuucugguggacaccucugaugugcgcugccagagccggacagggcgcugcggucagcuaucuccuggggcggggagccgcuuggguuggcgugugugagcuuuccgggcgcgaugccgcccaacuggcugaagaggccggauuucccgaaguggcgagaaugguccgggagagccauggcgagaccagaucuccugaaaaccgcucccccacaccgagccuccaguacugcgagaauugugacacccacuuccaggauucuaaccaucggacguccaccgcucaucugcuuagccugucucagggcccucaacccccuaaucucccccugggggugcccauuuccagcccuggauuuaagcugcuccugagaggcgggugggaaccgggaaugggccuugggccccgcggagagggccgggccaacccuauccccacaguucugaaaagagaccaggaaggccucggguaucgcuccgccccucagccccgggugacccacuucccggcuugggauacaagagccgucgcuggacgcgagcggccucccagaguggccacccugucuuggcgcgaggaacggagacgggaggaaaaggaccgcgcgugggagagagaccuucggacguacaugaaucuggaauuuuga

SEQ ID NO: 69890 - RNA, 2388 nt, Artificial Sequence
  derived and/or modified sequence opt5 from GPAT2__Homo_sapiens__NP_997211
auggccaccaugcuggagggcagaugccagacacaaccccggagcuccccuucugggcgcgaagcuagccucugguccucuggauucggcaugaagcuggaggccgugacgccguuucuugggaaauacagacccuucgucggacgguguugccagaccuguacaccuaagagcugggaaucccuguuucaccgcucuaucaccgaccucggcuucugcaacguuauucuggugaaagaggaaaauacaagauuucggggguggcuugugcgcagacuguguuauuuccucuggagccuggagcagcauauucccccuugccaggaugucccccaaaagaucauggaguccaccggagugcagaaccugcucagcggccggguuccuggcgggacaggagaaggccaggugccggaccuggucaaaaaggaggugcagcgcauccuugggcacauucaagcgcccccuagacccuuucugguuagacucuucucuugggcucugcuucgcuuucugaauugucucuuccugaacgugcagcugcauaagggacagaugaaaaugguccagaaggccgcccaagcuggccucccucuggugcuucuguccacccacaaaacgcuccuggaugggauccuucugcccuuuaugcuccugagccagggacugggcgugcucagagucgccugggacucucgggcuugcuccccggcccugcgcgcgcuucugagaaagcucggcgggcuguuccuuccucccgaagccagccugucucucgauuccagcgagggacugcuggcucgggccguugugcaggcugugaucgagcaacuccuggucuccggccagccucuucugauuuuucucgaggaaccucccggggcccugggacccagacugucugcgcuuggccaggccugggugggguucguugugcaggcuguccaagugggaaucguuccggacgcccuccuggugcccgucgcugugaccuacgaucuggucccugacgcccccugugauauugaccaugccagcgcuccucucggccuguggacaggcgcgcuugccgugcugcgcucccucuggagccggugggggugcucucacagaaucuguucccgcguucaccuggcucagcccuucagccugcaggaauauauugugucugcccggagcugcuggggaggcagacagacccuugagcaacuccugcagccgaucguccuggggcagugcacagccgugccugauaccgaaaaagagcaggaguggacgcccauuacaggaccucuccuggcucuuaaggaagaggaccaacugcucguucgccggcuguccugucaugugcugucugccagcgucggcuccagcgcggugaugucuaccgcuaucauggccacacuucuccuguuuaagcaccagaaacugcucggggaauuuuccuggcugaccgaggaaauccuucugagaggcuuugaugugggauucagcggccagcuccgcucucugcugcagcauucccuuagccuccugcgggcccacguugcucugcuccggauucgccaaggggaccugcuugucgugccccagccuggacccggccugacccaccucgcccagcuguccgcugagcugcuuccgguguuucugucugaggccgucggggcgugcgccgugcggggacuccuggcuggcagaguuccuccccaagggcccugggaacuccagggcauccugcuucugagccagaaugagcucuaccggcagauucugcugcuuaugcaucugcucccucaagaccugcuccugcuuaagccgugucaguccucuuauugcuacugucaggaagugcuggaucgccucauccagugcggacugcuggucgccgaggaaacacccggcagcagaccugcuugugacacggggcggcaaagacuuucccgcaaacugcucuggaagcccagcggagauuucaccgacucugauuccgacgauuuuggcgaggccgacgggcgguauuucagacugagccagcagucucacugcccugauuucuuccucuuucugugucgccuucugagcccccugcucaaagcguucgcccaggcugccgcuuuucugagacaaggacagcuuccugacacagagcugggcuacaccgaacaacucuuccaguuccugcaggccacagcccaggaggaagggauuuuugagugcgcugaucccaagcucgcgaucuccgccguguggaccuuccgggaccugggcguucuucagcaaacgccgucuccugcuggaccccgccugcaucugagcccuacauuugccucccucgacaaccaggagaaacuggaacaguucaucagacaguuuauuuguagcuga

SEQ ID NO: 69891 - RNA, 2796 nt, Artificial Sequence
  derived and/or modified sequence opt5 from GPATCH1__Homo_sapiens__NP_060495
auggccgcuagagacagcgauuccgaggaagaccuggugucuuacggcaccgggcucgagccccuggaagagggagaacggccuaagaaaccgaucccccuucaggaucaaacaguccgcgacgagaagggcagauauaaacgguuccacggggccuuuagcggaggcuucuccgcgggguacuuuaacacgguuggaucuaaggagggcuggaccccuagcacauucguguccucucgccagaauagagcugauaaaagcgugcugggccccgaagacuuuauggaugaggaagaccucuccgaguucgggauugccccuaaggccaucgucaccacagaugacuuugcuagcaagaccaaagaucggauucgcgagaaggccagacagcuggcugccgcgacagcccccaucccuggagcuacccuucuggacgaucucauuacgccggccaaacugucugugggcuucgaacugcuccggaagaugggguggaaagagggacagggcguugggccccgcgugaagagacggccucgcagacaaaagcccgacccuggagucaaaaucuauggcugcgcucugcccccgggcuccagcgaagggucugagggagaagacgaugacuaccuuccugauaacgugaccuuugcccccaaggacguuacaccuguggauuucacccccaaagacaauguccauggccuggcguauaaggggcucgauccccaccaggcccuguuuggaacauccggcgagcauuucaaccuuuuuagcgggggaucugagcgggcuggcgaccugggcgaaaucgggcucaauaaaggacgcaagcugggcauuuccgggcaggccuucggagugggcgcucuggaggaagaggaugacgauaucuacgccaccgaaacgcucagcaaauaugacacagugcugaaggacgaggagccuggggauggccuuuacggauggaccgccccgagacaguacaagaaccaaaaagaauccgagaaggaccugcgguaugucggcaaaauucucgauggguucucucuggcuagcaagccccuuuccagcaaaaagaucuacccucccccugaacugcccagagacuaucgcccgguucacuacuuucggccuaugguggcggccacaucugaaaauucccaucuccuccaggugcugagcgaaucugcuggaaaggccacccccgauccuggcacccacagcaaacaccagcugaacgccuccaagagagcugagcugcuuggggagacacccauucagggaucugccacgagcguccuggaguuccucucccaaaaagacaaggagcgcaucaaagaaaugaagcaggcgaccgaucugaaggcugcccagcuuaaagcccggagccuggcucaaaaugcccagucuuccagagcucagcucagcccugccgcggccgcuggccauuguucuuggaacauggcccucgggggcggaacagcuacccugaaggccuccaauuuuaaacccuucgcgaaggacccggagaaacagaagcgcuaugaugaguuucuggugcacaugaagcaaggccagaaagacgcccuggaacggugccuugauccuagcaugacagagugggaaagagggcgcgagcgggacgaguucgcuagagccgcucugcucuacgccuccucucauagcacccuguccucucgcuuuacgcacgccaaggaagaggaugacagcgaccagguugaagugccccgggaucaggagaacgacgucggagauaaacaauccgcugugaagaugaaaauguucggcaagcugacaagagacaccuuugaauggcaccccgauaaacuucucuguaagcgguucaauguuccugacccguaucccgauagcacccugguggggcugccucgcgucaagagagacaaauacucuguguuuaacuuccucacacugcccgagaccgcgucccuuccuacaacgcaggccagcucugaaaaggucucccagcaucggggacccgauaaaagcagaaagccuucucgcugggacaccagcaaacacgagaagaaggaggauuccauuagcgaauuucugucucucgcucgguccaaagccgagcccccgaagcagcaaagcuccccucuggugaauaaagaagaggaacaugcccccgagcugucugcuaaccagacaguuaacaaggacguggaugcccaggcggagggcgaagggagcagaccuuccauggaccuuuuccgcgcuaucuucgccucuagcuccgacgagaaaucuagcuccagcgaagaugagcagggcgacucugaggaugaccaagccggauccggcgaagcuaauuuucagagcucucaggauaccgaccucggggagacauccagcgucgcccacgcgcuggugcccgcuccgcaagaaccucccccuucuuuccccauccagaagaugcagauugaugagagagaagaguuuggaccccggcugccuccgguuuucugccccaacgcccgccagacccucgaggugccucaaaaggaaaaacauaagaaaaauaaggacaaacacaaggccaagaaagagcacagacggaagaaagaaaagaaaaagaaacaucgcaagcacaagcauaaaggcaagcagaaaaacaagaaacccgagaaguccagcuccagcgaaucuagcgauuccucugacagccaguccgaugaggagacggcugacgucucuccucaggaacugcuuagacggcucaagagccugccccugcgcagacaauga

SEQ ID NO: 69892 - RNA, 1131 nt, Artificial Sequence
  derived and/or modified sequence opt5 from GPATCH2__Homo_sapiens__NP_001284683
auguucggcgccgcugggagacagcccaucggagccccugcggcuggcaacagcuggcacuuuucccggaccauggaggaacuggugcaugaccucgucucugcccuggaggaaagcuccgagcaagcccgcgggggauucgcugaaacaggcgaucacucuagaagcauuuccugcccgcuuaagcggcaggcccgcaaaagacgggggcgcaagagacggucuuacaauguucaucaccccugggagacgggacauugucugagcgagggcuccgacagcucucucgaagaaccuuccaaagauuaucgcgaaaaccacaauaacaauaagaaagaccacagcgauucugacgaucagaugcugguggcuaagagacggcccuccagcaaccuuaauaacaaugugcgcggcaagagaccucuguggcaugagucugacuuugccgucgauaacguggggaaucggacccuccgcagacggagaaaaguuaagcgcauggcgguggaccugccccaggauaucuccaacaaacggacaaugacccaaccuccggagggaugcagagaccaggauauggacagcgaccgcgccuaccaguaucaggaguucacaaagaauaaagucaagaagcggaaacugaagauuaucagacaaggccccaaaauucaggaugagggggugguucucgaauccgaggaaaccaaccagacaaauaaggacaaaauggagugugaggaacagaaggugucugaugagcugaugagcgaauccgacagcagcucccuuagcucuaccgaugcuggacuguuuacgaacgacgagggccgccaaggggaugacgaacagagcgauugguucuacgagaaagaguccggaggcgccugcggcaucaccggggucgugccuuggugggaaaaggaggaccccacagaacucgauaagaacgugccugaccccgucuuugagucuauccugaccggaucuuucccgcuuaugucccacccuagccggagaggcuuucaggcucgccugucucggcuccaugggauguccagcaaaaauauuaagaaaucuggaggcacacccaccuccauggccacgaacuggacaagcgaaaucccucuguga

SEQ ID NO: 69893 - RNA, 1449 nt, Artificial Sequence
  derived and/or modified sequence opt5 from GPATCH2L__Homo_sapiens__NP_060396
auggacgagcuggugcacgaucucgccagcgcucuggaacagaccuccgagcaaaacaaacuuggcgaacugugggaggaaauggcccucucucccagacagcagcggcgccagcugagaaagcggcgcgggagaaagcggcgcagcgacuucacacaucuugcggagcacacgugcuguuacuccgaggcuucugaaagcucccuggaugaggccaccaaagacugcagagaagucgccccuguuacaaauuuuucugauagcgacgauaccaugguggcuaagcggcauccggcccucaacgcuaucgugaaauccaagcaacacagcuggcaugagucugacuccuucacagagaaugcccccugucgcccucugagacggcgcagaaaggucaaacgggugaccagcgaaguugcggccucucugcagcagaagcucaaaguguccgauuggagcuaugagcgcggaugcagauuuaagucugcuaaaaagcagcggcuguccagauggaaggaaaacacacccuggaccagcuccggccacgggcuuugugagucugccgaaaaucgcacguuccugagcaaaaccggacggaaggagagaauggagugcgaaacagacgagcaaaaacagggcuccgaugaaaacaugagcgagugugaaaccucuuccgucugcagcucuagcgacacagggcucuuuaccaaugaugagggacgccagggcgacgacgagcaguccgauugguucuacgaaggcgagugugugccuggguuuacgguucccaaccugcuuccuaagugggcuccggaccacugcucugaaguggagcggauggauagcggacuggacaaauucuccgauagcacauuucuccugcccucuagaccugcccaacgcggcuaucauacccggcugaauagacuccccggggcggccgcucgcugucugcggaagggaagacgccggcuugucggcaaagaaacauccauuaacacccuggggaccgagagaaucagccacauuaucucugacccucggcagaaggagaagaauaaagcccucgcuuccgauuucccccauauuagcgccugcgcccacgaauuuaacccgcuguccccucuuuacucucuggacgugcucgcugaugcgagccaccgcagaugcucccccgcccauuguucugcucggcaggccaaugugcacuggggaccucccugcagcagagacaucaagcgcaaacggaagcccgucgccacagcuucccugagcucuccuuccgccguucauauggaugcgguggagccgacgacccccgcuagccaagccccuaaaucucccuccagcgaauggcuggugagaacaucugccgcugagaaggccaccgacgcuacaaccgccacguucuuuaagaugccucaggagaaaagccccggcuauuccuga

SEQ ID NO: 69894 - RNA, 4509 nt, Artificial Sequence
  derived and/or modified sequence opt5 from GPATCH8__Homo_sapiens__NP_001002909
auggcugacagauucagccgguuuaacgaggaucgcgacuuccagggcaaucacuuugaucaauacgaagaggggcaucuggaaaucgagcaggcuucccucgacaagcccauugaaucugauaacaucggacacagacugcuucagaagcauggcuggaagcuggggcagggacucggcaaaagccugcaagggcggaccgacccuauuccgaucguggucaaguaugauguuaugggaaugggccgcauggagauggagcuugacuacgccgaagaugcgacagagagacggcgcgugcuggaaguggagaaagaggacacggaggaacucagacagaaguauaaggauuacgucgacaaagaaaaggcuauugccaaagcccuggaggaucugcgggcuaauuucuauugcgaacucugugacaagcaguaccagaaacaccaagaguuugacaaccauaucaauuccuaugaucacgcccacaagcagcgccugaaggaccuuaaacagagagaguucgcucggaacgugucuagccgcuccagaaaggaugaaaagaagcaggagaaagcccugcggcgccuccaugaacuggcggagcaaagaaagcaggccgaaugcgcucccggcucugggccuauguuuaaacccaccacaguugccguggacgaggagggaggcgaagaugacaaggaugagagcgcuaccaauuccgggacaggagccaccgcgagcuguggccuugggucugaguucuccacagacaagggaggcccuuuuaccgccguccagaucacgaacaccacaggccuggcucaagcccccgggcucgcuagccagggaauuucuuucggcaucaaaaauaaccuggggaccccucugcagaagcucggaguguccuuuagcuucgccaaaaaggccccgguuaaacuggaaucuauugcuuccguguuuaaggaucacgcggaagagggcacaagcgaggacgggaccaagcccgaugaaaaauccucugaccagggacuucaaaaggucggcgacagcgauggcuccagcaaucuggacgggaaaaaggaggaugaagacccucaggauggaggcucucucgccuccacgcugagcaaacuuaagcggaugaagagagaggagggggcuggagccacagaacccgaguacuaccauuauaucccucccgcccacugcaaagugaagccgaacuucccuuuccugcucuuuaugcgcgcuucugaacagauggacggcgauaauaccacacaccccaaaaacgccccugagagcaagaaaggguccucucccaagcccaagagcuguauuaaagcggcugccucccagggcgccgaaaagaccgugagcgaggucucugagcaaccuaaagaaaccuccaugacagagccgagcgaacccggaucuaaggcugaggccaaaaaggcucugggcggggacguuuccgaucagagccuggaaucccauucucagaaagugagcgagacgcagaugugcgaguccaauucuagcaaggaaaccucccucgccaccccugcgggaaaggagagccaagaaggccccaaacacccuacagggcccuucuuuccggugcugucuaaggacgaguccacagcccuucaguggccuagcgaacugcucaucuucaccaaagcugagcccucuauuuccuacagcuguaacccucuguauuuugauuucaaacuuucucggaacaaagacgccagaacgaagggaacagagaagcccaaagauaucggcagcuccagcaaggaccaucugcaggggcucgacccuggcgaacccaauaaaucuaaggaggucggaggcgaaaagaucgugcgcuccagcgggggacggauggaugcuccggccuccggcucugcgugcagcgggcugaacaagcaggagccuggaggcucccacgggucugagaccgaagacaccggcagaagccugcccuccaagaaagagcgcucuggaaagagccaucggcacaaaaagaaaaagaagcacaaaaaguccagcaaacauaagagaaaacacaaggccgauacagaagagaaaucuuccaaggcugaaagcggcgagaagucuaaaaagcgcaaaaagcggaaaagaaagaagaauaaauccagcgcccccgcugacucugagcgcgggccuaagccggaacccccuggauccggcagccccgccccuccccggagacggcgcagagcccaagaugacucccagcggagaagccucccugcugaggaagggucuagcggcaaaaaggaugagggcgggggcggauccucuagccaggaccauggcgggcgcaaacacaagggagaacugcccccguccucuugucaacggagagcgggcaccaagcgcagcuccagaucuagccaccggucccagccuagcucuggggaugaggacuccgaugacgccagcucucaucgccuucaccagaaaucccccagccaguacuccgaggaagaggaagaggaagauucuggaagcgagcauuccagaagccggucucgcuccggcagacggcacagcucucaucgcagcuccagacggucuuauagcuccucuagcgacgcuuccagcgaccaaucuugcuacucccgccagagaagcuauuccgaugacucuuacagcgauuacuccgaccggucuagacgccacagcaagcggucccacgauagcgacgauucugacuaugccuccagcaaacauagaucuaagcgccacaaauacuccagcucugaugacgauuauagccuguccuguucucagagccgguccagaagccgcucccauacacgggagagaucucgcagccggggcagaucccggucuagcuccugcucucgcagcagauccaagcggcgcagcagaucuacgaccgcccacuccuggcagcggagcagaucuuacucccgcgaccggagcagaucuacacgcuccccuagccaacgguccgggagcagaaagcgcucuuggggacaugaaagccccgaggaacggcacuccggcagacgcgacuuuauuagaucuaaaaucuaucggagccaguccccgcacuacuuccgcucugggagaggagagggcccugggaagaaagaugacggacggggcgaugacagcaaggcuaccggacccccuucccagaacucuaauauugggacaggacgcggcagcgagggggauugcucccccgaagacaaaaacagcguuaccgccaagcuccugcuggagaagauccagucuagaaaaguggaacggaagcccuccgucagcgaggaagugcaagcgacgccuaauaaagcuggaccgaaacuuaaagaucccccucagggcuauuuugggcccaagcucccucccucucugggaaacaaaccuguucugccgcucauuggcaagcugcccgccaccagaaagccuaauaaaaagugugaggaguccggccuugaacgcggggaggaacaggagcaaagcgaaacagaggagggacccccuggcuccucugacgcccuguucgggcaucaguuucccagcgaagagaccacaggaccgcuccuggauccuccucccgaagaguccaaaagcggcgaagcuaccgccgaccaccccguggcgccccuggggacgccugcucauucugauugcuacccgggagaccccacaaucucccacaacuaccuuccugaucccagcgacggcgacacccucgagucucuggauagcuccucucagccuggccccgucgagagcucccugcucccgaucgccccugaccuggaacacuuccccucuuaugccccucccagcggggauccuuccauugagagcacagacggagcugaagaugccucucuugcuccccuggagucccagccgaucaccuuuaccccugaggaaauggagaaguacagcaaacuccaacaggccgcgcagcagcauauucaacagcagcugcuggccaaacaggugaaggcuuuccccgccuccgcugcccuugcccccgcuacgccugcgcuccaaccgauccacauucagcagcccgccacagcuucugccaccagcaucacaaccguccagcaugccauccugcaacaccaugcugccgcggcugccgccgcuauuggcauccacccucacccccauccucagccccuggcccaggugcaccauauuccucaaccgcaccucacacccaucucccugucucaccuuacccauagcauuaucccugggcaccccgcgacguuccuggcuucccauccuauucacaucauccccgccagcgccauucauccgggaccuuuuacauuccaccccguuccccacgcugcccucuauccuacccugcuggcuccccggccugccgcggccgcugccaccgcccuucaucuccacccgcugcugcaucccaucuuuucuggccaggaccuccagcacccucccucccacgggacauga

SEQ ID NO: 69895 - RNA, 993 nt, Artificial Sequence
  derived and/or modified sequence opt5 from GPBAR1__Homo_sapiens__XP_011509046
augacccccaacagcacaggcgaggugccuuccccgauccccaagggggcccugggacucucucuggcucuugccagccugauuaucacggcgaaucuccugcuugcucugggcauugccugggacagacggcuccgcuccccucccgccgggugcuucuuucugucucugcuccuggcuggacuucugaccggccucgcccugccuacacuucccgggcuguggaaccagagcagacggggauacugguccugucuccuggucuaucuggcuccuaauuucucuuuucucagccugcuugccaaccugcuccugguucacggcgaacgcuacauggcggugcuuagaccgcugcaacccccuggcuccauccggcucgcccugcugcucaccugggcugggccccugcuuuucgccagccugccugcucucggauggaaucauuggacacccggcgccaacuguucuucccaggcgauuuuuccggccccuuaucuguaccuugagguguaugggcugcuccugcccgcugucggagccgcugccuuccugagcgugcgcguucucgccaccgcucacagacagcugcaggauaucugccggcuugaacgcgcggugugcagagacgagccuucugcccuggcucgggcccucacauggcgccaagccagagcucaggccggcgcgaugcugcuguuugggcuuuguuggggacccuacgucgcuacccuccugcuguccgugcucgccuaugaacagcggcccccucugggcccgggcacgcuucugagccuccugucucugggguccgccagcgcugccgcuguucccguggccaugggacuuggcgaucagcgcuacaccgcgccuuggagagccgcugcccaacggugccuccaggggcuguggggcagagcuucccgcgacucucccggaccuagcaucgccuaccaucccuccagccagucuuccgucgaucuggaccucaauuga

SEQ ID NO: 69896 - RNA, 1677 nt, Artificial Sequence
  derived and/or modified sequence opt5 from GPC1__Homo_sapiens__NP_002072
auggagcugagagcccggggcugguggcuccugugcgcugccgcggcucuuguggccugugcccgcggggaccccgcuagcaaguccagaucuugcggagaaguccggcagaucuacggcgccaaaggguucagccuguccgauguuccucaagcugagauuucuggagaacaccuccgcaucuguccgcagggcuauaccugcuguacaagcgagauggaagagaaccuggccaauagaucccaugcggagcuugaaacggcccugcgggacucuagccgcgugcuccaggcuaugcuggccacccagcugagauccuuugaugaccacuuccaacaucuccugaacgauagcgagcggacacuucaggcuaccuuucccggggccuucggagaacuguacacacagaaugcgcgcgccuuuagagaccucuauucugagcugcggcuuuacuaucgcggcgcuaaccugcaccucgaggaaacccuggccgaguucugggcuagacugcucgaacggcuguuuaagcagcuucauccucaacugcuccugcccgaugacuaccuugauugccugggcaaacaggccgaggcccuccgcccuuucggggaagcucccagagagcugcggcugagagcgacacgcgccuuuguggcugcccgguccuucguccagggacucggcguggccagcgacguugugagaaaggucgcucaggugccucuggggccggaguguucucgcgccguuaugaaacuuguguauugcgcgcacugucugggaguccccggcgcucggccuugccccgauuacuguagaaaugugcucaaggggugccuggccaaccaagccgaccuugaugcugaauggcgcaaucugcucgacuccauggugcugauuaccgacaaguuuuggggaacgagcggcgucgagucuguuaucggcuccgugcacaccuggcuggccgaagcuauuaacgcccuccaggauaaucgggacacacugaccgcgaaagugauccaggggugcggaaacccuaaggucaauccccaaggcccggggccugaggaaaaacggcgccggggaaagcuggcccccagagagcgcccucccagcggcacacuggagaaacucguguccgaagcuaaggcccagcugcgggauguucaggacuucuggaucucucugcccgggacccuuuguagcgagaagauggcucucuccacggccagcgaugacagaugcuggaacggaauggcgcggggccgcuaccugccugaagugaugggcgaugggcuggccaaucagauuaacaauccggaggucgaaguggacaucacaaaacccgauaugaccauuagacaacagaucaugcagcucaagauuaugacaaaccggcugagaucugcuuauaacggaaaugacguugauuuucaggacgccuccgacgauggcagcgggucuggaagcggcgacgggugucuugaugaccugugcucccgcaaagugucuagaaagagcuccagcucuagaaccccucucacccaugcucugcccggccuguccgagcaagagggacagaaaacaagcgccgccucuuguccucagcccccgacguuccuucucccucugcuucucuuccuggcucuuaccgucgcgcgccccagauggcgguga

SEQ ID NO: 69897 - RNA, 1740 nt, Artificial Sequence
  derived and/or modified sequence opt5 from GPC2__Homo_sapiens__NP_689955
augagcgcccugagaccccuccugcuucugcuccugccucuuugcccgggccccgggccuggacccggcuccgaggcuaaggugacccggucuugugccgaaacacgccagguccugggggcgagaggauacagccucaaccugaucccucccgcucugauuuccggcgagcaccuccggguuugcccucaagaauauacguguugcucuagcgagaccgaacagcgccugaucagagagacagaggccaccuuccgggggcuuguggaagacuccggaucuuuucuggugcauacacucgccgcucgccacagaaaauucgaugaguuuuuccuggaaaugcuuagcgucgcccagcauucccugacccagcucuuuagccacucuuacggccggcuguaugcucaacaugcccugauuuucaauggccucuuuucccgccugagagacuucuacggggagagcggagagggccuugaugacacacuggcggauuuuugggcccagcuccuggaacggguguucccgcuucugcacccccaguauucuuuuccucccgacuaccuccugugucugucccgccucgcuagcucuaccgaugggucccugcagccuuucggagacagccccagacggcuucgccugcaaaucacgagaacccucguugccgcucgggccuuugugcagggccuggagacagggagaaacgucguguccgaagcgcuuaagguuccggugucugagggaugcagccaggcccugaugcgccucauuggcuguccucugugccggggcguccccucccugaugccuugucagggguucugccucaauguggugagaggaugucugagcucucgcggccuugaacccgauugggggaacuaucuggacggacuccugauccuggcugauaaacuucaaggccccuucuccuuugagcucaccgccgagagcaucggggucaagauuucugaaggacugauguaccugcaggagaauagcgcuaaaguuuccgcccagguguuccaagaaugcggcccuccggaccccgugccugcccggaacagacgcgcucccccuccccgggaggaagcgggcagacucuggucuauggucacagaggaggaacgcccgaccacggccgcugggacaaaucugcaccggcuugugugggagcugagagaacgccucgcccggaugagaggauuuugggcccggcugagccugaccguuugcggcgauucccgcauggcugccgacgcgagccuugaggcugccccuuguuggacaggggccggaagaggccgguaccuucccccuguggucgggggcucucccgcugaacaggugaacaauccugagcugaagguugacgccuccggacccgaugugccgaccagacgccggagacugcagcuccgcgcugccaccgcgagaaugaagacagccgcucugggccaugaccuugaugggcaggacgccgaugaggacgcuagcggaucuggcgggggacaacaguaugccgaugacuggauggcgggcgccgucgcuccucccgcccggcccccucgcccgcccuacccucccagacgggauggguccggcggaaaaggcgggggaggcagcgcucgcuauaaccaggggagaucccggucuggaggcgccagcaucggguuccacacgcagaccauucugauccucucccugucugcccuggcucuccucggcccucgcuga

SEQ ID NO: 69898 - RNA, 1812 nt, Artificial Sequence
  derived and/or modified sequence opt5 from GPC3__Homo_sapiens__NP_001158089
auggccggcaccgugagaacagcuugucuggucguugccaugcuccugagccuugacuuccccgggcaggcgcaaccuccgcccccucccccugaugcuacgugucaccaggugcgguccuuuuuccagcgccugcagcccggacucaagugggugccugagaccccgguccccggcucugaccugcaagugugccuuccuaaagggcccacauguugcagcagaaagauggaagagaaauaccagcugaccgcccggcucaacauggaacagcugcugcaguccgccucuauggagcucaaguuucugaucauucaaaaugcugccguuuuccaggaggcuuuugaaaucgugguccgccaugccaaaaacuauacaaaugcgauguucaagaacaauuacccuagccuuacaccccaggccuuugaguucgugggagaauuuuucaccgauguuucccuguauauucucggcucugacaucaacguggaugacauggucaaugagcuguuugauagccuuuucccggugauuuacacccagcugaugaacccugggcuccccgacuccgcucuggauaucaaugaaugucugagaggagcccggcgcgaccucaagguguuuggcaacuucccuaaacugaucaugacgcaagucagcaagucucuucagguuaccagaauuuuccugcaggcucucaaucugggcaucgaggugauuaacacaaccgaucaccuuaaauuuuccaaggacugcgggcggaugcugacacgcaugugguauuguagcuacugccaaggacucaugauggugaaacccuguggcggguauugcaaugucgugaugcagggauguauggccggcguuguggagaucgauaaguacuggagagaauacauucugucucuggaggaacucgucaacgggauguaucggaucuacgacauggagaaugugcugcuuggacuguucuccaccauucaugacagcauccaguauguucagaagaacgcgggcaaacucacgacaaccgaaacagagaagaaaaucuggcacuuuaaguaccccauuuucuuucugugcaucggccuugaucugcaaauugggaaacucugcgcccauucucagcagcgccaguauagauccgcuuacuauccugaggaccuguucaucgauaagaaagugcugaaggucgcccacguggaacacgaggaaacccucagcucccggcgcagagagcugauucaaaaacuuaagucuuuuaucagcuucuacuccgcucugccgggauacaucuguagccauucucccgucgccgaaaacgacacccucugcuggaauggccaggagcugguggagcgguauucccagaaggccgcuagaaacgggaugaaaaaucaguuuaaccugcacgaacuuaagaugaaaggaccugagcccguugugagccaaauuaucgauaagcucaagcauauuaaucagcugcugcgcacaaugucuaugccuaaaggccggguccucgacaagaaccuggaugaagagggguucgaaagcggagacuguggcgaugacgaggaugagugcaucggcggguccggagacggcaugauuaaagugaagaaucagcuuagauuucuggcggaacucgccuacgaccuggauguugacgaugcucccgggaacucucagcaagccacgccgaaagacaaugagaucagcaccuuccacaaccugggaaaugugcacuccccucuuaagcuccugacaagcauggccaucucugucgugugcuuuuucuuccuggugcauuga

SEQ ID NO: 69899 - RNA, 1671 nt, Artificial Sequence
  derived and/or modified sequence opt5 from GPC4__Homo_sapiens__NP_001439
auggccagauucggccugcccgcucuccugugcacccuugccgugcugagcgcggcucuccuggccgccgagcuuaaguccaaaucuuguagcgaaguccggcgccuguacguuuccaagggguuuaacaaaaaugacgcuccucuccacgagaucaacggagaucaucugaagauuugcccgcagggcucuacauguugcagccaagaaauggaggaaaaauauucccugcagucuaaggacgauuucaagagcgugguguccgagcaguguaaucaccuccaggccgucuuugcuagcagauacaaaaaguucgacgaguuuuucaaagaacugcuugagaacgccgaaaagucucugaaugauauguuugugaaaacguaugggcaucucuacaugcaaaacuccgagcuguucaaggaccuuuuuguugagcugaagcgguauuacguggucggaaaugugaaccucgaagagaugcugaaugauuucugggcgcgccugcucgaaagaauguuucggcugguuaacagccaguaucacuucaccgacgaguaccuugaaugcgugucuaaauacacagagcagcugaagcccuuuggcgaugucccucgcaaacucaagcugcaagugaccagagccuucguggcugcccggacauucgcucaggggcuugccgucgcgggagacguuguguccaaagugagcgucgugaaucccaccgcccaguguacacaugcucugcucaagaugaucuauugcucucacugucgcggccugguuaccgugaaaccuugcuacaacuauuguuccaauauuaugagaggcugccuggccaaccagggggaucucgacuuugaguggaauaacuucaucgaugcuaugcugauggucgccgaacggcuugagggacccuuuaacauugaaagcgugauggacccuaucgacguuaagaucuccgaugccauuaugaauaugcaggacaacucugugcaagucagccagaagguguuccagggcugcgggccgcccaaaccucugcccgcuggacgcaucuccagaagcauuucugaguccgcguuuagcgcccgguuccgcccucaccaucccgaagagagaccgacgaccgcugccggcacaucucucgaucggcuggucaccgacgugaaggagaaacuuaagcaagccaaaaaguuuuggagcucccugccuucuaauguuuguaacgaugaaagaauggcugccgggaauggaaacgaggacgauugcuggaauggcaagggcaaaagccgcuaccucuucgcggugacagggaacggacuggcuaaucagggcaacaaucccgaaguccagguggacaccuccaagccugauauccugauucuccggcagaucauggcccugagaguuaugacgagcaaaaugaagaacgccuauaaugggaacgacguggacuuuuucgauauuucugacgaguccagcggagaaggcucuggguccggaugugaguaccaacagugccccagcgaguuugauuauaaugcuacagaccacgccggcaaauccgcuaacgaaaaggccgauucugcgggcguccgccccggggcccaggcuuaccuucugaccguguucuguauccucuuucuggugaugcagcgggaguggagauga

SEQ ID NO: 69900 - RNA, 1719 nt, Artificial Sequence
  derived and/or modified sequence opt5 from GPC5__Homo_sapiens__NP_004457
auggacgcccagaccuggcccgugggcuucagaugccugcuccugcuugcucuggucgggagcgcccgguccgagggaguucaaacaugugaagaggugcgcaagcucuuucaguggagacugcuuggcgcggugcgggggcugccugauucuccgcgcgcuggacccgaccuccaggucugcaucagcaaaaagccuacguguugcaccagaaaaauggaggagcgguaccagauugccgcccgccaagauaugcagcaguuccugcagacauccucuagcacccugaaguuucucaucuccagaaacgcugccgcuuuccaagaaacacuggagacccuuauuaaacaggccgagaauuauacaucuauccuguuuuguagcaccuaccggaacauggcgcucgaagccgcugccuccgugcaggaguucuuuacggacguuggccuguaucuuuucggggcugaugugaaucccgaagaguuugucaaccgcuucuuugacagccuguucccucucguguacaaucaccugauuaaccccggaguuaccgauucuucccuggaguauagcgaaugcaucagaauggcccggcgcgacgugucuccuuuuggcaauaucccgcagagagucaugggccaaauggggcggucccuccugcccagccgcacauuccuucaggcgcugaaccucggaauugaggugaucaauaccacagauuaccugcauuucucuaaggaauguuccagagcccuucugaagaugcaguauugcccucacugucaaggccucgcucugaccaaacccugcaugggguacugucugaacgugaugcggggaugccucgcccauauggcugagcugaauccucacuggcaugccuacauuagaagccuugaggaacuguccgacgccaugcacggcacguaugauaucgggcacguccuccugaacuuucaucuucugguuaaugacgcugugcuccaggcgcaccugaacggacagaagcugcucgaacaggugaaucgcauuugcggccggcccgucagaacaccgacccaaucuccucgcuguagcuucgaucaguccaaagaaaagcauggcaugaaaacaaccacccggaacagcgaggaaacacuggccaacagacgcaaggaguuuaucaauucucuucggcuguacagauccuucuaugggggacucgcugaccagcugugcgccaacgaacuggccgcugccgacggccuucccuguuggaauggggaggauauuguuaagagcuacacgcagcgcguggugggaaacggcaucaaagcgcaaucugggaauccugaggucaaggugaaaggaaucgaccccguuauuaaccagaucauugauaagcucaaacacgugguccagcugcugcagggccggagccccaagccugacaaaugggaacuccugcaacuuggcuccgggggaggcaugguggagcaggucucuggggauugcgacgaugaagacggauguggcgggagcggcuccggagaggugaagagaacccugaagaucacagauuggaugccggacgauaugaauuuuagcgacguuaaacagauucaccagaccgacacaggcucuacccucgauacgacaggggcuggaugcgccguggccaccgaauccaugaccuucacacugaucagcgucgugaugcugcuucccggcaucugguga

SEQ ID NO: 69901 - RNA, 1668 nt, Artificial Sequence
  derived and/or modified sequence opt5 from GPC6__Homo_sapiens__NP_005699
augcccagcuggaucggcgccgugauucugccucuccuggggcuucugcucucccugccggcuggagccgacgucaaggcgagaucuugcggcgagguucggcaggcuuacggggccaaaggauucagccuugccgauauccccuaucaagaaauugcuggcgagcaucugcgcaucuguccucaggaauauaccugcuguacaacggagauggaagacaagcucucccagcagucuaaacuggaguuugagaaccugguggaagagaccagccacuucgugagaacaaccuuugucucccggcacaagaaauucgaugaauuuuuccgcgagcuccuggagaaugccgaaaagucucuuaacgacauguuugugagaacauacgggaugcuguacaugcaaaauagcgagguuuuccaggaucucuuuaccgaacugaagcgguauuacacaggaggcaacgugaaucuugaggaaaugcugaacgacuucugggcucgccuccuggagagaauguuucagcugauuaauccccaguaucauuucuccgaggauuaccucgaaugcgucagcaaauacaccgaccaacugaagccuuuuggcgaugugccccggaaacuuaagauccagguuacgcgcgccuucaucgcggccagaaccuucgugcaggggcugacagucggacgggagguggcuaaccgcgugucuaaagucuccccuaccccgggcuguauuagagcccucaugaagaugcuguauugccccuacugucgggggcuuccuacaguucgccccugcaauaacuauugucugaaugugaugaagggaugccucgcuaaccaggccgaccuggauaccgaauggaaucuguuuaucgacgcgaugcuccugguggccgagagacuugaaggcccuuucaacauugagagcgucauggaucccaucgacgugaaaauuucugaggcuaucaugaauaugcaagaaaacuccaugcagguuagcgccaagguguuucagggguguggacaaccgaaaccugcucccgcccugcggucugccagauccgcuccugagaacuucaauacgcgcuuucggcccuacaaccccgaagagagaccuacaaccgcggccggcacaagccucgaccgccuggucaccgauauuaaggaaaaacuuaagcuguccaaaaagguguggucugcucucccguauaccaucugcaaggacgagagcguuacagccggcacguccaaugaggaagagugcuggaacgggcacagcaaagcccgguaccugcccgaaaucaugaaugauggacugaccaaccagauuaauaacccugagguggacgucgauaucacaagacccgacaccuucauucgccagcagaucauggcucuccgggugaugacaaauaagcugaaaaacgccuauaauggcaacgaugucaauuuucaagacaccucugaugaguccagcgggucuggaagcggcuccggguguauggacgaugugugcccuacggaguucgaauuuguuacaaccgaagcgcccgcuguggacccggacagacgcgaggucgauucuagcgccgcccagcggggacauucccuucugagcuggucucucaccuguauugugcuggcucugcagagacuuugccgcuga

SEQ ID NO: 69902 - RNA, 2019 nt, Artificial Sequence
  derived and/or modified sequence opt5 from GPCPD1__Homo_sapiens__NP_062539
augacccccagccagguggccuucgagaucagaggcacacugcucccuggggaagucuuugcuauuugcggauccugugacgcccugggcaacuggaauccgcaaaacgcgguugcccuucugcccgagaaugauacgggggaaucuaugcucuggaaggcuaccaucgugcugagccggggaguguccguccaguaccgcuauuucaaaggcuacuuucuugagccuaagacaauugggggacccugccaggugaucguucacaaaugggaaacccaucugcagccuagaucuauuacaccccucgagagcgagaucaucauugacgauggccaauucggcauccacaacgggguggaaacccuggacuccggauggcugacaugucagaccgagauucggcuccgccugcauuauucugaaaagccuccggucagcaucacgaaaaagaagcugaaaaaguccagauuucgggugaaacugacccucgagggccuggaggaagaugacgaugaccgcguuagccccacagugcuucacaagaugucuaauucccuggagauuagccucaucucugauaacgaguucaaaugcagacauucccagccugaauguggguacggacugcagcccgaccgguggaccgaauauagcauucaaacaauggagccugauaaucuggagcucaucuuugacuucuuugaagaggaucugucugaacacgucgugcagggcgacgcccuucccgggcacgugggaaccgcuugccugcucuccagcacgaucgccgaguccggcaagucugcuggcauucugacacuuccgaucaugagccgcaacuccagaaagaccauugggaaaguccggguugacuacaucauuaucaagccucugcccggauauagcugugauaugaaaucuuccuucagcaaguacuggaaaccucgcaucccccucgacgugggccauagaggggccggaaauucuacaaccaccgcgcagcuggccaaggugcaggaaaacacaauugcuagccugcggaaugccgcuucccacggcgccgcguuugucgaguucgaugugcaucucucuaaagacuuuguucccguggucuaccacgaucugacgugcugucuuaccaugaagaagaaauucgacgccgauccuguggagcuguucgaaaucccgguuaaggagcucacauuugaccaacugcagcuucugaaacucacccacgugacagcucuuaagagcaaagaucgcaaggaauccgucgugcaggaggaaaacagcuucucugagaaucaacccuuuccuucccugaagaugguccucgagagccugcccgaagacgugggguucaacauugagaucaaauggauuugccagcagagagauggaaugugggacggcaaucuuucuaccuauuuugacaugaaccuguuccucgauaucauccugaagacgguucuggaaaacuccggcaaacggagaauuguguuuagcuccuucgacgccgauaucuguacaaugguccgccagaagcaaaauaaauacccuauucuuuuucucacccaggggaagucugagaucuaucccgagcugauggaccugcggagcagaaccacaccgauugcuauguccuucgcccaguuugaaaaccuccugggaaucaaugugcauaccgaggaucuucugcgcaacccuucuuacauucaggaagccaaggcuaaaggccucguuaucuucugcuggggagacgauacaaaugaccccgagaaccggagaaagcugaaagaacugggggugaauggccuuaucuaugaucgcauuuacgacuggaugccugagcaacccaacaucuuucaggucgagcagcucgaacggcugaagcaggagcugccugaacucaaaagcugccugugucccacgguguccagauucgugccgagcucucuuugcggggaguccgauauucacguugacgcgaauggcaucgauaacgucgaaaaugccuga

SEQ ID NO: 69903 - RNA, 981 nt, Artificial Sequence
  derived and/or modified sequence opt5 from GPD1__Homo_sapiens__NP_001244128
auggccagcaagaaagugugcaucgucggcuccgggaacuggggaucugcuauugccaagaucguuggcgggaaugcggcucagcuggcccaauucgaccccagagugaccauguggguguuugaggaagauauuggaggcaaaaagcucacagagaucauuaacacgcagcacgaaaaugucaaauaccugccugggcauaaacuuccgcccaacguguucaucggaaagaucugugaccagcugaagggccaccucaaggccaaugcuaccggcauuagccugaucaaagggguugaugagggaccuaacggccuuaagcugauuuccgaagugaucggggagcggcucggcauucccaugucuguccugaugggagccaauaucgcuagcgagguggccgacgaaaaauuuugcgagacaaccauuggguguaaggauccugcgcagggacaacugcucaaggaacugaugcagacacccaacuuccgcaucaccguugugcaggaggucgacacaguggagaucugcggcgcccuuaaaaauguggucgcuguuggcgccggguuuugugauggacugggcuucggggacaacaccaaggcugccgugauuagacucggacugauggaaaugaucgcguuugccaaacuuuucugcuccggcccugugucuagcgcuacguuucuggaguccuguggggucgccgaucucauuaccacaugcuauggaggccggaaucgcaagguggcugaagccuucgccagaaccggcaaaagcaucgagcagcuggaaaaggagcugcucaacgggcaaaaacugcagggaccggagacagcucgggaacuuuacucuauucugcagcauaagggccucguugacaaguuuccccuguucauggcgguguauaaagucuguuacgaggggcagccugugggagaauuuauccacugccuucaaaaucaucccgagcacauguga

SEQ ID NO: 69904 - RNA, 1056 nt, Artificial Sequence
  derived and/or modified sequence opt5 from GPD1L__Homo_sapiens__NP_055956
auggccgcugcgccccugaaggugugcaucgucggcagcgggaacuggggauccgccguugcuaaaauuaucggcaauaacgugaagaaacuccagaaguucgccucuaccgugaaaaugugggucuuugaggaaacagugaaugggagaaagcugacggacauuaucaacaaugaucacgagaacguuaaguaccuuccuggacauaaacugccggaaaauguggucgccaugagcaaccucuccgaggcugugcaagacgccgaucugcuuguuuucgugauuccccaccaguuuauccaucggaucugugacgaaauuaccggccgcgucccuaagaaagcucuggggaucacacucauuaagggaaucgaugagggccccgagggccugaaacugauuucugacaucauuagagaaaagauggggaucgauaucagcgugcucaugggagccaauauugcgaacgagguggccgcugaaaaguucugcgagaccacaaucggcuccaaagucauggagaaugggcugcuuuuuaaggaacugcuccagaccccuaacuuccggauuacaguuguggacgaugccgacaccguggagcuguguggagcucuuaaaaauaucgucgccgugggcgcgggguuuugcgauggacugcgcuguggcgacaacacgaaggccgcuguuauuagacucggccugauggaaaugaucgccuucgcucggaucuuuugcaaaggacaggugucuaccgccacauuccuggagagcuguggggucgccgaucucauuaccacaugcuauggcgggcgcaauagacggguggcugaagcguuugcccgcaccggaaagacgaucgaggagcuggaaaaagagaugcuuaacggccaaaagcugcaggggccccagacauccgcugaaguuuaccggauucucaagcagaaaggacugcuugacaaguucccucuguuuaccgccguguaucaaaucuguuacgagagcagaccgguccaggaaaugcucucuugccugcagucccaccccgagcauacauga

SEQ ID NO: 69905 - RNA, 2184 nt, Artificial Sequence
  derived and/or modified sequence opt5 from GPD2__Homo_sapiens__NP_001076581
auggccuuccagaaggcugugaaaggcaccauccuggucgggggaggcgcccucgcgacaguucuggggcuuagccaauuugcucacuacagacggaagcagaugaaccuggccuaugugaaagccgcugacugcauuuccgagcccgugaaucgcgaaccuccgucuagagaggcccagcuccugacgcuucagaacaccagcgaguucgauauccuggucauuggaggcggggcuacaggauccggcugugcccucgacgcggugacccggggccugaagacagcccugguugaacgcgaugacuuuucuagcgggaccuccucuagaagcacaaaacucauccauggaggcgugcgguaccugcaaaaggcuauuaugaaacuugauaucgaacaguaucgcauggucaaggaggcccugcacgagagagcuaaucuccuggaaaucgcgccccaucuuuccgccccucugcccauuaugcucccuguguacaagugguggcagcugcccuauuacuggguugggaucaaacuguaugaccucguggccggaagcaacugccugaagucuuccuacguccuuagcaaaucucgggcucuggagcacuucccuaugcuccagaaggauaagcuggugggcgccauuguguacuaugacgggcaacauaaugaugcucgcaugaaccuugccaucgcccugaccgcugcgagauacggagccgcuacggccaauuauauggaagucguuucccuccugaaaaagaccgacccgcagacaggcaaagugcgggugagcggcgcccgcuguaaggauguccugaccgggcaggaguuugacgugagagcuaaaugcguuauuaacgccacaggacccuucaccgauucugugcggaagauggacgacaaagaugcggcugccaucugucagccuuccgccggcguccacauugugaugcccggguacuauagcccugaguccaugggacuccuggaccccgcuacgucugauggccgcguuaucuuuuuccuuccguggcaaaagaugacaaucgccgggaccacagacaccccuaccgaugugacacaccaucccauuccuagcgaagaggacaucaauuuuauucugaacgaagucagaaauuaccucuccugcgauguggagguccggagaggagacgugcuggcugccuggagcggcauccgcccccuuguuacggaucccaagucugcggacacccaguccauuagccggaaccacguggucgauaucucugaaagcggccugaucacaauugccgggggaaaauggaccacauauagauccauggcugaggacaccaucaaugccgcugugaagacgcauaaccucaaagccggcccuucucgcacaguugggcuguuccugcagggaggcaaggacuggagcccgacccucuacauucggcuggugcaagauuacgggcuugaguccgaagucgcgcagcaccuggccgcuaccuauggcgacaaagccuuugagguggcuaagauggccagcgugacaggaaagagauggcccaucguuggcguccgccucgugucugaguucccuuacauugaagccgaagugaaauaugggaucaaggaguacgcuuguaccgcggucgauaugaucucccggagaacacgccuggccuuucugaaugugcaggcugccgaggaagcccuuccccggauuguugagcucaugggaagagaacugaacugggacgauuauaaaaagcaggagcaacuggaaacggcucgcaaauuccucuacuaugagaugggcuacaagagccggucugagcagcugaccgacagauccgaaaucagccuucugccuuccgauauugaccgguacaagaaacgcuuccacaaguuugaugccgaccagaaaggguucaucacaauuguggauguccagagagugcucgagucuaucaacguucaaauggacgaaaauacccugcaugagauucugaacgagguggaucuuaauaagaacggacaggucgaacucaaugaguuucugcagcugaugagcgcgauccagaaaggccggguguccgggucuagacucgcuauccugaugaagacagccgaagagaaccuugaccgccggguucccauuccgguggacagaagcugcggcggacuguga

SEQ ID NO: 69906 - RNA, 1128 nt, Artificial Sequence
  derived and/or modified sequence opt5 from GPER1__Homo_sapiens__NP_001091671
auggacgugaccagccaggccagaggcgucgggcuggagauguaccccggaacagcucaaccugccgcgccgaacacgaccucccccgaacucaaucugucucacccucuucugggcacagcucucgccaacgggaccggagagcugagcgaacaucagcaguauguuaucggccuuuuccuguccugccucuacacaauuuuucuguuccccaucggguuugugggaaauauucugauccucguggucaacauuucuuuccgggagaagaugaccaucccugaucuguauuuuaucaaucuugccguggcugaccugauucucguugccgauagccugaucgaaguguucaaccuucacgagcgcuacuaugacauugcuguccuguguacauuuaugucccucuuccugcagguuaauauguacucuagcguguuuuuccugaccuggauguccuuugauagauauaucgcccucgcgcgggccaugcgcugcagccuguucagaacgaaacaucacgcucggcuuucuuguggccugauuuggauggccuccgugagcgcuacccucguccccuuuacagccgugcaucugcaacacaccgacgaggcgugcuucuguuucgccgaugugcgcgaaguccaguggcuugagguuacacugggcuuuaucgugccuuucgcuauuaucgggcucugcuacucucugaucgugagaguccuggugcgggcccaccgccauagaggacuccggccgcgcagacagaaggcucugcggaugauucuugccguugugcuggucuuuuucguguguuggcuccccgaaaacguuuuuaucuccgugcaucugcuucagcgcacccaaccuggcgccgcucccugcaaacagagcuucagacacgcgcacccucugacggggcacauugucaaucucgccgcuuuuucuaacuccugucugaauccccugaucuacagcuuccucggagagacauuucgggacaagcugagacuuuauauugagcagaaaaccaaccugccggcccucaaucgcuucugccaugccgcucugaaggccgugaucccugauuccacagaacagucugacguccgguuuagcuccgcgguguga

SEQ ID NO: 69907 - RNA, 390 nt, Artificial Sequence
  derived and/or modified sequence opt5 from GPHA2__Homo_sapiens__NP_570125
augcccauggccagcccucagacccuggugcucuaccugcuuguccuggcuguuacagaggccuggggccaagaagcggugaucccggggugccaccuccaucccuucaacgugacggucagauccgaccggcagggaaccugucagggcucucacguggcucaggccugcguugggcauugugagagcuccgccuuuccuucucgcuauagcgugcuggucgcuuccggauacagacacaauauuacaucugugagccaaugcuguaccaucuccggccuuaagaaaguuaaggugcagcugcagugcgucgggagccggcgcgaggaacucgaaauuuucacagccagagcuugucagugcgauaugugucggcugucucgcuauuga

SEQ ID NO: 69908 - RNA, 2211 nt, Artificial Sequence
  derived and/or modified sequence opt5 from GPHN__Homo_sapiens__NP_001019389
auggccaccgagggcaugauccugacaaaccacgaccaucagauuagaguggggguccucacgguuagcgauuccugcuuccggaaucuggcugaagaccgcucuggaaucaaccuuaaggaucuggugcaagaccccagccuccugggcgggaccauuuccgccuacaaaaucgugccugaugagauugaagagaucaaggaaacacuuaucgacuggugugaugagaaagagcugaaucucauucugaccacaggaggcaccggguuugcgccgagagacgucacacccgaagcuaccaaggaggugaucgaacgggaggccccuggaauggcccuggcuaugcucaugggcucucugaacguuacgccccuuggcaugcugagccgcccugugugcgggauuagaggaaaaacccucaucauuaaucugcccggcuccaagaaggggucucaggaguguuuccaguuuauccuuccugcccugccgcacgcuauugaucuccugcgggacgccaucgucaaagugaaggaaguucaugaugagcuggaagaccuccccagcccucccccuccccuguccccgccucccacaaccagcccucacaaacagacagaggauaagggagugcaaugcgaagaggaggaagaggagaaaaaggacucuggcgucgcguccaccgaagacucuagcuccagccauaucacggccgcugccauugcugccaagauccccgauucuauuaucucccgcgggguccaggugcuucccagagacacagcgagccuguccaccacaccuucugaaagcccgcgggcccaggcuaccucccgccucagcaccgccucuugucccacaccuaaagugcaguccagaugcagcucuaaggagaacauucugcgggcuagccacuccgccguugauaucacgaaaguggcccgcagacaccggaugucucccuucccucuuaccagcauggacaaggcuuuuaucacagugcuggagaugacccccguccucggaacagaaauuaucaauuaucgcgauggcaugggcagagugcuggcgcaagacguuuacgccaaagauaaccugccgccuuuccccgcuuccgugaaggacggguaugccguccgggccgcugauggaccuggcgacagauuuauuaucggggagagccaggccggagaacagcccacccagacggugaugccuggccaaguuaugcgcgugacaaccggggcgcccauuccguguggagcugaugccgucgugcaggucgaggacaccgaacucauccgggagucugacgauggcacagaggaacuggaggugagaauccuuguucaggcccgcccuggccaagacauucggcccaucgggcaugauauuaaaagaggagaaugcgugcuggcuaagggcacccacauggggcccuccgagaucggacuccuggccacagucggcgugacggagguugaagugaauaaguucccugucguggcugugaugagcaccgggaacgagcuucugaauccggaagacgaucuccugcccggcaaaauucgcgacucuaaccgguccacacugcucgccaccauccaggagcauggauacccuacaauuaaucugggcaucguuggggauaaccccgacgaucuucugaaugcgcucaacgaaggaaucagcagagccgacgucauuaucaccuccggcggggugucuaugggagagaaggauuaucugaaacaggugcuggacauugaucuucacgcucagauccacuuuggccgcgucuucaugaagccugggcuccccacgaccuuugccacacuggacauugacggcgugcggaaaaucaucuucgcucugccuggaaaccccguuagcgccguggucaccuguaaucucuuugugguuccggcgcugagaaagaugcaaggcauucuugauccucgccccacaaucauuaaggcccggcuguccugcgacgugaaacucgauccuagacccgaguaccaucgguguauccugaccuggcaccaucaggaaccgcugccuugggcucagucuacggggaaccagaugagcucccgccuuaugagcaugagaucugccaauggacuccugaugcugcccccuaagacagagcaauaugucgaacuccacaaaggcgaggugguugacgugauggucauugggcggcuguga

SEQ ID NO: 69909 - RNA, 555 nt, Artificial Sequence
  derived and/or modified sequence opt5 from GPIHBP1__Homo_sapiens__NP_835466
augaaggcccugggcgcugugcuccuggcccuucuccuguucgggagacccggacggggccagacccaacaggaggaagaggaagaggacgaagaucacgggccugacgauuacgacgaggaggaugaagacgaggucgaagaggaggaaacaaaccgccugccgggaggcagaagccggguucuucugcgcugcuauacguguaaaucccuccccagagaugagcggugcaaucugacccagaacuguucucaugggcagacaugcaccacacugaucgcgcacggaaauaccgaaagcggccuccugacaacccauuccacgugguguaccgacucuugccaaccuauuacaaagaccguggagggcacacaggugaccaugacguguugccagagcucccuuuguaacgugcccccuuggcagucuagccgcguccaagaucccacagggaaaggagcuggcgggccuagaggauccagcgaaaccguuggcgccgcccugcuccugaaucuucuggcugggcucggagccaugggcgcucggcgcccguga

SEQ ID NO: 69910 - RNA, 1710 nt, Artificial Sequence
  derived and/or modified sequence opt5 from GPI__Homo_sapiens__NP_001171651
augguggcccugugcagccuccagcaccugggcuccucugaccccagagcccuuccuacccugccgacagcuacgagcgggcaacggcccgcgaagcgcagacggaaauccccugcuauggccgcccucacccgcgauccccaguuccagaagcugcagcaaugguacagagagcaucggucugaacuuaaccugcgcagacucuuugacgcuaauaaagaucgguucaaccacuuuagccugacacugaauaccaaccauggacacauccucgucgacuauuccaagaaucugguuacagaggaugugaugcgcaugcuuguggaccuggccaaaucuagaggcgucgaagcugcccgggagcgcauguucaacggggaaaagauuaauuacaccgagggcagagcggugcuccauguugcccugcggaaccgcagcaauacaccuauccuuguggauggaaaggacgucaugcccgaggugaacaaaguucuggauaagaugaaauccuuuugucaggggccucucauggugaccgaagcucugaagccguauagcucuggaggccccagagucugguacguguccaauauugacggcacgcacaucgccaaaacccuggcucagcucaacccugagagcucucuguucauuaucgccuccaagacauuuaccacacaggaaaccaucacgaaugcggagacagccaaggagugguuccuucaagcugccaaagaucccagcgcuguggccaagcacuuugucgcccugucuaccaacacaaccaaaguuaaggaauuugggauugacccucagaauauguucgaguucugggauugggugggaggccgguauucccucuggagcgcuaucgggcuguccauugcgcuucaugugggauuugacaacuucgaacagcugcucucuggcgcccacuggauggaccagcauuucagaaccacaccccuggagaaaaacgcuccgguccugcucgcccugcuugggaucugguacauuaauugcuuuggaugugaaacgcacgccaugcugccuuaugaucaauaccuccaccgcuucgcugccuacuuucagcagggcgacauggagagcaacggcaaguauaucaccaaauccgggacacggguggaucaucaaaccggacccauuguuuggggcgagccugggacaaauggacagcacgcguucuaccagcugauccaucagggcaccaagaugauccccugcgacuuucuuauucccgugcaaacgcagcacccuaucagaaaggggcugcaucacaaaauucuccuggcuaacuuccuggcccagacagaagcccucaugcgcggaaagagcaccgaggaagcucggaaagagcugcaggccgcuggcaagucuccggaagaucuugagagacugcucccccacaaagucuuugagggcaaucgcccuaccaacuccaucguguucacaaagcugacccccuuuaugcugggggcccuuguugcgauguaugaacauaagauuuucgugcaaggaaucaucugggacauuaauagcuuugaucaguggggcgucgagcucgggaaacagcuggccaagaaaaucgaaccugagcuggacggaucugcucaggugacaagccacgaugccuccacgaacggccucauuaauuucaucaagcaacagcgggaagcuagaguccaguga

SEQ ID NO: 69911 - RNA, 1431 nt, Artificial Sequence
  derived and/or modified sequence opt5 from GPKOW__Homo_sapiens__NP_056513
auggccgacagcaaggagggcgugcugccccucaccgcugccuccacagcgccuaucucuuucggguuuacgagaaccagcgcucggcgcagacuggccgauuccggagacggcgccgggccgucucccgaagagaaagauuuccuuaagacagucgaaggacgggagcugcagagcguuaaaccucaagaagcucccaaggagcucgugauuccucugauccagaacggccaccgcagacagcccccugcccggccgcccgggccuuccaccgacacaggagcucuugccgauggcguggucucucaggcggugaaagagcugauugccgaaagcaagaagucccucgaggaacgcgagaaugcuggcguugaccccacccuggccaucccuaugauucaaaaagggugcacacccagcggagagggcgcugauucugaaccgagagccgagaccgugccugaagaggcgaacuacgaagccguccccguggaggcuuaugggcuggccaugcuccggggaaugggcuggaagccuggggagggaaucggccgcacguuuaaucagguugugaaacccagagucaacucccugcggcccaagggccuugggcugggagcuaaucucaccgaagcccaggcccugacaccuaccggcccgagccgcaugcccagaccugacgaggaacaggagaaagauaaggaagaccaaccccaggggcuugugccuggaggcgcuguggucguucugucugggccccaucggggacucuacggcaagguggagggccuggauccggacaacgugcgcgcgauggucagacuggccguggggucccggguugugacagucagcgaguauuaccucagaccugugucucagcaggaguucgauaaaaauacccuggaccuucgccaacagaacggaacggcuuccagccggaagacacuguggaaucaggaacucuauauccaacaggacaacuccgaaagaaaacgcaagcaucugcccgaucggcaggacggcccugccgccaaaucugagaaggcugcccccagaagccagcacuggcuucaccgcgaucugcggguuagauuuguggacaauauguacaaagggggacaauauuacaacaccaagaugauuaucgaagauguccucuccccugacacaugugugugccgcaccgaugagggccggguccuggaggggcugagagaagacaugcucgagacccuggugcccaaggcggaaggcgaucgcguuauggugguccuuggaccgcagacaggccggguggggcaucugcucagcagagaccgggcucgcucuagagcccugguucagcuuccucgggagaaucagguggucgagcugcacuacgaugccauuugucaauauaugggacccuccgacacggacgaugacuga

SEQ ID NO: 69912 - RNA, 2523 nt, Artificial Sequence
  derived and/or modified sequence opt5 from GPLD1__Homo_sapiens__NP_001494
augagcgccuucagacuguggcccggccuccugaucaugcuugggucccugugccaccggggaucuccuuguggccucagcacccauguggagauugggcaccgcgcucuggaauuucuucagcugcauaacggaagagucaauuaccgggagcuccugcuggaacaccaagacgccuaucaggcgggcaucguuuucccggauugcuuuuaccccuccauuuguaaagggggaaaguuccaugacgugucugagagcacacacuggacgccuuuucucaacgcuuccgugcacuauauccgcgaaaauuacccccugccuugggagaaggauaccgagaaacuugucgccuuccuguuuggcauuacaucucauauggccgcugacgugagcuggcacucccucggccuggaacagggguuccuuagaaccaugggagccaucgauuuucauggcagcuauucugaggcucacuccgccggggacuucggaggcgauguucugagccaguuugaguucaacuuuaauuaccucgcgcggcgcugguaugugcccgucaaggaccugcuggggaucuacgaaaaacucuacggaagaaaggugauuacagagaacguuaucguggauugcucucacauucaauuccuggaaauguauggcgagaugcuugccgucuccaagcuguacccuaccuauagcacaaaaucuccguuccucguggaacaguuucaggaguacuuccugggcgggcuugacgauauggcuuuuugguccaccaauaucuaucaucugacgagcuucaugcucgaaaacggaaccuccgacuguaaucugcccgagaacccucuguuuauugccugcggcgggcagcaaaaucacacacagggaucuaagaugcagaaaaacgauuuccaucggaaucucaccacaagccugaccgaguccguggaccgcaacaucaauuacacggaaagaggcgucuuuuucagcguuaacucuuggacacccgacuccaugagcuuuauuuauaaggcucuugagcggaacauccgcaccauguucaucgggggaucucagcugagccaaaaacacguguccucuccucucgccagcuacuuucuguccuuccccuacgcgagacuuggcugggccaugacaagcgcugaucugaaucaggacggccauggggaucucguggucggagccccgggcuauucucggccugggcacauucacaucggacgcguguaccugauuuauggcaacgaccuggggcugcccccuguugaucucgaccuugauaaggaagcucauagaauccuggagggcuuucagcccuccggacgguucggcagcgcccucgccgugcuggacuucaaugucgauggggugcccgaccuggcuguuggagcgccuucugugggcuccgaacaacuuaccuacaagggggccgucuauguguacuuuggaagcaaacagggcgggauguccucuagcccgaacauuaccaucuccugucaggauaucuauugcaaucucggcuggacacugcuggcugccgacgucaacggagacucugagcccgaucucgugauuggcagcccuuucgcccccgggggaggcaagcagaaagggaucguugcugccuuuuacuccggaccuagccugucugacaaggagaaacuuaauguggaagcggcuaacuggacggucagaggcgaggaagauuucuccugguuuggguacagccugcacggcgugaccguugacaaucgcacacuccugcuggugggaucucccaccuggaagaacgccucccggcuuggccaucuccugcacauuagagaugagaaaaagagccuggggcgcgucuauggauacuucccgccuaauggccaaucuugguuuacaaucagcggggacaaggccaugggaaaacucggcaccucccugagcucugggcacgugcuuaugaacggcacgcugaaacaggugcuccugguuggagcucccacauaugaugacgucuccaagguggccuuccugaccgugacccuucaucagggcggggcuacacggauguacgcccucaccagcgaugcgcagccucugcugcucuccacauuuucuggagacagacgcuucagccgguuuggcgggguccugcaccuuuccgaucuggacgaugacggacucgacgaaauuaucauggccgcuccccugagaaucgccgaugugacgucuggccugauuggcggggaggacggacgcguuuauguguacaauggcaaggagaccacacuuggggauaugaccggaaaauguaagagcuggaucacaccuugccccgaagagaaggcucaauauguccucauuuccccggaagccucuagccgguucggcuccagccugaucaccgugagaucuaaagcgaagaaccagguugugauugccgcugggcgcuccagccugggagcccggcucucuggcgcucugcaugucuacucccuuggcagcgacuga

SEQ ID NO: 69913 - RNA, 816 nt, Artificial Sequence
  derived and/or modified sequence opt5 from GPM6A__Homo_sapiens__NP_001248377
augaccgaccuggagggcugcuucgaauguugcaucaagugucucgggggcauucccuacgccagccugaucgcuacaauucuucuguaugccggaguggcgcucuuuugcggguguggacacgaggcucuguccggcacggucaacauccuucagaccuacuucgaaauggccagaacagccggggauacccuggacguuuuuacaaugauugauaucuucaaauaugugaucuacggaauugcugccgccuuuuucguguauggcauccuccugauggucgagggcuuuuucaccacaggggcuauuaaggaccuguacggagauuuuaaaaucaccacgugcggccggugugugucugcgugguucauuaugcucaccuaucuguuuaugcuugccuggcuggggguuacagcuuucaccagccucccuguguacauguacuuuaaucuguggacaaucugccgcaacaccacgcuugucgaaggagccaaucugugucucgaccugagacaauucggcauugugacaaucggggaggagaagaaaaucugcaccguuuccgaaaacuuccugcggaugugugagucuacagaacucaauaugaccuuucaucuguucauuguggcucuugccggagcgggcgccgcugucaucgccauggugcacuaucugauggugcucagcgcuaacugggccuacgucaaggaugccugccgcaugcagaaguaugaggacauuaaauccaaggaggaacaggagcugcaugauauccacucuaccagaagcaaagaacggcuuaaugcuuacacauga

SEQ ID NO: 69914 - RNA, 741 nt, Artificial Sequence
  derived and/or modified sequence opt5 from GPM6B__Homo_sapiens__NP_001001994
augggcugcuucgaguguugcaucaagugucucgggggagugcccuacgccagccuggucgcuaccauucugugcuuuuccggcguugcccuuuucugugggugcggacacguggcgcuggcuggcacaguggccauccucgaacagcauuuuucuacgaacgccagcgaccacgcucugcuuuccgaggucauucaacugaugcaguaugugaucuacgggauugccucuuucuuuuuccucuauggaaucauccugcuggcugaaggcuuuuacaccacaagcgccguuaaagagcuccauggcgaguucaagaccacagcgugugggagaugcauuuccggaauguuuguguuccugaccuauguccuuggcguggccuggcuggggguuuuuggauucucugcugugccugucuuuauguucuacaauaucuggagcacaugugaagugauuaaauccccgcagaccaacggcacgaccgggguggagcagaucugcgucgauauucggcaauauggaaucauucccuggaaugccuucccuggcaagaucuguggcagcgcucucgaaaacaucugcaauacaaacgaguuuuacaugucuuaccaccuguucauuguugccugcgcgggggccggagcuaccgugaucgcccuucugauuuauaugauggcuacaaccuacaauuaugccgugcucaaauuuaagucccgcgaagacuguugcacgaaguucuga

SEQ ID NO: 69915 - RNA, 1089 nt, Artificial Sequence
  derived and/or modified sequence opt5 from GPN1__Homo_sapiens__NP_001138519
augaccggccacacaagaagcucccugccccggugcacggggaucgugcuccugauuaaacuucgcuucucugagagacugaccggacaucuccacgcccagggcacaccuccguacgucaucaaccuggaccccgcuguucaugaagugccuuuucccgccaauauugauauccgggacaccgugaaguauaaggaggucaugaaacaauacgggcuuggaccuaacggcgggauugugacaagccugaaucucuucgcgacccgcuuugaucagguuaugaaguucaucgaaaaagcucagaacauguccaaguaugugcugaucgacacacccggacagauugaggucuuuaccuggucugccagcggcacgaucauuaccgaagcccuggcuuccucuuucccuacagugguuaucuacgugauggauaccagcagauccacaaauccggucaccuuuaugagcaacaugcucuaugccuguucuauucuguacaagacgaaacuucccuucaucguggugaugaauaagacagacauuaucgaucacuccuuugcugucgaguggaugcaagacuucgaggccuuucaggaugcgcugaaccaggaaaccacauauguuagcaaucucacccggucuaugucccuggugcuugacgaguucuacagcucucugcgcguggucggcguguccgccguucucgggaccggacuggaugaacuguuugugcaggucacaagcgcugccgaggaguacgaaagagaguaucggccugaauacgagcgccucaaaaagucccuggcuaacgccgaaucucaacagcagagagagcagcuugagcggcugcgcaaagacaugggcagcguggcgcucgaugccgggacggcuaaggacucccugagccccguucuucauccuucugaccugauccucaccagaggaacacuggaugaagaggacgaagaggccgauuccgacaccgaugacauugaucaccgggugacagaagagagccacgaggaacccgcuuuccaaaauuucaugcaggagucuauggcccaguauuggaagcgcaacaauaaauga

SEQ ID NO: 69916 - RNA, 1719 nt, Artificial Sequence
  derived and/or modified sequence opt5 from GPNMB__Homo_sapiens__NP_001005340
auggagugccuguacuauuuccucggcuuucugcuucuggccgcuagacucccccuggacgccgcgaagcgguuccacgaugugcuugggaacgaacgcccuagcgcuuacaugagagagcauaaucagcugaacggaugguccucugacgaaaaugauuggaacgagaaacucuauccggucuggaagcggggcgacaugcgcuggaaaaauagcuggaaagggggaagaguucaagccgugcugaccuccgauucucccgcccuggugggcagcaacaucacauuugcugucaaucucauuuucccucggugucagaaagaagacgccaacgggaauaucguguacgagaagaacugccgcaaugaggcuggacuguccgccgaucccuauguuuacaacuggacggcguggucugaagacagcgauggcgagaauggcaccgggcagucccaccauaacguguuuccugacggaaagcccuucccucaccauccgggcuggagacgguggaauuuuauuuaugucuuccacacacuugggcaguacuuucaaaaacugggacgcuguagcgugagaguuucugugaacaccgccaacgucacacucggcccccagcugauggaagugaccguguaccggcgccacgggagagcuuaugucccuaucgcccagguuaaggauguguacguggucacagaccagauucccguguucguuaccauguuucaaaagaaugaucggaacuccagcgacgagacguuccuuaaggaccugccuaucauguuugaugugcucauccaugaccccucucacuuccugaauuauuccaccauuaacuacaaauggagcuucggagauaauacaggccuguuugucucuaccaaccauacagugaaucacaccuauguucucaacggcacguucucccugaaucuuacagugaaggcugccgcgccggggccuugucccccucccccucccccgccccgcccuagcaagcccaccccuucccuggccacaacccucaaaucuuacgacagcaacacccccggaccggcuggcgauaauccucuggagcuuuccagaauccccgacgaaaacugccagauuaaucgguaugggcacuuucaggccacaaucacgauugucgagggaauccuggaagugaacauuauccagaugaccgauguccucaugccugugcccuggccugagagcucucugaucgacuucguugugacaugccaaggcuccauucccaccgaagucuguacaaucauuagcgauccgaccugcgagaucacgcagaauacaguguguucuccuguugacguggaugagaugugccugcucaccgucagacgcaccuuuaacgggagcggaacauacugugugaaccugacccuuggcgacgacacaucccuggcucucacgucuacccugauuagcgugcccgaucgggaccccgccuccccucuuagaauggccaauagcgcucugaucucuguuggcugccucgcgaucuucgucacagugauuucccugcugguguacaagaaacauaaggaauauaacccgaucgagaauagccccgggaacgucgugcgcucuaaaggacucuccguuuuucugaaucgggccaaggcuguguucuuuccuggcaaccaggaaaaagauccccuucugaagaaucaagaguucaagggggucagcuga

SEQ ID NO: 69917 - RNA, 1527 nt, Artificial Sequence
  derived and/or modified sequence opt5 from GPR101__Homo_sapiens__NP_473362
augaccagcacaugcacgaacuccaccagagagucuaauagcucccacacauguaugccccugucuaagaugccuaucagccucgcccauggcauuauccgguccaccgugcuggucauuuuccuugcugccucuuuuguugggaacaucgugcuggcgcucgugcugcagcgcaaaccgcaacuucugcaggucacaaauagauucauuuuuaaccuccuggugaccgaccugcuccagaucagccugguugcucccuggguggucgccacauccgugccucuuuucuggccccugaauagccacuuuugcaccgcccucguuucucugacgcaucuuuucgcuuuugccuccgugaacaccaucgucguggugagcgucgaucgguaccugucuauuauccacccucucuccuaucccagcaagaugacacagcgcagaggauaccugcugcucuauggcaccuggauuguugcuauccugcaaucuacaccuccgcuuuacggguggggacaggccgcguucgacgaacggaaugcccuguguuccaugauuuggggcgcuagccccuccuauaccauccucucuguggugagcuuuauugucaucccucugaucgugaugauugccugcuacuccguuguguucugugcugcccgcagacagcaugcgcuucuguauaacgucaaacggcacagccucgaggugcgcguuaaggauugcguggaaaaugaggacgaagagggggccgagaaaaaggaagaguuucaggaugaaucugaguucagacggcaacacgagggagaagucaaggcuaaagagggccgcauggaagccaaggacggcucccugaaagcuaaggaggggagcacgggaacaucugaaagcuccguggaggccagaggcucugaggaaguccgggagagcuccaccguggccagcgaugggucuauggaaggaaaagagggcuccacaaagguugaagagaacagcaugaaggcugacaaagggcgcaccgaggugaaucaguguucuaucgaucugggagaagacgauauggaguuuggcgaagacgauauuaacuucuccgaggacgacgucgaagcggugaauauccccgagagccucccucccuccagacggaacucuaauagcaacccgccucugcccagaugcuaccaguguaaggccgcuaaaguuauuuucaucaucaucuuuuccuacgugcuuucucugggcccuuauugcuuccucgccguccuggccguguggguggauguugagacccaggucccccaaugggugauuacaauuaucauuuggcuguuuuuccuucaguguugcauccaucccuacguguauggguacaugcacaagacgaucaaaaaggaaauucaggacaugcucaaaaaguuuuucugcaaggagaaaccuccgaaggaagauagccaucccgaccugccuggaaccgagggcgggacagagggaaaaaucguccccuccuaugauagcgcuaccuuuccuuga

SEQ ID NO: 69918 - RNA, 1008 nt, Artificial Sequence
  derived and/or modified sequence opt5 from GPR119__Homo_sapiens__NP_848566
auggagagcuccuucucuuuuggcgugauccuggccguccucgcuagccugauuaucgccaccaacacacuuguugcgguggcugugcugcuccugauucacaagaaugacggggucucccuuugcuucacgcugaaccucgccguggccgauacccugaucggaguugcuauuucuggccugcucacagaccagcugagcucccccucuagaccuacccagaaaacacuuuguagccugcggauggccuuugugaccuccagcgcugccgcgucuguccucacagugaugcugaucaccuucgaucgcuaccuugccaucaagcaaccguuuagauaucugaaaauuauguccggguucguugcuggagccugcaucgcuggccucuggcuggugagcuaccugauuggguuucucccccugggaaucccuauguuccagcagacggccuauaagggccaauguuccuuuuucgcggucuuucauccccacuucgugcuuacccugucuugcgugggcuuuuucccugccaugcuccuguucgucuuuuucuacugugacaugcuuaaaauugcuagcaugcauucucagcagauccggaagauggaacacgccggggcuauggccggaggcuaucgcucccccagaacaccuagcgauuuuaaggcccugcggaccguuuccgugcucauugggucuuucgcucugagcuggacaccguuucugaucaccggaaucgugcaggucgcgugccaagagugucaucucuaccuggugcuugaacgcuaucuguggcuccugggcguuggaaauucccuucugaacccccucauuuacgccuacuggcagaaagaggugagacugcagcuguaucacauggcucucggggucaagaaagugcugacgagcuuccuucuguuucucucugcccggaauugcggcccugaacgccccagagaguccagcugucacaucguuacaauuucuagcuccgaguucgacggcuga

SEQ ID NO: 69919 - RNA, 1005 nt, Artificial Sequence
  derived and/or modified sequence opt5 from GPR12__Homo_sapiens__NP_005279
augaacgaggaccugaaggugaaucucagcggccugcccagagauuaccuugacgccgcugccgcggaaaacaucuccgcugccgucucuagccggguuccugccguggagccggaacccgagcugguggucaauccuugggauauugugcucugcaccuccgggacacugaucucuugugaaaacgcuauuguugugcuuaucauuuuccacaaucccagccugcgcgccccuauguuucuccugaucggaucccuggcucucgccgaccugcuugcgggcaucgggcugauuacgaacuucgucuuugccuaucuccugcagucugaggcuaccaaacuugugacaaucggacugauuguugccagcuucuccgcuagcgugugcucucuccuggccaucaccgucgauagauaccugucccucuauuacgcgcugacauaucauagcgagcggaccgugacauuuaccuacgugaugcuugucaugcuguggggcacgucuauuugucucgggcugcuucccguuaugggauggaauugccugcgcgacgaauccaccuguagcguggugagaccucucacaaagaacaaugccgcuauccugucugucuccuuccuguuuauguucgcccucaugcugcaacuuuauauucagaucugcaaaaucgugaugcggcacgcucaucagauugcccugcagcaccauuuucucgccaccagccacuacguuacaacccgcaagggcguguccacgcuggcuaucauucuuggcacauucgcggccuguuggaugccguuuacccuguacucucucaucgcugauuauacauaccccagcauuuauaccuacgccacccugcugccugccacauauaacuccaucaucaaucccgucauuuacgcuuucagaaaccaagagauccagaaagcccucugccugauuuguugcggguguaucccuagcucucuugcgcagcgggcucgcucccccagcgacguguga

SEQ ID NO: 69920 - RNA, 1143 nt, Artificial Sequence
  derived and/or modified sequence opt5 from GPR132__Homo_sapiens__NP_001265623
augugccccaugcugcucaagaacggcuacaaugggaacgccaccccugugacaacgaccgcuccgugggccagccugggacuuuccgcgaaaacauguaauaacgucucuuucgaggaaagcagaaucguucuggugguggucuauuccgcugugugcacccucggcguucccgccaauugucugacagccuggcuugcucugcuccaggugcugcaagggaacguccuggccguguaccuccugugccuugcucugugugagcuccuguauaccggaacacuuccucuguggguuauuuacauccggaaucagcaccgcuggacccucggccugcuggccugcaaggugacggcguauaucuuuuucuguaacauuuacgucucuauucucuuucugugcuguaucagcugcgacagauucguggccguggucuaugcucuugaaucccgggggcgcagacggcgcagaaccgccauccugauuucugcuuguaucuuuauucucguuggaaucgugcauuaccccguguuccagacagaggauaaagaaaccugcuuugacaugcugcagauggauagccggauugccggcuacuauuacgcgcgcuucacagucggcuuugccaucccucuuuccauuaucgcuuucaccaaucacagaaucuuucggagcauuaagcaaucuauggggcuguccgccgcucagaaagccaaggugaagcauagcgccaucgcuguuguggucauuuuccucgugugcuuugcgcccuaucaccugguucugcucgugaaagccgcugccuucucuuacuaucgcggagacagaaacgccauguguggccuggaggagcggcuuuacacggcuuccgucguguuccugugccucagcacagucaaugggguggccgauccuaucauuuauguucuggcgaccgaccauucucgccaggaaguguccagaauccacaagggauggaaagaguggagcaugaagacagaugucacccggcuuacccacuccagagacacagaggaacugcagucuccgguggcucucgccgaucauuacacguuuagccgccccguucacccucccggcuccccuugucccgccaaacggcugaucgaggaaagcugcuga

SEQ ID NO: 69921 - RNA, 1485 nt, Artificial Sequence
  derived and/or modified sequence opt5 from GPR135__Homo_sapiens__NP_072093
auggaggaaccccagccuccgagacccccugccagcauggcucugcucggcucccaacacucuggggcccccagcgcggcuggaccucccggcgggaccuccucugccgccacagcugccgugcugagcuucuccacggucgcuaccgccgcgcuuggaaaccugucugacgccagcggcgggggaacagcugccgcuccuggcggcgggggacucggcggguccggagccgcgcgggaggccggcgcugccguucgcagaccgcuggggcccgaagcugccccucuucugagccauggagccgcuguggcggcccaggcucucgugcugcugcucaucuuucugcuuucuucccugggcaauugcgccgucaugggcgugauuguuaagcaccggcagcuccgcaccgugacaaacgccuucauccugagccuuucucuguccgaucuccugaccgcucugcucugucugcccgccgcguuucuugaccuguucacaccucccgggggaagcgcuccggccgccgcugccggcccuuggagaggguuuugcgcugccucucgguucuuuuccagcuguuucggaauugucuccacccucucuguggcgcugaucagccuugaucgcuacugcgccauuguuagacccccucgggagaaaaucggccgcagacgggcucugcagcuccuggccggggcuuggcugacggcccucggauuuucccugcccugggaacuucugggcgcgccccgcgagcucgccgcugcccagagcuuccauggcugucuguauagaaccucuccugacccggcucaacuuggggccgccuuuuccgugggacuggucguggcuugcuaccuccugcccuuccugcucauguguuuuugccacuaucauaucuguaagacagugcggcugagcgauguccgcguuagaccugugaauaccuacgcgcgggugcuuagauucuucucugagguccgcacagccaccacggugcugauuaugaucguuuuugugauuugcuguuggggccccuauugcuuccucguccugcuggcugccgcccggcaggcucagacaaugcaagccccuagccuucucuccgugguugcgguguggcugaccugggcuaacggggccaucaaucccgucauuuacgccaucagaaacccgaauauuucuaugcugcucggacgcaaccgggaagagggcuauagaacacgcaauguggacgcuuuucugccuagccaggggcccggccuucaggcccgguccagaagccgccugcggaacagauacgcgaaucgccucggagcuugcaaccggaugucuuccagcaauccugccucuggcgucgccggggauguggcuaugugggcccggaaaaaccccguugugcuguucuguagagaaggaccucccgagccggucaccgcugugaccaagcagccuaaauccgaggccggcgacacaagccuguga

SEQ ID NO: 69922 - RNA, 1290 nt, Artificial Sequence
  derived and/or modified sequence opt5 from GPR137C__Homo_sapiens__NP_001093122
augagagugagcguccccggcccugccgcugccgcggcuccggccgccgggcgggagcccuccaccccuggaggcgggucuggaggcgggggagcuguugccgcugccagcggcgcggccgugcccggcuccgugcagcuggcucucucuguccugcacgcccuucuguacgcugcccucuucgcguuugccuaucugcaacuuuggcgccugcuccuguacagagaacggcgccugagcuaucagucccucugccuguuccuuugucugcucugggcugcccugagaacaacgcuguuuucugcugccuucagccuuuccgggagccucccucugcugcggcccccugcccaucuccacuuuuucccgcauuggcugcuuuacugcuuucccucuugucugcaguucuccacccucugccugcuuaaccuguaucucgcugaggugaucuguaagguucgcugcgcgacagaacuggacagacacaaaauucugcuccaucugggauuuaucauggccagccuucuguuccucguggucaaucugaccugugcuaugcuugugcacggcgauguuccugagaaccagcugaaguggacaguguuuguccgggcccucauuaaugacucucuguucauccugugcgccauuucccucguguguuacaucugcaaaaucaccaagaugagcucugcuaacguguaucuggaauccaaagggaugagccuuugucaaacagucguugugggauccguggucauucugcucuacucuagccgcgccugcuacaaucuggugguugugaccaucucccaggauacgcuggagagccccuuuaacuauggcugggacaaucuuucugauaaggcgcacgucgaggacauuuccggggaagaguacaucguguucggaaugguucucuuccugugggaacaugugccugcuuggagcgucgugcuguuuuucagagcccagcggcucaaccagaaucuggcccccgcuggcaugauuaacucucacagcuauuccucucgcgccuacuuuuucgauaauccgagacgguaugacagcgaugacgaucuuccucgccugggcuccagcagagaggggucucuccccaacucccaaagccugggaugguacggcaccaugacagggugcggaucuuccagcuauaccgucacaccucaucugaauggccccaugaccgacacggcuccccuucucuuuacauguuccaaccuggaucugaauaaccaccacucucucuacgugaccccucagaacuga

SEQ ID NO: 69923 - RNA, 1062 nt, Artificial Sequence
  derived and/or modified sequence opt5 from GPR139__Homo_sapiens__NP_001002911
auggagcacacccaugcccaccuggcugccaacagcucccucucuugguggagccccggcuccgcgugcgggcugggauucgugccugucguuuacuauucucuucugcucugucugggccuuccggcuaauauccugacagugauuauccucagccagcugguggccagacggcaaaaguccucuuacaacuaucugcucgcccuggcugccgcugacauucuuguccuguuuuucaucguguuuguugauuuccuccuggaagacuuuauucuuaauaugcagaugccccaggugccugauaaaaucaucgagguccuggaguucagcuccauucauacgagcaucuggauuaccgugccccucacaaucgaccgcuacauugccguuugccacccucugaaguaucauaccgugucuuaccccgcgagaacacggaaagucaucguguccguguauauuaccuguuuucugacaagcaucccuuacuacugguggccgaacaucuggaccgaagauuauauuucuacguccguccaccacguucucaucuggauucauugcuucaccguguaccuggugcccuguagcaucuuuuucauucuuaauucuaucaucgucuauaagcugcgcagaaaauccaacuuucggcuccgcggguacagcacaggaaagaccacagccauucuguucaccaucacguccauuuuugcuacacuuugggccccuagaaucauuaugauccuguaucaccucuacggcgcucccauccagaaucgguggcuggugcauauuaugucugacaucgccaacaugcuggcgcuccugaauaccgccauuaacuucuuccuuuauugcuuuaucagcaagcgcuucagaacaauggcugccgcuacccugaaagccuuuuucaagugucaaaaacagccuguucaguuuuacaccaaucacaacuucuccauuacaagcucucccuggaucuccccggccaauagccacugcauuaagaugcucguguaccaguaugauaaaaacgggaagccuaucaaggucucucccuga

SEQ ID NO: 69924 - RNA, 1215 nt, Artificial Sequence
  derived and/or modified sequence opt5 from GPR143__Homo_sapiens__NP_000264
auggccagccccagacugggcaccuucugcuguccuacacgggacgcugccacgcagcucgugcuguccuuucaaccgcgcgcguuccacgcucuuugccuggggucuggaggccucagacuggcccuugggcugcuccagcugcugcccggacggcgcccugccggccccgggagcccugcuaccucucccccugccuccgucagaauccuccgggcugccgcggccugugaucugcuuggaugccugggcaugguuauucgcagcacaguguggcucggcuuuccgaacuucguggacuccgucucugauaugaaucauaccgagaucuggcccgcugccuuuuguguggggagcgcuauguggauucagcugcuuuacuccgccugcuucugguggcuguuuuguuaugcgguugacgccuaccucgugaucagacggagcgcuggacugucuacaauucugcucuaucacaucauggccuggggccuggcuacccuucugugcgucgaaggggccgccaugcucuacuauccuuccgugagccgcugugagagaggacuggaucaugcuaucccccacuacguuacaauguaucuuccucugcuccuggugcuggucgcgaaccccauucucuuccagaagaccgugacggccguggcuucucugcuuaaaggccggcaagggaucuacaccgaaaaugagcgcagaaugggagccgucauuaagauccgguuuuucaaaauuaugcugguucucaucauuugcuggcuguccaacaucaucaaugaaagccuucuguuuuaccucgagaugcagacagacauuaacggcggcucucugaagccggugcgcaccgccgcuaaaacaaccugguucaucauggggauucugaauccugcccagggauuucuccugucccuugcguucuauggcuggacgggguguagccugggauuccagucccccagaaaggagauccaaugggaaucucucacaaccagcgcugccgagggcgcccauccuagcccccugaugccccacgaaaacccugcuuccgggaaggugucucaggucggaggccagacauccgaugaggcccugagcaugcuuucugagggcagcgacgcuuccaccauugaaauccacaccgccucugagagcugcaauaaaaacgaaggggauccggcgcuccccacacauggagaccuguga

SEQ ID NO: 69925 - RNA, 1044 nt, Artificial Sequence
  derived and/or modified sequence opt5 from GPR148__Homo_sapiens__NP_997247
augggcgacgagcuggcccccugcccuguggggaccacagcuuggccggcccucauccagcugauuagcaagacgcccuguaugccucaagcggcuuccaacaccucucuuggacugggcgaucucagaguccccagcuccaugcuguacuggcuuuuccugccuucuagccuccuggccgccgcuacacuggccguuucuccccuccugcuugugaccauccugcggaaucagcgccucagacaggaaccucacuaucugcuuccggcuaacauucugcucuccgaccuggccuacauccugcuccauaugcugauuagcuccagcucucuugggggaugggagcugggccggauggcgugcgggauccucacagaugccguguuugcugccuguaccuccacaauccugagcuucaccgcuauuguccuucacacguaucuggccgugauccauccccuccgcuaccugucuuuuaugucccacggagcggccuggaaagcuguugcccugauuuggcucguggcuugcuguuucccuaccuuucugaucuggcuuagcaaguggcaggacgcccaacuggaggaacagggcgccucuuauauucugcccccuuccaugggcacacagcccgggugcggacugcuugucaucgugaccuacacaagcauucuguguguucucuuccugugcaccgcucugaucgcgaauuguuuuuggagaaucuaugccgaagcuaaaacguccggcauuugggggcagggauacucucgggcccgcggcacacuccugauccauagcgugcuuauuacccuguacgucuccacaggggugguguucagccucgauaugguccugaccagauaucaccacaucgacucuggaacccauacauggcugcuugccgcuaacuccgagguucucaugaugcugccgcgggccaugcugacguaccucuaucugcuucgcuacagacaacugcucggcauggugcggggccaccucccuagccgcagacaucaggcgauuuuuaccaucucuuga

SEQ ID NO: 69926 - RNA, 2196 nt, Artificial Sequence
  derived and/or modified sequence opt5 from GPR149__Homo_sapiens__NP_001033794
augagccuguuccucuccaaccugucuaccaaugacagcucccuuuggaaggagaaccacaauucuacagaucugcucaaucccccuggcacgcugaauaucuaccuguuuugccuuaccugucucaugacauucgccgcucugguggggagcauuuauucccugaucucucuccugaaaaugcagaacagaaccgucguuagcaugcuuguggccuccuggagcguggacgaucugaugucuguccucuccgugacaauuuuuauguuccugcaauggccgaaugaaguucccggauacuuucaguuccuuugcaccacaagcgcgcugauguaucucugucagggccugucuuccaaccugaaggcuacccuccuggugagcuacaauuuuuauacgaugcaucgcggggucggaucucagaccgccucccggagaagcggccaagugcuugggguugugcugacagucugggccgcuucccuccugcuuucugcccugccucucugcggauggggcgcuuucgugcggacccccuggggcugucugguggacugcagcuccagcuacguccuguuucucucuaucguuuaugcccuggcguucgggcuucuggugggacucuccgugccucugacacaccgccuucuguguagcgaggaacccccuagacuccauucuaacuaccaggagauuagccggggcgccuccaucccggggacacccccuacggcuggacgcgucgugucucugagccccgaagaugccccuggccccucccugagacggagcgggggaugcucuccguccagcgacacaguuuuuggcccuggcgcucccgccgcggccggggcugaggccugucgcagagagaaucggggaacccucuacggcacacgcucuuucaccguguccgucgcucagaaaagauuugcccugauccuugcccugaccaaggugguucucuggcugccuaugaugaugcacauggugguccagaacguggucggguuccaaagccugccccuugaaacauucuccuuucuccugacgcugcucgcuaccacagugacccccguuuucgugcugucuaaacgguggacacaucuuccuugcggauguauuaucaauugccgccagaacgcguaugccgucgcuagcgauggcaagaagauuaaaagaaagggguuugaguucaaucuguccuuucagaaaucuuacggaaucuauaagauugcccacgaagacuacuaugaugacgaugagaacagcaucuucuaccacaaccucaugaacuccgagugcgaaaccacgaaagacccgcagcgggauaacagaaauauuuuuaacgccaucaagguggagaucagcacaacccccucucuggacuccagcacccaacgcggcauuaauaaguguacaaacaccgacaucacagaagcuaaacaggauucuaauaacaagaaagacgccuucuccgauaagacgggcggggacauuaauuaugaggaaaccacauuuagcgagggaccugagcggagacugucucaugaagagagccagaaacccgaucuuuccgacugggaauggugccgcagcaagucugagcggaccccuagacaacgcuccggcuacgcgcucgcuaucccccugugugccuuccaggggacaguuagccugcacgccccgaccggaaaaacgcucucccugucuaccuacgaagugagcgcugagggccagaagauuaccccugccuccaagaaaaucgaggucuaucggucuaagagcguggggcaugaacccaacuccgaggauucuagcuccaccuuuguggacacaagcguuaaaauccaccuugaaguccuggagauuugcgauaaugaagaggcucucgacaccgugucuaucauuuccaacaucagccagucuuccacgcaagugagaagcccuucucugcgcuacucccggaaggagaauagauucgucagcugugaucugggcgaaacagccuccuauagccuuuuucuccccaccucuaacccugacggagacauuaauaucagcauccccgauacaguggaggcgcaccgccagaacuccaaacggcagcaucaggaaagagacggcuaccaagaggagauucagcugcugaacaaggccuaucggaagcgcgaagaggaaucuaaagggagcuga

SEQ ID NO: 69927 - RNA, 1305 nt, Artificial Sequence
  derived and/or modified sequence opt5 from GPR150__Homo_sapiens__NP_954713
auggaggaccuguucagccccuccauccucccuccggcccccaacauuucugugccuauccugcuuggcugggggcugaaucucacccugggacagggcgcucccgccagcgggccucccuccagacggguccgccuuguuuuucugggagugauucucguggucgcgguggcuggcaacacaacgguucugugcagacugugugggggaggcggcccuugggccgggccgaagcggcgcaaaauggauuuccuccuggugcaacuugcccuggcugaccucuacgccugcggaggcaccgcucugucucagcuugccugggaacugcucggggagcccagagcggccacaggagaucuggcuugucgguuucugcagcuccugcaggccagcggccgcggggcuuccgcccaccuugucgugcugaucgcgcucgaaagacggcgcgccguuagacugccucauggacggccccuuccugcucgcgcccuggcugcccucggcuggcugcuggcccuccugcuugcucugcccccggcguucguggucagaggcgacucuccuagcccccucccucccccucccccgcccaccucccugcaaccuggggcucccccugccgcccgggccuggcccggagagcgcagaugccacggcauuuuugcuccgcuuccucgguggcaucuccagguguaugccuucuacgaagcgguggcuggguuugucgcccccguuacagugcugggaguggccuguggccaucugcugagcgucugguggagacaccgcccucaggcucccgccgcugccgcgccuuggucugccucccccgggcgggcuccggccccuagcgcucuccccagagccaaggugcagucucugaaaaugucccuucugcucgcgcugcuguucguuggaugcgagcuucccuauuuugccgcucgccucgccgcugccuggagcucuggcccugccggcgauugggagggggaaggacuguccgcugcgcugcggguggucgccauggcuaauagcgcccucaacccguucguguaccuguuuuuccaagccggcgacuguagacuucgccggcagcugagaaagcgccucgggucccugugcugugcuccccagggaggcgccgaggaugaagaggggccucggggccaccaggcgcuguauagacaacgcuggccccacccucauuaccaccaugcucggagagagccccuugacgaaggaggccuccggccucccccgccucgccccagaccucugcccugcucuugugagagcgccuuuuga

SEQ ID NO: 69928 - RNA, 1260 nt, Artificial Sequence
  derived and/or modified sequence opt5 from GPR151__Homo_sapiens__NP_919227
augcuggccgcugccuucgcggacagcaacuccucuagcaugaauguguccuuugcucaccuccauuucgccggcggguaccugcccucugauagccaggacuggagaaccaucauuccugcccuucuggucgcuguuugccucgugggauuugugggcaaccugugugucaucgggauucuucugcacaaugccuggaagggaaaaccguccaugauccauucucucauucugaaccugagccucgcugaucugucccuucuccuguucagcgcccccauccgggcgacagccuauucuaaguccgugugggaccugggcugguuuguuugcaaaagcucugauugguucauccacacguguauggcugccaagucccuuaccauuguggucguggcuaaaguuugcuuuauguacgccagcgacccugcgaagcaagugucuauccauaauuauacaauuugguccguccugguggccaucuggaccguggcuagccuccugccccugccugagugguucuuuuccacaauucgccaccacgaaggggucgagaugugucucguugaugugcccgccguggcugaagaguucaugucuauguuuggaaagcuguacccucuucuggccuucggccucccgcuguuuuucgccagcuucuauuuuuggagagcuuacgaccagugcaaaaagcggggcaccaaaacacagaaccuucgcaaucagaucagauccaagcaagucaccgugaugcugcucagcauugcgaucaucucugcccugcuguggcuccccgaauggguugcuuggcuguggguguggcaucuuaaagccgccgggccugcucccccucagggauucauugcccugucccagguccucauguuuagcaucucuagcgcgaacccccugauuuuccuugugauguccgaggaguuucgggaaggccugaaggggguuuggaaguggaugaucacgaaaaagccgccuaccgugucugagagccaggaaacacccgcuggaaauuccgagggccucccugauaaaguccccagccccgagucuccugccuccauuccggaaaaggagaaacccagcucuccuuccagcgggaagggaaaaaccgaaaaggccgagauccccauccugccugacguggaacaauucuggcacgagcgcgauacaguccccuccgugcaggacaacgauccgauuccuugggagcaugaagaccaggagaccggcgaaggcguuaaguga

SEQ ID NO: 69929 - RNA, 1413 nt, Artificial Sequence
  derived and/or modified sequence opt5 from GPR152__Homo_sapiens__NP_996880
auggacaccacaauggaggccgaucugggcgcuacggggcacagaccccggaccgaacucgacgaugaggacagcuacccucagggaggcugggauacaguguuccuggucgcccuucugcuccuggggcuuccggcgaacggacugauggcuuggcucgccggcucccaagcccgccauggggcuggaaccagacuggcccugcuccugcuuucucuggcucucagcgacuuucuguuccuugccgcggccgcuuuucagauccuggaaauucggcacggcggccauuggccccucgggacagccgcuugccgcuucuauuacuuucuguggggaguuuccuauucuagcggccuguuccuccuggccgcgcuuucccuggauagaugucuccuggcccuuugcccucacugguaccccgggcaucggccugugcgccugccccucugggugugugcuggagucugggugcuggccacccuguuuucuguuccuuggcucguguucccggaggcugccgucuggugguaugaccuggugaucugccuugauuuuugggacagcgaggaacugucccucagaaugcuggagguucuuggcggguuccugcccuuucuccugcugcucgugugucacguccugacacaggccaccgcuugccggacgugucaccgccagcaacagccugcggccugcagaggauucgcucggguggcccgcaccauucuuagcgccuacgugguccugagacuccccuaucagcuggcucagcugcuuuaccucgccuuucugugggauguuuacucuggcuaucugcucugggaagcgcugguguacuccgacuaucuuauccugcucaauagcugucugucuccuuuccugugccuuauggcuuccgccgaucuccggacacugcugcgcagcgugcucucuuccuucgccgcugcccugugugaggaaagacccggcagcuuuaccccgacagagccucaaacccagcuugacuccgaggggcccacgcugccugaacccauggcugaggcccagucucagauggaccccgucgcgcaaccucaggugaacccgacacuccagccccggagcgauccuaccgcccaaccccagcugaauccuacagcucagccccaguccgacccgaccgcccaaccucagcugaaccuuauggcucagccccagagcgauucuguugcccaaccucaggcggacaccaaugugcagacacccgccccugcugccuccagcguccccucuccgugcgaugaagcuagcccuacgcccuccucucaucccaccccuggagcccucgaggacccggccacacccccugcuagcgaaggcgagucccccagcucuaccccucccgaggcggccccuggggcuggacccacauga

SEQ ID NO: 69930 - RNA, 1830 nt, Artificial Sequence
  derived and/or modified sequence opt5 from GPR153__Homo_sapiens__XP_011539736
augagcgacgagagacggcugcccggcuccgccgugggguggcucgucugcggaggccugucucuucuggcuaacgccugggggauccucagcguuggagcgaagcagaaaaaguggaaaccucuggaguuccuucuguguacccucgcugccacacacaugcugaauguggccgugccgauugcuacguacuccgucgugcaacugcgcagacagcggcccgauuuugaguggaacgaaggccucugcaagguuuucgugucuaccuuuuauacacugacccuugccacauguuucagcgucaccucccugucuuaccaucgcauguggauggugugcuggccuguuaauuauagacucagcaacgcuaaaaagcaggccgugcacacagucauggggaucuggaugguguccuuuauucugagcgcgcuucccgccgugggauggcaugacaccucugagcgguucuacacgcacggcugucgcuuuaucgucgcugaaauuggccugggguucggaguuugcuuucuccugcuggugggcggguccguggccaugggagucaucuguaccgcuaucgcccucuuccagacacuggcggugcaaguuggcagacaggccgaucggcgcgcuuuuaccgugccuacaauugucguggaggacgcccaggggaagagacggagcucuaucgauggauccgagcccgcuaaaaccagccuucagacgacaggccugguuaccacaauuguguucaucuaugacugccucaugggcuuuccuguccugguggucucuuucuccagccuucgcgccgaugccuccgcuccguggauggcgcugugugugcucuggugcucuguugcccaagcucugcugcuccccguguuccugugggccugugacagauaccgggccgaucuuaaggcuguccgcgaaaaaugcauggcccugauggcgaaugacgaggaaagcgaugacgagaccucccucgaagggggaauuagcccugaucuggugcuugaaagaucucuggacuauggcuacgggggagacuuuguugcucucgaucggauggccaaguacgagaucuccgcccuggaaggcgggcugccccagcucuauccucugagaccccuucaggaggacaaaaugcaguaccugcaagugccgccuacccgccgguucagccaugaugacgcugaugucugggccgcugugccccucccugccuuucugcccagauggggaucuggcgaagaccuggcggcccuugcucaccucgugcugcccgccggcccugagcgccggagagcuagccugcucgccuucgcggaggaugccccgcccucccgcgcucggagacgcucugccgaaagccugcuuucccugcggccuagcgcucucgacucugggcccagaggagcccgcgauuccccucccggcagcccgcggagacggccugggcccggaccucgcucugccuccgcuagccugcugcccgacgcguuugcccuuacagcuuucgagugcgaaccucaggcccucagacggcccccgggcccuuuucccgccgcucccgccgcgccugauggggcugacccgggcgaggcccccacgccucccuccucugcccagagaagcccuggaccccgcccuuccgcucacucucaugccggcagccugcggcccgggcuguccgcgagcuggggagaaccgggcgggcucagagcugccggaggcgggggcucuaccuccagcuuccugucuuccccuagcgagucuagcggauaugccacacuucacuccgacagccugggcucugcuuccuga

SEQ ID NO: 69931 - RNA, 2529 nt, Artificial Sequence
  derived and/or modified sequence opt5 from GPR155__Homo_sapiens__NP_001253980
augaacagcaaucugcccgccgagaaccucaccaucgcugugaauaugacaaagacgcugccuaccgccgucacacacggcuucaacuccaccaaugacccgcccucuaugagcauuacaagacuuuuuccugcgcugcucgaaugcuucgggaucguucuguguggauacauugcuggccgggccaacgugaucaccuccacacaggccaaagggcuuggaaauuuugugucucgcuucgcucugcccgcccuccuguuuaagaacauggucgugcugaauuucagcaacguugauugguccuuucucuauucuauucugaucgcuaaagccagcguguucuuuaucgucugcgugcuuacccugcucguugcguccccugacagcagauucucuaaggccggccuguuucccauuuucgcuacgcaauccaaugauuuugcccuuggguacccuaucguggaggcucuguaucagaccacauacccggaauaucuccaguacauuuaucuggucgcccccaucagccugaugaugcucaacccuauuggauucaucuucugugagauucagaaauggaaggacacccaaaaugcgucucagaacaagaucaaaaucgugggccugggccuucugcgggugcuccagaaucccauugucuuuaugguuuucaucgggauugccuuuaacuucauccuggaucgcaaggugccuguguacgucgaaaacuuucuugacggacugggcaauuccuucagcgggucugcucucuuuuaccugggacugacaauggugggcaaaauuaagagacucaaaaaguccgccuucguugugcugauccuucugaucaccgcuaagcuccugguccuuccccugcucugccgggagaugguggagcugcuggauaaaggggacagcguugugaaccauacgucccucucuaauuaugccuuucuguacggagucuucccgguggccccuggcgucgcuauuuuugcgacacaguucaacauggaaguggagaucauuaccagcggcaugguuaucuccacauuugugagcgcccccauuauguaugucucugcuuggcuucugaccuucccuaccauggaucccaagccccucgccuacgccauccaaaauguguccuucgacaucagcauuguuucucugaucagccuguccauugugugugcugggaugaugaucuggaacuuugucaaagaaaagaauuucgugggacagauucuuguguuuguucuccuguauucuagccuguacuccacauaucucuggacgggccugcuugccaucagccuguuccuccugaaaaagcgcgagagaguccagauuccuguggggaucaucauuaucucuggauggggcauuccggcgcugcuuguggggguccuccugaucaccggaaaacacaacggcgauuccauugacagcgccuuuuucuacggcaaggagcagaugaucacaaccgcugugacacuguuuugcucuauccucauugccgggaucucccugauguguaugaaucaaaccgcucaggccggaagcuacgaaggcuucgaucagucccaaucucauaagguuguggagcccgggaacacggcuuuugaagagagcccugcccccgucaaugaaccugagcuuuucacauccucuauucccgagaccagcugcuguuccugcagcaugggaaacggcgaacugcacuguccgucuaucgagccuauugcgaauaccuccacaagcgaacccgugaucccuucuuuugagaaaaacaaucauugcguuucccggugcaacagccagucuuguauccucgcccaggaagaggagcaguaucugcaaagcggggaccagcagcugacccgccacgugcuucucugccugcugcucauuaucggccuguucgcuaaccuuuccagcugucugugguggcucuuuaaucaggaacccggaagacuguacgucgagcugcaauucuucugcgccguguuuaacuucggccagggguuuauuucuuucggaaucuuuggccuugacaagcaccucauuauccugccuuucaaacggcgccuggaauuucucuggaauaacaaggauacagcugagaauagagacucccccguuagcgaagagaucaaaaugacgugucagcaguucauucauuaucaccgggaucugugcauccgcaacauugugaaggagagacgguguggggccaagaccuccgcgggaacauuuugcggcugugaccuugucucuuggcugaucgaaguggggcucgccagcgauagaggcgaggcugugauuuacggagaccgccugguccaaggcgggguuauccagcauauuaccaaugaauaugaguuccgggaugaguaccuguuuuauagauuccuucagaaauccccggaacagucuccucccgccaucaacgcuaauacacugcaacaggagcgcuacaaggaaaucgagcacagcucucccccuucccacagcccgaaaaccuga

SEQ ID NO: 69932 - RNA, 2433 nt, Artificial Sequence
  derived and/or modified sequence opt5 from GPR156__Homo_sapiens__NP_001161743
auggagcccgaaaucaacugcagcgagcugugugacuccuucccuggccaggaacucgauagacggccgcugcacgaccuuugcaagaccacaauuacgucuagccaucacuccucuaaaaccaucagcucccugucucccgugcuccuggggauugucuggacauuucuuagcuguggacugcuccugauccuguucuuucucgccuucaccauucauugccgcaagaauagaaucguuaaaauguccagcccuaaccugaauaucgugacacuucugggcucuugucucaccuacuccagcgcuuaucuguuugggauucaagaugugcuugucggaucuuccauggagacacugauccagacccggcucagcaugcugugcauuggcacgucucugguguucgggcccauccucggaaaguccuggcgccuguacaaaguuuuuacccagagagugccugacaagcgggucauuaucaaggaucuucagcugcucggccugguggccgcgcuucugauggcugacguuauucuccugaugacaugggugcugaccgaucccauccaaugucuccagauccugagcgucacaggcaaagacguguccugcaccucuacgagcacacacuucugugccucccgcuauagcgauguguggauugcccuuaucugggggugcaagggacugcuccugcuuuacggcgcuuaucuggccgggcucaccggacaugucucuuccccuccgguuaaccagagccugacaauuauggugggcgugaaucugcucguccuggcugccgggcuucuguuugugguuaccagauaccuccacucuuggcccaaccugguguucggacugaccagcggcggcaucuuugucuguacaacgaccauuaauugcuucaucuuuaucccucagcuuaaacaauggaaggcguucgaagaggagaaccagacaauucggcgcauggccaaauauuucuccacccccaauaagucuuuucacacacaguacggggaagaggaaaacugccauccuagaggagaaaagagcuccauggagcggcuccugaccgaaaagaaugcugugaucgagagccugcaggaacaaguuaacaaugccaaggagaaaauugugcgccucaugucugcugaauguacguacgaccugcccgagggcgccgcgccgccugccuccagccccaacaaggauguccaggcuguggccucuguccacacacuugcugccgcccaggggccuuccggacaucugagcgacuuccaaaaugaucccggcauggcugcgagagacucccagugcaccucugggcccagcuccuaugcccagucucucgagggaccuggcaaagacagcuccuuuagcccgggcaaggaagagaaaaucucugauuccaaggacuucagcgaucaccuggacucuggguguucccagaagcccuggaccgaacaaagccugggaccugagcggggcgaucaggugcccaugaacccuucucagagccuucuccccgaacgcgggggauccgacccgcagagacaacggcaccuggagaacagcgaggaaccucccgagagacgcucucggguuuccagcgugauuagagaaaaacugcaggagguccuccaggaucugggccuugggccugaggcuucccugucuacagcccccagcugccaucagcaaaccuggaaaaauuccgccgcuuuuucuccucagaaaaugccccucagcaaggagcugggcuucuccccguacauggugcgccggagacgcgccgcgcagcgggcuagaucucacuuuccuggaagcgcccccuccagcguuggccaucgcgccaaccggacagugcccggggcucacucuagacugcauguccagaauggagacuccccuagccuugccccgcaaacgaccgauucucgcgugcggagacccuccagccggaaaccuucucuccccuccgacccucaggaucgccccggcacacuggaggggagcaagcagucccaaaccgaaccugagggagcuagaggcagcaaggccgcguuccugcggcagcccucugggagcggcagagccccguccccugcugcccccugucucucuaaagcuagcccugaccugcccgaacaguggcagcuuuggccgccugugcccuccggaugcgccucucugagcucccaacacucuuauuuugacacagagagcuccagcucugaugaguucuuuugucgcugccaccggccuuacugugaaaucugcuuccaguccagcucugacuccagcgauuccggcaccucugacacggaucccgagcccaccgggggacucgcgagcugggaaaagcugugggccagauccaaaccuaucguuaacuuuaaggacgaucugaaaccgacacuugucuga

SEQ ID NO: 69933 - RNA, 3648 nt, Artificial Sequence
  derived and/or modified sequence opt5 from GPR158__Homo_sapiens__NP_065803
augggcgccauggcuuacccccugcuccugugccuucugcucgcccagcuggggcuuggagcggugggcgcuagcagagacccucaagggcggccggauucccccagagagagaaccccuaagggaaaaccccacgcccagcagccuggccgggccucugcuagcgacuccucugcccccuggagccgcuccacagaugggacgauccuggcucagaagcucgccgaagaggucccuauggacguugcgucuuaucuguacaccggagauagccaucaacugaaaagagccaacuguuccggccgguaugaacucgcuggccugccggggaaguggcccgcccuugcuagcgcccacccuucucugcaucgcgcgcucgacacacugacccacgccacaaauuuccuuaacgugaugcugcaguccaauaaaagcagagagcagaaccuccaggaugaccuggauugguaccaagcucugguguggucucuccuggaaggagagcccuccauuagccgggccgcuaucaccuuuucuacagacucccuuagcgccccugcuccccaggucuuccugcaggccacccgcgaggaaucccgcauucuccugcaggaucuuucuagcuccgcgccgcaucuggccaaugcuacgcucgagaccgaaugguuucacggccugcggcgcaaguggagaccucaucugcaccggcgcgggcccaaccaaggaccuagaggccucgggcacagcuggcggagaaaggacggacugggcggcgauaaaucucauuucaagugguccccucccuaucuugagugcgagaaugggagcuacaaacccggauggcuggugacacucucuagcgccaucuauggccugcagccgaaccuuguucccgaauuucgcggggugaugaaggucgacauuaaucugcagaaaguggacaucgaucaauguuccucugacggaugguucagcggcacccacaagugccaccucaacaauuccgaguguaugccuaucaaggggcugggauuuguucugggcgccuacgaaugcauuuguaaagcuggcuucuaccaucccggggugcucccugucaacaauuuucggagacgcggacccgaucagcacaucagcggcucuacaaaggacguguccgaggaagccuaugugugccugccgugucgggaggggugcccuuucugugcggaugacagccccugcuuuguccaggaggauaaauaccuuagacuggcuauuaucucuuuccaggcccucugcaugcugcuggacuuuguuuccaugcuugugguguaucauuuccgcaaggccaaaagcauucgggcuuccggacucauccugcuggaaaccauucucuucggcucucugcuucuguacuuuccugucgugauccucuauuucgagcccagcacguuuagauguauccugcugcgcugggcccggcuucucggguucgcuacaguuuacggcaccgugacacugaagcugcacagaguccucaaaguguuucugucccgcaccgcccaacggauuccuuauaugaccggaggcagaguuaugcggaugcuugcggugauccugcucgucguguucugguuucugauuggguggacaucuagcgucugccagaaccuggaaaagcagaucucccuuauuggacagggcaagacgagcgaucaucucaucuucaauaugugucugaucgaccgcugggauuacaugaccgccguggcugaguuucuguuccuccuguggggaguuuaccuuugcuaugccgugagaacaguccccucugcuuuucacgaaccgcgguacauggccguggcgguucacaacgagcugauuaucuccgccauuuuccauaccaucagauuugugcucgcuagccgccugcaaucugacuggaugcugaugcuuuauuucgcccacacacaucucaccgucacggugacaauugggcugcugcucaucccuaaauucucccacagcucuaacaauccccgggacgauaucgcuaccgaggccuacgaagacgagcuggauaugggcagaagcggguccuaucuuaacagcucuauuaauuccgccuggagcgaacacucccuggaccccgaggauauccgcgacgaacucaagaaacuguacgcucagcuggagauuuauaagagaaagaagaugaucaccaacaauccucaucuucagaagaaacgguguucuaagaaaggccugggacgcagcauuaugagacggaucacagagauuccggaaaccgugucccgccagugcucuaaggaggauaaagaaggcgcggaccacgggacagccaagggaacggcucucaucagaaagaaucccccugagagcuccggcaacaccgggaaaucuaaggaggaaacacugaaaaaccggguuuuuagccucaagaaaucccauagcaccuacgaucacguccgcgaccaaacagaggaaucuuccagccugcccaccgagucucaggaagaggagacgaccgaaaauuccacacuugagagccugucuggaaagaagcucacccagaaacugaaggaagauuccgaggccgaaagcacagaguccgugccucugguguguaaaagcgccucugcucauaaccuuagcuccgagaagaaaaccggccaccccagaacgucuaugcugcagaaaagccucuccgucaucgccucugcgaaagaaaagacacuggggcucgcuggcaagacccaaacagccggaguggaggaacggaccaaaagccagaagccucugcccaaagacaaggagaccaaucgcaaccacuccaauucugauaacacagaaacgaaagacccggccccucagaauagcaaccccgcugaggagccuagaaagccccaaaaguccggcauuaugaaacagcagcggguuaacccgaccacagccaauagcgaccuuaacccugggaccacacagaugaaggauaauuucgacaucggagaagugugccccugggaggucuacgaucugaccccuggccccgugcccucugaauccaaaguucaaaagcaugugagcauugucgcgucugagauggagaaaaacccuacguuuucccucaaggaaaagagccaccauaaaccgaaggcugccgaggugugucagcaguccaaucagaaaagaaucgacaaggccgaaguuugccugugggagucucaagggcagagcauucuggaagaugagaaacuucugaucuccaagacacccgugcucccugagcgcgcuaaggaagagaacggaggccagccccgggccgcuaaugucugugccgggcagagcgaggaacugccucccaaagcgguggccucuaagaccgaaaacgagaaucucaaccaaaucggccaccaggagaaaaagaccuccagcucugaagagaaugugagaggaagcuauaacuccucuaauaacuuccagcaaccucugacaagccgcgcugaagucugcccgugggaguuugaaacccccgcccagccuaaugcuggccgguccguugcccuucccgccucuagcgcucuguccgcgaacaaaauugccgggccuagaaaggaggagaucugggacagcuucaaaguguga

SEQ ID NO: 69934 - RNA, 1083 nt, Artificial Sequence
  derived and/or modified sequence opt5 from GPR15__Homo_sapiens__NP_005281
auggaccccgaggaaaccagcguguaccuggauuauuacuaugccacauccccuaacucugacaucagagagacgcacagccaugucccguacaccuccguuuuccuccccguguuuuauacagcuguguuccugaccggcguccuugggaaucuggugcucaugggagcccugcacuuuaagccuggcucucggcgccuuauugauaucuucauuaucaaccuggcggcuagcgacuuuauuuuccucguuacacugccccuguggguggauaaagaagccucccucgggcuguggagaaccggaucuuuucuuugcaagggcagcuccuacaugaucagcgucaauaugcauuguucugugcugcuccugacaugcauguccguugaccgguaucuugccaucguguggccugucgugagccgcaaauucagacggaccgauugugcuuacguggucugcgccucuauuugguuuaucuccugucugcucgggcugcccacgcugcucagccgcgagcugacccuuauugacgauaagccuuacugcgcugagaaaaaggccacaccgaucaagcugauuuggucucucguugcgcugaucuucaccuuuuucgugccccuucuguccauugugacauguuauugcuguaucgccagaaaacucugcgcucacuaccagcaaagcggaaagcauaacaaaaagcugaaaaaguccaucaagauuaucuuuauugucguggccgcuuuccugguuucuuggcucccuuucaauaccuuuaaauuccuggccaucgugagcggccuucggcaggaacacuaucugcccuccgcgauucuccagcugggcauggaggucagcgggccucuugccuuugcuaacucuugugugaaucccuucaucuacuauaucuuugacuccuacauucgcagagccaucguucacugccugugcccgugucucaagaacuaugauuucggaagcucuacggaaacaagcgacucccaucugaccaaagcucugucuacauuuauucacgccgaggauuucgcccggcgcagaaagcggagcgugucccucuga

SEQ ID NO: 69935 - RNA, 1017 nt, Artificial Sequence
  derived and/or modified sequence opt5 from GPR160__Homo_sapiens__NP_055188
augaccgcccugagcuccgagaacugcucuuuccaguaccaacucagacagacaaaucagccccuggacgugaacuaucuucuguuucucaucauucugggcaagauccuucugaauauucucacgcuggggaugcggcgcaaaaacaccugucagaauuucauggaauacuuuugcaucagccuggcuuucgucgaucuccugcuucugguuaacauuuccaucauccucuauuuuagagacuucgugcugcuuucuauucgguuuacaaaguaccacaucugucuguucacccaaauuaucagcuuuacauauggauuccuccauuacccuguguuucugaccgccugcauugauuauugucugaauuucuccaaaacaaccaagcucucuuuuaaaugccagaagcuguucuacuucuuuacggucauccuuauuuggaucagcgugcuggcguacguucucggcgacccggcuaucuaucagucccugaaggcccagaacgccuacagccgccacugucccuucuaugugucuauucaauccuacuggcuuagcuuuuucauggucaugauccuguuuguggcuuucauuaccugcugggaggaaguuacaacccucgugcaggccaucagaauuacaucuuauaugaaugagaccauccuguacuuuccuuucuccagccauucuuccuauacgguccggagcaaaaagaucuuucuguccaaacucauuguguguuuccugucuacauggcuucccuuugugcugcuccaggucaucauuguucugcuuaaggugcagaucccugcuuacauugaaaugaacauccccuggcuguacuucgugaauagcuuucucaucgccaccgucuauugguucaacugccacaaacugaaucugaaggauauugggcucccucuggacccguucgugaacuggaaguguugcuuuaucccccuuacaauuccuaaucuggagcaaaucgagaaacccauuuccaucaugauuugcuga

SEQ ID NO: 69936 - RNA, 1641 nt, Artificial Sequence
  derived and/or modified sequence opt5 from GPR161__Homo_sapiens__NP_001254540
augaaggugguccagcacgcccugcccaccccuagacggggcgcucucacaaugagccugaacuccucucuuagcugccgcaaagagcuguccaaucucacggaagaggaagggggagagggcgggguuaucauuacccaauucaucgccauuaucgugauuacaaucuuugugugccugggaaaccuugucaucgugguuacccuguacaagaaaucuuaucuccugacacugagcaauaaguucguguuuucccucacccugucuaacuuccuucugagcguccucgugcugccguuuguugugacauccagcauuagacgggaauggaucuucggcgucguguggugcaauuuuucugcgcuucuguaccuccugauuuccagcgcuucuaugcugacccucggggugaucgccauugaccgcuauuacgccguccuguaucccaugguuuacccuaugaaaaucacgggaaacagagcugugauggcccuuguguauauuuggcugcauucccucaucggcugucugcccccucuuuucggcuggagcucugucgaguuugaugaguucaaguggaugugcguggcugccuggcaccgggaacccggguacaccgcguuuuggcagaucuggugugcccuguucccuuuucucguuaugcuggugugcuacggauucauuuuccgcgucgcuagagugaaggcccggaaaguucauuguggcacaguggucaucguggaggaagacgcucagcgcaccgggagaaagaauagcagcacauccaccucuagcuccggaagccggcgcaacgccuuucagggcgucguguauucugcgaaucaaugcaaagcccugauuacgauccucguugugcugggggcuuucauggucacauggggaccguacauggugguuauugccuccgaggcucuuuggggcaagagcucugugagccccucccuggagaccugggccacauggcucucuuuugccagcgcugucugucacccucugaucuauggccuuuggaacaaaaccgugagaaaggaacugcucgggaugugcuucggagaucgguacuaucgcgagcccuuugugcagagacagcggaccuccagacuguucagcaucucuaaucgcauuacagaccugggccucuccccucaucugacggcgcuuauggccgggggacagccccugggccacuccucuuccaccggggauacaggauuuagcuguucccaagacucuggcaccgauaugaugcuccuggaagacuacacaagcgaugacaacccgccuucccacugcaccugucccccuaagcggagaucuagcguuacguucgaggaugaagucgagcagaucaaagaggcugccaaaaauuccauucugcaugugaaggccgaagugcacaagagccuugacucuuaugcugccucccucgcgaaagcuaucgaggccgaagccaagauuaaccuguuuggcgaggaagcucugcccgggguccucgugacagcccgcaccguucccggaggcggguucggaggccggagagggagccgcacccuggugucucagcggcuucagcugcaauccaucgaggagggcgauguccucgcugccgaacagagauga

SEQ ID NO: 69937 - RNA, 915 nt, Artificial Sequence
  derived and/or modified sequence opt5 from GPR162__Homo_sapiens__NP_055264
augcugagcaccggcguggucuccuucuuuucucucaagagcgacuccgcucccccuuggaugguucuggccgugcuuuggugcucuauggcccagacacugcuccugccgagcuucaucugguccugugagagauaccgggcggaugugcgcacggucugggaacaaugcguggcuauuaugucugaggaagacggggaugacgauggaggcugugacgauuaugccgaggggagaguuugcaaagugcgguuugacgccaacggagcuaccggccccgggagccgcgauccugcccaggucaagcuccugcccggaagacacaugcuuuucccuccccuggaacgggugcauuaccugcagguuccucucucccgcagacugagccacgacgagacaaauaucuuuucuaccccgcgggagcccggcuccuuccuucauaaauggucuagcuccgaugacauucgcgugcugccugcucagagcagagcccucggcgggcccccugaauaucugggacaacggcaccgccuugaggaugaagaggacgaggaagaggcggaaggcgggggacuggccucucucagacaguuucuggaguccggcguccuggggagcggaggcgggcccccgcgggggccuggauucuuucgcgaagagaucacaaccuucauugacgagacaccccucccuucccccaccgcuucucccggccauagcccuagacggccgagaccccuggggcuuuccccucgccggcugagccucggaucucccgaauccagagccgugggccugccucuugggcugagcgcuggacgccgguguucucucacgggcggcgaggaaagcgccagagcguggggcggauccuggggccccgggaacccgaucuuuccucagcugacccuguga

SEQ ID NO: 69938 - RNA, 960 nt, Artificial Sequence
  derived and/or modified sequence opt5 from GPR171__Homo_sapiens__NP_037440
augaccaacagcuccuucuuuugccccguguacaaggaccuggagccuuucacauacuuuuucuaucucgucuuucugguuggcaucauugggucuuguuucgccacgugggcuuuuauccagaaaaauaccaaccacagaugcgugagcauuuaucuuaucaaucugcucacagccgauuuccugcuuacccuggcgcucccggugaagauugucguggaccugggaguugcucccuggaaacugaagaucuuucauugucaagugacagccugccucaucuacauuaacauguaucuguccaucauuuuccuugccuuugucucuaucgaucggugucugcagcucacccacagcugcaaaauuuaccgcauccaggaaccuggcuucgcuaagaugauuuccacagugguuuggcugauggugcuucugaucaugguccccaauaugaugaucccuauuaaggacaucaaagagaagucuaacgugggguguauggaauuuaaaaaggaguucggaagaaauuggcaucuccugaccaacuucauuugcguggccaucuuucugaauuucagcgcuauuauccucaucuccaacugucuggucauucggcagcuuuaucgcaauaaagauaacgaaaauuaccccaacguuaagaaggcccugaucaauauucuccuggugacgaccggcuacaucauuugcuuugugccuuaucacaucgucagaaucccguacacacuuagccaaaccgaggugauuacagacuguucuacccggaucucccuguucaaagcgaaggaggccacgcuccugcuggcuguuagcaaccucugcuuugaucccauucuguauuaccaucuuucuaaagccuuccgcuccaaggugacagaaaccuuugcuagcccuaaagagacaaaggcccagaaagaaaagcugagaugcgagaacaaugcguga

SEQ ID NO: 69939 - RNA, 1002 nt, Artificial Sequence
  derived and/or modified sequence opt5 from GPR174__Homo_sapiens__NP_115942
augcccgccaacuauaccugcacaagaccugacggcgauaauacggacuuccgguacuuuaucuacgcugugaccuauacagucauucugguuccggggcucaucggaaacauucuggcccuuuggguguucuacggcuauaugaaggagaccaaacgcgcggugaucuuuaugauuaaucuggcuaucgccgaucuccugcagguccuuagccugccccucagaaucuucuacuaucugaaccacgacuggccuuuugggcccggacuguguauguucugcuuuuaccucaaguacgugaauauguaugccuccauuuacuuccugguuuguaucucugugcggcgcuuuugguuccuuauguauccuuuuagauuccaugauugcaaacaaaaguacgaccuguauauuagcaucgcuggcuggcucauuaucugucuggccugcguccuuuuuccccugcuccggacauccgaugacaccucugggaaccgcacaaaauguuucguggaucugccuaccagaaauguuaaccuggcucagagcguggucaugaugacgauuggagaacucaucggcuucgugaccccgcugcuuaucgugcuguacugcacauggaagaccguccucucccugcaggacaaguaucccauggcccaggaucuuggcgagaaacaaaaggcgcugaaaaugauucucacaugugccgggguuuuucugaucugcuucgcuccuuaccacuuuucuuucccccuggacuuucucgucaagagcaaugaaauuaaauccugucuggcccggcgcgugauccuuauuuuccauagcguggcucugugccucgccucucugaacuccugccuugauccugugaucuacuauuuuagcaccaaugaguucagacggcgccugucuagacaggaccuccacgacuccauccagcugcaugccaagagcuuuguuucuaaccacacggcguccacaaugacccccgaacuguguuga

SEQ ID NO: 69940 - RNA, 1413 nt, Artificial Sequence
  derived and/or modified sequence opt5 from GPR176__Homo_sapiens__NP_001258784
augcccgccccucugcuccugaucagcagaacccuuggcaacuucauggugcugugguccacaugccggacgaccgucuuuaagucuguuacaaaucgcuucauuaaaaaccucgcuuguagcgggaucugcgccucccuggugugugugccguuugacauuauccuuucuaccagcccccacugcuguugguggauuuacacaaugcuguucugcaaggucgugaaauuucuccauaagguuuucuguuccgugaccauccugucuuuuccugcgaucgcucuggauagauauuacagcguccucuauccccuggagcggaaaauuuccgacgccaagagccgcgaacuugugauguacaucugggcccacgcuguuguggccucugucccuguguucgcugugacaaaugucgccgauauuuaugcgaccuccacgugcaccgagguuuggagcaacucucugggacaucucguguacgugcuggucuauaauaucacaaccgugauuguucccguggucgugguuuuucuuuuccugauccucauuagacgggcccuguccgcuagccagaagaaaaaggugaucaucgccgcucugcgcacaccucaaaacaccauuucuaucccguacgccucccagagagaagcggagcuccacgccacgcugcuuagcauggucaugguguuuauucuguguuccguccccuacgcuacacucgugguuuaucagaccgugcugaaugucccugacacaucuguguuccuucugcucaccgccguuuggcugcccaaagugagccugcucgcuaacccuguccuguuucuuaccgugaauaaguccgugcggaaaugccugaucggcacacucguucagcugcaucaccgcuacagcagacggaacgucgugucuacgggguccggaauggccgaagccagccuugagcccucuauucgcagcggcucccaacugcucgagauguuccacaucgggcagcagcagaucuucaagccgaccgaagaugaggaagagucugaggcuaaguauauuggaagcgcggacuuucaagccaaagaaaucuucuccacaugucuggagggcgaacagggcccucaguuugcucccagcgccccuccccugucuaccguggauuccgucagccagguggcccccgcugccccuguugagccggaaacauuccccgacaaguacucucuccaauuuggguucggaccuuuugagcugcccccucaguggcuuuccgagaccagaaauagcaaaaagcggcugcugcccccgcucggcaacacgccugaggaacugauucagacaaaagugcccaaggucgggcgcguggaaagaaaaaugucccggaauaacaagguuucuaucuucccuaagguggauagcuga

SEQ ID NO: 69941 - RNA, 7104 nt, Artificial Sequence
  derived and/or modified sequence opt5 from GPR179__Homo_sapiens__NP_001004334
augggaaccagaggggcugugaugcccccuccgauguggggacugcucggcugcuguuucgucugcgcuugggcucucggcgggccccggccuaucagaagccuucccccucuguccucucagguuaagcccgggagcgugccuaugcaagugccgcucgagggggccgaagcugcccuggccuaccuuuauuccggagacgcucagcagcugucucaggucaacuguagcgagagauacgaagcccggggcgcuggcgccaugcccgggcucccucccucccugcagggagccgccggcacacuggcucaggccgcuaacuuucucaacaugcugcuucaggccaacgauauucgcgagucuagcguggaagaggacguugagugguaucaggcccuggugagauccgucgccgaaggggauccucggguguaccgcgcucuccugacguucaaucccccgccuggagccagccaccuucaacuggcucuccaggccaccagaaccggcgaggaaaccauccugcaggaccugucugggaauuggguucaggaggagaaucccccuggagaucucgacacacccgcccugaaaaagcgggugcuuaccaaugaucugggcucccucggcagccccaaauggccucaagcugacggguaugucggagauacacaacaggugcgccugucuccgcccuuucuugaaugccaagagggcagacugcggccuggguggcucauuacccuguccgcgacguucuacggacugaagcccgaccucagcccugaagugcgcggccagguccagauggauguugaccugcagucuguggauaucaaccaaugugccuccgggcccggaugguauagcaauacccaucuuugcgaccugaacuccacacagugugugccgcucgagucucagggcuuuguccugggcagauaccuuugccggugucgcccuggguucuacggagcuagccccuccggcgggcuggaagagagcgacuuucagaccacaggacaauucggcuuuccugaggggagaucuggccggcuccugcagugccugcccuguccugaaggaugcaccuccugcauggaugccacgcccugucucguggaggaagccgcuguucugagagccgcggugcuugcuugccaggccuguugcaugcuggccauuuuccucagcaugcuggucucuuaucgcugucggagaaauaaacgcaucugggcuagcggcgugguucugcuugagacagugcucuuuggguuccugcugcucuacuuuccggucuucauccuguauuucaagccuuccguguuucggugcauugcccuuagauggguccgccugcucggauucgcuaucguguacggcaccauuauccugaagcuguaucggguucuucagcucuuucugucuagaacagcccaacgcagcgcgcugcucuccagcgggcggcugcuuagacaccugggacuccugcugcuucccgugcucggcuuccuggccgucuggaccgugggggcucuggaacgcggcauucagcaugcgccccugguuauccggggacacaccccuucuggcagacauuuuuaccugugucaccacgaccggugggauuauauuaugguggucgcugagcuucugcuccugugcuggggguccuuccuguguuacgccacacgcgcggugcuuagcgccuuucaugagccgagauacaugggaaucgcucuccacaacgaacugcugcucucugccgcuuuccauacggcccgguuugugcugguucccucccuucacccugacuggacccugcuccuguucuuuuuccacacacauagcaccgucacaaccacgcuggcccuuaucuuuauucccaaauucuggaagcugggcgcuccucccagagaggaaaugguggaugaggugugcgaagacgagcucgaucugcagcacuccgggucuuaucucggaagcuccaucgcgucugccuggagcgagcauucccuggacccuggcgauauucgcgacgaacuuaaaaagcuguacgcucagcucgagguccacaaaacaaaggaaauggccgccaauaacccccaucugccgaagaaacgggggagcucuugucaaggccugggaagauccuucaugcgcuaucuugcugaguuuccugaggcccuggcgagacagcacagccgggauucuggcucccccgggcacggaagccucccuggcucuagccgcagacggcugcucuccagcucucugcaggaacccgaggggaccccggcccuucauaagucccgcagcaccuacgaccaaagacgggaacaggacccuccccugcucgauucccugcugcgcagaaaacuugccaagaaagccucucggacagagagccgcgaauccguggagggaccucccgcucugggcuucagaucugccagcgcgcacaaucucaccguuggggagcggcugcccagagcucgcccugccucccuccagaagucucugagcguggccuccagccgggaaaaagcccuucugauggccucucaggcuuaucuggaggaaacauacagacaagccaaggagcgcgaagaacggaagaaagcgaaggccgcuauggccucccucgucagacgcccgagcgcucggagacuggagcgcccccggggcgccccucuuucugcgcccccuucccccgcuaaauccucuagcguggacagcucccauacgagcggaagacugcacgaagaggcgcggcgcagacucccucacccgcccauccggcaucagguuucuaccccuauucuggcccucagcggcgggcugggagaaccccgcaugcuuuccccuacaucuacccuggcucccgcccugcucccggcccuggcuccuacacccgcccccgcgcuugcuccugugcccgucagcccucaguccccgaaccugcucaccuauaucugccccugggagaacgccgaacugccugccaagcaggagaaugugccccaagagggcccuucugggcccgaaagaggacaccauagcccggcuccugcccgggcgagacucuggcgcgcucuguccguugccguggagaaaucucgggccggcgaaaacgagauggaugcugaggacgcccaccaucagagagaagcuaaugaugucgacgaggaucgccccaagaucuuuccuaagagccacucccuuaaagcccccgugcagcagggcagcaugcggucucuggggcuggcgauuaaggcccucacgagaucccgcagcaccuaccgggaaaaagagucuguggaagaguccccugagggacaaaacagcggcacagcuggggaauccaugggagcccccucuagaagcccgcgccugggcagaccuaaggcugucuccaaacaggccgcccuuauccccagcgacgauaaggagucucugcagaaucaacagaacgcucacaccucccggaugcuccagguuugccagcgcgaagggagcagagagcaagaagaccggggacgcagaaugacacagggccugggcgagcggaaggcggagagagccgggaaaaccggacucgcuaugcugcgccaggugucucgggauaagaauauuaaacagagcaaggaaacgcccgugggcuggcaagagcuuccuaaagccgggcugcagucccugggaucugccgaccauagagucgcugaaguguguccgugggagguuacagaaagcgagacccgccagcccgauuccggcaacaaggccgagaucugcccuugggaaacaucugagggggcgcccgaaagccgggcucucagacaggacccuggagacucccaaaagaaacggggcgaggcccgcggcaagagcgagcccauugauguggucccuaugaugcgcaagaaaccggaacggcuggugcgcgagcaggaagccguuugucccugggagucugcugacagagggggacuuuccccuggcagcgcgccccaggauccugggcggauccgcgacaaauccgaagcgggagauucuguggaggccagaaaagucgagaaacccggcugggaagcugccgggccggaggcucacaccccugacaucaccaaggccgaacccugccccugggaggcuagcgaaggaggcgaggauggcaagccugcccaggaggcggugaaagaccugccccaagaaaagcagaaaacacggaaggccacguucuggaaagagcagaagccugggggagaucucgaaucccuguguccgugggagucuaccgacuuucgcggccccagcgcuguuuccauucaagccccugggagcucugaaugcuccggaagccugggcucugggaucgcugaggugugucucugggaggccggagaugcccccgcuauucagaaggcggaaaucugcccuugggagcuugacgauaaugucaugggccaggaaaugcugucccugggcacagggagagagagccuccaggagaaagaaaaggccucucggaaaggcagcuucggcgagaugggggaacaaaccgugaaggcugugcagaaacugucccagcagcaagagucugucugucccagagaaagcacaguuccgggacauuccagcccuugccuugacaacuccucuagcaaggccggcucccaguuucuguguaaugggggaucucgcgccacccaggugugcccccaggaggaccuccggccugaggcucaagaagccacgcccgcgaagacagagauuugcccuugggaagugaacgagagaacccgcgaagaguggaccagcgcccaggucccccggggcggcgagucccagaaagauaaggagaaaaugccggggaagucugagaucgaagacgugacagcuugggagaaaccugaaggacaaauucagaagcaggaggccguuggccccugggagagcguggaucccggguccuucagcccucagccgagaccccaagacaccgaacgcccucagacacugcugcagaugucuggauccgucggcagcaaggcugccgauaucuguccccucgacguggaggaaaaucuuacggcggggaaagccgagaucugcccuugggagguuggagcuggcgccggcgaggaacgggcucugggggccgaagcuauuagaaagucucccaacgauaccggaaaaguguccgccgaccugggcccucgcgagcgggcggucacagcccccgaaaagccgcagaaaccuacccccgagugggagguggcuuguccuugggggagcgucggacccggcgccugcucucaacacccggggacacucgaugcugacggcccuaaggccggauuucaggaacuggaucauaugggcuguagacccggggaggugugccccugggaagcccaggaggcggcuaccuccgaaaaagccaagaucuguccuugggagguuagcgagggaacgaccggcaaggggcuugaccagaaagcuggauccgaaagcgccgagcaacgcgaaaaggcccuggagaaaggccggcucacaucucugggggaagacgugagcaagggcauggcuaaacugugccagcagcaggagaccauuuguaucugggagaauaaggaucucagagaaucccccgcccaagcgccuaagauuucugaccuuccgagcuccaugucuagcgaggucgccgaaggacacucccuggaggcuacagagaaaggcgaucugcgccaggaccccaagaccgggucuuucccugaacacaucacacaggagaaagcccccgcugccgauaccgaagaguuuacgacagaagacggagagaagaccagccaugagcuccaauccgugugcccuugggaaaccacagcgcccgccgauagcguuucucaccuggacagacagcggccugaucagccgaaggcuagcagccagcgccuugugucuaccggcgggagagccgcugacgucugucccugggaugugccugacgccggaguguacaaguccgauagcuccgcuaaggccgagacgugccccugggaaguuacagagcggaucccugucaaaggcgugucuagacaagacgggaagggcgacagccaggaagagaaaggacgggcgcccgagaaguccgaaccgaaaggcgugccuguccagaagaagcccgagauggccgauuuccgccagcaagaagcugugugccccugggagagccaggacgggaaaggacugucuccucagcccgccccugaugcuuccgacagaagccggggcucuagcgaagccgccggguccguugagacccgcguggcggaggucugucucugggaagugguugaggcuccgucugccaagaaagccgaaauuugccccugggaggcuggaggcggcgccgcugaggaaggggagcaggaaagagagagccaaggacagggcgaaauguuucugcagaaggccgggccuggaggcacagaggagcauuucuccaaagcggccgcuaagccccgggaacaagaggccguguguccuggggaaggaaccggcucuggcgggcugcucccccagagcggagcucuugauccggagcugaaggucuccccuaaagaagccggcagcauggggucucgcauggcggagcugugccagugggagaucacagaccccgaaggaaacaagauuaaaggcaccauggccgauaucuguccuggggaggaaacgggagugcccuccgaggaaagcggccuccuggcucuuaccgccacaagacgggaguucuuuccgaccgcuccugagaagccccugugccuccugguucacggcccccuggaccacuucuuuccugaauccaaaauucccuguccuaaggugucucgcccggccagcacauucacccucgagggggucagagaacuucagggacccuccggccuggagccucggacgucucuggcucccgagccuagccuccaagaagccgagucccaguccucuucccugacagaagauagcggacagguggcguuugaggcccaguaugaagaguucacacccccuacaguguacccgugggacugggaguga

SEQ ID NO: 69942 - RNA, 1020 nt, Artificial Sequence
  derived and/or modified sequence opt5 from GPR17__Homo_sapiens__NP_001154889
augaacggccuggagguggcucccccugggcucaucaccaauuucagccuggccacagccgaacagugcggacaagagacgccgcuugaaaacaugcuguuugcguccuucuaccuccuggacuuuauucuugcucuggucggcaauacccucgcccuguggcuguucaucagagaucacaagucugggacacccgccaacguuuuucucaugcaucuggcuguggccgaccuuagcugugugcugguccucccuacccggcugguguaucacuucuccggaaaucauuggcccuuuggcgagauugcuugccgccuuacaggguuccuguuuuaccucaacauguaugccucuaucuacuuccugaccuguauuagcgcggauagauuucuggccaucguucacccugugaaaucccucaagcugcggcgcccccuuuaugcucaucuggccugcgcuuuccucugggucgugguugccguggcgauggccccucugcuugucucuccgcagacagugcagaccaaucacacgguggucugucugcagcucuacagagaaaaagcuagccaccaugcccugguuucccuggcuguggccuuuaccuuccccuucaucacaaccgugacaugcuaucuccugauuauccggagccuucgccaaggacugagagucgagaagcggcucaaaaccaaggccgugcgcaugauugcuaucguucuggcgauuuuucuuguguguuucgucccuuaccacgugaacagaucuguuuacgugcugcauuaucggucccacggcgccagcugcgcuacgcagcgcauccucgcccuggccaauagaauuacaucuugucugaccucccucaacggcgcucuggaccccaucauguacuuuuucgucgccgagaaguuucggcacgcgcuuugcaaucugcucugugggaaacgccugaagggaccucccccgagcuucgaaggcaaaacaaacgagucuucccugagcgcuaaguccgaacuuuga

SEQ ID NO: 69943 - RNA, 1323 nt, Artificial Sequence
  derived and/or modified sequence opt5 from GPR180__Homo_sapiens__NP_851320
augggcgggcugagacuccuggccguggcucuuaccugcuguugguggccccagggaagccaaggcaagacacugcggggguccuucucuagcacggccgcgcaggacgcucagggacagcgcaucggccacuuugaguuccauggggaucacgcccuccugugcgucagaauuaacaauaucgccguugcugugggaaaagaagccaaacuuuaccuguuucaagcucaggaguggcucaagcugcagcaguccucucauggcuauagcuguuccgaaaagcugucuaaagcccaacucaccaugacaaugaaccagaccgagcacaaucugacagugagccagauuccuuccccgcagaccuggcaugucuucuacgcggacaaguauacaugccaagaugacaaggaaaacagccagguggaggauauccccuuugagaugguucuucugaauccugacgccgaaggcaaccccuucgaucacuuuucugcuggggaguccggacuccacgaauuuuucuuccugcuugugcuggucuacuuugugauugccuguaucuaugcucagagccucuggcaagccaucaaaaagggcgggccuaugcauaugauucugaaaguucugaccacggcgcuccugcuucaggccggaucugcucuggccaauuacauccacuucuccagcuauucuaaggacggcauuggggugcccuuuaugggaucccucgcugaguucuucgauaucgccagccagauucagaugcuguaccuucugcucucccugugcaugggcuggaccaucguccggaugaaaaagucucaaagccgcccucugcagugggacuccacaccggccagcaccggcauugcuguguuuaucgugaugacacagucuguccuccugcuuugggagcaguucgaagauaucucccaucacagcuaccacucucaucacaaccuggcggggauucuccugaucguucuuagaauuugucuggcccucagccugggaugcggccuguaucaaaucauuaccguggagcgguccacgcucaagcgcgaauuuuacaucacauucgcuaaaggguguauccugugguuucuuugccaucccgugcuggccuguauuucugucaucuucagcgacuaucagagagauaaggugauuaccaucggaguuauucucugccaguccgugagcauggucauccuguaccggcuguuucuuucucacucccucuauugggaggugagcucucuguccagcguuacacugccucucaccaucuccucuggccauaaaagccgcccccacuucuga

SEQ ID NO: 69944 - RNA, 1215 nt, Artificial Sequence
  derived and/or modified sequence opt5 from GPR182__Homo_sapiens__XP_011536129
augagcgugaagcccuccuggggcccugggccgucugagggagucaccgccguucccacaagcgaccugggcgaaauccacaacuggacggagcuccuggaucuuuucaaucauacccuguccgaaugccacguggagcucucucagagcacaaaaagagugguccuguuugcucuuuaccuggccauguucgugguugggcucguggaaaaccugcuggucauuugugugaauuggcggggauccggccgcgcggggcucaugaaccuguauauccuuaauauggcuauugccgaccugggaaucguucucucucugccuguguggaugcuugaggucacccuggauuacacauggcucuggggcagcuuuuccugcagauucacccauuauuuuuacuucgugaacauguauagcucuaucuuuuuccuggugugucuguccgucgaccgguacguuacacucaccagcgccucucccuccuggcaacgcuaucagcacagagugcggcgcgcuaugugcgccggcauuugggugcugagcgcuaucauuccucuucccgaggucgugcauauccagcugguugaagggccugagccgaugugucucuuuauggcccccuucgaaacguacucuaccugggcgcuggccguggcucuuuccacaaccauucugggauuucuccugccuuucccccugaucacagucuuuaaugugcucaccgccugcagacugcggcagccuggccaacccaagagccgcagacacugucuucugcucugcgcuuacguugccguguucgucauguguuggcugccguaucacgugacgcuucugcuccugacacugcaugggacccacauuucccuccauugccaccugguccaccuucuguacuucuuuuaugaugugaucgacuguuucucuaugcuccauugcguuauuaacccuauccuguacaauuuucugagcccccacuuccggggacgccuucucaacgcggugguccauuaucugccuaaagaucagacaaaggccgggaccugcgcuuccucuagcuccuguagcacccagcacucuaucauuaucacaaaaggcgacagccagcccgccgcugccgcuccccauccugagccgucccugucuuuucaagcccaccaccuccugcccaauacgagcccuauuucccccacccagccucuuacacccagcuga

SEQ ID NO: 69945 - RNA, 1086 nt, Artificial Sequence
  derived and/or modified sequence opt5 from GPR183__Homo_sapiens__NP_004942
auggacauccagauggccaacaauuucacacccccuagcgcuaccccgcaaggcaacgauugcgaccuguacgcccaccauuccacggcgagaauugugaugccccuccacuauucucuggucuuuaucauugggcuuguuggaaaucugcucgcucugguggugaucguccagaaccggaagaaaauuaauagcaccacacuuuacuccaccaaccuggugaucucugauauccucuucacaaccgcccugccuacacgcauugccuauuacgcuaugggcuuugacuggagaaucggggaugcccugugucggauuaccgcucucguuuucuauaucaauacguacgccggagugaacuuuaugaccugccugagcauugaccgcuucaucgcggucgugcauccccuuagauauaauaagauuaaacggaucgagcacgccaagggcguuuguaucuuuguguggauucuggucuucgcucagacacucccucugcuuaucaaccccauguccaaacaggaagccgagcgcauuaccugcauggaauacccuaauuuugaggaaacaaagucucugccguggauccuccugggggcuuguuucauuggauacgugcugccccucaucaucauucugaucugcuauagccaaauuuguugcaaacuuuuuagaaccgccaagcagaacccucugacggagaaguccggcgugaauaaaaaggcgcucaacacaaucauucugaucaucgucguuuucgugcuuuguuuuacccccuaccauguggccauuauccagcacaugauuaaaaagcugcgguucagcaauuuccucgagugcucucagcgccacuccuuucaaaucagccugcauuucacagucugucugaugaacuuuaacugcugcauggauccuuucauuuacuuuuucgcuuguaagggcuauaaaagaaaggugaugcggaugcucaaacgccagguuucuguguccaucagcucugccgucaaguccgcucccgaagagaauagcagagaaaugaccgagacccagaugaugauucacuccaaaucuagcaacgggaaguga

SEQ ID NO: 69946 - RNA, 1305 nt, Artificial Sequence
  derived and/or modified sequence opt5 from GPR19__Homo_sapiens__XP_011518926
augaaggaggccagcuucuuuuucucccccaccagaaucaaacggaagaaagugaacauggucuuugcucaccgcauggacaauucuaagccccaucugauuaucccgacacuccugguuccccuucagaacagaagcugcacggaaaccgccacaccucugcccucccaauaccucauggagcugucugaggaacacagcuggauguccaaucagaccgaucuucauuaugugcugaaaccuggcgaaguggcgacagcuucuauuuucuuugggauccucuggcuguucagcauuuuuggaaacucccuggucugucucgugauccaccggagccgcagaacccagucuacaaccaauuacuucguuguguccauggccugcgccgaccugcuuaucagcgucgcuucuacgcccuuugugcugcuccaguucaccacaggccgguggacccugggguccgccacauguaagguugugcgcuauuuucaauaccuuaccccuggaguccagauuuaugugcugcucagcaucugcauugauagauucuacacgaucguguauccgcugucuuuuaaggucucccgggagaaagcuaagaaaaugauugccgcgagcuggguuuucgacgccggcuucgugacacccgugcuguuuuucuacggguccaacugggauucucauuguaauuacuuucucccuagcuccugggagggaaccgcuuauacagucauccacuuccuggugggcuuuguuauucccagcgugcuuaucauccuguucuaccagaaggucauuaaauauaucuggcgcauuggcaccgacgggagaaccgugcggcgcacaaugaacaucguuccuagaacgaaggugaagaccauuaaaauguuucucauccugaaucuucuguuccuccugucuuggcugcccuuucacgucgcccagcucuggcauccgcacgaacaagauuacaagaaauccagccugguguucacagcuaucaccuggauuucuuuuagcuccucugccagcaagccuacacuuuauuccaucuacaacgcgaauuuccggcgcggaaugaaagagaccuuuugcaugagcucuaugaaguguuauagauccaacgccuacacgauuacaaccagcucucggauggcuaaaaagaauuacgucggcaucuccgaaauucccagcauggccaagaccaucacaaaagacuccaucuaugauucuuucgacagagaggcuaaggagaaaaagcuggccuggccuauuaacagcaauccucccaacaccuucguguga

SEQ ID NO: 69947 - RNA, 1068 nt, Artificial Sequence
  derived and/or modified sequence opt5 from GPR1__Homo_sapiens__NP_001091669
auggaggaccuggaagagacccucuucgaagaguuugaaaacuacagcuaugaucuggacuacuauucccuugagucugaucuggaggaaaaggugcagcucggcgucguucacugggugagccuggugcuuuacugccuggccuucguccucgggauccccggaaaugcuauugugaucugguuuacaggcuucaaauggaagaaaacgguuaccacacugugguuucugaaccucgccauugcggacuucaucuuucugcuuuuccugccucucuauauuuccuacguggcuaugaauuuucauuggccguucgggaucuggcuguguaaggccaacucuuuuaccgcccaacuuaauauguucgcuagcgucuuuuuccugacagugaucucccucgaucacuauauucaucugauccaccccguucugucucauagacaccggacccucaaaaacagccugauugugaucauuuucaucuggcuucuggccucccucauuggaggcccugcucuguacuuucgcgacacagucgaguucaauaaccacacccuuugcuacaauaacuuucagaagcaugaucccgaccugacgcucaucagacaccaugugcugaccugggugaaguucaucauuggguaucuguuuccucuccugacaaugagcaucuguuaccuuugccugauuuucaaagucaagaaacggucuauccucauuuccagccgccacuuuuggaccauccugguugugguggucgccuucgugguuuguuggacacccuaucaccuguuuucuaucugggaacuuaccauucaucacaauuccuacagccaucacgugaugcaggcgggaaucccucucucuacgggccuggccuuccugaacuccugccucaauccgauucuguauguccuuaucagcaagaaauuucaggcuagauuccgguccucuguggccgagauucugaaguacacacucugggagguuagcuguuccggcaccgugagcgaacaacugcgcaacucugagacaaagaaucugugccuucucgaaaccgcucaguga

SEQ ID NO: 69948 - RNA, 1077 nt, Artificial Sequence
  derived and/or modified sequence opt5 from GPR20__Homo_sapiens__NP_005284
augcccagcguguccccugccggcccgucugcuggggccguccccaacgcgaccgcuguuacaacggugagaaccaaugccagcggacuggaggugccucucuuccaccuguuugcccggcuugacgaggaacugcauggcacauuccccgggcucuggcuggcucuuauggccguccacggagcuaucuuucuggccggccucgugcugaacgggcuggcgcucuacguuuucugcugucgcaccagagccaagacaccuuccgugauuuauaccaucaaucuggucgugacagaucuucugguuggacucucucugcccacccgguuugcuguguacuauggcgcccgcggcugccuuagaugugcuuucccucauguccugggguacuuucucaacaugcacugcagcauucuguuccugacguguaucugcguggaccgguaucucgccauugugcgcccggaaggauccagacggugucgccagcccgcgugcgccagagcugucugugccuuuguuuggcuggcugccggcgccgugacccuuucugugcugggggucacaggaagccggccuugcugucgcguguucgcucucaccguucuggaguuucuucugccccuccuggugaucuccgucuucacaggcagaaucaugugcgcgcugagccggccugggcuccugcaucaaggacgccagagacgggugagagccaugcagcuucugcucaccguucugauuaucuuucuugugugcuucacgcccuuccacgcucgccaggucgccguggcccuguggccggauaugccucaccauacaucucucgucguguaccacguugcugugacccuguccagccucaauucuuguauggaccccauugucuauugcuuugugacauccggcuuccaagccaccguucggggccuguuugggcagcauggagaaagagagccuagcucuggcgauguggucuccaugcaccgcagcuccaaagggucuggacggcaccauauccugagcgcgggcccccacgcucuuacccaggcccuggccaacgggcccgaggcuuga

SEQ ID NO: 69949 - RNA, 1302 nt, Artificial Sequence
  derived and/or modified sequence opt5 from GPR22__Homo_sapiens__XP_011514358
augugcuucagccccauccuggagauuaacaugcaguccgaaucuaauaucaccgugagagacgauauugacgauaucaacacaaauauguaccaaccucucagcuauccgcuguccuuucaggucucucuuacgggcuuccugaugcucgagauuguucuggggcuuggaagcaaccugaccgugcucgugcuguacuguaugaaguccaaucugaucaacucugucagcaauaucauuacaaugaaccuccacgugcuggacguuaucauuugcgugggcuguaucccccuuaccauugucauccugcuccugucccuugaaagcaauacagcccugauuugcuguuuucaugaggcuugcgugucuuucgccuccguuagcaccgcgaucaacguguuugcuaucacacucgaucgguaugacauuucugucaaaccugccaaucgcauccugaccauggggagagccgugaugcugaugauuuccaucuggauuuucagcuuuuucucuuuucucauccccuucaucgaagugaacuuuuucucccugcagagcggaaauacgugggagaacaagacccuucugugugucuccacaaaugaguacuauaccgaacucggcauguacuaucaucugcuuguucagauuccuaucuuuuucuucacagugguggucaugcugauuaccuacacgaaaauccuccaagcucugaacauucggaucgggacacgcuuuucuaccggacagaagaaaaaggccagaaagaaaaagacaaucagccugaccacccagcacgaggcuacagauaugucccagagcucuggcggccggaacgugguuuucggggugcgcacguccgucagcgugauuaucgcccucagacgggcgguuaaacgccacagagaacggcgcgagagacaaaagcggguguuucgcaugucucugcuuauuaucagcaccuuccugcucugcuggacacccauuuccguccugaauaccacaauccuuugucugggaccuucugaccuccuggugaaacugagacucugcuuucuggucauggccuacggcaccacgauuuuccauccgcuucuguaugcuuuuacacggcagaaguuccagaaggugcucaaaagcaagaugaaaaagagaguuguguccaucgucgaggccgauccccugccuaacaaugcugugauccacaacagcuggauugaccccaaacgcaauaagaaaaucaccuuugaagauucugagauucgggaaaagugucugguuccucagguggucaccgacuga

SEQ ID NO: 69950 - RNA, 1014 nt, Artificial Sequence
  derived and/or modified sequence opt5 from GPR26__Homo_sapiens__NP_703143
augaacagcugggacgccggccuggcugggcuccuggugggaaccaugggcgucucccuucugucuaaugcccucguucugcuuugccugcuccacagcgcggauaucagacggcaggcucccgcccuguucacacugaaccucacgugugggaaucugcuuugcaccguggugaacaugccucugacacucgccggagucguggcucaacgccagccggccggcgacagacugugucggcuugcugccuuucuggauaccuuccucgcggccaauuccaugcugucuauggcugcccugagcauugaccgcuggguugcuguggucuuuccccucuccuacagagccaagaugcggcugcgcgaugcggcccuuaugguggcuuauacauggcugcaugcccucaccuucccugcugccgcccuggcucuuucuuggcugggguuucaccagcucuacgcgagcugcacacuguguuccagacggcccgacgagcgccugagauucgccguuuuuaccggagcuuuccaugcccucagcuuucugcuuucuuucgugguccugugcuguacguaucucaaagugcugaagguggcccgguuucacugcaaacgcaucgaugucauuaccaugcagacacuuguucugcucguggaccugcauccuuccgugagagaacggugucuggaggaacaaaagcgcagacggcagagagcuaccaaaaagaucagcacauucauuggcaccuuucucgucugcuucgcccccuacgugaucacgcgccugguugagcuuuucucuacagugccuaucggcucccacuggggaguccugagcaagugucucgcguauucuaaagcugccuccgauccguuuguguacagccugcugcggcaccaguauagaaaguccugcaaagaaauucuuaaccgccuccugcaucggagaucuauccacagcuccgggcugaccggcgacagccauucucagaauauucuccccguuuccgaguga

SEQ ID NO: 69951 - RNA, 1146 nt, Artificial Sequence
  derived and/or modified sequence opt5 from GPR34__Homo_sapiens__NP_001091048
augagaagccacaccaucacaaugacgaccacauccgugucuagcuggcccuacuccucucaucggaugcgcuucauuaccaaccacagcgaccagccuccgcaaaauuuuuccgccacacccaacgucaccacaugcccuauggaugagaagcugcucucuaccguucugacgaccagcuauuccgugaucuucauugugggccuugucgggaauaucauugcucuguacguguuucucggaauccauagaaaacggaacagcauccagauuuaucugcuuaauguugccaucgcggaccugcuccugauuuucugucugcccuuucgcaucauguaccacauuaaccagaauaaguggacacucggcgugauccugugcaaagucguggggacccuuuucuauaugaacauguacauuucuaucauccugcucggauuuauuucccuggauagauauaucaagauuaaucggagcauccagcaacgcaaagcuauuacaaccaagcagucuaucuacguuuguugcaucguguggaugcuugcccugggcggguuccucacgaugauuauccugacacugaagaaaggaggccauaacuccaccauguguuuucacuacagagacaagcacaaugccaaaggcgaagcuauuuucaacuuuauccucgucgugauguucuggcugauuuuucuucugaucauccucagcuauauuaagaucgggaaaaaucugcuucggauuucuaagcgcagauccaaguucccuaacagcggaaaauacgccacaaccgcucgcaauuccuucaucgugcugauuaucuuuaccauuugcuucguccccuaucaugccuuucgguucaucuacaucucuagccagcucaacguuuccagcuguuauuggaaggagauugugcacaaaacaaacgaaaucaugcuggugcugucuuccuuuaauagcugccucgauccugucauguacuuccugaugucuagcaacauuagaaagaucaugugucagcuucuguuucggcgcuuccaaggcgagccguccagaucugaaagcacguccgaguuuaaacccggguauagccuccaugacaccucuguggcgguuaagauucaguccagcucuaaauccacauga

SEQ ID NO: 69952 - RNA, 1023 nt, Artificial Sequence
  derived and/or modified sequence opt5 from GPR35__Homo_sapiens__NP_001182311
augcugagcggcuccagagccgugcccaccccucaccgggggucugaggaacuccugaaguacaugcuucauagcccgugcgucucccugacaaugaacggaacguauaauaccuguggcucuagcgaccucacauggcccccugcuaucaaacugggguucuacgccuaucuuggaguucugcucgugcugggccugcuccugaacucccuugcgcuguggguguuuugcugucgcaugcagcaauggaccgagacaagaauuuacaugaccaaucucgcugucgccgaucugugccuucuguguacacuccccuucgugcugcacucucugcgggacaccagcgauacgccucucugccagcugucccaggggaucuaucuuaccaaccgcuacaugagcauuucucugguuacagccaucgcuguggacagauaugucgccgugcggcauccccuccgcgcuagaggacugcgguccccucgccaggccgcggccguuugugcugugcuuuggguccuggugauuggcagccucguggccagauggcugcugggcauccaagaagggggauuuugcuuccggucuacccgccacaauuuuaacuccauggcuuucccgcuccugggcuuuuaccuuccccuggccgucguuguguucuguagccucaagguggucacagcgcuggcccagagaccucccaccgauguggggcaggcugaggccacgcggaaagcugcccgcaugguuugggccaaucuucugguguuugucgugugcuuccucccucugcauguuggacugacagugagacucgcugucggcuggaacgcgugugcccugcuugaaaccauccggagagcucuguacauuacaucuaagcucuccgacgccaauugcugccuggaugccaucuguuauuacuauauggcuaaagaguuucaggaggccagcgcgcuggcuguggcccccuccgccaaggcucacaagucucaagacagccuuugcgucacccucgccuga

SEQ ID NO: 69953 - RNA, 1842 nt, Artificial Sequence
  derived and/or modified sequence opt5 from GPR37__Homo_sapiens__NP_005293
augagagcccccggcgcucugcucgcccggaugagccgccugcuucugcuccugcuucugaagguguccgcgucuagcgcucucggggucgccccugccuccagaaacgagaccugccugggagaaucuugugcuccgacaguuauccagcggcgcggcagagacgccugggggcccggaaauagcgcucgggaugugcugcgcgccagagcgccucgggaggaacaaggcgccgcuuuccucgccgggcccuccugggaccugccugcugcccccggacgcgauccugcggccggcagaggcgcugaggccucugcugccgggccgcccggaccucccacgcggccucccggcccguggcgcuggaaaggggccagaggacaggaaccuagcgagacccuuggccgggggaaccccacagcucugcagcucuuucugcagauuuccgaggaagaggaaaagggaccucgcggcgcgggcaucagcgggagaucucaagagcaguccgugaaaaccguccccggagccagcgaccuuuucuacuggccccggagagcuggcaagcugcaggggucucaccauaaaccucucuccaagacagccaauggacuggccggccacgagggguggaccauugcucugccgggacgcgcccucgcgcagaacggcagccugggcgaagggauccaugagcccggaggcccucggagagggaauagcacaaaccgccgggugagacuuaagaaucccuuuuauccucugacccaagaauccuacggagcuuaugccguuaugugccucagcguggucauuuucggcacggggaucaucggcaaccuggccgugauguguauuguuugccacaauuacuauaugcgcuccaucucuaacagccuucuggcuaaucucgccuuuugggauuuccugauuaucuuuuucugucugccccucgugauuuuucaugagcugaccaaaaaguggcuucuggaagacuucuccugcaaaaucgucccguacauugagguggcuagccucggagugacaaccuuuacacugugugcccuuugcaucgaucgguucagagcggccaccaacguccagauguauuacgagaugaucgaaaauuguucuuccacgacagcuaagcuggccguuauuugggugggcgcucuccugcuggcccucccugaggugguccugcgccagcuuagcaaagaagaccugggguuuucuggacgggcgcccgccgagagaugcaucauuaagaucagcccugaucuccccgacaccauuuacgugcuggcucugacauaugauuccgcccgccuuuggugguacuucggcuguuauuucugccucccuacccuguuuaccaucacaugcucucugguuacggcucggaagaucagaaaagccgaaaaggccuguacccgggggaacaaacgccagauucaacucgagagccagaugaauugcacaguggucgcucugaccauccuuuacggauucuguauuauccccgagaacauuugcaacaucgugacagcguauauggccaccggcguuucccagcaaacgauggaccugcucaauaucauuagccaguuucugcuguucuuuaagucuugugugacaccgguccuucucuucugccuguguaaaccuuuuuccagagcuuucauggaaugcuguugcuguugcugcgaggaauguauccagaagucuucuaccgugaccuccgaugacaacgacaaugaguacacaaccgaacuggagcucagccccuuuuccacaauucggagagagaugucuacguucgccagcgucgggacccacugcuga

SEQ ID NO: 69954 - RNA, 1446 nt, Artificial Sequence
  derived and/or modified sequence opt5 from GPR37L1__Homo_sapiens__NP_004758
augagauggcuguggccccucgccgugagccuggcugucauccuugccguuggccugucccgggugucugggggagcgccucuccaccugggccgccauagagcugagacccaggaacaacagagccgguccaagcgcgggacagaggacgaagaggccaaaggagugcagcaguacgucccggaagagugggccgaguaucccagaccuauucaccccgcuggccuucaaccuacgaagccccugguggccaccucuccuaacccggggaaagauggaggcacacccgacagcggccaggaacuccgggggaaucugaccggagcuccuggccagcgccugcagauccaaaacccccucuacccuguuacagaguccucuuauagcgccuacgcgauuaugcugcuugcccugguggucuucgcuguggggaucguuggaaaucucuccgugaugugcauugucuggcauagcuauuaccugaagucugccuggaacuccauccuugcuagccuggcccucugggauuuucuggugcuguucuuuugucuccccaucgugauuuucaaugaaaucaccaaacagagacugcuuggcgacgucucuugccgggcgguuccguuuauggagguguccagccugggggugacaaccuucucucucugugcccugggaauugaucgcuuucacgucgcuacguccacccuuccuaaggugagacccaucgagcggugccagagcauucuggccaagcucgcuguuaucugggugggcuccaugacacuggccgucccugaacugcuccuguggcagcuugcccaagagcccgcucccaccaugggcacacuggacucuuguauuaugaaaccuagcgcgucccucccggaaagccuguauucucuugugaugaccuaccagaacgcccgcauguggugguacuucgggugcuauuuuugucugcccauccucuucacgguuacaugccagcuggugaccuggagaguccggggaccucccggccgcaaguccgaguguagagcuagcaaacaugaacaaugcgagucucagcugaauagcacaguggucgggcucaccgugguuuacgccuuuuguacccugccugagaacgugugcaauaucgucguggccuaucuuuccacagaacugacgcggcagacccucgaucugcugggacuuauuaaccaguucucuacauuuuucaagggcgcuaucacccccguucuccugcugugcauuuguagaccgcucgggcaagccuuccuggacugcuguugcuguugcuguugcgaggaauguggaggcgcgagcgaggcuuccgccgccaauggcagcgauaacaaacuuaagacagaagugucuuccagcaucuacuuucacaagccucgcgagucucccccucugcucccccuggggaccccuugcuga

SEQ ID NO: 69955 - RNA, 1362 nt, Artificial Sequence
  derived and/or modified sequence opt5 from GPR39__Homo_sapiens__NP_001499
auggccagccccucccugccuggcucugacugcagccagaucauugaucacucccaugugccggaguucgaagucgcuaccuggaucaagauuacacucauccugguuuaccuuauuaucuuugugauggggcugcucggaaacucugccacgaucagagugacccaaguccugcagaaaaagggcuaucuucagaaagaggugacagaccacaugguuagccuggcguguuccgauauucucguguuccugaucgggaugcccauggaauuuuacucuauuaucuggaauccucugaccacaagcuccuauacccucagcugcaagcugcauacauuccuuuuugaggcuuguucuuacgccacccugcuccacguccugacgcuuuccuucgaacgguauauugccaucugccaucccuuucgcuacaaagcugugagcggaccuugucagguuaagcugcucauuggcuucgugugggucaccucugcccugguggcucugccccuccuguuugccauggggacagaguauccucuugugaacgucccgucccacagaggacugaccugcaaucggagcucuacacgccaccaugagcaacccgaaaccuccaacaugagcaucuguacgaaucucuccucuagauggacaguuuuccagagcuccaucuuuggcgcguucgugguguaccuggucgugcuucugagcguugccuuuaugugcuggaacaugaugcaagugcucaugaagucucagaaaggcucccuggcugggggaacccggccuccccagcugcgcaagagcgagucugaagagagcagaacagcccggcgccagaccauuaucuuccucagacugauugucgugacccuugcuguuuguuggaugccuaaucagauccggcgcauuauggccgcggccaaacccaagcacgacuggacaagauccuacuuccgggcuuauaugauccugcucccguuuucugagacguucuuuuaccugagcuccgugaucaacccucuucuguauaccgucagcucucagcaauuccgcagaguguuuguccaggugcucugcugucggcugucccugcagcaugccaaucacgagaaaagacuccgcguucacgcucauagcacaaccgauucugcccgguucgugcaaagaccccugcuuuuugccucccgccggcagagcuccgcuagacgcacagaaaagauuuuccugucuaccuuucagagcgaagcggagccucaguccaagucucaaagccucucccuggaaagccuggagcccaacucuggcgccaaacccgcuaauuccgccgccgagaacggguuccaggaacacgaggucuga

SEQ ID NO: 69956 - RNA, 1089 nt, Artificial Sequence
  derived and/or modified sequence opt5 from GPR4__Homo_sapiens__NP_005273
augggcaaccacaccugggaggggugccauguggacagcagagucgaucaccuguuucccccuucccucuacaucuuuguuauuggagugggccugccgacaaauugucuugcccugugggcugccuaucggcagguucaacagcgcaacgaacucggggucuaccugaugaaucuuucuaucgcggaccugcucuauauuugcacgcugccccuguggguggauuacuuccuccaucacgacaacuggauccauggaccuggcagcuguaagcuguuuggguucauuuucuauaccaauaucuacaucuccauugcuuuccuuugcuguaucucuguugauagauaucuggccguggcccacccccuccgguuugcucgccugagacgggucaaaacagccguggcuguuagcuccguggucugggccaccgagcuuggagcgaacucugccccucuguuccacgacgaacucuuucgcgauagauacaaucauacauucugcuuugagaaguuccccauggaaggcuggguggcuuggaugaaccuguaccggguguuugucggcuuccuguucccuugggcccucaugcugcuuagcuaucgcgggauucugagagcuguucggggauccgugagcaccgagcgccaggagaaagccaagaucaaaagacucgcgcugucucuuauugccaucgugcuggucuguuuugcuccguaccacgugcuccugcugucccggagcgccauuuaucucggccgccccugggacugcggguucgaagagagaguguuuucugcuuaccauuccagccuggccuucacaucucuuaauuguguggccgauccuauccuguauugccucgucaacgaaggagcucgguccgacguggcgaaggcccugcacaaucuucugagauuucucgcuagcgauaagccccaggagauggccaacgccucccugacccuggagacgccucucaccucuaaacgcaauagcacagcuaaggccaugaccggcuccugggcggcuacacccccgagccaaggggaccagguucagcugaaaaugcuuccucccgcccaguga

SEQ ID NO: 69957 - RNA, 1854 nt, Artificial Sequence
  derived and/or modified sequence opt5 from GPR50__Homo_sapiens__NP_004215
augggccccacccuggccgugccuacaccguacgggugcaucggauguaagcucccccagccugaguaucccccugcucugauuaucuucauguuuugcgccauggucauuacgaucguuguggaccuuauuggcaacagcauggugauccuggcggucaccaaaaauaagaaacucagaaacuccgggaauaucuucgugguuucucugagcguggcugauaugcuugucgccauuuaccccuauccucugaugcuccacgccauguccaucggaggcugggaccugucucaacugcagugucagauggugggguuuauuacaggacucagcguugugggcuccaucuucaacauugucgcuaucgccauuaaucgguacugcuauaucugucauucucugcaguacgaacgcaucuuuagcgugagaaauaccugcauuuaucuugugaucacauggauuaugaccguccuggcuguucucccgaacauguacaucggcacaauugaguacgauccccggaccuauacguguaucuucaacuaccugaauaacccuguguuuaccgugacaaucgucugcauucacuucgugcuuccccugcucaucguuggguuuuguuaugugcgcauuuggaccaagguccuggccgcgagagacccugccggacaaaaucccgauaaccagcuggcugaagugcggaauuuccucacaauguuuguuaucuuccugcuuuuugccgugugcugguguccgauuaacguccugaccgugcucgucgcuguguccccuaaagagauggccggcaagauccccaauuggcuguaccuugcggccuauuucaucgcuuacuucaacagcugccugaacgccguuauuuaugggcuccugaaugaaaacuuucgcagagaguacuggacgaucuuccaugcuaugcggcacccuauuaucuuuuucucuggacugauuuccgacauccgcgagaugcaggaagccagaacacucgcccgggcucgcgcgcaugccagagaucaggcucgggagcaagaccgcgcccacgccugccccgcuguggaagagacccccaugaaugucagaaacgugccucugccgggcgaugccgcggcugggcaccccgaccgggccagcggacauccuaagccccacucuagauccagcucugccuaccgcaaauccgcuagcacacaucacaaguccguuuuuagccacagcaaagccgcuuccggccaucuuaagccugugagcggccacucuaaacccgccuccgggcauccgaagucugcgaccgucuauccuaagcccgccucugugcacuucaaagcugauagcgugcauuuuaagggagacuccguucacuucaaaccugauucuguccacuuuaagcccgccagcuccaauccuaaacccauuaccggccaucacgugagcgcugggucucauuccaagagcgccuucucugcggccacaucccacccgaaaccuacgaccggacacaucaagcccgcuacaagccaugccgagcccaccacagcugacuacccuaagccggccaccacgucccaccccaaaccuacagccgcugacaaccccgaacugucugcgagccauuguccugagauccccgccauugcucacccuguguccgaugacucugaucuccccgaaagcgccuccagcccggccgcuggcccuaccaagcccgccgcgucucagcuggaguccgacaccaucgcugaucuuccugaccccacagucgugaccacaagcacgaaugauuaucaugacguuguggucauugauguggaagacgauccggacgagauggccguuuga

SEQ ID NO: 69958 - RNA, 1086 nt, Artificial Sequence
  derived and/or modified sequence opt5 from GPR52__Homo_sapiens__NP_005675
augaacgagagcagauggaccgaauggcggauccugaauauguccucuggcauugugaacgucagcgagcgccacuccugcccccucggguucggacauuacucuguuguggacguguguaucuuugaaacagucgugauuguucugcuuacguuccugaucauugccggcaaucucaccgugaucuuugucuuccacugcgcuccucugcuucaucacuauacaaccagcuacuuuauccagacaauggccuaugcggaucuguucguggggguuuccugucucgugccgacccugucucugcuccauuacagcacaggaguccacgagucccugaccugccaaguguuuggcuauauuaucagcgugcuuaagucugucuccauggcuugucuggccugcauuagcguugacagauaccucgccaucacgaaaccccugucuuauaaccagcuugugaccccuugucggcugcgcauuugcaucauucucaucuggaucuacuccugucugauuuuccugcccagcuuuuucggguggggaaagccuggcuaccacggcgauaucuuugaauggugcgcuacaucuuggcucaccuccgccuauuucacaggguuuauugugugucugcuuuacgcucccgccgcguucgucgugugcuucaccuauuuucauaucuucaaaauuugcagacagcacacgaaggagaucaaugaccggcgcgccagauuuccuagccaugagguugauuccucucgggaaacaggacacagcccggaccgcagauacgcuauggugcuguuccggaucaccuccgucuuuuauaugcucuggcugcccuacauuaucuauuuccuucuggagagcucucgcgugcucgauaacccuacacuguccuuucugaccaccuggcucgccauuagcaauucuuucuguaacugcguuaucuacagccuguccaauucuguguuuagacuuggccugcggcgccucagcgaaacaauguguacguccugcaugugugucaaagaccaggaggcucaagagcccaagccuagaaagcgggccaacagcugcucuauuuga

SEQ ID NO: 69959 - RNA, 960 nt, Artificial Sequence
  derived and/or modified sequence opt5 from GPR55__Homo_sapiens__XP_011510479
augagccagcaaaacaccuccggcgacugccuguucgauggggugaaugagcucaugaagacacugcaguuugccguccacauccccacguucguucuuggacugcuccugaaccuucuggcuauucauggcuuuucuaccuuccucaaaaauagauggccugacuacgccgcgacaagcaucuauaugauuaaccuggcuguguuugaucugcuccuggugcuuucccugccguucaagaugguccucucucaggugcagagccccuuuccuucccuguguacccuuguugaaugccuguacuucgugucuauguaugggagcgucuuuacaaucuguuucauuuccauggaccgguuucucgccauccgcuacccccugcuggugagccaccucagaucuccucggaaaaucuucggaauuugcuguaccaucuggguucugguguggacaggcuccauucccaucuauagcuuucaugggaaggucgagaaauacaugugcuuccacaauaugucugaugacaccugguccgccaagguguucuuuccucuugaaguguucggauuucugcucccgaugggcauuaugggcuucuguugcagccgcucuauccauauucugcuugggagacgggaucacacgcaagacuggguccagcagaaggcuuguaucuauuccaucgccgcuagccuggccguuuuugugguguccuuccuccccguccaccugggauuuuuccugcaguuucucgugcgcaacucuuucauuguugagugcagagcgaaacaaagcaucuccuuuuuccugcagcuuagcauguguuuuucuaaugugaacugcugccuggaugucuucuguuacuacuucgugauuaaggaauuucggaugaauauccgcgcccauagaccuucccggguucagcucgugcugcaggacaccacaauuagccgcggcuga

SEQ ID NO: 69960 - RNA, 1014 nt, Artificial Sequence
  derived and/or modified sequence opt5 from GPR65__Homo_sapiens__NP_003599
augaacagcacaugcaucgaggaacagcacgaccuggaucauuaccucuuccccauuguguauaucuuugucauuaucguuuccauuccugccaauaucggcucucugugugugagcuuccuucaagcuaagaaagaguccgaacuggggaucuaccucuuuucucugagccuuuccgaccugcucuaugcccugacccugccgcucuggauugauuacacguggaacaaggacaauuggaccuucucucccgcgcugugcaaaggaagcgcuuuucuuauguauaugaacuucuacuccagcacagccuuucugaccuguaucgccguggauagauaucucgcugucguguacccucugaaguucuuuuuccuucggacacgcagauuugcccugaugguuucucucuccauuuggauccuggagaccauuuucaaugcugugaugcugugggaagacgagacagucguggaguacugcgaugccgaaaagagcaacuuuacccucuguuaugacaaguacccccuggagaaguggcagaucaaucuuaaccuguuccggacgugcaccggcuaugcgauuccucucguuacaauccugaucuguaaucgcaaaguguaccaggccgucagacacaacaaggcuaccgaaaauaaagagaagaaacggauuaucaaacuucuggugucuauuacagugaccuucguccucugcuuuacgcccuuccauguuaugcugcugauccgcuguauucucgagcacgccgugaacuuugaagaucauuccaauagcgggaagagaacauauaccauguaccggaucacaguggcucugaccucucuuaacugcgucgccgacccuauccuguauuguuucgugaccgagacaggacgcuacgauauguggaauauucucaaauuuugcacgggcagaugcaacaccucccagcggcaacgcaagagaauccugagcguuuccacaaaagacaccauggaacuugaggugcuggaauga

SEQ ID NO: 69961 - RNA, 1098 nt, Artificial Sequence
  derived and/or modified sequence opt5 from GPR68__Homo_sapiens__NP_001171147
augggcaacaucaccgccgacaauagcuccaugucuugcacaauugaucacacgauccaucagacccuggcucccguggucuacguuacagugcucguggucggguucccugccaacugucugagccuuuauuuuggauaccugcaaauuaaggcgagaaaugagcucggcguguaucugugcaaccuuaccguugcugaccuguucuacaucuguucccucccguuuuggcugcaguaugugcugcagcacgauaauuggucucauggggaccucagcugccaggucuguggcauucugcuuuacgaaaacaucuauaucuccgugggauuccugugcuguauuucuguugaucgguaccucgccguggcccaccccuuucgcuuccaucaauuuagaacacugaaagcugccgucggggugagcguggucaucugggcuaaggagcuucugaccuccauuuacuuccucaugcacgaagagguuaucgaagacgagaaucagcaccgggugugcuuugagcauuauccuauucaggccuggcagcgcgcgaucaacuacuauagauuccuggugggauuucuguuccccauuugucuccugcuugccagcuaccaaggcauccugcgggcuguccgcagaucucacggcacacagaaaucccggaaggaucagauccagcgccucgugcugagcaccguugugauuuuucuugccugcuuccugccuuaucauguccuccugcuggugagaucuguuugggaggcuuccugugacuucgccaaagggguguuuaaugcguaccacuucagccuccugcuuacgucuuuuaacugcgucgccgaucccgugcuguauugcuucgucuccgaaaccacacaccgggaccucgcucgccugagaggagccugucuugcuuuucugaccugcagccggacaggccgcgccagagaagccuacccucucggggcuccggaggcguccggaaagucuggcgcccaaggggaggaacccgagcugcugaccaagcuccauccugcuuuccagacgcccaauagcccuggauccggcggcuuucccacagggcggcuggccuga

SEQ ID NO: 69962 - RNA, 1134 nt, Artificial Sequence
  derived and/or modified sequence opt5 from GPR6__Homo_sapiens__NP_001273028
augacccugcucgccuggugcacaagaggcgcuaaccccgccgcgaugaaugcuagcgccgccucccugaacgacucucagguggucguuguggcugccgagggggcugccgcggccgcuacggccgcuggaggcccugauaccggggaauggggaccgcccgccgcggccgcucuuggcgccgggggaggcgcuaauggcagccuggagcucuccucucaacugagcgccgggccucccggacuucugcucccugccgugaaccccugggacguccugcuguguguguccggcacaguuaucgcuggggaaaaugcgcucguggucgcccugauugcuucuaccccugcccuucggacaccgauguucgugcugguuggaagccucgccaccgcugaucugcuugccggcugcgggcugauccuccacuuuguguuccaguaccugguccccuccgagacagugagccugcucaccgugggauuucuggucgcgucuuucgcugccuccguuagcucucuucuggccauuacgguggaccgcuaucucucccuguacaacgcucuuaccuauuacagcagacggacacugcucggcgugcaucugcugcucgccgcuaccuggacagucucucugggccuugggcugcucccugugcugggauggaauugucuugccgaacgcgcggccugcuccguugugagaccccuggcucggagccacgucgcccuccuguccgcugccuuuuucaugguguuuggcaucaugcugcaucucuauguucgcauuugucagguggucuggagacacgcgcaucagaucgcccugcaacagcacugccuugcuccuccccaccuggccgcuacccggaagggggugggaacgcucgccgucgugcugggcacauucggggccucuuggcugccguuugcuaucuacuguguugugggaagccaugaggauccugcggucuauaccuacgccacacuucuccccgcuaccuacaacuccaugauuaauccuaucauuuaugccuuccgcaaccaggagauccagagagcccuguggcugcuccugugcggcuguuuucaaagcaaagugcccuuccggucucgcucccccagcgaaguuuga

SEQ ID NO: 69963 - RNA, 1623 nt, Artificial Sequence
  derived and/or modified sequence opt5 from GPR75__Homo_sapiens__NP_006785
augaacagcaccggccaucugcaggacgcccccaaugcuacaucccuccacgugccucacucucaagaggggaacagcacgucccugcaggaaggacuucaggaucugauccauaccgccacacucguuaccugcacauuccugcuugcggucaucuuuugucugggcucuuacgggaauuucauuguguuucucagcuucuuugacccggcuuucagaaaguuucggaccaacuucgauuuuaugauucugaaucuguccuucugcgaccucuuuaucuguggagugacagcccccauguucaccuuuguccuguucuucucuagcgccuccagcauuccugaugcuuuuugcuucacguuucaccuuaccucuuccggcuucaucaucaugagccugaaaacaguggccguuauugcucuccaucgccugagaauggugcuugggaagcagcccaaccggaccgccucuuuuccuuguacaguccugcucacccugcugcucugggcgacguccuucacacuggccacccuugcuacacugaaaaccagcaagucucaccucugccugcccauguccagccuuaucgccggaaaaggcaaggcuauucugucccucuaugugguugacuuuaccuucuguguggccgucgugucugugagcuacaucaugauugcgcaaacacugcgcaagaaugcccaggucagaaaaugcccuccgguuaucacgguggaugcuucccggccccagccuuuuaugggcgugcccguccaagggggaggcgacccuauucaaugugccaugcccgcucuguaucgcaaccagaauuacaacaagcuccagcacgugcagaccagaggguauacaaaaagcccgaaucaacugguuaccccugccgccucucggcuucagcugguguccgcuaucaaccucagcacagcgaaggauucuaaagccgucgugaccugcguuaucauugugcugagcguccuuguguguugccugccccucggaaucucccugguccaggugguucugucuagcaauggcuccuucauucucuaccaauuugagcuguucggguuuacgcuuaucuucuucaagagcggacugaacccuuuuauuuauucucgcaauuccgcuggccucagacggaaggugcuguggugccugcaguacaucggccuuggguucuuuuguugcaaacagaagacacgccucagagccaugggaaaaggcaaccuggaagucaaccggaauaagagcucucaucacgagaccaacuccgccuacaugcugagccccaaaccccagaagaaauucguggaccaggcuugugggccuucccauucuaaggaaagcaugguuuccccgaagaucucugccggacaccagcacugcggccagagcuccagcacccccauuaauacacgcaucgagccuuauuacucuauuuauaacuccagccccucucaggaggaauccagcccuuguaaucuccaacccgugaacucuuuuggguucgcgaauagcuacaucgcuaugcauuaucacaccacaaacgaucugguccaggaguacgacuccacgagcgccaaacagauuccggugccuucuguguga

SEQ ID NO: 69964 - RNA, 1092 nt, Artificial Sequence
  derived and/or modified sequence opt5 from GPR78__Homo_sapiens__NP_543009
augggccccggggaggcccugcucgcuggacugcuugugaugguccuggccguugcgcuccugagcaacgcucuugugcugcucugcugugccuacuccgccgaacugagaacccgggcuucuggcgugcugcucgucaaucugagccuugggcaucugcuccuggccgcucuugacaugccuuucacacugcucggagugaugcgcggcagaacgccguccgcccccggggcgugccagguuaucggauuucuggauaccuuccuggccucuaacgcugcccucagcguggcugcccuguccgcggaccaauggcuugccgucggcuuuccucugcgguaugcuggccgccucagaccccgguacgccgggcugcuucugggaugugcuuggggccagucucucgccuucagcggggccgcucugggaugcuccuggcugggcuauagcucugcguuugccuccuguagccuccgccugccucccgagccugaaagaccgcgguucgcugccuuuacagccacccuucacgcugugggguucguucugccccucgccgugcugugccuuacaucucugcagguccaccgcguggcgagacggcauugucagcgcauggauaccgugacaaugaaggcucucgcccugcuggccgaccuccacccuuccgucagacaacggugccugauucagcagaaacgcagacggcauagagcuacccgcaagaucggaauugccaucgcuacguuucuuauuuguuucgcccccuacguuaugacccggcuggcggagcucgugccuuuugugacagucaaugcccaguggggcauccugagcaaaugccugaccuauucuaaggcuguggccgaucccuucacauacucccuucucagacgcccguuucggcaaguucuggcuggcauggugcacagacugcucaaacgcaccccucggcccgccagcacgcacgacuccucucuggaugucgcggggauggugcaucagcuucugaagagaacaccucgccccgccagcacccacaacggauccguugacacagaaaaugauagcugucuccagcagacccauuga

SEQ ID NO: 69965 - RNA, 1272 nt, Artificial Sequence
  derived and/or modified sequence opt5 from GPR83__Homo_sapiens__NP_057624
auggugccccaccuucuccugcuuugccugcucccucuggucagagccaccgagccgcaugaaggccgggcugacgagcagagcgccgaagcggcucuugccguucccaacgccucccacuucuuuucuuggaauaacuacacauucagcgauuggcaaaauuuuguggggcgcagacgguauggagcugagucccagaacccuacggugaaggcccugcucaucgucgcuuacucuuucauuaucguguuuagccuguucggcaauguucuggugugucaugucauuuuuaaaaaccagcgcaugcacuccgccaccucucucuucaucgugaaucuggcgguugccgacauuaugaucacacuucugaacacccccuuuacacucgugagauucgucaauagcaccuggaucuuugggaagggaaugugccaugugucccgguucgcucaguauuguagccugcacgugucugcccuuacacugaccgcuauugccgucgaucgccaccaaguuaucaugcauccucucaaacccagaauuuccaucacgaagggcgugauuuacaucgcggugauuuggaccauggccacauuuuucagccugccucacgcuaucugccagaaacuguucaccuuuaaguauucugaagacaucguccggucccucugucugccggauuuccccgagccugccgaccuguuuuggaaguaccuggaucucgcuacauucauucugcuuuauauccugccccuccugauuaucagcguggccuacgcccgcguugcuaaaaagcuguggcucugcaacaugauuggggacgugaccacggagcaguacuuugcgcugagacggaaaaagaaaaagacaaucaagaugcuuaugcuggucgugguucucuucgcccuguguugguuuccucuuaauugcuaugugcugcuccugucuuccaaagucauccgcaccaacaaugcucuguacuucgccuuucauugguucgccaugagcuccacauguuauaaccccuuuauuuacugcuggcucaaugaaaacuucagaaucgagcugaaggcccuucugucuaugugucagcggccgccuaaaccccaagaagaucgcccucccagccccgugccuuccuuuagagucgcuuggaccgagaagaacgacggacagcgggcgccgcucgcuaauaaccugcugcccaccagccagcuucagucuggcaaaacagaucucuccagcguggagccuauuguuacgaugucuuga

SEQ ID NO: 69966 - RNA, 1077 nt, Artificial Sequence
  derived and/or modified sequence opt5 from GPR87__Homo_sapiens__NP_076404
augggcuucaaccugacccucgccaagcugcccaauaacgagcuucacgggcaggaaagccauaauuccggaaacagaucugacggcccugggaaaaauacaacgcugcacaacgaguuugauaccaucgugcucccgguccuguaccuuauuaucuucguugcuagcauucugcucaauggacuggccguguggaucuuuuuccauauucggaacaagacauccuuuaucuucuaucugaaaaauaucguggucgcggaccucauuaugacccugacauuucccuuccgcaucgugcacgaugcuggcuuugggccuugguacuucaaguuuauucuuugcagauauaccucuguucuguucuacgccaacauguauacaagcaucguguuucucggacugauuuccaucgaccgguaccuuaaagucgugaagcccuucggcgauucucgcauguauagcauuaccuucacgaagguucuguccgugugugucugggugaucauggccgugcucagccugccuaauaucauucugaccaacggccaacccacagaagacaauauccaugauugcucuaaacucaaguccccucugggggucaaauggcacaccgcuguuacauacgugaacagcugucuuuuuguggccguccuggugauucucaucggaugcuacauugcuaucucuagauauauccacaaguccagccggcaguucauuucucaguccagccgcaaaagaaagcauaaucaguccauccggguuguggucgccguguuuuucaccuguuuucugccguaccaccuuugccgcauucccuucacguuuucucaucuggacagacuccuggaugagagcgcgcaaaagauccuguauuacuguaaagaaauuacacucuuccuguccgccugcaacguuugucuugacccuaucaucuacuuuuucaugugccggagcuuuucucgcagacuguucaagaaauccaacauucggacccgcagcgagucuaucagaagccuccaguccgugcggagaucugagguccgcauuuauuaugauuacacagacguguga

SEQ ID NO: 69967 - RNA, 4188 nt, Artificial Sequence
  derived and/or modified sequence opt5 from GPRASP1__Homo_sapiens__NP_001092881
augaccggcgccgagaucgaaagcggggcucaggugaagcccgagaaaaagccuggagaagaggucguuggcggggccgaaauugagaacgacgugccgcugguggucagacccaaagugcggacacaagcgcagaucaugccuggagcucgccccaagaauaaauccaagguuaugccuggcgccucuacgaagguggagaccagcgccgucgggggagcuagacccaaauccaaggccaaagcuauuccugugucucgguucaaggaagaggcccagaugugggcgcagccgcgcuuuggcgccgaaagacucagcaaaacagagcggaacucccaaaccaauaucauugcuucuccccugguuagcacagauuccgugcuugucgccaagaccaaguaccugagcgaggaccgcgaacucgugaacacagauaccgagucuuucccuagacggaaagcucacuaucaggccggcuuucagcccuccuuccgcagcaaggaagagacgaauauggggucuuggugcuguccuagacccaccuccaaacaggaagcgagcccgaacucugacuuuaaguggguggauaaauccgucagcucccuguucuggucuggagacgagguuacagccaaguuucauccuggcaaucgggugaaagauagcaaccgcuccaugcacauggcuaaucaagaggccaacaccaugagcagaucucagacaaaucaggaacuuuacaucgcuuccagcucugggagcgaggacgaauccgugaagacccccugguucugggcccgggauaagacgaacacauggucuggaccucgcgaggaccccaauagcagaucccgguuuagaagcaaaaaggaagucuauguggagucuuccagcggcucugagcaugaagaucaccuggaguccugguucggggccggaaaagaagcuaaguuucgcagcaaaaugcgggcgggcaaggaggccaacaauagagcucgccaucgggccaagagagaagccugcaucgacuucaugcccggcuccauugauguuaucaaaaaggagucuuguuuuuggccugaggaaaacgcuaacaccuucagccgcccgaugauuaaaaaggaggcccgggcgagagcuaugacaaaagaagaggccaagaccaaggcccgcgcucgggccaaacaggaggcuagauccgaagaggaagcccucaucgggaccugguucugggcgacagacgagucuagcauggccgacgaagccuccauugagagcucucugcaaguggaggaugaauccaucauuggaagcugguuuuggacggaggaagaggccucuaugggcaccggggcuuccagcaagucucgcccccggacagacggagaaagaaucggcgauagccuguucggggcccgggagaaaaccuccaugaagacaggagcggaggccaccagcgaaucuauccucgcugccgacgaugagcaggucauuaucggcuccugguuuugggcuggcgaagaggugaaucaggaagccgaggaggaaacgauuuucgggagcugguuuuggguuaucgacgccgcuuccguggagucuggagucggcgugagcugcgaaucccgcacaagaucugaggaggaagaggucauugggccuugguucuggagcggagaacaaguggauaucgaggcgggcaucggggaagaggcccggcccggcgcugaggaagagaccauuuuuggauccugguucugggccgaaaaccagaccuacauggacuguagagccgagacaucuugcgauaccaugcagggcgcugaagaggaggaaccuaucauugggagcugguuuuggacacgcguugaggccuguguggaaggagacgucaauuccaaaagcucucuggaggauaaggaagaggcgaugauccccugcuucggcgcuaaggaggaaguguccaugaaacacgggacgggaguucgguguagauuuauggccggcgccgaggaaaccaacaauaagagcugcuucugggcugagaaagagccguguauguauccugccgggggcggaucuuggaagucccgccccgaagaggaagaggacauugugaacagcugguuuuggucuagaaaauacacaaagccugaagcgaucaucggcuccuggcuuugggcuaccgaggagagcaauauugacgggacaggagaaaaagccaagcugcucaccgaggaagagacgaucauuaacuccugguucuggaaggaagaugaggccaucagcgaggcuaccgaccgggaagagucucgccccgaagccgaggaaggcgauauuaucgggagcugguucugggcuggagaggaggacagacuggaaccugccgcggagacacgggaagaggaucgccuugccgcugagaaagaaggcauugucggguccugguuuggcgccagagaggaaaccauccggcgcgaggcuggaucuugcagcaaguccucucccaaagccgaagaggaggaagugaucauuggcagcugguucugggaggaagaggccuccccggaagcuguggcggggguuggauuugagucuaagccuggcacagaggaagaggaaaucaccgucgggagcugguucuggcccgaggaagaggccuccauucaggcuggaagccaagccguggaggaaauggagucugaaacggaggaggaaacaaucuuuggcuccugguucugggacgggaaagaggugagcgaagaggccggccccugcugugucucuaagccugaagaugacgaggagaugauuguggaauccugguuuuggagcagagauaaggcuaucaaagagaccggaacaguugcuaccugcgaauccaagccggagaaugaagagggcgcgaucguggggucuugguucgaggcugaagacgaggucgauaaccggaccgacaauggaagcaacuguggcucccgcacacuggccgaugaagacgaggccauuguggggagcugguuuugggcuggagacgaagcccacuucgagucuaaucccuccccuguuuuuagagcgaucugccggagcacguguucuguggagcaggaacccgauccuagcagacgcccccaguccugggaggaagucaccgugcaguucaaaccuggccccuggggccggguuggguuuccgucuauuagcccuuucagauuccccaaggaggcugccucccucuuuugcgagauguucggaggcaaaccucgcaacauggugcugucucccgaaggggaggaccaagaaagccugcuccagccggaucagccuucccccgaguuuccuuuccaguaugaccccagcuaccggucuguccaagaaaucagagagcaucugcgcgccaaggaguccacagaacccgagagcuccucuuguaauugcauucagugugaacuuaagaucggaagcgaggaauuugaggagcugcuccugcuuauggagaaaauccgggauccuuucauucacgaaaucuccaagauugcuaugggcaugagaucugccagccaguuuacccgcgacuucauccgggauuccgggguggugagccugauugaaacacuccugaacuacccgucuuccagaguccggaccagcuuucuggagaacaugauccgcauggcucccccuuaucccaaucucaacaucauucagacguacaucugcaaaguuugugaagagacacuggccuauucuguggacuccccugagcaacuuagcggaauuagaaugauccggcaucugaccaccacaaccgauuaccacacacucguggcgaauuauaugucuggcuuccugagccuucuggccacgggcaacgcuaagacccgcuuucacguccucaaaaugcugcugaaucucuccgaaaaccuguucaugacaaaggagcuucugucugccgaagcugugagcgaguucauugggcucuuuaauagagaggaaaccaacgacaauauccagauuguucuggccaucuucgagaacaucggaaauaacauuaagaaagaaacaguguuuuccgaugacgauuucaauaucgagccccugauuagcgccuuucauaaggucgaaaaauucgcuaaggagcuucagggcaaaaccgacaaccaaaaugacccugagggggaucaggaaaacuga

SEQ ID NO: 69968 - RNA, 1074 nt, Artificial Sequence
  derived and/or modified sequence opt5 from GPRC5A__Homo_sapiens__NP_003970
auggccaccacagugcccgacggcugcagaaacgggcuuaagagcaaauacuaucggcucugugauaaggcugaggccuggggaaucguccuggaaacgguugcgaccgcuggcguggugacauccgucgccuucaugcuuacccugccuauucucgugugcaaaguucaggacucuaaucgcagaaagaugcugccgacacaauuucuuuuccugcucggggugcugggaaucuuuggccugaccuucgccuuuauuaucgggcucgauggaagcacaggccccacccgguucuuucuguucggcauucuguuuuccaucuguuucucuugccugcucgcucacgccgucagccugacgaaacuugugcgcgggagaaagccucugucccuccugguuauccugggacucgcugugggcuuuucucugguccaggacgugauugccaucgaguacauugugcuuaccaugaaccggacaaaugucaacguuuucagcgaacuguccgcgccccgcagaaaugaggauuuugugcuccugcuuaccuaugugcuguuccucauggcccugacauuccugaugagcucuuuuaccuucuguggguccuuuacgggauggaagcggcauggcgcucacaucuaccucacaaugcugcuuagcauugccaucugggucgcuuggauuacccugcucaugcugccugacuucgaucgcagaugggacgauacaauccuuucuuccgcccuggcggccaacggguggguguuucuccuggcuuauguuagccccgaguucuggcugcucaccaaacagcggaauccuauggacuacccgguggaagaugccuuuugcaagccccagcuggucaaaaagucuuauggaguggagaaccgcgcuuacucccaagaagagaucacccagggcuucgaagagacaggcgacacgcuuuacgccccuuauagcacccauuuucagcugcagaaucaacccccucagaaagaguucuccauucccagagcccacgcuuggccgucuccuuacaaggauuaugaaguuaagaaagaggggagcuga

SEQ ID NO: 69969 - RNA, 1605 nt, Artificial Sequence
  derived and/or modified sequence opt5 from GPRC5B__Homo_sapiens__NP_001291700
augugcgccgugggcgucguugcuauccugagacgggacccccgcgagggguguaccgauuggacaugcguguucagaggagccaaggaagcgggcguggggccuagcguccggaaacgcacgaccacauccggaucuugggcugugagacgggaaaagagcguuucccgcagaaaccucccgggcgggggacuggccguguguguccggcuuggcguguaccgcggcguuggggacuuugagagacaccgggccggaucuauucugagcgcuuccuggaccuggugcuggugugugucuggcaaacuccugcuuaugaaucccccuuggagcgucgccugggggcaggagggauuccgcgcuggcacacccggguccagauaucugccucggauguuuguggccagcgaacgcaagaugagagcgcaucaagugcucaccuuccugcugcucuuugucaucacaucuguugccuccgagaacgcuagcaccucucggggaugcggccuggaucuucugccccaguacgugucccucugugaccuggaugccauuuggggcaucguggucgaggcuguggccggggcgggagcccuuauuacgcugcuccugaugcugauccuccugguuagacuuccuuucaucaaagaaaaggagaagaaaagcccggugggccugcacuuucucuuccugcuugggacccugggacucuuuggccugacauucgcuuuuauuauccaggaagacgagaccauuugcucuguccgccgguuccuguggggagugcucuuugcccuguguuucuccugccuucugagccaggcuuggagaguucgccggcucgugagacaugggacaggccccgccggcuggcaacuggucgggcuugcccugugucucaugcuggugcaggucaucauugcuguggaguggcugguucucaccgugcugcgcgauacgcggccugcgugcgccuaugaacccauggacuucgucauggcucuuaucuacgauauggugcugcucguugugacacugggacuggcccuuuuuacccucugcggcaaguucaaaagauggaagcugaauggggccuuucugcucauuacagcuuuccuguccguccuuaucuggguggccuggaugaccauguaucuguuuggaaacgugaaacuccagcagggcgacgcguggaaugauccuacccuggcuaucacacuggccgccucuggguggguuuucgucauuuuucacgcuauccccgagauucauuguacgcuucucccggcccugcaagaaaacaccccuaauuacuucgacacaagccagccccgcaugcgggagaccgcuuuugaagaggaugugcagcugccuagagccuauauggagaacaaggcguucuccauggacgaacacaaugccgcucuccgcacagccggcuuucccaacggaagccugggcaagcggcccucugggucccuuggaaaaagaccuagcgcuccguuccggucuaauguguaccagcccaccgagauggccgucgugcugaacggcgggacgaucccuacagcgcccccuagccacaccggacgccaucucugguga

SEQ ID NO: 69970 - RNA, 1362 nt, Artificial Sequence
  derived and/or modified sequence opt5 from GPRC5C__Homo_sapiens__NP_061123
augggcacccagcccgagccugggcugggagccagaauggcuauccacaaggcccucgugaugugccugggccuuccgcuguuccucuuucccggggcgugggcucaaggacaugucccucccggcuguagccaggggcugaacccucuuuacuauaaucugugcgaccgguccggagccuggggcauuguucucgaagccguggcuggcgccgggaucgugacaacguucguccugaccauuauccugguggcuucucuccccuuuguucaggauaccaaaaagcgcagccugcuuggaacacagguguucuuucugcucggcacacuggggcuuuucugucuggucuuugccugcgugguuaaaccugacuucuccaccugugcgucuagacgguuucucuucggagugcuguuugccauuugcuucagcugucuggcugcccacgucuuugcucucaacuuccuggcccgcaagaaucauggcccgagagggugggugaucuucacaguggcgcuucugcucacccuggucgagguuaucauuaacacggaauggcuuaucauuacccuggugcggggauccggcgagggcgggccccaaggaaauucuagcgccggcugggcuguggccuccccuugcgcuaucgccaacauggauuuugucauggcccucauuuacgugaugcugcugcuccugggggcuuuccuuggagcguggcccgcccuguguggccgcuauaaaagauggcggaagcacgggguuuuugugcuccugacaaccgcuacaagcgucgccaucugggugguuuggauugugauguacaccuauggaaauaagcagcauaacucuccuacgugggacgaucccacacuugccaucgcucuggccgcgaaugcuugggccuucguccucuuuuacgugaucccggaagucucccaggugaccaaaagcucuccugagcaguccuaucaaggcgacauguaccccacacgcggcguuggguacgagaccauucugaaggaacagaaaggacagagcauguucguggagaacaaggccuuuucuauggaugaaccugucgcugccaaaagacccgugucccccuauagcggcuacaaugggcagcugcucaccuccguuuaucaaccuacagagauggcucugaugcacaaggugccgucugagggagccuacgacaucauucuuccccgggcgacggccaacagccaggucaugggcuccgcuaauagcacccugcgcgccgaagauauguauucugcucagucccaccaagccgcgacaccucccaaggacgggaaaaacagccagguguucagaaauccuuacgugugggauuga

SEQ ID NO: 69971 - RNA, 1038 nt, Artificial Sequence
  derived and/or modified sequence opt5 from GPRC5D__Homo_sapiens__NP_061124
auguacaaggacugcaucgagagcaccggcgauuauuuccugcucugugacgccgaagggcccuggggaauuauccuggagucccuugcuauucugggcaucguggucacaauucuccugcuucuggccuuucucuuccugaugagaaaaauccaggauugcucucaauggaacguucugccuacgcagcuccuguuucuucugagcgugcucgggcuguucggacuugcguuugcuuucaucauugaacugaaucagcagaccgccccggugcgguacuuucucuucggcguccuguuugcccuguguuucuccugccuccuggcucacgccucuaaccuugugaagcugguucgcgggugugugagcuuuuccuggacaaccauccucugcauugcuaucggauguucucugcuucaaauuaucauugccacagaguaugucacccugaucaugacaagaggcaugauguucgugaauaugacccccugccagcucaacguugacuuugugguccugcugguguacguccucuuccugauggcgcuuacguucuuugugagcaaagccaccuucuguggcccuugcgaaaauuggaagcagcaugggcggcugaucuuuauuacaguucucuucuccaucauuaucugggugguguggauuagcaugcugcuucgcggaaacccccaguuucaaagacagccucagugggaugaccccgucguguguaucgcucugguuaccaaugccuggguguuccuccugcuguauaucgucccugagcucugcauucuguaccggucuugccgccaggaguguccgcuucaaggcaacgcuugccccgugacagccuaucagcacuccuuucagguugaaaaucaagagcugagcagagcgcgggauucugacggggccgaagaggauguggcucucaccuccuacggaacgccuauccagccccagacagucgacccuacccaggaguguuucauuccccaagccaaacugagcccgcagcaggaugcuggcgggguguga

SEQ ID NO: 69972 - RNA, 2256 nt, Artificial Sequence
  derived and/or modified sequence opt5 from GPRC6A__Homo_sapiens__NP_001273283
auggccuuccugaucauucucauuaccugcuuugugaucauccuggcuacaagccagcccugucaaacgccugacgauuucgucgccgcgaccuccccgggccacauuaucaucgggggacuuuuugcuauucaugagaagaugcugucuagcgaagacucccccagacggccucagauccaggagugcguuggcuucgaaauuucuguguuucuccagacacuggccaugauccacagcauugagaugaucaacaauuccacccuucugcccggggugaaacucggauacgaaauuuaugauacauguaccgaggucacaguggccauggcugccacccugcgcuuccugucuaaguuuaacugcagcagagagacgguugaguucaaaugugacuacuccagcuauaugccucgggugaaggcugucaucggcucuggguacuccgaaaucaccauggccgugagccgcaugcucaaucugcaacuuaugccccagguuggauaugaaucuacagcggagauucuguccgauaaaaucagauuuccuagcuuccuccggaccgugccgucugacuuucaucagauuaaggccauggcucaccugauccagaaguccggcuggaacuggauuggcaucaucacaaccgaugacgauuacgggcgccuugcccugaauacguucauuauccaagcugaggccaacaaugucugcauugcguuuaaagaagugcuccccgccuuccugagcgacaacacaaucgaggugagaauuaaucggacccugaagaaaaucauccucgaagcucagcugcuuggaguccugaagaacguuacauucaccgauggcuggaauagcuuucauuucgacgcccacggggaucucaacaccggauaugacguggugcuguggaaagagauuaauggccacaugacagucacgaagauggcugaauacgaccuucagaacgauguguuuaucauuccugaccaggagaccaagaaugaguuccgcaaccugaaacaaauccagucuaaguguagcaaagaaugcucccccgggcagaugaagaaaacaaccagaagccaacauauuuguugcuacgagugucagaacugcccugaaaaucacuauacaaaccagaccgauaugccccauugccuccuguguaauaacaagacgcacugggccccgguucggucuacaaugugcuuugagaaagaaguggaguaccugaauuggaacgacucccucgccauccugcuucugauucucagccugcuuggaaucaucuucguccuggugguuggcauuaucuuuacccgcaaucucaacaccccuguggucaagucuagcggcgggcugagaguguguuaugucauucugcucugccacuuccugaauuuugcuuccacaucuuucuuuaucggagagccccaggauuucaccuguaagacacggcaaacgauguuuggcgugagcuucacccuuugcauuuccuguauccugacaaaaagccucaagauccugcuggcguucucuuuugacccuaaacuucagaaguuccucaaaugccuguaccgccccauucugaucauuuuuaccuguacagggauccagguugugauuugcacccucuggcugaucuucgccgcucccacggucgaagugaacguuucccuuccuagagugaucauucuggagugugaagagggaagcauccucgccuuuggcaccaugcugggguauauugccauccuggcuuucauuugcuuuaucuucgccuuuaagggaaaguacgaaaauuauaacgaggcgaaauucaucacauuuggcaugcuuauuuacuucaucgcuuggauuaccuuuaucccgauuuacgccacaaccuucggcaaguauguccccgccguggagaucauugugauccucaucucuaauuacgggauucuguauugcacguucaucccuaaauguuacguuauuaucugcaagcaggaaauuaacacaaaauccgcuuuucugaagaugaucuauagcuacuccucucauagcgucuccucuaucgcccucagccccgcuucccuggauagcaugucuggaaaugugaccaugacaaacccuuccagcucuggcaaguccgccaccuggcaaaaauccaaggaccuucaggcgcaggccuucgcucacauuugucgggagaacgccaccucugugagcaaaacacugcccagaaagcgcauguccagcaucuga

SEQ ID NO: 69973 - RNA, 3027 nt, Artificial Sequence
  derived and/or modified sequence opt5 from GPRIN1__Homo_sapiens__XP_005265863
auggacaccgccgaggaucccgcuuggcugcagcuccugcaaaaggacagcuccccuccgggccccagaccuacagccuucuuuugcccccaggaugggucucuuggagcgggcagcuccgcuaugcgggacuacuguccuucucagcagaaagccagccccgccccuccgcgccacacgcccgaucaauccccugggauggaaucuagacaucggagccccuccggagcuggcgagggggccagcugcucugacggaccucgcggcucccuggcuugucccagcccgaccugcuucucuccucaggaaucccccagcaaggagacacucgaagcccacggcgcgucuaucuccgggaccccugaggccacaaccagcggaaaacccgagcccguguccucugucaagacagaaccuaaaagcuccgaugacagaaacccgauguuucuggagaagauggauuucaagagcucuaaacaggcugacuccaccagcauuggcaaggaagaucccgggucuagccggaaagccgacccuauguuuacgggaaaggcugagcccgagauccuuggcaaaggggauccuguugcccccggacgcauggacccgaugaccgugagaaaggaagaccugggcucccucggcaagguggauccucuguguucuagcaaaacauauaccgucuccccucggaaggaggaccccgggagccugcgcaaaguggaucccguuucuuccgacaagguggauccugucuuccccagaaaagaggaaccgcgguacagcggaaaggaacauccugugucuuccgagaaaguugcgcccacaagcgccgagaagguggaccucguccuguccggcaagcgcgaucccgggccuucuggaaaagcugacccgaugccccuugaaagcauggauuccgccucuaccggcaagacggagccugggcugcucggaaaacugauucccggcagcuccggcaagaaugggccugugagcucuggaacaggcgcucccgggucccuuggaagacuggacccuaccugccucggcauggccgaucccgccagcguggggaacgucgaaacaguuccggcuaccaaagaggacucucgguuucugggcaagauggacccugcguccagcggagaaggccgccccgugucugggcacaccgauacaacggccagcgcuaagaccgaccugacaucccucaaaaauguggauccuaugagcucuggaaaggucgaccccgugucccugggcaaaauggauccgauguguagcgggaagccugagcuucugucccccggacaggccgagagaguuucugugggcaaagccgggaccgucagcccuggcaaggaagaccccguguccucucggagagaggaucccaucagcgcuggaucccgcaagacaucuagcgaaaaaguuaacccugaguccagcggcaagaccaauccggugucuuccgggcccggagacccucggagccucggcacggccgggcccccuucugcggucaaagcugaacccgccacaggaggcaagggggauccucuguccagcgagaaagccggccuuguggcuucuggaaaggccgcuccgaccgccuccggcaaggcggagccccuggccgucgggaaagaagacccugugagcaagggaaaagcugaugccggccccuccgggcaaggagacagcguuucuauuggcaagguggucagcaccccugggaaaacagugcccguuccguccggcaagguggauccugucucucucggaaaagcugaggccauccccgaaggcaagguggggagccugccccuggagaagggauccccugugaccacaacgaaagcggaccccagagccucuggcaaggcucagccucagagcgggggaaaagccgagaccaagcucccgggccaggaaggcgcugccgcccccggggaggcuggagcgguuugccugaaaaaggaaacaccucaagccuccgagaaggucgaccccggcucuugucgcaaagcugaaccucuugccagcgggaagggagagcccgugucccugggcaaagccgauagcgcuccgucucggaagaccgaguccccuagccucgggaaaguggucccccugucucuugaaaagacaaagccuuccagcuccucuagacagcuggaccgcaaagcccucggaagcgcgcggucccccgagggcgcuagaggcagcgaagggcgcguggagccuaaggccgaacccguuucuuccaccgaggccagcucucugggacagaaagaucuggaggcugccggcgcggaacggagcccgugcccugaggcugccgccccuccgcccgggcccagaacgcgcgacaacuucaccaaggcucccuccugggaagccucugcuccucccccuccccgggaggaugccggaacacaagcgggcgcccaggcuugugugagcgucgccguguccccuaugucuccgcaggacggggcuggaggcagcgccuuuuccuuccaggccgcucccagagcgccuucucccccuagccggcgcgaugccggccuccaaguuucccugggggcugccgaaaccagaagcguggccacaggacccaugaccccgcaggcugccgcgccucccgcuuuucccgagguccgggugagaccuggcuccgcccuugccgcugccguugcgcccccugagccggcugaacccgugcgcgacgucucuugggaugagaaagggaugacgugggaaguguauggagccgccauggagguggagguccugggcauggcuauccagaagcaucucgaacggcagauugaggaacacgggagacaaggagccccugcucccccucccgccgcgcgcgccggcccgggcagaagcggguccguucggacagcuccucccgacggagccgcuaagcgcccucccggccuguucagagcccugcuucagucugugcggcgcccuagaugcugcagccgggccgggcccaccgcugaguga

SEQ ID NO: 69974 - RNA, 1449 nt, Artificial Sequence
  derived and/or modified sequence opt5 from GPRIN2__Homo_sapiens__XP_011538700
augcugaacgagagccucauggaaaaggccgacgcuuggggccugucccuuccccuggagcucgaagccgcgaugucuagcuccagaccugagccggggcccugggcuccucugucuccccggcuucagccucugagccaauccucuagcucccuccugggagaaggccgcgagcagagacccgagcugcggaaaaccgccagcucuacaguguggcaggcccagcucggggaggcuuccacgcgcccucaagccccggaagaagagggaaaucccccugagagcaugaagcccgcuagagccucuggcccuaaagcgcggcccuccgccgggggacacugguggagcucuaccgucggcaacguuuccacaaugggcgggagcgaucugugccgccuuagagcuccguccgccgcugccaugcagcggucucauagcgaccuggugcgcuccacccagaugagaggacacagcggcgcgcggaaggccucucucuccuguagcgcucuggggucuagcccugugcaucgcgcccagcuucaacccggaggcacauccgggcagggaggccaggcuccugccggccuggaaagagaucucgcccccgaggacgaaaccucuaauagcgcuuggaugcugggggcgucccagcugagcgugcccccucucgaucugggagacacaaccgcccacucuuccagcgcucaagccgagccgaaagccgcugaacagcuugccacgaccacaugccaugcgcugcccccugcugcccuccuguguggcaugcgggagguccgcgccgggggaugcugucacgcccuucccgcuaccggcauccuggcuuucccuaagcucguugccucuguguccgagagcgggcugcaggcgcaacacggagucaagauucauugcagacuguccggcggccuccccgggcacucucauuguugcgcccaccuguggggaccggcuggccuugugccugaacccgggagccggacaaaagauguuuggaccaugacguccgccaacgaccuggcuccugccgaggcgucuccccucagcgcccaggaugcuggagugcaggccgcuccugucgccgccuguaaggcuguggcgacaucccccagccuggaagccccggcugcccuucacguguuuccugaggucacccuggggucuucccucgaagagguucccagccccgugagagacgugcgcugggaugccgagggcaugacaugggaagucuacggcgcugccguggaccuggagguucugggaguggcgauccagaaacaucucgaaaugcaauucgagcagcugcagcgggcuccugccucugaagauucccuuagcgucgagggcagacgcgggccgcugcgggccgugaugcagucucucagacgccccagcugcuguggaugcuccggcgcugccccugaguga

SEQ ID NO: 69975 - RNA, 2331 nt, Artificial Sequence
  derived and/or modified sequence opt5 from GPRIN3__Homo_sapiens__XP_005262993
augggcaccgugcccgacccucugagaagcgccaagacaucccucaucgcugccucugggaaagaggaugaccugggagaaccgcaggcggcuagcccccggcaccgcccugcccuucugugcaagaacgccaauggcuucuccggggcucccgccgagccugaucucucucccagagcugccgcggaagcccugaugcaagucugugagcaugaaacgacccagccugacaugagcuccccgggaguuuuuaacgaggugcagaaagcucccgccacauucaauucuccuggcaacccccagcuuccugggagcucccaacccgcugccagcgcgccgucuuccgccgcuggacgggaucugauucacaccccucucacaaugcccgccaaucagcauaccugccagagcaucccuggcgaccagcccaacgcuauuacaucuuccaugcccgaggauagccugaugcgcucucaaagaaccuccaaucgggaacagccugagaagccgagcugucccgugggcgggguccuguccucuagcaaagaccagguguccugcgaauuuccuagccccgagacgauccagggaaccguucaaacaccugugaccgccgcccgcgucgugucucacuccagcucucccguuggcgggccggagggagaaagacagggcgcuauuugugauagcgagaugcgguccugcaagccucucacacgcgaaucuggguguagcgagaacaagcagcccuccgugaccgcgagcggaccucaaggcacgacaucugucaccccucagcccacaccccugaccuccgaaccgagcgccugcccucccggccccgagaaagugccucuuccggcucagagacagaugucucgguucaaggaggccuccaccaugacaaaucaagccgaaagcgagaucaaagaagugcccucccgcgcuuggcaggacgccgagguccaggcgguugcuucuguggaaagcagauccgugucuacgagcccuuccauccugaccgccuuucucaaggagagccgggcccccgagcauuucgaacaggagcaacugcgcgucauuugucacucuuccgggagccacacacuugaacugucugauuccacccucgcuccucaggagagcucucagugccccggaaucaugccucaggugcauauucaagccgcugccgcggaaagcacagccuuucagagagagaacaaacuggcuucccugcccggcgggguucucaagaccagcucuaucaaucugguguccagcaacgcccagcacacguguaaggaggacggacggcuugcuggcaugacaccggucagagaagaguccaccgccaaaaagcuggcggggaccaauucuagcucccucaaagccacagcuauugaucagaucucuauuagcgccugcucccaagcugaaaccucuuacggacugggcaaguucgagacacgcccuagcgaguuugccgaaaagacgaccaacggccauaaaacagaccccgacugcaaacuuuccgauagcugugggucuaucuccaaggccgaccacagcggaucucuggauccuaccaauaagggcgacgcucgggagaaaaagcccgcguccccgcaagugguuaaagaaaaggagagcacagggaccgauacgucugacgccaaaacccuccugcugaacccuaagucccaggaaagcggaggcacagaguccgcugccaaccccaccccuagccccaucagaaagaaucaggagucuacacucgaagagaaccgccagaccaaaacggccacaagccugucccuucccucugauccuaugggggacagcuccccgggcucuggaaagaaaacccccagccgguccgugaaggcuucuccuagacgccccagccgggucuccgaguuccugaaagaacagaagcucaaugugacagccgcggcugcccaggucggccugaccccuggggauaagaaaaagcaacuuggagccgacagcaaacugcagcucaagcagucuaaaagagugcgcgauguugugugggacgaacagggcaugaccugggaggucuauggggcuucccuggacgccgagagccugggaauugcgauccaaaaccaccuccagcggcagauuagagaacaugagaagcugaucaagacacaaaauucucagacgcgccgguccauuagcuccgauaccucuagcaacaaaaagcugagaggccggcagcacuccguguuucagagcaugcuucaaaauuuccgcagacccaacugcuguguucggccugcuccgucuuccgugcucgacuga

SEQ ID NO: 69976 - RNA, 984 nt, Artificial Sequence
  derived and/or modified sequence opt5 from GPS2__Homo_sapiens__NP_004480
augcccgcccugcucgagagaccuaagcugagcaacgcuauggcccgggcgcuucaccgccauaucaugauggaaagagagcggaaacgccaggaagaggaagagguggacaagaugauggagcagaaaaugaaggaggaacaagaaagacggaaaaagaaggagauggaggaacgcaugucccuggaggaaaccaaagagcagauucucaagcuggaagagaaacuucuggcucuccaggaggaaaagcaccaacuguuccugcagcucaaaaagguccugcaugaggaagagaagagacggcgcaaagaacagucugaucuuacaacgcugaccagcgccgccuaccagcaaucccucacaguucacaccggcacacaucugcuuucuaugcaggggagcccgggaggccacaauagacccgggacccugauggcugccgaccgggcuaagcagauguuuggaccucaggugcucacaacccgccacuaugugggcuccgccgcggccuucgcugggacgcccgagcauggacaauuucagggcucuccuggcggggccuacggaaccgcucagcccccuccgcacuauggccccacacaaccugccuacagccccucccagcagcugagagcgccuagcgccuuccccgcuguccaguaucugucucaaccgcagccucagcccuacgccgugcaugggcacuuucagccuacccaaacaggauuccuccagcccggcggggcucugucccuucagaaacagauggagcacgccaaccaacagaccggauuuagcgauucuuccagccugcggcccaugcauccucaggcccuccacccggcucccggccugcuugcgucuccucagcugcccguucaaaugcagccugccggcaaguccggguucgcugccacgagccagcccggaccgcgccucccuuuuauccaacauucccagaaucccagauucuaucacaaauga

SEQ ID NO: 69977 - RNA, 2028 nt, Artificial Sequence
  derived and/or modified sequence opt5 from GPSM1__Homo_sapiens__NP_001139110
auggccggccccgcuccuccggccgcggacgagcugcccgggccugcugccagacggcucuacagccgcauggaagccuccugccuggagcuugcucuggaaggagagagacucuguaaggccggcgauuucaaaaccgggguggccuuuuucgaagcugcgguccagguuggaacagaggaccugaagacgcuuucugccaucuauagccaacugggcaacgcuuacuuuuaucucaaagagcacgggcgggcccuggaauaccacaagcacgaucugcuccuggcucgcaccauuggagacagaaugggcgaggccaaagcguccggcaaucuugggaacacacugaaggugcucggacgguucgaugaagccgcugugugcugucagcgccaucugucuaucgcccaggagcagggcgacaaggucggggaggcuagagcccuuuauaauauuggaaacguguaccacgccaaaggcaagcaacugagcuggaaugcugcgaacgccacccaggaucccgggcaucucccucccgacguucgggaaacacugugcaaggcuuccgaguuuuaugaacgcaaucugucucucgugaaagagcugggagauagagccgcccagggccgggcuuacggcaaccuugggaauacccacuaccugcucggaaacuucacagaagccaccacguuucacaaagagcgccuggcgaucgcuaaggaguucggcgacaaggccgccgaaagacgggcuuauagcaaucuugggaacgcccaugucuuucugggacgcuucgauguggcugccgaguacuauaaaaagacccuccagcuguccagacaacugcgggaccaggcgguugaagcccaggcuuguuacagccucggcaauacauauacccugcuucaggauuacgagagagccgcugaauaucaccugagacaucuccugauugcccaagagcuugcggaccgggugggggagggacgcgccugcuggucucugggcaacgcuuacgucuccaugggccgcccugcccaggcucucacauuugccaaaaagcaucugcagaucagccaagaaaucggggaccggcacggagagcugaccgccagaaugaauguggcucagcuccagcuggugcuuggccgccugacgucuccggcggccuccgaaaaacccgaucucgcuggguacgaggcccagggagcccggccuaagagaacacaacgccugagcgcugaaaccugggaccugcuucggcucccccuggagagagagcagaacggcgauucucaccacuccggggacuggcgcggcccuagccgggauucccugccccucccggucagaucucggaaauaucaggaaggaccugacgccgagcgcagaccccgggaaggcagccauuccccucuggauagcgcggacguuagagugcacgugccccgcacaucuauuccccgggcuccuuccagcgaugaggaguguuucuuugaccuucugaccaaguuccagucuagcagaauggaugaccaacgcugcccgcucgacgaugggcaggccggagccgcugaagccaccgcggcucccacacuggaggacagaaucgcccagccuuccaugacggccucuccccagaccgaagaguucuuugaucugauugcuagcucccaaagccggcgccuugacgaucagagagccucugucggcucccucccugggcugcggaucacacauagcaacgcuggacaucugcgcggccacggggaaccccaggagccgggcgacgauuucuuuaauaugcucauuaaguaccagucuuccagaaucgacgaucaacgguguccucccccugacgugcugccccgcggaccuaccaugcccgaugaggacuucuuuagccuuauucagagaguucaggccaaacggauggaugaacaacgcguggaccuggcgggcgggccggagcagggagccggcgggccucccgaaccccagcagcaaugccagccuggagcuuccuga

SEQ ID NO: 69978 - RNA, 1377 nt, Artificial Sequence
  derived and/or modified sequence opt5 from GPSM2__Homo_sapiens__XP_011539605
auggaggaaaaccugaucagcaugagagaggaccacuccuuccaugugcgguaccgcauggaagccucuugccucgagcuggcucuugaaggcgagagacuguguaagagcggggauugccgggccggagucuccuuuuucgaggcggcuguucaggugggcaccgaagaccucaaaacacugucugccauuuauagccaacuugggaaugccuacuuuuaucugcacgauuacgcuaaggcccucgaguaucaucaccaugaccugacgcuggcucgcaccaucggagaucagcucggcgaagccaaagcguccgggaaccugggaaauacacuuaaggugcugggcaacuucgacgaggccauugucuguugccagagacaccucgauaucucucgggagcugaaugacaaagugggcgaagcucgcgcccuuuacaaccuggggaauguuuaucacgcuaagggaaagagcuuuggcugucccgggccucaggaugugggagaguucccggaagaggucagagacgcccuccaagcggccguggauuuuuacgaagagaaccugucccugguuaccgcucucggcgaccgggccgcucaggggcgcgccuucggaaaucugggcaacacacauuaccuucugggcaauuuuagagaugccgugauugcucacgagcagcggcuccugaucgcgaaagaguucggggacaaggccgcugaacgcagagccuauagcaaccuuggaaaugccuacaucuuucugggcgaguucgaaaccgcuucugaauauuacaaaaagacacuccugcuggcccggcagcucaaagaccgcgcggucgaggcucaauccugcuauagccuggggaacaccuacacgcuucugcaggauuaugagaaggccauugacuaccaucucaagcaccuggccaucgcucaggaacuuaaugauagaauuggagagggccgggccuguuggucucuggggaacgcuuacaccgcccucggaaaccacgaccaggcgaugcauuuugccgaaaaacaccuggagaucuccagagaagugggcgauaagagcggcgagcugacagcucgccucaaucugucugaccuucaaauggugcuggggcucuccuauagcaccaacaauuccauuaugucugagaacacagaaaucgauagcucccugaauggaguccggcccaaacugggcagacgccauagcauggagaacauggaacuuaugaagcucaccccugagaaaguucugaagaaucagcacuucaacgugcugauuaugcggauccauucuaugcaccucgugcagguccugaaaaucgugcaauacacgaagaaggacauuuucaaagagaucuga

SEQ ID NO: 69979 - RNA, 483 nt, Artificial Sequence
  derived and/or modified sequence opt5 from GPSM3__Homo_sapiens__NP_071390
auggaggccgaaagaccccaggaggaagaggacggcgaacaagggccuccgcaggaugaggagggauggcccccucccaacagcaccacacggccuuggcgcuccgcucccccuucuccgcccccucccggcacgagacacaccgcccuggggccucggagcgcgucccuccugucucuucagacagaacugcuccuggaccuuguggcugaggcccagagccgcagacuggaggaacaacgggccaccuucuacacaccccagaauccguccucucucgcuccugcuccccugcgcccucuggaggauagagaacagcucuauagcaccauccugucccaucagugccaacggauggaggcccagcgcagcgaaccuccccuucccccgggaggccaggagcugcucgaacugcuucugagaguccaagggggaggccggauggaggagcagcgcucuagacccccuacacacaccuguuga

SEQ ID NO: 69980 - RNA, 1272 nt, Artificial Sequence
  derived and/or modified sequence opt5 from GPT2__Homo_sapiens__NP_001135938
augggccagcaacccaucaccuuccugagacaggugauggcccucugcacauacccuaaccugcuugacagcccguccuuucccgaggaugcuaagaaacgggcccgccggauucugcaggcgugugggggaaauucucucggcagcuauuccgcuucucagggggucaacugcaucagagaagacguugccgccuacauuacgcgcagagauggaggcgugccugcugaccccgauaauaucuaucugaccacaggggccagcgacggaauuuccaccauccuuaagauccuggugucuggcggcgggaaaagccggacaggagucaugauuccuaucccccaauacccucucuauuccgcugugauuagcgagcuggaugccauccagguuaacuacuaucuggacgaagagaauuguugggcgcucaacgugaaugaacugcgcagagccguccaggaggcuaaggaucacugcgacccgaaagugcuuuguauuaucaaccccggcaauccuaccgggcagguucaaucucggaagugcauugaggaugugauccauuucgccugggaagagaagcuguuucuccuggcugacgaagucuaccaggauaacguguacucccccgacugucgcuuccacagcuuuaaaaaggugcuuuaugagaugggaccugaguacucuuccaaugucgaacuggccagcuuccauucuacauccaaaggcuauaugggggagugcggauacagaggcggcuauauggaaguuaucaaccuccaccccgagauuaaggggcagcuggugaaacugcucagcgugcggcuguguccgccugucuccggacaggcggccauggacaucgugguuaaucccccuguggcuggcgaagagucuuuugagcaauucagccgcgaaaaggaguccguccuugggaaccuggccaagaaagcuaagcucaccgaagaucuguuuaaucaggugcccggcauucauugcaacccccuucagggagccauguacgccuucccuagaaucuuuauuccggcuaaagcgguugaggccgcucaagcccaccagauggcccccgacauguucuauuguaugaagcugcucgaagagacggggaucugcguggucccuggaagcggcuuuggccagcgggaggggaccuaccacuuccgcaugacaauccugcccccuguggaaaaacugaagaccguccuccagaaagugaaggauuuccauauuaacuuucuggagaaguacgcuuga

SEQ ID NO: 69981 - RNA, 1491 nt, Artificial Sequence
  derived and/or modified sequence opt5 from GPT__Homo_sapiens__XP_011515295
auggccagcuccaccggcgacagaucucaggcugugcggcacgggcugcgcgccaagguccucacacuggauggaaugaaccccagaguucggcgcguggaguacgcggugagaggcccuaucguccaacgggcucuugaacuggagcaggaacuccgccagggggugaaaaagccguucacggagguuauuagagccaauaucggagacgcccaggcuaugggccaacggcccauuaccuuucugcgccaggugcuugcccugugcgucaacccugaucuccugagcucccccaauuucccugacgaugcuaaaaagagagccgaacggauccugcaggcgugugggggacauucucucggcgccuauagcguguccucuggcauucagcugauccgcgaggacguugcuagauacaucgagcggcgcgaugggggcauucccgccgacccuaacaauguguuucuuagcacaggagcuuccgaugccaucgucaccgugcugaaacuccugguggcgggggaaggacacacaagaaccggcguccuuauuccgaucccccaauauccucuguacagcgccacacucgcugagcugggggccguucagguggacuauuaccuggaugaggaacgggcuugggcccucgacguggccgagcugcauagagcucuuggacaggcgcgcgaucacugccggcccagagcccugugugucauuaacccuggcaaucccaccggccaggugcaaacgcgcgaaugcaucgaggcuguuauucgguucgccuuugaagagagacucuuccugcuugccgacgaaguguaucaggacaacgucuacgcugccgggucucaguuucauuccuucaagaaggugcugauggagaugggaccgccuuacgcgggccaacaggagcucgcuagcuuucacucuaccuccaaaggguauaugggagaauguggcuuccgcgggggauacguugagguggucaauauggaugccgccgugcagcagcaaaugcugaagcugaugagcguccggcucugucccccugugcccggccaggcucugcuugaccugguugugucucccccugccccgacagaucccuccuuugcucaguuccaggccgaaaaacaagcgguccucgccgagcuggcugccaaggcuaaacuuaccgaacagguguuuaacgaggccccuggcaucagcugcaaucccguucagggggcgauguauuccuucccuagagugcagcugcccccgcgcgccgucgagcgggcucaagaacucggacuggccccugacauguucuuuugccugagacuccuggaggaaacaggcaucuguguggugcccgggucuggauucggccagcgcgaggggaccuaccacuuucggaugacgauucuuccuccccuggaaaagcucagacugcugcuugagaagcucagccgguuccaugcuaaauuuacacuggaguauuccuga

SEQ ID NO: 69982 - RNA, 666 nt, Artificial Sequence
  derived and/or modified sequence opt5 from GPX5__Homo_sapiens__NP_001500
augaccacacagcugagagugguccaccuccugccccuucugcucgccugcuucguucaaacgagcccuaagcaggagaaaaugaagauggacugucauaaagaugaaaagggcaccaucuacgacuaugaggcuauugcccugaacaaaaaugaauacguguccuuuaagcaguauguggggaagcacauccuuuucgucaacguggcgacauacugcggacugaccgcucaguauccggagcucaaugcccugcaagaggaacugaaacccuacggccucguugugcugggguuuccuuguaaccaguucggaaagcaggagcccggcgauaauaaagaaauucuuccugggcugaaguauguccggcccggaggcggcuuugugccuucuuuccagcucuuugagaaaggggacguuaacggagaaaaggagcaaaagguguucagcuuucugaaacauuccugcccgcaccccucugagauccuuggcacauucaagagcauuuccugggauccugucaaagugcaugacauccgcuggaauuuugaaaaguuccugguggggcccgauggaaucccugucaugagauggucucaccgggccaccguuagcuccgugaaaacagacauucucgcuuaccugaagcaguuuaaaaccaaguga

SEQ ID NO: 69983 - RNA, 2238 nt, Artificial Sequence
  derived and/or modified sequence opt5 from GRAMD1B__Homo_sapiens__NP_001273492
augaagggcuucaaacugagcugcaccgccuccaacucuaauagaagcacacccgcuuguuccccuauccuccggaagcgcucuagaagcccgacgccccagaaccaagacggggauaccaugguggagaaaggauccgaccacucuagcgauaaguccccuagcacacccgaacagggcguccagcggucuugcuccagccagucugggcgcuccggaggcaaaaauagcaagucucauaagagacuguccaaaaagagccaauccugguacaacguucuuucuccuaccuauaaacagcggaaugaggacuuucgcaagcuguucaaacagcuccccgauacagaaagacugauuguggacuacagcugugcccuucagcgggauauccugcuccaagggcgccuguaucuguccgagaacuggauuugcuuuuacagcaauaucuucagaugggaaacccuccugacagugcggcuuaaggacauuuguucuaugaccaaggagaaaacggcgcgccugaucccuaacgcuauccaggucugcaccgauuccgagaagcacuuuuucaccagcuuuggagccagagaccggacauauaugaugauguuccgccucuggcagaaugcccugcuugaaaaaccgcugugucccaaggagcucuggcauuuugugcaccagugcuacggcaacgaacugggccugacaucugaugacgaggauuauguuccucccgacgacgauuucaauaccaugggguacugugaggaaauuccuguggaggaaaacgaggucaaugacagcuccucuaaaagcuccaucgaaacgaagcccgaugcuagcccgcaacucccuaaaaagucuauuacaaacuccacccugacaagcaccggaucuuccgaggcccccgugagcuuugacggccuuccucuggaggaagaggcucucgaaggggauggaucccuggagaaggaacuugccaucgacaauauuaugggcgagaaaaucgagaugauugcgcccguuaacucucccagccuggauuucaacgacaaugaagauaucccuaccgagcucuccgacucuagcgauacacaugacgaaggggaggugcaggccuuuuacgaagaccuguccggaagacaguaugucaacgagguguucaauuucagcguggauaagcuguacgaccuccuguuuacgaacucuccguuccaacgggauuuuauggagcagagacgcuucuccgacaucauuuuucaccccuggaaaaaggaagagaauggcaaccagagccgggucauccuuuauaccauuacacugaccaauccucucgcucccaaaacagccaccguuagagaaacgcagacaauguacaaggcuucucaagaguccgagugcuaugugaucgaugccgaagugcugacccacgacgucccuuaccaugauuauuucuacaccauuaaccgcuacacacuuacccggguggcgagaaauaagagccgccugcggguuucuacagagcucagauaucgcaaacagcccuggggccuggugaagacguuuaucgagaaaaacuucuggagcgggcuggaagacuacuuucggcaccucgaauccgagcuggccaagaccgagagcacauaucuugcugaaaugcauagacagucuccgaaagagaaggccuccaagaccacaaccguccgccggagaaaacggccucacgcucaucugcgcgugccccaccucgaagagguuaugagcccugugacgacccccacagaugaagacgucggacacagaaucaagcauguggccggcuccacccagacacggcacauuccugaggauacccccaauggguuccaucugcaaucugucagcaaacugcuucucgugaucuccuguguuauuugcuuuucucuggugcugcucgucauccugaacaugaugcuuuucuacaagcuguggaugcucgaguauacgacacagacccugacagccuggcagggacugagacuucaggaacgccucccgcaaagccagaccgagugggcucagcugcuggaaucccagcaaaaauaccacgacaccgagcuccagaaguggcgggaaauuaucaagucuagcgugaugcugcuugaucagaugaaagacucccugaucaaucuccaaaacggcauuagaagccgcgacuauacaucugaguccgaggaaaagagaaaucgguaccacuga

SEQ ID NO: 69984 - RNA, 1344 nt, Artificial Sequence
  derived and/or modified sequence opt5 from GRAMD3__Homo_sapiens__NP_001139791
augaccagacggcagcaagugcugcaggccaagcgcagcauccagcagacauuccaagcucagcucaugcccuggaaauccauguuucacggcagagaggucaagccuguugggccggaccuggaacuuucugaggccgaaaacggaguggaggagaaaaagaaagcgugccggagccccacggcucaguccccuacccccucuguggaggccgauagcccugaccagaagaagauuaucucccuguggucuaaaagcuccuucgauggcgccagccucgcuucugacaagaaugauuguaaaacagaguccaagaacgaccccaaaaccgaacgcaagaagucuagcuccagcucucaauacaaagccaauaugcauuuucacaagcuguuccuuuccgucccuacagaggaaccgcugaaacagagcuuuaccugcgcucuccagaaggagauucuguaucaggggaaacuguucguguccgagaacuggaucuguuuucauucuaagguuuucggaaaagauacaaagauuagcauccccgccuuuuccgugacccucaucaagaaaacgaagaccgcgcugcuugucccuaaugcccugauuaucgcuacagugaccgacagauacauuuucguuagccuccugucucgggauuccacauauaaacuucuuaagagcgugugcggccaccucgaaaacaccucugucgggaauagccccaacccuuccucugccgagaauagcuuucgcgcugacagacccuccagccugccgcuggauuucaacgacgaauuuucugaucucgacggaguggugcaacagcggcgccaggacauggagggcuacuccagcucuggcucccaaacgccugaaagcgaaaauuccagagauuuccaugccacagagucucagaccguccugaacguuagcaaaggggaagcgaagcccacacgggccgacgcucacgugaaucgcgugccugagggaaaggccaaaucccuucccguccagggccugucugaaaccguggggauccuccacaagguuaaaagccagaagugucccaugcugcaucacauucuuaucuucuaugcuauuguggucugcgcccugaucaucuccaccuuuuacaugagauaucggauuaacacacucgaggaacaacugggacugcucacgagcaucguggauacccauaauacagagcaggccgcuccuucuggccugcgcucccagguucaguucaacguggagguccuuugucaagaacugaccgcgaacauugugaaacucgagaagauccagaauaaccugcagaagcugcuggaaaauggggacuga

SEQ ID NO: 69985 - RNA, 1737 nt, Artificial Sequence
  derived and/or modified sequence opt5 from GRAMD4__Homo_sapiens__NP_055939
augcugagacggcucgacaagauccgcuucagaggccacaaacgggaugacuuucuggaucuugccgagagccccaacgcuuccgacaccgaaugcucugaugagauuccucugaaggugccgcgcacaagccccagagacuccgaagaacuccgggauccugccgggcccggaacgcugaucauggcgaccggcguccaggacuucaaucgcacagaauuugauagacuuaacgagauuaaagggcaucuggagaucgcucuccuggaaaagcacuuccugcaagaggaacuccggaaacugcgcgaggagaccaaugccgaaaugcuuagacaggagcuggaccgggaacgccagagacggauggagcucgaacagaagguucaagaggugcugaaggcccgcacagaggaacagauggcucagcagccucccaaaggacaagcccaggcuucuaacggcgccgagagacggagccaggggcuuuccucuagacugcagaagugguuuuacgaacgcuucggagaguauguggaagauuuucgguuccaaccugaggagaauaccgucgaaacagaggaaccgcucagcgcgagacgccugaccgagaacaugcggagacugaaacgcggcgccaagcccgugacgaauuuuguuaaaaaccucuccgcucugagcgacugguacucuguguauaccuccgccauugcuuucacagucuacaugaaugccguguggcauggcugggcgaucccucuuuuucuguuccucgccauccugcggcuuagccugaacuaucucauugcuagaggguggcgcauccaguggucuauuguucccgaaguguccgagccugucgagcccccgaaggaagaucugaccgugagcgagaaguuucagcuggugcucgacgucgcccaaaaagcucagaaucuguucggaaagauggccgacauccuugagaaaauuaagaaccuguucauguggguucagccugagaucacacagaaacucuacguggcccugugggcugcguuucuugccucuuguuucuuucccuaucggcuggugggccucgcugucgggcuguacgccggaauuaaguucuuucugaucgauuucaucuuuaaaagaugcccucgccuccgggccaaguacgacacccccuauauuaucuggagaucccugcccacggauccucaacuuaaggagcggagcuccgcugccgugucucgcagacugcagacaaccagcucccggagcuacguuccgucugcgcccgcuggccucgggaaagaagaggacgccggaagauuccacuccacaaagaaaggcaauuuucaugaaauuuucaaccugaccgagaaugaacgcccucuggccgugugugagaacggcuggcggugcugucuuaucaacagagaucgcaagaugcccaccgacuauauuagaaaugggguccucuacgugacagagaacuaucugugcuuugaaagcucuaaaagcggauccucuaagcggaauaagguuaucaaacugguggauaucacggacauucagaaguacaaaguccucagcgugcugccuggcuccgggaugggaaucgcugucagcacccccucuacacagaagccgcuuguguucggcgccaugguucaccgcgaugaggcuuuugaaaccauucugucccaauauaucaaaauuacaagcgccgcggccucugggggagacuccuga

SEQ ID NO: 69986 - RNA, 993 nt, Artificial Sequence
  derived and/or modified sequence opt5 from GRAP2__Homo_sapiens__NP_001278754
auggaggccguggcuaaguucgacuuuaccgccagcggcgaagaugagcuguccuuccacacaggggacguccucaaaauccugucuaaccaggaagagugguuuaaggcggaacuuggaagccaagagggcuacguucccaaaaauuucauugauauccaguuuccuaagugguuccaugaggggcuguccagacaccaggcugaaaaccuccugaugggaaaagaggugggcuuuuucauuauccgggccucucagagcuccccgggggacuuuucuauuagcgugcgccaugaagaugacguccaacacuucaaggugaugagagauaauaagggaaacuauuuucuuuggacggagaaauuccccucccugaauaagcucguugacuacuaucggaccaacagcaucucucgccagaaacagaucuuucugagagaucggacacgcgaggaccagggccauagaggcaauucccuggaucggcgcagccaagggggaccucaccucucuggcgccgugggggaagagauuagacccuccaugaaccggaagcugagcgaccacccucccacccuuccucugcagcagcaucagcaccaaccgcagcccccucaguacgcucccgccccucaacagcuccagcagcccccgcaacagcgcuaucugcagcaucaccacuuccaucaggaaagacggggaggcucucuugauaucaaugacgggcacugcggaacaggccugggcuccgagaugaacgcugcccucaugcaucgcagacacaccgacccuguccaacugcaggcggccgggcgggugagaugggcucgcgcccuguacgauuucgaagcucucgaggacgaugagcugggauuucauagcggcgaaguuguggagguccuugacuccucuaaucccagcugguggacagggcggcugcacaacaaacucggacuguucccugccaauuauguggcgcccaugaccagauga

SEQ ID NO: 69987 - RNA, 654 nt, Artificial Sequence
  derived and/or modified sequence opt5 from GRAP__Homo_sapiens__NP_006604
auggagagcguggcccuguacuccuuccaggcuaccgaaucugacgagcucgccuuuaacaagggcgauacacugaaaauccuuaauauggaagacgaucaaaacugguauaaggcggagcugagaggggucgaaggauucauucccaaaaauuacauccggguuaagccucacccgugguauagcggccgcauuuccagacagcucgcugaggagauccugaugaaacggaaccaucuuggggccuuucugauucgcgaaucugagagcucccccggagaguucucugugagcgugaauuacggcgaccagguccagcacuuuaaggugcucagagaggccuccgggaaguauuuccugugggaggaaaaauuuaacagccugaaugagcucguugauuucuaccggacgaccacaaucgcuaagaaacgccaaaucuuucugagagacgaagaaccucuucugaagucucccggagccugcuucgcucaggcccaguuugauuucuccgcgcaggacccuagccaacucucuuuucggcgcggcgauauuaucgaagugcuggagagacccgacccucauugguggcggggccgcuccugugggagagucggauucuucccgcggagcuaugugcagcccguucaccuuuga

SEQ ID NO: 69988 - RNA, 759 nt, Artificial Sequence
  derived and/or modified sequence opt5 from GRASP__Homo_sapiens__NP_001258785
augacccugcuccccagcaagggcggggacacaaucgccuccgugaacggacugaaugucgagggcauuagacaccgggaaaucguugauauuaucaaggcuucugggaacgugcuucgccuggagacgcucuacggaaccagcauuagaaaagccgaacuggaggcgcggcuucaguaucugaaacaaacacucuacgaaaaguggggcgaguaucgcucccugauggugcaggagcagagacugguccaugggcucgugguuaaagacccuucuaucuacgauacccuggaaagcgugcgguccugccuuuauggagcuggccugcucccgggcucucugcccuucgggccucuucuggccguccccggacgcccuagaggcggggcccggcgcgcuagaggagacgccgaugacgcuguguaccacacaugcuuuuucggcgauagcgagcccccugcccucccgcccccucccccucccgcgcgggccuuugggccgggaccugcugaaacccccgccguuggcccuggccccgggccccgcgcugcccuguccagaagcgcgucugugcggugugccggaccuggcgggggaggcgggggaggcgcuccgggcgcccuguggacagaggcucgcgagcaggcccucugugggcccggacugagaaagaccaaguaucgguccuucagacgccggcuucugaaauuuaucccuggccucaauagaagccuggaagaggaagagucucaacuuuga

SEQ ID NO: 69989 - RNA, 1647 nt, Artificial Sequence
  derived and/or modified sequence opt5 from GRB10__Homo_sapiens__NP_001001549
auggcccuggcuggcugccccgacagcuuccuccaccauccuuacuaucaggauaagguggagcaaaccccgagaucccagcaggaccccgccgggccuggacugcccgcgcagucugaucggcuugcuaaccaccaagaagacgaugucgaccuggaggcccucguuaaugauaugaacgccagccuggaaucccuuuacucugcuuguagcaugcaguccgacacagugccucugcuccagaauggccagcaugcccgcucucaacccagagcuagcgggccuccgcgguccauccagccccaggugagcccucgccagagaguccaacggucucagcccgugcacauucuggccguucgcagacugcaggaggaagaucaacaguuucggacguccagccucccugcgauccccaacccguucccugagcugugcggacccggcucuccucccgugcuuacccccgggucccugccuccgagccaggccgcugccaaacaggacgucaagguguuuucugaggauggaacauccaaaguuguggaaauucucgcugacaugaccgcccgcgaucugugucaacuucuggucuauaagagccauugcguggacgacaauuccuggacacucguggagcaccacccccaucugggccuggaaagaugucucgaggaucacgagcuggucguucagguggaaucuaccauggcgagcgaguccaaauuccuuuuucggaagaacuacgccaaguaugaguucuuuaaaaauccuaugaacuucuuucccgaacagauggugacauggugccagcaaagcaauggcucucagacccagcugcuccaggaaccucgccaucugcaacuucuggcugaccucgaggauuccaacaucuucagccugauugccgggagaaagcaguacaaugcucccacggaccacggacuguguaucaaaccgaacaagguccggaaugagaccaaagaacuccgccugcuuugcgccgaggaugaacagacaagaaccuguuggaugacagccuuucggcugcucaaguauggcaugcugcuuuaccagaacuacagaaucccucaacagcgcaaggcucugcucucucccuucagcaccccugugcgguccguuucugagaauagccugguggcgauggacuuuuccgggcagacgggaagagucauugaaaaccccgccgaggcucaaagcgccgcccuggaggaaggccacgcuuggcgcaaacggucuacaagaaugaacauccucgggucccagagcccucugcaucccucuacccuuuccacagugauucaccgcacccagcauugguuccacggacggaucagcagagaggaaucccaucgcauuaucaagcagcaaggccugguugauggccucuuccugcugcgggacucucagagcaauccgaaagccuuugugcuuacccucugccaccaccagaagauuaaaaacuuccagauccugccuugugaggaugacgggcaaacauuuuucucccuggaugacggaaauacgaaguuuucugaccucauccagcuggucgauuucuaucagcuuaacaaaggcgugcugcccugcaagcucaagcaucacugcauuagagucgcgcuguga

SEQ ID NO: 69990 - RNA, 1362 nt, Artificial Sequence
  derived and/or modified sequence opt5 from GRB14__Homo_sapiens__NP_001290351
augagccuguccgccagacgggugacccuccccgcuaucacaccuauuauccugcagaagcgcgucauuaaaguuuacucugaggacgaaacgagcagagcccuugaugugccguccgacaucaccgcgcgggaugugugccaacugcucauucugaagaaccacuauaucgacgaucauucuuggacacuuuucgagcaucugccccacaucggcgucgaacgcaccauugaggaccacgaacucgugaucgagguucugagcaauugggggauugaggaagagaacaaacuguacuuuagaaagaauuaugcuaaauacgaguucuuuaagaacccuauguauuucuuucccgaacauaugguguccuucgccacagagaccaauggagaaaucucuccuacacagauucuccagauguuucugagcuccagcaccuaccccgagauccacggcuuccuucacgccaaggaacaggggaaaaagucuuggaaaaagauuuauuucuuccugcggcgcuccggacucuacuuuagcacgaaaggcaccucuaaggagccuagacaucugcaauucuuuuccgaauuugggaacagcgauaucuacgucucucuugcuggaaagaaaaagcacggcgccccgacaaauuauggcuucuguuuuaaacccaacaaggcugggggaccucgggaccugaaaaugcucugcgccgaggaggaacagucccgcaccuguugggugacagcgaucagacugcugaaguacggcaugcagcucuaucagaauuacaugcaucccuaucaagggcggagcggaugcuccucucagagcauuuccccuaugcgcagcaucucugagaacucccugguugccauggauuucagcggccagaaaucuagagugauugaaaaucccaccgaggcucuuagcgucgccguggaagaggggcuggcuuggcggaagaagggaugucuccgccugggcacgcacggcuccccgacagccucuagccaguccagcgcgaccaacauggccauccacagaucucaaccuugguuucaucacaaaauuucccgggacgaggcucagagacuuaucauccagcaagggcugguggauggagucuuccucguucgcgacagccagucuaaucccaagacauuugugcuguccaugagccauggccagaaaauuaagcacuuccagaucauuccuguggaagaugacggggagauguuucauacccuggacgauggacacacccgguucacagaccucauccaacuggucgaauuuuaccagcuuaacaaaggcgugcugcccugcaagcucaagcacuauugugccagaauugcucuguga

SEQ ID NO: 69991 - RNA, 654 nt, Artificial Sequence
  derived and/or modified sequence opt5 from GRB2__Homo_sapiens__NP_002077
auggaggccaucgcuaaguacgacuucaaagccaccgcggaugacgaacugagcuuuaagagaggcgauauucucaaagugcugaacgaggaaugcgaccagaauugguauaaggcugagcuuaacgggaaagauggauucauccccaagaauuacauugaaaugaagccucacccgugguuuuucggcaaaaucccccgggccaaggccgaggagaugcuguccaaacaacgccaugacggggcuuuucucauuagagaaucugagagcgccccuggagauuucucccugucugucaaguuuggcaacgacguucagcacuucaaagugcuucgggauggggcuggaaaguauuuucuguggguggucaaguucaauagccucaacgaacugguggacuaccaucgcuccacaucuguuagcagaaaucagcagaucuuucugcgggauaucgagcaagugccccagcagccuacguauguccaggcccucuucgacuuugauccccaagaggacggcgaacugggcuuccgcagaggggacuucauucacgugauggauaacuccgacccuaauugguggaaaggagcgugucauggccagaccgggauguuuccgcggaacuacguuacacccgugaaucgcaacgucuga

SEQ ID NO: 69992 - RNA, 1668 nt, Artificial Sequence
  derived and/or modified sequence opt5 from GRB7__Homo_sapiens__NP_001229371
augggcaaguggagacccgggcagggacacaccacaggcagcgugaaaccucugucccggucugacgccauggaacucgaucugagcccgccccaucuuuccucuagcccugaagaccugugccccgcuccugggacgcccccuggaaccccgagacccccugauacaccccucccugaggaagucaagagaucccaaccccugcuuaucccgaccacaggccggaaacugcgcgaggaagagagacgggccaccucucucccuagcauucccaacccuuuccccgagcuguguuccccucccagccagucuccgauccucgggggacccuccagcgcgcgcggccugcugccuagagacgcuucucggccccacguugugaagguguacuccgaagauggcgccugccgcagcgucgagguggccgcuggggccacagcuagacauguuugugaaaugcuugugcagcgggcccacgcgcugucugacgagaccuggggacucgucgagugccauccucaccuggcccuugaacgcggccuggaggaucacgaauccgugguugaggugcaggcugccuggcccgucgggggagacagcagauuuguguuccggaaaaauuuugcuaaguaugaacucuucaaguccucuccgcauagccuguuuccugagaaaaugguguccagcugucuggaugcccacacgggcauuucucaugaggaccucauccaaaacuuccugaaugcgggguccuuucccgaaauucagggauuccuucagcugcgcggcagcggcagaaagcucuggaaacgguuuuucugcuuucugagacgcucugggcuuuacuauagcaccaagggaacauccaaagauccucggcaccuccaguacgucgccgacguuaacgagucuaauguguauguggucacccaaggcagaaagcuguacgggaugcccacagauuucggauuuugugugaagccuaacaaacugcgcaauggccacaaggggcugcggaucuucugcagcgaagacgagcaguccagaaccuguuggcucgcugccuuccgccuguuuaaauauggaguucagcuuuacaagaacuaccagcaagcucagagccggcaucugcaccccucuugccucggcuccccgccucugagaagcgccucugacaauacgcuuguggccauggauuucuccggccaugcugggcgcgucaucgaaaacccccgggaggcgcugagcguggcccucgaggaagcucaggccuggcgcaaaaagacaaaucaccgccugucccugcccaugccugccucuggaaccagccucuccgcugccauucaucggacacaacugugguuucacggcagaaucucucgggaggaaagccagcgccuuauugggcagcagggacugguugacggccucuuccuggugagagagucccaacggaacccgcagggguuuguccugagccuuugucaccuccagaaagugaagcauuaucugauccugcccucugaagaggagggcagacucuacuucuccauggaugacggacagacccgcuuuaccgaucugcuucaacuggucgaguuccaccagcucaaucggggcauucugccuugccugcuuagacauugcuguacacgcguggcgcucuga

SEQ ID NO: 69993 - RNA, 1230 nt, Artificial Sequence
  derived and/or modified sequence opt5 from GREB1__Homo_sapiens__NP_683701
augggcaacagcuacgccgggcagcugaagaccacaagauucgaggaagugcuccacaauuccaucgaggcuucucugcggagcaacaaucuugucccccgcccuauuuucucccaacuguaucucgaagccgagcagcagcuggcggcucuugaaggaggcucuagaguugacaacgaggaggaagaggaagagggggagggaggccuggaaacgaaugggccgcccaacccuuuccagcuccauccccugccugagggaugcuguaccacagauggcuuuugccaagccggcaaagaccugcggcucgugagcaucuccaaugaacccauggaugugccugccggguuccugcuugucggagugaagucuccgagccugcccgaccaccuccugguuugugcuguggauaaacgcuuucuuccugacgauaacggccauaaugcccugcucggguucuccggaaacugcgucggcugugggaagaaaggauuuugcuacuucaccgaguuuagcaaucacauuaaccugaagcugacaacccagcccaagaaacagaagcaucucaaauauuaccuggugagaaaugcucagggcacacuuaccaagggcccucugaucuguuggaaagggucugaauuucggucccgccaaauucccgccagcacguguucuuccagccucuuuccggcgcuggagucuaccgccgcuuucccuuccgagcccguuccuggaacaaaccccagcauccuuaugggcgcccagcaggcugggcccgccuccgaccacccuucucugaaugcggccaugggaccggcuguguuuaacggcaaggauagccccaagugccagcaacucgccaaaaacaaucugcuggcucucccuagacccuccgcccuggggauccuuagcaacucuggaccucccaagaaacggcacaagggcugguccccggaaagcccuucugcccccgacggcgggugcccucagggaggcgggaaucgcgcuaaauaugagagcgcgggaauguccugugucccccaggugggccugguggggccugccucugucaccuuccccguuguggcuagcggcgaaccgguguccgucccugauaaccuccugaagauuugcaaagccaagcccgugaucuucaagguuuuugugaauggagccacacaaauggucgcucuuggccccgccgagccugcgagcccgagaucucuguga

SEQ ID NO: 69994 - RNA, 432 nt, Artificial Sequence
  derived and/or modified sequence opt5 from GREM1__Homo_sapiens__NP_001178252
augagcagaaccgccuacacagugggcgcucugcuccugcuucuggggacgcuccugcccgccgcggagggaaagaaaaagggcucccagggggcuaucccuccgcccgacaaagcccuucacgucaccgaacggaaguaucugaaacgcgauuggugcaagacacaaccucucaagcagaccauucaugaggaaggauguaacucuagaacaaucauuaaucgguucugcuacggccaguguaacagcuuuuauaucccccgccacauuagaaaagaggaaggguccuuccagucuugcagcuuuuguaagccuaaaaaguucaccacaaugaugguuacccugaauugccccgagcugcaaccuccgacgaaaaagaagcgggugacccgcgugaaacaguguagaugcaucuccaucgaccucgauuga

SEQ ID NO: 69995 - RNA, 561 nt, Artificial Sequence
  derived and/or modified sequence opt5 from GREM2__Homo_sapiens__XP_005273283
augagagcccugcgggcugagagcaccuccggcucucgccagacacccugcagaauguucuggaagcucagccugucccuuuuucugguggccguccucguuaaaguggcggaagcucggaagaaccgcccugccggggccaucccgucucccuacaaagacggaagcuccaauaacucugagagauggcaacaccagauuaaggaagugcuggcuagcucccaggaggcccuugucgugacggaacggaaauaucucaagagcgauugguguaagacccagccucugcgccaaacaguuucugaggagggcugcagaucccggaccauccugaaucgcuucuguuacgggcagugcaacagcuuuuauauucccagacaugugaaaaaggaagaggaaucuuuccaguccugugcuuuuugcaaaccucagcgggucacaagcgugcugguugagcucgagugucccggacuggacccuccguuccgccuuaagaaaauccaaaaggugaagcagugcagauguaugucugucaaucuguccgauagcgacaaacaguga

SEQ ID NO: 69996 - RNA, 1857 nt, Artificial Sequence
  derived and/or modified sequence opt5 from GRHL1__Homo_sapiens__NP_937825
augacccaggaguacgacaacaagagacccgugcugguccuccaaaaugaagcccuguauccucagcggcgcagcuacacauccgaggaugaggcuuggaaaucuuuccuugaaaacccgcugacggccgcgaccaaggcuaugaugagcaucaauggcgacgaagauuccgccgccgcucucgggcugcuuuaugacuacuauaaaguucccagagagcggcgcucuagcacagccaagccugagguggaacaccccgagccugaucauuccaaaagaaacucuauucccaucgugaccgaacagccucugauuagcgcuggagagaaucggguccaggugcucaagaacguuccguuuaauaucgugcugccccacggcaaccaacuggggauugacaagcgcggacaucucacagccccugauaccacagucaccguguccaucgcgacgaugcccacccacagcaucaaaacagagacccagccucauggcuucgccguugggauucccccggcuguguaccacccugaacccacagagagagucgugguguuugaccggaaucugaacaccgaucaguucucuuccggagcccaggcuccuaaugcccaacgcagaacgcccgacagcacauuuucugaaaccuucaaggagggcguccaggaaguguuuuuccccuccgaucuuagccugcggaugccuggcaugaacucugaggacuauguuuuugauuccgugagcgggaauaacuucgaguacacacucgaagcguccaaaucucugcgccagaagccgggagacagcaccaugaccuaccuuaauaaaggccaguuuuaucccaucacacugaaggaggucuccagcucugaagggauucaccauccuaucuccaaggugagaagcguuauuaugguggucuucgccgaggacaaaucucgggaagaucaacuccgccacuggaaguacuggcauagcagacagcacacggcuaaacagcggugcaucgacauugccgauuauaaggaguccuuuaacaccaucucuaacaucgaggaaauugcuuacaaugccaucagcuucacaugggacauuaacgaugaggccaaaguguucaucuccguuaauugucugagcaccgacuuuucuucccaaaagggagugaaaggccugccccucaacauucaggucgauacauauagcuacaauaacagaucuaauaagccugugcaccgcgcuuauugccagaucaaggucuucugugacaaaggggcggaacggaagaucagagaugaggaacgcaaacaguccaagcggaaagugagcgacguuaaggugccccugcuuccgucccauaagagaauggauauuaccgucuuuaaaccuuucaucgaccuggacacgcaacccgugcucuuuauuccugauguucacuucgccaaccugcagcgcggaacacaugugcuucccaucgcuucugaggagcuggaaggcgagggcagcguccucaagcgggggccuuacggaaccgaagacgauuuugccgugcccccguccaccaaacuggccagaauugaggagccuaagcgcgugcugcucuacguucggaaagaaucugaggaagucuucgacgcucugaugcuuaagacacccagccugaagggccucauggaggccaucuccgauaaauaugacgugccccacgauaagaucgggaaaauuuuuaagaaaugcaagaagggaauccuggugaauauggacgauaacauugucaaacauuacagcaaugaagacaccuuccagcuucagaucgaggaggcgggcgggucuuauaagcugacacucacggaaauuuga

SEQ ID NO: 69997 - RNA, 1878 nt, Artificial Sequence
  derived and/or modified sequence opt5 from GRHL2__Homo_sapiens__NP_079191
augagccaggaguccgacaacaauaagagacugguggcccucguccccaugccuucugauccgcccuucaacacccggcgcgcuuacacaagcgaagacgaggccuggaaauccuaucuggaaaauccucuuacggcggcuaccaaggccaugaugucuaucaacggcgaugaggacagcgccgcugcccuggggcuccuguacgauuauuacaaaguucccagagacaagcggcuucuguccgugucuaaagcuagcgauucccaagaagaccaggagaagcgcaauugccucggaacaagcgaggcccagucuaaccuguccggcggggaaaauagagugcagguccugaagaccgugccuguuaaccucagccugaaucaagaucaccuugagaacucuaaacgggaacaguauuccauuagcuuucccgagucuuccgcgaucauuccugugagcggaaucacagucgugaaggccgaggacuucaccccgguuuuuauggcucccccugugcauuacccccgcggcgauggggaagaacagagagucgugauuuucgaacagacacaauaugacgugccuucccuggccacccacucugcuuaccucaaagaugaccagcggagcacgcccgacuccaccuacagcgagucuuuuaaggaugccgcgacagaaaaauuccgcuccgccagcgucggagcugaggaguauauguacgaccagaccucuagcggcacauuucaguauacccuggaagccacgaagucccuuagacaaaagcagggcgaggggccgaugacauaccugaauaaaggacaguucuaugcuaucacccucucugaaacaggcgauaacaaguguuuucggcauccuaucagcaaaguucgcuccguggugauggucguguucagcgaggacaagaauagagaugaacaacugaaauacuggaaguauuggcacucucggcagcauaccgccaaacagcgcguucuggacauugccgauuacaaggaguccuuuaacaccaucgggaauauugaggaaaucgcuuacaacgcggugagcuucacaugggacgucaacgaggaagccaagauuuuuaucacggugaauugccucucuaccgauuucuccagccagaaaggaguuaagggccugccccuuaugauucaaaucgacacauauuccuacaacaauagaucuaacaaaccuauccaccgggcuuauugucagauuaagguguucugcgauaaaggggccgagagaaagauccgcgacgaggagcggaagcagaauagaaagaagggaaaaggccaggccagccaaacccaguguaacuccucuagcgacggcaagcuggcugccauuccccuccagaaaaaguccgauaucacauacuuuaagaccaugcccgaccugcacagccagccuguccuuuucauuccggaugugcauuuugcgaaucugcaacgcacggggcaggucuauuacaacacagacgaugagcgggaaggaggcucugugcucguuaaaagaauguuccgccccauggaggaagaguuugggccugugcccuccaagcagaugaaagaggaaggaaccaagcggguccugcuguaugugagaaaagagaccgacgauguuuucgacgcucucaugcugaaaagcccuacagugaagggccuuauggaagccaucucugagaaauacgggcugcccgucgaaaagaucgccaaacucuacaagaaauccaagaaaggcauucuggugaauauggaugacaacaucauugagcacuauagcaaugaggauaccuuuauccuuaacauggaaucuaugguggagggauucaagguuacacugauggaaauuuga

SEQ ID NO: 69998 - RNA, 987 nt, Artificial Sequence
  derived and/or modified sequence opt5 from GRHPR__Homo_sapiens__NP_036335
augagacccgugcggcugaugaaggucuucguuacccgcagaaucccugccgagggccggguggcucucgcccgcgcggcugacugcgaaguggagcagugggauagcgacgaaccgauucccgccaaggagcuggaaagaggggucgccggagcucacggccuucugugucuccuguccgaucauguggacaagcggauccuugaugccgcuggggccaaccugaaaguuauuucuacaaugagcgugggaaucgaccaccucgcgcuggaugagauuaagaaacgcggcaucagagucggguacacgccugacgugcugaccgauacaaccgccgagcucgcuguuucccugcuucugacaaccugccggcgccuccccgaagccaucgaggaagugaagaauggaggcuggacaucuuggaagccucuguggcuuuguggcuaugggcugacccaaagcacggucggaauuaucggccucgggagaauuggacaggcuaucgcccggcgccugaaacccuuuggcgugcagagauuccuguacaccgggcggcagccucgcccggaggaggcggccgaauuucaagcugaguucguguccacacccgaacucgccgcucagucugacuuuauugucguugccugcagccugaccccugccacagagggacuuuguaacaaggauuucuuucagaaaaugaaggaaaccgcuguguucaucaauauuuccagaggcgacguggucaaccaggaugaccuguaucaagcgcucgccagcggcaaaaucgcugccgccgggcuggacgugacgucucccgagccucuucccacaaaucauccgcugcucacccugaagaacugcguuauccugccucacauuggauccgcuacacaucggaccagaaauaccaugagccuccuggccgcgaacaaucuucuggcuggccuccgcggggagcccaugccuucugaacugaaacuuuga

SEQ ID NO: 69999 - RNA, 2721 nt, Artificial Sequence
  derived and/or modified sequence opt5 from GRIA1__Homo_sapiens__NP_000818
augcagcacaucuucgccuuuuucugcaccggcuuucugggggcuguggucggagccaacuuccccaauaacauucaaaucggcgggcucuuuccuaaucagcagagccaggagcaugcggcuuucagauuugcccugucccaacuuacagaaccgcccaagcugcucccucagauugacaucguuaacauuucugauagcuucgagaugacguaccgguuuuguucccaguucucuaaaggaguguaugccaucuuuggcuucuacgaacgcagaaccgugaauaugcugaccagcuuuugcggggcccuucacgucuguuucaucacacccuccuucccuguggacacaucuaaccaguuuguucugcaacuccggcccgagcugcaggaugcucugauuagcaucauugaccauuauaaguggcagaaauucguguacaucuaugaugcugaccgcggacucuccguccugcagaaggugcuugauaccgccgcggaaaagaauuggcaaguuacagccgugaacauucugaccacgaccgaggagggcuacagaaugcucuuucaggaccuggaaaagaagaaagagcggcuugucgugguggauugcgaaagcgagcgccugaaugcuauccucggccagauuaucaagcuggagaaaaacgggaucggauaucacuacauucuggccaaucucggcuucauggacaucgaucugaacaaguuuaaagaaucuggggcuaaugucacaggauuccaacuuguuaacuacaccgacacaauuccugccaagaucaugcagcaguggaaaaauuccgaugcgagagaccauacccggguggacuggaaacgcccgaaguauacgagcgcccugacauacgauggcgugaaagucauggcugaggccuuucagucucucagacggcaacgcauugacaucuccagacgggggaacgcuggagauugucuggccaaccccgccgugccuuggggccagggcaucgacauucagcgcgcgcuucagcaaguuagauucgaagggcugaccggaaaugugcaguuuaacgagaagggccggagaacaaauuauacccuccacgucaucgaaaugaaacacgaugggauucgcaagaucggauacuggaacgaggacgauaaauucgugcccgcugccaccgacgcucaggccggcggggauaauagcucuguucagaaccggacauauauugugacgaccauccuggaggacccuuacgucaugcugaagaagaaugccaaccaauuugaaggaaaugauagauaugagggcuacugcguggaacucgcugccgagaucgcgaaacaugucggcuacuccuaucgccuggaaauugugagcgacgggaaguacggagcucgggaccccgauacaaaagccuggaacggcaugguuggggagcuuguguaugggagagccgacgucgcuguggccccgcugaccaucacacucguucgcgaggaagugauugauuucuccaagccuuuuaugucucugggcaucagcauuaugaucaaaaagccccagaaguccaaaccuggggucuucagcuuccuugacccccuggcuuacgagauuuggauguguaucguguuugccuauaucggcgugucuguuguccucuuccuggugucccgguuuagccccuacgaauggcacucugaggaguucgaagagggaagagaucagaccacgagcgaccaguccaaugaauuuggcauuuucaacucucugugguuuagccucggggcguucaugcaacagggaugcgauaucuccccucgcagccugucuggccggauugugggaggagucuggugguuuuucacacuuaucauuaucuccagcuauaccgccaaucuggcugccuuucucaccguggagagaaugguuucuccgaucgaauccgcugaggaccuggccaagcagacagagauugcguacggcacccuggaagccgggagcacaaaagaguucuuucgccgguccaagaucgcuguguucgaaaagauguggacguacaugaagucugccgagcccagcgucuucgugagaaccacagaagagggcaugauucggguucgcaaguccaaaggaaaguaugcuuaccuucucgagucuaccaugaacgaauauaucgagcaaagaaaaccuugugauacaaugaaggugggcgggaaucuggacagcaaaggauacggcauugccacccccaagggguccgcccugcggaacccugucaaccucgcugugcugaaacuuaaugaacagggacugcucgauaaacugaagaacaaauggugguaugacaagggcgagugcgggagcggcggaggcgauucuaaagacaagacguccgcgcugagccuuucuaauguugccgggguguuuuacauccucaucggaggccuggggcuggcuaugcucgucgcccugauugaguucuguuauaaauccagaagcgaaucuaagcgcaugaagggauuuugccuuaucccccagcagagcauuaacgaggccauccggaccuccacacugccgagaaauagcggcgcuggggccucuuccggcggaagcggcgaaaacgggcgcguggugucccaugacuucccuaaaucuaugcaaagcauucccugcaugucccacucuagcggaaugccucucggcgcgaccgggcuguga

SEQ ID NO: 70000 - RNA, 2652 nt, Artificial Sequence
  derived and/or modified sequence opt5 from GRIA2__Homo_sapiens__NP_000817
augcagaagaucaugcacauuagcgugcugcucucccccguccuguggggccuuaucuucgggguuucuagcaacuccauucaaaucggaggccuguuuccuagaggggccgaccaggaguacucugcuuuccgggugggaauggugcaguuuagcaccuccgaguuccgccucacaccgcauauugauaaucuggaagucgccaacucuuuugcggugacgaaugcuuucugcagccaguuuuccagaggcguuuaugccaucuucggguuuuacgacaaaaagagcgugaacaccaucacaucuuucuguggaacccuucacgucuccuuuauuacacccagcuucccuaccgauggcacacaucccuuugugauccaaaugcggccugaccugaaaggcgcccuccugucucugauugaauauuaccagugggauaaguucgcuuaucucuacgacuccgaucgcgggcugagcacccuucaggccguucuggacucugcugccgagaaaaaguggcaagugacggcgaucaaugucggaaacauuaauaacgauaagaaagacgaaauguauagaucccucuuccaggaucuggagcuuaagaaagagcggcgcgugauccuggacugcgaaagagauaaggugaaugacauugucgaccagguuaucaccaucggcaaacacgugaagggguaccauuacauuaucgccaaccucggauuuacagauggcgaccugcugaagauucaguucgggggagcuaaugugagcggcuuucagaucgucgauuaugacgauucccucgugucuaaauucauugagcgguggagcacccuggaagagaaggaguaccccggcgcccacacaaccacgaucaaauauacauccgcucuuaccuacgacgccguucaagugaugacagaagcguuucgcaaccugagaaagcagcggaucgagauuagccgcagagggaaugccggagauugucucgcuaacccugccgucccguggggccaggggguggaaaucgagcgggcucugaaacaaguucagguggaaggacuuucuggcaauauuaaguucgaccagaacgggaaacgcaucaacuauaccauuaauaucauggagcugaagaccaacggacccagaaagaucggcuacugguccgaggucgauaaaaugguggucacacucacggaacugccuagcggcaaugacaccucugggcuggagaacaagacagugguugugaccacaauucucgaaagccccuaugucaugaugaaaaagaaucacgagaugcuggaaggaaacgagcgguacgagggcuacugcguggaucuugccgccgaaaucgcuaaacauuguggguuuaaguauaagcugaccauuguuggagacggcaaauacggggcgagagacgccgauacgaagaucuggaauggcauggugggagagcucgucuauggcaaagcugacauugccaucgccccucugacaauuacccuugugcgcgaagaggugaucgauuucuccaagcccuuuaugucucuggggaucagcauuaugaucaaaaagccgcagaaguccaaaccuggaguuuucagcuuucucgacccccuggcuuacgaaauuuggaugugcaucgucuucgccuauauuggcgugucugugguccuguuucucgugucccgguucagcccuuacgaguggcacaccgaggaguucgaagaugggagagaaacacaaucuuccgagagcaccaacgaguuuggaaucuucaauucccugugguuuucucuuggcgcguucaugcgccaggggugugacaucagcccccggucccugucuggcagaauuguuggaggcguguggugguuuuucacacucaucauuaucagcuccuauacggcuaaccuggccgccuuucugaccgucgaacgcauggugagccccauugagucugcugaagaucuuuccaagcagacagagaucgccuacgggacccucgacagcggaucuacaaaagaguucuuucggagauccaagaucgcuguuuucgauaaaauguggaccuacaugcgcagcgccgaaccuucuguguuuguccggacgaccgcggagggcguggccagaguucgcaagagcaaggggaaauaugcuuaccugcuggaauccacaaugaaugaguauauugaacagcggaagccgugcgacaccaugaaagugggaggcaaccucgauagcaagggguacggcaucgccacacccaaaggaucuucccugagaaccccugucaaucuugcugugcugaagcucagcgagcaaggcgugcuggacaaacugaagaacaaguggugguaugauaaaggggaauguggagccaaggacuccggcucuaaagagaagacgagcgcgcuuucccucucuaaugucgccgggguuuucuacauucuggugggaggccuggggcucgcuaugcugguggcccuuaucgaguuuugcuauaaaagccgggcugaagccaagcgcaugaaggucgccaaaaacgcucagaacauuaaucccuccucuagccagaacucccagaauuucgcgacauacaaggagggcuacaacguguauggaaucgaaagcguuaaaaucuga

SEQ ID NO: 70001 - RNA, 2685 nt, Artificial Sequence
  derived and/or modified sequence opt5 from GRIA3__Homo_sapiens__NP_000819
auggccagacagaagaaaaugggccaaagcgugcugcgggcugucuucuuucucguucuggggcuucugggacacucccauggcggguuccccaacaccaucucuauuggaggccucuuuaugcgcaauacagugcaggagcacagcgccuucagauuugcggugcagcuguacaacacgaaucagaacaccacagaaaagccuuuccaucuuaauuaucacgucgaccaucuggauuccucuaacagcuuuuccgugaccaaugcuuucugcucucaauuuagccgcgggguuuacgccaucuucggauuuuaugaccagauguccaugaacacacucaccagcuucuguggcgcccugcacacaucuuuugugaccccguccuuccccacggaugcugacguccaguucgugauucagaugcggccugcccugaaaggcgcuauccucagccugcuugggcacuacaagugggagaaauuuguuuaucuguacgauaccgaaagaggauucucuauucuccaagccaucauggaggcggccgugcagaauaacuggcaggucacagcucgguccgugggcaauaucaaggacgugcaggaauuucgcagaauuaucgaggagauggaucggcgccaagaaaagagauaucugauugacugcgaggucgaacggaucaacaccauucuugagcagguugugauccuggggaaacauagccgcggauaccacuacaugcucgccaaucugggcuucacagauauucugcucgagagagugaugcaugggggagcuaacaucaccggcuuucagaucgucaauaacgaaaaccccauggugcaacaguucauucagcgguggguucgccuggacgagagagaauuuccugaggccaagaaugcgccccuuaaauauacgucugcccugacacacgaugcuauccucgugauugccgaggcuuuccgguaccugagacgccagcgggucgacguguccagacgcggcagcgccggggauugucuugccaacccugcuguuccguggucccaaggaaucgacauugagcgggcgcugaagauggugcagguccagggcaugaccgggaauauccaguuugacacauauggaagacgcaccaacuacaccaucgauguguaugagaugaaagucucuggcagccggaaggccggguacuggaaugaauaugagagauucgugcccuuuuccgaccaacagauuagcaacgauucugcuuccagcgaaaaucgcacaaucguugugacgaccauucucgagucuccuuacgucauguacaagaaaaaccacgaacagcuggagggaaaugagcgguaugaaggcuacugcguggaccuggccuaugagaucgccaagcauguuagaauuaaauacaagcucagcaucgugggcgaugggaaauauggagcucgcgaccccgaaacaaagaucuggaacggcauggucggggagcugguguacggacgggccgauauugcgguggcuccucuuaccaucacacugguuagagaagaggucauugacuucuccaaacccuuuaugucucucggcaucagcauuaugaucaagaagccgcagaaauccaagccugggguguucagcuuccuggauccccuugccuaugagauuuggauguguaucguguuugccuacaucggcgucucugugguucuguuccucgugucccgguuuagcccuuacgaauggcaccuggaggacaauaacgaagaaccccgcgauccccaaucuccuccggaucccccuaaugaguucggaauuuuuaacucccugugguucagccucggcgcuuuuaugcagcaggggugcgacaucucccccagaucucugagcggacggauugucggcgggguguggugguucuuuacccuuaucauuaucuccucuuauacggccaaucuggcugccuuccucacaguugaaagaauggugagcccuaucgaguccgcggaagaccuggccaaacagaccgagauugcuuacggaacccuggacagcggcucuacaaaggaauuuuuccgccgguccaaaaucgccgucuaugagaagauguggagcuacaugaagucugcugagcccuccguguuuaccaaaacaacggccgaugggguugcgagagugcgcaagagcaaaggcaaguucgccuuccuucucgaaucuaccaugaacgaguauauugaacaaagaaaaccgugugacacaaugaaggucggaggcaaccuggauagcaagggguacggaguggcuaccccuaaaggcuccgcccuggggaaugcugugaaccucgccguccugaaacuuaaugagcagggacugcucgacaagcugaagaacaaauggugguaugauaagggcgaaugcgggagcggcggaggcgacucuaaggauaaaacauccgcccugagccuuuccaauguugcugggguguuuuacauccucgugggaggccuggggcuggcgaugauggucgcccucauugaguucuguuacaagucucgggcugagagcaaacgcaugaagcugaccaaaaacacgcagaauuuuaagcccgccccugccaccaacacacaaaauuaugcuaccuacagagaaggauauaacguguacggcacagaguccguuaaaaucuga

SEQ ID NO: 70002 - RNA, 2655 nt, Artificial Sequence
  derived and/or modified sequence opt5 from GRIA4__Homo_sapiens__NP_001070711
augagaaucauuagccggcagaucgugcuucucuucuccggcuuuugggggcuggccaugggagcuuuccccucuagcguccaaauuggcgggcuuuuuauccgcaacaccgaccaggaguacacagccuucagacuggcgauuuuucuccacaauacguccccuaacgcuucugaagccccguucaaucugguuccccauguggauaacaucgagaccgccaauagcuuugcugugacaaacgccuucugcucccaguauucucggggagucuuugcuaucuucggccuuuacgacaagcgcagcgugcacacccugacauccuuuuguagcgcccuccauauuucucugaucaccccuuccuuccccacagaaggggagagccaguuuguucugcaacucagaccuucucugcggggagcgcuucugucccuccuggaucacuaugaauggaauugcuucguguuccuuuacgacaccgaucgcggcuauagcauucugcaggccaucauggagaaagcuggccagaacggguggcaugucucugccauuuguguggagaauuuuaacgacguuuccuacagacagcuccuggaagaacuggaucggcgccaagaaaagaaauucgugaucgacugcgagauugagagacuccagaauauccuggaacagaucgucagcgugggaaagcacgugaaaggcuaucacuacauuaucgcuaaccuuggguuuaaggauauuucccuggagcgguucauccauggaggcgccaaugucacgggguuucagcucguugacuucaacacccccauggugauuaagcugauggaucgcuggaaaaagcuggaccaaagagaauacccuggaucugagacaccgcccaaauauaccagcgcgcugacauacgauggcgugcucgucauggccgaaaccuuucggucccugcgcagacagaagaucgacaucagccggagaggcaaugcuggggacugucuggccaacccugcugcccccuggggacagggcauugauauggagcgcacgcucaaacaagugcggauccaggggcugacaggaaacguucaguucgaccacuauggcagacgcgugaauuacaccauggaugucuuugagcuuaagucuacagggccucggaaggugggauauuggaacgacauggauaaacugguucucauucaggacgugcccacccugggcaaugauaccgccgcuaucgaaaacagaacagucguggucacgaccauuauggaguccccguacgugauguauaagaaaaaucaugaaauguucgagggcaacgacaaguacgaaggguacugcguugaucuugcgagcgagaucgccaaacacaucggaauuaaguauaaaaucgcuauugugccugacggcaaguacggggcccgcgaugccgacacaaagaucuggaauggaauggucggcgagcugguguaugggaaagcugaaauugccaucgcgccccucaccauuacacugguucgggaggaagugaucgacuuuucuaagccuuucaugagccugggcaucuccauuaugaucaaaaagccccaaaaaucuaagcccggagucuuuagcuuccucgauccucuggcuuacgagauuuggauguguaucguguucgccuauauuggcguguccguuguccuuuuucuggugagcagauucucuccguacgaauggcacaccgaggagcccgaagacgggaaggagggaccuuccgaucagcccccuaacgaauuuggcaucuucaauagccucugguuuucucugggggccuucaugcagcagggaugcgacaucagcccccgcucccuguccggccggauugucgggggcguguggugguuuuucacgcuuaucauuaucucuagcuauacagcuaaccucgccgcuuuucugaccguggagagaaugguuuccccgauugagucugccgaagaucuggcgaaacaaaccgagaucgccuacggaacacucgacagcggcuccaccaaggaguucuuucgccggagcaaaaucgcuguguacgagaagauguggacauauaugagaucugccgaaccuuccgucuucacgcggaccacagcugaggggguggcccgcguuagaaaaagcaagggaaaguuugcguuccugcuugagucuaccaugaaugaauacauugagcagcggaaacccugugauacaaugaaggugggcgggaaccuggacuccaaaggauauggcgucgccaccccuaaggggagcucucucggcaaugcugugaaccuggccguucugaaacuuaaugaacagggacuccuggauaagcugaagaacaaauggugguacgacaagggcgagugcgggagcggaggcggggauuccaaagacaagacgagcgcucucucucuguccaacguggccggagucuucuauauccuugugggcgggcugggccucgccaugcugguggcucugauugaauuuuguuacaaaagcagagcggaggccaagcgcaugaaagucgcuaaguccgcccagaccuucaaucccacaucuagccaaaacacccagaaucuugccacauaucgggagggauacaacguuuacggcaccgaauccaucaagauuuga

SEQ ID NO: 70003 - RNA, 3030 nt, Artificial Sequence
  derived and/or modified sequence opt5 from GRID1__Homo_sapiens__NP_060021
auggaggcccugacccucuggcugcuucccuggaucugccagugugugagcgucagagcugacuccauuauccacauuggcgccaucuucgaagagaacgcggcuaaggaugaccggguuuuucaacuggccgugucugaucucagccugaaugacgauauucuucaguccgagaaaaucacauacucuaucaaggugauugaggccaacaauccuuuccaggcuguccaggaagccugcgaccugaugacgcaagggauccucgcucuggugaccagcacaggaugugccuccgcgaacgcccugcagucucucaccgaugcuaugcauauuccgcaccuguuuguucagcgcaaucccggcgggagcccuagaacagccugccaucuuaaccccuccccugacggagaggcuuauacccuggccagccggcccccugugcgccucaaugaugucaugcugagacuugugacagagcugcgguggcagaaauucguuauguuuuacgacucugaauaugauauccgcggccuccaauccuuccuggaccaggcgagcagacuggggcucgaugugucucugcagaaggucgacaaaaacauuucccacguguuuaccagccuuuucacgaccaugaagacagaggaacugaaucgguaccgcgacacccucagacgggccauccugcuucugucuccgcagggagcucauuccuuuauuaacgaggccguggagacaaaucucgcuagcaaggauucccacugggucuucguuaacgaagagaucucugaccccgaaauccuggaucuggugcacagcgcccucggccgcaugaccguggucagacaaauuuuuccuuccgccaaagacaaucagaaguguacgcggaacaaucaucgcaucagcucucugcuuugcgauccccaggagggcuaucugcaaaugcuccagauuuccaaccuguaccuuuaugacagcgugcugaugcucgcuaacgcguuccacagaaaacuggaagaucggaaguggcauucuauggccagccugaauuguaucagaaaauccacaaagccuuggaacgggggacgcucuaugcucgacaccauuaagaaaggccacaucacagggcugaccggaguuauggaguuucgggaggauagcuccaaucccuacgugcaguucgaaauccuuggcaccacauacagcgagacguucgggaaggacaugagaaaacuggcuaccugggauucugaaaagggacucaacggcucccugcaggagcgcccgaugggcagccggcugcaagggcuuacacucaaagucgugaccguucuggaggaaccuuuugugauggucgccgagaauauucugggacagcccaagagauauaaaggcuucucuaucgacgugcucgacgcccuggcuaaggcccuuggguuuaaguacgaaauuuaucaggcgccugauggacgcuacggccaccagcugcauaacacauccuggaaugggaugaucggagagcucauuagcaaacgggcugaccuggccaucuccgccaucaccauuacgcccgaaagagagucugucguggauuucagcaagcgcuauauggacuacuccguuggcauccugauuaaaaagcccgaagagaaaaucucuauuuuuagccuuuucgcuccuuuugauuucgccgugugggcuugcaucgccgcggccauuccggucgugggcguucucaucuuugugcugaaccggauccaagcugucagagcccaguccgcugcccagccccgcccuagcgcgucugccacacugcacuccgcuauuuggaucguguauggggccuucgugcagcaaggaggcgagagcucuguuaauuccauggcuaugcggauugucauggggagcugguggcucuuuacccugaucguguguucuagcuacaccgccaaccuugccgcuuuccugacaguguccagaauggacaaucccauucggaccuuucaggaucucagcaagcaggucgaaaugucuuacggaacagugcgcgacuccgcgguuuaugaguacuucagagccaagggcacgaacccucuggaacaggauagcaccuucgcugagcuguggcggacaaucuccaaaaaugggggcgccgacaacugcgugucuagccccuccgagggaaucagaaaggccaaaaagggcaauuaugcuuuucuuugggaugucgccgugguugaauacgcggcucucaccgacgaugacuguucugugacagucauugggaacagcaucuccucuaaaggauauggcauugcccugcaacaugggagcccguaccgcgaccuguucucccagcggauccucgagcugcaggauaccggagaccuugaugugcugaagcaaaagugguggccucacaugggcagaugcgaccucacgagccaugccucugcucaggccgaugggaaaucccugaagcugcacagcuuugcgggcguuuucugcauucuugcuaucggacuccugcuggccugucucguggccgcucuggaacuuugguggaacucuaaucgcugccaccaggagacccccaaagaagacaaggaggucaaccuggaacaggugcauagacggaugaacucccucauggaugaagacaucgcccacaaacaaauuagcccugcuucuaucgagcuguccgcccuggaaaugggcgggcuugcgcccacacagacccuggagccuacacgcgaauaucagaauacccagcucagcguguccacguuucugcccgagcaaagcucucauggaacaagcagaacccucuccucuggcccgagcuccaaucugccucuuccccugucuagcuccgccacaaugcccucuaugcaguguaagcaccggagcccuaacgggggacucuuccgccaguccccggucaagacccccauuccuaugagcuuucagcccguuccuggcggggugcugcccgaggcucuggauaccucucacggcacauccaucuga

SEQ ID NO: 70004 - RNA, 2739 nt, Artificial Sequence
  derived and/or modified sequence opt5 from GRID2__Homo_sapiens__NP_001273767
auggagguguuccccuuucugcucguccugagcguuuggugguccagaaccugggacucugccaacgcugauagcaucauucacaucggcgccauuuucgacgaauccgcgaagaaagaugacgagguguuucggacagcugugggggaucuuaaucagaacgaagagauccugcaaacggaaaagauuaccuucucugucacauuuguggacggaaauaacccuuuccaggccguucaggaggauauccgcggcauccaggaguuucucgacaaagugagccaacaggggauggaugucgcccugcagaagguggaaaauaacauuaauaaaaugaucaccacacuuuucgacaccaugagaauugaggaacugaaccgguaccgcgauacacucagacgggcuauccugguuaugaauccggccaccgcuaaguccuuuauuacggagguggucgagaccaaccugguggccuucgacugccauuggaucauuaucaaugaagagaucaacgauguggacguccaggaacucguucgcagaucuauuggacggcugacaaucauucgccaaaccuuucccgugccucagaauaucagccagagauguuuccggggcaaccaccgcauuuccagcacacuuugcgaccccaaggauccuuuugcgcagaauauggagaucucuaaccuguauaucuacgacaccgugcuccugcuugccaacgcuuuccauaaaaagcuggaagauagaaaauggcacuccauggccagccucucuuguauucggaaaaauuccaagcccuggcaagggggacgcagcaugcuggagacgaucaagaagggcggcgucucugggcugacaggagagcucgaguucggcgaaaacgggggaaauccuaacgugcauuuugaaauucugggcaccaauuauggggaggaacuuggaagaggcguucggaaacugggcugcuggaacccggugacagggcucaauggaucccugaccgacaagaaacuugagaacaauaugagaggcgucgugcugcgcguugugaccguccucgaggaacccuucgugauggucagcgagaacgugcuggggaagccuaaaaaguaccagggauuuuccaucgauguucuggacgcucucucuaauuaucugggcuucaacuacgaaauuuauguggcccccgaucacaaauacgggagcccucaggaggacggaacauggaauggccuugucggcgaacugguguuuaagcgggcggauaucgggaucuccgcccucacgauuacccccgacagagagaacguuguggauuucacaacccgcuacauggacuauagcgucggagugcugcuucggagagcugagaagacaguggacauguuugccugucuggcuccguucgaucucucucugugggccugcaucgccggcaccguucugcucgucgggcugcuuguguaccugcucaauuggcugaacccuccccgccugcaaaugggauccaugacgagcacaacccuuuauaacucuaugugguuuguguacggcagcuucguccagcaagggggcgaagugccuuauaccacacucgcuacccggaugaugaugggagcgugguggcuguuugcccugauuguuaucuccucuuacacagcuaaucucgccgccuuccugacgauuaccagaaucgagagcuccauucagagccuucaggaccugucuaaacagacagaaauccccuauggcaccgugcucgauuccgcugucuacgagcacgugcgcaugaaggggcugaaccccuuugagcgggacagcauguacucucagauguggagaaugaucaaucgcuccaacggaagcgaaaauaacguucuggagucccaggccggcauucaaaaagugaaguaugggaauuacgcguucgucugggaugcugccgugcuugaauauguugccaucaacgacccugauuguucuuucuacacaauuggaaauaccguggcugaccggggcuaugggaucgcccuccagcauggcagcccguacagagaugucuuuucccagcggauucuggagcugcagcaaaacggagacauggauauccucaaacacaagugguggcccaagaauggccagugcgaccuguauucuagcguggauacgaaacagaaagggggagcucuugacaucaaguccuucgccggcguguuuuguauucuggcggccgggaucguccucagcugcuucauugcuaugcuggaaaccugguggaacaagcgcaaaggaucuagaguuccuuccaaggaggacgauaaggagaucgaccuggaacaucuucaccggagagugaauagccucuguacagaugacgauucuccccacaaacaguuuuccaccagcucuauugaccugacaccucuggauaucgacacccuccccacgcgccaagcccuggagcagaucagcgauuuccggaacacacauauuaccacaaccaccuuuaucccggaacagauucaaacacuuuccagaacgcugagcgcuaaggccgcgucuggcuucaccuuugggaaugugccugagcaccgcacaggccccuucagacaucgggccccuaacggaggcuuuuuccgcucccccaucaaaaccaugagcuccauuccuuaccagcccacaccgacccucgggcugaaccugggaaaugacccugauagaggcacgucuaucuga

SEQ ID NO: 70005 - RNA, 2757 nt, Artificial Sequence
  derived and/or modified sequence opt5 from GRIK1__Homo_sapiens__NP_000821
auggagcacggcacccugcucgcccagcccgggcuguggacaagagacacgagcugggcucugcuguacuuccucugcuauauccugccucaaaccgccccgcaagugcuucggauuggaggcaucuuugaaacagucgagaacgaacccguuaauguggaggaacuggcguucaaguuugcugugaccuccauuaaccgcaauagaacacucaugccuaacaccacacugaccuacgauauccagcggauuaaucuguucgacucuuuugaggccagccgcagagccugugaucagcucgcucugggggucgccgcucuuuucggacccucccauucuagcuccgugucugccguucagagcaucugcaacgcgcuggaggugccucacauccagacgcgguggaaacaucccuccgucgacaauaaggaucucuuuuauauuaaccuguacccugacuaugccgcuaucagccgcgccauucuugaucuggugcucuacuauaauuggaaaaccguuacaguggucuacgaagacucuaccggccugaucagacugcaggagcucauuaaggcuccgucccgguacaacaucaaaauuaagauccgccagcugcccagcgggaauaaggaugccaaaccucuucugaaggaaaugaaaaagggaaaagaguucuaugugaucuuugacuguucucacgagacagcggccgaaauucucaagcaaauccuguucaugggcaugaugaccgaguacuaucauuacuuuuucacgacacuugaucuguuugcucucgaccuggaacuguauagauacuccggcgugaacaugaccggguuccggcuccugaauauugauaacccccacgucagcucuaucauugagaagugguccauggaacgccuucaggccccucccagaccggagacaggacugcucgacggcaugaugaccaccgaggcugcccugauguaugacgccguuuacaugguggcuaucgcgagccaccgggccucccagcuuacagugucuagccugcagugccaucgccacaaaccuuggagacucgggccccgguucaugaaucugaucaaggaagcuagaugggauggacugacgggccauauuaccuuuaacaaaacaaacgggcuccgcaaggacuucgaucuggacaucauuucccuuaaagaggaaggaaccgagaaggccgccggcgaagucagcaaacaccuguacaagguguggaagaaaaucggcauuuggaacucuaauuccgggcucaauaugacagauagcaacaaggacaaaucuagcaauaucaccgauucccuggcuaaccggacgcugaucguuacaaccauucuugaggagccuuaugugauguacagaaagucugacaaaccccucuauggaaaugaucgcuuugaaggcuacugucuggaccugcucaaggagcugagcaacauccuuggguucauuuaugaugucaagcuggugcccgacggaaaauacggcgcccaaaaugacaagggggaauggaacggaaugguuaaagagcucaucgaucaccgggcggaccuggcuguggccccucugaccauuacauaugucagagaaaaggugaucgauuuuuccaaaccguucaugacccuuggcauuagcauccucuaccgcaagcccaauggcacaaacccuggggucuuuucuuuccugaauccccuguccccugacaucuggauguacgugcuccuggccugccuuggaguuagcugugugcuguuugucauugcucgguucacgcccuaugagugguacaacccgcauccuugcaaucccgauucugacgugguugagaacaacuuuacccuccuuaauuccuucugguuuggcgugggggcccugaugcagcagggaagcgaacuuaugccuaaggcucucuccacaagaaucgucggcgggauuuggugguucuucacccugaucauuaucucuagcuauacagccaaccuggcggccuuucucaccguggagcgcauggaaucccccaucgauucugcugacgaucuggccaaacaaacgaagauugaguacggcgcugugcgggacggaagcaccaugacauucuuuaaaaaguccaaaaucagcaccuaugagaagaugugggccuucaugucuuccagacagcagacagcgcuuguucgcaauagcgaugaaggcauucagcggguccugaccacggacuacgcccuccugauggagucuacauccaucgaauaugugacccaaagaaacuguaaucugacacagauugggggacuuaucgauagcaagggcuacggggugggaaccccuaucggcucucccuaccgggacaaaauuaccaucgcuauucuccagcugcaggaggaagggaagcugcacaugaugaaagagaagugguggcgcggcaacggaugcccggaggaagacaauaaagaggccagcgcucucggcgucgaaaacaucgggggaauuuuuaucgugcuggccgccggccuuguucuguccguguucgucgcuaucggggaguuuauuuauaagagcagaaagaauaacgauaucgaacaagcguucugcuuuuucuacggacuccaguguaagcagacacauccuaccaauucuacguccggcacaacccugagcacagaccuggagugcgggaaacuuauucgggaggaaagaggcauccgcaaacaguccucugugcacaccguuuga

SEQ ID NO: 70006 - RNA, 2727 nt, Artificial Sequence
  derived and/or modified sequence opt5 from GRIK2__Homo_sapiens__XP_005267002
augaagaucauuuuccccauccugagcaacccuguguuuagacggaccgucaaacuccugcuuugccugcucuggauuggcuacucccaggggacaacgcacguucugcgcuucggaggcaucuuugaguauguggaaucugggccgaugggagccgaggaacuugcuuucagauuugccgugaauaccauuaaccggaaucgcacacugcuccccaacaccacacugaccuacgacacacaaaagaucaaucuguaugauagcuucgaggcguccaaaaaggcuugugaccagcucucucugggcgucgccgccaucuuugggccuagccauuccucuagcgcuaacgccgugcaguccauuugcaaugcucuuggaguuccccacauccagaccagauggaaacaucaagugagcgauaacaaggacucuuucuacgucucccuguauccugauuuuagcucucucucccgggccauucuggaccuugugcaguucuuuaaguggaaaacgguuaccguggucuacgaugacagcacaggccugauccgccuccaggaacugauuaaggcgcccucuagauauaaucugcggcucaaaauccgccagcugccugccgauaccaaggacgcuaaaccgcuucugaaggagaugaagagaggcaaagaguuccacgugauuuuugauuguucccaugaaauggccgcugggauccucaagcaagcccuggcgaugggaaugaugacagaguacuaccacuauaucuucaccacgcuugaccuguucgcccucgauguggaacccuaccgguauagcggcgucaacaugacaggguuucgcauucugaauaccgagaacacacagguuuccucuaucauugagaaauggagcauggaaagacugcaggcuccucccaagccugacuccggacuccuggacggcuucaugaccaccgaugccgcucuuauguacgacgccgugcacguggucagcguggccguucagcaauuuccccagaugacagugucuucccugcagugcaaucggcauaaaccguggcgcuucgggacgagauuuaugagccucaucaaggaggcucacugggaaggacugaccggccggauuacauucaacaaaaccaauggccuuagaacagauuuugaccuggaugucaucucucucaaggaggaagggcuggagaagaucggaaccugggacccugcgagcggccugaacaugacggagucccaaaaagggaagcccgccaacauuacagauucucucagcaaucgcucccugaucgugaccaccauucuugaagaaccuuauguucuguucaaaaagagcgacaaaccccucuacggaaacgaucgguuugaaggcuauuguaucgaccugcugagagagcuuucuacaauucucggguucaccuacgaaauccgccugguggaggauggaaaguacggcgcucaggacgacgccaauggccaguggaacgggaugguccgggagcugaucgaucauaaggccgaccucgcuguggcgccccuggccauuacauaugucagagaaaaagugaucgauuuuuccaagccuuucaugacgcuuggaauuagcauccuguaccgcaaaccgaauggcaccaaccccgggguuuucucuuuccucaauccucugucccccgacauuuggauguauauccugcuugcuuaccucggagugagcugcguccuguucgugauugcccgguuuuccccuuaugagugguacaacccccacccguguaauccugauucugacguuguggaaaacaauuucacacugcucaacagcuuuugguucggcgucggggcccugaugcagcaaggcuccgagcuuaugcccaaggcucugucuaccagaaucgugggaggcaucuggugguuuuucacacucauuaucauuagcuccuauaccgccaaucuggcugccuuucugacgguggaacgcauggagagcccuaucgauucugcggacgaucuugccaaacagaccaagauugaguacggggcuguugaagacggagccacaaugaccuucuuuaagaaauccaagaucagcacauacgauaaaaugugggcuuucaugucuucccggagacagagcguccucgugaagucuaacgaggaaggcauccagcgcgugcugaccagcgacuaugccuuucugauggaguccacgacaauugaguucgucacccaacggaauugcaaccucacacagaucgggggacugauugauagcaaaggcuacggggugggcacccccaugggaucuccuuauagagacaagaucaccauugcgauccuucagcugcaggaagagggcaagcuccacaugaugaaagaaaagugguggcgggggaacggaugucccgaggaagaguccaaagaggccagcgcucugggcguucaaaauaucgggggaauuuuuaucgugcuggccgcuggccuuguccucuccguguucguugccgugggggaauuucuguacaagucuaaaaagaacgcccagcuggagaaacgcagcuuuugcuccgcuauggucgaggagcucagaaugucucugaagugucagcggagacuuaagcauaaaccgcaggcgccugugauuguuaagacagaagaggugaucaauaugcacacguucaacgaccgccggcugcccggcaaagagaccauggccuga

SEQ ID NO: 70007 - RNA, 2871 nt, Artificial Sequence
  derived and/or modified sequence opt5 from GRIK4__Homo_sapiens__NP_001269399
augcccagagugagcgccccucugguccuccugccggcuuggcuuguuaugguggccugcucuccccacucccugcggaucgcggcuauucucgacgauccuauggaguguagccgcggcgaaagacuguccaucacccuugccaagaaccggauuaaucgcgcccccgagagacuggggaaagcuaagguggaagucgacaucuucgagcuccugcgggauucugaauacgagacagccgagacgaugugccagauucugccuaaaggagugguugcugugcucggccccagcuccucuccugccagcuccagcaucaucucuaacauuuguggggaaaaggaggucccgcauuuuaaaguggcgcccgaagaguucguuaaguuucaauuccagcgcuuuaccacacugaaucuucacccuuccaacaccgacaucagcguggccgucgcuggcauucugaauuucuuuaacugcacaaccgccugucucaucugcgcuaaggccgagugucugcuuaaucuggaaaaacuccugagacaguuccugauuucuaaggauacacucuccgugcggaugcuggacgauacccgcgaccccacgccucuucugaaagagaucagagaugacaagaccgcgacaauuaucauccaugccaacgcuagcaugucucacaccauucuccugaaagccgcugaacuuggaaugguguccgccuauuacacauauaucuuuaccaaucuggaguucagccuccagcggauggauucccuggucgacgaucgcguuaacauucugggguuuucuaucuucaaucaaagccaugccuuuuuccaggaguucgcucagucccucaaccagagcuggcaagaaaauugcgaccacgugcccuuuacgggaccggcgcugucuuccgcccuucuguucgacgcuguguacgccgucgugacagccguucaggagcucaacagaagccaggaaauuggcgugaagccucugucuuguggcagcgcucagaucuggcaacacgggaccucccuuaugaauuaucugcggauggucgagcucgaaggacugacaggccauaucgaguuuaacucuaaggggcagcgcagcaacuacgcccugaaaauucuccaguucaccagaaauggauuucggcaaaucggccaguggcacguggcggaagggcuguccauggauagccaucuuuaugcuucuaacauuuccgacacccuguucaauacaacgcucguugugaccacaauccuggagaaccccuaccugaugcuuaagggaaaucaccaggagauggaaggcaacgauagauacgagggcuuuugcgucgacaugcucaaagaacuggccgagauucugcgcuucaauuauaagauccggcucgugggggauggagucuacggcgugccugaagccaacgggaccuggacaggaaugguuggcgagcugaucgcuagaaaagccgaccuugcuguggccgggcugaccauuacggcggagcgcgaaaaggucaucgauuuuagcaaacccuucaugacacucggaauuucuauccuguaucgggugcacaugggcagaaagcccggcuacuuuuccuuccuggacccuuuuagcccggggguuuggcuuuucaugcuccuggccuaucuggcuguguccuguguccucuuccugguggcccgccuuacccccuacgagugguauucuccucaucccugcgcucagggacggugcaaucugcucgugaaccaauacagccugggcaauucccugugguuuccuguugggggauucaugcagcagggcucuaccauugcccccagagcgcuuagcacacgcugugucuccgggguguggugggccuuuacccucaucauuaucagcucuuacacagcuaaccuggccgcuuuccugacggugcagcggauggaugucccgaucgaauccguggacgaucucgccgaccaaaccgccauugaguauggcacaauccacggaggcagcucuaugaccuuuuuccaaaauuccagauaccagacauaucagcgcauguggaacuacauguauagcaagcagccuucuguuuuugugaaaagcaccgaggaagggauugcucggguccuuaauuccaacuacgcguuccugcuggagagcacgaugaacgaauauuacagacagcggaauugcaaccucacccagaucggaggccugcuggacacaaagggguacggaauuggcaugcccguggggucuguuuuucgcgaugaguucgaccuugccauccuccagcugcaagaaaauaacagacuggagauccucaaacggaaguggugggagggcggaaaauguccuaaggaagaggaucauagagcuaagggccuggggauggaaaauauuggaggcaucuuugugguccuuauuugcgggcugaucguggccauuuucauggccaugcucgaguuucuguggacccugcgccacuccgaagcuacagagguuagcgugugucaggagauggucaccgaacuucgguccaucauccugugccaggacucuauucaucccagacgcagacgggccgcggugccucccccgcgcccucccauccccgaggaaagacggccucgcggaacggcuacacucagcaacggcaaacuguguggggccggcgagccggaucaacucgcccagagacuggcucaggaagccgcgcuuguggcucggggaugcacccacauucgcgucugucccgagugcagacgguuccagggccugcgcgccagaccuucccccgcccggucugaggaaagccucgagugggaaaagacaaccaauuccucugagccugaguga

SEQ ID NO: 70008 - RNA, 2946 nt, Artificial Sequence
  derived and/or modified sequence opt5 from GRIK5__Homo_sapiens__NP_001287959
augcccgccgagcugcuccugcuucugaucguggcuuucgccagcccuuccugccagguccucucuagccugagaauggcggcuauucuugacgaucaaaccguuuguggccgcggggaacggcuggcccucgcccuggcuagagagcagaucaacggaauuaucgaagugccggccaaggcucggguggaggucgacauuuuugaacugcagcgcgauucccaguacgagacaacggacaccaugugccaaauccuccccaaaggcgugguuucugugcuggggccuagcuccucucccgccagcgcguccacagucagccacaucuguggagagaaggaaauuccucauaucaaagugggccccgaggaaaccccuagacuucaguaucugcgguucgccucuguuucccucuacccgagcaaugaggaugugucucuggcugucucccgcauucuuaagagcuuuaacuaucccucugccucccugaucugcgcuaaagccgagugucuccugagacuggaggagcucgugcggggguuccugauuagcaaggaaacacuuuccgugcgcaugcuggacgauucuagagacccuacaccccuccugaaggagauccgggaugacaaagucagcaccauuaucaucgaugcgaaugccuccauuagccaccuuauccugcgcaaggcuucugaacucggaaugaccuccgccuuuuacaaauauauucugacgaccauggacuucccuauccugcaucucgauggcauuguugaggacagcucuaacauccugggcuuuagcauguucaauacaucccaccccuuuuacccggaguucgugagaucucuuaacaugagcuggcgggaaaauugcgaggcuuccaccuaucuggggccugcccucagcgccgcucugauguuugacgcggugcaugucgugguuucugccgugcgcgaacuuaacagaucccaggagaucggagucaagccccuggcuuguacaagcgccaauauuuggccucacggcaccucucucaugaacuaccugcggaugguggaauacgaugggcugacgggaagaguugaguucaauuccaaaggccagcgcacaaacuauacccuccggauccuggaaaagagcagacaagggcaccgcgaaauuggagugugguacuccaaucggacacuugccaugaacgcuaccacccuggacaucaaucucucucagacacuggccaacaagacgcuggucgugaccacaauucuugagaaccccuaugucaugagacgccccaauuuucaggcgcucagcggcaacgaacgguucgagggcuucugcguggauaugcugagagaacuggcugagcuccugcgcuuucgguacagacuucgccugguugaggacgggcucuauggagccccugaaccgaauggcuccuggaccgggauggugggagagcugaucaaccggaaagccgaucuggcugucgccgcuuucacaaucaccgccgaaagagagaaggugauugacuuuucuaaacccuucaugacgcuuggcaucagcauucucuaccggguucauauggggcgcaagccuggauauuuuuccuuccuggaucccuuuagcccugcgguguggcuguucaugcuccuggccuaccuugcugucucuugugugcuguuucucgccgcuagacugucccccuacgagugguauaauccgcacccuugccugcgggccagaccccauauccuugaaaaccaguacacacucggcaauagccugugguucccugugggcggguuuaugcaacagggaucugagauuaugccccgcgcgcuguccacccgguguguuagcggcgucuggugggccuucacccucaucauuaucucuagcuauacagcuaaccuggccgcuuuucuuaccgugcagagaauggaagugccugucgaguccgccgacgaucuggccgaccaaacaaauaucgaauacgggacgauucacgcuggaagcaccaugacauucuuccagaacucucgcuaucagaccuaccagagaauguggaauuauaugcaauccaaacagcccagcguguuuguuaaguccacagaggagggcaucgcgcgggugcucaacucucgcuacgccuuccugcuggaaagcaccaugaaugaguaccacagacggcuuaacugcaaucucacgcagauugggggccugcuggauaccaaaggauauggcaucgggaugccgcucggauccccuuuucgcgacgaaauuacacuggcuauccuucagcugcaagagaacaacagacucgaaauccugaagcggaaguggugggagggcgggcgcugccccaaagaggaagaccauagagccaagggacugggcauggagaauauugggggcaucuucauuguccuuaucuguggacugauuaucgccguguuuguugcugugauggaguucaucuggucuacccggcgcagcgccgaauccgaagagacacccgcgcuccacccugcugccugccaguguucugcccugggcccgagaacgccccucaaagagccuagcaugcugcuugucaaggugcccuccacccggguucagguggcuuuuagcagaacaucucugcgccaggucugcccuuuccuccugcaacaucagcuguccagccuuuacuggauucaggccaccaacgugcagaucuguugccacuuuucuucccugaaacccagcccugaucucacauuucccccgucucaucggccucuguccagccuccuguucaccgcgcuugcugccgucgggggacugcccgacgccuccagcuucuuuuucccucccauuucuagcuguccgccucuccaauccggcaucgggcccugccacucuaccgaagcuacacuggugacgagcaauuuccacguuuga

SEQ ID NO: 70009 - RNA, 2658 nt, Artificial Sequence
  derived and/or modified sequence opt5 from GRIN1__Homo_sapiens__NP_000823
augagcaccaugagacugcucacacuggcccuucuguucuccugcucuguggcucgggccgcgugugaccccaagaucgucaacauuggcgcuguucucagcacgcgcaaacacgagcagauguuuagagaagccgugaaucaagccaacaagcggcauggguccuggaaaauccagcugaaugcuaccucugugacacacaagccuaacgccauucagauggcucuuagcgucugcgaggaucugaucuccucucagguguacgccauucucguuagccauccgcccaccccuaaugaccacuucacacccaccccuguguccuauacagcgggauuuuaccgcauccccguccugggccugaccacgagaaugagcaucuauucugauaaauccauucaucucagcuuccugcggaccgugccuccguacucucaccaauccagcguuugguuugaaaugaugcgcguguauucuuggaaccacaucauucuucuggucuccgacgaucaugaggggagagccgcucagaagcggcucgaaacacugcuugaggagcgcgaaagcaaggccgagaaagugcugcaguucgaccccggaaccaagaaugugacagcucuccugauggaagccaaagagcuggaggcgagagucaucauucucuccgccucugaagaugacgcugccaccguuuaccgggcugccgccaugcugaacaugacgggcagcggguauguguggcuugugggagagcgcgaaaucuccggcaaugcucugagauacgcgccugauggcauucucgggcugcagcuuaucaacggaaagaaugagagcgcccacaucucugacgcugucggcgugguugcccaagccgugcaugaacugcucgagaaagagaacauuacagaucccccucgggggugugucggaaauaccaacaucuggaagacaggcccccuguuuaagcgcgugcugauguccagcaaauacgcugacgggguuaccggaagaguggaguucaaugaagauggcgaccggaaguuugccaacuauucuauuaugaaccuccagaauagaaaacugguccaggugggcaucuacaacgggacccacgucauuccgaaugaccgcaagaucaucuggccuggaggcgaaacagagaaaccccggggguaucagaugagcacgagacuuaagauugugaccauccaccaagaaccuuucguuuacgugaaacccacacuguccgauggaaccugcaaggaggaguuuacagucaacggcgaccccgugaagaaaguuauuuguaccgggccuaaugauacgucuccgggaagcccccgccauacagugccucagugcuguuauggcuucugcaucgaccuccugauuaaacuugcgcggaccaugaacuuuaccuacgaaguccaccugguggcugauggcaaguucgggacacaggagagagugaauaacuccaauaagaaagaauggaacggaaugaugggcgagcuccugagcgggcaagccgacaugaucguugcuccccugaccaucaauaacgaacgcgcccaguauauugaguucucuaagccuuuuaaguaccagggacucacaauccuggucaaaaaggagauuccccgguccacgcuugauagcuucaugcagccguuucaaucuacccuguggcuccuggugggccuguccgugcaugucguggccguuaugcuuuaccuccuggacagauucagcccuuuugggcgcuucaaagucaauuccgaagaggaagaggaggaugcucugacacucucuagcgccaugugguuuuccuggggcgugcugcuuaacucuggaaucggcgaaggggcgccccggagcuucuccgcccgcauucugggaauggugugggcuggcuuugccaugaucauuguugcuagcuauaccgccaaucucgcggccuuccuggugcuggacagaccugaggaacggaucacagggaucaacgaucccagacuucggaacccuucugacaaguuuauuuacgcuaccgucaaacaguccagcguggacaucuauuuccgcagacagguugagcucucuacgauguaccggcacauggaaaagcauaauuaugaguccgccgcugaggccauucaggccgugagagauaacaagcugcacgcuuuuaucugggacagcgcgguccuggaguucgaagccucucaaaaaugugaucucgugaccacaggagaacuguucuuucgcagcggcuucgggauuggcaugcggaaggacucccccuggaaacagaaugugagccuuucuauccugaagucccacgagaacggauuuauggaagaucucgacaaaaccugggucagauaccaggagugcgauagccgcuccaaugcuccggccacacugaccuucgagaacauggccggcguuuuuaugcugguggcugggggaaucguggccggcauuuuccuuaucuuuauugaaaucgcguauaagagacauaaggacgcucggcgcaaacagaugcaacucgccuucgccgcugucaauguguggagaaagaaccugcagcaguaccacccuacggauauuacagggccccugaaucucucugaccccagcguuuccaccguggucuga

SEQ ID NO: 70010 - RNA, 4395 nt, Artificial Sequence
  derived and/or modified sequence opt5 from GRIN2A__Homo_sapiens__NP_000824
augggcagagugggguacuggacccugcucguccugcccgcccuucugguuuggcggggaccugcuccgagcgccgcggcugagaaggggcccccugcccucaacaucgccgugaugcugggccacucccaugacgugacagaacgcgagcuuagaacgcuguggggacccgaacaggcugccggccucccucuggaugucaaugugguugcucugcucaugaaccggaccgaccccaaaucucugauuacacacgugugcgaucuuaugagcggggcccgcauccauggacuggucuucggcgacgauaccgaccaagaggcgguggcccagaugcucgauuuuauuuccucucacacauucguuccuauccugggcauucaugggggagcuagcaugaucauggccgacaaggauccgaccuccacauuuuuccaguuuggcgcuucuauccagcaacaggccaccgugaugcuuaaaauuaugcaggacuaugauuggcacgucuucagccuggugacgaccaucuuucccggguacagagaauuuauuuccuuugugaagacaaccgucgacaauagcuucguuggaugggauaugcagaacgugaucacacucgacaccucuuuugaggacgcgaaaacgcaagugcagcugaagaagauucacuccagcgucauccugcucuauuguucuaaagaugaggccgugcugauucuuuccgaagcucggagccugggccucacaggguacgacuucuuuuggaucguuccuucucugguguccggaaauaccgagcuuauccccaaggaguucccuagcggccugauuuccgucucuuaugaugacugggauuacagccucgaagcccgcgugagagacggcaucgggauucugacaaccgcugccuccagcaugcuggagaaauucucuuauauccccgaagccaaggcuuccugcuacggacagauggagcggccggaaguuccuaugcauacccuccaccccuuuauggugaacgucacaugggauggcaaagaccugagcuucacggaggaaggguaccaggugcauccucgccuugucgugauuguucugaauaaggauagagagugggagaaggugggaaaaugggaaaaccacacccucucucugcggcacgcggucuggccccgcuauaagagcuuuuccgacugugagcccgaugacaaucaucuuucuaucgugacacuggaagaggccccuuucguuaucguggaagacauugauccgcucaccgagacaugcgucagaaacaccgugcccugucggaaauuugugaagaucaauaacagcacgaaugagggcaugaacguuaaaaagugcuguaaaggguucugcauugacauccugaagaagcugucccgcacagucaaauuuaccuacgaucucuaucuggugaccaauggaaagcacggcaaaaaggugaacaacgucuggaauggcaugauuggggaagugguuuaccaaagagcugugauggccgucggaagccuuacaaucaacgaggaacggucugaggugguugacuucuccgugccuuuugucgaaaccggcaucagcgugaugguuucuagauccaaugggacagugagccccuccgccuuccuggagccuuuuucugcuagcgucugggugaugauguucgugaugcuccugauugucuccgccaucgcgguuuuuguguucgaguauuucucucccgugggauacaaccgcaaucuggcuaaaggcaaggccccgcaugggccuagcuuuacgauuggcaaggccaucuggcuucucuggggacuggucuucaacaauuccgugcccguucagaacccuaaaggcaccacaagcaagauuauggugucugucugggcuuucuucgccgugaucuuucuggcuuccuauaccgccaaucucgcggccuucaugauucaggaagaguuuguugaucaagugacagggcugagcgacaaaaaguuccagcggccccacgauuacucuccucccuuuagauucggaaccgucccgaacggcuccacggaacgcaauauccggaacaauuacccuuauaugcaucaguacaugaccaaauuuaaccagaaggggguggaggacgcucuuguuagccugaagacaggaaaacucgaugccuucaucuaugacgcugccgugcugaauuacaaggcgggcagagaugagggguguaaacuggucaccauuggcucuggauauaucuuugccacaaccggcuacgggauugcccuucaaaagggaagccccuggaaacgccagaucgaccucgcucugcugcaguucgugggcgauggggaaauggaggaacucgagacgcuguggcuuacaggaauuugccacaacgaaaagaacgaggugauguccagccagcuggacaucgacaauauggcuggcgucuucuauaugcucgccgccgcuauggcgcugucucugaucaccuuuauuugggagcaccuuuucuacuggaagcuccgguuuuguuucacagggguuugcuccgauagacccggccugcuguuuagcaucucccgcggaauuuacucuugcauccauggcgugcacauugaagagaaaaagaaaagcccugacuucaaccucaccgggucccaaucuaauaugcugaaacuucugcggagcgccaagaacaucuccucuaugagcaauaugaacuccagcagaauggauucuccgaagcgcgcugccgacuuuauccagcggggaucccucauuauggauauggugagcgacaaaggcaaucugauguauucugauaacagauccuuccaggggaaggaaagcaucuuuggagacaauaugaacgagcugcagaccuucgucgccaaucggcaaaaggauaaccuuaauaacuacguguuucagggccagcauccccucacacugaaugaaucuaacccuaacacgguugagguggcugucuccaccgagagcaaagccaauucccgccccagacagcuguggaagaaaagcguggacucuauucggcaagauagccucucccagaacccuguuucucagagagacgaagcgacagcugagaaucgcacccacagccugaagucuccccgguaucuuccugaagagauggcccacuccgauaucagcgaaacauccaacagagccaccugucaucgcgagcccgacaauucuaaaaaccacaagacgaaggacaauuucaaaagaagcguggcuuccaaguacccgaaagauugcagcgaggucgaacggacauaucugaagaccaaaucuuccagcccucgcgacaagauuuacaccaucgauggggagaaggaacccggcuuccaucucgacccuccccaauuuguggagaacgucacacugccggagaauguggauuucccugaccccuaucaggauccuucugaaaacuuuagaaaaggagacuccacccugcccaugaaucggaacccccuucacaaugaggaaggccugagcaacaaugaucaguacaagcucuacuccaaacauuucacacugaaggacaaagggucuccucacagcgagacguccgaacgcuauagacagaacagcacccacugucggucuugccucuccaacaugccgacauacagcggacauuuuaccaugcgcucucccuucaagugugaugccugccugagaaugggcaaucuuuaugacaucgacgaggaucaaaugcugcaggagacagggaacccugcgaccggagaacagguuuaccagcaagacugggcucagaauaacgcccuccagcugcagaagaauaaacugcggauuagccgccaacacuccuaugauaacaucguggacaagcccagagagcuugaucugucucggccuagcagauccauuucucucaaagaccgcgaacggcugcucgagggcaauuuuuacggcagccuguucuccguccccagcucuaagcuguccgggaaaaagagcucccuuuuuccucagggacucgaagauucuaaaagaagcaagucccugcugccggaccauacgucugauaaccccuuccuucacagccaucgcgacgaucagcggcuggugaucggcagauguccuuccgaccccuauaagcacagccucccuucucaagccguuaaugauuccuaccugcgcagcucucuccgguccaccgcuagcuacugcucuagagacagccgcgggcacaacgacguguauauuuccgagcaugucaugcccuacgccgcuaauaaaaacaauauguauucuacaccgcgggugcugaacagcuguuccaauagacggguguacaagaaaaugccuagcaucgaguccgauguuuga

SEQ ID NO: 70011 - RNA, 4455 nt, Artificial Sequence
  derived and/or modified sequence opt5 from GRIN2B__Homo_sapiens__XP_011518932
augaagcccagagccgagugcuguagcccuaaauucuggcuggugcucgcuguccuggccguuuccggcucucgggcgcgcagccagaaguccccgcccucuaucgggauugcugugauccuugugggaaccagcgacgaagucgccauuaaagaugcccacgagaaggacgauuuucaucaccuguccgugguuccuagaguggaacucgucgcuaugaacgagacagaccccaaaucuaucauuacgcggaucugcgaucugaugagcgaccgcaagauccaaggcgugguuuucgccgaugacaccgaucaggaagcuauugcccagauccuugacuuuauuuccgcgcagacacugaccccuauccucgggauucauggaggcagcucuaugaucauggccgauaaggacgaguccagcauguucuuucaauucgggcccucuauugagcagcaggcuuccgugaugcugaauaucauggaagaguacgauugguauaucuuuagcauugucacaaccuacuucccuggauaucaggacuuugugaacaaaaucagaucuacaauugaaaauuccuucgugggcugggagcuggaggaaguccuccugcuugacaugagccuggaugacggcgauuccaagauccaaaaccagcucaaaaagcugcagucuccgauuauccuucuguacuguaccaaagaggaagccacguauaucuuugagguugcuaauagcguggggcucaccggauacggcuauacauggauugugcccucccuggucgccggggacaccgauacagugccugcggaguuccccaccggacugaucagcguuucuuacgacgaaugggauuacggccucccugcccgggugcgcgacgggauugcuaucauuacgacagccgcuuccgauaugcugagcgagcacucuuuuauccccgaacccaagagcuccugcuauaacacccaugagaagagaaucuaccagucuaauaugcuuaaccgguaucugauuaaugucacauucgaaggacgcaaccucagcuucuccgaggacggcuaccaaaugcacccuaaacuggugaucauucuucugaauaaggaaagaaaaugggagcggguuggcaaguggaaagauaagagccuccagaugaaauauuacguguggccccgcauguguccugagaccgaggaacaggaagacgaccaccugucuaucgucacccuggaggaagcccccuuugugauugucgaguccguggauccccucagcgggacaugcaugagaaacacgguuccuugucaaaagcggaucgugaccgagaauaagacagacgaggaaccgggauauauuaaaaagugcuguaaaggcuucugcaucgauauccugaagaaaauuucuaaguccgucaaguuuaccuacgaccuuuaccuggugacaaacgggaaacauggaaagaaaaucaauggcaccuggaacgggaugauuggagaaguugugaugaagcgcgccuauauggcugucggcagccucacgaucaacgaggagagauccgaagugguggauuucucuguucccuuuauugagacaggcaucagcgucauggugucccggucuaaugggaccgugagcccuuccgcguuccuggaacccuuuagcgccgacgucugggugaugauguucguuaugcuucugaucgugucugcugucgccguguuuguuuucgaguacuuuuccccugugggauauaacagaugucucgccgauggccgcgaacccgggggaccgagcuucaccauuggcaaagcuaucuggcugcugugggggcucgucuuuaauaacucugugccuguucagaaucccaagggcacaaccuccaagauuauggugagcgucugggccuucuucgcggugaucuuucuggcuucuuacacagccaaccuugccgcuuucaugauucaggaggaguauguggaccaggucagcggacuguccgauaaaaaguuucaacggccuaaugacuucagcccgccuuuuagauucggcacgguucccaacgggucuaccgaacgcaauauccggaacaauuacgccgagaugcacgcuuauaugggaaaauuuaaccagagaggcguggaugacgcccuccugucccugaagacagggaaacuugaugcguucaucuacgacgccgcugugcucaauuacauggccggacgcgacgaaggcugcaagcuggucaccauugggagcggcaagguguuugcuuccacaggauauggcaucgccauucagaaagauucuggguggaagcggcagguugaccuggcgauccuccaacuguucggagauggcgagauggaggaacuugaggcccuguggcucaccgggauuugccauaacgagaaaaaugaagugaugagcucccagcuggacaucgauaacauggcuggagucuuuuacaugcugggcgccgcuauggcccuuucucucaucacguucauuugugaacaccuguuuuauuggcaguucagacacugcuucauggggguguguagcggcaagccgggaaugguguuuuccaucucucgcggcauuuacagcugcauccaugggguugccauugaggaacggcaguccgucaugaacagcccuaccgcuacaaugaauaacacccacucuaauauccugagacuccugcgcacagcgaaaaacauggccaaucuuuccggagugaacggcagcccccaaucugcucuggacuucauucggagagaguccagcguuuaugauaucucugagcaucggcgcuccuuuacccacagcgacuguaaguccuacaauaaucccccuugcgaagagaaccucuucagcgauuauaucucugaaguggagagaacguuugggaaccugcagcugaaagacagcaaugucuaccaggaucauuaccaccaccaucaccggccgcauuccauuggaucugccagcuccaucgacggccuuuaugauugugacaaucccccuuucacaacccagucuagaagcauuuccaagaagccccucgacaucgggcugccuucuagcaaacacucccaacugagcgaucucuacggcaaguuuucuuucaaauccgaccgcuauagcggacacgaugaccugauucggucugauguguccgacaucagcacacauaccgugaccuacggcaacaucgaggggaacgccgcuaagagacgcaaacagcaguauaaggauucccuuaagaaaagacccgccucugccaagagccggcgcgaauuugacgagauugaacuggcuuacagacggcgcccucccagauccccggaucacaaacgguauuuccgcgacaaggagggacucagagauuuuuaccuggaccaauuccggacaaaagaaaauagcccucauugggagcacgucgaccugacggauaucuacaaggagcgcucugacgauuucaagagagacuccguuagcggcgggggacccugcaccaaccggucucauauuaaacacggcacaggcgauaagcacgggguggugagcggagucccugcccccugggagaaaaaccuuaccaauguggaaugggaagacagauccggcgggaacuuuugucgcucuugcccgagcaagcuccauaauuauuccacaaccguuacgggacagaacucuggccggcaggccuguaucagaugcgaggcuugcaaaaaggccgggaaucuguacgauauuagcgaagacaacucccugcaggagcucgaucaaccugcggcucccguggccgucacaagcaaugccucuaccaccaaguauccucagucccccacaaacagcaaagcucagaagaaaaaucgcaacaagcugcggagacagcacuccuacgacaccuucguggaucuucaaaaagaggaagccgcucuggcgccccgcucuguuagccucaaggacaaaggacgguuuauggauggcuccccuuaugcgcauauguucgagaugucugccggcgaaagcacauuugcuaauaacaaguccagcgugccgacggccgggcaccaucaccacaauaaccccggaggcggguacaugcugucuaagucccuguauccugacagagucacccagaaucccuucaucccuacauuuggagacgaucagugucuucugcauggcagcaaaucuuacuucuuucgccagcccaccguggcuggggccuccaaggcccggccugacuucagagcucucgucacaaacaaaccggugguuagcgcgcugcacggagccgugcccgcucgguuucaaaaggauaucugcauuggcaaccagucuaauccuuguguccccaacaauaaaaacccucgcgccuucaauggcagcuccaacgggcauguguacgagaagcucucuagcaucgaauccgacguuuga

SEQ ID NO: 70012 - RNA, 3702 nt, Artificial Sequence
  derived and/or modified sequence opt5 from GRIN2C__Homo_sapiens__NP_000826
augggcggggcccugggacccgcucuccugcuuaccagccuguucggcgccugggcggggcucggaccuggccagggggagcaaggaaugacaguggcugucguguuuuccucuagcggcccgccccaggcccaguucagagcccggcugacgccucaguccuuucuugaccugccccucgaaauccaaccucugaccguuggcgugaacacaaccaaucccucuagccugcucacacagauuugcgggcugcuuggagcugcccacguccauggcaucguguucgaggauaacguugacaccgaagcuguggcccagauucuggauuuuaucuccucucagacacacgucccuauucucagcaucuccgggggaagcgcggugguucugaccccgaaggagcccggcucugccuuccuucaacugggggugucccucgaacagcagcugcagguccuguuuaaagugcucgaggaguacgacuggagcgcuuucgccgugaucacgucucugcauccuggacacgcucuuuuucuggaaggcguccgcgccguugcggaugccucccaugugagcuggagacuccuggacguggucacccuugagcugggccccgggggaccucgggcucgcacacaaagacuccugcggcagcuggaugcccccguguucguugcuuauuguucucgcgaagaggccgaggugcucuuugccgaagcugcgcaggccggccuggucgggccgggacacguguggcuuguuccuaaucuggcucucggcuccaccgacgcucccccugccacauuccccguggggcugauuagcgucgugaccgaguccuggagacuuucucugcggcaaaagguccgcgauggaguggccauccucgcccugggcgcgcacagcuacuggagacagcauggcacgcugcccgcuccugccggggacugccggguucacccgggacccguguccccugcccgcgaggcuuuuuauagacaucuccugaacgucacaugggaaggccgggauuucagcuucucucccgggggauaccuugugcagccuaccaugguugugauugcccugaaucgccacagacucugggaaauggucggccggugggagcacggggugcuguauaugaaauaccccguguggccgagauauuccgcuagccugcagccuguugucgacucucgccaucuuacaguggccacccucgaggaacggcccuuugugaucgucgagagcccugaucccggcaccggaggcugugugccuaacacaguucccugcagacgccaauccaaucacacguucucuagcggggacguggcgccguacaccaagcuguguugcaaaggauuuuguauugacauccugaagaagcucgcccgggucgugaaauucuccuacgaucuguaucuuguuacaaacggcaagcaugggaaaagagugcgcggagucuggaauggcaugauuggggaaguguacuauaagcgggcugacauggccaucggcagccugaccaucaacgaggaaagaucugagauuguugauuuuuccgugccuuucgucgagacaggaaucagcgugaugguggcucgcucuaauggcaccgucucccccagcgccuuucucgaacccuacuccccugcgguuugggugaugauguucgugaugugccugacggucguggccauuacaguuuuuauguucgaguauuuuucuccggugagcuacaaccagaaucugacccgggggaaaaaguccggaggccccgcuuucaccaucgggaagucugucuggcuucucugggcccugguguuuaacaauagcguuccuauugaaaaccccagaggaacaaccuccaaaaucauggugcuggucugggcuuucuucgccgugaucuuucucgccagcuauacagcuaaccuggcggccuucaugauucaggagcaguacaucgacacgguuucuggccuuuccgauaagaaauuucaacgcccucaggaccaguaucccccuuuccgguuugggaccgugcccaauggcagcacagaaagaaacauucggucuaauuaccgcgauaugcacacccauauggucaaguucaaccagagauccguggaggacgcucugacaagccucaaaaugggaaagcuggaugccuuuaucuacgacgccgcugugcugaauuauauggccggcaaagaugagggguguaaacuugucaccauuggaucuggcaagguuuucgcgacgaccggguacggaaucgcuaugcaaaaggacagccacuggaagcgggccaucgaccucgcccugcugcaguuucucggcgauggggaaacacagaaacuggagaccguguggcuuuccggcauuugccagaacgaaaagaaugaggugaugagcucuaaacuggacaucgauaacauggcuggagucuucuauaugcuccugguggccaugggccuggcgcuucucguuuuugcuugggagcaccugguguacuggaagcugagacauuccgucccgaauagcucccaacucgacuuccugcuugccuuuucucgcgggauuuauagcuguuucuccggagugcagucucuggccagcccuccccggcaggcuuccccugaucucacagccucuagcgcucaagccuccguucugaagaugcugcaggcggccagagacauggugaccacggcuggcgucucuagcucccuugaucgcgccacaagaaccaucgaaaacuggggagggggccggcgcgcucccccgccuagccccugcccuacacccagaucuggccccuccccuugccugccgacccccgacccucccccugagcccagcccuaccggguggggaccgcccgauggcgggcgggccgcccucgugcgcagagcuccucagcccccuggacggcccccgacaccuggcccuccccugucugacgucucccgcgugagcagacggcccgcgugggaagcccgcuggcccguuagaacggggcacuguggacggcaucucuccgcuagcgagagaccucugucuccggcccgcugccacuacagcuccuucccccgggccgauagaucuggccgcccuuuucuuccccuguucccugaacucgaggaccugccccugcuuggcccggagcagcuggcucggagagaagcccuccugcacgcggcuugggcccgcgggagccggccuagacaugccucccuccccucuagcguggcugaggccuuugcgcgcccuuccucucugcccgcuggauguaccggcccugccugcgcccggcccgaugggcacagcgcuuguagacggcuugcccaagcucaguccaugugccugccgauuuaccgcgaagccugucaggagggagaacaggcgggcgccccugcuuggcaacauagacagcacgucugccuccaugcccacgcucaccuucccuucuguuggggagccgugugcccccaucugccuccgugugccagccacgggucuuggcuguccggcgcuuggggcccccuggggcaucggggacgcacacucggccuggggaccggauauagagacagcggcgggcucgacgagaucucucggguugcgagaggaacacagggcuuuccuggccccugcaccuggcgccggauuuccagccuggaguccgaaguguga

SEQ ID NO: 70013 - RNA, 4011 nt, Artificial Sequence
  derived and/or modified sequence opt5 from GRIN2D__Homo_sapiens__NP_000827
augagaggcgccgggggaccccggggcccucgcgggccggcuaagaugcugcuccugcuugcccuggcgugcgcuagccccuucccugaggaagcccccggaccuggcggggccggaggccccggcgggggacucggcggggcuagaccucugaacguggcccuugucuuuuccggaccggcuuacgccgcggaggccgcucggcugggccccgccguugcugccgcggugcgcucuccugggcucgacgugagacccgucgcccuggugcugaauggaagcgauccucggucccucguucugcagcuuugugaccugcucucuggccugcgcgugcacggcgucguguucgaagaugacagcagagcucccgccguugcuccgauccuugauuuucuguccgcccaaaccucucucccuauuguggccguccaugggggagcugcgcuggugcugacacccaaagagaagggcagcacguuccuccagcugggguccagcaccgaacagcagcuucaagugaucuuugagguccuggaggaauaugacuggacaucuuucguugccgugaccacacgggcuccuggacaccgcgccuuucucuccuacauugaggugcugaccgauggcagccuugucgggugggaacauagaggagcccugacacucgaccccggcgcuggcgaggccgugcugucugcgcagcugcgguccguuagcgcucagauccgccuccuguucugcgccagagaggaagccgagcccguguuucgggcugccgaagaggcugggcuuaccggaucuggcuaugucugguucaugguggggccucagcuggccggaggcgggggcuccggagcgccgggcgaacccccucuccugcccgggggagccccucuucccgcuggccuguuugccguucgcagcgcuggguggagagaugaccucgcccggagaguggcggccggagucgcuguggucgcccgcggcgcucaagcccugcugcgggauuacggguuccucccggagcugggccacgacuguagagcccagaaccgcacgcaucggggagagucccuucacagauauuuuaugaauauuaccugggauaaccgcgacuacucuuucaaugaagacggcuuccuggugaacccuagccucguugugaucucccugacacgggauagaaccugggaggucguggggagcugggaacagcagacacugcgccuuaaauauccccucuggucucgguacggaagauuucugcaaccuguugacgauacccagcaccugacgguggcuacacucgaggaacgccccuucgucaucguggagccugcggaccccauuuccgggaccugcauccgggauagcgugccguguagaucucagcugaaucggacacauagcccuccucccgacgccccucgcccggagaagagaugcuguaaaggcuuuugcauugauauccuuaagcggcuggcucacaccauuggauucuccuacgaccucuaucugguuaccaacggcaagcaugggaaaaagaucgauggcgucuggaauggaaugauuggcgaaguguuuuaccaaagagccgacauggccaucgggucucugacaaucaacgaggaacgcagcgagauuguggauuucuccguccccuuuguggaaacgggaaucagcguuaugguggcucggucuaauggcaccgucuccccuagcgccuuccuugagcccuauucuccugcgguguggguuaugauguuugugaugugucucacagucguggcuguuaccguguucauuuuugaguaccugucccccgucggguauaacagaagccuggccacaggaaaacgcccuggcggguccaccuucacgaucggcaagucuauuuggcuccugugggcccuuguguuuaauaacagcgugcccgucgaaaauccgagaggaacaaccuccaaaaucaugguucuggugugggcuuucuucgccgugaucuuucucgcgucuuacaccgcuaaccuggccgccuucaugauucaggaggaauaugucgacacagugagcggccuguccgaccggaaguuucagcgcccucaggagcaauaucccccucuuaaguucgggaccguucccaacggaagcacagagaaaaauaucagaucuaacuacccggauaugcacuccuacauggugcgguacaaucagccucgcgucgaagaggcucucacgcagcugaaggccggcaaacuggacgcuuuuauuuaugaugccgcggugcucaacuacauggccagaaaggacgaagggugcaaacugguuaccaucggaagcggcaagguguucgcuacaaccggcuaugggauugcccuucacaaaggaucucgguggaagcgccccaucgaucuggcucuccugcaguuucugggcgacgaugagaucgaaaugcuugagagacucuggcuguccgggauuugucauaaugacaagaucgaggucaugagcucuaaacuggauauugacaacauggccggaguguucuacaugcuccugguugccaugggccuuagccugcucguguuugcuugggaacaccuggucuauuggcggcugcgccauugccuugggccuacacacagaauggauuuccugcucgcguuuucccggggaauguacagcugcuguucugccgaggcugcucccccucccgccaagccgcccccucccccucaaccccugccuuccccggccuaccccgccccuagacccgcgccuggccccgcuccguucgugccucgcgaacgggccagcguggacagauggcgccggaccaaaggcgccgggccucccggaggcgcugggcucgccgauggauuucauagauauuacggccccaucgagccccaggggcugggacuuggccugggcgaagcgcgcgcugccccuagaggggccgcuggacggccgcucucucccccugccgcucagcccccucagaagcccccgccuuccuauuucgccauuguccgcgacaaagagcccgcggagccucccgccggcgcuuucccuggguuucccagcccgccugccccucccgcugccgccgcuacggcgguuggacccccgcugugccggcuggccuucgaagacgaguccccucccgcucccgccagauggccccggucugaucccgaaagccaaccucuucugggcccgggggccggaggcgcuggcgggaccggaggcgccgggggaggcgcgcccgcugccccucccccuugucgcgccgcucccccgccuugccccuaccucgaccuggagcccuccccuucugauagcgaagacuccgagagccucgggggagccucucugggcggccuugagcccuggugguuugcggauuucccuuauccguacgccgaaagacuggggcccccucccggacgguauugguccguggacaagcucggcggguggcgcgcuggaagcugggauuaccugccucccagaucuggcccggccgcuuggcacugucggcacugcgccucccuggagcuucugccucccccuagacaucucagcuguucucacgacgggcuggauggaggcuggugggcucccccucccccgccuugggccgcgggcccccucccccgccggagagcccgcugcggguguccucggucccauccgcacagaccccgcgcuagccaccggaccccugccgcugccgcuccccaucaccauagacaccgcagagccgcgggaggcugggaccugccucccccugcccccacaucccggagccuugaagaucugucuagcugcccgcgcgcugccccugccagacggcugacagggcccucccgccaugcuagacgguguccucacgccgcgcacuggggacccccgcucccuaccgccucucauagacgccaccggggcggggaccugggaacgagacgcggcagcgcucauuuuuccucucuugagagcgagguguga

SEQ ID NO: 70014 - RNA, 3348 nt, Artificial Sequence
  derived and/or modified sequence opt5 from GRIN3A__Homo_sapiens__NP_597702
augagacggcugagccucugguggcugcuuucccgcgugugccugcuccugcccccuccgugugcccuuguccuggcuggcguucccucuagcuccucucacccucagcccugccaaauccucaagagaauugggcaugccgugcgggugggagcgguccaccuucagccuuggaccacagcuccccgcgccgccagcagagcuccugacgauucccgggccggcgcucagcgcgacgagccggaacccgggacgagacggucuccugcccccagcccuggagcgcgcuggcugggcuccacccuccaugggagaggacccccgggcagccggaaaccuggcgagggggcccgcgcugaagcccuguggcccagagaugcccuucuguucgcuguggacaaccucaaucggguugagggacugcuuccuuacaaccugucucucgaaguggucauggcgaucgaggccggccugggggaucugccccuccugcccuuuuccagcccuucuuccccguggagcucugaccccuucuccuuucuucagagcgugugucacacaguugugguccaaggaguguccgcucugcucgccuucccucagucucagggcgagaugauggaacuggaucuugugagccugguccuccauauucccguuaucuccauugugcgccacgaguuuccuagagaaagccagaauccccugcaucugcaacucucucuggagaacucccuuagcucugacgcugaugugaccgucagcauccugacaaugaauaacugguauaauuucucccuccugcuuugccaggaggacuggaacaucaccgauuuucugcuccugacacagaauaacucuaaguuccaccuggggagcauuaucaauauuaccgccaaccucccguccacgcaggaccugcuuagcuuucugcaaauccagcucgaaucuauuaaaaauuccaccccuacagugguuauguucggaugugauauggagagcauccggagaauuuuugaaaucaccacacaguucggcgugaugcccccugagcugcgcuggguccugggcgacucucaaaacguggaagaacuucggaccgaggggcucccccugggacugaucgcccacggcaagacgacacaguccguuuuugaacauuacgugcaggacgcuauggagcucgucgcgagagccguggcuaccgccacaaugauucagccugaacuggcccuuauccccagcaccaugaauugcauggaggucgaaaccacaaaccugacguccgggcaauaucucucucgcuuccuggcuaacaccacauuccggggacugagcggcuccauuagagugaaagggucuaccaucguuagcuccgagaauaacuuuuucauuuggaaucuucagcacgauccgaugggaaagccuauguggacacgccucggcagcuggcagggcgggaagaucgugauggacuacggaaucuggcccgagcaggcccaacggcacaaaacccauuuucagcaccccucuaagcugcaucugagagucgugacgcucauugaacacccuuucguuuuuacacgcgagguggaugacgaaggccuguguccggcggggcagcuuugccuggaucccaugaccaacgacuccagcacccucgauucucuguucuccagccugcauucuagcaaugacacagucccuaucaaauuuaagaaauguugcuauggauacuguauugaucuucucgagaagaucgcugaagacaugaacuucgauuuugaccuguauauugugggcgacgggaaguacggcgccuggaaaaauggacacuggaccggccuggugggggaucuccugcggggaacagcccacauggcuguuacguccuucagcaucaacaccgccagaucucaggucaucgacuuuacaucccccuucuuuagcaccucccuuggcauucuggugcgcacacgggauaccgcugccccuaucggggcguucauguggccccuccauuggacgauguggcugggaauuuucguggcccugcacaucaccgcugucuuucuuacacucuacgaguggaagucuccuuucggccugacccccaaagggagaaaucggagcaagguguuuuccuucucuagcgcccugaacauuugcuaugcucuccuguuuggccgcacaguugccaucaaaccgccuaagugcuggaccggaagauuccuuaugaaucugugggcgaucuuuuguauguucugccucuccacguacacagccaaccuggcugccgugauggucggcgagaaaauuuaugaggagcugucugggauccaugaccccaagcugcaccacccuagccaaggauuucgguucggcaccgugagagaauccagcgcugaggauuacguucgccagucuuuucccgagaugcaugaauauaugcggagauacaaugugccggccacaccugacggggucgaguaucugaagaacgaucccgaaaaacucgacgccuucauuauggauaaggcucugcucgacuacgagguguccaucgaugcggacuguaaacugcuuaccguuggaaagccuuuugccauugaaggcuacgggaucggccugccucccaauagcccccucaccgcuaacauuucugagcugaucucccaguauaaaagccacggauucauggauaugcugcaugacaagugguaccgcguggucccgugcggcaagagaucuuucgccgugacagagacgcuucagauggggaucaaacacuuuuccggacuguucgugcuccuguguauuggcuuugggcucagcauccugaccacaauuggagaacauaucgucuaucggcuucugcucccccgcauuaagaacaaauccaagcugcaauacuggcugcacaccagccagagacuucaccgggccaucaauacaucuuucaucgaggaaaaacagcaacauuuuaagaccaagcgcguugagaaaagaagcaacgugggcccucggcagcugacgguguggaauacauccaaccucucucacgacaaucgcagaaaguauauuuucagcgaugaagaggggcagaaccagcugggcauccggauucaucaagacaucccccucccuccccgcagacgggagcugccugcucuuagaaccaccaauggaaaagccgauucccugaacgucucucgcaauagcgugaugcaggaacuguccgagcucgaaaagcagauucagguuauccggcaagagcugcagcuugcggugucuagaaaaacagaacuggaggaguaccagcgcaccagccggacaugcgaauccuga

SEQ ID NO: 70015 - RNA, 3132 nt, Artificial Sequence
  derived and/or modified sequence opt5 from GRIN3B__Homo_sapiens__NP_619635
auggaguucgugagagcccuguggcucggccuggcucuugcccuggggcccggaagcgcgggcgggcacccucagccgugcggaguccucgcucggcugggcggguccguucgccuuggagcccugcuccccagagccccucuggcucgggcccgcgcuagagccgcgcuggcccgggcugcccucgcuccccgccugccucauaaccuuucucuggaacucgugguggccgcgcccccugccagagacccggcuagccugacccggggccuuugucaagcccuggugcccccuggcgucgcugcccuccuggccuuucccgaggcucgcccugaacugcuccagcugcacuuccuugcggccgcuacagagacgcccguucugucccuccugagacgggaagcccgcgccccgcuuggggcuccuaaucccuuucaucugcagcuccacugggccucuccucuggagacccugcucgaugugcuggucgcggugcuucaggcucaugccugggaggacguuggacuggcccucugcagaacacaagaucccggcgggcugguggcucuuuggaccagccgggccggacggcccccucagcugguccucgaccuguccagacgggauacaggcgacgcugggcugagagcccgccucgcgccgauggccgcucccgugggaggcgaagccccugugcccgcugccguccugcuuggcugugauaucgcgcgggccagacgcguucuggaggcugugccucccgggccgcacuggcuccugggaaccccucugcccccuaaggcccuucccacagcuggccucccucccgggcugcuggcccucggagaaguggcccggccgccucuggaggcugcgauucacgacaucguccagcuuguggccagagcucugggcucugccgcccagguucaacccaaacgcgcucuccugcccgccccugugaacugcggggaucugcagccggcgggacccgagagcccuggccgguuccuugcuagauuucucgccaauaccuccuuccagggccgcacggggcccgucugggugaccggaagcucucagguucauaugucccggcacuuuaagguguggagccugagacgcgacccucggggcgcccccgcuugggccacagucgggucuuggagagauggacaacuggaccucgaaccuggcggggcguccgcucggcccccgccuccccagggcgcccagguguggccuaaacugcgcgucgugacccuucuggagcaucccuucguuuuugccagagauccggacgaagacggacaauguccugcuggccagcucugccuggaucccgggacaaacgacagcgccacccuggaugcucuuuucgccgcgcucgccaauggaucugcuccucgggcccugagaaaguguugcuacggcuauuguauugaccugcucgagcgccuggcugaagauacgcccuuugacuucgagcuuuaccuggugggggauggaaaauauggcgcccuccgggacgggagauggacaggccuggucggagaucugcuugccggccgcgcucacauggcggugaccuccuuuagcaucaacuccgccagaucucagguuguggacuucacaagccccuucuuuuccaccagccucgggauuaugguccgggcucgcgauaccgccucuccuaucggagccuucauguggccgcugcacugguccacauggcugggcguguuugcugcccuccaucugacggcgcuuuuccugaccguguacgaguggagaagccccuaugggcucacaccucggggacgcaauagaucuaccguuuuuagcuacuccucugcucugaaccugugcuaugccauccuuuuccggcgcacagucagcuccaagacccccaaguguccuacgggcagacugcucaugaaucugugggccaucuuuugccuccuggugcuuagcucuuacacagcuaaccuggccgcggugauggucggggacaaaaccuucgaggaacucuccggcauucacgaccccaagcugcaucacccugcucagggauuucgguucggcaccgugugggaaagcucugccgaggccuacauuaaaaaguccuuuccggauaugcaugcucacaugcgcagacacagcgcccccacaaccccucgcgggguugcuaugcugacauccgaucccccuaaacuuaaugccuucaucauggacaagucucugcucgacuaugaagugagcauugaugcggacugcaagcugcucacggucggaaaacccuuugccaucgagggcuacgggauuggacugccgcaaaacuccccucuuaccucuaaucugagcgaguucaucuccagauauaagagcucuggcuucaucgaucuccugcaugacaaaugguacaagauggugcccugugggaaacgcguuuuugcugugacagaaacccugcagauguccauuuaucacuucgccggccuuuuuguccugcucugccugggacucggcagcgcucugcuuucuucccugggggagcaugccuucuuucggcuggcccuccccagaauccgcaagggaagccggcugcaguacuggcuucacacaucucagaaaauucacagagcucugaacaccgaaccucccgagggcagcaaggaagagacggcggaggccgaaccuuccgggccggagguggaacaacagcagcagcaacaggaucagcccaccgcuccugagggauggaagcgcgcccggagagccguugacaaagagcgccgggugagauuccuccuggaacccgcugucgugguggccccugaggcggaugcugaagccgaggccgcuccccgggaaggcccggucuggcucuguagcuauggccgcccucccgccgcgagaccuacaggggcuccccagccuggagagcugcaagagcuugaacggcgcaucgagguugccagagaacggcugagacaggcccuggugcgccggggccagcuccuggcucaacuuggggacucugccagacaucgcccccggagacugcuccaggcucgcgccgcgccggccgaggcuccuccccacuccggacggcccggcagccaggaauga

SEQ ID NO: 70016 - RNA, 1116 nt, Artificial Sequence
  derived and/or modified sequence opt5 from GRINA__Homo_sapiens__NP_001009184
augagccacgagaaguccuuccuggugucuggcgacaacuaucccccuccgaaucccggguacccuggaggcccccagccucccaugccuccguacgcccaacccccuuaucccggggcuccuuacccccagccgccuuuucagcccagcccuuauggacagcccggcuacccccaugggccuuccccguauccccaaggaggcuacccucagggccccuacccucaagggggauauccccagggcccguacccucaggaaggguauccccagggaccuuacccccagggcggguauccucagggacccuacccgcaaucuccuuucccucccaaccccuauggccagccgcaggucuuucccggccaagauccugacagcccccagcacgggaauuaccaggaggaaggaccucccuccuacuaugauaaccaggacuucccugccaccaauugggaugacaaaucuaucagacaagcguuuauucggaagguuuuccucgugcugacacuucagcugagcgugacgcucuccaccgucagcguguuuacauucguugcugaggugaaaggcuuuguccgcgaaaacguguggaccuacuauguuucuuacgccguguucuuuaucucccugauuguccuuagcugcuguggggauuucagacggaagcaucccuggaaucugguggcccucucugugcugacagcuucccugagcuauauggucggaaugaucgccucuuuuuacaacaccgaggcuguuauuauggccgugggcaucacaaccgcggugugcuucacggucgugaucuucuccaugcagacccgcuaugacuuuacaagcuguauggggguucuccugguguccauggucgugcuuuucauuuuugccauccugugcauuuucaucagaaaucggauucucgagaucguuuacgcuucucugggagcccuucuguuuaccuguuuccucgcuguggauacacagcugcugcucggcaacaaacaacugagccuuuccccggaagaguacgucuuugccgcgcugaaucucuauaccgacauuaucaacaucuuccuguacauucuuacgaucauuggccgcgccaaggaauga

SEQ ID NO: 70017 - RNA, 3231 nt, Artificial Sequence
  derived and/or modified sequence opt5 from GRIP1__Homo_sapiens__NP_066973
augaucgccgugagcuucaagugcagaugucagauucugcggcgccucaccaaagacgagucccccuacacaaagucugcuagccaaacgaaaccuccggauggcgcccuggcggucagacggcaguccauccccgaagaguuuaaggggucuaccguuguggaacuuaugaaaaaggagggaacaacccugggccucacagugagcgggggaauugacaaggauggcaaaccucgcgucuccaaccugagacaagggggaaucgcugcccggucugaccagcuugaugugggcgacuauauuaaggccguuaauggcaucaaccuggcuaaauuccgccacgaugaaaucauuagccuccugaagaaugugggggagagagucgugcuggagguugaauacgagcugcccccuguguccguccagggaagcucugugaucuuucggaccguggaagucacacugcauaaagagggcaacaccuucggguuuguuauucgcggaggcgcccacgacgauagaaauaagucccggcccguggugaucacgugcguccgcccugggggaccggcugacagagagggcaccauuaagcccggcgaucggcuucugagcguggacgggauccgccuccugggaacaacccaugccgaagcgaugucuauucuuaaacaguguggccaggaggccgcucugcucaucgaauaugauguuuccgugauggacagcgucgccacagcuucugggccucugcugguggagguugccaagacccccggagcgucccucggcguggcccugacgacaagcaugugcuguaacaaacaggucaucgugauugacaagaucaaauccgcuucuauugccgauagaugcggggcccuucacgucggagaccauauccugagcauugauggcaccuccauggaauacuguacacucgcugaggccacccaauuccuggcuaauaccacagaccaggugaaacuugagauccugccucaccaccagacgcggcucgcgcugaagggccccgaucaugccgcucugguuuccucuuccuuuagcccgaccucuaugagcgccuauucccucucuagccugaacauggggacacuuccuagaucccuguacagcaccucuccccgcggaacaaugaugcggagacgccucaagaagaaagacuucaaguccagccugucucuugccuccagcaccgugggccuggcugggcaggucgugcacacggaaacaaccgagguugugcucaccgccgauccugucacaggauuuggcauccaacugcagggguccguguucgcgaccgaaacacugucuagcccuccccucauuuccuauaucgaggcugacucucccgccgaacggugcggcgugcugcagauuggagauagaguuauggccaucaauggcauuccgacggaggacagcaccuuugaggaagcuagccaacuucugcgcgauagcucuaucacauccaaagucacccucgagaucgaguucgacguggccgaaagcgugauucccucuuccgggacauuucaugucaagcugccuaaaaagcacaacguggaacugggaaucaccauuagcucucccagcucccggaagccuggcgacccccuuguuaucagcgauauuaaaaaggggucuguggcucacagaacgggaacccucgagcugggcgacaaacugcucgccaucgauaauauucgccuggacaacuguuccauggaggaugcgguccagauccuucagcagugcgaagaccuggugaagcucaaaauccggaaggaugaggacaauagcgaugaacaagaguccucuggggccauuaucuacacaguugagcugaagagauacggcggaccgcugggcauuaccaucagcgggacagaggaaccuuucgaccccauuaucaucuccucucuuaccaaaggaggccucgcugaacgcacgggggccauucauaucggagaucggauucuggcuaucaacagcuccucucugaagggcaaaccucucagcgaggccauucaucugcuucagauggcgggggaaacagugacccugaagaucaaaaagcagacagacgcccaguccgcuagcucucccaagaaauucccuaucuccagccaccucucugaucugggcgacgucgaggaggacuccagccccgcccaaaagccgggaaaacugucugauauguauccuuccaccgugcccagcguugacuccgcuguggauagcugggacggcucugccauugauaccagcuacgggacacagggaacguccuuucaggccucuggcuauaauuucaacaccuacgacuggagaagccccaagcagcgggggucccuuucuccugucacaaaaccgcgcagccaaaccuaucccgaugugggacucuccuacgaagacugggauagaucuacagcuagcggcuuugcgggggccgcugacuccgccgagaccgaacaggaggaaaacuucuggagccaggcccuggaggaucuggagacguguggccagucuggaauccuccgggaacuggaggaaaaggcugacagacgcgugucccuucggaauaugacacugcucgccaccauuaugagcggcucuaccaugucccugaaccacgaggcgccuacacccagaagccaacuggggcgccaggcuuccuuucaggaaagaucuagcucccggccucauuauagccaaaccacacgcucuaauacgcuucccuccgaugucggaagaaaaagcguuacccuccggaagaugaagcaggagaucaaagagauuaugucuccuacacccguggaacugcacaaggugacccuguacaaagacagcgacauggaggauuucggcuuuuccgucgccgacgggcuccuggaaaagggaguguacguuaaaaacauccgcccggccggcccuggcgaucuugggggacugaagcccuaugacagacuccuccaggugaaucacguccggacacgcgauuucgacugcugccuggugguuccucuuaucgcugagucuggcaacaagcuggaucucgugauuagcagaaauccccuggccucccagaaaucuaucgaccaacagagccucccgggggauugguccgagcagaacagcgcguuuuuccagcaaccuucucauggaggcaaucuggaaacccgggagcccacgaacacccuuuga

SEQ ID NO: 70018 - RNA, 1692 nt, Artificial Sequence
  derived and/or modified sequence opt5 from GRK1__Homo_sapiens__NP_002920
auggacuucggcagccuggagaccguggucgccaacuccgcuuuuaucgccgcgagagggucuuucgauggaagcuccucucagcccagccgggacaagaaauaccucgcuaagcugaaacuuccuccgcuguccaagugcgaaucucuccgcgauagccugucccuugaguuugaaagcguuugucuggagcaacccauuggcaaaaagcuguuccagcaguuucugcagucugccgaaaagcaccucccugcccucgagcuguggaaagacaucgaggauuaugacacagcugauaaugaccuucaaccccagaaggcccagacgauucuggcucaguaccucgauccucaagccaaacuguucugcuccuuucuugacgaagggaucguggcgaaguucaaagagggacccguggaaauucaggauggccuguuucagccucuccugcaggccacccuggcucaucucgggcaagccccguuccaggaguaucugggaagccuuuacuuucugagauuccuccaguggaaguggcuggaggcucaacccaugggcgaagacugguuucuugauuuccggguccugggcaaagggggauucggcgaggugucugccugucagaugaaagcgacagggaagcucuaugccugcaaaaagcugaacaaaaagcgccugaaaaagagaaagggauaccagggcgcuaugguugaaaagaagauccucaugaaagugcacucccgguuuaucgucagccuggccuaugcuuucgagaccaaggccgaccuuugucuggugaugacaauuaugaaugggggagacauccgcuaccauauuuacaacguuaaugaagagaacccuggcuuucccgagccuagagcccucuucuauaccgcucagaucauuugcggccuggaacaccuucaucaacggcgcaucguguacagagaucugaaacccgagaauguccuccuggacaacgaugggaaugugcggauuucugaccugggacucgcgguggaacugcuugauggccaguccaagacaaagggguaugccggaaccccgggcuuuauggcuccugagcugcuccagggggaagaguacgacuucagcgucgauuauuuugcccugggaguuacgcuguacgagaugaucgccgcucgcggccccuucagagcccggggcgaaaaaguggagaacaaggaacuuaaacaccgcaucauuuccgagccugugaaguaucccgacaaauuuucucaggcgagcaaggauuucugugaagcucuccuggagaaggaccccgagaaaagacugggguuucgggaugaaaccugcgacaagcucagagcccacccucuguucaaagaccuuaauuggcgccaacuggaggccggaaugcucaugccgcccuuuaucccugauuccaagacagucuacgcuaaagacauucaggaugugggcgccuucagcaccguuaaggggguggcuuucgacaagacagauaccgaauuuuuccaggaguuugccacgggaaacugucccaucccuuggcaggaggaaaugauugagacaggcaucuucggggaacugaaugucuggcggucugacggccaaaugcccgaugacaugaaaggaaucuccggcgggagcucuagcuccucuaagagcggaaugugccugguguccuga

SEQ ID NO: 70019 - RNA, 1641 nt, Artificial Sequence
  derived and/or modified sequence opt5 from GRK4__Homo_sapiens__NP_001004056
auggagcuggaaaacaucguggccaauagccuccugcuuaaggcuagacaggagaaagacuacuccucucugugcgauaagcaacccauuggccggcgccucuucagacaguuuugugacaccaaaccuacacugaagcggcacaucgaguuccuugaugccgucgcggaauaugaaguugcugacgaugaggaccgcagcgauugcgggcuguccauucucgacagauuuuucaacgauaaacuggccgccccgcugcccgagaucccucccgacguggugacggaaugucggcucggacugaaggaggaaaauccuucuaagaaggcuuuugaggagugcacccgcgucgcccauaacuaccuuagaggcgaacccuucgaggaauaucaggagagcuccuacuuuucucaguuccugcaauggaaguggcucgaacggcagccugugaccaaaaauacauuucgccacuauagaguucuggggaagggaggcuucggggaggugugugcuugccagguccgggccacaggaaaaauguacgcguguaagaaacuucagaaaaagcgcauuaaaaagagaaaaggcgaggccauggcucugaacgaaaagcggauccucgagaaagugcaaagccgcuuuguugugucccuggccuaugcuuacgaaaccaaggaugcccugugccucguccugacaaucaugaauggcggggaccuuaaguuccauauuuacaaccugggaaauccgggcuuugaugagcagagagcgguguucuaugccgcugaacucuguugcgggcuggaggaccuucagcgggagagaaucguguaccgcgaccugaaacccgaaaacauucuccuggaugaccggggacacaucagaauuagcgaucugggccucgccaccgagaucccugaagggcagcgcguccggggaagaguuggcacggugggcuauauggcucccgagguggucaauaacgaaaaguacaccuucucuccugacuggugggggcugggaugucuuauuuaugagaugauccaaggccauucccccuuuaaaaaguacaaagagaaggugaagugggaagagguugaucagcgcaucaaaaaugacacagaagaguauagcgagaaguucucugaagaugccaaauccauuugccggaugcugcucaccaagaacccgagcaaaagacuggggugccgcggagagggcgccgcuggggugaagcagcacccugucuuuaaggacaucaauuuccggagacuugaagcgaacaugcuggagcccccuuuuugucccgauccccacgccguguacugcaaagacguucucgauauugaacaauucucuguggucaagggaaucuaccuggacacagcugacgaggauuuuuaugcccgcuucgccaccggcuguguguccauuccuuggcagaacgagaugaucgaaagcggcugcuuuaaagacaucaauaaguccgagucugaagaggcucugccgcucgaucuggacaaaaacauucauacgcccgucagccggccuaauagaggguucuuuuaccggcuuuuccgcagaggaggcugucugacaauggugcccuccgaaaaggagguugagccuaagcagugcuga

SEQ ID NO: 70020 - RNA, 1773 nt, Artificial Sequence
  derived and/or modified sequence opt5 from GRK5__Homo_sapiens__NP_005299
auggagcuggaaaacaucguggccaauaccguccuccugaaggcuagagagggcgggggaggcaaacggaaggggaaaagcaagaaauggaaggaaauucuuaaguucccccacaucucccagugcgaggaccugcgcagaacaauugaucgggacuacuguucucucugcgauaaacaaccuaucggacgccugcuuuuuagacaguucugugaaacgcggccgggccuggagugcuauauucaguuucucgacagcguugccgaguacgaagugacccccgaugagaagcugggggaaaaaggaaaggagaucaugacaaaauaucugaccccuaagucccccguguucaucgcgcaggucggccaagaccucgugucucagacagaggaaaagcugcuucagaaaccuuguaaggagcuguuuagcgcuugcgcccaguccguucaugaauaccuccgcggcgagcccuuccacgaauaucuggauucuauguuuuucgacagauuucuucaauggaaauggcuggagcggcagccugugaccaagaacacauuccgccaguacagaguccucgggaaaggaggcuuuggggaggugugugccugccagguucgggcuaccggaaagauguaugccuguaaacgccuggaaaagaagagaauuaaaaagcggaaaggcgagagcauggcucugaaugaaaagcaaauccucgagaaagugaacucccaguucgucgugaaucuggccuacgcguacgaaacgaaggaugcccuuugccuggugcucaccauuaugaacgggggagaccugaaguuucauaucuauaauaugggcaacccgggcuucgaggaggaacgcgcucuuuucuacgccgcugagauucugugugggcucgaagaucugcacagagagaauacagucuaucgggaccugaaacccgaaaacauccuccuggaugacuacggacauauuagaaucagcgaccuuggccuggccguuaagaucccugagggggaucucauucgcggacgggugggcaccgugggguauauggcgcccgagguccugaauaaccagagauacggacuuucuccugacuauuggggccugggcugccucaucuacgaaaugauugaggggcaaucccccuuucgcggacggaaagaaaaggugaaaagagaggagguugaucgccgggugcuggaaacagaggaagucuacagccacaaguucucugaggaagccaaguccaucugcaaaaugcugcucaccaaggacgcuaaacagagacugggcugucaggaggagggggccgcugaagugaagcgccacccguuuuuccggaauaugaacuuuaaaagacuugaggccggaaugcuggauccucccuucguuccugacccccgcgccguguauugcaaggauguccucgacauugaacaguuuagcacggugaagggcgucaaucuggaucauacagacgaugacuucuacucuaaauuuuccaccgggagcguguccauccccuggcaaaacgagaugaucgaaacagaguguuucaaggagcugaacguuuuuggcccuaauggaacccuuccgcccgaccucaaccggaaucacccucccgaaccucccaaaaagggccugcugcagagacucuucaaacggcagcaucagaacaauucuaagagcuccccgagcucuaaaaccuccuuuaaccaccacauuaauagcaaccaugugucuagcaauuccacagggucuagcuga

SEQ ID NO: 70021 - RNA, 1683 nt, Artificial Sequence
  derived and/or modified sequence opt5 from GRK6__Homo_sapiens__NP_001004105
auggagcuggaaaacaucgucgccaauaccguccuccugaaggcuagagagggcgggggaggcaaccggaaaggaaagagcaaaaaguggcgccagaugcuucaauucccccacauuucccagugcgaggaacugagacucucucuggaacgggacuaccauagccuuugugagcgccagccuaucgggagacugcucuuucgggaguucugcgccacacgcccggaacuguccagauguguugcguuucuggauggcguggcugaguaugaagugacgcccgacgauaaacggaaggccugcgggcgccagcucacccaaaauuuccugucucacacaggaccugaccuuauucccgaggucccuagacagcuggugaccaacuguacacagcggcucgagcagggccccugcaaggaucuguuucaagaacuuacccgccugacacaugaguaccucagcguugccccuuucgcugacuaucuggauuccaucuacuuuaauagauuccugcaguggaaauggcucgaacggcagccggugaccaagaacacguuucgccaguauagaguccugggcaaagggggauucggcgaggugugugccugccaaguucgggcuaccgggaagauguacgccuguaaaaagcuggaaaagaaaagaauuaagaaacgcaagggagaggcgauggcccuuaaugagaaacagauccucgaaaaggugaacucucgguuugucgugagccuggcuuaugccuacgagacaaaagacgcucuuugccuggugcucacccugaugaauggcggggaucugaaguuccacaucuaccauaugggacaggccggcuuucccgaagcgagagccgucuucuaugcugccgagauuuguugcggccucgaagaccugcaccgcgagcggaucguuuacagagaucuuaagccugagaacauucugcucgacgaucacgggcauauccgcauuuccgaccugggacuugcugugcacgugcccgaaggccaaacaaucaaagggcgggucggaaccgugggcuauauggccccugagguugugaagaaugaaagauacacguucagccccgacuggugggcccuggggugccuccuguaugagaugauugcuggacagucuccguuucagcagcgcaaaaagaaaaucaagcgggaagaggucgagagacuggugaaggaaguuccugaggaauacuccgagcgcuucagcccccaagcgcggucucucuguucccagcugcuuugcaaagauccugccgagagacugggcugucggggcgggagcgcucgcgaagugaaggagcauccccucuuuaaaaagcugaacuucaaaagacugggagccggcaugcuugaacccccuuuuaagccggacccccaggccaucuauugcaaggauguccucgacauugagcaguucucuacagugaaaggggucgaacuggagccuaccgaucaagacuuuuaccagaaguucgcuacaggauccgugcccaucccuuggcagaaugagaugguugaaaccgaguguuuucaggaacugaacguguucggccucgaugggagcgugcccccggaccuggauuggaaaggccaaccucccgccccucccaagaaaggacuucugcagcggcucuuuuccagacagcgcuga

SEQ ID NO: 70022 - RNA, 1662 nt, Artificial Sequence
  derived and/or modified sequence opt5 from GRK7__Homo_sapiens__NP_631948
augguggacaugggcgcccuggauaaccucaucgcuaauaccgccuaccugcaggcgagaaagcccagcgacugcgauuccaaagagcuucaacggcgcagacggucucuggcucucccugggcugcagggaugugccgaacuucgccagaagcugagccucaacuuccacucccugugcgagcagcaaccgauuggcagacggcuguuucgcgacuuccucgccacaguccccacguuuagaaaagcugccaccuuccuggaagauguucagaauugggagcuugcugaagaggggccuacaaaggacucugcccugcagggacucguggcgaccugugccagcgcucccgccccuggcaacccccagccuuuucugucccaagcuguggccacaaaaugccaggcggccaccacagaggaagaacgggucgcugccgugacccuugcuaaggccgaagccauggcuuuccugcaggagcagccguuuaaggauuucguuacgucugcguuuuaugacaaauuccuccaauggaagcuguuugagaugcagcccgugagcgauaaauacuucaccgaauuucgcguccuggggaagggaggcuucggcgaggugugugccguucaggugaaaaauacagggaagauguaugcuugcaagaaacucgacaagaaaagacugaagaaaaagggaggcgagaaaauggcccuucuggagaaggaaauccucgagaaggucuccagcccuuucauugugucucuggccuacgcuuuugaguccaaaacccaucuuugucuggugaugagccucaugaacgggggagaucugaaguuccacaucuauaaugucggcacacgggggcuggacaugucucgcguuaucuuuuacuccgcccaaauugcgugcggaaugcuccaucugcacgaacuuggcaucguguauagagauaugaaacccgagaacgugcugcucgacgaccugggcaauugucggcuuagcgaucuggggcucgcugucgaaaugaagggaggcaaaccuauuacccagcgcgccgggacgaacggauacauggcccccgagauccugauggaaaaggugucuuacuccuauccgguugacugguucgcuaugggcugcagcauuuacgagaugguggccgggagaacaccuuuuaaggauuauaaagagaaggucuccaaagaagaccugaagcagcggacccuccaggaugaggugaaauuccaacaugacaauuuuacagaagaggcuaaggauaucuguagacuguuccuugccaagaaacccgaacagcgccugggaucucgggaaaagagcgacgauccuagaaaacaccacuuuuucaagaccauuaacuuuccccgccucgaggcgggccugaucgaacccccuuucguuccggaccccuccguggucuacgccaaagauauugcugagaucgacgacuuuagcgaagugcggggcgucgaguucgaugacaaggauaagcaguucuuuaaaaauuucgccaccggggcugugccuaucgccuggcaggaggaaauuaucgagacaggacuguuugaggagcuuaacgaccccaauagaccuacgggcugcgaagaggggaacucuuccaagagcggaguuugccuccugcuguga

SEQ ID NO: 70023 - RNA, 2721 nt, Artificial Sequence
  derived and/or modified sequence opt5 from GRM1__Homo_sapiens__NP_001264995
auggugggccugcuccuguucuuuuuccccgccaucuuucuugaagucagccugcucccuagauccccggggcggaagguucugcuugcuggagccucuagccagcgcuccguggcgagaauggacggcgaugugauuaucggggcucuguucucuguccaccaucaacccccugccgaaaaagugcccgagcggaagugcggagaaauucgcgagcaguacggcauccagagaguugaagccauguuucacacccucgacaaaauuaacgcugauccugugcugcugcccaauaucacacucgggagcgagauccgggacuccuguuggcauucuagcgucgcccuggagcaguccauugaguucauccgcgauagccuuauuucuaucagagacgaaaaggauggaauuaaccggugccugccugacggccaaucccucccgcccggccgcacgaaaaagccuaucgcuggggugauuggacccggcagcagcuccguugccauccaggugcagaaucugcuucagcuguuugauaucccucaaauugcguauagcgccaccucuaucgaccucuccgauaagacacuguacaaauauuuccugagagucgugcccagcgacacccuccaggcucgggccaugcuggauauugugaagcgcuacaacuggacauaugucuccgcuguucacaccgaagggaauuacggagagucuggcauggacgccuuuaaagagcuugcggcccaggaagggcuguguaucgcucauagcgacaagauuuauuccaacgccggagagaaaucuuucgauagacuccugcggaaacuucgcgaaagacugccgaaggcucgggugguggucugcuuuugugagggcaugacagugagaggccuccugucugccaugcgccggcuggggguugugggagaguucucccucaucggcagcgacgggugggccgauagagacgaagucaucgagggauacgaaguggaggcuaauggcgggauuaccaucaagcugcagucuccugaaguucgcagcuuugaugacuacuuccuuaagcugcggcucgauacgaacaccagaaaucccugguucccugaguuuuggcaacaccgcuuccagugccggcugcccggacaccuucuggaaaaccccaauuuuaaaagaauuuguacaggcaacgagucccucgaggaaaauuaugugcaggacucuaagaugggcuucgucaucaacgcgauuuacgccauggcucaugggcugcaaaauaugcaccaugcccugugcccuggacacgugggccucugugaugccaugaaaccgaucgacgggagcaagcugcuugauuuucugaucaaauccagcuucauuggagucucuggcgaggaagugugguuugacgagaagggggacgcucccggccgcuaugauaucaugaaccuccaguacaccgaagccaaccgguaugacuacguucacgugggaacauggcaugagggcguccugaauauugaugacuauaagauccagaugaacaaauccggggugguuagaagcgugugcucugagccuugucugaagggacagauuaaagucauccgcaagggcgaaguguccugcugcuggauuuguaccgcgugcaaagagaaugaauacgugcaagaugaguucacguguaaggcuugcgaccuugggugguggcccaacgccgaucucacaggaugugagccuauccccguucgguaccuggaauggagcaauaucgaguccauuaucgccauugcuuuuucuugccugggcauccucgucacccuguucgugacacuuauuuuugugcuguauagagacaccccggucguuaagagcuccucucgggaacucuguuacaucauccuggccgggauuuuccugggcuaugugugcccuuuuacccuuaucgcuaaacccacaacgaccagcuguuaccuccagcgccugcuggugggacucuccagcgccaugugcuauucugcgcuggucacaaagaccaacagaauugcccggauccuugcuggcuccaaaaagaaaauuuguacaagaaagccucgcuucaugagcgccugggcucaggugaucaucgccucuauucugaucuccguucagcucacccugguggucacgcugauuaucauggagcccccuaugcccauucuuagcuacccgucuaucaaggaaguguaucucaucugcaauacaagcaaccuggggguuguggcgccucugggauacaauggccuccugauuauguccugcaccuacuaugccuucaaaacccggaacguccccgcuaauuuuaacgaggccaaguacaucgcuuucacaauguauaccacauguauuaucuggcuugccuuugugcccauuuacuucgggagcaauuauaaaaucauuacgaccugcuuugccgugucucuguccgucacaguugcucucggauguauguucaccccuaagauguacaucaucauugcgaaaccggagagaaacgugcgcagcgccuuuacaaccuccgauguggucagaaugcacgugggcgacgggaagcugcccugccggucuaauacguuccugaacaucuuucgcagaaagaaagcuggcgccggaaacgccaagaaacggcaaccugaguucagccccaccucccaguguccuucugcucauguucagcuuuga

SEQ ID NO: 70024 - RNA, 2619 nt, Artificial Sequence
  derived and/or modified sequence opt5 from GRM2__Homo_sapiens__NP_000830
augggcagccugcucgcccugcuugcucugcuccugcuuuggggagccguggcggaggggcccgcuaagaaaguccugacccucgaaggcgaccugguucucgggggacuguucccugugcaccagaagggcgggccggccgaggauugcggacccgugaacgaacauagaggcauccaacggcuggaggccaugcuuuuugcucuggaccgcauuaauagagauccucaccuccugcccggcguccggcuuggggcccauauccuggacuccuguucuaaagauacacacgcucucgaacaggcccuggacuucgugcgcgcgagccuguccagaggagccgauggcucucggcauauuugcccugacgggagcuacgcuacgcacggagaugcccccaccgcuaucacaggcguuauugggggauccuauucugacgugagcauccaggucgccaaccuccugcgccuuuuucagaucccucaaauuuccuacgcgagcaccucugccaagcuguccgauaaaagcagauaugacuacuucgcucggacagugccgcccgacuuuuuccaggccaaggcuauggccgagauccuccgcuuuuucaauuggaccuauguuucuacaguggccuccgagggcgauuacggcgaaaccgggauugaggcuuuugaacuggaggcgagagcccggaacaucugugucgcuacgagcgagaaggugggacgcgccaugucuagagccgcuuucgaaggcgugguccgggcccuucugcagaaaccuuccgcgcgcguugcugugcucuuuaccagaagcgaggacgcccgggaacugcuggccgcuucccagagacucaaugccucuuucacauggguggcuagcgauggguggggagcccuggaguccgucguggcgggcagcgaaggggccgcugagggagccauuaccaucgagcuugcuucuuaucccauuuccgacuuugccagcuacuuccaaucucuggauccuuggaacaauagccgcaaccccugguuccgggaauuuugggagcagagauuccgcugcuccuuucggcagagagacugugcggcccacucucuccgcgcuguuccguucgaacaggagagcaagaucauguuuguggucaaugccguguacgcuauggcccaugcccugcacaacaugcaucgggcucuuugcccuaauacaaccagacugugugaugcgaugcgccccguuaacggccggagacucuauaaagacuucgugcugaaugucaaguuugaugccccuuuccgccccgcugacacgcacaacgaagugcgguuugauagauucggcgacgggaucggacgguacaauauuuuuacauaucugcgcgccggcuccgggagauaccgguaucaaaaagucggauacugggccgagggccucacccuggauacaagccuuauccccugggcuucuccuuccgccgggccgcugcccgcgagcagaugcucugagccuugucuccagaacgaagugaaguccguucagcccggcgaggugugcuguuggcugugcauuccuugccaacccuaugaauaccgccuggacgaguucaccugugcugacugcggacuuggcuacuggccgaacgccagccucaccggguguuuugaacugccucaggaguauauccgguggggagaugccugggcugucggccccgugacaauugccugccugggggcgcucgcuacgcuguucguucuuggaguguucgucagacacaaugccaccccuguggugaaggccuccggccgcgagcuguguuacauccuccuugggggcguuuuucugugcuauuguaugacauucaucuuuauugcuaaacccucuaccgccgucugcacacugagacggcucggacugggcaccgcuuucagcguguguuacuccgcccugcucacgaagacaaaccgcaucgcgagaauuuuugggggagcccgggaaggcgcucagcgcccuagauucaucucucccgccagccagguggcuauuugccuggcccuuaucuccgggcaacugcucaucgucguggccuggcugguuguggaggcuccgggaaccggcaaagaaaccgcgccugagcggcgcgaggucgugacacugagauguaaucaucgggacgccagcaugcuugggucucucgcuuauaacguucugcugauugcccucugcacccuguacgccuuuaagacacgcaaaugccccgaaaauuucaacgaggcuaaguuuaucggcuucacgauguauaccacauguauuaucuggcuugccuuucugcccauuuucuacgugaccuccagcgauuacagaguccagacaaccacgaugugcgugucuguuucccucagcggaucugugguccugggcugucuguuugcgccuaaacuucacaucauucucuuccagccgcagaagaauguggugagccaucgggcucccaccuccagauucgggagcgccgccgcucgcgccucuuccagccugggacaaggcuccgggucucaguuugucccuacaguuugcaacggacgggaagugguggacagcaccacauccucucuguga

SEQ ID NO: 70025 - RNA, 2640 nt, Artificial Sequence
  derived and/or modified sequence opt5 from GRM3__Homo_sapiens__NP_000831
augaagaugcugaccagacuccaggugcugacacuugcccuguucagcaaaggcuuucuccugucccuuggggaccacaacuuccugcggcgcgagaucaagauugaaggagaucucguccugggcgggcuguuucccaucaaugagaaaggaacgggcaccgaagagugcgggagaauuaacgaagaccggggaauccaacgccucgaggcuaugcuguucgccauugaugagaucaauaaggacgauuaccuucugccuggcguuaaacucggcgugcauauccuggacacauguucuagagauaccuaugcgcuugaacagagccuggaguuugugcgggcuucccucacaaaggucgacgaagccgaguacaugugcccggaugggucuuaugccauucaggagaacaucccccugcugauugcuggagugaucggcgggagcuacuccucuguuagcauucagguggccaaucuccugcgccuuuuccaaaucccucagauuuccuaugcuagcaccucugccaagcuguccgacaaaagcagauacgauuauuuugcgcggacagugcccccugacuucuaccaggccaaggcuauggccgaaauccuccgcuuuuucaacuggaccuacgucucuacgguugcuuccgagggagauuauggcgaaaccgggaucgaggccuuugaacaggaggcgagacugcggaauauuuguaucgccacagcugagaaagugggacgcagcaacauuagaaagucuuacgacuccgucauccgggaacuucugcaaaaacccaaugcccgcguggugguccucuucaugagaagcgacgauucccgggagcugauugcugccgccucuagagcuaacgcgagcuuuaccuggguugccuccgacggcuggggcgcucaggaaagcaucaucaaggggucugagcacguggccuauggagccauuacacuggaacucgcuucccagccugugcgccaguucgaucgguacuuccaaagccugaauccguauaacaaucauagaaaccccugguuucgcgacuucugggagcagaaguuucagugcucucuucaaaauaaacggaaccacagacgcgucugugauaagcaucuggccaucgacagcuccaacuacgagcaggaaucuaaaauuauguucgugguuaaugcgguguaugcuauggcccacgcccuccacaagaugcagcggacccugugcccuaacacgacaaaacuuugugaugcuaugaagauccuggacggcaaaaagcucuacaaggauuaccugcugaaaauuaauuuuaccgcccccuucaacccuaauaaggacgcugauagcaucgucaaauuugacacauucggggacggaaugggcagauauaacguguuuaauuuccagaacguugggggaaaguacuccuaucucaaagugggccauugggccgagacccugagccuugaugucaauucuauccacuggucccgcaacagcgugcccaccucucaaugcuccgacccgugugcgccuaaugaaaugaagaacaugcagcccggcgaugucugcuguuggauuugcaucccuugcgagcccuacgaauaucuggccgacgaguuuacauguauggauugcgggagcggacaguggcccacggcugaccucaccggcuguuacgaucugccugaggacuauauucggugggaagaugccugggcuaucgggccggugacaauugccugccugggauucauguguaccugcaugguugugacagucuuuaucaagcauaauaacacgccccuugugaaagcguccggcagagagcucuguuacauucugcuguucgggguuggccucucuuacugcaugaccuucuuuuucaucgccaagccuagccccgugaucugugcucugcgccggcuuggacugggcuccucuuuugccauuugcuauagcgcucuccugacaaaaaccaauuguaucgccagaauuuucgacggggucaagaacggagcccagcggccuaaauuuaucucccccagcucucaaguguucauuugccugggccuuauccucgugcagaucguuauggucuccguguggcugauucuggaagcuccggggacccgcagauacacacucgcggagaagcgggagaccgugauccugaagugcaacgucaaagauagcucuaugcuuauuucccugacauaugacgugauccucguuauucuguguacgguguacgccuuuaagaccagaaaaugcccugaaaauuucaacgaggcuaaguuuaucggauucacaauguauaccacauguaucauuuggcuggccuuucuucccaucuucuacgucaccagcucugauuaucgcgugcagacgaccacaaugugcauuagcguuucccucagcggcuuugugguccuggggugucuguucgccccuaaagugcacaucauucucuuccagccccaaaagaauguugugacccaccggcugcaucuuaacagauuuucugucuccggcacaggaaccacguacagccaguccucugcuagcacauacgugccuaccgugugcaauggccgcgaaguccuggacuccacaaccucuagccucuga

SEQ ID NO: 70026 - RNA, 2739 nt, Artificial Sequence
  derived and/or modified sequence opt5 from GRM4__Homo_sapiens__NP_000832
augcccggcaagagagggcugggaugguggugggcccggcucccucugugccuucugcucagccuguacggcccguggaugcccuccucucuugggaaaccuaagggacacccccauaugaacagcauccgcauugacggcgauaucacccuugggggacucuucccugugcacggcagaggcuccgaggggaaacccuguggagaacugaagaaagagaagggcauucaucggcuggaagcuaugcucuuugcccuggaccgcaucaauaacgauccugaccuucugccgaauauuacacucggggcgagaauccuggauacgugcucucgggacacccacgcucuugagcagagccugacauucguccaagcccucaucgaaaaggauggaaccgagguucgcuguggcuccgggggacccccuauuaucacaaaacccgagagaguggugggcgucauuggcgccucugggagcuccgugagcaucaugguugcuaacauucugcggcuguuuaagaucccucagauuucuuaugccuccaccgcucccgaccucagcgauaauucucgcuacgacuucuuuuccagaguggucccgagcgauacauaucaggcccaggcgaugguggacaucguucgggcccugaaauggaacuacgugucuaccgucgcuuccgaaggaagcuauggcgaguccgggguggaagccuucauccaaaagucucgcgaggauggaggcgugugcauugcucagagcgucaaaaucccuagagagcccaaggccggggaauuugacaagauuauccggcgccuucuggagacguccaaugcgagagccguuauuaucuucgcuaacgaagacgauauccggagagugcucgaggccgcucgccgggccaaucagaccggacauuucuucuggaugggcagcgacucuuggggcuccaaaauugccccugugcugcaccuugaagaggucgcugagggggcggugacaauccugcccaagagaaugagcguucgcggauuugaucgguacuucucuagcagaacccucgacaacaaucgccggaacauuugguuugccgaauuuugggaggauaauuuccacuguaaacuguccagacaugcucugaagaaaggcucucacgugaagaaaugcacaaaccgcgaacggaucgggcaggacagcgccuaugagcaagaaggaaagguccaguuugugauugaugccguuuacgcuaugggccaugcccuccacgcgaugcacagagaccugugucccgggcgcgugggccuuugcccucggauggauccggucgacggaacccagcugcucaaguacaucagaaaugugaacuucuccggcaucgcugggaaccccgucacguuuaaugagaacggagaugccccuggccgguaugacauuuaccaguaucaacugcgcaaugacagcgccgaguacaaagugaucgggucuuggacagaucaucuucaccugagaauugaacggaugcauuggcccggauccggccagcagcucccuagaagcaucuguucucugcccugccaaccgggggagcgcaagaaaaccguuaagggcaugccuuguugcuggcacugcgaacccuguacaggauaucaguaccagguggaccgguauaccugcaaaaccuguccuuacgauaugagacccacagagaaccgcacgggcugcagaccuauucccaucauuaagcuggaauggggguccccgugggcuguccucccucuguuccuugccgugguuggaaucgcugccacccuguuuguggucaucacauucgugcgguacaaugacacccccauugugaaggcgagcggccgcgagcucuccuauguucugcuggccgggaucuuucuuuguuacgcuacaaccuuccucaugauugccgagcccgaucugggaacgugcucucugagacggaucuuucucggccuggggaugagcauuuccuaugcugcccuucugacaaaaaccaaccgcaucuacagaaucuucgaacagggcaagcggucugucagcgcgccucgcuuuauuuccccggccagccaacucgcuaucaccuucucucugauuucccugcagcuucucggaaucugugugugguuuguggucgaccccagccauucugugguugauuuccaggaccagagaacacuggauccucgguucgcccgcggcgugcugaaaugcgacauuuccgaucucagccugaucugucuucugggguauucuaugcuccugauggugaccugcacagucuacgcuaucaagacgagaggaguucccgagaccuuuaaugaagccaaaccuauuggcuucacaauguauaccacauguaucguguggcuggccuuuauucccaucuucuuugggaccagccaauccgcugacaagcuguacauucagacgaccacacucaccgucagcgugucucuguccgcgagcguuucccugggaaugcucuacaugccuaagguguauaucauccuguuccaccccgagcagaacgucccgaaacggaagagaucucuuaaagccguggugacagcugccaccaugagcaauaaguuuacgcagaaaggcaacuuccgcccuaauggggaggccaaguccgaacugugcgagaaccucgaagcucccgcccuggcgacaaagcaaaccuacgucacauauaccaaucacgcuauuuga

SEQ ID NO: 70027 - RNA, 3543 nt, Artificial Sequence
  derived and/or modified sequence opt5 from GRM5__Homo_sapiens__NP_000833
auggugcugcuccugauccuuagcguccugcuccugaaggaggacguuagaggcuccgcccagucuagcgaacggcgcgugguggcucacaugcccggggauauuaucauuggagcccuuuucuccguccaucaccaaccuaccguggacaaaguucaugagagaaagugcggcgcggugcgggaacaguacgggauccagcgcgucgaggcuaugcugcacacacucgaaagaauuaacucugauccgacgcugcugcccaauaucacccucggaugugagauccgggacagcugcuggcauuccgccguggcccuggagcagucuauugaauuuauccgcgauagccuuauuuccagcgaggaagaggagggccugguuagauguguggacgggucuuccagcucuuuccgguccaaaaagccuaucgucggagugauuggccccggcagcagcuccguggcuauccaaguccagaaccuccugcagcuuuuuaauauuccucagaucgccuauagcgcuacauccauggaucugucugacaaaacccucuucaaguacuuuaugcgcguugugcccagcgaugcccaacaggcgagagccaugguggacaucgucaagcgguauaacuggacauacguguccgcuguucacaccgaagggaauuauggagagagcggcauggaagccuucaaagauaugucugcuaaggaggggauuugcaucgcccacuccuacaaaauuuauagcaacgcgggagaacagucuuuugacaagcugcugaaaaagcucacaagccaucugccuaaggcccgcguggucgcuuguuucugcgagggcaugaccgugagagggcuucugauggccaugcggcgccucggacuggcuggcgaguuucuucugcucggcuccgaugggugggccgacagauacgacguuacggauggauaccagcgggaagccgugggcgggaucaccauuaaacugcaaucuccggacgucaagugguucgaugacuauuaccugaaacucagacccgagacaaaucaccgcaacccuugguuucaggaguucuggcagcaucgguuucaauguagacuggaaggauucccccaggaaaauagcaaguauaacaaaaccugcaauuccagccuuacacugaagacccaccacgugcaggauucuaaaaugggcuucgucaucaacgcuaucuacuccauggcguaugggcuccauaauaugcagaugagccuguguccuggauacgccggccuuugcgacgcuaugaagcccauugauggccgcaagcugcucgagucucugaugaaaacgaacuuuacagggguguccggagacaccauccuguucgaugagaauggcgacagcccggggcgguaugaaauuaugaacuuuaaggagaugggaaaagauuacuucgacuacaucaacguuggcuccugggacaauggggaacucaagauggaugacgaugagguguggucuaaaaagagcaacauuaucagauccgucuguucugaaccuugcgagaagggccaaaucaaagugauucgcaagggagagguuagcugcuguuggacaugcacccccuguaaagaaaaugaguauguguuugacgaauacacaugcaaggccugucagcugggcuccuggccuacagaugaccuuacggggugcgaucugauccccguccaguaucuccgguggggagaccccgagccuauugccgcugugguguucgccugucugggccugcuugcgacccucuuuguuacagucguguucaucauuuacagagauaccccgguggucaaaucuucuucccgcgagcugugcuauaucauucuggcugggaucugucucggauaccugugcacauuuugucuuaucgccaagcccaagcagauuuauugcuaccugcaacggaucggcauugggcucagcccugccaugucuuacuccgcucuggugaccaaaacgaacagaaucgcccgcauucuggcuggcagcaagaaaaagaucugcaccaaaaagccccgguucaugucugccugugcgcagcuuguuaucgccuuuauucucaucugcauucagcugggaaucauuguggcucuguucaucauggaaccucccgacaucaugcacgauuauccgagcauuagagaggucuaccucaucuguaauaccaccaaccugggcgugguuacaccucuuggguauaauggacugcucauucuguccugcaccuuuuacgccuucaagacacggaacgugcccgcuaauuucaacgaagccaaauauaucgcguuuacgauguacaccacauguauuaucuggcuggccuucgucccuaucuauuuuggcagcaauuacaagauuaucaccaugugcuucucugugucccuuagcgcuacaguugcccucggguguauguuugugcccaaagucuacauuauccuggcuaagccugagcgcaacgugagauccgccuucaccacgucuaccgugguccggaugcauguuggagacggcaaaagcuccucugccgcuagcagauccucuagccuggugaaucucuggaagcgccggggguccagcggcgaaacacugucuuccaacggaaaaagcgugaccugggcgcagaaugagaagucuuccagaggccaacaccuuuggcagcgccugagcauucauaucaacaagaaagagaaccccaaucagacagccgucauuaagccguuuccuaaaucuaccgaauccagagggcucggagcuggcgccggggccggaggcagcgcugggggcgugggagccacgggcggggcgggaugcgcuggcgccgggcccggaggccccgaguccccugaugccggcccgaaggcucuguaugacguugccgaagcggaggaacacuuccccgcuccugcccggccccgcagcccuucucccaucagcacacugucccacagagccgggucugcuagccggaccgacgaugacgugccuucccuucauucugagcccgucgcccgcagcuccucuagccagggaucccucauggagcaaaucagcucugugguuacaagauuuaccgcuaacauuuccgaacugaauagcaugaugcugucuaccgccgcgccguccccuggcgugggggcuccccucuguagcuccuaccugaucccuaaagagauucagcuucccacaacgaugaccacauucgccgaaauccagccgcugccugccauugaggucaccggaggcgcucaacccgccgccggggcucaggcggccggagaugcugcccgggaaucuccugccgcuggccccgaggccgcggcugccaagcccgaccucgaggaacugguggcccugacaccuccgagccccuuucgcgauuccguugacagcggcucuaccacgccuaacucccccgugagcgagucugcucuuugcaucccuagcucccccaaguaugauacacugaucauuagagacuacacccagucuagcuccucucucuga

SEQ ID NO: 70028 - RNA, 2634 nt, Artificial Sequence
  derived and/or modified sequence opt5 from GRM6__Homo_sapiens__NP_000834
auggccagaccccggcgcgcuagagagccucugcucguggcccugcuuccgcuggcguggcucgcucaggccggccuggcccgggcugccgggagcguccgccuugcuggaggccugacccucgggggacuguuccccguucacgccagaggcgcggccgggcgggcuugcggacaacugaagaaagaacagggcgugcaucgccucgaggccaugcuguacgcucuugacagagugaacgccgauccugaacugcuccccggcguccggcugggggcgcgccuucuggacacauguuccagagauacguaugcccucgagcaggcucugucuuuugugcaggcccugauccggggacgcggcgacggggaugaaguuggagugagaugcccuggcggggugcccccucuccggccggcucccccugagcgcgucguugccguggucggagccagcgcuuccucugugagcauuaugguggcgaauguccugagacuuuucgccaucccccaaauuuccuacgcuucuaccgccccugagcugagcgacuccacacgguaugauuucuucagcagaguugugcccccggacucuuaccaggcccaggcuaugguggauaucguccgcgcccucggcuggaacuauguguccacccuggcgagcgaaggcaauuacggggagucuggaguugaagccuuugugcagauuucccgggaggccggcggggucuguaucgcccaaagcaucaagauuccuagagagcccaaaccuggagaauuuucuaaggugauccgccggcuuauggagacacccaacgcuagaggcauuaucauuuuugccaaugaagacgauauccgccggguucuggaggcugccagacaggcgaaccucaccgggcacuuccugugggugggauccgacagcuggggcgccaaaacaucccccauucugucucucgaagaugucgcugugggcgccaucaccauccugccuaagcgcgcuagcauugacggguuugaccaguauuucaugacgcggucccuugagaauaacagacgcaauaucugguuugccgaguucugggaagagaacuuuaauugcaagcugaccagcucuggaacacaguccgaugacagcacccggaaauguacaggcgaagagagaauugggcgggauucuaccuacgaacaagagggaaagguccaguucgugaucgacgcgguuuacgccauugcucaugcccuccacagcaugcaucaggcucugugcccgggccacacggggcuuugucccgccauggagccuacagauggccgcaugcugcuccaauauaucagagccgugcgguucaacggauccgcuggcacccccgucauguuuaaugaaaacggggacgcgccuggaagauacgauaucuuccaguaucaggccacaaauggcucugcuagcuccgggggauaccaggccgugggccaaugggccgagacccugcgccuggacguugaagcucuccaguggagcggggauccccacgaggugccgucuucccugugcagccuuccuuguggccccggagaacggaaaaagauggucaaaggcgugccuugcuguuggcauugcgaggccugcgacggguauagauuucagguggaugaguucaccugugaagcgugccccggagacaugcgcccuacacccaaccacacgggcuguagaccgaccccuguuguccggcugucuugguccagccccugggcugcucccccucuccugcuggccgugcuugggauuguggcuacaaccacagucguggccaccuuuguucgcuacaacaauacgccgaucgugagagcguccggacgggagcucucuuauguccugcugacaggcauuuuccucaucuacgcuauuaccuuucugaugguggccgaacccggggccgcuguuugcgccgcucgcagacuuuuccugggccucggaaccacacugagcuacuccgcccugcuuaccaagacaaaccggaucuaucgcaucuuugagcagggcaagagaucugugacgccucccccuuucauuagccccaccucccaacucgucaucacauuuagccugaccucucuccaggugguugggaugauugcguggcugggagcccggccuccccauuccgugaucgacuacgaggaacagcgcacagucgauccggagcaggcuagaggcgugcugaaaugugacaugagcgaucuuucucugauugggugccucggauauucccugcugcuuauggugaccuguacggucuacgccaucaaggcucggggcguuccugaaaccuucaaugaggccaaacccauuggguuuacaauguauaccacaugcaucaucuggcucgccuucgugccuauuuucuuuggcaccgcucaaagcgcggaaaagaucuacauucagacgacaacccugacagugucucugagccucuccgccagcgucucucugggaaugcuuuaugugcccaaaaccuacguuauccuguuccacccggagcagaacgugcagaagagaaaacgcucccucaaggcuaccagcacagucgccgccccucccaagggcgaggacgcugaagcccacaaauga

SEQ ID NO: 70029 - RNA, 2748 nt, Artificial Sequence
  derived and/or modified sequence opt5 from GRM7__Homo_sapiens__NP_000835
auggugcagcugagaaagcuccugcggguccuuacccugaugaaauuccccugcuguguucucgaggugcugcuuugcgcccuggcugccgcggcucgcggccaagaaauguacgccccucacagcaucagaauugagggggacgugacacucggaggccuguuuccgguccaugccaaggggcccuccggagugccuuguggcgauaucaaacgggaaaacgggauucaccgccuggaggcuaugcucuaugcccuggaccagaucaauucugaucccaaccuucugccuaauguuacgcucggagcucggauucuggauaccugcagcagagacacauacgcccuugaacagucccugaccuucgugcaggcgcucauccaaaaggacacaucugauguccgcuguaccaacggcgagcccccuguguuuguuaaaccggagaagguggucggcgugaucggggccagcggauccucugugagcauuauggucgcuaauauccugagacuguuccagauuccccagaucuccuaugccagcacagcuccugaacucucugacgaucggcgcuacgacuuuuucuccagaguugugcccccugauagcuuucaggcccaagcgaugguggacauugucaaggcccugggcuggaacuaugugucuacccuugcuuccgaggggagcuacggagaaaaaggcguugagucuuucacgcagaucuccaaggaggccgggggacugugcauugcucagagcgugcggaucccccaggaacgcaaagauagaaccaucgacuuugaccggauuaucaagcaacuccuggauacaccuaauucccgcgccgucgugauuuucgccaacgacgaggauaucaaacagauucuugcugcggccaagagagcugaccagguuggccauuuucugugggugggcucugauagcuggggguccaagaucaauccgcuccaccaacaugaagacaucgccgagggagccauuaccauccagcccaaacgggcuacagucgaaggcuucgaugccuauuuuaccagcagaacgcuggagaacaaucgccggaacgugugguucgcggaguacugggaagagaauuucaacuguaagcugacaauuucuggguccaaaaaggaagacaccgauagaaaaugcacaggacaggagcgcaucggcaaggacagcaauuacgaacaggaggggaaaguccaauuugugauugaugcuguuuaugccauggcccacgcucuccaccauaugaacaaggaccugugugccgacuaccggggagugugcccugagauggaacaggcuggcggcaagaaacuucugaaguauaucagaaacgucaauuucaacgggucugccggaacccccgugauguuuaauaaaaacggcgaugcgcccgggcgcuacgacaucuuccaguaucagaccacaaauacgagcaacccuggauaccggcucauuggccaauggaccgaugagcugcagcuuaauaucgaagacaugcagugggggaagggcguuagagagauuccggccuccguguguacacugcccugcaaaccuggacagcgcaagaagacccaaaaaggcacacccugcuguuggaccugcgaaccuugugauggguaucaguaccaguuugacgagaugacgugccagcacugucccuacgaucaacggccgaacgagaauagaacaggaugccaggacaucccuauuaucaagcucgaauggcauucucccugggcugucauuccuguguuccuggccaugcugggcaucaucgcuaccauuuuugugauggccaccuucauccgcuauaacgauacacccauuguucgggcgagcgggagagagcucuccuacguccugcuuaccggaaucuuucuguguuauauuaucacauuccucaugaucgccaaaccugacguggcugugugcagcuuucggcgcgucuuccugggccuggggauguguauuucuuacgccgcccuucucacgaagaccaauagaaucuaucggauuuuugaacagggcaaaaaguccgugacagcucccagacugaucagcccgaccucucaacuggccauuacauccagccucaucuccguucagcugcuuggaguguucaucugguucggcgucgauccucccaacauuaucauugacuacgaugagcacaagaccaugaaucccgagcaggcucgcggggugcugaaaugcgacaucacggaccuccagauuaucuguucucugggauauagcauccugcuuaugguuaccugcacaguguacgcgauuaagacccggggcgucccugaaaacuuuaaugaggccaaaccgaucggguucacaauguacaccacgugcauuguguggcucgcuuuuauccccauuuucuuuggaacagcccaauccgccgaaaagcuguauauccagaccacaacccugaccauuucuaugaaccucagcgcuuccguugcccugggcaugcuuuacaugccuaaaguguauaucaucauuuuccaccccgagcugaacguccagaagagaaagcgcagcuuuaaagcgguggugacagcugccacgaugucuuccagacucagccauaagccuucugaucggcccaauggggaagccaaaaccgagcugugugagaacgucgacccuaauucccccgcugccaagaaaaaguacguuagcuauaacaaucuggugaucuga

SEQ ID NO: 70030 - RNA, 2727 nt, Artificial Sequence
  derived and/or modified sequence opt5 from GRM8__Homo_sapiens__XP_006716001
auggugugcgagggcaagagaagcgccuccugucccugcuucuuucugcucaccgcuaaauucuacuggauccugacaaugaugcagcggacgcacucucaagaauaugcccauagcauucgcgucgacggggauaucauucuuggaggccuguuuccuguucacgcgaagggggagagaggagugccguguggcgaacucaaaaaggagaaagggauccaucggcuggaagcuaugcuuuacgccauugaccagaucaacaaggaucccgaccugcucuccaauaucacccugggagugcgcauucuggauacaugcucuagagacaccuaugcccucgagcagagccugacauucguccaggcucuuaucgagaaggaugccuccgacgugaaaugugcuaacggcgauccucccauuuuuaccaagccugacaaaaucucuggcguuauuggggccgcggccagcuccgugagcaucauggucgcuaauauucugcggcuuuucaagaucccccaaaucucuuacgccuccacagcuccugaacugagcgauaacacccgcuaugacuuuuucucuagagugguuccgcccgauuccuaccaggcccaggcgaugguggacauugucacggcccuuggauggaauuaugugagcacccuggcuucugagggcaacuacggggaauccggaguggaggccuuuacacagaucagccgggagauuggcggggucugcaucgcucaaucccagaaaauuccucgcgaacccagaccuggagaguucgaaaagaucaucaagcggcuccuggagacccccaaugcccgcgccguuauuauguuugcuaacgaagacgauaucagacggauucuggaggcggccaaaaagcucaaucagucuggccacuuccuguggaucggcagcgacuccugggggagcaaaauugcuccgguguaccagcaagaggaaaucgccgagggagccgugacaauccuuccuaagcgcgcuucuauugauggcuuugacagauauuuccgguccagaacccuggccaacaaucgccggaacgucugguucgcggaauuuugggaggaaaauuucggguguaaacucggaagccauggcaagagaaacucucacaucaaaaagugcacggggcuggagcgcauugcucgggauagcuccuacgagcaggaaggaaaggugcaguuuguuaucgacgccguguauucuauggccuacgcucuccacaauaugcauaaagaucugugucccggcuauauuggccucugcccuagaaugagcacaaucgacgggaaggagcugcugggauacauucgcgccgucaacuucaacggcuccgcugggacccccgugacauuuaaugaaaacggagaugcccccggccgguaugacaucuuccaauaccagaucaccaauaaaagcaccgaguacaagguuauugggcacuggacaaaccagcuccaucugaaaguggaagauaugcagugggcgcacagagagcacacgcauccugccucugucuguucccuuccgugcaagcccggcgagcgcaagaaaaccgugaagggagucccuugcuguuggcacugcgaacggugugagggcuauaauuaccaaguggacgaacugagcugcgagcucuguccccuggaccagagaccuaacaugaaucgcacagggugccagcuuauccccauuaucaaacuggaguggcauucuccgugggcuguugugccugucuuuguggccauucucggaaucaucgcuaccacauucguuauugugaccuuuguccgguauaacgauacgcccaucgugagagccuccggccgggaacugagcuacgugcugcucacagggauuuuccuguguuauuccaucaccuuucuuaugauugcggccccugacaccaucaucugcucuuuccgcagaguuuuucugggacucggcauguguuucagcuacgcugcccugcugacaaagaccaaucggauucacagaaucuucgagcaggggaaaaaguccgucacagcucccaaguuuauuucuccugccagccaacuugugaucacguucucccucauuagcgugcagcugcugggcgucuuugugugguucguuguggaucccccgcauaucaucauugacuauggagaacagcgcacccucgauccugagaaagcccggggcguccugaagugcgacaucucugaucuuucccugauuuguagccucggguacucuauccugcugauggugacaugcaccguuuacgcuauuaaaacaagaggagugcccgaaaccuuuaacgaggcgaagcccaucggcuucacgauguauaccacaugcauuaucuggcuugccuuuaucccuauuuucuuugggaccgcucaguccgccgagaaaauguacauccaaacaaccacgcucacagucagcaugucucugagcgccuccgugagccugggaaugcucuauaugccgaagguuuacauuaucauuuuccaccccgaacagaaugugcagaagcgcaaaagaucuuuuaaggcugucgugaccgccgcgacaaugcaguccaaacugauccaaaagggcaacgaccggccuaauggggaggugaaaagcgaacuuugugagucccuggaaaccaacaccucuagcacaaagacgaccuauaucuccuacucuaaucacagcauuuga

SEQ ID NO: 70031 - RNA, 1782 nt, Artificial Sequence
  derived and/or modified sequence opt5 from GRN__Homo_sapiens__XP_005257310
auguggacccuggugagcugggucgcccucacagcuggccugguugccgggacgagaugccccgacggacaguucuguccuguggcgugcugucuugauccgggcggggcuuccuacucuugcugucggccccugcucgacaaguggccuaccacacugagccgccaccuuggaggccccugccaaguggaugcccauuguuccgccgggcacucuugcaucuuuaccgucagcggaacauccucuuguugcccuuuccccgaggcuguggccuguggcgacggccaucacugcugcccuagaggguuucauuguagcgcugauggacgguccugcuuccagcgcagcggcaacaauucuguuggggccauucaguguccggacucccaguuugaaugccccgauuucagcaccuguugcgugauggucgacggaucuuggggcuguugcccuaugccccaagcguccuguugcgaggauagagugcacuguugcccucacggggccuuuugcgaccugguucauacacgguguaucacccccacgggaacccacccgcucgcuaaaaagcugccugcccagcgcacaaacagagcuguggcccugagcuccuccgucaugugccccgaugcgcggagccgcuguccugacggcucuaccugcugugaacuccccucuggcaaauaugggugcugucccaugccuaaugccacaugcuguagcgaucaucugcacugcuguccgcaggacaccgugugcgaccuuauucaguccaagugccugagcaaagagaacgcuacgacagaucuccugaccaagcugcccgcccacacagugggagacgucaagugugauauggaaguuucuugcccugacggcuacaccuguugcagacugcaauccggggcuuggggauguugccccuucacccaggccguguguugcgaggaucauauccacuguugcccugccggcuuuacaugugacacgcagaaagggaccugcgagcagggaccccaucaagugccguggauggaaaaggcuccugcgcaccucagccugcccgauccucaggcccugaaacgggacguccccugcgauaaugugucuagcuguccuuccucugacacaugcugucagcucaccagcggcgaguggggcugcugucccauuccggaagcuguuugcuguuccgaucaucaacacugcuguccucagggguauacaugcguggccgagggacagugucagcgcggcagcgagaucgucgccgggcuggaaaagaugcccgcuagacgggccucucuuucccacccccgcgacaucggaugcgaccaacauaccagcugcccugugggccagacguguugcccgucucuugggggcuccugggcguguugccagcucccccacgcuguuuguugcgaggauagacagcauuguugcccugccggauacacauguaacgugaaagcccggagcugcgaaaaggaggucguguccgcucaacccgccaccuuccuggcuagaucuccucacgucggcgugaaggacguugaauguggggagggacacuuuugccaugauaaucagaccugcugucgcgacaaccggcagggcugggccugcugucccuauagacagggggugugcugugcggaucgccggcacugcuguccugccggauucagaugcgcugcccgcggcacaaaaugucuucggagagaggcuccccgcugggacgccccgcugcgggauccugcgcucagacaacugcuguga

SEQ ID NO: 70032 - RNA, 654 nt, Artificial Sequence
  derived and/or modified sequence opt5 from GRPEL1__Homo_sapiens__NP_079472
auggccgcucagugcgugagacuggcccggcgcagccuccccgcgcuggcucuuucccugagaccuucuccgcggcuccuguguaccgccacaaagcaaaagaacagcggccagaaucuugaggaagacauggggcaguccgagcagaaggccgaucccccugcuacggagaaaacccugcucgaagaaaaggucaaacuggaggagcaacugaaggaaacaguugagaaguacaaacgcgcccucgcugacaccgaaaaccugagacagcggucucagaaacuuguggaggaggccaaacuguauggaauccaggcguucugcaaggaucuccuggaaguggccgacguccuugagaaagcuacacaaugugugcccaaggaagagauuaaggaugacaauccucaccugaaaaaccucuacgaaggccugguuaugaccgaggugcagauccagaaggucuuuacaaaacaugggcugcucaagcugaaucccgugggagccaaauucgauccuuaugagcacgaagcucuuuuucauaccccgguugagggcaaggaacccgggacgguggcccuggucagcaaagugggauacaagcuccacggccgcacccugagaccugcgcuugugggcgucguuaaggaggccuga

SEQ ID NO: 70033 - RNA, 426 nt, Artificial Sequence
  derived and/or modified sequence opt5 from GRP__Homo_sapiens__NP_001012530
augagaggccgggagcugccccucgugcugcuugcccugguccucugccuggcuccucgcgggagagccguuccgcuucccgcgggaggcgggaccgugcugacaaagauguacccucggggaaaccacugggcugugggccaucucauggggaaaaagagcacgggagaauccucuagcgucuccgagcgcggcucucugaaacagcaacugagagaauauauccggugggaggaagccgcccgcaaucuccugggccuuauugaggcuaaggagaacagaaaucaccagcccccucagcccaaagcccuggggaaccagcaaccuagcugggacuccgaagauucuagcaauuucaaggacgugggauccaagggcaaagggagccagcgggagggacgcaacccgcagcucaaucagcaauga

SEQ ID NO: 70034 - RNA, 1155 nt, Artificial Sequence
  derived and/or modified sequence opt5 from GRPR__Homo_sapiens__NP_005305
auggcccugaacgacugcuuccuccugaaucuugagguggaucacuuuaugcauuguaacaucagcucccacucugcugaccugcccgucaaugaugacuggagccauccuggcauucucuacguuaucccggccguguauggggugauuauccugauuggacuuaucggcaacaucacccugauuaagaucuucugcacagucaaauccaugagaaaugugcccaaccucuuuauuucuagccuggcgcugggggaucuccugcuucugaucacgugugcuccuguugacgccucccgguaccucgccgaucgcuggcuguucggaagaauuggcugcaaacuuauccccuuuauucagcugaccucugugggggucagcguguucacacucaccgcucuguccgccgaccgguauaaggcuaucguucgcccuauggauauccaagccagccacgcgcugaugaagauuugucucaaagccgcuuuuaucuggauuaucucuaugcugcuugccauucccgaagcuguguucuccgaccugcauccuuuucacgaggaaagcacaaaucagaccuucaucucuugcgccccguacccccacuccaacgagcuccauccuaagauccacagcauggcgucuuuucuggucuucuaugugauuccccuuuccaucauuagcguguacuauuacuuuaucgccaagaaucugauucaguccgcuuacaaccucccugucgaaggaaauauccauguuaaaaagcagaucgagucuagaaaacggcuggccaagacagugcugguguucgucggccucuucgcuuuuuguuggcugcccaaccacgugauuuaucuuuaccgcagcuaucacuacuccgagguugauaccagcaugcugcauuucgugacgucuaucugcgccagacuccuggccuuuaccaauuccugugucaacccguucgcucuuuaucugcucagcaaaucuuuucggaagcaauucaauacacagcugcugugcugucagccuggccucauuauccgcagccacuccaccgggagaucuacaaccugcaugacgagccugaaguccacaaaccccagcguggcgaccuuuucucuuauuaacggaaauaucugccaugaacgguacguuuga

SEQ ID NO: 70035 - RNA, 957 nt, Artificial Sequence
  derived and/or modified sequence opt5 from GRSF1__Homo_sapiens__NP_001091947
auggaggacgugcugaacuucuuuagcgauugcagaauccggaauggcgaaaacgggauucacuuccugcugaaucgcgacggaaagagacggggcgaugcccuuaucgagauggaauccgagcaggacguccaaaaagcucuggaaaagcaucgcauguacauggggcagagauauguugagguguacgagauuaacaaugaagauguggacgcccucaugaaaucucugcaggucaagagcucccccgugguuaacgauggagugguccggcuucgcggccugccuuauucuuguaaugagaaagacaucguggacuuuuucgcggggcucaacauuguugauaucaccuuugugauggauuacagaggacggcgcaagacaggcgaggcuuauguccaguucgaggagccggaaauggccaaucaagcccugcugaagcacagagaggaaaucggcaaccgguacauugagaucuuucccagccgcagaaaugaagugcggacgcaugugggguccuauaaaggaaagaaaauugcuucuuucccuaccgccaaguacaucacagagcccgagauggucuuugaagaacacgaaguuaacgaggacauucagccuaugaccgcuuucgaaagcgagaaagagaucgaacuccccaaggaggugccugaaaagcugccggaggccgcggauuuuggcacaaccuccagccuucauuucgugcacaugcgcgggcugcccuuucaggccaaugcucaggacauuaucaacuucuucgccccucucaaacccgucagaaucacaauggaauacucuuccagcggaaaggcuaccggcgaggccgacgugcacuuugagacgcaugaagaugcgguugccgcuaugcugaaagaccggucucacgugcaucacagauauauugagcuuuuccucaauuccugcccuaaggggaaauga

SEQ ID NO: 70036 - RNA, 873 nt, Artificial Sequence
  derived and/or modified sequence opt5 from GRXCR1__Homo_sapiens__NP_001073945
augcugaagagagagaugaaacccgaaagcgaccggccucgcaaggugagauuccggaucgccuccucucacagcggccgcguccucaaagagguuuacgaagaugggcagccguccggaucucuggacagcgagugcgcuuccauuuguggcaucgaugggcuuggagacucugauggccaacagaacgggcauauugaaagcgagggagacgagaaugaaaacgaucaggacucccugcucgugcuggccagagcggcuagcgagaagggcuuuggcacccggcgcgugaauauccuuucuaaaaacgggacagucagaggagugaaguauaagguuuccgccggccaggcccuguucaauaaccucacgaaagugcugcaacagcccagcaccgaucuggaauuugaccgggucgugauuuacacaaccugccuccgcguugugagaacaaccuucgagcggugugagcugguccgcaagaucuuucagaaucacagagugaaauucgaagagaagaacaucgcucuuaauggggaauauggaaaagagcuggaugaacggugccgcagagugucugaggccccuucccuccccgucguuuuuauugacggccauuaccuugggggagcugagaagauccugagcaugaacgaaucuggcgagcugcaggauauucucacaaagaucgaacgggugcaacacccucaugagugucccuccugcggcggguucggauuucugccuuguagcgugugccacggcuccaaaaugucuauguucagaaauuguuuuaccgacagcuucaaggcccugaaaugcacggcguguaacgaaaaugggcuccagcgcugcaagaacugcgccggauga

SEQ ID NO: 70037 - RNA, 747 nt, Artificial Sequence
  derived and/or modified sequence opt5 from GRXCR2__Homo_sapiens__XP_011535976
auggaggaccccgaaaagaaacugaaccaaaagagcgauggcaaaccuagaaaggugcgguucaaaaucuccucuagcuacuccgggcgcguccucaagcagguuuuugaggacggacaggaacuggagucuccgaaggaagaguauccccacagcuuccuucaggagucccuggaaaccauggauggcguguacgggucuggagaggugccuagaccccagaugugcagcccuaaacucacagcccaacggauuuccgucuuucgcgaaggcaaugcuuauacgcuggccgggggacagcccagauucaacgacuacaaggcgaaugaucauaaaccucuuccgaucauugacuuuggcaagaucauuaucuauaccaacaaucugaaaaucauucggacacccauggauaagcgcgacuucgugagaaagauccuccagaaagaggaggaagcugaggaagagagccugaugaacaaggaagagucuuacggcgggcgggaucagcacgaccgcccucugguugaggccgaauccacccucccccaaaauagauauacacaggagggagauauuccugaagacagcuguuuucauugccggggcucuggguccgccaccuguagccugugccacggaucuaaauucuccaugcuugcuaaccgcuuuaaggagagcuacagagcccugcggugucccgcuugcaaugaaaacggccuccagccgugucagaucugcaaucaauga

SEQ ID NO: 70038 - RNA, 618 nt, Artificial Sequence
  derived and/or modified sequence opt5 from GSC2__Homo_sapiens__NP_005306
auggccgcugccgcgggcggggcugccagcagacggggagccggccgccccugcccuuucuccaucgagcacauucugucuagccucccggaaagaucccugcccgcucgggccgcuuguccuccccagccugccgggcgccaaucucccgcgaagccugaggaaccgggagcccccgaggcugccccuugcgcuuguugcuguugcuguggccccagagccgcgccuugcgggcccccggaagccgcugccggacuuggcgcucggcuggccuggccucuccgccugggccccgccgugccucuuagccugggggcucccgcgggaggcuccggggcccuccccggagcugucggcccugggucucagagacggacccgcagacaucggacaaucuuuagcgaggagcagcugcaggcccuggaagcccucuucguucaaaaccaguacccggacguguccacgcgcgagagacuggcuggacggauucgccuuagagaggaacggguggaggucugguuuaaaaauagacgcgccaaguggcggcaccagaaaagagcgagcgcuucugcccgccugcuccccggcgugaagaaauccccuaagggcagcuguuga

SEQ ID NO: 70039 - RNA, 774 nt, Artificial Sequence
  derived and/or modified sequence opt5 from GSC__Homo_sapiens__NP_776248
augcccgccagcauguucuccaucgacaacauucuggcugccagaccucggugcaaggauucugugcucccggucgcgcacagcgcugccgcccccguuguguuuccugcucugcauggcgacucccuuuacggggccucuggaggcgcuagcuccgauuauggggccuucuacccccgcccuguggcgcccggaggcgccgggcugccugcugccgucucuggaagcagacucggcuauaauaacuacuuuuauggccagcugcacgugcaagcugccccgguugggcccgcguguugcggagccgugccuccccuuggcgcucagcaguguuccugcgucccuacacccccgggguacgagggaccuggcagcgugcugguuucucccgugccucaucagaugcuccccuauaugaaugucgggacccugucccggacggaacugcaacuccugaaccagcuucacugucgcagaaaacggcgccauagaaccaucuucacagacgagcagcuggaagcccucgagaaucuguuucaggaaaccaaguaccccgaugugggaacacgggagcaacuugcucgcaaagugcaccugagagaggaaaaggucgagguuugguucaaaaaccggcgcgccaaguggagacggcagaagcgcuccucuuccgaagagagcgagaaugccgaaaaauggaacaagaccucuuccagcaaagcuagcccugagaagagagaagaggaaggcaaaucugaccucgauagcgacuccuga

SEQ ID NO: 70040 - RNA, 1338 nt, Artificial Sequence
  derived and/or modified sequence opt5 from GSDMA__Homo_sapiens__XP_006721895
augaccauguucgagaacgugacaagagcccuggcucggcagcucaauccccgcggcgaccugacgccucuugauagccugaucgacuuuaagagauuccacccguuuugccucguccugcggaaacgcaaguccacccuuuucuggggagccagauacguucggacagauuauacccugcucgacgugcuggaacccgggucuagcccuuccgaucccacagacaccggcaacuuuggguucaaaaauaugcuggauacacgcguggagggagacgucgaugugccuaagaccguuaaagugaagggcacggcggggcucucucaaaacagcacccuggaaguccagacacuuuccguggcucccaaggcccuggagaccguucaggaaagaaaacucgccgcugaccauccuuuucugaaggagaugcaggaucaaggagagaaucuuuacguggucauggaagugguggagacaguccaggaaguuacccuggagcgggccggcaaagcugaggccuguuucucucucccguuuuucgcgccccugggccugcaggggagcauuaaccacaaggaagccgugacgaucccuaaaggaugcgugcucgcuuuucgcgucagacagcugauggugaagggcaaggacgagugggauauuccccauaucuguaaugacaacaugcaaacauucccucccggggaaaaauccggagaggaaaagguuauucuuauccaggccagcgacgugggcgauguccacgagggguuucggacccugaaagaggaagugcagcgcgagacacagcaaguugaaaagcucucuagagugggacaguccagccugcuuucuucccugagcaaacuccugggcaagaaaaaggagcugcaggaccucgaacuggcucuugagggcgcccuggauaaggggcaugaggucacccucgaagcgcugccgaaagacgugcuucugucuaaggaggccgucggagcuauccucuauuucgugggcgcccugaccgaacuguccgaggcucaacagaaacuccugguuaagagcauggagaaaaagauucuuccugugcagcugaagcucgucgaguccacaauggagcagaauuuccugcuggauaaagaagggguguuuccccuucaaccugagcuccugucuagccugggagacgaagaacucacgcugaccgaggcccuuguuggccuguccgggcucgaagugcagcggagcggaccccaguacaugugggaucccgacacacugccucgccugugcgcccuuuaugcuggccucucucugcugcagcaacucaccaaggcguccuga

SEQ ID NO: 70041 - RNA, 1251 nt, Artificial Sequence
  derived and/or modified sequence opt5 from GSDMB__Homo_sapiens__XP_011523318
auguucagcguguuugaggaaaucaccagaauugucguuaaggagauggacgccggcggggauaugaucgcugugcggucccugguggacgccgaucgcuucagaugcuuucaccucgucggagaaaaacggacauucuuuggcugucgccauuacacgaccgggcugacacuuauggacauucuggauaccgacggagauaaguggcucgacgagcuggauucuggccuucaggggcaaaaagcggaguuccagauccuggacaacguggauagcacaggagaacucauuguuagacugcccaaggagaucaccaucuccggcucuuuucagggcuuccaccaucagaaaauuaagaucagcgaaaaucggauuucccaacaguaucuggcuacacucgagaaccgcaagcugaaaagagaacuuccuuuuucuuuccggagcaucaauacccgcgagaaccuguaccucgugacggagacccuggaaacagucaaggaggaaacccuuaaauccgacagacaguauaaguuuuggagccagauuucucaagggcaccuguccuacaaacauaagggacagcgggaggugacaaucccgcccaaucgcguucucagcuauagagugaagcagcuggucuucccuaacaaagaaaccaugaauauucacuuucggggcaagacgaaaucuuuccccgaggagaaggauggggccuccagcugccugggaaaaucucucggcuccgaagacagccgcaacaugaaggagaaacuggaagacauggaguccgugcuuaaggaucugacagaagagaagagaaaagacgugcucaauucucuggccaagugucuugggaaagaggauauccggcaggaccuggaacaaagagucagcgagguucucaucuccggagaacugcacauggaggauccugacaagccccugcucagcucucuguucaacgcugccggcgugcuuguggaagcucgcgccaaagcgauucuggauuuucucgacgcccugcuugagcuguccgaggaacagcaguucgucgcugaggcccucgaaaagggcacccugccucugcucaaggaucaagugaaaagcguuauggagcagaauugggacgagcuggcuucuagcccgcccgauauggacuacgacccugaagcccggauccuuugcgcgcuguauguggucguguccauucuccuggagcuggccgaagggcccacaucuguuagcuccuga

SEQ ID NO: 70042 - RNA, 1527 nt, Artificial Sequence
  derived and/or modified sequence opt5 from GSDMC__Homo_sapiens__NP_113603
augcccagcaugcuggagagaaucuccaagaaccucgugaaagaaauuggcucuaaggaccugaccccugucaaauaccuucugagcgccacaaagcuccggcaguucguuauccugcgcaaaaagaaggauuccagaucuagcuuuugggagcaauccgacuaugugccgguggaguucucucuuaaugauauucuggaacccagcuccagcguccucgaaacggugguuaccgggccuuuucacuucucugacaucaugauucagaaacauaaggcugauaugggagugaacgucggcaucgagguguccguuagcggggaggccucuguggaccacggaugcucccuggaauuucagaucgucacaauucccagcccuaaucuggaggauuuccagaaacggaagcuccuggaccccgaaccuucuuuucuuaaagagugucgcagacggggcgauaaccuguacguggugaccgaggcggucgaacucaucaauaacacaguucuguaugacuccagcuccgugaauauucuugggaagaucgcucuguggauuaccuacggaaagggccaaggccagggggagucucuccgcgugaaaaagaaagcccugacacugcagaagggaauggucauggccuauaaaagaaagcagcucgugaucaaagaaaaggcuauucugaucagcgaugacgaugagcaacggaccuuccaggacgaauacgagaucuccgagaugguuggcuauugcgccgcucgcagcgaagggcuucugccgucuuuucauacgauuucccccacccucuucaacgccagcucuaaugacaugaagcugaaaccugagcuuuuucugacacagcaguuccucagcggacaucugcccaaguacgaacaagugcacauccugccugucggcagaauugaggaacccuuuuggcagaacuucaaacaccuccaggaggagguguuccaaaagaucaaaacccuggcgcagcuuuccaaggauguucaggacgugauguuuuacucuauucuggccaugcuccgggaucgcggggcucugcaggaccuuaugaauaugcuggaacucgauagcuccggacaccuggacggcccgggcggggccauccugaagaaacuccaacaggauagcaaccaugcuugguucaauccuaaggaccccauccuguaucuucuggaggccauuaugguccucucugauuuucagcacgaccugcuggcguguuccauggagaaaagaauccuucuccagcaacaggaacuggugcggagcauucuggaaccuaacuuccgcuaccccuggucuauccccuuuacacucaagccugagcugcuugccccgcugcaguccgagggacucgcuauuaccuauggccugcuggaagagugcgggcuuagaauggaacucgauaauccccggagcacgugggacgucgaggccaaaaugccucuguccgcucuguacggaacacucucucugcuucagcaacuggccgaggccuga

SEQ ID NO: 70043 - RNA, 1455 nt, Artificial Sequence
  derived and/or modified sequence opt5 from GSDMD__Homo_sapiens__NP_079012
augggcagcgccuucgagagagugguccggcgcguugugcaggaacuggaccacgggggagaguuuauccccgugaccucccuccaaucuagcacaggcuuccagccuuacugccuggucgugagaaagccguccucuagcugguuuuggaaaccccgguauaaguguguuaaccuuuccauuaaagauauccuggaaccugacgcugccgagcccgaugugcagcgcgggagaucuuuccauuuuuacgacgcgauggauggacagauucaaggcagcgucgaacucgcugccccugggcaggccaagaucgcuggaggcgccgcuguguccgacucuagcuccacgagcaugaauguuuauucucuguccguggaucccaacaccuggcagacacuucugcacgagcggcaucuccgccagccugagcacaaaguccugcaacagcugagaagccggggcgacaauguguacguggucaccgaaguucuccagacacagaaggagguggaagugacccgcacacauaagagagaggggucuggacgguucucccugccgggcgcgaccugccuucaaggggagggacagggccaccugagccagaaaaagacggucaccauucccuccgggucuacacucgccuuucgcguggcccaacugguuaucgauagcgaccuugaugugcuccuguucccugacaaaaagcagagaaccuuucagcccccugcuacaggacacaaacgguccaccagcgaaggcgccuggccccagcugccgucuggccuguccaugaugcgcugucuccauaacuuccugacggauggggucccugcugagggagccuuuacagaagacuuccaaggccuuagagcggagguggaaaccaucagcaaggagcuggagcuccuggaccgggaacuuugccagcugcuccuggaggggcuggaaggaguucucagagaucagcuggcccuucgcgcucuggaggaagcccucgagcagggccaaucucuggggcccguggagccucuugacggacccgcuggcgccguccuggaaugucucgugcugagcuccggcaugcugguccccgagcucgccauuccugugguuuaucugcuuggggcucugacaaugcucucugaaacccagcacaagcugcuggcggaggcccuugaaagccagacccuccugggaccgcuggagcucgugggcucccugcuugagcagagcgcucccuggcaagaacggucuacaaugucccugccucccgggcuccugggaaauagcuggggcgagggggccccugccuggguccugcuugaugaaugcggccucgagcugggagaggacacgccccauguguguugggaaccgcaggcucagggcagaaugugcgcccuguacgcgucucucgcucugcuuuccgggcugagccaggagccucacuga

SEQ ID NO: 70044 - RNA, 3342 nt, Artificial Sequence
  derived and/or modified sequence opt5 from GSE1__Homo_sapiens__NP_001127945
augggccccaucauugugccucccgggggacacagcguccccuccaccccucccguugugacaaucgccccuacgaagaccgugaacggcgucuggagaucugagagccggcaggacgcugggucccgcucuagcuccggaggcagagaacggcugauuguggagcccccucucccgcaagaaaaagccgggggacccgcgaucccuucucaucugcuuagcacacccuacccuuucggccugucccccagcucuguugugcaggauucccgcuuuccgccucucaaucugcagagacccguccaccacgugguuccucccagcaccgugacagaggacuaucuucggucuuuccgccccuaccacaccacagaugaccugagaauguccagccucccuccgcugggccuggaucccgcuaccgccgccgcuuauuaccauccuucuuaucucgcuccccacccuuuuccccacccggccuuccggauggacgauuccuacugccugagcgcccuucgcuccccuuuuuaucccauuccuacgcccgggucucugccuccccuccauccgagcgcgaugcaucugcaccuuuccggagucagauacccucccgaacugagccacucuucccucgccgcucugcacagcgagcggaugucuggccugagcgccgagcgccuccagauggacgaggagcugagacgggaacgcgagagagagcgggaaagagagcgcgaacgggaggcugauagagaacgcgagaaggagcgggaaagagagcgcgaaaaagagcgggaacaagagaaggagagagaacgcgagaaagaacgggagagagaacuugagcgccagcgggagcagagagcccgggaaaaggagcugcucgcggccaaggcucuggaacccuccuuccuuccuguggccgagcugcaugggcuccgcggacacgcuaccgaggaaagaggcaaaccgucugagcagcugacacccacccgggccgaaaagcugaaagacgccgggcuccaagcuccuaagcccgugcagcauccucugcaccccgucccuacaccccaucacaccguuccgagccuuaucuccaaccacggaaucuuuagccugccuucuuccagcgcggccacggcucuccugauucagagaacaaaugaggaagagaaauggcuugcccgccagcggagacugcgccaagagaaggaagauagacagucucagguguccgaguuccggcaacaggugcucgaacagcaucuggacaugggccgcccgcccguccccgccgaggcugaacacagacccgagagcaccacacggccuggccccaaccgccaugagccugggggaagagauccgccccagcacuuuggcgggccuccgccccugaucuccccuaagccccaacuccacgccgcgccuaccgcucuguggaaucccgugucucuuauggacaacacccuggaaacacggcgcgccgagagccauucccuccacucucauccugccgcuuucgaaccgagcagacaggccgcuguuccccuggugaaagucgagcggguguuuuguccugaaaaggccgaggagggaccccgcaaaagagaaccugcgccccuggacaaguaccagccgccuccucccccuccccgggagggcgggucccuugaacaccagccuuuccucccgggacccggcccuuuucuggccgagcuggagaaaagcacgcaaaccauucucggccagcagagagcuucucugccccaggccgcuacauucggggaacuuuccggaccucugaagcccggcagcccguaucgcccucccguuccucgggcccccgauccugcguacaucuaugacgaguuccuccaacagagacgccggcuggugucuaaacuggaucuugaagagagacgccggagagaagcccaggagaagggguacuauuacgaccucgaugacuccuaugaugagagcgacgaagaggaaguccgcgcucaucugcggugcguggccgagcagcccccgcugaagcucgauaccucuagcgaaaaacuggaguuucuucaacuguucggacucacaacccagcagcaaaaggaggaacuggucgcucagaaaagacggaagcgcagacggaugcugcgcgagagauccccuagcccucccacgauucagucuaaacggcagacacccuccccgagacuugcccucagcacccgcuacucccccgacgaaaugaauaacucuccuaauuuugaggaaaagaagaaauuccugaccaucuuuaaccugacacacauuagcgccgagaagcggaaagauaaggagagacucguggaaaugcugcgcgcuaugaaacaaaaggcgcuuuccgccgcuguugccgacucucugaccaauagcccccgggacuccccugccgugucucucagcgagcccgcuacacagcaggccucccuggaugucgaaaagccugugggcguugcggcuagccugucugacaucccgaaagccgccgagcccgggaaacuugaacaggugagaccucaagaacucucccgcguccaggagcuggcucccgccagcggcgaaaaggcgcggcugucugaggcuccuggaggcaagaaaucccucagcaugcugcacuacaucagaggggccgcccccaaggauauuccggugccucuuucucauuccacgaacggaaagagcaaacccugggaacccuucguggcugaggaguuugcccaccaguuccaugaauccguucugcagagcacccaaaaggcucuccagaaacacaagggcucugucgccgugcugagcgcggagcagaaucauaaaguggacacauccguccacuauaacaucccugaacugcaaucuagcucccgcgcucccccuccgcagcacaaugggcagcaggagcccccuaccgccagaaagggacccccuacacaagaacuugaucgggacucugaggaggaagaggaagaggaugacgaagauggcgaggacgaggaagaggugcccaaacgcaaguggcaggggauugaagccguuuuugaggcuuaccaggagcauaucgaggaacagaaccuggaaagacaagugcuccagacccagugucggcgccuggaggccagacacuauagccucucccugacggccgaacagcuuucucauagcgucgcugagcugcggucccaaaagcagaaaauggugagcgagagagaacgccuccaggcggagcuggaucaucugcggaagugccuugcccugccggcuaugcacuggccuagaggcuaccucaaaggauauccccgcuga

SEQ ID NO: 70045 - RNA, 996 nt, Artificial Sequence
  derived and/or modified sequence opt5 from GSG1L__Homo_sapiens__NP_001103233
augaagaccagcagacggggccgcgcccugcucgcuguggcccugaaccuucuggcgcuccuguucgcuacaacggccuuucuuaccacacacuggugccaggggacccaaagaguccccaaaccuggauguggccaagggggacgggccaauugcccgaacuccggcgcuaaugccacagcuaacgggaccgccgcgcccgccgcugccgcugccgcggccacagcuucuggaaauggcccucccggcggggcccuguacagcugggagaccggagacgaucgcuuccucuuuagaaacuuccauacgggcaucugguauuccugugaagaggaacugucugggcugggagagaagugccggagcuuuauugaccucgcuccugccuccgaaaaaggcguucuguggcuuucuguggugagcgagguccuguacauccuccugcuugugguuggguucucccugaugugucucgagcuguuucacagcucuaaugugauugauggacugaagcucaacgccuucgcugcggucuuuaccgugcuguccggccuucugggcaugguugcccauaugauguauacacagguguuccaggucaccgugagccucgggcccgaagacuggcgcccucacucuugggauuacggaugguccuuuugccuggcuuggggcagcuucacauguugcauggccgccucugugaccacgcuuaauuccuauacaaaaaccgucaucgaguuuagacauaagcggaagguuuucgaacagggguaccgcgaggagccgacauucauugaccccgaagcuaucaaauauuuuagagagcggauggaaaagcgcgauggaagcgaggaagacuuccaccuggauuguagacacgagcgguacccugcccgccaucagccccacauggcggacuccuggccuagaucuagcgcucaggaggcccccgaacucaaccggcagugcugggugcugggccauuggguguga

SEQ ID NO: 70046 - RNA, 1452 nt, Artificial Sequence
  derived and/or modified sequence opt5 from GSK3A__Homo_sapiens__NP_063937
augagcggcgggggacccuccggcgggggaccuggcgggucuggacgcgcccggaccagcuccuucgcugagccgggcggcgggggaggcgggggaggcgggggacccggcggcucugccagcgggccuggaggcacagggggaggcaaggcguccgugggggcuaugggaggcggcgucggggccucuagcuccggaggcgggcccggaggcagcgggggcggaggcucugggggaccuggcgccgggacguccuuucccccuccgggaguuaaacugggccgcgacagcgggaaggugaccacaguggucgcuacccucggccagggacccgaaagaucucaagagguggccuacacagauaucaaaguuaucggcaacggguccuucggaguggucuaucaggcucggcuggccgaaacccgcgagcuuguggcgaucaagaaaguucugcaggacaagagauuuaagaaucgggaacuccagauuaugcgcaaacuggaucacugcaacaucgugagacuucgguacuucuuuuauagcucuggcgagaagaaagacgagcuguaccucaaucugguccuggaauaugugccugagacaguguaccgcgucgccagacauuucaccaaggcuaaacucacgauucccauccuguauguuaagguguacauguaccaacuuuuucggucccuggccuauauccacagccagggggugugucaucgcgauauuaagccucagaaccuccuggucgaccccgauaccgcugugcuuaaacugugcgacuucggauccgccaagcagcucguuagaggcgaaccgaaugugucuuacaucuguagccgguauuaccgcgcgccugagcugauuuuuggggccacagauuauaccuccagcaucgacgucuggucugcuggcugcgugcuggccgagcuccugcuuggacaacccauuuucccuggcgauuccgggguugaccagcugguggaaaucauuaaaguccucggaacacccaccagagagcagauccgggaaaugaaccccaauuacacggaguuuaaguucccucagaucaaagcucacccguggacaaagguguuuaaaagcagaacacccccugaagccauugcccuguguucuagccuucuggaguauacccccuccucucgccucagcccucuggaggcuugcgcgcauuccuucuucgaugaacugcggugucucggcacccaacugcccaacaauagaccgcuuccuccccuguuuaacuucagcgccggggagcucucuauccagccuucccugaaugcuauucuuauucccccucaccugagaagccccgccggaaccacaacgcucaccccgucuucccaggcccugacagaaaccccuacaagcuccgacuggcaaucuaccgacgcuacgcccacacugaccaacagcuccuga

SEQ ID NO: 70047 - RNA, 1263 nt, Artificial Sequence
  derived and/or modified sequence opt5 from GSK3B__Homo_sapiens__NP_001139628
augagcggcagaccccggaccacauccuucgccgagucuugcaagccugugcagcaaccgagcgcuuuuggguccaugaaagucucucgcgacaaggauggaagcaaaguuacgaccgugguggccacacccggccaggggccugacagaccccaggaagucuccuacaccgauacaaaggugaucggaaacggcucuuucgggguuguguaucaggcgaaacugugugacagcggagagcucgucgcuauuaagaaggugcugcaagauaaacgguuuaagaaucgcgaacuucagaucaugagaaaacuggaccacugcaacauuguucggcuccgcuacuucuuuuauuccagcggcgagaagaaagaugaaguguaccugaaucuuguccuggacuaugugccugagaccguguacagagucgcccggcauuauucucgcgccaagcagacacuccccguuaucuacgugaagcuguacauguaucagcuguucagaucccucgcuuacauucacagcuuuggcaucugucaucgggauaucaaaccucaaaaccugcuucuggacccggauaccgccgugcucaagcugugcgacuucgggucugcuaaacagcuuguccgcggagagcccaauguguccuauauuuguagcagauacuaucgggccccugaacugaucuuuggcgcgacggauuacaccucuuccauugacguuuggagcgccgggugcgugcucgcugagcugcugcucggacagcccaucuucccuggcgacuccggggucgaucagcugguggaaauuaucaagguucuuggaacacccacccgcgagcaaauuagagagaugaacccgaauuauacagaauuuaaauucccucagaucaaggcccaccccuggaccaaaguguuucggccuagaacgccucccgaggcuaucgcccuguguucucgccuccuggaauacacacccaccgcgcggcuuacaccgcuggaggccugcgcucauagcuucuucgacgaacucagagaucccaacgucaagcugccuaauggccgcgacacccccgcccuguuuaacuucaccacacaggagcucuccagcaauccuccccuggcuacgauucuuaucccgccucacgcccggauucaagccgcugcgucuacccccacaaacgccaccgcugccuccgaugccaauacaggcgacagagggcagaccaacaaugcugccagcgcgucugcuagcaacuccacguga

SEQ ID NO: 70048 - RNA, 2349 nt, Artificial Sequence
  derived and/or modified sequence opt5 from GSN__Homo_sapiens__NP_000168
auggcuccccacagaccugccccggcccugcucugcgcgcugagccuugcucugugugcccucucccugcccgugcgggccgcuaccgccucucgcggcgcuagccaggccggggcgccucaaggaagaguccccgaggcccggccuaacuccaugguuguggaacaucccgaguuccuuaaggcuggcaaagaaccugggcugcagaucuggcgcguggagaaguuugaccucgucccggugcccacaaaucuguacggagauuucuuuacgggcgacgccuauguuauucugaaaaccgugcagcucagaaacgggaaucugcaguacgaucuucacuauuggcugggaaacgaaugcucucaagacgagagcggcgcugccgcgaucuucacaguccagcucgaugacuaccugaauggccgggccgugcagcaucgcgagguucagggguuugaauccgcuaccuuccuuggauauuuuaagucuggccugaaauacaagaaagggggaguggccagcggcuucaaacacgucgugccuaacgagguggucguucaaagacucuuucaggugaaggggcggcgcguggucagagcuacagaagugcccguuuccugggagagcuucaauaacggagauuguuuuauucuggaccugggcaauaacauccaucaguggugcggcucuaauuccaaccgguaugagcgccucaaagccacccaggugagcaaggggauuagagauaaugaacggucuggacgcgccagaguccacguguccgaggaaggcacagagccugaagcuaugcugcaaguucuugggcccaaaccggcgcugccugccggaaccgaggacacggcuaaggaggaugccgccaaccggaagcucgcuaaacuguacaaggugagcaauggcgccgggaccaugucugucucccuuguggcggacgaaaaccccuucgcucagggagcccugaaaagcgaggauuguuuuauccucgaccacggcaaggacggcaaaaucuucgucuggaaggggaaacaggccaacacagaagagagaaaggcugcccugaagaccgcuuccgauuucauuacaaaaauggacuacccuaagcaaacccaggugucuguucugcccgaaggaggcgagacgccccucuuuaaacaguucuuuaagaauuggcgcgauccugaccagacagaugggcugggacuuagcuaucuguccagccauaucgccaacguggagcgggucccguucgacgcggccacccuccacacaucuaccgcuauggccgcucaacauggcauggaugacgaugggaccggccagaaacagauuuggagaaucgaaggauccaauaaggugcccguugacccugccacauacggccaguuuuaugggggagauagcuacauuauccuguauaacuaccgccacggcgggcggcaaggacagauuaucuauaauuggcagggcgcgcagucuacgcaagacgagguggccgcuagcgccauccuuaccgcucagcuggacgaggagcucgggggcacacccguccaguccagaguggugcagggaaaggaaccugcccaccugaugucucuguucggcgggaaacccaugauuaucuacaagggaggcaccagccgcgaagggggacaaacagccccggcuuccacccggcucuuucagguuagagcgaacagcgccggcgcuacgcgcgccgucgaggugcugccuaaagccggggcucuuaauucuaacgaugccuucgugcugaagacacccuccgcggcuuaccucugggucggcaccggagccagcgaagccgagaaaaccggcgcucaggaacugcugcgggugcuuagagcccaaccuguucagguggcggaggggucugagcccgacggauuuugggaagcucucggcgggaaggccgccuaucgcacauccccucggcugaaggauaaaaagauggacgcucaucccccgagacuguucgccugcagcaauaaaauuggacgguuugucaucgaggaagugccuggcgagcucaugcaggaagaucuggcuaccgacgauguuaugcuucuggacacaugggaucagguguucgucuggguggggaaggacucccaagaggaggaaaagacggaggcccucaccucugcgaagcgcuacauugaaacagaucccgccaacagagaccggagaacccccaucacaguugugaagcagggcuuugagccuccgagcuucgucggaugguuccugggcugggaugacgacuauugguccguggauccccuggaccgcgcuauggccgaacuugcugccuga

SEQ ID NO: 70049 - RNA, 1911 nt, Artificial Sequence
  derived and/or modified sequence opt5 from GSPT1__Homo_sapiens__NP_001123478
auggaccccggcagcgggggaggcgggggaggcgggggaggcggcggguccucuagcggauccucuagcuccgauucugccccugacugcugggaucaggcugacauggaggccccgggccccgggccuuguggaggcgggggaagccuggcggcugccgccgaagcucaaagagagaaccucuccgccgcuuucagccggcagcugaaugugaacgccaagcccuuugucccuaauguucacgcggccgaguucgugcccucuuuucuucgcggcccugcugccccgcccccucccgcuggcggggccgcgaacaaucauggagccggcuccggggcuggaggcagagccgcuccuguggagagcucucaggaagaacagucccugugcgaggggagcaacucugccgucuccauggaacucagcgagcccaucgaaaauggagagaccgagauguccccggaagagucuugggaacacaaagaggaaauuagcgaggccgagccuggcggcgggucccugggagauggccggcccccugaagagagcgcucaugaaaugauggaggaagaggaggaaauccccaagcccaaaucugugguugcgccuccgggggcccccaagaaagagcacgugaacgucguguucauuggacauguugacgcuggcaaguccacaaucgggggccaaauuauguaccuuacgggaaugguggauaagcgcacccuggaaaaauaugagagagaagccaaggagaaaaaucgggagacaugguaccucagcugggcccuggacaccaaccaggaagaacgcgauaagggcaaaacagucgaaguggggagagcuuauuuugagaccgagaagaagcacuucacaauccuggacgccccuggacacaaaucuuuugugcccaauaugaucggcggggcgagccaggcugaucucgccguccugguuauuuccgcccggaagggagaguucgagaccggcuuugaaaaagggggccagacgcgcgagcaugcuaugcuugccaagaccgcuggagugaaacaccugaucgugcucauuaacaagauggacgauccuacagucaauuggucuaacgaaagauacgaggaguguaaagaaaagcuggugcccuuccuuaagaaaguuggcuuuaauccgaagaaagacauccauuucaugccuugcagcgggcugaccggagccaaccucaaggagcaauccgacuuuugucccugguauauuggccugccuuucauccccuaccuggauaaccucccuaauuucaaccggagcguggacgggcccauucgccugccgaucgucgauaaauauaaggacaugggaacagugguucuuggcaagcuggaaucuggguccaucugcaaaggccagcagcucgugaugaugccuaauaagcacaacgucgaggugcugggcauucuuagcgaugacgucgaaaccgauacgguggcgcccggagagaaucugaaaaucagacucaaggggauugaggaagaggaaauccugcccggauuuauucugugugacccuaacaaucucugccacucuggccggacauucgaugcccagaucguuaucauugagcauaaauccaucauuuguccgggguacaacgcugugcugcacauccauaccugcauugaagaggucgagaucacagcccuuaucugucugguggacaaaaagagcggagaaaaguccaagacccgccccagauuuguuaaacaagaucaggugugcauugcucggcucagaaccgccggcacaaucugccuggagacguucaaggacuuuccucagauggggcgcuucacccuucgggacgaaggcaaaacaauugcgaucggaaagguccugaagcucgugcccgagaaagauuga

SEQ ID NO: 70050 - RNA, 1887 nt, Artificial Sequence
  derived and/or modified sequence opt5 from GSPT2__Homo_sapiens__NP_060564
auggacagcggcuccucuagcuccgauucugcccccgacugcugggaucagguggacauggagagcccuggguccgcuccgucuggagauggcgucagcuccgccguugcggaagcucaaagagagccccugagcucugccuucucccggaagcucaacgugaaugccaaaccuuuugugcccaacguccacgcugccgaguucgugccuagcuuucugcgcgggcccacccagccuccgacacuucccgcuggaucuggcuccaaugacgaaacguguaccggggccggauacccucagggcaagagaaugggccgcggggcgcccguugaaccuagccgggaggagccccuggugucucucgaaggauccaacagcgccgucacaauggagcuguccgaaccggugguugagaauggcgagguggaaauggcucuugaggaaucuugggagcauagcaaagaagucuccgaggccgagccugggggaggcagcucuggggauuccggacccccugaagagagcggccaggaaaugauggaggaaaaggaggagaucagaaaaucuaagagcgugauugugcccuccggcgcucccaagaaagaacacgucaacguuguguucaucgggcauguggacgccggaaagucuaccauuggcgggcaaaucauguuucugacaggaauggucgauaaacggacccucgagaaguaugaacgcgaggcgaaagaaaagaauagagagacaugguaccugagcugggcccuggacaccaaccaggaggaacgggauaagggcaaaacgguggagguugggcgcgcuuauuucgaaaccgagagaaagcacuuuacaauucucgacgccccuggacauaaauccuucgugccgaauaugaucggcggcgcuagccaggccgaucuggccguccuugugaucucugcucggaagggggaguuugaaaccggauucgagaaaggcgggcagacacgcgaacacgcgaugcuggccaagaccgcuggaguuaaacaccucauugugcugaucaacaagauggacgaccccacggucaauugguccauugagagauacgaagagugcaaggagaaacuugugccuuuucugaagaaagucggcuucagccccaagaaagauauccauuuuaugccuuguucugggcucacaggcgccaacauuaaggaacaauccgacuucugccccugguauaccggacugccguucaucccuuaccuggauaaucuccccaacuuuaaucggagcauugacggcccuauccgccugcccaucguggauaaguauaaagacauggggacaguugugcuuggaaagcuggaguccggcucuauuuucaaagggcagcagcucgucaugaugccuaacaagcacaacguggaaguucugggaauccuuagcgaugacaccgagaccgauuuuguggcccccggcgaaaaucugaaaauuagacucaaggggaucgaggaggaagagauucugccgggcuucauccugugugacccuuccaaccucugccauucuggacggacauuugauguccagaucgugauuaucgaacacaagagcauuaucugucccggcuacaaugcugugcugcacauucauacgugcaucgaggaaguugagaucaccgcccuuauuucccuggucgacaaaaagagcggggagaaaucuaagacaagaccccgcuucgugaaacaagaccagguguguaucgcgcggcucagaaccgcuggaacaauuugccuggaaaccuuuaaggauuucccucagaugggccgcuuuacgcuucgggacgaggggaagacaaucgccauuggaaaaguccugaagcucgugccggaaaaagauuga

SEQ ID NO: 70051 - RNA, 1569 nt, Artificial Sequence
  derived and/or modified sequence opt5 from GSR__Homo_sapiens__NP_000628
auggcccugcuccccagagcucugagcgccggcgcggggccuuccuggcggcgcgcugccagagccuuccggggauuucuucugcuccugccggagcccgcugcccuuacccgcgcucugucuagagccauggcgugccggcaggaaccucaaccccagggcccucccccugccgcuggggccguggcuagcuacgacuaucucgucaucggaggcggguccggaggccuggccucugcgcgcagagccgcugagcugggcgcccgggcugccguuguggaaagccacaagcucgggggaacaugugugaacgucggcugcgugccgaaaaagguuauguggaauacggccgugcauuccgaguucaugcacgaucaugcugacuacggguuucccucuugugaaggaaaauucaacuggcgcgucauuaaggagaaaagagaugcguaugugagccggcugaaugccaucuaccagaacaaucuuaccaagucccacauugagaucauucgcggccaugcugccuuuacaagcgacccuaagcccaccaucgaaguuucugggaaaaaguauacagccccucacauccugauugcuaccggaggcaugcccuccacaccgcacgagagccagaucccuggcgccucucucgggauuaccuccgauggauucuuucaacuggaagaacuucccggcagaagcgugaucgucggggcgggauacauugcuguggagauggccggcauccugucugcccucggguccaaaacgagccugaugauucggcaugacaaggugcugcgcuccuucgauucuaugaucagcaccaacugcacagaggagcucgaaaaugcuggagucgagguucugaaauuuucccaggugaaggaagugaagaaaacccuuagcggccuggaggucucuauggugacagccguuccuggcagacuccccgugaugaccaugauccccgacgucgauugucugcuuugggcuauugggcgggugccuaacacgaaggaccugucccucaauaaacugggaauccagacagaugacaagggccacauuaucguugaugaguuccagaacaccaaugugaaagggauuuaugccgucggagacgugugcggcaaggcgcugcucacaccggucgccaucgcugccgggagaaaacuggcucaucgccuuuuugaauacaaggaggacagcaagcuggauuacaacaauauccccaccgugguuuucucucacccucccauuggcaccgugggacucacagaagacgaggccauccacaaauauggcauugaaaacgucaagacguacagcaccuccuuuacaccuauguaucaugcggugaccaaacggaagacaaaauguguuaugaagauggugugcgccaauaaggaggagaaagucguggggauccacaugcaaggacugggcugugaugaaaugcuucagggguucgcuguggccguuaagaugggagcuaccaaagccgacuucgauaacacggucgccauucaucccacaucuagcgaggaacuggugacccucagauga

SEQ ID NO: 70052 - RNA, 1425 nt, Artificial Sequence
  derived and/or modified sequence opt5 from GSS__Homo_sapiens__XP_011527098
auggccaccaacuggggcagccugcuccaggacaagcaacagcuggaggaacuugcuagacaggccguggaucgggcgcuggcugaggggguccuccugcgcacaucccaggaacccacgucuagcgagguuguguccuacgccccuuucacccuuuuuccgucucuggugcccagcgcccuccuggaacaggcuuaugccguccagauggacuucaaucugcucguggaugcuguuucccagaacgccgcguuucuggagcagacacuuucuagcaccaucaaacaagacgauuucacagccagacuguuugacauucacaagcaagugcucaaagagggaaucgcucagaccgucuuccugggccuuaaucgguccgauuacauguuucagcgcagcgccgacgggucuccugcucugaagcaaauugaaaucaacacaauuuccgccagcuucggaggccucgcgucuagaacccccgccgugcaucggcacguucuguccgugcugagcaaaacgaaggaggcugggaagauccucucuaauaacccuuccaaaggacuggcccuuggcaucgcuaaggccugggaacuguauggcagccccaaugcccucguccugcuuauugcucaggagaaagagcgcaacaucuuugaucagagagcgauugaaaaugagcugcucgcccggaacauccaugugauucgcagaaccuucgaagacaucuccgagaaggggucucuggaucaagaccggcgccuguuuguggauggacaggaaauugcugucguuuacuucagagacggcuauaugccucggcaguacagccuccagaauugggaggcccgccugcuucuggagagaucccacgccgcuaaaugcccggacaucgccacacaacucgcggggaccaagaaggugcagcaggaacugagccggcccggaaugcuugagaugcugcucccuggccagcccgaagcuguggccagacugcgcgccacauuugcugggcuguauucucucgaugucggagaggaaggcgaccaagccaucgcugaggcccuggcggccccuucccgguucgugcuuaaaccccagagagagggcgggggaaacaaucuguacggcgaagagaugguucaggcucucaagcagcugaaagauagcgaagaacgcgccucuuacauucugauggaaaagaucgagccggagccuuucgaaaacugucuucuccggcccgggagcccugcuagagugguccaaugcauuuccgagcugggaaucuuuggcguguauguucgccaggagaaaacccuggugaugaauaagcaugucgggcaccuccugcggacgaaagccauugagcacgcggacggaggcguggccgcuggcgucgccgugcuugauaaccccuaccccguuuga

SEQ ID NO: 70053 - RNA, 669 nt, Artificial Sequence
  derived and/or modified sequence opt5 from GSTA1__Homo_sapiens__NP_665683
auggccgagaagcccaaacugcacuacuucaacgcuagaggccggauggaaagcacccgcuggcuccuggccgcggcugggguggaguuugaagagaaguucaucaaauccgccgaagaccuugauaagcugagaaaugacggauaucucauguuucagcaagucccuaugguugagauugauggcaugaaacuggugcagacacgggccauccuuaacuacauugcuucuaaguauaaucuguacgggaaggacaucaaagagcgcgcccucauugauauguauaucgaaggaaucgcugaccugggcgagaugauucugcuccugccggugugcccucccgaagagaaggaugccaaacuugcgcugaucaaggagaaaauuaagaacagauacuuccccgccuuugaaaagguccucaaaagccaugggcaggacuaucuggugggaaauaaacuuucccgggcugauauccaccugguugagcuccuguacuacguggaggaacuggacucuagccucauuuccucuuucccucugcuuaaggcccugaagacgcgcaucagcaaccuccccaccgucaaaaaguuucugcagccuggcuccccgagaaaacccccuauggaugaaaagagccuugaggaggcucggaagauuuuccgcuuuuga

SEQ ID NO: 70054 - RNA, 669 nt, Artificial Sequence
  derived and/or modified sequence opt5 from GSTA2__Homo_sapiens__XP_011512834
auggccgagaagcccaaacugcacuacagcaacaucagaggccggauggaauccauucgcuggcuccuggcugccgcggggguggaguucgaagagaaguuuaucaaaucugcugaagaccuugauaagcugagaaaugacggauaucucauguuccagcaagucccuaugguugagauugauggcaugaaacuggugcagacccgggccauccuuaacuacauugccagcaaguauaaucuguacgggaaggacaucaaagagaaggcucucaucgauauguauauugaaggaaucgccgaccugggcgagaugauucugcuccugccguuuucccagcccgaagaacaggaugcuaaacuugcccugauccaagagaagacgaaaaaccgcuacuucccugcguuugaaaaggugcucaagucucaugggcaggacuaucuggucggaaauaaacuuagcagagccgauauucaccugguggagcuccuguacuacguugaggagcuggacuccucucucaucagcuccuucccccugcuuaaggcucugaaaacacggauuagcaaccucccuaccgugaagaaauuucugcagcccggcucuccucgcaagccgcccauggaugaaaaaucccuugaggagagcagaaagaucuuccgguuuuga

SEQ ID NO: 70055 - RNA, 669 nt, Artificial Sequence
  derived and/or modified sequence opt5 from GSTA4__Homo_sapiens__XP_005249092
auggccgcuagacccaagcugcacuacccuaacggccgggggcgcauggagagcgugagauggguccucgccgcggcuggaguugaguucgacgaagaauuucuggagaccaaagaacagcuuuauaagcugcaagauggcaaucaucuccuguuccaacaggugccgaugguggagaucgacgggaugaaacuuguccagacacgguccauucugcacuacaucgccgauaagcauaaccucuuuggcaaaaaucugaaggagcgcacgcugauugacauguauguggaaggaacccucgaucugcuugagcugcucaucaugcaccccuuccugaagccugacgaucagcagaaagaaguugugaacauggcccagaaggcuauuaucagauacuuucccgucuucgagaaaauccuucgggggcauggacagucuuuucuggugggcaaucaacucagccuggccgacguuauucugcuccagacaauccuggcucuugaggaaaagauuccuaacauccuguccgccuuccccuuucuccaggaguauaccgugaaacugucuaauauuccuacaaucaagcgcuuccuugaaccgggcagcaagaaaaagcccccucccgaugagauuuacgucagaaccguguauaacaucuuucggccuuga

SEQ ID NO: 70056 - RNA, 669 nt, Artificial Sequence
  derived and/or modified sequence opt5 from GSTA5__Homo_sapiens__NP_714543
auggccgagaagcccaaacugcacuacagcaacgcuagaggcuccauggaaucuauccgguggcuccuggccgcggcugggguggagcuugaagagaaguuccuggaaagcgccgaggaccucgauaaacugcgcaaugacggaucccuucuguuucagcaagucccuaugguugagauugauggcaugaagcucgugcagaccagagccauccugaacuauauugcuucuaaauacaaucuguaugggaaggacaugaaggaacgggcccucaucgauauguacacagagggaauuguggaccugacggaaaugauccuucugcuccugaucugccagccggaggagcgcgaugcuaaaaccgcccuugucaaggagaaaauuaagaacagauauuuccccgcguuugagaaagugcucaagagccaucggcaggacuaccugguuggcaauaagcuguccugggccgauauccaccugguggaacucuucuauuacgucgaggaacuggacucuagccuuauuuccagcuuuccucugcucaaagcucugaagacacgcaucucuaaccuucccaccgugaaaaaguuccugcaaccugggucccagagaaaacccccuauggaugaaaagagccucgaggaagcccggaaaauuuuucgcuucuga

SEQ ID NO: 70057 - RNA, 1902 nt, Artificial Sequence
  derived and/or modified sequence opt5 from GSTCD__Homo_sapiens__NP_001026890
augaaggccaucaaaaagagccugaccgaggaagaguaccucuaucuggacuucucccaccagacagaaggcugcauuuuuccccuucauacgucugugacccuguuccuccugagcuacugugauugcaaaaucuuuaagauuugucuugucguuacaaaagagguguccagagacucuagccugcuccgggaugaccugauccaagauguggaaauucagaucaucucccgccaggagcugccuccgauuguccagaacugcugucuccccgcugugguugagagaucugacaauuucugccgggccgggcuggcggugguccuucgccacaucauucaaaagagcuaugaagcugauccucugaagaaagagcuccuggaacuucugggauuuaagaaaaccugucucaaggccugcgccgaggugucccaguggacaagacugugugagcugaccaucccccucgcuauugaaaacuuccugcgggagagcucugaccagccucccacaaucccuguugaaauucuucagcuggagaaaaagcucuccgaaccggugcgcguccauaaugaugacaagcugagacggcaaaaacuuaagcagcagaaagccgauggcguggggcccccucugaccaagggaaaagcuaagagcaaagugcacacgcaggagaccucugagggccucgacuccagcucuaagucccuggaacugaaggucgccuuuagcaaacucacaguucaagaggaacccgcgaccacaaaccgcgagccuucccauaucagaaaggccaaggcuucugaucugcccccgcuugaacacguguucgccgaggggcuguacuuuacccucgcugacaucgugcugcuuccuugcauucaccauuuccuggucaucauuagccggaaauuuuccgagaaacucguggaguucccccugcuggccagcugguaucagcgcauccaggagguuccuggagugaagacggcggccucuaaguguggcauucaauuucuccaccuccccaaacuucugacaaccuccacagaacagcaucccaaucucugcgaggucccuggcguggaagaacagagcgacccgcuguucaucgggggacccagaccuaccauggcuaagcugauggagaaaggcaucgaaguuauguucucuccccacccuugccccaccuggacacuugauuggaacgugcucccggccgcugucagcccuaaggaggggaaaauguccucugaccgggcccugcgcaagcagcaacagcugaauaaccucguguacgucgugacgaaucaggccaagcccggagauagaauuguugacuuuuguagcggcgggggacacgugggcaucguccuggcucauaugcuuccuuccugccaggugacccugauugaaaacaaagagcucagccugauccgggcgaagaaaagaucugaugagcugggccuuuccaauauuugguucauccaagccaacauggaauauuuuacagggauguucaauaucggaguugcucuccacgccuguggcguggccaccgacauggucauugagcauugcaucaagacacgcgcuagcuuugugaccugucccugcuguuacggguucauucagaacacgucuaaauuuaauuucccuaaguccgaacaguuuaagaaaacacugagcuacaaggagcacaugauccugugccgguucgccgaucagaccgcggugcaacugcccccgcagagacgccugauuggaaaacaguguaugugccuuguugaccuggaucgggcuagagccgccgaagaguguggcuauuccguccaggugaucucuauggagccugaaagcugcucccccaagaacaacaugauuguggggguccccaucuga

SEQ ID NO: 70058 - RNA, 849 nt, Artificial Sequence
  derived and/or modified sequence opt5 from GSTK1__Homo_sapiens__NP_001137151
augggcccccugccuagaaccguggaacucuucuacgacguccugagcccguauuccuggcuuggguuugagauccugugccgguaccagaacauuuggaauaucaaccuccaacugcgccccucucuuauuacaggaaucaugaaggauagcggcaauaaaccucccgggcugcucccuagaaagggacuguauauggccaacgaccugaaacuccugcggcaccaucuucagauucccauccacuucccuaaggauuuucuguccguuaugcucgagaaaggcucucugagcgcuaugcgcuuccuuacggccgugaaucuggaacauccggagaugcucgaaaaggcguccagagagcuguggaugcggguguggucucgcgucagcguggggcugugggaguccagcggaagaacccucgacgauuuucugacauucccccggcacguuuuucgcgugaugauccuuccucccccuggcggcucuaccguccugcccgugacaccgcucuccccucauagacugcccgcuguuuucucuagcucccagaacgaagacauuaccgagccucagagcauccuugccgccgcugaaaaggccgggaugucugcugagcaagcccagggacugcucgagaaaauugcgacacccaaggugaaaaaucagcugaaggaaaccacggaggccgcuugucgguacggcgccuuugggcugcccaucaccgucgcucacguggauggacagacacacaugcuguucggcuccgaccgcauggaacuccuugcccaucugcucggggagaaauggaugggaccuauuccgcccgcggugaacgccagacuguga

SEQ ID NO: 70059 - RNA, 897 nt, Artificial Sequence
  derived and/or modified sequence opt5 from GSTM3__Homo_sapiens__XP_011539598
augaacgagguguggcugcccccugccggcaaagggggagcuagcaccuccggcccgcuccugucuugcagcacacccgccagagucccuccccgggggcgccaggcgcuuaauccuaacgcuggaaucuccagagccugugcccggcccugcggcgcugccgaagcucgcgacggggagagaggaggcggcgggguucgggccccugcgcgcggaccgagaccccugaugucuggcauuaagccucucccccugacggugagccuugugcuggaaggguccgaggcccggcaccaugucgugcgcguuguguacggaucuagaguccucggcuauagcugggcuccugauuacgaccggucccaauggcuggaugugaaguucaaacuggaccucgauuuucccaaucugccguaucuucuggacgggaagaacaaaaucacccagagcaaugccauucuccgcuacaucgcuagaaagcacaacauguguggagaaacagaggaggaaaagauucggguugauaucaucgagaaucaggugauggacuuccgcacccagcugauuagacuuugcuauucuuccgaucaugaaaaacugaagccucaauaccucgaggagcugcccggccagcugaaacaguuuagcauguuccucggcaaguuuucuugguucgccggggaaaaacugacauuugucgacuuccuuaccuaugauauccuggaccagaaccggauuuuugauccuaagugucucgacgaguuccccaaucugaaggcguuuaugugcagauucgaagcccuugagaaaaucgcugccuaccugcaauccgaccaguuuuguaagaugcccauuaacaauaaaauggcucaguggggaaacaagccugugugcuga

SEQ ID NO: 70060 - RNA, 627 nt, Artificial Sequence
  derived and/or modified sequence opt5 from GSTO1__Homo_sapiens__NP_001177931
augagcggcgaguccgccagaucucuggggaagggaagcgcucccccuggcccggugcccgaaggguccauccggauuuacucuaugcgcuucugcccuuuugccgagagaacccggcucguccugaaagcgaagggaauccgccacgaaguuauuaacaucaaucuuaaaaacaagcccgagugguucuuuaaaaagaauccuuucggccuggugcccgugcucgaaaacagccaggggcaacugauuuaugaguccgcuaucacaugugaguaccuugacgaagccuauccuggaaagaaacugcucccggaugaccccuacgagaaggccugccagaaaaugauccuggaacuguuuucuaagguccucacgaauaaaaagaccacauucuuuggcggcaacagcauuuccaugaucgauuaucugauuuggccuugguucgagagacuugaggcuaugaagcugaaugaauguguggaccauacccccaaacucaagcuguggauggccgcuaugaaagaggauccuacaguuagcgcccuucugaccucugaaaaggacuggcagggguuucucgagcuguaccugcagaacucccccgaagcgugcgauuauggacucuga

SEQ ID NO: 70061 - RNA, 630 nt, Artificial Sequence
  derived and/or modified sequence opt5 from GSTO2__Homo_sapiens__NP_001177942
augagcggcgacgccaccagaacacuggggaagggaucccagcccccuggcccggugcccgaggggcucauccggauuuacucuaugcgcuucugcccuuauagccacagaacgcggcugguccuuaaagcuaaggauauccgccaugaaguugugaacauuaaucugagaaacaaacccgagugguacuauaccaagcacccuuuuggacauauccccgugcucgaaacaucccaaugucagcugauuuacgagucugucaucgccugcgaauaucuugacgaugcguacccuggccggaaacuguucccguaugaccccuacgagcgcgcuagacagaagaugcuccuggagcuguuuuguaagauccucgaauaccagaauaccacauucuuugggggaaccugcauuagcaugaucgauuaucugcuuuggccuugguucgagcggcuggacguguacggcauucucgauuguguuucccacacacccgcccugcgccuuuggaucucugccaugaaaugggacccuaccgugugcgcucugcucauggauaagagcauuuuucaaggcuuccugaaccuguauuuucagaauaaccccaaugccuucgacuuugggcucuguuga

SEQ ID NO: 70062 - RNA, 633 nt, Artificial Sequence
  derived and/or modified sequence opt5 from GSTP1__Homo_sapiens__NP_000843
augcccccuuacaccguggucuauuucccgguuagaggccggugcgccgcucugcgcaugcuccuggccgaccaggggcagagcuggaaggaggaaguggugacagucgagacguggcaggaaggaucccuuaaagcgucuugucuguacggccagcuccccaaguuucaggauggggaccugacccuuuaucaaagcaacacaauccugagacaccucggacggacccugggccuguacgggaaagaucagcaggaggcugcccucguggacaugguuaaugauggaguggaagaccugcgcugcaaguauauuucccuuaucuacacaaacuaugaggccggcaaagaugacuacgucaaggcucugccuggccagcucaagcccuucgagacccugcuuucucaaaaucaagggggaaaaacauuuauugugggcgaucagaucagcuucgccgacuacaaccugcucgaucugcugcucauucaugaaguucuggcuccugggugucuugacgccuuuccccugcucuccgcguaugugggaagacugucugcccggccuaaacuuaaggcuuuccuggccagcccggaguacgucaaucuccccaucaacggcaaugggaagcaguga

SEQ ID NO: 70063 - RNA, 723 nt, Artificial Sequence
  derived and/or modified sequence opt5 from GSTT1__Homo_sapiens__NP_000844
augggccuggagcucuaccuggaccuucugagccagcccugcagagccguguauaucuucgcuaagaaaaacgauauuccuuucgaacuccggaucgucgaccugauuaaggggcaacaccuuuccgaugccuucgcgcagguuaauccgcugaaaaaggugcccgcucucaaagacggagauuuuacccugacagagucuguggccauccugcucuaccugacgcgcaaguauaaggucccugacuacugguauccccaggaucuucaggccagagcucggguggacgaauaccuggccuggcaacauaccacacuccgcagaagcugucugcgggcucuuuggcacaaaguuauguucccuguguuucugggcgagcccgucuccccucagacccucgccgcgacacuggccgaacuggaugugacccuccagcugcuugaggacaaguuccugcagaacaaggcuuuucucacagggccgcauauuucucuggccgaucuuguugcuaucaccgagcugaugcaccccgugggagccggcugccaagucuucgaagggcgcccuaaacucgcgacguggagacagcggguggaggccgcugugggagaagaccuguuucaggaggcccaugaggucauccugaaagcuaaggauuuucccccugccgaccccaccauuaagcagaaacucaugccguggguucuggccaugauccgcuga

SEQ ID NO: 70064 - RNA, 735 nt, Artificial Sequence
  derived and/or modified sequence opt5 from GSTT2B__Homo_sapiens__NP_001074312
augggccuggaacucuuccuggaccuugugagccagcccuccagagccgucuacaucuuugcuaagaaaaacgggauuccucuggaacuccggaccguugaucuggugaagggacaacacaaaucuaaggaguuccuucagaucaauagccugggcaaacucccgacacugaaggacggggauuuuauucugacggaauccucugccauccucauuuaucugagcugcaaguaccagacccccgaccauugguauccuuccgaucuucaggcgcgcgcuagagugcacgaguaccugggauggcaugccgacuguauccggggcacauucgggaucccccucuggguccaagugcugggaccucuuauuggcguucaggugcccgaagagaaagucgagcgcaacagaaccgccauggaucaggcucugcaguggcucgaagacaaguuucugggcgaucggccuuuccuggccgggcaacaggugacacucgcugaccugauggcccuugaggaacugaugcagccgguugcgcucggauaugagcuguuugagggccgccccagacuugccgcuuggcgggggcgcguggaagccuuccugggagcugagcucugccaggaagcccacucuaucauucugagcauccuggagcaagcggccaaaaagacccucccuacacccuccccugaggcuuaccaggccaugcugcuuagaauugcucggauccccuga

SEQ ID NO: 70065 - RNA, 735 nt, Artificial Sequence
  derived and/or modified sequence opt5 from GSTT2__Homo_sapiens__NP_000845
augggccuggaacucuuccuggaccuugugagccagcccuccagagccgucuacaucuuugcuaagaaaaacgggauuccucuggaacuccggaccguugaucuggugaagggacaacacaaaucuaaggaguuccuucagaucaauagccugggcaaacucccgacacugaaggacggggauuuuauucugacggaauccucugccauccucauuuaucugagcugcaaguaccagacccccgaccauugguauccuuccgaucuucaggcgcgcgcuagagugcacgaguaccugggauggcaugccgacuguauccggggcacauucgggaucccccucuggguccaagugcugggaccucuuauuggcguucaggugcccaaagaaaaggucgagcgcaacagaaccgccauggaucaggcucugcaguggcucgaggacaaauuucugggcgaucggccuuuccuggccgggcaacaggugacacucgcugaccugauggcccuugaggagcugaugcagccgguugcgcucggauaugaacuguuugagggccgccccagacuugccgcuuggcgggggcgcguggaggccuuccugggagcugaacucugccaggaggcccacucuaucauucugagcauccuggaacaagcggccaagaaaacccucccuacacccuccccugaggcuuaccaggccaugcugcuuagaauugcucggauccccuga

SEQ ID NO: 70066 - RNA, 651 nt, Artificial Sequence
  derived and/or modified sequence opt5 from GSTZ1__Homo_sapiens__NP_665877
augcaggccggcaagcccauccuguacagcuauuucagauccucuugcagcuggcgggugcgcauugcucucgcccugaaagggaucgacuacgagaccgucccuauuaaccuuaucaaggauggaggccaacaguuuuccaaagacuuccaggcgcugaauccgaugaagcagguucccacacucaaaauugaugggaucacgauccaccaaucucuggcuauuaucgaauaucuugaggaaaugagaccuacaccccggcugcucccucaggaccccaagaagcgcgccagcgugagaaugauuuccgaucugaucgccggaggcauucagccucugcagaaccucucugugcugaaacaagucggggaggaaaugcagcuuaccugggcucagaaugccaucaccuguggauuuaacgcucuggagcagauucuccaaagcacagccggcaucuacugcgugggcgacgagguuaccauggcggaucugugucuugugccgcaggucgccaaugcugaacgguucaagguggaccugacacccuauccuaccaucuccagcauuaacaaacgccuccugguucuggaggccuuucaggugucucaucccugcagacaaccugauacgcccaccgaacuccgggcuuga

SEQ ID NO: 70067 - RNA, 795 nt, Artificial Sequence
  derived and/or modified sequence opt5 from GSX1__Homo_sapiens__NP_663632
augccccggagcuuccugguggacucccucguccugagagaggccggcgaaaagaaagcuccugaggggucuccgcccccucuuuuucccuacgccguuccucccccucacgcgcugcauggacucagcccgggcgcuugccacgcccgcaaggccgggcugcuuugugugugcccccugugugugaccgcuucccagcuccauggaccucccggcccucccgcccugccgcugcucaaagcuagcuucccucccuuugggagccaauauugccacgccccucugggaagacagcauuccgcggucucucccggcguggcccacggccccgcugccgcugccgcggccgcugcccuuuaccagacaagcuauccucugccggauccccggcaguuccacuguaucuccguugacucuucuuccaaccaacucccuagcucuaagcgcaugagaacggcuuuuaccuccacacagcugcuugaacuggagcgggaguucgccagcaauauguaccucucucgccugagacggauugaaaucgccaccuaucugaaccucuccgagaaacaggugaagauuugguuucagaaucgcagagucaagcauaaaaaggaagggaaaggaagcaaccaccggggcgggggaggcgggggagcuggcggcgggggauccgcgccccaaggcugcaagugugccucucugagcuccgcuaaaugcagcgaggaugacgaugaacuuccuaugucucccuccagcucugggaaggacgaucgcgaccugacagugaccccguga

SEQ ID NO: 70068 - RNA, 915 nt, Artificial Sequence
  derived and/or modified sequence opt5 from GSX2__Homo_sapiens__NP_573574
augagcagauccuucuacguggacucucugaucauuaaggauaccagccggcccgccccuucccucccggagccccacccuggccccgacuuuuucaucccucuggggaugcccccuccgcuugucaugucuguuagcggacccggcugcccuucccgcaaaucuggggcuuuuugugugugcccccugugugugacaagccaucuccacuccagcagaggaucugucggcgccggguccggaggcgcgggcgcuggggugacgggagccggcgggagcggaguugccggcgcugccggggcucugccucuucugaagucucaguucuccagcgcccccggagaugcgcaauuuugcccgcgggugaaccaugcccaccaucaccaccauccuccccagcaccaucaccaccaucaccagccucagcaacccggcucugcugccgcugccgcggccgcugccgcugccgccgcugcggccgcugcccucggccauccccagcaccaugccccugucuguaccgcuacaaccuauaauguggccgacccgcgcagauuccacugccugacaaugggaggguccgaugcgagccagguucccaacggcaaacggaugcgcaccgcuuuuacauccacccagcugcucgaacuggagagagaguucucuagcaauauguaccuuucccggcugcgcagaauugaaaucgccacguaucucaaccugagcgaaaagcaagugaaaauuugguuucagaaucggcgcgucaagcacaagaaagaggggaagggaacccagagaaacucucaugccggcuguaaaugcguggggucccaggugcacuacgcucggagcgaggacgaagauucucuuagcccugccuccgcuaaugacgauaaggagaucucuccccuguga

SEQ ID NO: 70069 - RNA, 1377 nt, Artificial Sequence
  derived and/or modified sequence opt5 from GTDC1__Homo_sapiens__NP_001006637
augagcauccugauuaucgaggccuucuacggcgggucccacaagcagcucguggaccugcuucaagaggaacugggagauugcgucguuuauacccuccccgcuaaaaaguggcauuggagagcccggacaucugcgcuguacuuuagccagacgauuccuaucuccgaacacuaucgcacccuuuucgcuucuagcgugcugaaccucacagagcuggccgcccugagaccggaccucggcaaacugaagaaaauucuuuacuuucaugaaaaucagcugaucuaucccgugaagaagugucaggagcgggauuuccaauacggguauaaccagauccucuccugccuggucgcugacgugguuguguuuaauucugucuucaacauggagagcuuucuuaccuccaugggaaaauucaugaagcugauuccugaucaccgccccaaagaccucgaaagcaucauuagaccuaagugucaggugaucuacuuucccauucgguucccugauguuucucgcuuuaugccgaaacauaagacaacccaccugaagaaaaugcugggccucaaggggaauggaggcgccgugcuguccauggcccuucccuuccagccugagcaaagagacagcgaagaucugcucaaaaacuuuaauucugagugcgacacacacuguggccuggauaccgcucggcaggaguaccuugggaacucccugcgccaggaaagcgaccucaagaaaucuacguccagcgauaauuccucuagccaucacggagagaacaagcagaaucugaccgucgaccccugcgacauccugggcgggguggauaaccaacagagacuccugcauauuguguggccucaccggugggaacacgacaaagaucccgaguccuucuucaagguccuuaugcaucugaaggaccucggacugaauuuucacguuagcgugcuuggcgaaacauucaccgaugugccggacaucuuuucugaggcgaaaaaggcccugggguccagcguccuccauuggggauaucugccuucuaaagaugacuacuuccaggugcuguguauggcugauguugugaucagcacagccaagcacgaguuuuucggcgucgcuaugcucgaagccguguauugcggcuguuacccccugugcccuaaagaccuuguuuaucccgagauuuuucccgcggaauaccuguauuccaccccugagcaacucucuaagcgccugcagaacuucuguaagagaccggauaucauucggaaacaucuguacaagggggaaaucgcccccuuuagcugggcugcccuucacggaaaauuccgcucccuccugacgacagagccuagagaggaccuguga

SEQ ID NO: 70070 - RNA, 1131 nt, Artificial Sequence
  derived and/or modified sequence opt5 from GTF2A1__Homo_sapiens__NP_056943
auggccaacagcgcuaauaccaacacagugcccaagcuguacagauccgucaucgaggacguuauuaaugaugugcgggacaucuuccucgaugacggcguggaugaacagguccugauggagcuuaaaacgcugugggaaaacaagcucaugcaaucucgcgccguggacggguuucacagcgaggaacagcagcugcuucugcagguucaacagcagcaucagccucaacagcagcagcaccaucaccaucaccaccaucaacaggcgcagccgcaacagaccgugccccagcaggcucaaacacagcagguccucauuccugccucccagcaagccaccgcuccccaggugaucguuccugauucuaaacugauucagcacaugaaugccagcaacauguccgcugccgcgacagccgcuacccuggcccuccccgcuggagugacaccuguccagcaaauccugaccaauucuggccagcuucuccagguggugagagccgcgaacggggcccaguauaucuuccaaccgcagcagagcgucguucuccaacaacaggugauuccccagaugcagccuggaggcgugcaggcucccgucauccaacaggugcuggccccucuucccgggggaauuuccccgcagacgggcguuaucauucagccucagcagauccuguuuaccggcaauaagacacaagugauucccaccacagucgcugccccuacccccgcccaggcucagaucacggcgacagggcaacagcagccccaggcccaaccugcucagacccaggccccgcucgugcugcagguugacggaacaggcgauaccagcucugaggaggacgaagaugaggaagaggacuacgaugacgacgaggaagaggauaaagaaaaggacggggccgaggauggacaaguggaagaggagccccugaacuccgaagacgaugucagcgacgaggaaggccaggagcuguucgauaccgaaaauguggucgugugccaguaugacaagauccaucggucuaaaaacaaguggaaauuucaccugaaggaugggauuaugaaucuuaacggacgcgacuacaucuucuccaaagcuauuggcgaugccgagugguga

SEQ ID NO: 70071 - RNA, 1335 nt, Artificial Sequence
  derived and/or modified sequence opt5 from GTF2A1L__Homo_sapiens__NP_001180416
auggccugccugaaccccgugcucugggagaccaagguccugcagagcaaagcuacagaagacuucuuuagaaauuccauccaaucuccucuuuucacgcugcagcucccgcacagccugcaucagacccuucaguccucuacagccagccugguuauucccgcgggccggacccucccuuccuuuacaaccgcugagcuggggacaucuaacagcuccgccaauuucaccuuucccggauacccuauccacgugcccgccggcgugacgcugcaaaccgucagcgggcaucucuauaaggugaacguuccuauuauggugacagaaaccucuggacgcgcuggcauccugcagcacccgauucagcaggucuuccaacagcuugggcagcccuccgugauccagacaagcguuccucaacugaaucccuggucucuccaggccaccacggagaaaucccagagaaucgaaacagugcugcaacagccugcuauucuucccagcggaccggucgaucggaagcaucuggagaacgccaccucugacauccucguguccccuggcaaugagcacaaaauugugcccgaagcgcugcugugucaccaggagagcucccauuacaucucucucccuggcgucguuuuuagcccccaggugucccaaacaaacagcaauguggaaucuguccuguccgggagcgccucuauggcucagaaccuucacgaugagagccuguccaccucuccccauggagcccuccaccagcacgugaccgacauucagcugcauauccuuaagaaucgcauguauggcugcgauagcguuaagcaaccuagaaacauugaggaaccguccaauauccccgugagcgagaaagacucuaacucccaggucgaucugagcauccgggugacagacgaugacauuggggaaaucauucagguugauggaucuggcgacacguccagcaaugaggaaaucggguccacccgcgaugcugacgagaacgaguuccucggaaacauugacggcggcgaucugaaggugccugaagaggaagccgacucuaucagcaaugaggauuccgcgacaaacucuagcgacaaugaagauccccaggucaacaucguggaggaggacccucucaauuccggggaugacgucagcgaacaagaugugcccgaccuguuugauaccgacaacguuauugugugucaguacgacaaaauccacagaucuaagaauaaauggaaguucuaucugaaggauggagucaugugcuuuggcgggcgggacuacguguucgccaaagcuauuggagaugccgagugguga

SEQ ID NO: 70072 - RNA, 330 nt, Artificial Sequence
  derived and/or modified sequence opt5 from GTF2A2__Homo_sapiens__NP_004483
auggccuaccagcuguauagaaacaccacacucggcaauagccugcaggagucccuugacgaacugauccagucucagcagauuacgccccaacucgcucugcaagugcuucugcaguucgauaaggccaucaacgcggcucucgcccagcggguccgcaauagaguuaacuuucgggggagccugaauaccuaccgcuucugcgacaacguguggacauuugugcugaaugaugucgaguucagagaagugaccgagcucauuaaaguugacaaggugaaaaucgucgccugugauggaaagaacacaggcuccaauaccacagaauga

SEQ ID NO: 70073 - RNA, 1320 nt, Artificial Sequence
  derived and/or modified sequence opt5 from GTF2E1__Homo_sapiens__NP_005504
auggccgaccccgaugugcugaccgaggucccugcugcccucaagagacuggcgaaauacguuauccggggcuucuaugggauugaacacgcucuugcccuggacauccucauucgcaacagcugcgugaaggaggaagauaugcuggagcuucugaaauuugacagaaagcagcuccgguccgugcugaauaaccugaaaggagauaaguucaucaagugucgcaugagagucgaaacagccgcugacggcaaaacgacccggcauaauuacuauuuuauuaacuaccgcacacucgugaauguugugaaguauaaacuggaucacaugagacggcgcaucgagaccgacgagagagauucuacaaaccgggccagcuucaagugcccggucuguuccucuaccuuuacagaccuugaagcuaaucaacuguucgaucccaugaccgggacguuucgcugcaccuucugucauacagagguggaagaggacgagagcgccaugccuaaaaaggaugcgagaacccuccuggcccgguuuaacgaacagaucgagcccauuuacgcccuucugcgcgaaacagaggacguuaaucucgcuuaugaaauccuggagccugagcccaccgaaauuccugcucugaagcaguccaaagaccacgccgcgacgacagccggagcugccucucucgcuggcgggcaucacagagaggccugggccaccaagggaccgagcuacgaagaucuguacacacagaacguggucaucaauauggacgaucaagaggaccuucaccgggcuucccuggaaggcaaaagcgcgaaggagagacccauuuggcuccgcgagucuaccgugcagggcgccuauggguccgaagauaugaaagagggaggcaucgacauggaugcuuuccaggaacgggaggaagggcaugccggaccugacgauaacgaggaggugaugagagcccugcuuauucacgaaaagaaaaccagcucugcuauggccggcuccgucggggcggcugcccccguuacagccgcuaauggaagcgacucugaguccgaaacgagcgaguccgaugacgacucuccuccccgcccggccgcuguggccgugcauaagcgggaggaagaugaggaagaggacgaugaauuugaggaggucgcggacgauccuaucgugaugguugccggcagacccuucagcuacuccgaagugagccagcgcccugagcuggucgcucaaaugacccccgaagagaaggaagccuauaucgcuaugggccagcggauguuugaggaccucuucgaguga

SEQ ID NO: 70074 - RNA, 876 nt, Artificial Sequence
  derived and/or modified sequence opt5 from GTF2E2__Homo_sapiens__NP_002086
auggaccccagccugcucagagagcgggaacuguucaagaaacgcgcccuuuccaccccuguggucgagaagagaucugcuagcuccgaaucuagcuccucuagcuccaaaaagaaaaagacaaagguugagcacggcgggagcucuggauccaaacagaacagcgaucauucuaauggcuccuuuaaccugaaggcccucagcgggucuuccggauacaaauucggcgugcuggcgaagaucgugaauuauaugaaaacgcggcaccaacgcggggacacccauccgcuuacacuggaugaaauucucgacgagacccagcaccuggauaucggacugaagcagaagcaguggcucaugacagaggcucuggucaacaaucccaaaauugaagugaucgacggcaaguacgccuuuaaaccuaaguauaacguuagagauaaaaaggcccuucugcggcuccuggaccaacaugaucagcgcggccuugggggcauucugcucgaggacaucgaagaggcucugcccaauagccagaaagccgugaaggcucugggagaucagauccucuucgucaacagaccugacaagaaaaagauucuguuuuucaaugauaaauccugccaauuuucuguggacgaggaguuccagaaacuuuggcggagcguuaccguggacuccauggaugaagaaaagaucgaggaauaccugaagcgccaggggauuagcucuaugcaggaguccggacccaagaaagucgccccuauccaaagacggaagaaaccggcgagccagaagaaacgcagauuuaagacacacaacgagcaccucgccggcgugcugaaggacuauucugauauuaccagcuccaaauga

SEQ ID NO: 70075 - RNA, 1554 nt, Artificial Sequence
  derived and/or modified sequence opt5 from GTF2F1__Homo_sapiens__NP_002087
auggccgcucugggccccagcucccagaacgugaccgaguacgucguuagagugccuaagaauacaacgaaaaaguauaacaucauggccuucaaugcggcugacaaagugaacuuugccaccuggaaucaagcccggcucgaacgcgaucugucuaacaagaaaauuuaccaggaggaagagaugccggaaagcggggcuggauccgaguucaauagaaaacuucgggaggaagcccgcagaaagaaguauggcaucguccugaaggaguuucggcccgaagaccagccuuggcuccugcgcgugaacgggaaaucuggaagaaaguucaaaggcauuaagaaagggggaguuacagagaauaccagcuacuauaucuuuacacagugccccgauggcgcuuucgaggccuuuccugugcacaacugguacaauuucacaccccuugcgcggcaucgcacccugaccgccgaagaggcugaagaggaaugggagagacggaacaagguccucaaucacuuuuccauuaugcaacagcgcagacugaaggaccaggaucaggacgaggaugaagaggaaaaagagaagcggggccgcagaaaagccucugaacugcggauccaugaccucgaggaugaccuggagaugagcuccgaugcuagcgacgccucuggggaagagggaggcagagugccuaaggcgaaaaagaaggccccgcuugcuaaagggggacgcaagaaaaagaaaaagaagggcuccgaugacgaagccuucgaggacagcgaugacggggauuuugaaggacaagagguugacuauaugucugauggcuccucuagcucccaggaggaacccgagagcaaagcuaaggccccucagcaggaagagggccccaaagggguggacgagcaauccgauucuagcgaagaguccgaagaggaaaagccucccgaggaggacaaagaagaggaagaggaaaagaaggccccgacgccucaggagaaaaagcggagaaaagauagcucugaggaauccgacagcucugaggaaagcgauaucgacuccgaggcuucuagcgcgcuguucauggccaagaaaaagacacccccuaagcgcgaacggaaacccuccggaggcagcucuagagggaacucccgccccggaaccccuagcgcugagggcgggucuaccuccagcacacuccgggccgccgcuuccaagcuggagcagggaaaaagagucucugaaaugccggccgcgaagcgccuucggcuggacaccggcccccaaagccucuccggcaaaucuacgccucagcccccuagcgggaagacaacccccaauuccggagauguccaggugacagaggacgcugugagacgcuaccugacccggaaaccgaugaccacaaaggaucugcucaagaaauuucagacgaagaaaaccggccugagcucugaacaaacaguuaacgugcuugcccagauucugaagagacucaacccugagcggaaaaugaucaaugacaagaugcacuucucccugaaggaguga

SEQ ID NO: 70076 - RNA, 750 nt, Artificial Sequence
  derived and/or modified sequence opt5 from GTF2F2__Homo_sapiens__NP_004119
auggccgagagaggcgaacuggaccucaccggggcuaagcagaacacaggaguguggcuggucaaaguucccaaguaccuuagccaacagugggccaaagcguccggccgcggggaggugggaaagcugcggaucgcuaaaacgcagggcagaaccgaagugucuuucacacucaaugaggaucuggccaacauucacgacaucgggggaaagccugccagcgucuccgcuccgcgggaacaucccuuugugcuucagucuguuggcggccaaacccugacaguguucaccgagagcuccucugauaagcucagccuggaggggauugucgugcagcgcgccgaaugcagaccugcugccuccgagaauuauaugcggcugaaacgccuccagaucgaagagagcucuaagcccguuagacugucccagcaacuugacaaaguggucacaaccaacuacaagccuguggcgaaucaccaguauaacauugaguacgaacggaaaaagaaggaggauggaaaacgcgccagagcugacaagcagcaugugcuggauaugcucuuuagcgccuucgaaaaacaccaguauuacaaucugaaggaccuugucgauaucacgaaacaacccguuguguaucugaaggagauccucaaagaaauuggcgugcagaacgucaaggggauccauaagaauaccugggagcugaaaccugaguaccggcacuaccagggagaagagaagucugacuga

SEQ ID NO: 70077 - RNA, 1647 nt, Artificial Sequence
  derived and/or modified sequence opt5 from GTF2H1__Homo_sapiens__NP_001135779
auggccaccagcuccgaggaagugcugcucaucgucaagaaaguuagacagaagaaacaagacggcgcucuguaccuuauggccgagcggauugcgugggcucccgaagggaaggaucgcuucacaaucucucacauguaugccgacauuaaaugccagaagaucagcccugagggaaaggccaaaauucagcugcagcucgugcugcaugcuggcgauacgaccaacuuucacuucuccaaugaaucuacagccgugaaggagagagacgcugucaaagaucuucugcaacagcuccugccgaaguuuaaacggaaggccaacaaggagcuggaagagaaaaaucgcaugcuccaggaagaccccgugcuguuccagcuuuacaaggaucugguugugagccaagucaucuccgcggaggaguuuugggccaacagacucaaugugaacgcuaccgacucuagcuccacaagcaaucauaaacaggauguugggaucucugccgcuuuccuggccgacgugcggccucagaccgauggauguaacggccuucgcuauaaucugacauccgacauuaucgaaagcauuuuuagaaccuaccccgcggucaagaugaaauaugccgagaacgugccucacaauaugacggaaaaggaguucuggacccgguuuuuccagucucauuacuuucaccgcgauagacucaacacaggguccaaagaccuguucgcugaaugcgccaagaucgacgagaagggacugaaaaccauggugagccucggcgucaagaauccccugcuugaucugacagcucucgaggacaaaccucuggaugaaggcuaugggauuucuuccguuccgagcgccuccaacucuaagagcaucaaagagaauagcaacgccgcuauuaucaagcgguuuaaccaccauagcgcgauggugcuugccgcuggacugcgcaagcaagaagcccagaaugagcagaccucugaacccuccaacauggacggcaauagcggggaugccgacuguuuccaaccugcugugaaaagagccaagcuccaggagucuaucgaguacgaagaucugggaaagaacaauagcgucaagacgauugcgcugaaccucaaaaaguccgaccgguacuaucacggccccacaccuauccagucucugcaguacgcuaccagccaagauauuaucaauuccuuccagagcauucgccaggagauggaagccuauacacccaaacuuacccaggugcugucuuccagcgccgcuucuuccaccaucacagcccucagcccugggggagcucugaugcaaggcggcacgcagcaggccaucaaccagaugguuccgaaugacauucaauccgagcuuaaacaucuguacguggcggucggggaacuccugagacacuuuuggucuugcuuccccgugaacaccccuuuucuggaggagaagguugugaaaaugaaguccaaucucgaacgguuccaggucacaaaacugugucccuuucaggagaagaucagacgccaguaucuuuccaccaaccuggugucucacauugaagagaugcuccaaacagccuacaauaagcugcauaccuggcagagccggagacugaugaaaaagacguga

SEQ ID NO: 70078 - RNA, 1188 nt, Artificial Sequence
  derived and/or modified sequence opt5 from GTF2H2C_2__Homo_sapiens__NP_001035955
auggacgaggaacccgagagaaccaagcggugggaaggcggguacgagcgcacaugggaaauccugaaagaggaugagagcggaucccucaaggccacgauugaagacauccuguucaaagcuaagagaaaacggguguuugagcaccauggccagguccgccuugggaugaugagacaccuguauguugugguggauggaucucggaccauggaagaccaagaucucaagccuaaccgccugacaugcacccuuaagcugcucgaguacuucgucgaggaauauuuugaccagaauccgauuagccagaucggcauuaucgugacaaaauccaagagagccgagaaacugaccgaacugucugggaacccccggaagcauaucacaagccucaaagaggcgguugauaugaccugucacggagaaccuucccuguacaauucucuuagcauggcuaugcagacgcugaagcauaugcccggccacaccucccgcgaggugcucauuaucuucagcucucugacaaccugcgacccuuccaacauuuaugaucuuaucaagacacugaaagccgccaagauuagagucagcgugaucggccucucugcugagguucggguguguaccguccuggcccgcgaaacagggggaacguaccacgugauucuggacgagucccauuauaaagaacuccugacccaccaucuuucucccccuccggcuagcuccagcuccgagugcucucugaucagaaugggcuuuccccaacacacaaucgccagccucuccgaucaggacgcgaagccuagcuucucuauggcccaccuggaugggaauaccgaacccggacuuacccugggcggguacuuuuguccucagugccgggcuaaauacugugagcuccccguggagugcaagauuuguggacugacacuggucuccgccccgcaucucgcucgcagcuaucaccaucuguucccucuugacgccuuucaggaaaucccccuggaggaauacaacggcgagagauucugcuauggcugucaaggggaacucaaagaccagcacguuuacgugugcgcggugugccagaaugucuuuuguguggauugcgacguuuucgugcaugauucucugcacuguugcccuggauguauucacaagauccccgcccccagcggcgucuga

SEQ ID NO: 70079 - RNA, 1017 nt, Artificial Sequence
  derived and/or modified sequence opt5 from GTF2H2C__Homo_sapiens__XP_005248650
augagacaccuguacguggucguugacggcagccggaccauggaggaucaggaccucaagcccaaccgccugacaugcacgcuuaaacugcucgaauauuucguggaggaauacuuugaucaaaauccuaucucccagauugggaucauugugaccaagucuaaaagagccgagaagcugacagaacuuagcggaaacccgcggaaacauaucaccucccugaaggaggcugucgacaugacaugucacggcgagcccucucucuauaauagccuguccauggccaugcagacccugaagcauaugccugggcacacaucucgcgaagugcucauuaucuucagcucccugaccacgugcgaucccagcaacaucuacgaccuuauuaaaacccugaaggcggcuaaaaucagaguuucugugauuggacucuccgccgagguccggguguguacaguucuggcccgcgaaaccggcgggacauaucaugugauccuugaugagagccacuacaaggagcugcucacccaccaucugucuccucccccugcuuccucuagcuccgaaugcagccugauuagaaugggauuuccgcagcacacgaucgccucccucucugaccaagaugcuaaacccagcuucuccauggcccaucuggacggcaauacagagccuggccuuacccucgggggauauuuuuguccccagugccgggcgaaguacugugaacugccugucgagugcaagauuuguggccugacacuugugagcgcuccccaccuggcccgcucuuaccaccaucucuucccgcuggaugccuuucaggaaaucccucuggaggaguauaacggggaaagauucugcuacggaugucagggcgagcucaaagaccaacacguguaugucugcgcuguuugccagaauguguuuuguguggauugcgacgucuucgugcaugacucccugcacuguugccccggguguauccauaagauuccugcccccagcggaguuuga

SEQ ID NO: 70080 - RNA, 1188 nt, Artificial Sequence
  derived and/or modified sequence opt5 from GTF2H2__Homo_sapiens__NP_001506
auggacgaggaacccgagagaaccaagcggugggaaggcggguacgagcgcacaugggaaauccugaaagaggaugagagcggaucccucaaggccacgauugaagacauccuguucaaagcuaagagaaaacggguguuugagcaccauggccagguccgccuugggaugaugagacaccuguauguugugguggauggaucucggaccauggaagaccaagaucucaagccuaaccgccugacaugcacccuuaagcugcucgaguacuucgucgaggaauauuuugaccagaauccgauuagccagaucggcauuaucgugacaaaauccaagagagccgagaaacugaccgaacugucugggaacccccggaagcauaucacaagccucaaaaaggcgguugauaugaccugucacggagagccuucccuguacaauucucuuagcauugcuaugcagacgcugaagcauaugcccggccacaccucccgcgaagugcucaucauuuucagcucucugacaaccugcgacccuuccaacaucuaugaucuuauuaaaacacugaaggccgccaaaaucagagucagcgugauuggccucucugcugagguucggguguguaccguccuggcccgcgagacagggggaacguaccacgugauccuggacgaaucccauuauaaggagcuccugacccaccaugugucucccccuccggcuagcuccagcuccgaaugcucucuuaucagaaugggcuuuccccaacacacaauugccagccuguccgaucaggacgcgaaaccuagcuucucuauggcccaccucgaugggaauaccgagcccggacugacccuuggcggguacuuuuguccucagugccgggcuaaguacugugaacugcccgucgagugcaaaaucuguggacucacacugguuuccgccccgcaucuggcucgcagcuaucaccaucucuucccucuggacgccuuucaggagauuccccuugaagaguacaacggcgaaagauucugcuauggcugucaaggggagcugaaggaccagcacguguacgugugcgcggucugccagaauguguuuuguguugauugcgacguguucguccaugauucucuccacuguugcccuggauguauccacaagauucccgcccccagcggcguguga

SEQ ID NO: 70081 - RNA, 804 nt, Artificial Sequence
  derived and/or modified sequence opt5 from GTF2H3__Homo_sapiens__NP_001258796
auggugcugggcaacagccaccucuucaugaauagauccaacaagcuggccgucaucgcuucucauauucaggagagccgguuucuuuaccccgggaaaaauggacgccugggcgacuucuuuggggauccuggaaacccgcccgaguucaauccuuccggcucuaaggacgggaaauaugaacuccugaccagcgccaacgaaguuaucguggaggaaauuaaggaucuuaugacaaaauccgacaucaagggacaacacacggagacccugcucgcgggcucucuggcuaaggcccugugcuacauucauagaaugaauaaagaggugaaggauaaccaggaaaugaaaagccggauccucgucaucaaggccgcugaggacuccgcccugcaguauaugaauuuuaugaacgugauuuucgcugcccagaaacaaaauauccuuauugaugcguguguucuggacagcgauucuggccuccugcagcaggccugcgacaucacagggggacuuuaccugaaggugccccagaugccuucccuccugcaauaucugcucugggucuuucugcccgaucaggaccagcgcagccagcuuauucugccuccgcccgugcacguugauuacagagcugccuguuucugccaucggaaccucaucgaaauuggcuauguguguucugucugccuguccaucuuuuguaauuucagcccuaucugcaccacaugugagaccgcuuuuaagauuucucuucccccugugcugaaagccaagaaaaagaaacucaagguguccgcguga

SEQ ID NO: 70082 - RNA, 1389 nt, Artificial Sequence
  derived and/or modified sequence opt5 from GTF2H4__Homo_sapiens__NP_001508
auggagagcacccccuccagaggccugaaccgggugcaccuccagugccgcaaucugcaagaguuccuugggggacugucuccuggcguccucgacagacuguacgggcauccggccacaugucuugcuguuuuucgggaacugcccagccucgccaagaacugggugaugcgcaugcuguuccuggaacagccucucccccaggcggcuguggcccugugggucaaaaaggaguuuuccaaagcccaggaagagucuacgggacuucugagcggccucagaaucuggcacacccaacugcuuccugggggacugcagggccucauucugaaucccaucuuccggcagaaccugcgcauugcucuccugggcgggggaaaggccugguccgaugacacaucucagcuuggcccugauaaacaugcuagagacgugccgagccuggauaaguaugccgaggaacggugggagguugugcuccacuuuauggucgggucccccagcgcggccgugucucaagaccuggcucagcuucugucccaggccggacucaugaaaagcaccgaaccuggcgagcccccuugcaucacaucugcuggguuccaguuucugcugcucgauacccccgcccaacugugguacuucaugcuucaguaucugcagacagcgcaaucccgcggaauggaccucguugagauucugagcuuucuuuuccagcugucuuuuuccacccucggcaaggauuacagcguggaaggcauguccgacucucugcugaauuuccuccagcaucugagagaguuugggcuugucuuccagcggaagcgcaaaagcagacgguauuacccgacgcgccuggccaucaaccucuccagcggagugucuggcgcugggggaaccgugcaccaaccuggcuucaucgucguugaaacaaauuauagacuguacgccuacaccgaguccgaacugcagauugcucuuaucgcccucuuuagcgagaugcuguaucgguuccccaacauggugguggcccaggucacaagagagucugugcagcaagcuauugcgagcgggaucaccgcccagcagauuauccacuuucugcgcacgcgggcucauccuguuaugcucaagcagacacccgugcugcccccuaccauuacagaucaaaucagacuuugggaacuggagcgcgaccggcucagauucaccgaaggaguccuguacaaucaguuucugucccagguggauuucgagcuucuccuggcccacgcccgcgaacugggcguucucguguuugagaacucugcuaaacggcugauggucgugaccccggccggccauagcgacgucaagagauucuggaagcgccagaaacacuccagcuga

SEQ ID NO: 70083 - RNA, 216 nt, Artificial Sequence
  derived and/or modified sequence opt5 from GTF2H5__Homo_sapiens__NP_997001
auggugaacguccugaagggcguucucaucgagugcgaccccgccaugaaacaguuccugcuuuaccuggaugaaagcaaugcucucgggaagaaauuuauuauccaagacauugaugacacccacguguucgugaucgccgagcuggucaacgugcuucaggaaagaguuggagagcugauggaucagaaugcguuuucccucacacagaaguga

SEQ ID NO: 70084 - RNA, 825 nt, Artificial Sequence
  derived and/or modified sequence opt5 from GTF2I__Homo_sapiens__NP_001267729
auggcccagguggcuaugagcacccugcccgucgaggacgaagaguccucugaaagcagaaugguugugacauuccucauguccgcccuggagucuaugugcaaggaacuugcgaaaagcaaggcugagguggccuguaucgccgucuacgagacggauguguuuguugugggcaccgaacgggggcgcgcuuucgucaacacaagaaaagacuuucaaaaggauuucgugaaauauugcguugaggaagaggagaaggccgcugaaaugcacaagaugaaauccaccacacaggccaaucggaugucuguggacgcggucgagauugaaacccugcgcaagacaguggaggauuacuuuuguuucugcuauggaaaagcccucggcaagagcaccguggucccuguuccguacgagaaaaugcugagagaccaguccgcuguggugguccaggggcuucccgaaggaguggccuuuaagcauccugagaacuaugaucuggcuacgcucaaguggauccuggaaaauaaagccggcauuagcuucaucauuaagcggcccuuucuggagccuaaaaagcacguugggggacgcgugauggucaccgacgcggauagaucuauccucucccccggcggcagcugugggccuaucaaagugaagacagaaccgaccgaggacucuggaauuucccuggaaauggccgcuguuacagugaaagaggagagcgaagaucccgacuacuaucaauacaacauccagggcucucaucacuccagcgaggggaaugaaggaaccgagauggaagucccugccgagggcuga

SEQ ID NO: 70085 - RNA, 2931 nt, Artificial Sequence
  derived and/or modified sequence opt5 from GTF2IRD1__Homo_sapiens__NP_001186136
auggcccugcucggcaagagaugcgacgugcccaccaacggguguggaccugaucgguggaauagcgcuuucacacgcaaagacgagaucauuacgucccuggucucugcccuugauagcaugugcuccgcgcugucuaagcucaacgcugaaguugccuguguggccgugcacgacgagagcgcuuuugucgugggcaccgaaaaagggagaauguuccugaaugcccggaaggagcuucaguccgauuuucugcgcuucugccucucugcugcccaacauagagcggccacaagccagcuggaaggacggguugugcgcagaguccugaccguggcuucccgggcccucuguccgacaggcgggcccccuuggaaagaccccgaggcugagcacccuaagaagguucagcgcggagaaggcggcgggagaagccugccccggucuucccuugagcauggaagcgauguguaccugcuccgcaaaauggucgaagagguguuugacgugcuguauucugaggcccuuggcagagcguccgucguuccucugccguacgaacggcuccugcgcgagcccgggcugcucgccgugcagggacugccugaaggccuugcuuucagacggcccgccgaguaugauccuaaggcucugauggccauccucgaacacagccaucgcauuagauuuaaacugaagcggccccuugaggacgggggaagagauucuaaagcccugguggagcucaacggcgucucccugaucccgaagggcagccgcgacugcgggcugcacggacaagcuccuaaggugcccccucaggaucucccucccaccgcgacauccucuagcauggccuccuuccuguacagcaccgcccuucccaaucacgcuauucgggaacugaaacaggaggccccgucuuguccccucgcuccuuccgaccugggccuuagcagacccaugccugaacccaaggccacgggggcgcaggacuuuucugauugcuguggacaaaaaccgaccggcccugggggaccccugauccagaacguucaugcuagcaagcgcauccucuucuccauugugcacgacaaaucugagaagugggaugccuuuaucaaagaaacagaggacauuaauacccugcgggagugcguccagauccuguucaacagcagauaugccgaagcucucggccuggaucauauggugccuguucccuaccgcaagauugccugugacccugaggcuguggaaaucgucggcauucccgauaagaucccguuuaaacggccuugcacauauggggugcccaagcucaaaagaauccuggaggaacgccacuccauucacuucaucauuaagcggauguucgacgagagaaucuuuaccggaaauaaauucacgaaggauacaaccaagcucgagcccgccagcccuccggaagacacaucugcggaggucucccgggccaccgugcuggaucuggcuggcaacgcccgcagcgacaaagggucuauguccgaagacugcggacccggcaccagcggggagcuuggcggacucagaccuauuaagaucgagcccgaagaucuggacaucauucagguuacagugccugaucccuccccuacgucugaggaaaugaccgacagcaugcccggccaucugccguccgaggauucuggguacggaauggaaaugcucacagacaaaggccugagcgaggaugcucggccugaggaaagacccgucgaggacucccacggggaugugauccgcccucuucggaagcaaguugaacugcucuuuaauaccagauacgccaaagcgauuggaaucagcgagcccgugaaggucccguauucuaaguuccugaugcauccugaggaacuguuuguggugggccuucccgaggggauuucccuccgcagaccuaacuguuucggcaucgccaaacugcggaagauccuggaagcuagcaauucuauucaguuuguuaucaaacgccccgagcuccugacagaaggagucaaggagcccauuauggacucccaggaaagagauagcggcgacccucuuguggaugagucucugaaacggcaaggguuccaggagaacuacgacgcccgccucagcagaaucgacauugcuaauacccugcgggaacaggugcaggaucuguuuaacaagaaguauggagaggcccuuggcaucaaauacccgguccaagugcccuauaagcgcauuaaauccaacccugggagcguuaucaucgaaggacuucccccuggcauucccuucagaaagccuugcacguuugggucucagaaucuggagcggauccuggccguggcugacaaaauuaaguucacagucacccgcccguuucagggccucauccccaaaccugaugaggacgaugcgaacagacugggagaaaaggugauucuucgggagcagguuaaggaacuguucaaugagaaauacggcgaagcccucgggcugaacagacccgugcuggucccuuauaaacuuauccgcgacucccccgaugcuguggagguuaccggacucccggacgauaucccuuuccggaaucccaacacauacgacauucacagacuggagaagauccugaaggcccgcgaacaugugcggauggucauuaucaaucaacuccagcccuuugccgagauuuguaacgaugcuaaagugccugccaaggacagcuccauccccaagagaaaacgcaagcgggugucugaaggcaauagcgucuccucuagcuccucuagcuccucuagcuccagcucuaacccugauuccguugcgagcgcuaaucagaucucucuggugcaguggccgauguacaugguggacuaugccgggcuuaacguccaacugcccggaccucucaauuacuga

SEQ ID NO: 70086 - RNA, 2850 nt, Artificial Sequence
  derived and/or modified sequence opt5 from GTF2IRD2__Homo_sapiens__NP_775808
auggcccagguggcugucagcacccugcccguugaggaagaguccucuagcgaaacaagaaugguggugacguuccucgucuccgcccuggagucuaugugcaaggaacuugcgaaaagcaaggcugagguggccuguaucgccguuuacgagaccgacguguuugucgugggcacagaacgggggugcgcuuucguuaacgcccgcaccgauuuucaaaaagacuucgcuaaguauuguguggccgagggacugugcgaagucaaaccuccgugucccgugaauggcaugcaagugcacuccggggagacagagauucucagaaaggcggucgaagauuacuuuugcuucuguuauggaaaggcccugggcaccacaguuauggugccugugcccuacgagaaaaugcuucgggaccagucugcugucgugguucaggggcugccugaaggaguggccuuucagcaucccgagaacuaugaucucgcuacccugaaguggauccuggaaaauaaagccggcauuagcuucaucauuaaccgcccuuuucucggcccggagucccagcugggcggacccggcauggucacggacgcggagagaagcaucgugucuccuuccgaaagcugcgggcccaucaauguuaagaccgagccuauggaagauucuggaauuucccuuaaagccgaggcugugagcgucaagaaggaaucugaggaccccaacuacuaucaguacaauaugcagggcucccacccgagcuccacaucuaacgaggugaucgaaauggagcugccuauggaagauagcacaccccucgucccuuccgaggaacccaaugaggaccccgaggccgaagugaaaauugaggggaacaccaauucuagcuccguuaccaacagcgcugccggaguggaagaucugaauaucguccaagugacgguuccugacaacgagaaggagcggcuuucuagcauugagaaaaucaagcagcugcgcgaacaggugaaugaucucuucuccagaaaauuuggcgaagccauuggcgucgacuucccggugaaggugcccuaccggaaaaucacauuuaacccuggguguguugucaucgacggaaugcccccuggcgugguguucaaggcucccggguaucuggagauuucuagcaugcgcagaauccuggaagcggccgaguucauuaaguuuaccgucauccggccgcucccuggacuggagcuuuccaacgugggcaaacgcaagauugaucaggaagggagaguuuuccaagagaaaugggaacgggcuuacuuuuucguggagguccagaauauccccacaugccugaucuguaagcagagcaugucuguguccaaagaauauaaccuccgcagacauuaccaaaccaaucacagcaagcauuaugaccaguacauggagcggaugagagaugagaagcugcacgaacuuaaaaagggacugcgcaaauaucuccuggggucuuccgacaccgagugcccugaacagaagcagguuuuugccaaccccagcccuacacaaaaaucccccgugcagccggucgaggaucuggccggcaaucucugggaaaagcugcgggagaagauuagaucuuucguggcuuacagcaucgccauugacgagaucacggauauuaacaauaccacacagcuugcgaucuuuauccgcgggguugacgaaaacuucgauguguccgaggaacugcucgacaccgucccuaugacaggaaccaaaucuggcaaugagauuuuuagccggguggagaagucccugaaaaaguucugcaucgauuggagcaaacuugugucugucgcuuccacggggacacccgccaugguugacgccaacaauggacuggugaccaagcucaagagcagaguggcuaccuuuuguaaaggcgccgaacugaagucuauuugcuguaucauucaccccgagucccugugcgcucagaaacucaagauggaccaugucauggaugugguugugaaaagcgucaacuggaucuguucucgcgggcugaaucacagcgaguucacaacccuucuguacgaacucgacucccaauauggcagccugcuguacuauacagaaauuaaguggcuuucucggggacucgugcugaaaagauuuuucgagucccuggaggaaaucgauagcuucauguccucucgcggcaagccucucccgcagcugagcuccaucgacuggauucgggaucuugccuuucugguugacaugacgaugcaucucaacgcgcugaauaucucucugcaggggcacagccagauugugacccaaauguacgaucuuaucagagccuuccucgcuaagcugugccugugggagacacaccucacccgcaacaaccuggcccauuuucccacacuuaaacuggcuucccggaaugaaucugacggacucaacuauauuccuaagaucgccgagcugaaaaccgaguuccagaagagacugagcgauuuuaaacuuuacgaauccgagcucacgcuguucagcucucccuuuuccaccaagaucgacagcguccacgaggaacugcagauggaagugauugaucuccaguguaauacaguucugaagaccaaauaugacaaggugggcaucccugaguucuacaaauaccuuugggggucuuaucccaaguacaaacaucacugcgcgaagauucuguccauguuuggaagcacauauaucugugaacaacucuucucuauuaugaagcuguccaaaaccaaguacugcagccagcugaaagauucccagugggacagcguccuucauaucgccacguga

SEQ ID NO: 70087 - RNA, 1098 nt, Artificial Sequence
  derived and/or modified sequence opt5 from GTF3A__Homo_sapiens__NP_002088
auggaucccccugccguggucgcugagagcguuuccucucugaccaucgccgacgcguucauugcugccggcgaaagcuccgccccgacacccccuagacccgcucucccucggcgcuuuaucugcucuuuccccgacuguagcgccaacuacuccaaggcuuggaaacuggaugcccaccuuugcaagcauacgggggagagaccuuuugugugugacuaugaaggaugcggcaaagcguucauucgggauuaccaccugucucgccauauccucacccacacaggggagaagccguuugugugugccgcuaauggaugcgaccagaaauucaacaccaagagcaaucugaagaaacauuuugaaagaaagcacgagaaccaacagaaacaguauauuuguuccuucgaggauugcaagaaaacauuuaagaagcaccagcaacuuaaaauccaucagugucagcacaccaaugaaccccuguucaagugcacacaggagggcugugggaaacauuuugccagcccuucuaagcucaaacggcacgcuaaggcccacgaaggauacgucugccaaaaaggcugcuccuucguggcgaagaccuggacggagcugcugaagcauguucgcgagacccacaaagaagagauccucugugaagugugcagaaagacauuuaaacggaaggacuaucugaaacagcauaugaagacccacgcccccgagcgcgaugucuguagaugcccucgggaaggcugugggcgcacauacaccacgguguucaaccuucagagccauauucugucuuuccacgaggaguccagacccuuuguuugcgaacacgcuggauguggcaagacauucgccaugaaacagagccucacccggcaugcugugguccacgacccggauaagaaaaagaugaaacugaaggugaagaaaucucgcgagaagagaucccuugccagccaucuguccggguauaucccucccaaacggaagcaaggacagggccucucucugugccagaauggggaaagcccuaacuguguggaggacaaaaugcuguccacagucgccguucucacccugggauga

SEQ ID NO: 70088 - RNA, 6330 nt, Artificial Sequence
  derived and/or modified sequence opt5 from GTF3C1__Homo_sapiens__NP_001511
auggacgcccuggagagccuccuggaugaaguggcucuugagggccuggacgggcucugccugcccgcccuuugguccagacuggaaacccgggucccuccguucccccucccucuggagcccuguacacaggaauuucuguggcgcgcgcucgcuacgcacccuggaaucucuuucuacgaggagcccagagaacggccugaucugcaacuucaggaccgcuaugaggaaauugaucuggagaccggcauccucgagagcagacgggacccgguugcccuggaagauguguaccccauucauaugauccuugagaacaaggacgggauucagggauccugccgcuauuuuaaagaaagaaagaauaucacaaacgauauccggaccaaaucucugcagccucgcuguacaaugguggaggccuucgacagauggggcaagaaacucauuaucgucgcuagccaagccaugcgguaccgcgcucugauugggcaggaaggagaucccgaccugaagcucccugauuuuuccuauugcauccuggagagacuuggccggucucgcuggcagggcgagcugcagagagaccuccacaccacagccuucaagguggacgcggggaaacugcauuaccaccggaagauucuuaauaaaaacggacugaucaccaugcaaagccauguuauuagacuccccacgggcgcccagcagcacuccauccugcugcuccugaaucgcuuucacguggaucggagaagcaaguaugacauccuuauggaaaaacugucugucaugcucuccacccgcacaaaccauauugagacccuggggaagcuucgggaagagcugggacucugugaaagaacauucaagcgccuguaccaguacaugcugaaugcuggccucgccaaagugguuagccugcggcuucaagagauccacccggagugcgggccuuguaagaccaaaaagggaacggaugugauggucagaugccugaaacuccugaaggaauuuaaacgcaacgaccaugaugacgaugaggacgaagaggugauuucuaagacagugcccccugucgauaucguuuucgaacgggacaugcugacccagacauaugaucuuauugagagacgcggcaccaagggcaucucccaggcugagauccggguggccaugaauguggggaaacucgaagcgagaaugcugugucggcugcuccaacgcuuuaaggucgugaaaggauucauggaggacgaaggcagacagcggaccacaaaguacauuagcugcguuuuugccgaggagucugaccuguccagacaguaucagcgcgaaaaagcucggagcgagcuucugacgaccgugucccucgccucuaugcaagaagagagccugcugcccgaaggggaggauacauuccuuuccgagagcgacucugaagaggaaagauccagcucuaagcgcagaggacggggcagccagaaggauacccgcgcuuccgccaaccucagacccaaaacacagccucaccacucuaccccgacgaaggggggauggaaagucgugaaucugcauccccugaagaaacagccucccagcuucccuggcgccgcugaggaacgggcgugucaaucccucgccagccgcgacucucugcuugauacauccagcguuucugagcccaacguguccuuugucagccacugcgcugacuccaauucuggcgauaucgccgugauugaggaagucagaauggagaacccgaaggaaagcuccucuagccugaagaccgggcggcauuccagcggacaggacaaaccucacgagaccuaccgccuccugaagagacggaaucugaucauugaagccgugacaaaccuucgccucaucgagucucuguucaccauccagaaaaugauuauggaucaggagaagcaagaaggcguuuccacaaaaugcuguaagaagagcaucgugagacugguccggaaccucucugaggaagggcugcuuagacuguaucgcacgaccgugauucaggacggaaucaaaaagaaaguugaucucgugguccaucccuccauggaccagaaugauccucuggugcggagcgcuauugagcaggugagauuucgcaucucuaacagcuccacagccaaucggguuaagaccagccaacccccugucccccagggcgaggcggaagaggacucucaggggaaagaaggcccguccggaagcggcgacucccaacugucugcuagcuccagaucugagagcgggcgcaugaagaaauccgauaacaagaugggaauuacaccucuucggaauuaccaccccaucguggugcccggccucgggagaucucugggauuccugccuaagaugccgcgccuccgggucgugcacauguuucugugguaucuuaucuacggccaucccgccagcaacaccguugaaaaaccuuccuucauuagcgagagacggacgaucaagcaggagucugggcgcgccggcgugagacccuccagcucuggauccgcuugggaagccugcagcgaggcuccuucuaaaggcucccaggacggggucaccugggaagccgagguggaacuggcgacagagaccguuuacguggaugacgccagcuggaugcgguauauucccccuauccccguccaccgcgauuuuggauucggcugggcucucguguccgacauucugcugugucuuccgcugagcaucuuuauccagauuguucaagugucuuacaaggucgauaaucucgaggaauuccugaacgacccucucaaaaagcauacacugaucagauuucuuccccggccuauuagacagcagcugcucuauaagcgccgguacaucuucagcgugguggagaaucugcagagacugugcuauauggggcuucugcaauuuggacccaccgaaaaauuccaggauaaggaccaggucuucauuuuucucaaaaagaacgccguuaucguggauacgacaaucugugacccgcacuacaaucuggcucgcuccucucggccuuucgagagacgccucuaugugcugaacagcaugcaggaugucgaaaauuacugguuugaccuucaaugcgugugucugaacaccccccucggcguugugcggugcccuagaguccgcaaaaauuccucuacagaccaggggagcgaugaggagggcucccugcagaaggaacaagagucugccauggacaagcacaaccuggaaagaaaaugugcgaugcuugaguacaccaccggaagccgggaggugguugaugaaggccugauucccggggacggacucggcgccgcugggcuggauuccagcuucuauggacaucucaagcgcaacuggaucuggacaucuuacauuaucaaucaggccaaaaaggagaacacggcugccgaaaauggccugaccgugagacuucagacauuucuguccaaacggcccaugccucugagcgcccgcgggaacucuagacucaauauuuggggcgaggcucgggucggauccgaacugugcgcgggcugggaggagcaguucgaaguggacagagagccgagccuugaucgcaaccggagaguucgcgggggaaagucccaaaagcggaaaagacugaagaaagaccccggcaagaaaaucaagcggaaaaagaagggggaauuuccuggagagaaaucuaagcgccucagauaucacgaugaagccgaccagagcgcucugcagcggaugacccgccucagagugacaugguccaugcaggaggauggccugcuuguccugugucggaucgccagcaaugugcugaacaccaaagugaagggccccuucgucacguggcaaguugugcgcgacauucuccaugccacauuugaggaaucucuggacaaaaccucccacagcguggggagacgggcucgcuacaucgucaagaauccucaggccuaucuuaacuacaaggugugccuggcggagguuuaucaggauaaagcucucgugggagacuucaugaauagacggggcgauuacgacgaucccaaggucugcgccaacgaauuuaaagaguucguggaaaagcugaaagagaaguuuucuagcgcccucagaaauuccaaccuggagauuccugacacccuucaggaacuguucgcucgcuaccggguucuggccaucggggaugagaaggaccaaacaagaaaagaagaugagcucaauucuguggacgauauucauuuccugguccuucagaaccugauccagagcacccucgcgcuguccgacucucagaugaagagcuaucaauccuuucagacauuccgccucuaccgggaguauaaagaucacgugcuggucaaggcuuuuauggaaugucagaaaagaagccuugugaaccgccggagaguuaaucacacgcugggaccgaagaagaaccgcgcccugcccuucgugccuaugucuuaccaacucucccagaccuauuaccggauuuuuacauggagauuccccagcaccaucugcacagaguccuuucaguuccuggaccgcaugcgggccgcuggcaaacuugaccagccugauagauuuucuuucaaggaccaagauaauaacgaacccaccaaugacauggucgccuuuagccuggaugggccgggaggcaacuguguggcuguucucacgcuguucucccugggccucaucucuguggacguccgcauuccugagcagaucauugugguggauagcuccaugguugaaaaugaggucaucaaaagccuugggaaggacggaucucuggaggaugacgaagaugaggaagacgaucuggacgagggcguggggggaaaaagacgguccauggaagugaagcccgcccaggcgagccauaccaacuaucuccugaugcgcggcuacuacucucccgggauugucuccacaagaaaucuuaacccuaaugacagcaucgugguuaacucuugccagaugaaguuccaacugcgguguacccccgugccugccagacuccggccggcugccgcuccccuggaggagcugacaaugggaaccagcugccucccugauacauuuaccaaacuuaucaauccccaggaaaacacguguucccuggaggaauucguccugcagcucgagcugucuggcuauagcccugaagaccuuacagccgcccuggagauucucgaggcuaucauugcgaccggcugcuuugggaucgauaaggaagagcugcgcagacgguucuccgcccuggaaaaagcuggaggcgggcgcaccagaacauuugccgacuguauucaggcccuccuugagcaacaccaggugcuggagguuggaggcaauaccgcucggcugguggccauggggagcgcguggcccuggcuccugcauuccguccgccuuaaggauagagaagacgcugauauccagcgggaggacccgcaagcccgcccucuggaaggaucuagcuccgaggauucucccccugaaggccaggcccccccuagccacucccccagaggcacgaaacggcgcgcuucuugggccagcgagaacggggagacagacgcggaaggaacccagaugacaccggcuaagagaccugcccuccaggauuccaaccuggcccccagccugggccccggggcugaggacggagccgaagcucaagccccuucuccgcccccugcgcucgaggacaccgccgcugccggcgcugcccaggaagaucaggagggggugggagaguucuccagccccggccaggaacaacuuucuggccaggcccagccucccgagggguccgaagacccucggggauuuacagagagcuucggcgcugcgaauaucucucaggccgcucgcgaaagagauugcgaguccguuuguuuuauugggcggccguggagaguggucgacggacaucugaaccugcccgugugcaaaggcaugauggaggccaugcucuaccacaucaugacccgcccugggauucccgaaagcucccugcuucggcacuaucaaggagugcugcagccugucgccguucucgagcugcugcagggccucgaaagccuuggcugcaucagaaagcgcuggcugcggaagcccagaccggugucucuguucagcacgccuguggucgaggagguggaaguucccuccucucucgaugagagccccauggcuuuuuacgaaccuacccuggacuguacacuucgccuggggcggguguucccccaugaggucaauuggaacaaauggauucaccucuga

SEQ ID NO: 70089 - RNA, 2010 nt, Artificial Sequence
  derived and/or modified sequence opt5 from GTPBP1__Homo_sapiens__NP_004277
auggccaccgagagaagccgguccgcuauggacucucccgugccugccagcauguucgcgccggaacccuccucuccuggcgcugcccgcgccgcugccgcugccgcgagacugcacgggggauuugauagcgacugcuccgaggauggcgaagcccucaacggggagcccgaacuggaccuuacaucuaagcugguccucguuagcccuacguccgagcaguacgauagccugcuucggcaaaugugggagcgcauggacgaaggauguggcgagaccaucuaugugauugggcagggaucugauggcacagaauacggccuguccgaggcugacauggaggccagcuaugcuaccgugaaaucuauggccgaacagaucgaggcggaugucauucuccugagagaacggcaggaggccgggggacgcgugagagacuaccugguucggaagcgcgugggcgauaaugacuuccucgaagucagaguggcuguuguggggaacgucgaugccggaaaauccacacugcuuggcgugcugacccauggggagcucgacaauggacggggcuuugcucgccaaaagcuguucagacacaaacaugagaucgaaagcggccggacaucuuccguggggaacgacauucuuggauuugauagcgagggcaaugucguuaacaagcccgacucccacgggggaucucuggaauggaccaagaucugcgagaaaagcacgaaggugaucaccuucauugaucucgccggccaugaaaaauaucugaagacaaccguguuugggaugacaggacaucugccugacuucuguaugcucauggucggcuccaaugccggcaucguggggaugaccaaagagcaccugggacuugcucuggcgcucaacguuccgguguuugucgugguuacgaagauugauaugugccccgccaauauccugcaggagacacuuaagcugcuccagcgccugcugaaaagcccuggcuguagaaagauucccgugcucguccagucuaaagacgaugugaucgucaccgcuuccaacuucagcucugaacggaugugcccuauuuuucaaaucagcaaugugacaggggagaaccuggaccuucugaagauguuccucaaucugcuuucccccagaaccucuuaccgcgaagaggaaccggccgaguuucagaucgaugacaccuauagcguuccuggagugggcacagucguguccgggacgacccugcggggccucauuaaacugaacgauacacugcuccugggacccgacccucuuggcaauuuccugagcaucgccguuaagucuauucacagaaaacgcaugcccgugaaggaggucagagggggacagaccgcuuccuucgcccucaagaaaaucaagcggagcucuauucgcaaaggcauggugauggugagcccccggcugaacccucaggcgagcugggaauuugaggcugaaauccugguucuucaccauccgacaaccaucucccccagauaccaagccaugguccacugugggucuauucgccagacggccacaauccucagcauggacaaggauugccugcggaccggagacaaagcuaccgugcacuucagauuuauuaagacaccugaguaccugcauaucgaucagcgccucguguuccgggagggcagaaccaaggccgucgggacaauuacgaaacugcuucaaaccacaaacaauucccccaugaacucuaagccucagcagaucaaaaugcagagcaccaagaaaggcccccugacaaagcgggacgaaggaggcccguccgggggaccugcugugggcgcgcccccucccggggaugaggccagcucuguuggagccggccaaccugcugccuccagcaaucuccagccccagccgaagccuucuuccgggggccgcagacggggaggccagagacacaaagugaagucccaaggggcuugugucacccccgccucuggaugcuga

SEQ ID NO: 70090 - RNA, 1416 nt, Artificial Sequence
  derived and/or modified sequence opt5 from GTPBP3__Homo_sapiens__NP_001122327
auguggagaggccuguggacccucgccgcucaggccgcgcgggggccccgcagacugugcacacggcgcagcuccggagcuccugccccgggcucuggggccacgaucuucgcucuuagcuccggacaaggcagaugugggauugccgugauccggaccucuggacccgcuagcggccacgcccugcgcauucucacagcgccuagagaccugccccuugcccggcaugcuucccugcgccuccugucugauccuagaagcggcgagccccuggaccgggcccucguccugugguuuccugggccgcaguccuucaccggagaagauugcguugaguuucacgugcauggcgggcccgcuguggucagcggagugcuucaggcccugggcucuguuccugggcuccgccccgcggaagccggagaguucacaagacgggcuuuugccaacggcaagcugaaucuuaccgaaguggagggccuggcugaccucauccacgccgagacagaagcccagcgcagacaagcucugcggcagcuggauggggagcucggacaucuguguagaggcugggcggaaacccuuacgaaagcccuggcucacgucgaggccuacauugacuucggggaggaugacaaccucgaagagggagugcuggaacaggccgauaucgagguucgcgcccuucagguggcucugggcgcgcaccuccgggacgcuagacgcgggcaacggcugagauccggaguccaugugguggucaccggcccucccaaugccggcaagagcucucugguuaaccuccugucccgcaaaccggugagcaucgugucuccugaacccgggacaacccgggauguccuugagacaccuguggaccuggccggauuucccguucuccuguccgauaccgcuggccuuagagagggggugggacccgucgaacaggagggcgugcgccgggccagagaaagcugcaauuuccuggcuacgguuguggccuccgucggggcgcagucuccuagcgacuccagccagcgccuccugcuggugcucaacaagucugaccugcuuuccccggagggccccggaccuggccccgaucugccuccccaccuccugcugagcugucuuacaggggaaggacucgacggccugcuggaggcccuccggaaagagcuggcugccgucugcggggauccgucuaccgacccuccccuucugacaagagcucggcaucaacaccaccuccagggaugucuggaugcccugggccauuauaagcagagcaaggaccuugcgcucgccgcugaagcccugcgcguggcuagagggcaccugacccggcucaccggcggaggcgggacagaggaaauucuggauaucauuuuucaagacuucugcguuggaaaauga

SEQ ID NO: 70091 - RNA, 1905 nt, Artificial Sequence
  derived and/or modified sequence opt5 from GTPBP4__Homo_sapiens__NP_036473
auggcccacuacaacuucaagaaaaucaccgugguccccagcgcuaaggacuuuauugaucugacacucuccaaaacgcagagaaagaccccuacaguuauccacaaacacuaucaaauucaucggauccgccacuucuacaugagaaaggugaaguuuacccagcagaauuaucaugaccggcugucucagauucuuacagauuucccgaaacuggacgauauccaccccuuuuacgccgaccucaugaacauccuguaugauaaggaccacuacaaacuugcgcugggccaaauuaauaucgcuaagaaccucguggauaaugucgccaaagacuaugugcgccugaugaaguacggggauagccuguacagaugcaagcagcucaaacgggccgcucugggacgcauguguaccguuauuaagagacagaaacagucccuugaguaucuggaacaagugcggcagcaucucucucgccugccuacaaucgaccccaacaccagaacgcuucugcucugcggcuacccuaaugucgggaaaagcuccuucauuaacaaagugacccgggccgauguugacgugcagcccuaugcuuuuacaaccaagucucuguucgucggacacauggacuacaaauaucugcgcuggcaagugguggauacaccuggcauccucgaccauccgcuggaggauagaaauaccauugaaaugcaggccaucacggcgcuugcccaucugcgggcugccguccucuacguuauggaccugagcgagcagugugggcacggacuucgcgaacagcuggagcucuuucaaaacaucagaccccuguucauuaauaagccucugaucgugguggcuaacaagugcgaugucaaacggauugccgagcucuccgaagacgaucagaagaucuuuacagaccugcagagcgagggcuuccccgugauugaaaccucuacacuuaccgaggagggcguuaucaaagugaagaccgaagcgugugauagacugcucgcccaccgcgucgagacaaaaaugaaggggaauaaggugaacgaaguucugaaucggcuucaccuggcuaucccuacgagacgcgacgauaaagagcggcccccguuuauuccugaaggaguggucgccagacgcaagcggauggagaccgaggaauccagaaagaagcgcgagcgggaccucgaacuggagaugggcgacgauuauauccuggaccuccagaaauacugggaucugaugaaccuuagcgaaaagcaugacaagauucccgagaucugggaggggcacaacauugcugauuacaucgacccugccaucaugaaaaagcuggaagaacucgaaaaagaggaagaacugagaacagccgcuggagaguaugauucuguguccgaaagcgaggacgaagagaugcuggagauucgccaacuugcgaagcagauccgggagaaaaagaagcucaaaauucuggagucuaaggagaaaaauacccagggccccagaaugccccggacagccaagaaaguccagcgcaccgugcuggagaaggaaaugagaucccucgggguugauauggacgauaaagacgaugcucauuacgccgugcaagcccggagaagccgcuccaucacgcggaagagaaagcgcgaggacucugcuccuccgagcuccgucgccagaagcggaucuugcucccggacaccccgcgacgugagcggccugagagauguuaaaauggugaagaaagcgaagaccaugaugaaaaacgcucagaagaagaugaaucggcuuggcaaaaagggggaggccgaccgccacgucuucgauaugaaaccuaagcaucugcucucuggaaaaagaaaggccggcaagaaagaccggcgcuga

SEQ ID NO: 70092 - RNA, 504 nt, Artificial Sequence
  derived and/or modified sequence opt5 from GTSF1__Homo_sapiens__NP_653195
auggaggaaaccuacacagacagccuggaucccgagaagcuccugcagugcccuuaugacaaaaaccaccaaaucagagccugucgguucccguaccaucuuauuaagugccgcaaaaaucaccccgauguggcuuccaagcuggccacguguccuuuuaacgcgagacaucaggucccccgggcugaaaucucucaccauauuagcuccugcgacgaucgcucuuguaucgagcaggacguugugaaucagaccagaagccuccggcaagaaacacuggccgaguccaccuggcagugcccucccugugaugaggacugggauaaagaccuuugggaacagacaucuaccccuuucguguggggcacaacccacuauagcgauaacaauuccccggccagcaacauugucacggagcacaagaauaaccuggcuucugggaugcgcgugcccaagucccucccuuacguucugcccuggaaaaauaacggaaaugcccaguga

SEQ ID NO: 70093 - RNA, 606 nt, Artificial Sequence
  derived and/or modified sequence opt5 from GUCA1A__Homo_sapiens__NP_000400
augggcaacgugauggagggaaagagcgucgaggaacuguccucuaccgaaugccaccagugguacaaaaaguucaugacagagugucccagcgggcaacucacgcuguaugaauuuagacaguucuuuggccuuaaaaaucuguccccuucugccagccaguacguugagcagauguucgagaccuuugacuucaacaaggauggguauaucgacuuuauggaauacguggcugcccucucccuggugcuuaaaggaaaggucgagcaaaagcugcggugguauuucaaacucuacgauguggacggcaaugggugcauugaucgcgacgaacugcugacaaucauucaggcgaucagagcuauuaacccguguucugauaccacaaugaccgccgaggaguuuacagacaccguuuucagcaagaucgaugugaauggagacggcgaacucucccuggaggaauuuaucgagggcguccagaaagaucagaugcuucuggacacgcucacccggagccuggaucuuacacgcauugugagacggcugcaaaacggggaacaggacgaggagggagccgacgaagcugccgaggcugccggcuga

SEQ ID NO: 70094 - RNA, 603 nt, Artificial Sequence
  derived and/or modified sequence opt5 from GUCA1B__Homo_sapiens__NP_002089
augggccaggaguucagcugggaagaggccgaagcugccggggagaucgacguggcggaacugcaagagugguacaagaaauuugucauggagugccccuccggaacccucuucaugcacgaauuuaagagauucuuuaaaguuacagaugacgaggaagcuagccaguauguggagggcauguuccgggccuuugauaagaacggggacaauacgauugauuuccuggaguacguggccgcucuuaaccugguccuccgcggaacccuggaacauaaacuuaaguggacauuuaagaucuaugacaaagauggcaauggguguauugacagacuggagcuccugaacaucguggaaggaauuuaccagcugaagaaagccugccggcgcgagcuccagaccgaacaaggccagcugcuuacaccugaggagguuguggauagaaucuuccugcucgucgacgaaaauggcgaugggcagcugagccuuaacgaguuuguggaaggagcucggcgcgacaaguggguuaugaaaaugcugcagauggauaugaauccguccucuuggcucgcccaacagagacggaagucugcgauguucuga

SEQ ID NO: 70095 - RNA, 720 nt, Artificial Sequence
  derived and/or modified sequence opt5 from GUCD1__Homo_sapiens__NP_001271183
augagaaccgaggccgaagcugccgggcccccucuggagccgggcgacuucgugcagcuccccgucccuguuauccaacagcuguaccacugggauugcggacuugcguguagccggauggugcugcgcuaucucggccagcuggacgauuccgaauuugagagagcccuucagaagcugcaacucacacggucuauuuggacgaucgaccuggcuuaccugaugcaucacuucggggugcgccauagauuuugcacccagacacucggagucgauaaaggcuauaagaaccagagcuucuaccggaaacacuuugacaccgaagagacacgcgugaaucagcuguucgcccaagcuaaggccuguaaaguucuuguggagaagugcaccgucuccgugaaggauauucaggcucaucuggcccaggggcacguugcgaucgugcucgucaacucuggagugcugcacugugaccuuugcagcucccccgugaaauauuguugcuuuacaccuucuggccaucacuguuucugcagaacccccgauuaccagggccauuuuauuguccugcggggguauaaucgcgccacgggauguaucuucuacaacaauccugcuuacgccgacagaaugugcagcaccuccaucagcaacuuugaagaggcucggacaucuuauggcaccgaugaagacauucucuucguuuaccuggauuccuga

SEQ ID NO: 70096 - RNA, 2199 nt, Artificial Sequence
  derived and/or modified sequence opt5 from GUCY1A2__Homo_sapiens__NP_000846
augagcagacggaagaucuccucugagagcuucuccucucugggcagcgacuaccucgaaaccucccccgaggaagagggggaaugcccucugucucgccuuuguuggaacggaagcagauccccgcccggcccucuggagcccagcccugccgcugccgcggcugccgccgcucccgccccuacaccggcugccucugcggccgcugccgcugccacggcgggggcccggcgcgugcagagacggcgcagagucaaucucgauucccugggagagagcauuucucggcuuaccgcucccuccccucaaacaauccagcagacccugaaacgcacacuccaguauuacgaacaccaaguuauuggcuauagagacgccgagaagaacuuucauaauaucagcaaccggugcucuuacgcugaucacuccaauaaagaagagauugaggacgugagcgggauccugcaguguaccgccaacauccugggacucaaguucgaagagauucagaaacgcuuuggcgaagaguucuuuaauaucugcuuccaugaaaacgagagagugcugcgggccgucggcgggacacuucaggacuuuuucaauggauuugaugcucugcucgagcacauucgcaccuccuucggcaagcaagcgacgcuggaaucucccagcuuucuuuguaaggagcugccugaagggacccucaugcugcauuauuuccacccccaccauaucgugggauuugccaugcugggcaugauuaaagcugccgggaagaaaaucuacagacucgauguugagguggaacaggucgccaacgagaagcugugcuccgacgugagcaauccgggaaacuguucuugccuuacauuccugauuaaagagugugaaaauaccaacaucaugaagaaucucccucagggcacaucccagguucccgcugaucugcggaucagcauuaacaccuucugcagagccuuuccuuuccaccuuauguuugaccccucuaugagcgugcugcaacucggcgaggggcugcgcaagcagcugcggugugauacgcauaaaguccucaaguucgaagacugcuuugagaucgugucccccaaagugaacgcgacauucgaaagaguccugcuucgccugucuaccccuuuuguuauucggacaaagccggaggcuagcggauccgagaauaaagauaaggugauggaagugaaaggccagaugauccacguccccgagagcaacucuauucucuuccugggguccccuugcguggacaaacuugacgaacugaugggaagaggccuccaccugagcgauauccccauccaugacgccacccgcgauguuauucuggugggggagcaagccaaggcucaggacggacucaaaaagcggauggauaaacugaaggccacccuugagagaacacaccaggcucuggaagaggaaaagaagaagacggucgaccuccuguauucuaucuuuccuggcgauguggcccagcaacuguggcagggccagcagguucaagcgcgcaaauucgacgaugugaccaugcucuuuuccgacauugucggguucacagccaucugugcucagugcacccccaugcaagugauuagcaugcuuaaugagcuguacacacgguuugaucaucaguguggauuccuggacaucuacaaggucgaaaccaucggcgacgccuauugcguggcugccgggcuccacagaaaaucccugugucaugcgaagccgauugcccuuauggcucugaaaaugauggagcucucugaggaaguucugacgccugauggacgccccauccagaugcggauuggcauccacagcggguccgugcuggccggcgucgugggaguuagaaugccucgguacugccuuuucggcaacaaugugacacucgcuucuaaguuugagagcgggucccacccccgcagaauuaacgucagcccuaccaccuaucagcugcugaagcgggaagagucuuucacauuuauccccagaucccgcgaggaacucccggacaauuucccuaaagagauucccggaaucuguuacuuucuggaagugcggaccggccccaagccuccgaaacccagccuuucuuccagcagaaucaagaaagugucuuauaacauugggacaauguuccugcgcgagacgagccucuga

SEQ ID NO: 70097 - RNA, 1368 nt, Artificial Sequence
  derived and/or modified sequence opt5 from GUCY1A3__Homo_sapiens__NP_001124157
augcccccuugcuuccacaacgacuguagcgaguuugugaaucagccguaccugcucuauuccguccauaugaagucuaccaaacccagccuguccccuucuaagccccaaagcucccuuguuaucccuacaucucuguucugcaaaacguuucccuuccacuuuauguucgauaaggacaugaccauucuccaguuuggcaacgggaucagacggcugaugaaucgcagagauuuccagggaaaaccuaacuuugaagaguacuucgaaauucuuacaccgaagaucaaucagaccuuuagcggcauuaugacaaugcugaacaugcaauucguggugcggguccgcagaugggacaauuccgugaagaaaagcucucggguuauggaucucaaggggcagaugaucuauaucguggaguccagcgccauucuguuucugggaucucccugugucgaccgccucgaagauuucaccggcagagggcuguaccuuuccgacaucccuauucauaacgcucugcgggaugugguucucaucggagagcaggcccgcgcgcaggacggccugaaaaagagacuuggcaaacugaaggcuacacucgagcaagcccaccaggcccuggaagaggaaaagaaaaagaccguggaucugcucugcagcauuuuccccugugaggucgcucagcagcuguggcaaggacagguggugcaggccaaaaaguuuucuaaugucacgaugcuuuucuccgacaucguuggguuuaccgcuauuugcagccaauguuccccucuccaggugaucacaaugcugaacgcccuguauacccgguucgaucagcagugcggcgagcuugacguguacaaagucgaaacaaucggggacgcguauuguguggccggaggccugcauaaggagucugauacccacgcuguucaaauugcccucauggcucugaaaaugauggaacugagcgacgaggugaugagcccccacggggaaccgaucaagaugcgcauuggacuccauuccggcucugucuuugccggcgugguuggggugaagaugccuagauacugccuguucggaaauaacgucacgcuugcgaauaaauuugaguccuguagcgugccccggaagaucaacgucucuccuacaaccuaccgccugcucaaagauugccccggcuucguguuuacacccagaagccgggaggaacugccuccgaauuuccccuccgagauuccugggaucugccacuuucuugacgccuaucagcagggaaccaacucuaagcccuguuuccagaaaaaggauguugaagacggcaacgcuaauuuucuggggaaggccagcggaaucgauuga

SEQ ID NO: 70098 - RNA, 1860 nt, Artificial Sequence
  derived and/or modified sequence opt5 from GUCY1B3__Homo_sapiens__NP_000848
auguacggcuucgugaaccacgcccuggagcuccuggucaucagaaauuaugggcccgaaguuugggaggacauuaagaaagaagcucagcuugaugaggaaggacaauuucuggugagaaucauuuacgacgauagcaagaccuaugaccucguggccgcggcuuccaaaguccugaaccuuaaugccggcgagauccugcagauguucgggaagauguuuuucguguuuugccaggagucuggauacgauacaauucuccgcguucugggcagcaacgugagagaguuccugcagaaucucgacgcccugcaugaucaccuugcuacgaucuauccugggaugcgggccccguccuuucgcuguaccgacgcugaaaaaggaaagggccugauccuccauuacuauucugaaagagagggccugcaagauauugucaucgggauuaucaagacaguggcccagcagauucacggaaccgagaucgacaugaaaguuauucagcaacggaacgaagagugcgaucauacacaguuccuuaucgaagagaaggaaagcaaagaggaggacuuuuacgaagaucuggaccgcuucgaggaaaauggcacccaggaguccagaaucucucccuacacauuuuguaaggcguucccuuuucacauuaucuucgaccgggaucucguggucacccagugcgggaacgccauuuaucgcgugcugccccaacugcagccuggaaauuguagccuccuguccguguucagccuugucagaccccacaucgacauuucuuuucauggcauccugucccacaucaacacgguuuucgugcuccggagcaaagaagggcugcuugauguggagaagcuggagugcgaagacgagcucaccggaacagaaauuucuugucugcgccugaagggccagaugaucuaccucccugaggcugauuccauucuguuucuuugcagcccgucugucaugaaucuggacgaucucaccagacggggccuguaucuuuccgacaucccccugcaugaugccacacgcgaccucgugcugcugggggaacaauucagagaggaguacaaacucacccaggaacuggagauucuuacggaucggcugcagcucacacugagagcucuggaagacgagaagaaaaagaccgacacacuucucuauagcguucugccucccuccguggccaacgagcugcgccacaaacggccuguccccgcgaagagauacgauaaugugaccauccucuuuucuggaaucguuggcuucaacgccuuuuguagcaaacacgcuuccggggaaggagccaugaagauugugaaucugcuuaacgaccuguauacccgcuucgauacacucacggacagccggaagaacccguuugucuacaaaguggagaccgucggcgauaaguacaugacagugucugggcugccugaacccugcauccaucacgcuagauccauuugucaucuggcccuugacaugauggagaucgccggacagguucaaguggauggcgaaagcguccagauuaccaucggcauucacacaggggaggugguuaccggagugaucggccagcgcaugccucgguauugccucuucgggaauacggucaaccugacaucuagaaccgagaccacaggagaaaaaggcaagaucaaugugagcgaguacaccuaucgcugccugaugucccccgaaaacucugacccccaguuucaucucgagcaccgggggccugugagcaugaaaggcaagaaggaaccgaugcaaguuugguuccugucccggaaaaauacaggaacggaggagaccaagcaggaugacgauuga

SEQ ID NO: 70099 - RNA, 3222 nt, Artificial Sequence
  derived and/or modified sequence opt5 from GUCY2C__Homo_sapiens__NP_004954
augaagacccugcuccuggaccuugcccuguggagccuccuguuccagcccggcuggcuuuccuuuucuagccaagugucccagaacugccacaaugggucuuacgagaucagcguccugaugaugggaaacuccgcuuucgccgaaccucucaaaaaucuggaggaugcgguuaacgaaggccuggagauugugagagggcggcuccagaaugcuggacugaacgugacagucaaugccacguuuauguauucugacggccuuauccauaacagcggggauugucgcuccucuaccugcgaaggacuggaccuccugagaaagauuagcaaugcccagcggaugggcugugugcuuaucggcccguccugcacauacagcaccuuccaaauguaucuggauacagagcucucuuaccccaugauuuccgcugggagcuuuggacugucuugugacuauaaagagacccugacacgccucauguccccugccagaaagcugauguacuuccuuguuaacuuuuggaaaaccaaugaucugcccuucaagacguauagcugguccaccucuuacguguacaagaacggcacagaaaccgaggacugcuuuugguaucucaaugcucuggaagccagcgucuccuacuucagccacgagcuuggguuuaaagugguucugcggcaggauaaggaguuccaggacauccucauggaucauaaccgcaaaucuaaugugaucauuauguguggaggcccugaauuucuguauaagcugaaaggggacagagcggucgccgaggauaucgugauuauccucguggaccuguucaacgaccaguacuucgaagauaacgucacagcucccgacuauaugaagaauguucuugugcugacccucuccccuggaaacagccugcuuaauucuagcuuuucccggaaccugucuccgacgaagcgcgauuucgcccucgcuuaccugaauggcauucugcucuuuggccacaugcugaaaaucuuccuugagaacggggaaaauauuacaacccccaaguuugcccaugcguucagaaaccugacauuugagggauaugacggcccugugacccucgaugacuggggagaugucgacagcaccauggugcugcuguacacauccguugauacgaaaaaguacaaagugcuucucaccuaugacacacacgucaauaagaccuaccccguggauaugagcccuacauucaccuggaaaaacucuaagcugcccaaugacaucacggggcggggcccgcaaauccugaugauugccguuuuuacacucaccggggcugugguccugcuucugcucguggcccugcugaugcuucgcaaguauagaaaagacuacgagcuccggcagaagaaauggucccacaucccucccgaaaacauuuucccucuggagaccaaugaaacaaaccaugucagccugaagaucgaugacgauaaacgcagagacaccauucagcggcucagacagugcaaguaugauaagaaacgcgugauccugaaggaccuuaaacacaaugauggaaacuuuacagagaagcagaaaaucgaacugaacaagcuccugcaaauugacuacuauaaucugacgaaguucuacggcaccguuaaacuugauacaaugaucuuuggcgugauugaguacugugagcgggggucucucagagaaguccugaacgacaccaucuccuaucccgauggaacauucauggacugggaguucaagauuagcgugcuguacgauaucgcuaaaggcauguccuaucuccauucuagcaagaccgaaguucacgggcgccugaaauccacgaauugcguggucgacucucggaugguggugaagaucaccgacuuuggauguaacagcauucuucccccuaagaaagaucuguggacagccccggagcaccucagacaggccaauaucucccaaaagggcgacguuuacagcuaugggauuaucgcucaggaaauuauccugcgcaaagagaccuucuacacacugucuugccgggauagaaacgagaagauuuuucgcgucgaaaauuccaacggcaugaaacccuuccggccugaccuuuuucucgagaccgcggaagagaaggagcuggaaguguaucugcucgugaaaaauugcugggaggaagaucccgagaagagaccugacuucaagaaaaucgaaacgacacuggccaagaucuuuggacuuuuccaugaucagaaaaacgagagcuacauggacacccugauucgccggcuccagcuguacucuagaaaucuggagcaccuugucgaagaacggacacaacuguauaaggcugaacgcgauagagccgaccggcucaacuuuaugcugcuccccagacuggugguuaaaucccuuaaggagaagggcuucguggaaccggagcuguacgaggaagucaccaucuauuuuagcgauauugugggguucaccacaaucuguaaauacucuacgccuauggagguuguggacaugcucaaugauauuuauaagagcuuugaccauaucgucgaccaccaugauguguacaaaguugaaaccaucggagacgccuauaugguggcuuccggccugcccaagcgcaacgggaaucggcacgccauugauaucgcgaaaauggcucuggagauucuuagcuucaugggaacauucgaacuggagcaccucccuggccugcccaucuggauuagaaucgggguccauucuggcccuugcgccgccggaguggugggcaucaagaugccccgcuacugucucuuuggggacaccgucaacacagcuuccagaauggagagcaccggacugccgcuucggauucacguuuccggcucuacgaucgccauucugaagcgcacagaaugccaguuccucuacgaggugagaggggaaaccuaucugaaaggacggggcaacgagaccacauacuggcugaccgggaugaaggaucagaaauuuaaucuuccuacaccucccacgguggagaaccagcaacgccugcaggcugaguucagcgacaugaucgccaauucccuccagaagagacaggcggccggcauucggucucaaaaaccccgcagagucgcuagcuauaagaagggaacccuggaguaccuccagcugaacacaaccgauaaagaauccacauauuuuuga

SEQ ID NO: 70100 - RNA, 3312 nt, Artificial Sequence
  derived and/or modified sequence opt5 from GUCY2D__Homo_sapiens__NP_000171
augaccgccugcgcuagacgggccggcgggcugcccgacccuggacucuguggcccggcguggugggcucccagccugccucgccuucccagagcccugccucggcucccccugcuucugcuccugcugcuccugcagccuccggcccuuuccgcuguguucacagucgggguucugggacccugggccugcgauccuaucuuuucucgcgcuagacccgaccucgccgcgcggcuggccgcugcccgccuuaacagagauccuggccuggcugggggaccccgguucgagguggcccuccugccggaaccuugucgcacgcccggcagccugggcgcgguguccucugcccucgcuagagucagcgggcuggugggaccuguuaaucccgccgcuugccggcccgccgagcuucuggccgaagaggcuggcauugcgcucgugccuuggggguguccguggacccaagccgaaggaacaaccgcucccgccgucacacccgccgcugacgcccuguacgcgcuucugcgcgcuuuuggcugggccagaguggcccucguuaccgcuccccaggaucuguggguggaggccgggcggucccugucuacagcucuccgcgccagaggacugccugucgcgagcgugaccuccauggagccccuugaccugagcggcgcccgggaagcucucagaaaggugcgcgauggcccgcgggucacggccguuaucauggugaugcacucugugcugcuugggggagaggaacagagauaucugcucgaggcugccgaggaacugggccugaccgacgggucccucgucuuccugccuuuugauacaauucauuacgcgcuuagccccggaccugaggcccuggcugcccucgcuaacucuucccagcugcgccgggcccacgacgccgugcugacccuuacaagacauugccccagcgaaggcucuguucucgauucccugcgccgggcucaagagagacgcgaacugccuagcgaccucaaucugcaacagguguccccucuuuucgggaccaucuaugaugcggucuuucugcucgcccggggaguggcugaggccagagccgcugccggcggccgcuggguuucuggggcggcuguggcccggcacauuagagacgcccaggucccgggauucuguggcgaccucgggggagaugaggaaccucccuuugugcugcuugacacggaugcugccggcgaccggcuguucgcgacauacaugcuggaucccgcucgcgggagcuuucuguccgccggcaccagaaugcauuucccucggggaggcagcgccccggggcccgacccuucuugcugguuugaucccaacaauaucuguggaggcgggcucgagccuggacuggucuuccuuggcuuccugcucgugguugggaugggccuggcuggagccuuucuggcucacuaugugagacaccgccuucuccauaugcagauggucuccggccccaacaaaaucauucugacaguggacgauaucaccuuccugcacccucaugggggaaccagccggaagguugcccagggcucuagaagcucccucggggcgcgcucuaugagcgacauuagauccggacccagccagcaccuggauucuccgaauaucggcguguacgaaggggaccgggucuggcuuaaaaaguuuccuggcgaccagcacauugccauccgccccgcuacaaaaacggccuucuccaagcugcaagagcucagacaugaaaacguggcucuguaucugggacuuuuucucgcccggggcgccgaggggccugcugcgcugugggagggaaaucuggccgugguuagcgaacacugcacccgcggcucucuccaggaucugcuugcucagagagagauuaagcuggacuggauguucaaauccagccuccugcuggaucuuaucaaggggauccgguaccugcaucaccgcggagucgcccauggcagacucaaaucccggaacuguauuguggacgggcgcuuugugcugaagaucacagaucacggccacggaagacuccuggaagcccaaaaaguccuucccgagccgccucgggcugaagaccagcuguggaccgcccccgagcuccugagagauccugcgcuggagcgccggggcacacuugcuggggacguguucucucuggccauuaucaugcaggaaguugugugcagaagcgcccccuacgcuaugcucgagcugacccccgaagaggucgugcagcgcguucgguccccuccgccccucugcagaccucuggugucuauggaucaagcccccgucgaguguauucuucugaugaagcagugcugggcggaacagccugagcuccgccccagcauggaccauacguuugaucuguucaagaauaucaacaaaggacggaagacaaauaucauugacuccaugcugagaaugcuugaacaguauagcucuaaccuggaggaucucauccgcgaacggaccgaggagcuggaacucgagaaacaaaagaccgacagacugcuuacacagaugcugccuccguccguggcugaagcccugaaaaccggcacacccguugagccugaauacuuugaacaggugacgcucuauuucagcgacauugucggguuuaccacaaucucugccauguccgagcccauugaggugguggaucugcuuaaugaccuguacacccucuucgaugcuaucaucggaagccacgacgucuauaagguugagacaauuggcgaugccuacaugguggcuucuggccugccucagcggaacgggcaacgccaugccgcggaaaucgccaacaugagccucgacauucuguccgcugugggaaccuucagaaugcggcacaugcccgaggucccggugcgcaucagaauuggccuucacagcgggccuuguguugccggaguggucggccugacgaugccccgguauugccuguuuggggauaccgugaauacagcuucuagaauggaauccaccggacuccccuaccgcauccauguuaaccugagcacagugggcauucuucgggcccuggacuccggcuaccaggucgagcucagagggcgcaccgagcugaaaggaaagggcgccgaagauacguucuggcucguggggcggagaggauuuaauaagccuauccccaaaccuccggaccugcagcccggcucuagcaaccacgggaucucccuucaggagauuccucccgaacgccggagaaagcuggagaaagcucgcccuggacaauucucuuga

SEQ ID NO: 70101 - RNA, 3327 nt, Artificial Sequence
  derived and/or modified sequence opt5 from GUCY2F__Homo_sapiens__NP_001513
auguuccugggccucgggagauuuagccggcuggugcuuugguucgccgcuuuucgcaagcugcucggacaccauggccuggccuccgcgaaauuccuuuggugccugugucuccugucugucaugagccugccccagcaaguuuggacccucccuuacaagaucgggguggugggaccgugggcuugcgacucccuguuuucuaaagcccuucccgaggucgccgcuagacuggccauugaacggaucaaccgcgauccuagcuucgaccucuccuauucuuuugaguacgugauucugaaugaagauugucagacaagcagagcucuuuccagcuucaucucucaccaucagauggccuccggcuuuauugggcccacgaacccuggauauugcgaggcggccagccugcucggcaauucuugggacaagggcaucuucuccugggcuuguguuaacuacgaacuggauaauaaaaucagcuaucccaccuuuucucggacacugccuuccccgauucgcgugcucgucaccgugaugaaguacuuccagugggcccacgcugggguuaucagcuccgacgaggauauuugggugcauacagccaacagagucgcgucugcccugcggagccacggacuucccgugggcgugguccugaccacagggcaagacucccagagcaugcgcaaggcucuccagagaauccaccaggccgaucggauucgcaucauuaucaugugcaugcauucugcucugaucggaggcgagacccaaaugcaccuucuggaaugugcccaugaccucaaaaugacggaugggaccuauguuuuugugccuuacgacgcccugcuguacucccuccccuauaagcacacaccuuacagagugcugcggaauaaccccaaacuucgcgaggcuuaugaugcgguccugaccauuacaguggaaagccaggagaagaccuucuaccaggccuucacggaggcugccgccagaggagaaaucccggagaaacucgaauuugaccagguuucuccucuguucggcacaauuuauaauagcaucuacuuuauugcucaagccaugaacaaugcgaugaaggagaacggccaggcuggggccgccucccuugugcagcacucucggaauaugcaauuccauggauuuaaccagcugaugagaaccgacagcaauggcaacgggaucuccgaauaugucauccucgauacaaaccugaaggagugggagcugcacagcaccuacaccguggacauggaaauggagcuccugcgcuucggaggcacacccauucauuuuccugggggacggccucccagagcugaugccaaaugcugguucgcugaaggcaagaucugucacggcgggauugaccccgccuuugcgaugaugguuugccuuacgcugcucaucgcccugcugucuauuaauggauucgcuuacuuuauccgccggagaaucaacaaaauucagcuuaucaagggcccgaaucgcauucuccugacccuggaggaugugacauucaucaacccccauuuuggguccaaacggggaagcagagccucugucuccuuccagauuaccagcgaagugcaauccggccgcucuccucggcucagcuucuccucugggagccugacacccgcuaccuaugaaaauuccaacaucgccauuuacgagggcgacugggucuggcuuaagaaauuuagccugggagauuucggcgaccucaagucuaucaaguccagagcgagcgauguguuugaaaugaugaaagaccugcgccacgagaauaucaacccucugcuuggguucuuuuaugauucuggaauguucgccauuguuacggaauuuuguucccggggcagccucgaggacauccugacaaaucaggacgugaagcuggauuggauguucaaaucuagccuccugcuugaccugauuaaggggaugaaauaccuccaccauagagaauuuguccacggacggcugaagucccgcaacugcgugguugauggcagauucgugcugaaggucaccgacuauggguuuaaugauauccuugagaugcuccggcugagcgaggaagagucuuccauggaggagcugcucuggaccgcucccgagcugcuuagagccccgcgcggcagccggcugggauccuucgcuggcgacguguacucuuuugccauuaucaugcaggaagugaugguuagagggacaccuuucugcaugauggaucuccccgcccaggagaucauuaaccgccugaaaaagccucccccugucuauagacccguggugccgccugaacaugcuccucccgagugucugcaacuuaugaaacagugcugggcggaagccgcugagcagcggcccaccuucgacgagaucuuuaaucaguucaagacauuuaacaaaggaaagaagacgaauauuaucgauagcaugcuccgcaugcuggaacaauacuccucuaaccuggaggaccucauuagagaacggaccgaggaacuggagaucgagaaacagaagacagaaaaacuucugacccagaugcucccgcccagcgucgccgagucccugaagaaaggcuguacaguggaaccugagggguucgaucugguuacccuuuacuuuucugacaucgugggauucacgaccauuagcgccauguccgaacccaucgaggucguggaucugcucaacgaccuguauacacucuuugacgcuauuaucggcagccacgauguuuacaagguggagaccauuggggacgccuauauggucgcgucuggccugccuaagcgcaauggauccagacacgcugccgaaaucgccaacaugagccuugauauccugucuuccgugggcacauucaaaaugcggcauaugcccgagguuccugugcgcauuagaaucgggcuccacagcggacccgucguggcuggcguggucgggcugaccaugccgcgguacugccuguuuggagacacgguuaauacagccucucgcauggaauccaccggccuuccuuaucggauucaugugagccuguccacagugaccauccuccagaaccugagcgagggguacgaggucgaacucagaggcagaaccgagcugaagggaaaaggcacagaagagacguucuggcuuauugggaagaaaggauuuaugaagccccugccugugcccccgccuguugauaaagacggccaaguggggcacggacuccagcccgucgaaaucgcggcuuuccagcgccggaaggccgagagacaacuggugcgcaauaagccuuga

SEQ ID NO: 70102 - RNA, 657 nt, Artificial Sequence
  derived and/or modified sequence opt5 from GUK1__Homo_sapiens__NP_001152862
augcugagacggccccucgccggccuggcugccgcggcucuugggcgcgccccuccggacggaaugagcggccccagaccugugguccuguccgggcccucuggagccggcaagagcacccuccugaaacggcuucugcaggagcacuccgggaucuucggauuuucuguuagccauacaacgcgcaacccuagacccggcgaagagaauggcaaggauuacuauuucgugacccgggaagugaugcaacgcgacauugcugccggggauuuuaucgagcacgcugaguucuccggaaaccucuacggcacaucuaaagucgccgugcaggcgguucaggccaugaauagaauuugcgugcuggacgucgaucugcagggggugcggaacaucaaggcuaccgaccuccgcccuauuuauaucagcguucaaccgcccucccugcaugugcuugaacagagacugcggcagcgcaauacagagaccgaagagagccucgucaaaagacuggccgcugcccaggcggauauggaaucuuccaaggagccuggacuuuuugacguggugaucauuaacgauagccuggaccaagccuacgcugagcucaaggaagcccugucugaggaaaucaaaaaggcucagcggacaggcgccuga

SEQ ID NO: 70103 - RNA, 876 nt, Artificial Sequence
  derived and/or modified sequence opt5 from GULP1__Homo_sapiens__NP_001239597
augaacagagccuucagccggaagaaagacaagaccuggaugcacacacccgaggcucuguccaaacauuuuaucccuuacaaugccaaguuccucggcucuacggaaguggagcagccgaaagggaccgaagucguucgcgaugcggugagaaagcugaaguuugcucggcacauuaaaaagagcgagggacagaaaauccccaagguggaacuucaaauuuccaucuauggcgucaaaauucuggagccuaagacaaaggaggugcagcauaacugccagcuccaccgcaucucuuucugugccgacgauaaaaccgacaagagaaucuuuacauucauuugcaaagauagcgaauccaauaagcaucuguguuacguuuuugacucugagaaaugcgccgaagagaucacccuuacaauugggcaagccuucgaucuggccuaucggaaguuucucgagagcggaggcaaagacguggaaacccgcaagcagaucgcugggcugcagaagcggauucaggaucuggagacggaaaacauggagcucaaaaauaagguccaagaccuggaaaaccagcuuagaaucacccagguguccgcucccccugcgggaagcaugacacccaaaucuccuuccaccgauauuuucgacaugaucccguuuagccccaucucucaccaguccagcaugccuacacgcaauggcacccaacccccucccguuccgucuagauccacggagauuaagcgggaucuguucggcgccgagccuuuugaccccuucaacuguggggcugccgacuucccucccgauauccagagcaaacucgacgaaaugcagcgccaaagauggcggggauccaagugggauuga

SEQ ID NO: 70104 - RNA, 1956 nt, Artificial Sequence
  derived and/or modified sequence opt5 from GUSB__Homo_sapiens__NP_000172
auggccagaggcagcgcuguggccugggcggcucuggggccccuccuguggggaugcgcccuuggccugcaagggggaaugcucuacccucaggaguccccgucucgggaauguaaggagcuggacggccuuuggagcuuccgcgccgauuuuuccgacaacagacggcgcggguucgaggaacagugguauagacggccccugugggaaucuggaccuaccgucgauaugcccguuccuagcuccuuuaaugacaucucucaggauuggcgccucagacacuucgugggcugggugugguacgagcgggaggucauucugcccgaacgcuggacacaggaccugagaacgcgggugguucuccgcaucggcagcgcucauuccuaugccauugugugggucaacgggguggauacccuggagcacgaaggaggcuaccuuccuuuugaggcugacaucagcaaucugguucaaguggggccgcuccccucuagacugcggauuacaaucgccaucaacaauacccuuacaccuaccacacugcccccuggaaccauucaguaucucacggauaccuccaaauaccccaagggcuauuucguccagaacacauacuuugacuucuuuaauuacgcggggcugcagcgcagcgugcugcucuauaccacaccgaccacguacaucgaugacauuacagugaccacaucugucgagcaagauuccggacugguuaacuaucagaucagcgugaaaggcucuaaucuuuucaagcuggaagugagacuccuggacgccgagaacaaagucguggcuaauggcaccgggacccagggacagcuuaagguuccuggcgugucccugugguggcccuaccucaugcaugaacggccugccuaucuguacagccuggagguccaacucacagcucagacgucccuggggcccgugucugacuuuuauacccuucccguuggaauuagaacaguggccgucaccaagagccaguuccugaucaacggcaaaccuuuuuacuuccacggggugaauaagcaugaagaugcggacauucgcggaaaaggcuucgauuggccgcuccuggucaaggacuuuaaccuucugcgguggcucggcgccaaugcuuucagaacaucccacuaccccuaugccgaggaggugaugcaaaugugcgaucgcuacgggaucguugugaucgacgaauguccuggagucggccuggcucugccccaguuuuucaacaacgugagccuccaccaucacaugcagguuauggaggaagugguccggagagauaaaaaucauccugccguggugauguggucuguugccaacgagcccgcuucccaccuggaaagcgcgggguauuaccuuaagauggucauugcccacaccaagucucuggacccgagccgcccugugacguuuguguccaauucuaacuaugcugccgauaaaggagcccccuacgucgacgugaucugccucaauagcuauuacuccugguaccaugauuauggccaccuggagcugauucagcuucaacucgcuacacaguucgagaacugguacaagaaauaucagaagccuaucauucagagcgaauacggggccgagaccaucgcgggcuuucaucaagaucccccucugauguucaccgaagaguaucagaaaucucugcucgaacaguaccaccugggacuugaccagaagcggagaaaauauguugugggcgagcugaucuggaauuuugcugacuucaugacagagcaaucccccacccgcguccucgggaacaagaagggaauuuuuacacggcagagacagccgaaaagcgccgccuuccugcugcgcgaacgguacuggaagaucgcuaaugagacgagauacccucauucuguggccaaaucccagugucuugaaaacagccucuuuaccuga

SEQ ID NO: 70105 - RNA, 1002 nt, Artificial Sequence
  derived and/or modified sequence opt5 from GYG1__Homo_sapiens__NP_001171649
augaccgaccaggccuucgugacacugacgaccaacgaugcuuacgccaagggcgcgcucguccuggggagcucccuuaaacaacacagaacaacccggcgccugguugugcucgcuacaccccaggugucugacagcaugagaaagguccuggagaccguguuugaugaaguuaucaugguggacguccuugauuccggagacucugcccaucugacacucaugaaacggccugagcugggcgugacccugacgaagcuccacugcuggagccugacccaguauuccaaauguguuuucauggaugccgacacacuugugcuggcuaauauugaugaccucuuugaucgcgaggaacugucugccgcuccggaccccggguggccugauugcuucaacagcggagucuuuguguaccagcccuccguggaaaccuauaaucaacuucugcaucucgccagcgagcagggcucuuucgacgggggagaccagggcauccugaacacauuuuucuccagcugggcgaccacggauauuagaaagcaucugccuuuuaucuacaaucucucuuccauuagcaucuauucuuaccugcccgccuucaaggucuuuggcgcuuccgccaaaguugugcacuuccuugggcgggugaagccuuggaacuauacauacgacccgaaaaccaagagcgucaaauccgaggcucacgaucccaauaugacacacccugaauuucugauccucugguggaacauuuucaccaccaaugugcugccccuucugcagcaauucggacucguuaaggacacauguucuuacgugaacgucgaggaugugagcggcgccaucucccaucugagccugggggaaauuccugcgauggcccagcccuuuguuucuuccgaggagcgcaaggaaagaugggagcagggacaggcugacuauaugggcgccgauagcuucgacaauaucaaacggaagcucgauacguaccugcaauga

SEQ ID NO: 70106 - RNA, 1413 nt, Artificial Sequence
  derived and/or modified sequence opt5 from GYG2__Homo_sapiens__NP_001073324
augagcgugaccgaccaggccuucgucacacuggcuacgaacgauaucuacugccaaggcgcccucguucuggggcagucccuuagacggcaccgccugaccagaaagcucguggugcugauuacaccccaggucucuagccuucugcgggugauccucuccaaaguuuuugacgaggugauugaagucaaucugaucgauucugcggacuauauucaucuggcuuuccucaagcgcccugagcugggacuuacccugacaaaacuccacuguuggacccugacacauuacagcaagugcguguuucuugaugccgacacccugguucucuccaacguggaugaacuguucgacagaggcgaguuuucugccgcuccggaucccggguggccugacuguuucaauagcggagucuuuguguuccagcccucccugcacacgcauaaacuccugcuucaacacgccauggaacacggcagcuuugauggggcugaccagggacugcucaacucuuucuuucggaauugguccaccacagauauccauaagcaucugccuuucaucuauaaccuuagcucuaauaccauguacacauauucccccgccuuuaagcaguucggcagcucugcgaaagugguccacuuccugggcuccaugaagccuuggaacuacaaauauaauccgcagagcggguccguucucgagcaaggaucugccagcuccagccagcaccaggcugccuuucugcaccugugguggaccguguaccagaacaaugugcucccccuguacaagucuguccaagcuggcgaggcccgcgcguccccugggcauacgcuuugccacagcgacgugggaggccccugugccgacucugcuagcgggguuggagaaccuugcgagaacuccacacccucugccggcgugccgugugcuaauagcccucugggcuccaaccagcccgcccaggggcucccugaacccacccaaauugucgaugagacacugagccuucccgagggaagacggucugaagacaugaucgccugcccugagaccgaaaccccggcugugauuacaugugauccccugucccagccuagcccccagccugcggacuucacggagaccgaaacaauccuccagcccgccaauaaaguugagucuguguccagcgaggaaaccuuugagccgucccaagaacugccugcugaggcccugcgcgaucccucucuccaggacgcccuggaagucgaucuugcugugagcgucucccagauuucuaucgaggagaaggugaaggaacugagcccugaggaagagagacggaaaugggaagagggccgcauugacuauauggggaaggaugccuucgcgagaauccaggagaaacucgaccgguuucugcaauga

SEQ ID NO: 70107 - RNA, 2166 nt, Artificial Sequence
  derived and/or modified sequence opt5 from GYLTL1B__Homo_sapiens__NP_001287650
augcugcccagaggccggccucgcgcccucggggcugccgcgcugcuucugcuccugcuucugcucggauuccugcuguuuggcggggaccucggaugcgagagacgggaaccgggcgggcgcgcuggagcccccggcuguuucccuggcccccugaugccuagagugcccccugaugggcggcuucgcagagccgcugcccuggacggagauccgggcgcugggcccggagaccacaaccggagcgauugcggcccucagcccccucccccgccuaagugugagcuccugcaugucgccaucguuugcgcggggcacaauuccucucgcgacgugauuacccuugugaaaagcaugcuguuuuacagaaagaacccccuccaucugcaccuggucacagaugccguggcucggaauauccucgaaacgcuguuccauaccuggaugguuccugccgugcgcgucuccuuuuaucacgcugaccaacuuaaaccccaggugucuuggauucccaacaagcacuacagcggacuguauggccucaugaaacugguucuuccuuccgcccugccggcggagcucgccagagugaucguccuggauacagacgugaccuucgcuucugauauuagcgaacugugggcccucuuugcucauuucuccgacacacaggccaucggccugguggagaaucagagcgauugguaccuugggaaccuguggaagaaucaccggcccuggccugcccucggacgcggcuuuaacaccggggucauccugcuuagacuggaccggcucagacaagcuggaugggagcagauguggcgccugacagcgcggagagaacugcucucucugcccgccaccucccuugcugaccaggauauuuucaaugccguuaucaaggagcauccuggccuggugcagcgccuccccuguguguggaacguccaacugagcgaccacacgcuggccgaacggugcuauucugaggcuuccgaucuuaaagugauucacuggaauagcccgaagaaacucagaguuaagaacaaacauguggaguuuuuccgcaauuuuuaccugaccuuccuggaauaugacgggaaccuccugcggagagagcuuuucgucuguccuucucagcccccucccggagccgaacagcugcagcaagcgcucgcucagcuggaugaggaagacccuugcuuugaguuccgccagcaacagcugacagugcaccggguucaugugaccuuucuuccccacgagccgccuccucccagaccccaugaugucacacucguggcccagcuguccauggaccgccugcagaugcucgaagcccugugucggcacuggccgggccccaugagccuugcucuguaccucaccgaugccgaggcucaacaguuccugcacuuugucgaagccuccccugugcuggcggccagacaggacguugcuuaccauguggucuaucgggagggcccccuuuacccugugaaucagcuccgcaacguugcccuggcucaagcccugacgcccuauguguuccucucugauaucgacuuucugccugcguacagccuuuaugacuaccugagagccuccauugaacagcucgggcugggaagccggagaaaggcugcccuggucgugcccgcuuucgagacacuucgcuaucgguuuucuuucccgcacuccaagguggagcuccuggcccugcucgaugccggcacccuguacacauuuagauaccaugaauggccucgcgggcacgcucccaccgacuaugcgagauggcgggaggcccaggcuccuuaccgcguucagugggccgccaacuaugaacccuacgucguggugccgagagauugcccucgguaugacccccgcuucgucggauuuggcuggaauaaaguggcucacaucguugagcuugaugcccaagaauacgagcugcucgugcugccugaggcguucaccauucaucugccccacgcucccagccuugacaucucuagauuccggagcuccccuacauaucgcgauugucugcaggcccucaaggacgaauuucaucaggaucugucuagacaccauggggccgcugcccucaaauaccugccggcgcuucagcaaccccagagcccugcucggggcuga

SEQ ID NO: 70108 - RNA, 453 nt, Artificial Sequence
  derived and/or modified sequence opt5 from GYPA__Homo_sapiens__NP_002090
auguacggaaagaucauuuucgugcugcuccugagcgagaucgucuccauuucugcccuuagcaccacagaaguugcuaugcacacguccaccucuagcuccgugacaaaaucuuauaucagcucccagaccaacgacacacauaagagagauaccuacgccgcgacaccccgggcucacgaggugagcgaaauuucuguccgcaccguguauccuccggaggaagagacgggggagagaguucaacuggcccaucacuuuuccgaacccgagaucacccucaucauuuucggagugauggccggcgucaucgggacaauucugcuuaucagcuacggcauucggcgccugaucaaaaagucuccuuccgacgugaaaccccucccuagccccgauaccgacguuccucugucuuccguggaaauugagaauccggagacaagcgaucaguga

SEQ ID NO: 70109 - RNA, 276 nt, Artificial Sequence
  derived and/or modified sequence opt5 from GYPB__Homo_sapiens__NP_002091
auguacggcaagaucauuuucgugcugcuccugagcgagaucgucuccauuucugcccuuagcaccacagaaguugcuaugcacacguccaccucuagcuccgugacaaaaucuuauaucagcucccagaccaacggggagacaggacaacuggugcauagauuuaccguccccgccccugugguuauuauccucaucauucugugcgugauggcgggcaucauugggacaauccuucugauuagcuacaccauccggcgccucauuaaggcuuga

SEQ ID NO: 70110 - RNA, 324 nt, Artificial Sequence
  derived and/or modified sequence opt5 from GYPC__Homo_sapiens__NP_001243513
auggccagcgcuuccaccacaaugcacacgaccacaaucgccgagcccgacccuggcaugucuggguggccggauggaagaauggaaaccagcacacccaccauuauggacaucguggucauugcgggcguuaucgcugccguggccauugugcuggucucccuccuguucgugaugcuucgguacauguaucgccauaaggggacauaccacaccaacgaggcuaaaggaacggaauuugccgagucugcugaugccgcgcugcagggcgacccugcccuccaagaugcuggggacagcuccagaaaggaauauuucaucuga

SEQ ID NO: 70111 - RNA, 237 nt, Artificial Sequence
  derived and/or modified sequence opt5 from GYPE__Homo_sapiens__NP_002093
auguacggcaagaucauuuucgugcugcuccugagcgggaucgucuccauuucugccagcuccaccacaggaguugcuaugcacacgucuaccagcuccucugugacaaaaagcuauaucuccagccagaccaacggcauuacacuuaucaauuggugggccauggcgagagugaucuuugaggucaugcuggugguuguggggaugauuauccucauuucuuacugcauccgguga

SEQ ID NO: 70112 - RNA, 2022 nt, Artificial Sequence
  derived and/or modified sequence opt5 from GYS1__Homo_sapiens__NP_001155059
augccccugaacagaacccucagcauguccucucugccuggccuugaggacugggaagaugaguucgaccuggaaaaugccgugcucuuugaggucgcuugggaaguugccaacaaggucgggggaaucuacacagugcugcagacgaaagcgaaggugaccggcgaugaguggggagacaauuauuuccuuguggggccguacacagagcaaggcguucggacccagguggaacugcucgaggcucccaccccugcccugaaacgcacacuggauagcaugaacuccaaggggugcaaauuucucgcccagucugaagagaagccccacgucguggcucauuuccacgaguggcuggccggaguuggccuuugucugugcagagcucggcgccucccuguggccacaauuuuuaccacgcaugcgacccugcuuggcagauaucugugugccggggcugucgacuucuacaauaaccucgaaaauuuuaacguggauaaggaggccggagaacggcagaucuaucaccgcuacugcauggagagagcugccgcgcauugugcccacguguucacaaccgucagccaaauuacagcuaucgaagcccagcaucugcugaaacggaagcccgacauuguuaccccuaauggccucaacgugaaaaaguuuuccgcuaugcacgaguuccagaaucugcacgcccagucuaaagcccgcauccaagaguuugugagagggcauuucuauggacaccuugauuuuaaccuggacaagacgcucuacuucuucaucgcuggccgguacgaauuuagcaauaagggggcggaugucuuccuggaggcccuugcucgccugaacuaucuccugagagugaauggauccgaacagacaguuguggccuuuuucauuaugccggcccggaccaacaacuuuaaugucgagacacugaaaggccaggcugugcgcaagcagcucugggacaccgccaacaccguuaaagaaaaguucggcagaaaacuguacgagagccuucugguggggucucuccccgauaugaauaagaugcuggacaaagaggacuuuacaaugaugaagcgggcgaucuucgcuacgcaaagacaguccuuuccucccgucugcacccacaacaugcuugaugacagcucugauccuauucugacaaccauccgccggauuggacucuucaauuccagcgccgacagagugaaggucaucuuucaucccgaguuccugucuuccacaagcccgcugcucccuguggauuaugaagaauuuguucgcggcugucaccuggggguguuccccuccuacuaugagccuuggggauacacccccgccgaaugcacggucaugggcauucccucuaucagcacaaaccuuuccggguucggauguuuuauggaggagcauaucgcugacccuagcgccuauggcauuuacauccuggaucggagauuccgcucucucgacgauuccugcagccagcugaccucuuuucuguacagcuucugucaacagucccggagacagcgcauuauccagcggaauagaaccgaacgccuuucugaccuccuggauuggaaauaucugggccgguacuauaugagcgcuagacacauggcccucuccaaggcguuuccggagcauuucacauacgaacccaacgaggccgacgcugcccaaggguaucgguacccucgccccgcuagcgugccucccucuccgucccugagcagacacucuuccccucaccagagcgaggacgaagaggauccccggaauggaccucuugaagaggacggcgaaagauaugaugaggacgaggaagccgcgaaagaucgccggaacauuagagcccccgaguggccucgcagagcuuccugcaccucuagcacauccgggucuaagcggaauagcguugacacggccaccuccagcucucuguccacacccagcgaaccgcucucuccuaccuccagccugggagaggaacgcaacuga

SEQ ID NO: 70113 - RNA, 2112 nt, Artificial Sequence
  derived and/or modified sequence opt5 from GYS2__Homo_sapiens__NP_068776
augcugagaggccggagccucuccgugaccucucugggaggacuuccccagugggaggucgaggaacugccuguugaggaacuccugcuuuucgaaguggccugggaggugacaaacaaggucggcgggaucuacacggugauucaaaccaaagcuaagacaaccgccgacgaguggggagaaaauuauuuucugaucggcccguacuucgagcacaacaugaaaacacagguugaacagugcgagcccgugaaugaugcgguccgcagagcuguggacgccaugaacaagcaugggugucagguucacuuuggacgguggcucauugagggcagcccuuaugugguccuguucgauaucggcuacuccgccuggaaucuggaccgcuggaaaggggaucucugggaggcuugcucuguggggauucccuaucaugacagagaagccaacgauaugcugaucuuuggcagccuuaccgcuugguuccugaaggaagugacagaccacgccgaugggaaguacgucguugcgcaauuucaugaguggcaggccggaaucggccucauucugucccgggcucgcaaacuuccuaucgccaccauuuucacgacccacgcuacacugcucgggagauaucugugugccgcgaauaucgacuuuuacaaccaccuggauaaguucaauauugacaaagaagccggagagcggcagaucuaccaucgcuauugcauggagagagcuucugugcacugugcccauguguuuaccacagucagcgaaauuaccgcuaucgaggccgaacacaugcucaagcggaaacccgaugugguuacgccuaacggccugaaugugaagaaguucuccgccguccacgaguuucagaaccuucaugcuauguacaaagcgcgcauccaagacuucgugagaggccacuucuaugggcaucuggacuuugaucucgaaaagacacuguuccuuuuuauugccggacgguacgaguucagcaauaaaggcgcugacaucuuucuggagucucucucccgccugaacuuccugcucagaaugcacaagagcgauauuaccguuaugguguuuuucaucaugccggccaaaacaaauaacuuuaacgucgaaacccugaaggggcaggccgugcggaaacagcuuugggacgucgcucauucugugaaggagaaguucgggaaaaagcuguaugaugcccuccugagaggcgaaauucccgaccuuaaugauauccuggaccgcgaugaccucaccaucaugaaacgggcgaucuuuuccacacagagacaaagccugccucccguuacgacccacaacaugauugaugacucuacagacccuauucuguccaccauccgccggauuggacucuucaauaacagaacagaucgcgugaaggucauccugcaccccgaguuucuuagcuccaccucuccgcugcucccuauggacuacgaagaguucgugcggggaugccaucugggcguuuuccccagcuauuacgagccuuggggcuacacgcccgcugaauguacagugauggggauccccuccgucaccaccaaucugagcggauuuggcugcuucaugcaggagcacguggccgauccuacagccuaugggauuuacaucguggacagacgcuuucggucuccggaugacuccuguaaccagcuuaccaaauuccucuauggauuuugcaagcaaagcagacgccagcggauuauccagagaaaucggacagaacgccugucugaucugcucgacuggagauaccugggccgguauuaccagcaugcuagacaccuuacgcugagccgcgccuuccccgauaaguuucacguugagcucaccuccccucccacaaccgagggguucaaauauccucggcccucuagcgucccgccuucccccagcggcucucaggcuuccagcccucaaucuuccgacguggaagaugagguggaagacgagagauacgaugaagaggaggaagccgagcgcgacagacugaacauuaagagccccuuuucccugucucaugucccucacggcaaaaagaaacuucauggagaauacaagaauuga

SEQ ID NO: 70114 - RNA, 1368 nt, Artificial Sequence
  derived and/or modified sequence opt5 from GZF1__Homo_sapiens__XP_005260860
auggagagcggcgccgugcugcucgaauccaagucuagccccuucaaccugcuucacgagaugcaugaacugagacuccuggggcaccuuugcgacgucaccguuuccguggaguaccagggagugcggaaagauuuuauggcucauaaggccguccuggcggcuacaucuaaauucuuuaaggaaguguuccucaaugagaaaagcguugacggcacgcgcaccaacguguaucugaaugagguccaaguggccgauuuugccuccuuccuggaauuuguuuacacagcuaaggugcaggucgaggaagacagagugcagcggaugcucgagguggccgagaagcugaaaugucuugaucugucugaaaccugcuuccagcucaagaaacaaaugcuggagagcguccuucuggaacuccagaacuuuuccgagagccaggaaguugaggugucuuccgggagccaggugucugcugccccugcgccgcgcgccuccgucgcuacagacggaccccacccuagcggccugaccgauucucuggacuaucccggggagagagccuccaauggaaugagcuccgaucucccucccaagaaaucuaaggacaagcuggauaaaaagaaagaagugguuaagccuccguaccccaaaauccggcgcgcuagcggcagacuugccggccggaagguguucgucgagauuccuaaaaagaaguauacacgcagacugcgggaacaacagaaaaccgcggagggggacgugggagauuaccgcuguccccaggaccaguccccugacagaguuggcacggaaauggagcaagugagcaagaacgaggggugccaggccggagcugaacucgaggaacugucuaaaaaggccggccccgaggaagaggaggaagaggaagaggaggaugaagagggggagaaaaagaaguccaauuuuaaauguagcaucugcgagaaggcuuuccuuuaugaaaaaucuuuucugaagcauagcaaacaccggcacggagucgccaccgagguggucuaccgcugugacacaugcggccagaccuucgccaacagauguaaucucaagucccaucaacggcacgugcauucuagcgagagacacuucccgugcgaacuguguggcaagaaauuuaagcgcaaaaaggauguuaaacggcacgugcugcagguccaugaagggggaggcgaaagacaccgcugcgggcagugcggaaagggccucuccagcaagacagcucugcggcuucaugagagaacccacacgggggaccgcccuuacggauguacagaaugcggcgcgcgguucucucagcccuccgcccugaaaacccauaugagauga

SEQ ID NO: 70115 - RNA, 789 nt, Artificial Sequence
  derived and/or modified sequence opt5 from GZMA__Homo_sapiens__NP_006135
augagaaacagcuaccgguuccuggccuccucucucagcguggucguuucccugcuucugauccccgaggacgugugcgaaaagauuaucggcgggaaugaggugaccccucacucucgcccguauaugguccuccugagccuugauagaaaaacaauuugugcuggagcccugaucgcgaaggacugggugcucacggcugcccauugcaaccugaauaaacggucccagguuauucugggcgcccacucuaucacccgcgaggaacccacaaagcaaaucaugcucgugaaaaaggaauuuccuuaccccuguuaugauccugcuaccagagagggggaccugaaacuucugcagcucacagagaaggccaagauuaacaaauacgucaccauccugcaucuucccaagaaaggagaugacgugaagccuggcacaaugugccagguugcuggguggggacggacccacaauagcgccuccuggagcgauacgcugcgcgaagugaacauuaccaucauugacagaaaggucuguaaugaucggaaccauuauaauuucaacccggugaucggcaugaauauggugugcgcgggcucucuccgcgggggaagagacuccuguaacggcgauagcgggucuccccugcugugcgagggagucuuucggggcguuacauccuucgggcucgaaaauaaauguggagacccucgcggccccggcguguacauucugcuuagcaagaaacaccugaacuggaucaucaugaccauuaagggggccguguga

SEQ ID NO: 70116 - RNA, 744 nt, Artificial Sequence
  derived and/or modified sequence opt5 from GZMB__Homo_sapiens__NP_004122
augcagcccauccugcuccugcuugccuuccugcuccugccuagagcugacgccggcgagauuaucgggggacacgaagcgaagccgcauagccggcccuacauggcuuaucuuaugauuugggaucaaaaaucccugaagcgcugcggcggguuucucaucagagacgauuucgugcugaccgccgcccacuguuggggaucuagcauuaacgucacacugggcgcucauaauaucaaagagcaggaaccuacgcagcaguuuauccccguuaagcggccuauuccccacccugccuacaacccgaaaaauuucuccaacgacaucaugcuccugcaacuugagcgcaaggcuaagagaacccgggccgugcagccccugcgccucccuucuaauaaagcccaggugaagcccgggcagacaugcagcgucgcgggauggggccaaaccgcuccucugggcaaacauucccacacacuucaggaagugaagaugaccguucaggaggauagaaaaugugagucugaccugcggcacuauuacgauagcacaauugaacucugcgugggggaccccgagaucaagaagaccuccuuuaaaggagauagcggcgggccgcuggucuguaacaagguggcccagggaauuguuucuuauggccgcaauaacgggaugccucccagagcuugcacgaaaguguccagcuucguccauuggaucaagaaaaccaugaagcgguacuga

SEQ ID NO: 70117 - RNA, 483 nt, Artificial Sequence
  derived and/or modified sequence opt5 from GZMH__Homo_sapiens__NP_001257710
augcagcccuuccugcuccugcuugccuuucugcucaccccuggcgcugggacagaggaaaucauuggaggccacgaggccaagccgcauagcagacccuacauggcguucgugcaauuucugcaggaaaaaucccggaagcgcugcgggggaauccuugucagaaaagacuucguucugacggcugcccacugucagggcucuagcauuaacgugacccucggggcccauaauaucaaggagcaggaacggacacaacaguuuauuccugugaaacgccccaucccucaccccgcuuauaacccuaagaauuucuccaacgauaucaugcugcugcagggagacucuggcggcccgcucgucugcaaggauguggcccaggggauucugagcuacggaaauaaaaagggcacacccccugggguuuauaucaaagugucccauuuucuucccuggauuaagagaaccaugaaacggcuguga

SEQ ID NO: 70118 - RNA, 795 nt, Artificial Sequence
  derived and/or modified sequence opt5 from GZMK__Homo_sapiens__NP_002095
augaccaaguucagcuccuuuucucuguucuuucucaucgugggcgccuacaugacacacgucugcuucaacauggagauuaucgggggaaaagaaguuagcccccauuccagaccuuuuauggcuucuauucaguauggcgggcaccauguguguggaggcgugcugaucgacccgcaauggguccuuacggccgcgcacugccaguaccgguucaccaaggggcagagccccacagugguucugggagcucauucccucucuaaaaaugaggccagcaagcagacccuggaaauuaaaaaguuuaucccuuucucccgcgugacaagcgauccccaaucuaacgacaucaugcuugucaagcugcagaccgccgcuaaacucaauaagcacgugaaaaugcugcacauuagauccaagacaagccugcggucuggcaccaaauguaagguuacgggcuggggagccaccgauccugacucccuccgccccagcgauacacugagagaggugaccgucacagugcuuucucggaagcugugcaacucccagagcuauuacaauggggacccuuuuaucaccaaagauauggugugugcuggcgacgccaaggggcagaaagauuccugcaagggagacucuggcgggccgcucauuuguaaaggagucuuccaugcgaucguuagcggcggccacgaaugcgggguggccacgaagcccggaauuuauacacugcuuaccaaaaaguaccaaacauggaucaaguccaaccuggugccuccccauaccaauuga

SEQ ID NO: 70119 - RNA, 774 nt, Artificial Sequence
  derived and/or modified sequence opt5 from GZMM__Homo_sapiens__NP_005308
auggaggccugcgugagcucccugcucguccuggcucuuggcgcccugucuguugggagcuccuucggaacccagaucauuggcgggagagaagugaucccccacucucggccuuacauggcgagccuccaacgcaacggaucccaucuguguggcggggugcuuguccacccgaagugggugcugacagcugcccauugccucgcccagagaauggcucagcugcggcugguucucggacugcacacgcuugacucucccggccugaccuuucauauuaaagccgcuauccagcacccucgcuauaagcccgugccugcccucgagaaugaucuggcgcuucugcaacucgacggcaaagucaagcccagcagaacaauucggccucuggcccugccguccaaacgccaggugguugcugccgggaccagauguagcauggcuggauggggccucacacaccaagggggacggcugucucgcgugcuuagagaacuggaucuccagguccuggacacccggaugugcaacaauucccgcuucuggaacggcagccuuucucccuccauggugugucuggccgcggauagcaaggaccaggccccuugcaagggggauucuggaggcccccucguguguggcaaagggagaguccuggcuggaguucuguccuuuagcucccgggugugcacagacaucuucaagccucccguggccaccgcugucgccccguacgugucuuggauccgcaaaguuacgggcagaagcgccuga

SEQ ID NO: 70120 - RNA, 585 nt, Artificial Sequence
  derived and/or modified sequence opt5 from H1F0__Homo_sapiens__NP_005309
augaccgagaacagcacauccgcccccgcugccaagccuaaaagagcgaaggcuucuaaaaagagcacggaccacccgaaauacuccgauaugaucguggccgccauucaggcugaaaagaaucgggccggcucuagccgccaauccauccagaaguauauuaaaucucauuacaaggucggggagaacgcugacagccagaucaaacuguccauuaagagacucguuaccacaggagugcugaaacagaccaagggcgugggggccagcggaucuuuccggcuugcgaaguccgaugaacccaaaaagagcgucgccuuuaaaaagaccaaaaaggagaucaaaaagguggcuacaccuaagaaagccucuaagcccaaaaaggcugccuccaaagcgccuacaaagaagcccaaagccaccccuguuaagaaagcuaagaaaaagcuggccgcuacgccgaagaaagccaagaaacccaagaccgugaaagccaagccugucaaggcuagcaaacccaagaaagcgaagccugugaaacccaaggccaaaucuuccgcuaagcgcgccggcaagaaaaaguga

SEQ ID NO: 70121 - RNA, 642 nt, Artificial Sequence
  derived and/or modified sequence opt5 from H1FX__Homo_sapiens__NP_006017
augagcguggagcuggaagaggcccuccccgucaccacagcugaaggcauggccaagaaaguuacgaaggcugggggauccgcggcccugucuccuagcaaaaagcggaaaaacuccaagaagaaaaaucagccgggcaaguacucucaacuugugguggagaccaucagacgccugggggaaagaaacggaagcucccucgccaaaauuuauacagaggcuaagaaaguccccugguucgaccagcagaauggccggaccuaccugaaguauucuaucaaggcccuugugcagaacgauacacugcuccaaguuaaagggaccggagcuaauggcagcuuuaagcugaaccgcaaaaagcuggagggcgggggagaaagacggggcgccccugcggccgcuacagcccccgcuccuaccgcccacaaagcgaagaaagccgcucccggggccgcuggaucccgcagagccgacaagaagccugcccggggccagaaaccggagcagcgcagccauaagaaaggggcuggagcgaagaaagauaagggcggcaaggccaaaaagacggcugccgccgggggcaaaaaggugaaaaaggcugccaagcccucugucccuaaagugcccaagggaagaaaauga

SEQ ID NO: 70122 - RNA, 390 nt, Artificial Sequence
  derived and/or modified sequence opt5 from H2AFJ__Homo_sapiens__NP_808760
augagcggcagagggaagcagggaggcaaagugcgggccaaggcuaaaucccgcucuagcagagccgggcugcaauuccccgucggacggguucaccgccuccugagaaagggcaacuacgcggagcgggugggggcuggagccccuguguaucuugccgcuguccuggaauaccucaccgccgagauccuggaacuugcuggcaaugccgcgcgcgacaacaaaaagacaagaauuaucccgcggcaucugcagcucgccauucgcaaugaugaggaacugaacaagcugcucggcaaagugacgaucgcucaagggggaguucugcccaauauucaggccgugcuucugccuaagaaaaccgagucccagaagacaaaaucuaaguga

SEQ ID NO: 70123 - RNA, 432 nt, Artificial Sequence
  derived and/or modified sequence opt5 from H2AFX__Homo_sapiens__NP_002096
augagcggcagagggaagaccggaggcaaagcccgggcuaaggccaaaucccgcucuagcagagcggggcugcaguuccccgugggacggguccaccgccuccugagaaagggccacuacgcugagcggguuggggccggagccccuguguaucuugcugccgugcuggaauaccucacagcugagauccuggaacuugccggcaacgcggcccgcgacaauaaaaagacgagaauuaucccgcggcaucugcaacucgcuauucgcaacgaugaggaacugaauaagcugcucggcggggucaccaucgcccagggaggcgugcugcccaacauucaggcuguucuucugccuaaaaagacauccgccaccguggggcccaaagcgccuucuggaggcaagaaagccacacaggcuagccaagaguauuga

SEQ ID NO: 70124 - RNA, 1119 nt, Artificial Sequence
  derived and/or modified sequence opt5 from H2AFY2__Homo_sapiens__NP_061119
augagcggcagauccgggaagaaaaagaugucuaaacugagccgguccgcccgcgcuggagugaucuuccccgucggcagacucaugcgguaccugaagaaagggaccuuuaaguaucgcauuucuguuggagccccuguguacauggcggcugugaucgaguaucuugccgccgaaauucuggagcucgcuggcaacgccgcuagagacaauaagaaagcccggaucgcgccgcgccacauucugcuugccgucgcuaacgaugaggaacugaaucagcuccugaagggggugacaaucgccagcggaggcguucugcccagaauccauccugaacuccuggcuaaaaagcggggcacgaaagggaaguccgagaccauucuuucucccccucccgagaagcgcggaagaaaagccacaagcggcaagaaagggggaaagaaauccaaggcggccaaaccucggaccagcaagaagucuaaaccgaaggacuccgauaaagaaggcacaagcaacucuaccuccgaggacgggcccggagauggcuucacaauccugagcucuaagucccucgugcugggccaaaaacuuagccugacccaguccgacauuucucacaucgggagcaugcgcgucgaaggaauugugcauccuacgaccgcugagaucgaucucaaggaggacauuggcaaggcccuggaaaaagcugggggaaaggaguuucuggaaacaguuaaagagcucagaaagucccagggcccccuggaaguggccgaggccgcugucagccagucuuccgggcuugcggccaaauucgugauccacugccauaucccucaauggggaagcgauaagugugaggaacagcuggaggaaaccauuaagaauugccucucugcugccgaggacaaaaagcugaaaagcguggccuuucccccguucccuuccggccggaacuguuuucccaagcagacagcugcccaggucacccuuaaagcgaucucugcucacuucgaugacagcuccgccagcucucugaagaauguuuacuuucuccuguucgauuccgaaagcauuggcaucuaugugcaagagauggccaagcuggacgcuaaauga

SEQ ID NO: 70125 - RNA, 1116 nt, Artificial Sequence
  derived and/or modified sequence opt5 from H2AFY__Homo_sapiens__NP_004884
augagcuccagaggcgggaagaaaaagucuaccaaaacaagccgguccgccaaggcuggagugaucuuccccgucggccgcaugcugagauacauuaaaaaggggcacccuaaguaucggaucggaguuggcgccccgguguacauggcggcugugcucgaguaucugacggccgaaauucuugagcuggccgggaacgcugcccgcgacaauaaaaagggaagagucacaccccggcauauccuccuggcuguggccaacgaugaagaacuuaaucagcugcucaaaggcguuacaauugcgucuggcggggugcugccuaacauccaccccgaacugcucgccaagaaacgcggaagcaagggcaagcuggaggcuaucauuaccccucccccugccaaaaaggcuaaauccccgucucaaaagaaacccgucagcaagaaagccgggggaaagaagggcgcgagaaaauccaagaaacagggggaggugagcaaggccgcuucugccgacuccacaaccgaaggaaccccugcugauggcuuuaccguucuuagcacgaaaucucuguuccucggccagaagcugaaucuuauccauuccgagauuagcaaccuggccggguuugaaguggaggccaucauuaaucccaccaacgcugacaucgaucucaaggacgaucugggaaauacacuggagaaaaagggcgggaaagaguucgucgaggcggugcucgaacugcggaagaaaaacggaccucuugagguggccggcgcugccgucucugccgggcacggacugcccgcuaaguuuguuauucauugcaauuccccgguguggggcgccgacaagugugaggaacuccuggagaaaaccgugaagaacugccuugcgcuggcugaugacaaaaagcucaaaagcaucgccuucccuuccaucggcucugggcgcaauggauuucccaagcagacagccgcucaacugauucugaaggccaucagcuccuacuucgucagcaccaugucuuccagcauuaaaacgguguauuuuguucucuucgauucugaaagcaucggcauuuacgugcaggagauggcuaagcuggacgccaacuga

SEQ ID NO: 70126 - RNA, 387 nt, Artificial Sequence
  derived and/or modified sequence opt5 from H2AFZ__Homo_sapiens__NP_002097
auggccggcgggaaggcuggaaaagacagcggcaaggccaaaaccaaggcgguguccagaucucagcgggcugggcugcaauuccccgucggacgcauccacagacaucucaaaagccggacaacgucccacggccgcguuggggccaccgccgcuguguacucugccgcuauucuggaguaucuuacagccgaagugcuggagcucgcgggaaacgccagcaaggaucugaaggucaaaagaaucaccccucggcaucuucagcuggcuauucgcggcgacgaggaacucgauucccugaucaaggccacaauugcuggcgggggagugaucccgcacauccauaaaucucugauuggcaagaaagggcagcagaagaccguuuga

SEQ ID NO: 70127 - RNA, 528 nt, Artificial Sequence
  derived and/or modified sequence opt5 from H2BFWT__Homo_sapiens__NP_001002916
augcugagaaccgaggugccccggcucccucgcagcacaacggccaucgucugguccugccaccugauggcuaccgccucugcgauggcuggcccgagcuccgaaacaaccucugaggaacagcuuauuacacaagagcccaaggaagccaacagcaccacaucccagaaacagucuaagcagagaaaacgggggcgccauggaccuagacggugucacagcaauugccgcggcgacuccuucgccaccuacuuuagacggguucugaagcaagugcaucaggggcucagccugucucgcgaggcuguguccgucauggauagccuugugcacgacauccuggauagaauugccacggaggcuggacaucucgcccggucuaccaaacgccagacaaucaccgcgugggaaacaagaauggccguucggcugcugcuccccggccagauggggaagcuggcugaguccgaaggaaccaaggccgugcuucgcacgagccuguaugcuauucaacagcagagaaaauga

SEQ ID NO: 70128 - RNA, 411 nt, Artificial Sequence
  derived and/or modified sequence opt5 from H3F3B__Homo_sapiens__NP_005315
auggccagaaccaagcagacagcucggaaaagcacgggcgggaaggcgccccgcaaacaacuggccaccaaggcugccagaaaauccgccccuucuacaggaggcgugaagaagccgcaccgguaccgccccgggaccgucgcucucagagagauccggcgcuaucagaaaagcacagaacugcuuauuagaaagcugccuuuccagcggcucguucgcgagaucgcccaggacuuuaaaaccgaucugagauuccaauccgcugccauuggagcgcuucaggaagccucugaggcuuaccuggugggccucuuugaagacacaaaccugugcgccauccaugcuaagcgggugaccauuaugcccaaagauauccagcuggcccgcagaauccgcggggagcgggcguga

SEQ ID NO: 70129 - RNA, 861 nt, Artificial Sequence
  derived and/or modified sequence opt5 from HAAO__Homo_sapiens__NP_036337
auggagagacggcugggcgugcgcgccugggucaaggaaaacagagggagcuuccagcccccuguuugcaauaaacucaugcaccaagagcagcugaaggugauguuuaucggaggcccgaacacccggaaagacuaccauauugaagagggggaagagguguucuaucagcuugagggagauaugguccugcgcgugcucgaacagggcaagcacagagacguugugauccggcaaggggagauuuuucugcuucccgcucgcgucccucauucuccccagagauucgccaauacagugggacugguuguggaacggcgcagacucgagacggagcuggauggccugcgguacuaugucggcgacaccauggaugugcucuuugaaaaaugguucuacuguaaggaccuggggacacagcuugcgccuaucauucaggaguuuuucuccagcgaacaauaucgcaccggaaagcccaucccugaucagcugcucaaagagccgcccuuuccucuguccacaagaucuaucauggaacccaugagccuugacgcuuggcuggauucccaccaucgggagcuccaggccggcaccccucugucucuguucggggacacauacgagacccaggugauugccuauggacaaggcagcuccgaagggcuccgccagaacgucgauguuuggcuguggcagcuugagggaagcucuguggugacgaugggcggcagacggcugucccucgcucccgacgauagccugcuuguccuggccgggaccucuuacgcuugggaaagaacacaaggauccguggcccucagcguuacccaggacccggcgugcaagaaaccucugggcuga

SEQ ID NO: 70130 - RNA, 1605 nt, Artificial Sequence
  derived and/or modified sequence opt5 from HABP2__Homo_sapiens__NP_001171131
augagccugcucgagucccuggaccccgauuggaccccugaccaguacgauuauucuuacgaagacuauaaccaagaggaaaauacaagcuccacgcuuacccacgccgagaacccggauugguacuauacagaagaccaggcugaucccugccagccuaaucccugugagcauggcggggacugccuggugcacggaucuaccuucacauguagcugccucgccccuuuuuccggcaacaagugucagaaaguccaaaauaccugcaaggauaaccccugugggagaggacagugccugaucacacagucuccuccguacuaucgguguguuugcaaacaucccuacaccggcccuagcuguucccagguggugcccgucugccgcccuaaucccugccaaaacggggcgacguguagcagacacaagcggcgcucuaaauuuaccugcgcuuguccggaccaguucaagggaaaguucugcgagauuggcuccgaugacuguuacgugggcgauggguauagcuacagaggaaaaaugaaucggacaguuaaccagcaugccugccuuuauuggaacucucaccuccuccugcaggaaaauuacaauauguuuauggaggacgccgaaacccacggcaucggggagcauaacuucugucgcaauccugacgcugaugagaagcccuggugcuuuauuaaagugacaaacgacaaggucaaaugggaauauugugauguguccgccugcagcgcucaagacguugccuacccugaggaaucucccaccgagcccuccacgaagcugccuggauucgauagcuguggcaagacagaaaucgcggagagaaaaauuaagcggaucuaugggggauuuaaauccaccgccggcaagcacccguggcaggcuucucuccagagcucccugccccuuacaaucagcaugccucaaggccauuucugcgggggagcccugauucaccccugcugggugcucaccgcugcccacuguaccgacaucaaaacacgccaucugaaggucgugcuuggcgaucaggaccugaaaaaggaggaauuucacgagcagucuuucagaguggaaaagauuuuuaaauacucccauuacaacgagcgggaugaaaucccucacaaugacauugcgcuccugaagcugaaacccgucgaugggcauugcgcccucgagagcaaguauguuaaaacggugugucugccggacggaucuuucccuagcggcuccgagugccacaucucuggguggggagugaccgaaacaggcaagggcagccgccagcuucuggacgcuaaggucaaacucauugccaacacccuguguaauuccagacaacuuuacgaucacaugaucgacgauagcaugaucugcgcugggaaccugcagaagcccggacaggacacaugucagggcgauucugggggaccucugaccugcgagaaagacggcacguauuacguguaugggauuguuuccuggggccuggaauguggaaagcggcccggcguguacacacaagucaccaaauuccugaauuggaucaaggccaccauuaagagcgagucuggguuuuga

SEQ ID NO: 70131 - RNA, 1242 nt, Artificial Sequence
  derived and/or modified sequence opt5 from HABP4__Homo_sapiens__NP_055097
augaagggcgcccuggggagccccguggcugccgcgggagcugccaugcaggaguccuucggcugcgucguugccaacagauuucaccaacuccuggacgaugaaucugacccuuucgauauccuucgggaggcugaacgcagacggcagcagcagcugcaacgcaaaagacgggacgaggccgcugccgcggccggggcuggaccgcgcggcgggagaagccccgccggagcuuccggccaucgggccggcgccgggggacgcagagaaucucagaaggagcggaaaagccucccugcgcccguggcucagcgcccugauucccccggcgggggacugcaggccccuggccaaaagagaaccccgcggcgcggggagcagcagggauggaaugacucuagaggccccgaaggcaugcuugagcgggcugaaagacgcagcuaccgggaguauagaccuuacgagacagaacgccaggccgauuuuacggccgagaaauuccccgacgaaaagccuggggaucgguuugacagagaucgcccccugcggggaagaggcgggccgcgcggaggcaugcgggggagaggacgcggcggcccugggaaccggguguucgacgcuuuugaucaaagaggaaagcgggaguucgaacgcuauggcgggaaugacaaaauugcggucagaaccgaggacaacaugggaggcuguggggugcggacauggggcuccggaaaggauaccagcgacguugagcccacagccccuauggaggaacccaccguggucgaagagucucagggcacacccgaagaggaguccccugcuaaagugccggaacucgagguugaagaggaaacccaggugcaagagaugacgcuggaugaguggaagaaucugcaggaacagaccagacccaaaccugaguuuaacauccgcaagcccgaaagcacagucccuucuaaggccguggugauucacaaauccaaguaccgggacgauauggucaaagacgauuaugaggacgauagccauguuuucagaaagcccgccaaugacaucaccucucagcucgagauuaacuuugggaaucugccgcgcccuggaagaggcgcucgcgggggaacacggggcgggagaggccggauccgcagagccgaaaacuacggaccccgggcggagguggugaugcaagaugucgcuccuaaucccgacgacccugaagauuuccccgcccuuuccuga

SEQ ID NO: 70132 - RNA, 867 nt, Artificial Sequence
  derived and/or modified sequence opt5 from HACD1__Homo_sapiens__NP_055056
augggcagacugaccgaggccgcugccgcggggagcggaucccgggcugccggcugggccgggucucccccuacacuccugccgcuuagccccacguccccucgcugcgcugccaccauggcuucuagcgacgaagauggaacaaacggcggggccuccgaggcgggagaagacagagaggcccccggcgaacggcgcagacugggcgugcucgcuaccgccuggcugacauucuacgauaucgcuaugaccgccggguggcuuguccuggcgauugccaugguucgguuuuauauggagaagggaacacaccgcggccucuacaaaucuauccagaagacccugaaauucuuucaaacguucgcucugcucgagauugugcauugucugaucgggauugugccuaccagcgucaucgugacaggaguucagguguccagcagaaucuuuauggucuggcuuauuacccacucuaucaagcccauucagaaugaagaguccgugguucuguuccucguggccuggacagucaccgaaaucacgcgguauagcuuuuacacauucucucugcuugaccaucugccuuauuuuauuaaaugggcucgcuacaacuucuuuaucauucucuauccggugggcguggccggggagcugcugaccaucuacgccgcucucccccacgucaagaagacaggaauguucuccaucagacugccuaauaaauacaacguuagcuuugauuauuacuauuuccuucugauuaccauggcgucuuacaucccccucuucccucagcuguauuuucauaugcuucggcaacgcagaaaggugcugcacggcgaggugauugucgaaaaagacgauuga

SEQ ID NO: 70133 - RNA, 765 nt, Artificial Sequence
  derived and/or modified sequence opt5 from HACD2__Homo_sapiens__NP_940684
auggccgcuguggccgcgaccgcugccgccaagggcaacgggggaggcgggggcagagcuggagccggggacgcuagcggaacacggaaaaagaaaggccccggcccucuggccacggcguaccucgucaucuauaauguugugaugaccgccggguggcuggugauugcugucggacuugugcgcgccuaccuggcuaagggcuccuaucacucucucuacuauagcaucgagaaaccgcugaaguucuuucagacaggggcccuucuggaaauucuccauugcgcgaucggaauuguucccuccucugugguccugaccagcuuccaagugauguccagaguuuuucugaucugggccgugacacacucugucaaggaggugcagagcgaagauuccgugcuccuguucgucaucgcuuggaccauuacagagaucauucgguacagcuuuuauaccuucucucuucugaaccaucucccuuaccugaucaaaugggcccgcuacacgcuuuuuauuguucuguaucccaugggcguguccggggaacuccugaccaucuacgcugcccugccuuucgugagacaggccggacucuauagcauuucucugcccaauaaguacaacuuuuccuucgacuauuacgcuuuucuuauccugaucaugauuagcuauaucccuauuuucccgcagcucuacuuucacaugauccaucaacggcgcaaaauucugucucacacagaggagcacaagaaauucgaauga

SEQ ID NO: 70134 - RNA, 699 nt, Artificial Sequence
  derived and/or modified sequence opt5 from HACD4__Homo_sapiens__NP_001010915
augggcccccuggcccucccugcuuggcugcagccgagauaccggaagaacgccuaucuuuucaucuacuaucugauucaauuuugcgggcacagcuggaucuucaccaauaugacagugcgcuuuuucuccuuuggaaaagacucuauggucgauacguucuacgcgauuggccucguuaugagacugugucagagcgugucccuucuggagcuccugcauaucuauguggggauugaaucuaaccaucugcucccccgguuucugcagcuuaccgagcgcaucaucauucuguucgucgugaucacaagccaggaagagguucaagaaaaguacguggucugcgugcucuuuguuuucuggaaucugcuugacauggugagauauaccuacuccaugcugucugucauuggaaucagcuacgcugugcucacauggcugucccagacccuguggaugccuauuuauccccucugugugcuggccgaggccuuugcuaucuaccagagccuuccuuauuucgagucuuuuggcacauacuccaccaaacugcccuucgaucucagcauuuauuucccuuacguccugaagaucuaucuuaugaugcuguuuaucgggauguacuucacguacucucaccucuauuccgaacggcgcgacauucugggaaucuuuccgauuaaaaagaagaaaauguga

SEQ ID NO: 70135 - RNA, 2730 nt, Artificial Sequence
  derived and/or modified sequence opt5 from HACE1__Homo_sapiens__NP_065822
auggagagagccauggaacagcugaaccggcucacccgcagccugagacgggcucgcacaguggagcuucccgaagacaaugagacggccgucuacacccugaugccuaugguuauggcggaucaacacagauccgugucugaacuccugagcaacuccaaguucgacgugaauuaugcuuuuggccgggucaaacgcucucuucugcauaucgccgccaacugcgggagcguggagugucucguucugcugcucaagaaaggagcuaauccgaacuaccaggauauuuccggcugcacaccccugcaccuugccgcuagaaaugggcagaagaaauguaugucuaagcugcucgaguauagcgccgacgugaacaucugcaauaacgaaggacugaccgcgauucauuggcuugccgucaauggccggacagagcugcuccacgaucuggugcagcauguuuccgacguggaugucgaagacgcuauggggcaaaccgcccugcacguggcuugucagaacggacacaagacaaccgugcagugccuccuggauagcggcgccgacaucaaucgcccuaacgucucuggcgcgacgccccuuuacuucgccuguucccaugggcagagagauaccgcucaaauucugcuccugcggggagccaaauaucuuccugacaagaauggcguuacaccccuggaucucugcgugcaagggggauacggcgagaccugugaggugcugauccaguaucacccucgccuguuucagacaaucauucagaugacccagaacgaagaccucagagagaacaugcugcggcagguccuugaacaucugagccaacagucugagucccaguaccucaaaauccugacgagccuugcugaaguggccacaaccaaugggcacaagcugcucucucuguccagcaacuacgacgcccagaugaaaucccugcuccgcauuguuagaauguucugccacguguuucggaucggaccgucuagccccuccaauggcauugauaugggcuauaacgggaauaagacaccuagaagccaagucuucaagccccuggagcuucuguggcauucucucgacgaguggcuggugcugaucgcuaccgaacuuaugaaaaacaagcgcgauuccaccgagauuacaagcauccuccugaaacagaagggacaggaccaggaugcggccucuaucccucccuuugaaccgccuggccccgggagcuacgagaaucuguccacgggaacccgggaaucuaaaccugacgcucucgccggcagacaagaggccagcgcugauugucaggacguuauuuccaugacagccaaccgccugagcgcggugauccaggcuuucuauaugugcugcucuugucagaugccucccgggaugaccagcccccgguuuauugaguucgucugcaagcacgaugaagugcuuaaauguuuugucaauagaaacccgaagaucauuuucgaccauuuucacuuccugcucgagugccccgaacugaugucccgcuucaugcauaucaucaaggcccaaccuuuuaaagaucggugugagugguucuacgaacaucugcacucuggacagcccgacuccgacauggugcacagaccuguuaaugagaacgauauucuucucgugcaccgcgacagcaucuuucgguccucuugcgaggucgugagcaaggccaauugugcuaaacugaagcagggcauugccguuagauuccauggcgaagaggggaugggacagggcgugguccgcgaaugguuugauauccuguccaacgagauugugaaucccgacuaugcucucuucacacaaucugccgaugggaccacguuucagccgaacagcaacuccuacgugaauccugaccaccugaacuauuuccgguuugcgggacagauccuuggccuggcccucaaucacagacaacugguuaacaucuacuucacacggagcuuuuacaaacauauucuggggauccccgucaauuaucaggauguggcuucuauugacccugaguacgccaagaaccuucaguggauccucgauaaugacauuuccgaucugggccuggaacucaccuucagcguggagaccgacgucuuuggagcuauggaagaggugccccugaagccuggcgggggaucuauccuuguuacacagaacaauaaagccgaauaugugcaacuggucaccgagcuccgcaugacaagagcgauucagccccagaucaacgccuuccugcagggcuuccacauguuuaucccgccuucccugauucaacuuuucgaugaguacgaacucgagcugcugcucagcgggaugcccgaaaucgacgugucugacuggauuaagaauacggaguauaccagcggauacgaacgggaggaucccguuauccagugguuuugggagguggucgaagacauuacacaggaggaaagagugcugcuucugcaguucguuaccggcuccagccgcgugccucaugggggcuuugcuaacaucaugggaggcucugggcuccaaaauuucacaaucgccgcugucccguauacccccaaccugcugccuacguccagcacaugcauuaauaugcuuaaacugcccgaguacccuuccaaggaaauccucaaagaucggcugcucguggcccugcacuguggaucuuacggcuauaccauggccuga

SEQ ID NO: 70136 - RNA, 1737 nt, Artificial Sequence
  derived and/or modified sequence opt5 from HACL1__Homo_sapiens__NP_036392
augcccgacagcaacuucgccgagagauccgaagaacaggugucuggcgcuaaggucaucgcccaagcgcugaaaacccaggauguugaauacauuuuugggaucgugggcauuccugugacagagaucgcuauugccgcccagcagcucggaaucaaguauaucgggaugcggaaugaacaagcugccugcuacgcugccagcgcgauuggauaucugacgucccgcccgggcgucugucuugugguuucugggcccggacugauccacgcccucggcggcauggcuaacgccaauaugaacugcuggccucugcuugugauugggggaagcuccgagagaaaucaggagaccaugggcgcuuuccaggaauuuccccaggucgaggccugucggcuguacacaaaauucucugcgcgcccuagcuccaucgaagccauucccuuugugaucgagaaggcuguuagaagcucuauuuaugggcggccuggagccugcuacguggacaucccggcugauuucgucaaccuccaagugaaugugaacuccaucaaauauauggagcgcuguaugucucccccuauuagcauggccgaaaccuccgccgucugcacagcugcgagcguuaucagaaaugccaagcagccccugcugauuaucggcaagggggcugccuacgcccaugcugaggaaucuauuaaaaagcucguggagcaguacaaacugccuuuucuucccaccccgaugggaaagggcguggucccugacaaccaccccuauugugugggcgccgcgcggucccgcgcucugcaguucgccgauguuaucgugcucuuuggggccagacugaauuggauccuucauuucggacugccuccccgguaccaacccgacgucaaauuuauucagguggauaucugcgcugaggagcucggcaacaauguuaagccugccgugacacugcuggggaacauucacgcugucaccaagcagcuccuggaggaacuugacaaaacgccguggcaauaucccccugagagcaagugguggaaaacccugcgcgaaaagaugaaauccaaugaggccgcgucuaaggaacucgccagcaaaaagucccugcccaugaacuacuauacaguguucuaccauguccaggagcagcuuccuagagauuguuuugugguuagcgagggagcuaacaccauggacaucggccggacagugcugcagaauuaucucccccgccacagacuggaugccgggaccuucggaacgaugggcgucggccugggguucgcuauugccgcggccgugguugcuaaggaccggucuccgggacaauggaucaucugcguggaaggcgauuccgccuuuggguucagcggaauggaggucgaaacaauuuguagauacaaccucccuaucauucugcuuguggugaauaacaauggcaucuaccagggguuugacaccgacacauggaaagagaugcugaaguuccaggaugcuaccgccguugugcccccuaugugccuccugcccaacucucacuaugaacaggucaugaccgccuuuggcggaaaaggcuacuucgugcaaacaccugaggagcuucaaaagagccugcgccagucccucgcugacacgaccaaacccucucugauuaauaucaugauugaaccgcaggcgacacggaaggcccaggauuuucauuggcugaccagaagcaacauguga

SEQ ID NO: 70137 - RNA, 2292 nt, Artificial Sequence
  derived and/or modified sequence opt5 from HADHA__Homo_sapiens__NP_000173
augguggccugcagagcuaucggcauucugagccgguucuccgccuuucgcauccucagaucucggggguacauuugucgcaacuucaccggaagcuccgcgcugcuuacaagaacgcacaucaauuauggcgucaagggggacguugcuguggugcggauuaacucucccaauagcaaagucaacacccuguccaaggagcuccauucugaauuuagcgaggugaugaaugaaaucugggccuccgaucagauccgcagcgccguucugauuucuuccaaaccuggaugcuucaucgcuggcgccgacauuaacaugcuugcugccuguaagacacugcaagaggugacccagcucagccaggaagcgcagagaaucgucgagaaacuggagaagucuacaaagccgauuguggccgcuaucaauggguccugccugggaggcggccucgaaguugccauuagcugucaauaccggaucgcuaccaaagaucgcaagacagugcuggggacccccgagguccuucugggagcccucccuggcgccgggggaacgcagagacugcccaaaauggugggcgugccugcggcucuugacaugaugcugaccgggcggucuauccgcgccgauagagcuaagaaaaugggacucgucgaccagcugguugaaccccugggcccuggccucaagccgcccgaggagcggacaauugaauaucuggaggaaguggccaucaccuuugccaaggggcuugcugauaaaaagauuuccccuaaacgcgacaagggacugguggagaaacucacagcguacgccaugaccauccccuucgucagacagcaaguguauaagaaaguugaagagaaggugcggaagcagacgaaaggccuguacccugcuccccuuaagauuaucgaugucgugaaaacagggaucgagcagggaagcgacgccggcuaucugugcgaaucccagaaguuuggggagcucguuaugaccaaagaaucuaaggcccugaugggacuguaccacggccaagugcucuguaagaaaaacaaguucggcgcuccgcagaaagaugucaagcaucuggccauucuuggggcgggacugaugggcgcugggaucgcccaggugagcgucgacaaaggacucaagacaauucugaaggaugccacccuuaccgcucuggacagaggccaacaacagguguuuaaagggcucaaugacaagguuaaaaagaaagcccugacauccuucgagcgcgauagcaucuuuucuaaccugacgggccagcucgacuaccaaggauucgaaaaggcugauauggugauugaggccgucuuugaggaccugucccuuaagcaccgggugcugaaagaaguugaggcggugaucccugaucauugcaucuucgccagcaauaccucugcucuccccauuagcgaaaucgccgcugucuccaagagaccugagaaagugauuggcaugcacuauuucucucccguggacaagaugcagcugcuggaaaucauuacaaccgagaaaacaagcaaggauaccuccgccagcgcgguugccgucgggcuuaaacagggaaaggugaucauuguggucaaggacggccccggguuuuacacgacacgcugucucgcuccuaugaugucugaggugauccggauccugcaggaaggaguugauccgaaaaagcuggacucccucaccaccagcuucggcuuucccgugggggccgcuacacuggucgaugaggugggcguugacguggccaaacacgucgccgaagaccuuggaaagguguucggcgagagauuugggggaggcaacccugagcugcucacccaaaugguuucuaaaggguuccugggacgcaaguccggcaagggguuuuauauuuaccaggaaggcgugaaacggaaggaucugaauagcgacauggauuccauccuugcuucucucaaacugcccccuaagagcgaggucuccucugacgaagauauucaguucagacuggugacacgcuuugugaacgaggcggucaugugccuccaggaaggaauccuggccacgcccgcugagggcgacauuggggccguuuucggacuuggcuuuccgccuugucucgggggacccuuccgguuuguggaucuguauggcgcccagaaaaucguggacagacugaagaaguacgaggcugccuaugggaaacaguucaccccuugccagcugcuugcggaucaugcuaauagccccaacaagaaauucuaccaguga

SEQ ID NO: 70138 - RNA, 1380 nt, Artificial Sequence
  derived and/or modified sequence opt5 from HADHB__Homo_sapiens__NP_001268441
augaccauccugacauaccccuucaagaaccucccuacggccagcaaaugggcucugagauuuuccauucggccgcuuucuugcagcucccagcugcgcgccgcgcccgcugugcaaaccaagaccaaaaagacacucgccaaaccuaauaucagaaacgucguugugguggacggcguccggacacccuuccugcuuucugggaccagcggacugcuccaccgcacauccgugccuaaggagguuguggauuauauuaucuuuggcaccgucauucaggaagugaagacgucuaauguugccagagaggcugcccugggggcuggauucagcgacaaaacccccgcccauacagugaccauggcguguaucuccgccaaccaggcuaugacaaccggcgucgggcugaucgccagcggacagugcgaugugauuguggcuggcggcgucgaacucaugucugacguuccuauccggcacucccgcaagaugagaaaacugaugcuugaucugaauaaggccaaaagcauggggcaacggcucucucugauuuccaaguuucgcuucaacuuucuugcgccggagcugcccgccgugagcgaguucucuacguccgaaacaaugggacauagcgcugacagacucgccgcugccuuugccgugucccggcuggagcaggaugaauacgcucugcgcucucacagccucgcgaagaaagcccaggacgagggccugcuuuccgaugucgugccuuucaagguucccgggaaagacaccgugacaaaggauaauggaaucagaccuagcucucuggaacagauggcuaaacucaagcccgccuuuauuaaaccguauggcaccgucaccgccgcuaacuccagcuuccugacagacggggccucugcgaugcuuaucauggcugaggagaaggcccuggccaugggauacaagccuaaggcuuaucuccgggauuuuauguacgugagccaagaccccaaagaccagcugcugcucggcccuacguaugccacccccaaaguucuggaaaaggcuggccuuacaaugaaugauauugacgccuucgaguuccaugaagcguuuuccgggcagauccuggccaacuucaaagcuauggauucugacugguuugccgagaauuacaugggacgcaagaccaaggugggccugcccccucucgaaaaauucaacaauuggggagggagccuuucccugggccacccguuuggggcuacaggauguagacucgucauggccgcggccaaccggcugagaaaggagggcggccaguacgggcugguggcugccugcgcugccggaggccaagggcacgccaugaucgucgaggcuuaucccaaauga

SEQ ID NO: 70139 - RNA, 996 nt, Artificial Sequence
  derived and/or modified sequence opt5 from HADH__Homo_sapiens__NP_001171634
auggccuucgugaccagacaguuuaugcggagcgucuccucuagcuccacagcuucugccagcgcgaagaaaaucauuguuaagcacgugacggugaucggcgggggacugaugggcgcugggauugcccaagucgccgcugccaccggacauacagugguucucguggaccagaccgaggauauccuggcuaaauccaagaaaggcauugaagagucucuucgcaaggucgccaagaaaaaguucgcggaaaaccccaaagccggggacgaguuuguggaaaagacacugagcaccaucgcuacauccaccgaugccgcuagcguugugcacucuacggaccucgucguggaggccaucguggagaaucugaaagucaagaacgaacuuuucaagagacuggauaaauuugcggccgagcauaccauuuucgcuuccaauacaagcucucuccagaucaccuccauugccaacgcuacaacccggcaggaccgcuuugccggacugcacuucuuuaauccuguuccggugaugaagcugguggaagucaucaaaacgcccaugacaagccaaaagaccuucgagucucucguggauuuuuccaaagcccugggcaagcauccuguuagcugcaaagacacacccggcuucauugugaacagacuucuggucccuuaccucauggaggcuauccggcuguaugaacgcgauuuucagaccuguggggacuccaauucuggacuuggcuucagccugaagggggaugcguccaaggaggacauugauaccgccaugaaacucggagcuggcuaccccauggggccuuucgaacugcuggacuaugugggacucgacacaacgaaguuuaucguugauggcuggcacgagauggacgccgaaaacccgcugcaccagcccagcccuucucuuaauaaacugguggccgagaacaaguucggcaaaaagaccggggagggauuuuacaaguauaaauga

SEQ ID NO: 70140 - RNA, 783 nt, Artificial Sequence
  derived and/or modified sequence opt5 from HAGH__Homo_sapiens__NP_001035517
augaagguggagguccugcccgcccucaccgacaacuacauguaucugguuaucgaugacgaaacaaaagaggcugccauuguggauccugugcagccgcaaaaggucguggacgcggcuagaaaacacggcguuaaacuuacgaccgugcugacaacccaucaccauugggaucacgccgggggaaaugaaaagcucgucaagcuggagagcggccuuaagguguacgggggagacgaucggaucggcgcccugacacauaaaauuacccaccucuccacacugcagguugggucucugaacgugaagugccucgcuacccccugucacacgagcggacauaucugcuauuucgucuccaaaccuggcggcucugaacccccugccguguuuaccggggacacacuguucguggcuggauguggcaaguuuuacgaggggaccgccgaugagaugugcaaagcgcuucuggaaguccucggacgccugcccccugacacaagaguuuauuguggccacgaguacaccauuaauaaccuuaaguucgcccggcauguggaaccggggaaugcugccauccgcgagaagcuggcuugggccaaagagaaguauagcaucggagaacccacggugccuuccacacucgcggaggaauuuaccuacaaccccuucaugagaguccgggagaaaacagugcagcagcacgccggcgaaaccgauccuguuaccacaaugcgcgcugugagacgggagaaggaccaauuuaaaaugccccgcgauuga

SEQ ID NO: 70141 - RNA, 1350 nt, Artificial Sequence
  derived and/or modified sequence opt5 from HAL__Homo_sapiens__NP_001245262
augcugcucgcccugagaaucaacgugcuugcuaagggcuacagcgggauuucccuggagacccucaaacaggucaucgaaauguucaaugccucuugccugcccuauguuccugagaagggaacagugggcgcgagcggggaccuugcuccgcugucccaccucgcccugggacuggugggcgaagggaaaauguggucucccaagagcggaugggccgaugcuaaauacguccucgaggcccauggccugaagccugugauucuuaagcccaaagaaggccuggcucucaucaacgggacgcaaaugauuaccucccugggaugugaggccguugagcgggcgucugccaucgcucgccaggccgacaucguggcugcccuuacacuggaaguccucaagggcaccacaaaagcguuugauaccgacauucacgcccugagaccucaucgggggcagaucgagguggcuuuccgcuuuagaagccugcucgauuccgaccaccaucccagcgaaauugccgagucucaccgguucugcgaucgcguucaggacgcuuauacacugagauguugcccucaagugcacggagucgugaaugauaccaucgccuuugugaagaacauuaucacgaccgagcuuaauuccgccacagacaacccgauggucuucgcuaaucggggcgaaaccguuagcgggggaaacuuucauggcgaguaccccgcgaaagcccuggauuaucucgcuauuggcauccacgaacuggccgccaucucugagcgcagaauugaacggcuuuguaauccuucccugagcgagcuccccgcuuuccugguggccgaagggggacugaacucuggcuuuaugaucgcgcauugcacagcugccgcccucguguccgagaauaaggcucugugucacccuagcuccgucgacucucuuagcaccuccgccgcuacggaggaucacgugagcaugggagggugggccgcgcgcaaggcccugagaguuauugaacauguggagcagguccucgcuaucgaacugcuugccgcuugccagggcauugaguuccugcggccccucaaaacaaccacaccgcuggagaagguguacgaccugguucgcucuguggucagaccuuggaucaaagaccgguuuauggcccccgauaucgaagcggcccacagacuccugcuugagcagaaggugugggaagucgcugccccuuauauugagaaauaccgcauggaacauauccccgagucccggccccugagcccuaccgcuuucucucuccaauuucugcacaagaaaagcaccaagauuccggaguccgaagaccuguga

SEQ ID NO: 70142 - RNA, 255 nt, Artificial Sequence
  derived and/or modified sequence opt5 from HAMP__Homo_sapiens__NP_066998
auggcccugagcucccagaucugggcugccugccuccugcuucugcuccugcuugcgucucugaccagcggcuccguguucccccaacagacagggcagcucgcugagcugcagccucaagacagagccggagcccgggcuucuuggaugccgauguuucagcgcagacggcgcagagauacgcacuuccccauuuguaucuuuugcuguggcugcugucaucggagcaagugcgggauguguugcaaaaccuga

SEQ ID NO: 70143 - RNA, 648 nt, Artificial Sequence
  derived and/or modified sequence opt5 from HAND1__Homo_sapiens__NP_004812
augaaccuggugggcagcuacgcccaccaucaccaucaccaucacccccacccugcucauccgaugcuccacgagcccuuccuguuugggccugccuccagaugccaucaggaacggcccuauuuccagucuuggcuucugagcccugcggacgcugcccccgauuuuccugccggaggcccgcccccugcugccgcugccgcggccaccgcuuacgggcccgacgcccgcccuggacagucccccggcagacucgaggcucuugggggacggcugggccgcagaaagggcucugggccgaaaaaggaacggcgcagaacagagagcaucaauuccgccuucgcggaacugcgggaguguauuccuaacguccccgccgauacgaaacucucuaagaucaaaacccugcgccuggcuacaagcuauauugccuaccucauggacguucuggcuaaggaugcccaguccggagacccugaggccuuuaaggcugaacuuaaaaaggcggauggcgggagagagagcaaacggaagcgcgaacugcagcaacacgagggauucccucccgcccucggccccguggagaaaagaaucaaggggcggaccggauggccgcaacaggugugggcucuggaacuuaaucaguga

SEQ ID NO: 70144 - RNA, 654 nt, Artificial Sequence
  derived and/or modified sequence opt5 from HAND2__Homo_sapiens__NP_068808
augagccuggugggcggguucccccaccauccugucguucaccaugagggauacccguuugccgcugccgcggcugccgccgcugccgcugccgcguccagaugcucucacgaagagaaccccuauuuccauggcuggcucaucgggcacccugaaaugagcccucccgacuacuccauggcccugucuuauagccccgaguacgcuuccggagccgcuggccuugaucacucucauuaugggggagugccuccgggcgccgggcccccuggccugggaggcccccggccugugaagcgcagagggaccgcgaaucggaaagaacgcagacggacacagagcauuaacuccgccuuugcugagcuccgcgaguguauccccaaugucccggccgacacgaagcugagcaaaauuaagacccuuagacuggcuacaucuuacaucgccuaucucauggaucugcuggccaaagacgaucaaaacggagaagcugaggcguucaaggccgaaauuaagaaaaccgacgugaaggaggagaaacggaagaaagaacucaaugagauccugaaguccacaguuagcucuaacgauaagaaaaccaagggccgcacaggguggccucagcacgugugggcucuugaacugaaacaguga

SEQ ID NO: 70145 - RNA, 1113 nt, Artificial Sequence
  derived and/or modified sequence opt5 from HAO1__Homo_sapiens__NP_060015
augcugcccagacucaucugcauuaacgacuacgagcagcacgccaagagcgugcugccuaaauccaucuaugauuacuaucggucuggcgcuaaugacgaagagacccuugccgauaacauugcggcuuucagccgcuggaagcuguacccgagaaugcuccggaaugucgccgaaacagaccuguccacgucuguucuugggcaacgcgugagcaugcccaucugugugggagccaccgcuaugcagagaauggcccaugucgauggcgagcuggcuacagugcgggccugccagucccucgggaccggaaugaugcugucuagcugggcgacauccagcauugaagagguugccgaggcuggcccugaagcccugcgcuggcuccagcuguauaucuacaaagacagagaggugaccaagaaacuuguccggcaagcugaaaagaugggguauaaggccaucuuugugacaguugauacccccuaccugggaaaccgccucgacgaugugagaaaucgguucaaacugccuccccagcuucgcaugaagaacuuugagacgucuacccuguccuucagcccugaggaaaauuuuggcgacgauucuggccucgcggccuacgucgcuaaagccauugacccguccaucagcugggaggauauuaaguggcugagacggcugacaucucuccccaucguggcuaaagggauucugcgcggagacgacgccagagaagccgugaagcacggccuuaacgggauccuggucuccaaucauggagcucggcagcucgauggcguuccugcgaccauugacgugcugcccgagaucguggaagccgucgaggggaagguggagguuuuccuugauggaggcgugagaaaaggcacagacguccugaaggcucucgcccugggggccaaagcuguguuuguuggacgcccuaucguguggggccuggccuuccagggggaaaagggaguccaagaugugcucgagauucugaaagaagaguuucggcuugcgauggcucugagcggcugucagaacgucaaggugaucgacaaaacccucguuagaaagaauccccuggccguguccaagauuuga

SEQ ID NO: 70146 - RNA, 1149 nt, Artificial Sequence
  derived and/or modified sequence opt5 from HAO2__Homo_sapiens__XP_011539860
augagccuggugugccucaccgacuuccaggcccacgcuagagagcaacuguccaagucuacacgggauuuuaucgaaggcggggccgacgauagcauuacgcgcgacgauaacaucgcggcuuucaaacggauuagacuucgccccagauaccugcgggacgucuccgagguugauacccgcacaaccauccagggagaagagauuucugccccuaucuguaucgccccgacaggcuuucauugccucguguggcccgacggggaaaugagcaccgcuagagccccugagggacugcggugguuccagcuuuaugugcaccccgaucugcagcucaauaagcaacugauucagcgcgucgagucccugggcuuuaaagcucucgugaucacacuggacaccccuguuugugggaacagacggcaugauauucgcaaucagcuuagacggaaccugacgcucaccgaccugcagucucccaagaaaggaaaugccaucccuuacuuccaaaugacaccgauuagcaccucccuuugcuggaacgaucugagcugguuucagucuaucacacgccuccccauuauccugaagggcauccugaccaaggaagacgcggagcucgccgugaaacacaauguccagggcauuaucguguccaaccaugggggaagacagcuggacgaaguucuugcuagcauugaugcccugacggagguggucgcugccgugaagggcaaaaucgagguguaucucgacgggggaguccggacaggcaaugauguucugaaggcgcuugcccugggggcuaaauguauuuuccucggaagaccuauccuguggggccuggccugcaaggcugccggccgcucucuccgguccaucgaaaccuggagcucuuuucccggguguaagaaaaagggaccuauuacaagacugcuucgccugcccaccggcgggucccaaacccacagcacagugugcgacgccgugcucccgggaccucacuccguccggagacugauggcucauaucucucacauuagcaacacgaccacacccgugcuucaggcgcugcagaccccuguuuuccccaaauguuccaugcccuuuuucgugagccucacaaucauuugcuguucucuggccuga

SEQ ID NO: 70147 - RNA, 1809 nt, Artificial Sequence
  derived and/or modified sequence opt5 from HAP1__Homo_sapiens__NP_001073339
augagacccaagcggcugggccgcugcugugccgggagcagacucggaccuggcgacccggcugcccugaccugcgcgcccuccccuucugcuagccccgccccugagcccuccgcccagccucaagcucgggggacaggacagcgcgugggcucuagagccacgagcgggucccaguuccuuucugaagcucggaccggagcccgcccggcgagcgaggccggcgcuaaagccggcgcuagacggcccuccgccuuuagcgcgauccagggggauguccgcucuaugccugacaacuccgaugcccccuggacaagauucguuuuucaaggaccuuucggcagccgggcuaccgggcgcggaacaggcaaggccgcugggauuuggaaaacccccgccgccuacgugggaagacggccgggcgugucuggcccugaacgcgcugcguuuaucagagagcuggaagaggcccucugucccaaucugccuccucccgucaagaaaauuacacaggaggacgugaagguuaugcuuuaucugcucgaagaggugugcaccgcuuuccugauccagcugcucccuccggucugggaauccgugacguacgggaugguucugcagcgggagagagaucuuaacaccgccgcccgcauuggacaaagccuggugaagcaaaauucuguccucauggaggaaaacuccaaacuggaggcccuucugggcagcgcuaaggaagagauccucuaucugcggcaccaggugaaucugagagacgaacuccugcagcuuuacuccgauucugacgaggaggaugaagacgaggaagaggaagaggaggaaaaagaggcggaagaggaacaggaggaggaagaggcugaagaggaucugcagugugcccaucccugcgacgccccuaagcucaucagccaggaggcucugcuucaccaacaucacuguccccagcuggaagcccuccaggagaaacugcgccugcucgaagaggaaaaccaucagcugcgggaggaggcuucccaacuugauacacuggaagacgaggaacagaugcucauucuggagugcguggaacaguuuagcgaggccucucagcaaauggcggagcuuuccgaaguccugguucucagacuggagaauuaugaacgccagcagcaggagguggcccggcugcaagcucaggugcucaagcugcagcagagaugucgcauggaaacccuuccuggguuccaagagacacuggccgaggaacuccggaccagccugagacgcaugaucucugaccccgucuacuuuauggagcggaacuaugaaaugccgagaggagauacgagcucccugcgguacgacuuccgcuacucugaggauagagaacaggugcggggcuuugaggcugaggaagggcuuaugcucgccgcggacauuaugagaggagaggauuucacacccgccgaagaguuuguuccccaggaggaacugggcgcugccaagaaagugccugcugaggaaggcgucauggaggaagccgagcuggugagcgaggaaaccgaggggugggaagagguugaacucgagcuggacgaggccacacgcaugaauguggucaccuccgcucuugaagcgagcggacugggccccucucaccucgauaugaacuaugugcugcaacagcuggccaauuggcaggacgcucacuaccggagacagcuucgcuggaagaugcuccaaaaaggggagugcccucauggagcccugcccgccgcuuccagaaccagcugucggucuuccugccgcuga

SEQ ID NO: 70148 - RNA, 1065 nt, Artificial Sequence
  derived and/or modified sequence opt5 from HAPLN1__Homo_sapiens__NP_001875
augaaaagccugcuccugcuugugcugaucuccauuugcugggccgaccaccucucugauaacuacacccuggaccaugauagagcuauccacauucaggccgagaauggcccccaucuucuggucgaagcggagcaagcuaagguuuucagccaccgcgggggaaacgugacacucccuuguaaguuuuaucgggacccgacggccuucggcuccgggauccauaaaauuagaaucaaguggaccaaacugacaucugauuaccugaaggaaguggacgucuuugugagcaugggauaucacaagaaaaccuacggcggguaucagggacggguuuuccucaagggcggcuccgauucugacgccagccuggugaucacagaucuuacccuggaggacuacgggcgcuauaaaugcgaagucauugagggacucgaggaugacacagugguuguggcucuggaucuucagggcgucguguuucccuacuucccuagacuggggcgguacaaucucaacuuucacgaagcccagcaggcuugucuggaccaagacgccgugaucgcguccuucgaucagcuguaugacgccuggcgcggaggccucgauuggugcaaugcuggguggcugagcgacggaucuguccaguaccccauuaccaagccuagagagcccuguggcggccaaaacacgguuccuggggugcggaauuauggauuuugggauaaagacaagucccgcuacgauguguucugcuuuaccagcaacuucaauggcagauuuuauuaccuuauccauccgacaaagcugaccuaugacgaagccguccaggcuugucucaacgauggggcccagauugcgaaagugggacagaucuucgccgcuuggaagauucugggcuacgaccggugcgaugccggguggcuugcugacggaucuguucgcuaccccaucuccagaccucggcgcagauguagccccacagaggccgccgugcgguucgucggcuuuccugacaaaaagcacaaacuguauggcguguacugcuucagagcuuauaauuga

SEQ ID NO: 70149 - RNA, 1209 nt, Artificial Sequence
  derived and/or modified sequence opt5 from HAPLN4__Homo_sapiens__NP_075378
auggugugcgccagagcugcccugggccccggggcgcucugggcugccgccuggggaguccugcuucugaccgcuccugccggcgcucagcgggggcgcaagaaaguugugcacgugcucgagggagaaagcggcuccgucgugguucagacagccccgggacagguggucucucauagagggggcacgaucgugcugcccugucgguaccacuaugaggcggccgcucauggccacgacgggguucgccuuaaguggaccaaaguggucgauccucuggccuucacagacguguuuguggcucucggaccccagcauagagccuucggcagcuaccgggggcgcgcggaacugcagggagauggcccuggggacgccucccugguccucagaaacguuacccugcaagauuauggacgguacgagugcgaagugacaaaugagcuugaggacgaugcuggcauggugaagcuggaccucgaaggcgucguguuucccuaucacccucgcgggggaagauacaaacugaccuucgccgaggcucagcgggccugugccgaacaggauggcauucuugcuucugcggagcagcugcacgccgcuuggcgcgacgggcucgauuggugcaacgccggauggcugagagacggcagcguucaauauccggugaaucggccccgcgagccuugugggggacugggcggcacaggguccgccggaggcgggggagaugcuaacggcgggcucagaaauuacggcuaccggcauaacgccgaagagagauaugacgcguuuugcuucaccucuaaucugcccggacgcgucuuuuuccuuaagccucugcggcccgugccguuuagcggcgcugccagagccugugcugcccgcggggcugccguugcgaaggugggacaacucuucgccgcuuggaaacugcagcuucuggaccggugcacggccggcuggcucgcugauggguccgccagauacccuaucgucaacccccgcgcgcgguguggaggcagacgcccuggggugcggagccugggcuuucccgacgccaccagacgccuguucggagucuauugcuaccgggcucccggcgccccugauccggcucccgggggauggggcugggggugggccggaggcgggggcugggccggaggcgcuagagacccugcggccuggacaccccuccacguguga

SEQ ID NO: 70150 - RNA, 1446 nt, Artificial Sequence
  derived and/or modified sequence opt5 from HARS2__Homo_sapiens__NP_001265660
augccccugcucggccugcuuccuagacgggccugggcuagccugcucucccagcugcuucgcccgcccugcgccucuuguaccggggcggugagaugccaaagccagggaacacgggaccuguccccucagcacauggucguucgcgagaagauccucgaucuggugauuucuuguuucaaaagacauggcgcuaaggggauggacacgcccgccuuugaacugaaagagacccucacagaaaaguacggagaggauagcggccugauguaugaccuuaaagaucaagggggagaacugcucucccugcgguacgaccuuaccgugccuuucgcccgcuaucuggcuaugaacaaggucaagaaaaugaagagauaccacgugggcaaaguuuggcggcgcgagucucccacaaucgugcagggcagauaucgggaguuuugccagugugauuucgacauugccgggcaguuugauccuaugaucccggacgcugaaugccucaagauuaugugugagauccugagcggacugcagcucggcgauuuccugaucaaagucaaugaccgcagaauuguggaugggauguuugccguuugcggagugcccgaauccaaguuccgggcgaucuguagcucuauugacaaacuugacaagauggccuggaaggauguccgccaugagaugguggugaaaaagggccuggcuccugaggucgccgacagaaucggggauuacguucaaugccacggaggcgugucccucguggaacagauguuucaggacccccggcugagccagaacaaacaagcucuugagggccugggggaucucaagcugcuguucgaauaucucacccuguuuggaauugccgacaaaaucucuuucgaucuuucccuggcgagaggccucgacuacuacacaggggucauuuaugaggccgugcugcuucagaccccuacgcaggcuggagaggaaccccugaauguuggcagcguggccgcugggggacgcuacgauggccucgucggcauguuugacccgaaggggcauaaggugccuuguguuggacugucuaucggcguggagcggaucuucuauauugucgaacaaagaaugaaaaccaagggggagaaagugcgcacaaccgaaacacaggucuucguggccacgccccagaagaacuuucugcaggagcggcucaaacugaucgccgaacuuugggauuccggaauuaaggcugagaugcuguacaagaauaacccuaaacuccugacccaacugcacuauugcgagagcacaggcaucccccuuguugugauuaucggggaacaggagcucaaggaaggcgucaucaaaauuagauccguggcgucucgcgaggaaguugccaucaagcgggagaauuucguggcugagauucagaaaagacugagcgaauccuga

SEQ ID NO: 70151 - RNA, 1410 nt, Artificial Sequence
  derived and/or modified sequence opt5 from HARS__Homo_sapiens__NP_001244969
auggccgagagagcugcccuggaagaacucgugaagcugcagggcgaacggguccgcgggcuuaaacaacagaaggcgagcgcugagcugaucgaagaggagguugccaaacuccugaagcucaaagcccagcugggacccgacgaauccaagcagaaguucgugcucaaaaccccuaaggagacacugaugggcaaauacggggaagauucuaagcugauuuaugaccucaaagaucaaggaggcgagcugcuuagccugagauacgaccucacggugccguuugcucgguaucuggccaugaacaaacuuaccaauaucaagcgcuaccacauugcuaaggucuauagacgggauaaccccgccaugacacgcgggagauaccgggaguucuaucagugcgacuuugauaucgcgggaaauuucgacccuaugauucccgaugccgaaugucugaagaucaugugcgagauccucuccucucugcagauuggcgacuuucuggugaaaguuaacgaucgcagaauccucgacggcauguucgcuauuuguggggugagcgauuccaaguuucggaccaucugcucuagcgucgacaaacuggacaagguguccugggaagagguuaaaaaugaaauggugggagagaagggccuugccccugaggucgcugaucgcauuggggacuacgugcagcaacauggaggcgugagccuggucgaacagcuccugcaggaucccaaacuuucucagaacaagcaagcccuggaggggcucggagaccugaagcugcuuuucgaauaccugacacuuuuuggcaucgaugacaaaauuuccuucgaucugagccucgcgagaggccuggacuauuacaccgggguuaucuaugaggccgugcuucugcagaccccugcucaggccggagaggagccgcucggcguggggucugucgcugccggaggccgguacgaugggcuggugggaauguuugaccccaagggccgcaaaguuccuugugugggccuguccaucggggucgagagaauuuucagcaucguggaacaacggcucgaggcccuggaagagaagauuagaacaacggaaacccagguucuuguggcuucugcgcagaagaaacugcucgaggagcgccugaagcuggucuccgaacuuugggaugccggaaucaaagcugagcuccuguauaagaaaaaucccaagcugcucaaccagcugcaauacugcgaagaggccggcauuccucuuguggccaucaucggggagcaggaacugaaggacggagucauuaaacuccggagcgugacauccagagaggaaguugacgugcgccgggaggaucuggucgaagagaucaagagacgcaccggccagccccuguguauuugcuga

SEQ ID NO: 70152 - RNA, 1734 nt, Artificial Sequence
  derived and/or modified sequence opt5 from HAS1__Homo_sapiens__NP_001284365
augagacaggacgcccccaagccuaccccggcugccugccgguguagcggccuggcgcgcagagugcucacaaucgcuuucgcccugcuuauucuggggcucaugacgugggccuacgcugccggagucccccuggcuuccgaucgguauggccuucuggccuuugggcucuacggagcguuccugucugcccaccugguugcucaaagccucuuugccuaucuggagcaucgcagaguggcugccgcggcccggggcccucuugacgcugccaccgcucgcuccguggcccugacaaucucugccuaccaggaagaucccgcuuaucucagacagugccuggcgagcgcccgggcccuucuguacccucgcgcuagacuccggguccugauggugguugacgggaaccgcgccgaggaucuguauaugguggacauguucagagaagucuuugcugaugaggaccccgccaccuacgugugggauggaaauuaccaccagccuugggaaccggcggcugccggcgccguuggcgcuggggccuaucgggagguggaggcugaagaccccggacgccucgccgucgaggcgcuggugagaacacggagaugugugugcgucgcccaacgcuggggcgggaaacgggaaguuauguacaccgcuuucaaggcccuuggagauuccguggacuaugugcaggucugugauucugacacaagacuggacccuauggcucuccuggagcuugugcgcguucuggaugaggacccccgggugggcgccgucgggggagaugugcgcauucucaacccucuggacagcuggguuuccuuucugagcucucucagauacuggguggcguucaaugucgaacgggccugccaguccuauuuucauugugugagcugcaucucuggcccccugggccuuuacagaaacaaucugcuccagcaauuccuggaggcuugguauaaccagaaauuucuugggacccacuguacguucggagaugaccgccaucugaccaaucggaugcucuccaugggcuacgccacaaaguacaccagcagaucucgcugcuauuccgaaacaccgagcuccuuucugcgguggcugucucagcagaccagauggagcaaauccuacuuccgggaguggcucuauaacgcucugugguggcaccgccaccaugccuggaugacguacgaagccgucgugagcgggcuuuuccccuuuuucguugcugcgacagugcugagacucuuuuaugccggacggccuugggcucugcuguggguccuucucugugugcaaggcguugcccuggccaaggcugccuucgcggcuuggcugagagggugccuccgcauggugcugcuuucucuguacgccccucucuauaugugcggacugcugcccgccaaguuucuugcucucgucaccaugaaucaguccggcuggggcacaagcgggcggagaaaacuggccgcgaacuacgugccccugcucccucuggcucuuugggcccugcuccugcugggaggccuugugcgcucuguugcccacgaggcuagagccgauuggagcgggccgucccgggcugccgaggcguaccaucucgccgcuggagccggcgcuuaugucggguacuggguggccaugcugacccuguauugggugggcguccgcagacucugucggcgcagaaccggaggcuaccgggugcagguuuga

SEQ ID NO: 70153 - RNA, 1659 nt, Artificial Sequence
  derived and/or modified sequence opt5 from HAS2__Homo_sapiens__XP_011515304
augcacugcgagagauuccuguguauccuccggauuaucggcaccacacuguuuggggugagccuucugcucggaauuacggccgcuuacaucgucggcuaucaguucauucaaaccgacaacuacuauuuuuccuucgggcuguacggagccuuucuugcgucucaucugaucauccagagccucuucgcuuuucuggaacaccgcaagaugaaaaagucccuggagacacccauuaaacucaauaagaccguugcccugugcaucgccgcuuaucaggaagauccugacuaccuuagaaaaugucugcagucugugaagcggcucacauauccgggcauuaagguggucauggugaucgaugggaacagcgaggacgaucuguacaugauggacauuuucuccgaaguuaugggacgcgauaaaucugccaccuacaucuggaagaauaacuuucaugagaaaggccccggcgagacagacgaaagccacaaggaguccagccaacaugugacccagcuuguccugucuaauaaauccauuugcaucaugcagaaguggggagggaagagagaagugauguauacggcuuuccgggcccucggccgcagcguugauuacgugcaggucugugacucugauaccaugcuggacccugcguccagcguggagauggugaaaguccuggaggaagaucccaugguugggggagugggcggggacgugcaaauccucaacaaguaugacucuuggauuuccuuucugagcuccgucagauacuggauggccuucaauaucgagcgggcuugccagucuuauuuuggaugugugcagugcauuagcggcccucuuggcauguaccgcaacucccugcuccacgaguucguugaagauugguauaaucaggaguucauggggaaccaauguagcuuuggagacgauagacaccugacaaaucgggugcuuucucugggcuacgccaccaaauacacagcucgcuccaagugccucaccgaaacgcccaucgaguaucugagauggcugaaccagcagacacgguggagcaaaucuuacuuccgcgaauggcucuauaaugccaugugguuucauaagcaccaucuguggaugaccuacgaggcgauuaucacaggguucuuuccuuucuuucuuaucgccaccgucauucaacuguucuauagaggaaaaaucuggaacauucuccuguuucuucugaccgugcagcucguuggccugaucaagagcuccuucgcuucuugucugcgggggaauauugugauggucuuuaugagccucuacuccgugcuguauaugagcucucuucugccggccaagauguucgcuaucgccacaaucaacaaagccggauggggcacguccggcagaaagaccauugucgugaacuuuaucgggcucauucccguuagcgugugguucacaauccugcugggaggcgucauuuucaccaucuacaaagaaucuaagcgcccuuuuuccgagagcaaacagacagugcuuauuguugggacccuccuguacgcuugcuauugggugaugcugcucacgcuguacgucgugcuuaucaauaagugcggacggagaaagaaaggccagcaauaugacauggugcuggauguuuga

SEQ ID NO: 70154 - RNA, 1662 nt, Artificial Sequence
  derived and/or modified sequence opt5 from HAS3__Homo_sapiens__NP_005320
augcccgugcagcugaccacagcccucagagucguuggcacgagccuguucgcucuugccgugcucgggggaauccuggcggcuuacgugaccggcuaucaauuuauucacacagagaagcauuaccuguccuucgggcuuuauggagccauccugggccuccaucugcugauucagucucucuuugccuuccuggaacaccggcgcaugagacgggcugggcaggcccuuaaacugccuagcccgcgcagaggauccgucgcucucugcaucgccgcguaccaggaggaccccgauuaucugcggaagugucuucgcucugcccaaagaauuagcuuuccugaccugaaagugguuaugguggucgauggcaaccggcaggaagacgcuuacaugcucgauaucuuccacgaggugcugggcgggaccgaacaggccggauuuuucguuuggcgcuccaauuuucaugaggcuggcgagggggaaacagaggccucucugcaggaaggaauggacagagugcgggaugucgugcgcgcgagcaccuucuccugcaucaugcaaaaguggggcgggaaaagagaggugauguauacagccuuuaaggcucucggagacagcgucgauuacauucagguuugugacucugauaccgugcuggaccccgccugcacgaucgagaugcuucgggugcuggaagaggauccucaggucggcggcguugggggagacgugcagauucucaacaaguacgacuccuggaucagcuuccugucuuccgugcgcuauuggauggcuuuuaaugucgaaagagccugucaaagcuacuucggcugcgugcaguguauuucugggccccuuggaauguaucggaacucccugcuccagcaauuccuggaggauugguaccaccagaaauuucugggcagcaagugcuccuucggggacgauagacaccucaccaaucgcguucugucucuuggauaucggacaaaauacaccgccagaagcaagugucugacagaaaccccuacgaaauaucuccgcuggcugaaccagcagacacggugguccaagagcuacuuuagagaguggcuuuacaauucucugugguuccauaagcaccaucucuggaugaccuaugaguccguggucacaggcuuuuucccguuuuuccugaucgcuaccgugauucaacuguuuuaccgcggccggaucuggaacauccuccuguuccuucugaccguccagcucguggggauuaucaaagcgacauaugccugcuuucugagaggaaaugcugaaaugauuuucaugagccuguacucucuucucuauaugagcucccugcugcccgccaagaucuuugccauugcuacgaucaacaaaucuggcugggggaccagcggacgcaagacaaucguugugaauuucauuggccucaucccugucuccauuuggguggccguucugcuugggggccuggcguacaccgcuuauugucaggaccucuucagcgagacagaacuggccuuucuggugucuggagccauccuuuacggcugcuacugggucgcucuccugaugcuguaucucgccauuaucgcucggagaugcgggaaaaagcccgagcaguacucccuggccuucgcggaaguguga

SEQ ID NO: 70155 - RNA, 1260 nt, Artificial Sequence
  derived and/or modified sequence opt5 from HAT1__Homo_sapiens__NP_003633
auggccggcuucggggcuauggagaaguuucugguggaauacaaaagcgccgucgagaagaaacucgcggaauauaagugcaacaccaauacagcuaucgagcugaaacuuguuagauuccccgaagaccuggagaacgauauucggacguuuuucccugaguacacccaccagcucuuuggagacgaugaaacagccuucggcuauaaggggcugaagauccuucuguacuauauugccggaucccucucuaccauguuucgcguggaguacgcuagcaaaguggacgaaaauuucgauugugucgaggccgacgauguggagggcaagaucagacaaauuaucccgcccggguuuugcacaaacaccaaugacuuccugucccugcucgaaaaagagguugauuuuaagccuuucggaacacugcuucauaccuauucugugcugagccccacgggcggcgaaaacuuuaccuuccagaucuacaaagcugacaugacaugucggggguuccgcgaguaccacgaaagacuccagaccuuucugaugugguucauugagacagccuccuuuaucgaugucgacgaugagcgguggcauuauuuccuuguguuugaaaaguacaauaaggacggagcgacccuguucgccacgguuggcuauaugacaguguacaacuauuacgucuauccugacaaaacccgccccagagugucucagaugcucauucugacaccuuuucaagggcagggacacggcgcucagcugcucgagaccgugcaucgguacuacaccgaguucccgacaguccuggauaucacggccgaggaccccagcaaguccuauguuaaacuucgcgauuuugugcuggugaagcucugccaggaccugccuuguuucagcagagaaaaacuuaugcaaggguuuaaugaggauauggcuauugaggcccagcagaaguucaaaaucaacaagcagcacgcgcggcgcgucuacgaaauucugagacuccuggugaccgacaugucugaugccgagcaauaucgguccuaccgccuggacaucaagagacggcucaucagccccuauaaaaagaaacagagagaucuggcuaagaugcgcaaaugccuucggccugaagaacugacaaaucagaugaaccaaauugaaaucucuaugcagcacgagcagcucgaggaauccuuucaggagcugguugaagacuacagacgcgugauugagcggcuugcccaagaguga

SEQ ID NO: 70156 - RNA, 1095 nt, Artificial Sequence
  derived and/or modified sequence opt5 from HAVCR1__Homo_sapiens__NP_001166864
augcacccccagguggucauccugagccucauucugcaucuugccgacuccguugcuggcucugugaaggucgggggagaggccggcccuagcgugacccugccgugccacuacuccggggcggugacaucuauguguuggaacagaggaagcugcucccucuucacgugucaaaauggcaucguuuggaccaacgggacacaugugaccuaucggaaagauacacgcuacaagcugcuuggagaccugucuagacgggaugucagccucaccauugaaaauacagcuguguccgacagcggcguuuauugcugucgcguggagcacagaggcugguuuaacgauaugaaaaucaccgucucucuggaaauugugcccccuaaggugacgaccacacccaucgucaccacaguuccuaccgugacgacagugcggaccuccacaaccguccccaccacaacgaccgugccuaugacaaccguuccgacaaccacggugcccacaaccaugagcaucccuaccacaaccacaguccugacgaccaugacagugucuaccacaaccuccguucccacgaccacaagcauuccuaccacaaccucugugcccgucacgacaaccguguccacauucgucccgccuaugccccucccucgccagaaucaugagcccguggccaccagccccuccucuccucagccggccgaaacccaccccacaacgcugcagggggcuaucagacgggagccuaccagcagcccccuuuacuccuauacaaccgacggaaacgauacaguuaccgagucuuccgacggccuguggaauaacaaucaaacgcagcucuuucuggaacacagccuucugacagccaacaccaccaaagggauuuacgcuggagugugcaucucuguccucgugcugcuggcccuccugggcguuauuaucgcgaagaaguauuucuuuaaaaaggaggugcagcagcuuagcgucuccuucucuagccugcaaauuaaagcccuccagaaugcuguggaaaaggaggugcaggccgaggauaacaucuacaucgaaaauucccuguacgcuacagacuga

SEQ ID NO: 70157 - RNA, 906 nt, Artificial Sequence
  derived and/or modified sequence opt5 from HAVCR2__Homo_sapiens__NP_116171
auguucagccaucugcccuuugacugcgugcuccugcuucugcuccugcuucugaccagauccucugaggucgaauaccgggccgagguuggccagaacgcuuaucucccuuguuucuacacaccggccgcgcccgggaaucuggugccugugugcuggggaaagggcgcuugucccgucuuugaaugcgggaacgugguucugcgcacggaugagagagacgugaauuauuggaccagccgguacuggcucaacggagauuuccgcaaaggcgacgucucccugacaaucgaaaaugugacccuugccgauucugggauuuauuguugcagaauccaaauuccuggaaucaugaacgacgagaaguuuaaucugaaacucguuauuaagcccgccaaagugaccccugcuccgacacggcagcgcgauuucacagccgcuuuucccagaaugcugaccacgcggggccacggcccugccgagacccagacacuugggagccugcccgacaucaaccucacccagaucuccacacuggcgaaugaacugcgcgauucuagacucgccaacgaccugcgggauagcggagcuaccauucgcaucggcauuuacaucggggccggaauuugugcuggccuugcccuggcgcucaucuucggggcccugauuuuuaagugguauucccacagcaaggagaaaauccaaaaucuuucucugaucucccucgcuaaccugccucccagcggacuggccaaugcugucgccgaaggcauuagaucugaggagaacaucuacacgauugaagagaauguguacgaaguggaggaaccgaacgaguauuacugcuaugucuccagccggcagcagccuucucagccccucggcugucgcuucgccaugccuuga

SEQ ID NO: 70158 - RNA, 696 nt, Artificial Sequence
  derived and/or modified sequence opt5 from HAX1__Homo_sapiens__NP_001018238
augagccuguucgaccucuuuagaggcuucuuuggguuccccggaccucgguccuuuucuccgggcgggggaauccgcuuccacgauaacuuuggcuucgacgaucuggugagagacuuuaauagcauuuucuccgauaugggggccuggacccuucccucucauccucccgagcugccuggacccgaaagcgagacaccuggcgaacggcuccgcgagggccagacgcugagagacuccaugcuuaaguacccggauucucaccaaccccggaucuuugggggaguccuggaaagcgacgcucgcuccgagagcccucagcccgccccugauuggggcucucagagacccuuccaucgguuugacgauguuuggccgauggacccucacccccgcaccagagaggauaacgaccucgacucccaggugagccaagaagggcugggaccugugcugcagccccagcccaaaucuuauuucaaguccauuagcgucacaaaaaucaccaagccugauggcauuguggaggaacggcgcacaguuguggacucugaggggagaaccgagacaaccgucacgcggcaugaagcggauuccagcccgcgcggagaccccgaguccccuagacccccugcucucgaugacgccuucucuauccuggaucuuuuucugggccggugguucagaagccgcuga

SEQ ID NO: 70159 - RNA, 429 nt, Artificial Sequence
  derived and/or modified sequence opt5 from HBA2__Homo_sapiens__NP_000508
auggugcugagccccgccgacaagaccaacgucaaagcugccuggggcaagguuggggcgcacgcuggagaguacggcgccgaagcccucgagagaauguuccuguccuuuccuacaacgaaaaccuauuucccgcauuuugaucuuucucacgggagcgcucaggugaagggacauggcaaaaagguggccgacgcucugacaaaugccgucgcgcacguggaugacaugcccaacgcccucuccgcucugucugaucuucaugcccacaagcugcggguugacccugugaauuucaaacuccugagccacugccugcucgucacccuggcugcccaucuucccgcggaauuuaccccugccgugcacgcuucccuggauaaguuccucgccucuguuagcacagugcugacauccaaauaccgcuga

SEQ ID NO: 70160 - RNA, 444 nt, Artificial Sequence
  derived and/or modified sequence opt5 from HBB__Homo_sapiens__NP_000509
auggugcaccugacccccgaggaaaagagcgccgucacagcucucuggggcaaaguuaacguggacgaggucgggggagaagcccugggcagacuucuggugguguacccuuggacgcagcgguucuuugaguccuucggggaucucucuaccccggacgcgguuaugggaaaucccaaggugaaagcucauggcaagaaaguccugggggccuuuagcgauggacuugcccaccuggacaaccucaagggcacauucgcuacccuguccgaacugcauugcgauaagcuccacguggacccugagaauuuucgccugcuuggcaacguucugguguguguccucgcccaucacuucgggaaagaguuuacacccccugugcaagcugccuaucagaagguggucgcgggaguugccaaugcucuggcccacaaauaccauuga

SEQ ID NO: 70161 - RNA, 444 nt, Artificial Sequence
  derived and/or modified sequence opt5 from HBD__Homo_sapiens__NP_000510
auggugcaccugacccccgaggaaaagacagccgucaacgcucucuggggcaaaguuaauguggacgccgucgggggagaggcgcugggcagacuucuggugguguacccuuggacgcagcgguucuuugagagcuucggggaucucuccucuccggacgcuguuaugggaaaccccaaggugaaagcccauggcaagaaaguccugggggccuuuagcgauggacuugcucaccuggacaaucucaagggcaccuucucccaacugucugaacugcauugcgauaagcuccacguggacccugaaaacuuucgccugcuuggcaauguucugguguguguccucgccagaaacuucgggaaagaguuuacaccccagaugcaggcugccuaucagaaggugguggcgggagucgccaaugcucuggcccauaaauaccacuga

SEQ ID NO: 70162 - RNA, 444 nt, Artificial Sequence
  derived and/or modified sequence opt5 from HBE1__Homo_sapiens__NP_005321
auggugcacuucaccgccgaggaaaaggcugccgucacaagccugugguccaaaaugaacguugaggaagcgggcggggaggcucucggaagacugcuugugguguaccccuggacgcagcgguuuuucgacucuuuuggcaaucugagcuccccuucugccauccucgggaacccgaaggucaaagcccauggaaagaaagugcugaccagcuucggcgaugcuauuaagaauauggacaaccuuaagcccgccuuugcuaaacuguccgaacuccacugcgauaagcugcauguugacccugagaauuucaaacugcucgggaacgugauggucaucauucuggccacacacuuuggaaaggaguucacccccgaagugcaagcggccuggcagaaacuuguuucugcuguggccaucgcucuggcccauaaguaucacuga

SEQ ID NO: 70163 - RNA, 627 nt, Artificial Sequence
  derived and/or modified sequence opt5 from HBEGF__Homo_sapiens__NP_001936
augaagcugcuccccagcgugguccugaaacuuuuccuggccgcuguucucuccgcccuggugaccggcgagucucuugaaagacugcggcgcgggcucgcggcuggaacaagcaacccugacccgcccacgguguccaccgaucagcugcugccucucggcgggggaagagaccggaagguccgcgaucugcaagaggccgaccuugaucugcucagagugacacugucuagcaaaccccaggcccuugcuaccccuaauaaggaggaacacggcaaacggaagaagaaagggaagggacugggcaaaaagcgcgaccccugccucagaaaauacaaggauuuuuguauccauggcgaaugcaaguauguuaaagagcugcgggccccuuccuguauuugccacccgggguaccauggagagcgcugucacggccugucucuccccguggaaaacagacuguauacauacgaccauaccacaauccuugcugucguggccguugugcugagcuccgucugccuccuggugauuguggggcuucugauguuccgguaucaccgcagaggaggcuacgaugucgagaaugaagagaagguuaaacucgggaugaccaacagccacuga

SEQ ID NO: 70164 - RNA, 444 nt, Artificial Sequence
  derived and/or modified sequence opt5 from HBG1__Homo_sapiens__NP_000550
augggccacuucaccgaggaagacaaggccacaaucacgagccugugggggaaagugaacgucgaggaugcuggaggcgaaacccucgggagacugcuuguuguguaccccuggacacagcgguuuuucgacuccuuuggaaaucugucuagcgccuccgcgauuaugggcaacccuaaggugaaagcucaugggaagaaaguccucaccucucugggagaugccacaaagcaccuugacgaucugaagggcaccuucgcccaacucagcgagcugcauugcgacaaacugcacguggauccggaaaauuuuaagcuccugggcaacguucuugugacaguccuggcuauccauuucgggaaagaguuuacccccgaggugcaggccuccuggcagaagaugguuacggcuguggccucugcgcucagcucccgcuaucacuga

SEQ ID NO: 70165 - RNA, 444 nt, Artificial Sequence
  derived and/or modified sequence opt5 from HBG2__Homo_sapiens__NP_000175
augggccacuucaccgaggaagacaaggccacaaucacgagccugugggggaaagugaacgucgaggaugcuggaggcgaaacccucgggagacugcuuguuguguaccccuggacacagcgguuuuucgacuccuuuggaaaucugucuagcgccuccgcgauuaugggcaacccuaaggugaaagcucaugggaagaaaguccucaccucucugggagaugccaucaagcaccuugacgaucugaagggcacauucgcccaacucagcgagcugcauugcgacaaacugcacguggauccggaaaauuuuaagcuccugggcaacguucuugugaccguccuggcuauucauuucgggaaagaguuuacacccgaggugcaggccuccuggcagaagaugguuaccggaguggcuucugcccucagcucccgcuaucacuga

SEQ ID NO: 70166 - RNA, 426 nt, Artificial Sequence
  derived and/or modified sequence opt5 from HBM__Homo_sapiens__NP_001003938
augcugagcgcccaggagagagcucaaaucgcccaggugugggaccucauugcgggccacgaagcucaguucggggccgagcugcuucugcggcucuuuaccgucuaccccuccacaaagguuuauuucccucaccugucugccugccaggaugcuacgcaacuucugagccacggacagcgcaugcucgccgcugugggcgccgcggugcagcaugucgacaaccugagagccgcucuguccccgcucgccgaucugcacgcucuugugcugcggguugaccccgccaauuuuccucuccugauccaguguuuccaugugguccuugcgucucaucugcaagaugaauuuaccgugcagaugcaggccgcuugggacaaauuccucacagggguugccgugguccugaccgagaaguaccgcuga

SEQ ID NO: 70167 - RNA, 1575 nt, Artificial Sequence
  derived and/or modified sequence opt5 from HBP1__Homo_sapiens__NP_001231191
auggccaccggccugagcgagcaccauaacauggugugggaagucaagacaaaucagaugcccaacgcuguucaaaaacuccugcuugugauggacaagagagccuccgggaugaaugauucucuggagcuccugcagugcaacgaaaaucuuccuagcuccccgggauacaacucuugugacgagcacauggaacuggaugaccuccccgagcugcaggcggugcagagcgauccuacgcaauccggcauguaucagcugucuagcgacgucucccaucaggaguacccccggagcucuuggaaucagaacaccuccgauaucccugaaacaaccuaucgcgagaaugaaguggacuggcucacagagcuggcuaacauugccaccagcccccaaucuccucuuaugcagugcuccuucuacaauagaagcucuccgguucacaucauugccacauccaaaagccugcauuccuaugcucggcccccucccgugucuagcuccagcaagucugagccugccuuuccccaccaccauuggaaagaagagaccccgguccgccacgaaagagcuaacuccgagagcgaaucugggaucuucuguaugagcucccucucugaugacgaugaccugggauggugcaauagcuggccuuccacgguguggcauuguuuucuuaagggcacccggcugugcuuccacaaggggagcaacaaagaguggcaggauguugaggacuuugcccgcgcggaaggaugugacaaugaggaagaucuccagaugggcauucacaagggcuacgggucugacggacugaaacugcucucccaugaggaaagcgugucuuucggcgaguccguccugaaacuuacauuugaucccgggaccguggaggacggacugcucacaguggaaugcaagcuggaucacccuuucuaugucaagaacaagggcuggagcuccuuuuaccccucucuuaccguugugcaacaugggauccccuguugcgaggugcacaucggagacgucugucugccuccgggccaucccgaugccauuaacuucgacgauagcggcguguuugacacguucaaauccuacgauuuuacaccuauggacucuagcgcuguuuaugugcucuccagcauggccagacagcggcgcgcuucucuguccugcgggggacccggcgggcaggacuucgccagaagcggauucucuaagaauugcggcuccccugggagcucucaacugagcuccaacagccucuacgcgaaagccgucaagaaucacucuuccggaaccgugagcgcuacaucccccaacaaauguaagcggccgaugaaugccuuuaugcuguucgcuaaaaaguaucgcguugaauacacccagauguauccuggcaaggauaacagagccaucucugugauucuuggcgaccgguggaaaaagaugaaaaaugaggaacgcagaauguacacccuggaggccaaggcucucgcggaggaacagaaacggcugaaccccgauugcuggaagagaaagcgcacaaauagcgggucccagcaacacuga

SEQ ID NO: 70168 - RNA, 429 nt, Artificial Sequence
  derived and/or modified sequence opt5 from HBQ1__Homo_sapiens__NP_005322
auggcccugagcgcugaggacagagcccucgugcgggcgcuguggaagaaacuuggcuccaacgucgggguuuacaccacagaagcucuggagcgcacguuccucgccuuucccgccaccaagacauauuucucucaccuggaucuuagcccuggauccucucaggugagagcucauggccaaaaaguggccgacgcucugagccucgccgucgaacggcuggaugaccugccgcacgcgcucuccgcccugucucaucuucacgcuugccagcugcgcguggaucccgccagcuuucagcuccuggggcauugucuucugguuacccucgcuagacacuacccuggagacuucucccccgcccugcaggcgagccuggauaaguuucucucucacgugaucuccgcccuggucagcgaguaucgguga

SEQ ID NO: 70169 - RNA, 1929 nt, Artificial Sequence
  derived and/or modified sequence opt5 from HBS1L__Homo_sapiens__NP_001138630
auggccagacaccggaacgugcgcggcuacaauuaugacgaggauuucgaagacgaugaccuguacgggcagagcgucgaggaugacuauugcaucucccccucuaccgcuagacucuacagcugucuggaucauaugcgggaaguucuuggagacgccgugccugaugagauucugaucgaagcggugcucaagaacaaauuugacguccaaaaggcucuguccggcgugcuugagcaggaucgcguucagucucugaaagacaagaaugaggccacagugagcacggggaaaauugccaagggaaagccggucgauucccagaccucuagaagcgaauccgagaucgugcccaaaguugcuaagaugacagugagcggcaaaaagcaaaccaugggguucgaagucccuggagugucuuccgaggagaacggccacagcuuucauacaccccagaaaggcccucccauugaagacgccaucgcuucuuccgacgugcucgagaccgccagcaagucugcgaauccuccgcacacaauccaggccuccgaagaacagagcuccacccccgcuccugucaagaaaucugggaagcugcggcaacagauugauguuaaagccgaacuggagaagcgccagggaggcaaacagcuccugaaccuuguggugaucgggcaugucgacgcuggaaagagcacgcugaugggccacaugcucuaucugcuugggaauauuaacaaaagaaccaugcacaaguacgagcaagaauccaagaaagccggaaaggcgagcuucgccuaugcuugggugcuggaugagacaggcgaggagcgggaacgcggcguuaccauggacguggggaugacaaaauuugagaccacgacaaaggucaucacccucauggaugcccccggacauaaagacuucauuccuaauaugaucacaggcgcugcccaggccgauguggcuguucugguggucgacgcgucuagaggggaguuugaagccggauucgagaccggcgggcagacccgggaacacggacugcucgugcgcucccugggcgucacacaacuugcuguggccguuaacaagauggaucaggugaauuggcagcaggagagauuucaagaaauuacgggcaagcuggggcauuuccucaaacaggccggauuuaaggagagcgacgucggcuucauccccaccucugggcugagcggagagaaccuuaucacacggucccagucuagcgaacugaccaaaugguacaagggccucugccugcuggagcagauugauuccuuuaaaccgccucaacgcagcaucgacaagcccuucagacucugugugucugacguuuucaaggaucagggguccggcuuuugcauuacaggaaaaaucgaagcuggcuacauucagaccggggaccggcugcuugccaugccucccaaugagacguguacagugaagggaaucacccugcacgaugagcccgucgacugggcggcugccggcgaucacgugagccucacccugguggggauggacaucauuaaaaucaacguuggaugcauuuucuguggcccuaaggucccgaucaaagccugcacaagauuucgcgcucggauucuuaucuucaauaucgaaauucccaucaccaagggguuuccugugcugcuccauuaucagacagugucugagcccgccgucauuaagagacugaucuccgugcugaacaaaagcacgggcgaaguuaccaagaaaaagccuaaauuccucacaaagggacaaaacgcucugguggagcuucagacccagcgccccauugcccuggaacucuacaaagauuuuaaggagcugggccgguucaugcugagauaugggggauccacaaucgcggccggcgucgugaccgagauuaaggaauga

SEQ ID NO: 70170 - RNA, 429 nt, Artificial Sequence
  derived and/or modified sequence opt5 from HBZ__Homo_sapiens__NP_005323
augagccugaccaagacagagagaacgaucauuguguccaugugggccaaaaucucuacccaggcugacacaauuggcaccgaaacacucgagcggcuguuccuuagccacccccaaaccaagacauacuuuccucauuucgaucugcacccgggguccgcccagcuccgcgcgcauggaucuaaagucguugcugccgugggcgacgccgucaagagcaucgaugacauugggggagcucuguccaaacuuucugaacugcacgccuauauccucagaguggaucccgugaacuuuaagcugcugagccauugccuccugguuacccuugcugcccgguucccugcggacuuuacggccgaggcucacgccgcuugggauaaguuccuguccguggucagcucugugcucaccgaaaaauaccgcuga

SEQ ID NO: 70171 - RNA, 1041 nt, Artificial Sequence
  derived and/or modified sequence opt5 from HCAR1__Homo_sapiens__NP_115943
auguacaacggcagcugcuguagaaucgagggggacaccauuucccaggugaugcccccucugcucaucgucgccuucguucugggagcucuuggcaaugggguggcccugugcggauuuuguuuccacaugaagacauggaaaccgucuacgguguaucucuuuaaccuggcggucgcugauuuccuucugaugauuugccuccccuuucggaccgacuacuaucugcgcagacggcauugggccuucggcgauaucccuugucgcguggggcuguuuacacucgccaugaauagagcuggaagcauuguuuuccugaccguggucgccgcugaccgguacuuuaaggugguucacccccaucacgccgugaacacaaucuccacccgcgucgcggccggcaucgugugcacacuuugggcucuggugauucucggcaccgucuaucugcuucuggaaaaucaucucuguguucaagagacggccgugucuugcgaauccuucaucauggaguccgcuaacggguggcacgauauuauguuucagcuggaguucuuuaugccucugggaaucauucucuucuguucuuucaaaaucguguggagccugagacggcgccagcagcuugccagacaagcgcggaugaagaaagccacccgcuuuauuauggucguggcuaucguuuucaucacaugcuaccugcccuccgugagcgccagacucuauuuucuguggaccgucccuucuuccgcuugugacccgagcgugcacggcgcccuucauauuacacugucuuucaccuacaugaauagcaugcucgauccccugguuuacuauuuuagcucuccuuccuuccccaaguuuuacaacaagcugaaaaucugcagccucaagccuaaacagcccgggcacuccaagacgcagcggccggaagagaugccuauuucuaaucugggacgcagaagcugcaucuccguggccaacagcuuccagucucaauccgacggccagugggauccccauauugucgaauggcacuga

SEQ ID NO: 70172 - RNA, 1092 nt, Artificial Sequence
  derived and/or modified sequence opt5 from HCAR2__Homo_sapiens__NP_808219
augaacagacaccaucugcaggaccacuuccucgagaucgauaagaaaaauugcuguguguuucgggacgauuucauugucaagguucugcccccugugcuuggccuggaauuuaucuucgggcuccugggaaacggccuugcccuguggaucuuuugcuuccaucucaaaagcuggaaguccucucgcauuuuucuguucaaucuggcuguggccgacuuucuccugauuaucugucuuccguuccugauggauaacuacgucagacggugggacuggaaauuuggggauauccccugccgccucaugcuguucaugcuugcgaugaauagacaaggaagcauuaucuuucugaccgugguugcuguggaccgguauuuccgcgucgugcacccucaucacgcccucaacaagauuuccaauagaacagccgcuaucauuucuugucugcuguggggcaucacgauugggcucaccguucaucugcuuaagaaaaagaugcccauccagaacggaggcgccaaucugugcagcuccuucucuaucugucacacauuucaguggcacgaggcuauguuccuccuggaauuuuuccuuccucugggcauuauccucuuuugcagcgcccggauuaucuggucccugcgccagagacaaauggaucggcaugcgaaaauuaagcgcgccaucaccuucaucaugguggucgcuauuguguuugugaucuguuuccugcccagcgucguugugcggauuagaaucuuuuggcuccugcacacaucugggacccagaacugcgagguguaccgcuccgucgaccuugccuucuuuauuacacugagcuucaccuauaugaacucuaugcucgauccugugguuuacuauuuuuccagcccgucuuuccccaauuucuuuuccacgcugaucaauagaugucuucagcggaaaaugaccggagaaccugacaacaauagaagcacauccguggagcugaccggcgaucccaacaagacacgcggggcuccugaggcccucauggcgaacucuggagaacccuggagcccguccuaccugggcccuaccagccccuga

SEQ ID NO: 70173 - RNA, 1164 nt, Artificial Sequence
  derived and/or modified sequence opt5 from HCAR3__Homo_sapiens__NP_006009
augaacagacaccaucugcaggaccacuuccucgagaucgauaagaaaaauugcuguguguuucgggacgauuucauugccaagguccugcccccuguucuuggccuggaauuuaucuucgggcuccugggaaacggccuugcucuguggauuuucugcuuccaucucaaaagcuggaaguccucucgcaucuuucuguucaaucuggccguggcggacuuucuccugauuaucugucuuccguucgugauggauuacuaugucagacggagcgacuggaaauuuggggauauccccugccgccuggugcucuuuauguuugcuaugaacagacaaggauccauuaucuuccugaccguuguggccgucgaccgguacuuccgcgugguucacccucaucacgcccuuaauaagauuucuaacuggacagcugccaucauuagcugucugcucuggggcaucacgguggggcugaccguccaucugcucaagaaaaagcugcuuauucagaauggaacagcuaacgugugcaucuccuuuucuaucugucacaccuucagauggcacgaggccauguuucugcucgaguucuuucugccccuuggcauuauccuguucugcagcgcgcggauuaucuggucccuccgccagagacagauggaucggcaugccaaaauuaagcgcgcuaucacauuuaucaugguggucgccauuguuuucgugaucuguuuucugccuagcguggucgugcggauucacaucuucuggcugcuccacaccucuggcacacaaaauugcgaaguuuauagauccguggaccuggccuuuuucauuacccuuagcuuuacguacaugaacucuaugcuggaucccgucguguauuacuucuccagcccuucuuucccgaacuuuuucuccacccucaucaaucgcugucugcagagaaaaaucacaggggaacccgacaauaaccggagcaccuccguugagcuuacaggagauccuaauaagaccagaggcgcucccgaggcgcugauugccaacucuggggaaccuuggagccccuccuaucucggaccgacgagcaacaaucauucuaagaaaggccacugccaucaggagccugcuucccuggaaaagcagcuggggugcuguaucgaguga

SEQ ID NO: 70174 - RNA, 807 nt, Artificial Sequence
  derived and/or modified sequence opt5 from HCCS__Homo_sapiens__NP_001116080
augggccugagccccuccgccccugcuguggccguccaggcgucuaacgcuagcgccuccccgcccucugggugcccuaugcacgagggaaagaugaaaggcugucccguuaauaccgaaccuagcgggcccacaugcgagaagaaaacguacuccgugccugcccaucaagaaagagcuuaugaguacguggaauguccgauccggggaaccgccgcugagaacaaggagaaucucgaccccucuaaccugaugccucccccuaaucagacacccgccccggaucagccuuucgcgcuuagcaccguccgcgaagaguccagcauucccagagccgacucugagaaaaaguggguguauccuuccgaacagauguuuuggaacgcuaugcugaagaaaggcuggaaguggaaagaugaggacaucagccaaaaggauauguacaauauuauccggauucacaaccagaauaacgaacaggccuggaaagagauccucaagugggaagcucugcaugccgcggagugccccugugggcccucucuuauccgcuucggaggcaaggccaaagaauauuccccuagagcucggauucgcagcuggaugggcuacgagcugccguuugacagacacgauuggaucauuaaucggugcgggacagagguucgcuaugugaucgacuacuacgauggaggcgaagucaacaaggacuaucaguucaccauucucgaugugagacccgcccuggacucucuguccgcuguuugggaucggaugaaaguggccugguggcgcuggacaagcuga

SEQ ID NO: 70175 - RNA, 6108 nt, Artificial Sequence
  derived and/or modified sequence opt5 from HCFC1__Homo_sapiens__NP_005325
auggccagcgcugugucccccgccaaccugccugcgguccuccugcagcccagauggaagcggguugugggcuggucugggcccgugccucgccccagacacggacaucgggcugucgccaucaaagagcuuaucgugguuuucggcgggggaaaugaaggcaucguggacgagcugcacgucuacaacaccgccacaaaucaaugguuuauuccugcugugcgcggggauauucccccuggaugcgccgcuuauggcuucguuugugacggcacgagacuccugguguuugggggaauggucgaauacggcaaguauagcaacgaucuuuacgagcugcaggccucccggugggaauggaaacgccucaaggcgaaaacccccaagaaugggcccccucccugcccuagacugggacauucuuucagccuggugggcaacaaguguuaucucuuugggggacuggccaaugacuccgaggaucccaaaaacaauauuccccgguaccuuaacgaccuguauauccucgagcugcgcccuggcucuggcguggucgcuugggauauccccauuacauacgggguucuuccuccgcccagagaaagccacaccgccgugguguacacagagaaggacaauaaaaaguccaaacuggucaucuauggaggcaugagcgggugccggcucggagaucuguggacccuggacauugauacacucaccuggaacaagccuucucuguccggcguggcuccccuuccccgcagccugcauucugccacgaccaucgggaauaagauguacguuuucggaggcugggugccucucgucauggacgaugugaaaguugcgacacacgaaaaggaguggaaauguaccaacacacuggccugccuuaaucuggacaccauggcuugggagacgauucucauggacacacuggaagauaacauccccagagcccgggcuggccacugugccguggccauuaacacccgccuguauaucugguccgggagagacggauaccggaaggcuuggaauaaccaggucugcuguaaagaucucugguaucuggagacagaaaagccucccccgccugcgagagugcagcuuguccgcgccaauaccaacagccuggaggugucuuggggcgcuguugccaccgccgacuccuaccuccugcaacuucagaaauaugauauccccgcuacagccgcgacggcuaccagcccuacacccaauccugugcccuccgucccggccaacccucccaagucucccgccccugcugccgcugccccggcggugcagccccugacccagguugggauuacacuccugccucaagccgcucccgccccucccaccacgacaaccauccaggugcugccuaccguccccggaagcuccauuagcgugccgacagcugcccggacccagggcgugccugcgguucucaaggucacagggccccaggccacgaccggcacaccucuggugaccaugagacccgcuucucaagccggaaaagcuccggugacagucaccucccuuccugccggcgugcgcaugguugugcccacgcagagcgcccaggggaccgucaucggaucuagcccucaaauguccggcauggcugcgcuggccgcugccgccgcugccacacagaagauuccgcccucuagcgcgccuaccgugcucuccguuccggcugggacaaccaucgugaaaacgauggccgucacacccggaaccacaacccugccugccaccgugaagguugcuagcucucccgugauggucuccaauccugccacacggaugcugaaaacggcggcugcccaggugggcaccagcgugucuuccgccacaaacaccagcacaagacccaucauuaccguccauaaguccgggacgguuacaguggcucagcaagcccagguggucaccaccgugguuggcggagugacaaagaccaucacacuugucaaaucuccuauuagcgugccgggcggguccgcucucaucucuaaucugggaaagguuaugagcgugguccagacgaaacccgugcagaccuccgccguuacaggccaagcgagcaccgggccugugacacagauuauccagaccaagggaccccugccugccggcacgauccucaaacuggucaccucugcugacgggaagcccacaaccauuaucacaaccacacaggccuccggcgcuggaaccaagccgacgauucuuggcaucagcucuguguccccuagcacaaccaaacccgggaccacaaccauuaucaagacgauucccaugucugccaucaucacacaagccggagcuaccggcgugacaagcuccccugggauuaaaagccccaucaccauuaucacaaccaaggucaugacgucuggaaccggcgcgccugccaaaauuaucacagcuguuccgaagaucgccaccgggcacggccagcagggagugacacaggugguccugaagggcgcccccgggcaaccuggaaccauucuccgcacggugcccaugggcgggguucggcuggugacaccugucaccguguccgcuguuaaacccgccgugacaacccuggucgugaagggaaccacaggcgucacgacccuuggcacagugaccgggacaguuagcaccucccucgcgggagcuggcgggcauucuacgagcgccucccuggccacaccgaucaccacccugggaacaauugcuacccucucuagccaggugaucaacccuacagccauuacggucuccgcggcucagaccacacugaccgccgccggcgggcuuacaacccccacgaucaccaugcaaccugugucucagcccacacagguuacccugaucacagcuccuagcggaguggaagcccagcccguccacgaucucccgguguccauucuggcuagcccuaccacagagcaacccacggccaccgugacaaucgcggacucuggccagggcgauguucagcccgggaccgucacccuggugugcuccaauccuccgugugagacacacgaaacgggaaccacaaacaccgccacaaccacgguggucgcuaaucuuggcgggcauccccagccuacacaagugcaguuuguuugcgacagacaggaggccgcugccagccucgugaccucuaccgucggacagcaaaacggcuccgugguucgcgugugcagcaaucccccuugugaaacacacgagaccgggacaaccaacacggccacaaccgcuacaucuaacauggcgggacagcauggcugcuccaaucccccuugugaaacccacgagacgggcaccacaaacaccgccacaaccgcuaugagcuccgucggggccaaucaucagcgggaugccagacgcgcuugcgccgcgggaacaccggcugugauucggaucagcguugccaccggcgcccuggaggcugcccaagggucuaaaagccagugucagacgagacagacauccgcgaccucuaccacaaugaccgugauggccacaggagcucccugcagcgccggcccucugcucgggcccuccauggcucgggaaccuggaggccgcucucccgccuucguccaacuggcuccgcuuagcuccaaggugagacugucuagcccuuccauuaaagaccuccccgccggccggcacagccacgcggugucuacggccgcuaugaccagauccagcgucggggccggagagccccgcauggcuccuguuugugaaucucugcagggcgggucccccagcacaaccgugacagugaccgcccuggaggcccuucucugcccuuccgcuacggucacccagguguguucuaacccgcccugcgaaacacaugagaccggaacaaccaauacggcgacaaccagcaacgccggcuccgcucagcggguuuguagcaauccucccugcgagacacacgaaaccgggaccacacauacggccaccacagccaccucuaacggaggcacaggccaaccugaagggggacagcagcccccggcuggcagaccuugcgaaacccaccagacgacauccaccgggaccacaaugagcgugucugucggagcccugcugcccgacgcgaccagcucccaccgcacaguggagucuggccucgagguugccgcugccccuagcgugacgccccaagcugggaccgcccugcuugcgccuuuucccacacagagagucuguuccaauccgccuugcgaaacccaugagacaggaaccacgcacaccgccacaaccgugacaucuaacaugagcuccaaucaggauccgcccccugcugccagcgaccagggcgaagucgagucuacccaaggcgauuccgugaacaucacaagcuccucugcuaucaccacgacaguuagcuccacccugacccgggccgugacaacggugacccagucuacaccgguccccgggccuagcguucccccucccgaggagcuccagguguccccuggaccccgccaacagcugccgccuagacagcugcuucagagcgcuucuaccgcccugaugggcgaguccgcggaagugcucagcgccucucaaacacccgagcugccugcugccgucgaccucuccagcaccggggaacccucuagcggacaggaguccgcuggcucugccgugguugccacaguggucgugcagccgccuccgcccacccagagcgaagucgaucaacugucccuuccucaggagcugauggcggaggcucaggccgggacgaccacacucauggugaccggacugacacccgaggaacucgcuguuaccgccgccgcugaagccgcggcccaggcugccgcuacggaggaagcccaagcgcuugccauucaggcugugcugcaggccgcucaacaggccgucaugggcacaggcgagccuauggacaccagcgaggcugccgcgacagugacccaggccgaacucgggcaucuguccgcugagggacaggaaggccaagccacgaccaucccgauuguucucacacagcaggagcuggcugcccuugugcagcaacagcagcugcaggaggcccaagcgcagcagcagcaccaucaccuccccaccgaagcucuggccccugccgauucucugaaugaccccgcuaucgagagcaacugucuuaaugaacuggccgggacagucccuuccaccguggcucuccugcccucuacagccaccgagagccucgcgccuuccaacacguucguggccccgcaacccguugucguggcuucuccugccaagcugcaggcugccgcgacacuuaccgaaguggccaacggaauugagagccugggcgucaaacccgaucugccucccccgccuuccaaggcucccaugaagaaagagaaucagugguuugacguuggggugaucaagggcaccaacgugauggucacacacuacuuccugcccccugaugacgccgugcccagcgaugacgaccugggaaccguuccugauuacaaucaacuuaaaaagcaggaacugcagccgggcacagcuuauaaauuucggguggccgggauuaacgcuugcggacgcggccccuucucugagaucuccgccuucaagacgugucucccuggguuucccggagcgccuugcgccaucaagauuagcaaaucucccgacggcgcucaucugaccugggaaccgccuuccgucacaagcgggaagaucauugaguacucuguguaucucgccauccaguccagccaagccggcggagaacugaaauccagcacccccgcucagcuugccuucaugagaguuuacuguggcccuucucccagcugccuggugcaguccucuagccuguccaaugcgcacauugauuauacaaccaagccggcuaucaucuuucggauugccgcccgcaacgagaaaggguacggaccugcuacgcaggucagauggcuccaagagaccucuaaggacagcuccggcacaaagcccgccaauaaacggcccaugucuagcccugaaaugaaguccgcucccaaaaagagcaaagccgaugggcaguga

SEQ ID NO: 70176 - RNA, 2379 nt, Artificial Sequence
  derived and/or modified sequence opt5 from HCFC2__Homo_sapiens__NP_037452
auggccgcucccagccugcucaacuggagacggguguccucuuucaccggcccugucccgcgcgccagacacgggcaucgggcgguugcuauccgcgagcugaugauuaucuuuggaggcgggaaugaaggaauugccgacgagcuucacguguacaacacagccacgaaucagugguuccugcccgcugugagaggcgauaucccucccgggugcgccgcucauggauuugucugugacggcacccggauucucguguucggcgggaugguugaauauggacgcuacagcaacgagcuguaugaacuucaagccuccagauggcuguggaagaaagugaagccucaucccccuccgucuggccugcccccuugcccccggcucgggcacagcuuuucccuguacggaaauaaauguuaucucuucggcgggcuggcgaacgagucugaggauagcaauaacaaugucccucgcuaccuuaacgacuuuuaugaacuggagcuccagcacggauccggcgugguuggcuggagcauccccgugacaaagggggucgugccgucuccuagagaaucccacaccgccgugaucuacugcaaaaaggauagcggaucucccaagauguacgucuucggcgggauguguggagcucggcuggacgaucuuuggcagcuggaccucgagacaauguccuggagcaaaccugagaccaagggcacaguuccccugccccgcucucugcauaccgccuccgugauugggaauaaaauguauaucuuuggaggcugggugccucacaagggcgaaaacacggagaccagcccgcaugauugcgaauggagauguacauccucuuucagcuaccucaaucuggacaccacagaguggaccacgcuugucuccgauagccaggaagacaaaaagaacucucggccccgcccuagagcugggcacugcgccguggcgauuggaacacggcuguauuuuugguccggcagagauggguacaagaaagcccucaauagccaaguuuguugcaaggaccugugguaucuugacaccgagaaacccccugcucccucucaggugcagcugaucaaggccacaaccaacagcuuccacgucaaaugggaugagguguccaccguugaaggauaccuccugcagcugucuacagaccucccguaucaagcugccagcuccgauagcucugccgcuccuaacaugcagggcgugcgcauggacccccaucggcagggguccaauaacauugucccuaauagcaucaacgauacgauuaauucuaccaagacagagcagcccgcgaccaaagaaacauccaugaagaacaagccugacuuuaaagcccugaccgauagcaaugcuauccuuuaccccucccuggccucuaacgccagcaaucacaacucccauguggucgacaugcucagaaagaaugagggcccgcacacgucugcuaacgugggaguucugagcuccugucuugaugugcgcacagucaucccugaaaccagcgugucuuccaccguuagcucuacacaaaccauggugacacagcagacgauuaaaaccgaguccagcucuacaaauggcgccgucgugaaggacgagaccagccugacaaccuucuccacgaaaagcgaaguggaugagaccuacgcgcuccccgcuacaaagaucucucggguugaaacccaugccacagccacccccuucuccaaggagacgccuagcaacccggucgcuacagugaaagccggggaaagacaauggugcgacgugggaauuuuuaagaauaacaccgcucuggucucccaguucuaucugcuccccaaaggcaagcagucuaucagcaaaguggggaacgccgacguuccugauuacucccugcuuaagaagcaggaccuggugcccggaacaggcuaucgcuuucgggucgcggccauuaaugggugcggcaucggaccuuucucuaaaaucagcgaguuuaagaccuguauucccggcuucccuggggcucccuccgccgugagaaucucuaaaaacguugagggcauucaccucagcugggaaccgccuaccucccccagcggaaauauccuggaguacucugcuuaucuggccauucgcacagcgcaaauccaggauaacccuucccagcuuguguuuaugcggaucuacugcgggcucaagacgagcuguauugucaccgccggacagcuggcuaaugcccacaucgacuauacaucuagacccgcuauuguguuccgcaucuccgccaaaaacgaaaagggcuacgggccggccacccaaguucgguggcugcagggcaauaacaagaaagcuccucucaauuga

SEQ ID NO: 70177 - RNA, 1578 nt, Artificial Sequence
  derived and/or modified sequence opt5 from HCK__Homo_sapiens__NP_001165601
augggcgggagaagcuccugcgaggaccccggauguccucgggaugaggaacgcgccccgagaaugggcugcaugaagucuaaauuccugcaggucgggggaaacaccuuuagcaagacagaaacguccgcuucuccccacuguccuguguacguucccgacccuaccagcacaaucaaacccggcccuaauucccauaacucuaauaccccggggauucgggagggaagcgaagauaucauugugguggcccucuaugacuacgaggcgauccaccaugaggaucuguccuuccaaaagggcgaccagauggucgugcuugaagagagcggcgaaugguggaaagcucgcucucuggccacaagaaaggagggguauauucccuccaacuacguugcccggguggauagccucgagaccgaagagugguuuuucaagggaaucucucgcaaagacgcugaaagacagcugcuugccccuggcaauaugcugggguccuuuaugauccgggauagcgagacaaccaagggaucuuauucccucagcguccgcgacuacgaucccagacagggcgacacggugaaacacuauaagauucggacccuggauaacgggggauucuacaucuccccucgcucuacauuuagcacccugcaagaacucguugaccauuacaaaaagggcaaugacggccugugccagaaacuuuccgugcccuguaugagcucuaagccgcagaagccuugggagaaagaugcuugggagauucccagagaaucccugaagcucgagaaaaagcugggggccggacaguucggcgaagucuggauggcgacauauaacaaacacaccaagguggccgugaagacgaugaaaccugggagcaugucugucgaggcuuuucuugccgaagcuaauguuaugaagacacugcaacacgacaaacucgugaagcugcaugccguggucaccaaagagcccaucuacauuaucacagaguucauggcgaagggaagccugcucgauuuucugaaguccgacgaaggcucuaaacagccccuuccuaagcugauugauuucagcgcccagaucgcugaggggauggccuuuaucgaacagcggaacuauauucaccgcgaccucagagcugccaauauccugguguccgccagccuuguuugcaaaauugcugauuucggacuggcgcgggugaucgaggacaacgaauacaccgccagagagggcgcuaaguucccgauuaaauggaccgcccccgaggccaucaauuuuggcucuuucacaaucaaguccgaugucuggagcuuugggauucuccugauggaaaucgugacguauggacgcauuccuuaccccggcaugucuaacccugagguuauccgggcucuggaaagaggguaucgcaugccccggccggagaauuguccugaggaacucuacaacauuaugaugagaugcuggaagaaccgccccgaggaacggccuaccuucgaguacauccaauccgugcuggacgauuuuuauacagccaccgaaagccaguaccagcaacagcccuga

SEQ ID NO: 70178 - RNA, 1461 nt, Artificial Sequence
  derived and/or modified sequence opt5 from HCLS1__Homo_sapiens__NP_005326
auguggaaaagcguggucggccacgacguuuccgugucuguggagacccagggggaugacugggauacagaccccgauuucgucaacgacaucagcgaaaaggagcaaagauggggagccaagacgauugaaggcuccgggcggaccgagcauaucaauauucaccagcugcgcaacaaagugucugaagaacaugauguucucagaaagaaagagauggaaagcggaccuaaggcuucccacggcuacgggggacgguuuggcguggagcgcgacagaauggauaagucugccgucggccaugaauauguggcggagguugagaaacacagcucccagacagacgcugccaagggguucggaggcaaauacgggguggaacgggaucgcgccgacaagagcgcugucggauuugauuauaaaggcgagguggaaaagcacaccucucagaaggacuacuccagaggguucggaggccgguauggcguggagaaagacaagugggauaaagccgcucugggguacgacuauaagggagaaacagagaaacaugagagccaacgcgauuacgccaagggcuuugggggacaguacggcauccagaaagacagagucgauaagucugcgguuggguucaaugaaauggaggccccgaccacagcuuauaagaaaaccacgcccauugaagccgcuuccagcggaacccggggccuuaaggccaaauuugagucuauggcggaagagaagcgcaaaagagaggaagaggaaaaggcccagcaaguggcucggcgccagcaggagagaaaggccgugacaaaacgguccccugaagcuccccagccugucaucgccauggaggagcccgccgugccugcuccgcugcccaagaaaaucagcuccgaagcguggccucccguuggcaccccucccucuagcgaguccgaaccggugagaacaagccgcgagcacccugucccccuccugccuauucggcaaacccuucccgaggacaacgaggagcccccugcccugccgcccagaacgcucgaagggcuccagguggaggaggaaccuguuuacgaggcugaacccgagccugaacccgagccggaaccugagcccgagaaugauuaugaagacguggaggaaauggaucgccaugagcaggaagacgagccugagggagauuacgaagagguccuggaacccgaggacucuuccuucagcucugcccuggccggcagcuccgggugcccugcuggagccggcgcgggggcuguggcccugggcaucucugccgucgcucuuuaugacuaccaaggagagggcagcgaugaacuguccuuugaccccgaugacgugauuacagauaucgagaugguugacgaagggugguggcggggaagaugucacggccacuucgggcucuuuccggccaacuaugugaagcugcuugaguga

SEQ ID NO: 70179 - RNA, 2673 nt, Artificial Sequence
  derived and/or modified sequence opt5 from HCN1__Homo_sapiens__NP_066550
auggagggcgggggaaagcccaacagcuccucuaauagcagagacgauggcaacuccguguucccugccaaggcuucugccaccggggcgggaccggcugccgccgaaaagcggcugggcacacccccugggggaggcggcgcuggggccaaagagcacggaaauagcgucugcuuuaagguugacggcgggggaggcgggggaggcggcgggggaggcggggaggaacccgcuggaggcuucgaagaugccgaggggccucgcagacaguacggauuuaugcaacggcaguucacguccaugcuccagcccggcgugaacaaauuuucucugcgcauguucggcagccagaaggcgguggagaaggaacaagagagagucaaaaccgccggguuuuggaucauucauccuuauuccgacuuccgguuuuacugggaucuuaucaugcugauuaugauggugggaaaucucguuaucauuccggugggcaucacauucuuuaccgaacagacaaccacacccuggaucauuuucaacgucgcuagcgacaccguguuucugcuugaucugaucaugaauuuccgcacggggaccguuaacgaggacucuuccgagauuauccucgauccuaaggugauuaaaaugaauuaucucaagagcugguucgucguggacuuuaucucuuccauucccguggauuacaucuuccugaucgucgaaaaaggaauggacagcgagguuuauaagacagccagagcucugcggauugugcgcuuuaccaagauccugucucuucugagacuccugcggcuuucccgccugauuagauacauccaccagugggaagagauuuuccauaugacauaugaucucgccagcgcggugguccggaucuuuaaccugaucggcaugaugcugcuccugugucacugggacgggugccuucaguuccuggugccucuccugcaagacuuucccccggauuguuggguuucccuuaaugaaauggugaacgacucuuggggcaaacaguacagcuacgcccuguucaaggcuaugucccauaugcucugcauuggauauggcgcccaggcuccugucagcaugucugaucuguggaucaccaugcuguccaugauugugggggccacguguuacgccauguuuguuggacacgcuacagcgcucauccagagccuggacucuagccgcagacaauaucaggagaaauacaaacagguggagcaauauauguccuuccacaaacuucccgccgauaugcggcagaagauucaugacuacuaugaacacagauaccagggcaaaaucuuugaugaggaaaauauccugaacgagcucaaugacccucugcgcgaagagauugucaacuucaacugccggaaacuuguggcuaccaugccccuguuugccaaugccgaucccaacuucgucacagcuaugcucucuaagcugagauucgagguguuucagccuggggacuacaucauucgcgaaggagccguuggcaagaagauguauuucauccaacaugggguggcgggcgucauuaccaaaagcuccaaggagaugaaacugaccgauggaagcuacuuuggcgaaaucugucuccugacaaaggggcggagaacggcuucugugcgcgccgacaccuauugccggcuuuacucccugagcguugacaauuucaacgaggugcucgaagaguauccgaugaugagacgcgccuuugagacagucgcuauugaucggcuggacagaaucggaaagaaaaauucuauccugcuucagaaguuccagaaagaucucaacaccggcguguuuaauaaccaggaaaaugagauucugaagcaaaucgugaaacacgaccgcgaaaugguucaggccauugcucccaucaacuacccucagaugacaacccucaauuccacgagcuccacaaccacccccacaucucggaugagaacccagagcccucccgucuauacagccacgucccugucucacagcaaccugcauuccccgagcccuucuacccaaacaccccagccuuccgcgauucuuagccccuguucuuacaccacagccgugugcuccccucccgugcagagcccgcuggcugcccggaccuuccacuacgcuucuccuacggccagccagcucucccugaugcaacagcagccccaacagcagguccagcaaagccagcccccucagacccagccgcaacagcccucuccucagccccagacaccuggguccagcacccccaagaaugaggugcauaaguccacacaagcgcugcacaacaccaaucuuacgcgcgagguuagaccucucucugccagccagcccucccugccgcaugaagugucuacacugaucagccggccucaccccaccgucggagagucccucgcuucuaucccucagcccgugacagccguuccgggcaccgggcugcaagcuggcggaagaagcaccgugccucagcgcgucacacuuuuucggcagauguccagcggcgccauucccccuaacagaggggugccucccgcucccccgcccccugccgcggcccugccccgcgaaucuuccagcguucucaacacggauccugacgcugagaaacccagauucgccucuaaucuguga

SEQ ID NO: 70180 - RNA, 2670 nt, Artificial Sequence
  derived and/or modified sequence opt5 from HCN2__Homo_sapiens__NP_001185
auggacgccagaggcgggggaggccggcccggggagagcccuggagcuaccccggcccccggcccucccccucccccuccgcccgcgccuccccagcaacagccucccccgccucccccucccgcucccccuccggggcccggaccugcgcccccucagcaucccccgcgcgccgaagcucugccucccgaggccgcugaugaaggcggcccuagagggcggcuccgcuccagagacucuagcugcggacggcccggcacaccuggggccgcguccacggccaagggaucucccaacggcgagugugggcgcggagaaccgcagugcagcccugcuggccccgagggccccgccagagggccuaaaguguccuucucuugucggggagcugccagcggcccggcgcccgggccuggacccgccgaggaagcuggcuccgaggaagccgggccugcuggagagccccgcggcagccaagccucuuuuaugcagagacaguucggcgcccugcuucagccuggggucaauaaguuuucccugcggauguucggaagccaaaaagcuguugagcgcgaacaggagagagugaagucugcgggcgccuggaucauucaccccuacuccgauuuucgguucuauugggacuuuaccaugcuccuguucaugguggggaaccuuaucauuaucccggucggaauuacauuuuucaaagaugaaaccacagcuccuuggaucguguuuaauguugugagcgacaccuucuuucugauggaucucguccugaacuuccgcacaggcaucgugauugaggacaauaccgaaaucauucuggaucccgagaagaucaagaaaaaguaccucagaacgugguucguuguggacuuugucucuuccauuccuguggauuauaucuuccugauuguggagaaagggaucgacagcgaagucuacaagaccgcccgggcccuuagaaucguucgcuuuacaaaaauucugucccuccugcggcuucugagacucucucgccugauccgguauauucaccagugggaggaaaucuuccauaugaccuacgaucuggcuagcgccgugaugagaauuugcaaccucaucuccaugaugcugcuucugugucacugggacggcugccuccaguuucuggugcccaugcuucaagacuucccgcgcaauuguugggucagcaucaacggaauggugaaucauucuugguccgagcuguauagcuuugcccucuucaaggcuaugucucacaugcugugcauuggcuacgggcggcaggccccugaaagcaugacagauaucuggcugaccaugcucuccaugauuguuggagccacguguuacgcuauguuuaucggccacgccacagcucugauucagucucuugacagcuccagacgccaauaucaggagaaguacaaacagguggagcaguauaugagcuuccauaagcugcccgccgauuuucggcagaaaauccacgacuacuaugaacauagauaccaagggaagauguucgaugaggacucuauccucggagaacugaacggcccucuucgcgaggaaauugucaauuuuaacugccggaaacugguggcguccaugccccucuucgccaaugcugaucccaacuucguuaccgccaugcugacaaagcugaaauuugagguguuccagccuggggacuauaucauuagagagggcaccaucggaaagaagauguacuuuauucagcacggcgucgugagcguccucaccaaagggaauaaggaaaugaaacugucugauggauccuacuucggcgagaucugucuucugacacgggggcgcagaacggcuagcgugcgggccgacaccuauugcagacucuacucccugucuguugauaacuuuaacgaagugcuggaggaguauccgaugaugcgccgggcguucgaaacagucgccauugacagacuugaccgcaucggaaagaaaaauagcauccuccugcacaaggugcaacaugaucugaacuccggcguuuuuaauaaccaggagaaugcuauuauccaggaaauugugaaguacgacagagagaugguccagcaagccgaacucgggcagcgggugggccuguuucccccucccccucccccuccccaggugaccucugcuaucgccacacuucagcaagccgcugcgaugagcuucugcccccagguugcccgcccucuggucggaccccucgcucugggcuccccuagacuggugcggcgcccgccgccugggcccgcccccgccgcugccagcccuggacccccuccgcccgcgucuccucccggcgcuccugccucccccagagccccgcggaccagcccuuaugggggacuucccgcugccccucucgcgggccccgcucugccugcccgcagacugucucgggccucccgcccccucagcgcuucucagccgagccugccucacggggcccccggccccgcugccuccacgagaccugcgucuagcuccacaccgcggcuuggacccaccccugccgcuagagccgcugcccccagcccugaucgccgggacuccgccucucccggcgcugccgggggacuggauccucaagacagcgcgagaucccgccucucuagcaaccuguga

SEQ ID NO: 70181 - RNA, 2325 nt, Artificial Sequence
  derived and/or modified sequence opt5 from HCN3__Homo_sapiens__NP_065948
auggaggccgaacagagacccgcugccggcgcgagcgagggggcuaccccuggacuggaagccgugccgcccgucgccccucccccugcuacagccgcuuccggccccaucccuaagucugggccggagcccaaacggcgccaccucggaacgcugcuucaaccuaccguuaacaaguucagccugagaguguuuggcucccauaaagccguggaaauugagcaggagcgggucaagucugcgggggccuggaucauucaccccuacagcgacuuccgcuuuuauugggaucucaucaugcugcuucugauggugggaaaucucauuguucugccugugggcaucacauucuuuaaagaagagaacucucccccguggaucgucuucaaugugcuguccgacaccuuuuuccuccuggaucuuguucugaacuuuagaacaggcauuguggucgaagagggggcugagauccuccuggccccucgggcuauucgcaccagauaccuucggacaugguuccugguggaccucaucagcuccauucccguggauuauaucuuucuggucguugaacuggagccucgccucgacgccgaaguguacaagaccgcgagagcccugcggauugugcgcuucacgaagauccuuagccugcucagacugcuucggcugucucgccucaucagauauauucaucagugggaggaaaucuuucacaugaccuacgaucuggcuuccgccgucgugcggauuuucaaucugaucggaaugaugcuccugcuuugccauugggacggcugucugcaguuccucguucccaugcugcaagauuuucccccugacugcugggugagcauuaaccacauggucaaucacucuugggggagacaguauucccaugcucuuuucaaagccaugagccacaugcuguguaucggauacggccagcaggccccgguggggaugcccgauguuuggcucacaaugcugucuaugaucgugggagcuaccugcuacgcgauguuuauuggccaugccacagcucugauccaaucccucgacagcucccgccggcaguaucaggagaaguacaaacaggucgagcaauauaugucuuuccacaagcugccugccgauaccagacagcgcauucacgaauacuaugagcaucgguaccagggcaaaauguuugacgaagagagcauccuuggggaacuguccgagccccucagagaggaaauuaucaacuucacgugucgcggacugguggcccacaugccucuguuugcucaugccgaccccagcuucgucacagcggugcuuaccaagcuccgguuugagguuuuccaaccgggcgaucugguggucagagaagggucugugggacgcaagauguauuuuauccagcacggccugcucuccguucuggcucggggcgccagagacacacgccuuaccgauggaagcuacuucggcgagauuugccugcucacccggggcagacggacagccucugugcgcgcugacacguacuguagacuguauagccuguccgucgaucauuuuaaugccgugcuugaagaguucccuaugaugcggagagcuuucgagaccguggccauggaccgccuccugcggaucgggaaaaagaacucuauucugcagagaaaacgcagcgaacccuccccuggaagcucuggcgggaucauggagcagcaccucguucaacacgauagagacauggcgcggggaguccgcggcagagcccccuccacaggggcucagcugagcggcaagccugugcuuugggaaccccuggugcaugccccgcuccaggcugccgcggucaccucuaauguggccauugcucugacacaccagcggggaccucugccccuuucccccgauagcccugccacccuccuggcucgcuccgccuggagaucugccggcagcccggcuucuccccugguuccugugcgggcggggcccugggccuccacgagccgccucccugcucccccugccagaacacugcaugccucccuuagccgggcuggacgcucucaagucucccugcucgggcccccgccugggggaggcgggagacggcugggccccagaggacgcccucugagcgccucucagcccucccuuccgcagcgggcgaccggcgacgggagcccuggaagaaaaggcucugggagcgagcgccugcccccuuccggacuccuggcuaagccuccccggaccgcccagcccccgagacccccugugcccgagccugccacaccccgcggccuccaacugagcgcuaacauguga

SEQ ID NO: 70182 - RNA, 3612 nt, Artificial Sequence
  derived and/or modified sequence opt5 from HCN4__Homo_sapiens__NP_005468
auggacaagcugcccccuagcaugagaaagcggcucuacucccugccgcagcaagugggcgccaaggcuuggaucauggaugaggaagaggacgccgaagaggaaggggcgggaggccgccaggaucccucuagacggagcauucgccuuagaccucugcccuccccuucucccagcgcugccgccgggggaaccgagucccggucuagcgcucucggcgccgcugacuccgaggggccugcccgcggagcgggcaaaagcucuacaaacggcgauugcagacgguuccgcgggucccuggccagccuuggaucuagaggcgggggauccggcgggacgggaagcgggucuucccacggccaucugcacgacagcgcugaggaacggcgccucaucgccgaaggcgaugcuuccccgggagaggacagaacacccccuggccuggccgcggagcccgaacggccuggggccucugcucagcccgccgcuagcccgccucccccucagcaaccuccccagcccgccuccgccagcugugagcagccgucugucgauaccgcuauuaagguugaaggaggcgcggccgcuggggaccagauccugcccgaggccgaagugcgccucggacaagccggcuuuaugcagagacaguucggcgcuaugcugcagccuggggugaauaaauuuucccuucggauguucggaagccaaaaggccgucgagagagagcaggaacgcgugaagucugcgggcuuuuggauuauccaucccuauagcgauuuccgguuuuacugggaccugaccaugcuccugcuuaugguugggaaccugaucauuaucccugugggaauuacauucuuuaaagaugagaauaccacacccuggaucgucuucaacgugguuuccgacaccuuuuuccucauugaccuggugcugaauuuuagaacgggcaucgucguggaagauaacaccgagauuauccucgacccgcagcgcaucaagaugaaauaucugaagucuugguucaugguggauuucauuagcuccaucccugucgacuacauuuuucuuaucguugaaacacggauugauagcgagguguauaaaaccgcuagagcccugcgcaucgugcgguucacaaagauccucucucugcuuagacugcuccgccugucccggcugauuagauacauccaccaaugggaggaaauuuuucauaugaccuaugaccucgccagcgcugucgugcgcaucguuaaucugauugggaugaugcuucugcucugccacugggauggcugucugcaguuccuugugcccaugcugcaggacuuuccugaugacugcugggucucuaucaacaauauggugaacaauuccuggggaaagcaguacagcuacgcccucuucaaagcuaugucccacaugcuguguaucggcuaugggcggcaagcccccguuggaaugucugauguguggcugacgaugcucagcaugauugucggcgcgacaugcuacgccauguuuaucgggcaugcuaccgcccugauucagucccuugacucuagcagacggcaguaucaggagaaguacaaacaaguggaacaguauauguccuuccacaagcugccucccgacacacgccagagaauccaugauuacuaugagcaccgguaccagggaaaaauguuugacgaagagagcauucucggcgagcugucugaaccgcugagagaggaaaucauuaacuucaauugucgcaaacuugucgcuuccaugccucucuuugccaacgcggaucccaauuucgugaccagcaugcugaccaagcugcgguuugagguuuuccaacccggggacuacaucaucagagagggcacaauuggaaagaagauguauuucauccagcacggcguggucucugugcucacgaaagggaacaaggaaaccaaacuggccgauggauccuacuuuggcgagauuugccuucugacacgcgggagacggaccgcuagcguucgcgccgacacauauuguagacucuacucucugagcguggauaacuucaaugaaguccuggaggaauauccuaugaugcggcgcgcuuuugagaccguggcccuugacagacucgaucggaucggaaagaaaaacuccauucugcugcauaaggugcagcacgaccucaauagcggcguuuucaacuaccaggagaaugaaaucauccaacagauuguccagcaugaucgcgagauggcccacugcgcucauagagugcaagcggccgcuucugccacgccgacacccaccccugugaucuggacaccccugauucaggccccucuucaggcugccgcggcuaccaccuccgucgccaucgcccugacacaccacccccggcucccugcugccauuuuuagacccccgccugggagcggccugggaaaccugggcgcggggcagacgccccgccaucuuaagcggcuccaaucccugaucccuucugcucugggaagcgccucccccgccucuagcccgucccagguggacaccccuucuagcuccagcuuccacauccagcagcucgcuggcuuuucugcccccgcugggcuguccccucuucugcccuccucuuccagcucucccccuccgggagccuguggcucccccagcgcgccuacacccuccgccgggguugcugccaccacaauugcuggcuucggacauuuucacaaagcccucggcgggagccugucuagcuccgauucuccucugcuuacgccccuccaaccuggagccagaagcccgcaggcugcgcagcccuccccugcucccccuggcgcccgcgggggacugggccugcccgaacacuuccucccgccuccucccucuagccggucccccucuagcucccccggccagcuggggcaaccuccgggagagcuuagccugggccucgccaccgggccccugucuaccccugaaacacccccuagacagcccgagccgccuucccugguggccggagcuagcggcggggccucucccgucggauuuaccccucgcggcggccuuagcccucccgggcauagccccggaccgccucggacauuccccuccgcgcccccuagagcuucuggcagccacgggucccugcuccugccgcccgccagcucuccucccccuccccaggugccucaacgccggggaaccccgccccucacgccuggcagacugacacaggaccuuaagcugaucuccgccagccagcccgcucucccucaggacggggcccaaacccugcgccgggcgucuccccauagcuccggagagucuauggcugccuuuccgcuguucccuagagccggcggcgggagcggaggcuccgggucuagcggaggccuugggccucccggacggcccuauggcgcuauucccggccagcacguuacacugccucgcaaaaccuccagcgggucucucccgcccccucugucccucuucggagccagagcuaccagcuccggcgggcccccucugacagccggaccccagcgggaaccgggcgcgcgcccugagcccgugagaucuaaacuuccuagcaaucuguga

SEQ ID NO: 70183 - RNA, 396 nt, Artificial Sequence
  derived and/or modified sequence opt5 from HCRT__Homo_sapiens__NP_001515
augaaccugcccagcaccaagguguccugggccgcugucacacuccugcuucugcuccugcuucugccuccggcccuccugucuagcggcgcggcugcccagccccugccugacugcuguagacagaaaacgugcuccugucggcucuacgagcugcuucacggggccggaaaucaugcugccggcauccugacccucgggaagcgcagaucuggacccccuggccugcaagggcggcuucagcgccugcuccaggcuagcggaaaccacgccgcgggcauucugacaaugggcagacgggccggggcugaacccgccccucgcccgugccugggaagacgguguuccgcucccgccgcggccucuguugcuccuggcgggcaaagcggaaucuga

SEQ ID NO: 70184 - RNA, 1335 nt, Artificial Sequence
  derived and/or modified sequence opt5 from HCRTR2__Homo_sapiens__NP_001517
augagcggcaccaagcuggaggacucucccccuugcagaaacugguccagcgccuccgaacucaaugagacacaggaaccguuccugaaccccacggauuacgacgaugaggaauuucuucgguaucuguggcgcgaguaccuccacccuaaggaguaugaaugggugcugaucgcuggguacauuaucgucuucguuguggcccuuauuggaaaugugcuggucuguguggcgguuuggaagaaccaucacaugagaaccgugacaaauuauuuuaucgucaaccucucucuggcugacgugcugguuaccauuacaugccuccccgccacccugguggucgauaucacagagaccugguucuuuggccaaagccuuuguaaagugaucccuuaccugcagacgguguccgucucuguuagcgugcucacccuguccugcauugcccuugaccggugguaugcuaucugucauccccugauguucaagagcacagccaaacgcgcuagaaauucuauugugaucauuuggaucgucuccugcauuaucaugaucccucaggccauugugauggaauguagcaccguuuuuccggggcucgcgaacaagacaacccuguucacggugugcgaugagcgguggggaggcgagaucuaccccaagauguaccacauuuguuucuuccuggucacauauauggccccucucugccugauggugcuugcuuaccugcagaucuuucgcaaacucugguguagacaaauucccgggaccucuuccguugugcagcggaaguggaaaccucugcagcccgucagccagccgcgcggaccuggccaacccacaaagucuagaauguccgccguggcugccgaaaucaaacagauccgggcgcgcagaaagaccgcccggaugcuuaugauuguccugcucguguucgcuaucugcuaucugccuauuagcauccugaauguucucaagcgcguguuuggcauguucgcccauaccgaggacagagaaacagucuacgcuugguucacguuuucccacuggcugguguaugccaacucugccgcuaaucccauuaucuacaacuuccuuagcgggaaauuucgggaggaauuuaaggcggccuuuuccugcuguugccugggaguucaccauagacaggaggaucgccucacccggggcagaacaagcaccgagucucgcaaaucccugacaacccagaucagcaauuucgacaacauuucuaaacuuagcgaacaagugguccugacguccaucucuacacuccccgcugccaauggggccggaccucugcagaacugguga

SEQ ID NO: 70185 - RNA, 279 nt, Artificial Sequence
  derived and/or modified sequence opt5 from HCST__Homo_sapiens__NP_001007470
augauccaccugggccauauucucuuccugcuucugcuccccguggccgcugcccagaccacaccuggggagagaagcucccugccggcguuuuaccccggaacgucuggcagcugcuccggguguggaucucuuagccugccucuccuggcuggccuggucgccgccgacgcuguugccucccuccugaucgugggggcuguguuccuuugcgcccggccccgcagaucuccugcgcaagauggaaaggucuauauuaacaugcccggccggggcuga

SEQ ID NO: 70186 - RNA, 1950 nt, Artificial Sequence
  derived and/or modified sequence opt5 from HDAC10__Homo_sapiens__NP_001152758
augggcaccgcccugguguaccacgaggacaugacagcuacgagacuccugugggaugaccccgaaugcgagaucgaacggccugagcgccuuaccgccgcgcuggauagacuccggcagcgcgggcuggaacaaagaugucuucggcugagcgcucgcgaggccuccgaggaggaacucggacugguccauucuccggaauauguuagccuggugagagagacacaggugcucggcaaggaggaacugcaggcccuuuccgggcaguucgacgcuauuuacuuucaccccucuaccuuccauugcgcccggcuggcugccggagcgggccuccaacuggucgaugccgugcuuacaggggcuguucagaacggacuggcccucgugcgcccucccggccaccauggccagagagcugccgcgaauggguuuugugucuucaacaauguggccaucgcugccgcucacgccaaacagaagcacggacugcaucggauucugguuguggacugggauguccaccauggccaagggauccaguaucucuuugaggacgauccuagcgugcuguacuucuccuggcaccgcuaugaacacggaagauuuuggcccuuccuucgggagucugacgccgaugcugugggccgcgggcagggacugggcuuuaccgucaaccucccuuggaaucagguuggcauggggaacgcggacuacguggccgcuuuccugcaucuucugcucccgcuggccuuugaaggacaaaugcaggccacacccgagugcuucgcucaccugacccagcuccugcaagugcuugccggcgggagagucugugcggugcuggagggaggcuaucaucucgaaagccuggcugaguccguuugcaugacggugcagacccuucugggggauccugccccuccucucagcggacccauggccccgugucagucugcucuggaauccauucagagcgcccgggcugcccaagcgccucacuggaaaucucugcagcagcaggacgucacagccgugcccauguccccuagcucucauucccccgagggcagacccccuccgcuccugcccggcgggccuguuugcaaggcugccgcuagcgcccccuccucucuucuggaccaaccuugucucugccccgcgccgagcgugcgcaccgccgucgcucugacaaccccugauaucacgcuggugcuucccccugacgucauccagcaggaagccuccgcucuccgggaggagacagaagccugggccagaccccacgagagccuggcucgcgaagaggcgcugaccgcccucggaaaacugcuuuaccugcucgauggcaugcuggacgggcagguuaauucuggaauugcugccacacccgccuccgcugccgcggcuacccuggauguggccgugcggagaggccuuagccacggggcccaacgccuccugugugucgcucugggccagcucgaccggcccccggaucuggcccaugacggaagaucucuuuggcugaacauccgcggcaaggaagcggcugcccucagcauguuucacguguccaccccucugcccguuaugacagggggauuccugucuugcauucuuggccucgugcugccccuggccuacggguuccagccugaucucguccugguggcucuuggaccgggccaugggcugcagggcccccacgccgcucuccuggccgcgaugcugcggggacuugccggcgggagagugcucgcucugcuggaggagaauagcacgccucaacucgccggaauccuggcucgcguucuuaacggcgaagcucccccuucccuggggcccagcucugucgccuccccugaggacgugcaggcccucauguaucugcggggacagcuggaaccccaauggaagaugcuucagugccacccgcaucugguggcguga

SEQ ID NO: 70187 - RNA, 891 nt, Artificial Sequence
  derived and/or modified sequence opt5 from HDAC11__Homo_sapiens__NP_001129513
augggccuggagaagcuccaccccuucgacgccgggaaauggggaaaggugaucaacuuucugaaagaagagaagcugcugagcgauuccaugcucgucgaagcuagagaggccucugaagaggaccugcuuguugugcauacccggcgcuaccugaaugagcucaaaagaaaggugcugcggccucugcgcacacagacgggcgggaccauuauggcgggaaagcucgcugucgaaagaggcugggccaucaacguugggggaggcuuccaccauugcagcuccgaucggggcgggggauuuugugccuaugcugacauuacacuggccaucaaauuccuuuuugagcgcguggaaggcauuucuagagcuaccaucaucgaucuggacgcccaccaagggaauggacaugagcgggauuucauggacgauaagcgcguguacauuauggacgucuauaacagacacaucuacccgggcgaucgguuugcgaaacaggccauucgcagaaagguggagcucgaaugggggacagaggacgaugaauaucuggacaaaguugagcggaauaucaaaaagagccuucaggaacaccuucccgacguggucguguacaacgcuggaaccgauauucucgagggcgaccgccugggcgggcuguccaucucuccugccggaauugugaagagagaugagcucgucuuccggaugguuagaggccgccgggugcccauccugauggugacaagcgggggauaucagaagagaaccgcucgcaucauugccgacuccauccuuaaucuguuuggccucgggcugauuggaccugaaagccccucugucuccgcgcaaaacagcgauacgccucuucugccgcccgccgugccuuga

SEQ ID NO: 70188 - RNA, 870 nt, Artificial Sequence
  derived and/or modified sequence opt5 from HDAC1__Homo_sapiens__XP_011539611
augaccgugagcuuccacaaguacggcgaguauuuucccgggacaggagaccugagagauaucggcgccgggaaaggaaaguacuaugcugucaacuacccucuccgggacggcauugaugacgaauccuaugaggccaucuucaaaccgguuaugucuaaggugauggaaauguuucagcccagcgcggugguccugcaaugcggguccgauucucuuagcggagaccgccugggcuguuucaaucucacgauuaaaggccaugcuaagugcguggaguuuguuaaguccuucaaccugccuaugcuuaugcucgggggaggcggguacaccaucagaaauguggcccgguguuggacauaugaaaccgccgucgcucuggauacagagauucccaacgagcugccuuacaaugacuacuuugaauauuucggacccgauuuuaaacugcacaucucuccuagcaacaugaccaaucagaacacaaaugaguaccucgaaaagaucaaacagcgccuguucgagaaccuuagaaugcugccgcaugcccccggcgugcagaugcaagcuauuccugaggacgccauccccgaagaguccggggaugaagacgaggaugacccugacaagcggauuagcaucuguucuuccgauaaacgcauugcgugcgaagaggaguuuagcgacucugaagaggaaggagagggcggcagaaagaacuccagcaauuucaagaaagccaagcggguuaaaaccgaagaugagaaggagaaagaccccgaagagaagaaagaagugacggaggaagagaagaccaaggaggaaaaaccggaggcuaagggggucaaagaagaggugaagcucgccuga

SEQ ID NO: 70189 - RNA, 1467 nt, Artificial Sequence
  derived and/or modified sequence opt5 from HDAC2__Homo_sapiens__NP_001518
auggccuacagccagggcgggggaaagaaaaaggugugcuauuacuaugacggcgauaucgggaacuacuauuacggacaaggccaccccaugaaaccucaucggauuagaaugacccacaaucugcuccugaacuaugggcuuuaccgcaagauggagaucuacagaccgcauaaagcuacagccgaagagaugacgaaguaucacuccgacgaauacauuaaguuccugcggucuauccgccccgauaauaugagcgaguauuccaaacagaugcagagauuuaacgucggagaagacuguccuguuuucgauggccucuuugaguucugccagcugucuaccggcgggagcguggcgggagcugugaaacuuaaucggcaacagacagacauggccgucaacugggccggcgggcugcaucacgcuaagaaguccgaggccucuggauuuuguuacgugaaugauauuguucucgcuauccuggaacugcucaaauaucaccagcgcgugcuguacaucgacauugauauccaucacggcgacggggucgaggaagccuucuauaccacagauagagugaugaccguuagcuuucauaaguacggagaguacuuccccggcacaggcgaccuucgggauauuggggcgggaaagggcaaauauuacgccgugaacuuuccuaugcgcgacgggaucgacgaugaguccuauggacagauuuucaagcccaucauuagcaaagucauggaaauguaccaaccuucugcuguggugcugcagugcggcgccgacucccucagcggggauagacugggauguuuuaaucuuaccgucaagggccacgcuaaaugcguugagguggugaagacguucaaccugccgcuccugaugcugggcgggggaggcuauaccauccggaaugucgcccgcuguuggacauacgaaaccgcgguggcccucgacugcgagauccccaacgaacugccuuauaaugauuacuuugaguacuucgggcccgacuucaaacuucacauuucuccuuccaacaugacaaaucagaacacccccgaguauauggaaaagaucaagcagagacuguuugagaaccuccggaugcugccgcaugcuccuggaguucaaaugcaggccauucccgaagaugcugugcacgaggacagcggcgaugaagacggggaggauccugacaaacgcaucucuauuagagccuccgacaagcggaucgccugugaugaggaguucagcgacuccgaagaugaaggcgagggaggcagacgcaaugucgcugaccauaaaaagggggcgaaaaaggcccggaucgaagaggauaagaaagagacggaagacaagaaaacagaugugaaggaggaagacaaaucuaaggauaacagcggagagaagaccgacacaaaaggcaccaaguccgagcagcuuagcaaucccuga

SEQ ID NO: 70190 - RNA, 1287 nt, Artificial Sequence
  derived and/or modified sequence opt5 from HDAC3__Homo_sapiens__NP_003874
auggccaagaccguggcuuacuucuaugaccccgaugucggcaacuuucacuacggggccggacauccuaugaaaccgcacagacuggcgcucacacauagccugguucuucacuauggccuguacaagaaaaugaucguguucaagcccuaucaggcuucccaacaugacaugugccgguuucacucugaggauuacauugacuuccuccagcgcgugagcccuacgaauaugcagggguuuaccaaaucccugaacgccuucaaugucggagaugacugucccguguuuccuggccuuuucgaauuuugcucuagauauacaggggccagccugcagggagcuacccaacucaacaauaagaucugugauauugccaucaacugggcuggcggccugcaccaugccaagaaauucgaggcguccggguuuugcuacguuaaugacauugugaucggaauccuggaacuccugaaguaccacccccggguccuuuauauugauaucgacauucaucacggcgauggggugcaggaggccuucuaccugacagaccgcguuaugaccgugucuuuucacaaauauggaaacuacuucuucccuggcacaggggauauguaugaagucggagcugagagcggcagauacuauugucucaaugugccgcugcgggacggcaucgacgaucaguccuacaagcaucuuuuucagcccgugauuaaccaagucguugacuucuaccagccuaccugcaucgugcugcaguguggggccgauagccucggaugcgaccgccugggcuguuuuaaucugucuauuagagggcacggagagugcguggaauaugucaaauccuucaacaucccccuccuggugcuuggcgggggaggcuacacgguucggaauguggcucgcuguuggaccuaugagacaagccugcucgucgaagaggccaucucugaggaacugccuuacuccgaguauuuugaauacuucgcgcccgauuuuacccuucauccggacgugagcacaagaauugagaaccaaaauucucggcaguaucuggaucagauccgccagaccauuuucgaaaaccucaagaugcugaaccacgccccuuccguucaaauccaugacgugcccgcugaucugcucacguacgacagaacagaugaggccgacgcugaggaacggggcccugaggaaaauuacagccgccccgaggcccccaacgaauuuuaugacggggaucacgacaaugauaaggaguccgacgucgagauuuga

SEQ ID NO: 70191 - RNA, 3255 nt, Artificial Sequence
  derived and/or modified sequence opt5 from HDAC4__Homo_sapiens__NP_006028
augagcucccagucucaccccgacggccugagcgggagagaucaaccuguggagcuccugaacccggcccgggucaaucauaugcccuccaccguugacguggcuacagcccuuccucuccagguggcgcccucugcugucccuauggaucugcgccuggaccaccaguucagccuucccguggccgaaccugcccugagagagcagcaacuccagcaggaacugcuggcucucaagcagaaacaacagauccagcggcagauucugaucgccgaguuucaacgccagcaugaacagcuuuccagacaacacgaggcucagcugcaugagcacauuaagcagcagcaagaaaugcucgccaugaaacaccagcaggagcugcuugaacaucagcggaagcuggagcgccacagacaagagcaggaacucgagaaacagcaucgggaacagaagcugcaacagcugaagaacaaagagaagggaaaagaaucugcgguugccagcacggaggugaagaugaaacuccaggaguucguccugaauaagaagaaagcucuugcccaccgcaaccugaaucacugcaucuccagcgauccgagauacugguauggcaagacccagcauucuucccucgaccaaagcucucccccucaguccggggugagcacaucuuacaaccaccccguucugggaauguaugaugcuaaagacgauuuuccucuucggaagaccgccuccgaacccaaucugaaacuccgcagcagacugaagcagaaaguggcggagcggcgcuccucuccgcugcucagacggaaggacggcccugucgugacagcccugaagaaaagaccccuugaugugaccgacagcgcuuguuccagcgccccugggucuggacccuccagccccaacaauucuagcggcuccgucucugcugaaaacggcauugccccugccguuccgagcauccccgcugagacaucccuggcgcaucgccucguggcccgggaagggagcgcugccccucugccccuuuacaccucuccuucccugcccaauaucacgcucggacugccggccaccggcccuagcgcugggacagccggacaacaggaugcggagagacugacccuccccgcucugcagcagcgccuuucucuguucccuggcacacaccucacccccuaucuguccacgagcccucuggagcgggacgggggagccgcccauagcccccuucuccaacacauggugcugcuggaacagccgccugcucaggcuccccucgucacaggccugggcgcccuuccccugcacgcccagucucucgugggggcggacagaguuagcccuuccauucauaagcugcgccaacaccggccgcugggaagaacccagucugcuccccuuccucagaacgcccaggcccuccaacaucuggugauccagcagcaacaccagcaguuucuggagaaacacaagcagcaauuccagcagcagcaacuccagaugaauaaaauuauccccaagccuagcgaacccgcucgccagccugagucccaucccgaagagacagaggaagaacugcgggaacaccaggcccuucuggaugagccguaccucgacagacugccuggccaaaaggaggcgcaugcccaggcugggguccaggugaaacaggaacccauugagagcgaugaagaggaagccgagccuccccgcgagguugaaccgggacaacggcagccuucugagcaggaacugcuuuuuagacaacaggcucuccugcuggagcagcagcggauccaccaacuccgcaacuaucaggccuccauggaagccgcuggcauucccgugagcuucgggggacauagaccucugucucgggcgcaguccagccccgccucugcuaccuuucccgucagcgugcaggagccuccgaccaagcccagauucacaacgggccuugucuacgacacccugaugcucaaacaccaaugcacauguggcuccuccucuucccacccugagcaugccgggcgcauccagagcaucuggucccggcugcaggaaaccggacugagaggcaagugcgaguguauucgcgggagaaaagccacacuugaggagcuccagaccgugcacucugaagcucauacgcugcuguacggaacaaauccccucaaccggcaaaagcuggauagcaagaaacuucugggcucccucgccucuguuuuugugcgccugccuugcgggggcgucggaguggacagcgauaccaucuggaacgagguucacuccgcgggcgcugccagacuggccguggggugugucguggagcuuguguucaagguugcuaccggagaacugaaaaauggcuuugccgucgugcggcccccugggcaucacgcggaggaaucuacaccgaugggauucugcuauuucaacagcguggcugucgccgccaagcuccugcagcagcgccucuccgugagcaaaauucugaucguugacugggaugugcaccauggcaaugggacccaacaggcuuuuuacucugaccccuccguccuuuauaugagccugcacagauacgaugacggcaacuucuuuccuggaucuggcgcccccgacgagguggggacaggaccuggcguuggguucaaugugaacauggcuuuuacgggaggccucgaucccccgaugggggacgccgaguaucuggcggccuuccggaccgucgugaugccuauugcuuccgaauuugcccccgauguugugcuggucagcucuggcuucgacgcuguggagggacaucccacaccucuuggcggguacaaucuguccgcccgcuguuuuggauaucucaccaagcagcugaugggccucgccgggggaagaaucgugcuggcucuugaaggcgggcacgaucugacagcgaucugcgacgccagcgaggcuugugucuccgcccuccugggcaacgaacuggauccccuuccugagaagguucugcagcaacggccgaaugccaacgcugugcgcagcauggagaaagugauggaaauucacucuaaguacuggagaugccuccagcggaccacgagcaccgccggaagaucccugaucgaggcgcagacaugcgaaaaugaggaagcugagaccgucacagccauggccucucucagcgugggcguuaaacccgcugagaagcgcccugacgaggaacccauggaagaggaaccuccccuguga

SEQ ID NO: 70192 - RNA, 3372 nt, Artificial Sequence
  derived and/or modified sequence opt5 from HDAC5__Homo_sapiens__XP_005256961
augaacagccccaaugaguccgccgacggcaugucugggagagaaccuagccuggagauccucccgcggaccucccugcacucuauucccgugacagucgaaguuaagccugugcuuccccgcgcuaugccuagcuccaugggaggcgggggaggcgggucucccagcccuguggagcugagaggagcccucgucggcuccguggauccgacgcugcgggaacagcaacuucagcaggagcugcucgcgcugaaacagcaacagcagcugcagaagcaacuccuguucgcugaguuucagaaacagcaugaccaccuuacccgccagcaugaaguucaacugcagaagcaccucaaacagcaacaggagaugcuggccgccaagcagcagcaagaaaugcuugcugccaagagacagcaggagcuggagcagcaacggcagcgcgaacagcagagacaagaggaacucgagaaacagcggcuggaacagcagcugcucauccugcgcaacaaggagaaaagcaaggagucugcuauugccuccacagaagugaaacuuagacugcaagaguuccuccugagcaagucuaaggaacccaccccuggcgggcuuaaucauucccugccccagcacccuaaaugcuggggagcgcaccaugccagccucgaucagucuuccccgccccaaagcggcccucccgggacaccucccuccuacaagcugccccugccuggaccguaugacucucgggaugacuuuccccuccgcaaaaccgcuagcgagccuaaccugaaggucagaucccggcuuaaacagaagguggccgaacgcagaagcucuccccugcuccggagaaaagauggcacaguuaucuccaccuucaagaagcgcgcuguggagauuacgggggccggaccuggcgcgagcucugucuguaauagcgcccccggcuccgggccgucuagcccuaacuccagccacucuaccaucgcugagaauggauuuacaggcuccgugcccaacaucccuaccgaaaugcugccccagcaucgggcccuuccucuggacagcucucccaaucaguucucccucuacacaagcccgucccugccuaacauuucucuggggcuccaagcuaccgugacggucacaaauagccaccugaccgccucccccaaacuuucuacacagcaggaggccgaaagacaggcucugcaaagccuccgccagggaggcacccugaccgggaaguuuauguccacaagcucuauccccggaugccugcuuggcguugcgcucgagggcgauggguccccucacggacaugccagccugcugcagcacgugcuccugcuugaacaggcucggcaacagucuacgcugauugccgugccgcuccauggccagagcccccuggucaccggggagagaguggccacauccaugcgcaccguuggaaaacugccucggcacagaccccuuucucgcacacaaagcuccccucucccccagagcccucaggcucugcagcaacuggugaugcagcagcagcaucaacaguuccucgagaagcagaaacagcaacagcugcagcuuggcaagauccugaccaagacgggggaacucccccggcagccgacaacccacccugaggaaaccgaggaggaacugacagagcaacaggaaguccugcuuggcgagggagcccucaccaugcccagagaaggcucuacagaguccgagagcacgcaggaagaccuggaggaagaggaugaagaggacgauggggaggaagaggaagacuguauucaagugaaagacgaggaaggagaguccggcgcggaggaagggccugaucuggaggaacccggagcuggcuauaagaaacucuuuucugacgcccagccgcugcagccucuucagguuuaccaagcgccccugagccucgcuaccgugccucaccaggcccuggggcgcacacaguccucucccgcugcccccggcggaaugaaaagcccuccggaucagcccgucaagcaucuguucaccacaggcguggucuaugacaccuuuaugcuuaagcaccaaugcaugugugggaacacgcaugugcacccugagcacgcgggacggauccaguccauuuggucuagacuccaggagaccggccugcugagcaagugcgaacggauccgcgggagaaaagccacacucgaugagauccagaccguucauuccgaauaccacacacugcuuuauggaaccagcccccugaaucggcaaaagcucgacucuaaaaagcugcugggcccuauuucccagaaaauguacgcugugcuucccugugggggcaucggagucgauagcgacacgguguggaacgagaugcauucuuccagcgccguuagaauggcugugggcugccugcucgaacuggccuucaaggucgcggccggggagcucaagaauggauuugcuauuauccgcccuccgggccaccaugccgaggaaucuacagcuaugggguucuguuucuuuaacuccguggccauuaccgccaaacugcuucagcaaaagcugaacgugggaaaaguucucaucgucgauugggacauccaccacggcaaugggacacagcaggcuuucuacaacgaucccagcgugcuguauauuucccugcaucgguacgacaauggcaacuuuuucccuggaagcggcgcgcccgaggaagucgggggaggcccuggggugggauauaaugugaacguugccuggaccggcggcguggaucccccgaucggggacgucgaguaccuuaccgcuuuuagaacagugguuaugccuauugcccacgaguucucucccgacgugguccuggugagcgccggauuugaugcuguugaaggccaucucucuccccucgggggauauuccgugacggcccgcugcuucggccaccugaccagacagcugaugacacuugccgggggacgggucgugcuggcucucgagggcggccaugaccugaccgccaucugugaugccagcgaggcuugcguguccgcccugcuuucugucgaacugcaaccucucgacgaagcgguucugcagcagaagcccaauauuaacgcuguggccacacucgagaaagugaucgaaauccagagcaagcacugguccugcguccaaaaauuugccgcugggcugggacgcucucuuagagaggcccaggcuggcgagaccgaagaggccgaaacggugagcgcgauggcccugcuguccguuggggcugagcaggcccaggcugccgccgcucgggagcacagcccucgcccggcggaggaacccauggaacaagagccugcccucuga

SEQ ID NO: 70193 - RNA, 3648 nt, Artificial Sequence
  derived and/or modified sequence opt5 from HDAC6__Homo_sapiens__NP_006035
augaccagcacaggccaggacuccacgaccacaagacaacggcgcucuagacagaacccccagagcccuccgcaggauuccucugugaccagcaagcggaauaucaaaaagggggccgucccccgcuccauuccuaaccuggcugagguuaaaaagaaaggaaagaugaagaaacucggccaagccauggaagaggaccugaucguggggcuucagggaauggaucugaaucucgaagcggaggcucuggccggcacagggcuugugcuggacgaacagcucaacgaguuccacugccugugggaugacucuuuucccgagggaccugaaagacugcaugccauuaaggagcagcucauccaagaaggccugcuugaucggugugucagcuuccaggcucgcuuugccgagaaagaggaacugaugcucgugcacucccuggaguacauugaccuuauggaaaccacacaguauaugaaugagggcgaacugagaguucucgcugauaccuacgacagcguguaucugcaucccaacucuuacuccugcgccugucuggcgagcgggucuguccuccggcugguggaugccguucuuggagcugagauccgcaauggcauggccaucauuagaccuccggggcaccaugcucagcacucccugauggacggauauugcauguucaaccacguggccgucgcggcccgguacgcucaacagaagcaucgcaucagacgggugcucauuguggauugggacguccaccauggccaggggacgcaauuuaccuucgaccaggaucccagcguucuguauuuuucuauccaccgcuacgagcagggaagauucuggccucaccuuaaagccuccaauuggagcacaaccggcuuuggccaggggcaaggauacacaauuaacgugcccuggaaucaggugggcaugcgggacgcugauuauaucgccgccuuccugcauguccuccugccuguggcucuggaauuucagccccagcucguucugguggcggccggguucgacgcucugcaaggagauccgaagggcgagauggccgccaccccugcuggguuugcccagcugacgcaccuccugaugggacuugcgggcggcaagcugauucucucccuggaagggggauacaaccugagagcucucgccgagggcgucucugccagccugcauacacuucugggggaccccuguccuaugcucgaaucccccggagcucccugccgcagcgcccaggcuucuguguccugugcccuggaggcgcuggagccuuucugggaaguucuugugcggagcaccgagacagucgaaagagauaauauggaggaagacaacguggaggagucugaagaggaaggcccgugggagcccccuguccuccccauccugaccuggccugugcugcagagccgcaccgggcucguuuaugaucaaaauaugaugaaccacugcaaccugugggacucccaucaccccgaggugccgcagcggauccuuagaauuaugugucgccuggaggaacucggccuggccggacggugccugacacuuacgccuagacccgcuaccgaagccgagcuccugacaugucacucugcugaauacgucggccaucugcgcgccaccgagaaaaugaagacacgggagcuccacagagaaagcuccaauuucgauagcaucuauauuugcccuucuaccuuugcgugcgcccagcuggcuacgggggccgcuugucgccuuguggaggccguucuguccggagaagugcucaacggcgccgcugucgugcggcccccugggcaucacgcggagcaggacgccgcuugcggauucugcuuuuucaauagcguggccguugccgcuagacacgcccaaacaaucucuggccaugcgcugcggauucugaucgucgacugggaugugcaccaugggaacggcacccagcacauguuugaagacgaucccuccgugcuuuacgucagccuccaucgcuaugaccacggaaccuucuuuccgaugggcgaugagggggcuuccucucagaucggacgcgccgccggcacaggguucaccgugaauguugcuuggaacggaccucggaugggcgacgccgauuaccuggcggcuuggcacagacuggugcuccccauugccuacgaguuuaaucccgaacugguccuugugagcgccggguucgacgcugcccgcggcgauccucugggaggcugucaaguuuccccggagggguaugcucaucucacacaccuucugaugggacuugccucuggccggaucauucucauccuggaagggggauacaaccugacgagcauuuccgagagcauggcggccuguaccagaucucuccugggcgaucccccuccccuucugacacucccuagacccccucuguccggggcucuggccagcaucaccgaaacaauccaggugcauagacgguauuggcgcucucuuagagucaugaaaguggaggaccgggagggccccuccagcucuaagcugguuaccaaaaaggcuccgcagccugccaaaccccgccucgccgaaagaaugacgacccgggagaagaaggugcuggaagcuggaaugggcaaagucacaagcgcguccuuuggggaggagagcaccccuggacagacaaauucugaaaccgccgugguggcucucacgcaagaccagcccuccgaggccgccacaggcggggcuacccuggcccagacaauuagcgaagcggcuaucggaggcgccaugcuuggccagaccaccuccgaggaagccgucgggggagcuacaccggaucaaacgaccucugaggagacaguuggcggggccauucuggaccagaccacaagcgaagacgcggugggaggcgcuacccucgggcagacgacauccgaggaagccgugggaggcgccacccuggcucagaccacaucugaggccgcuauggaaggcgccacccuggaucaaacaacgagcgaggaggcgccugggggaaccgaacuuauccagacaccccuggccuccucuaccgaccaccagacaccucccaccagccccguccaaggcacgaccccucagauuuccccgagcacacucaucgggucucugcgcacccucgagcugggauccgaaagccagggcgcuucugagucccaggcccccggggaagagaaccuucugggagaggcugccggcggccaagauauggccgacagcaugcucaugcaggggucuagaggacugacagaucaggcuauuuucuacgcggugaccccucugcccuggugcccucaucuuguugccgugugucccaucccugcugccggccuggacgucacacagccgugcggggauuguggaaccauccaagaaaauugggugugccucuccuguuaucagguuuacugcggccgguauauuaacgggcacaugcugcagcaccauggaaauagcggccacccccucgugcuguccuacaucgaccuuagcgccuggugcuacuauugucaggcuuacguccaucaccaagcccugcuggaugugaagaacauugcgcaccagaauaaauuuggcgaggacaugccucauccccacuga

SEQ ID NO: 70194 - RNA, 2865 nt, Artificial Sequence
  derived and/or modified sequence opt5 from HDAC7__Homo_sapiens__NP_001091886
augcacagccccggcgccgacgggacccagguguccccuggagcucauuacugcucuccgacaggcgccgggugucccagaccuugcgcggauacgcccggaccucaaccccagccuauggaccugcgggucggccagcgcccgcccguugagccucccccugaacccacccuccuggcccuucagagaccgcaacggcugcaccaucaccucuuccuggccgggcuucagcagcagcgcagcguggagccuaugagacuguccauggauacacccaugccugaacuccaagugggaccccaggagcaggaacugcggcagcugcuccauaaggacaaaucuaagcgcagcgccgucgcuuccucugugguuaaacaaaagcuggccgaggugauccuuaaaaagcagcaggcugcccuggagagaaccguccaccccaacagcccuggcauuccguaucggacacucgaaccccuggagaccgaaggcgcgacacgcuccaugcuuagcucuuuucugccucccgugccuucccuccccagcgauccgccugagcacuucccccugagaaagaccguuucugagccuaaucugaaacuccgguacaagcccaaaaagucccuggaacgccggaaaaacccucuucugagaaaggagagcgcucccccgucucuccgcagacggccugcugaaacgcugggggacuccagccccuccucuagcuccacccccgccagcggauguucuuccccuaaugauagcgagcauggcccgaaccccauccuugggucugaagcugacagcgauagacgcacacacccuacccugggaccccggggcccuauucucgggucuccccauacaccucuguuucugccccacggacucgagccggaggccggcggcacccugccuuccagacuucaacccauccugcuccuggacccuagcgggucccacgcgccccuucugacggugccgggacucggcccucugcccuuccauuuugcccagagccugaugacaaccgaacgccucucuggguccggacugcacuggccucuuagccggacaagaucugagccccugcccccuuccgcuaccgccccgcccccucccggcccuaugcagccccgccucgaacagcugaagacccauguccaagugauuaaacggagcgcuaagccuuccgagaaaccgagacugcgccagauccccucugccgaagaucuugagacagacgggggaggcccuggccagguggucgaugacgggcucgagcaccgggaacugggacauggccagcccgaggccagagggccugcuccccugcaacagcacccgcagguucuccugugggaacagcaacgccuugcgggacggcugccuagaggcagcacgggggacaccgugcuccugccccuggcccagggcggacaccggccccuuucccgcgcucagucuagcccugccgcccccgcuucccucagcgccccugagccggcgucucaggcuagagugcuguccagcucugaaacacccgcccggacccugccuuucacaaccggccucaucuaugauuccgucaugcugaagcaucaaugcagcuguggggacaauucuagacaccccgagcaugccggacgcauucagagcaucuggucccggcuucaggagagaggccugcgcagccaaugcgaaugucucagagggcggaaagcgucucuggaggaacugcaguccgugcacagcgagcgccacguucuucucuacggaacgaacccucuguccagacugaagcucgauaauggcaaacuggccgggcuucuggcucagcggauguuugugaugcuccccugcggcggagucggcguggacacagauaccauuuggaacgagcugcauucuagcaaugccgcgcgcugggccgcuggguccguuaccgaccuggccuucaagguggcuucuagagaacuuaagaacggauuugccgucgugcggccgccuggccaccaugcggaucacagcacagccaugggguucugcuuuuucaauuccgucgcuaucgccugucgccagcuccaacagcagucuaaagcuagcaagauucugaucguggacugggauguucaucacggaaacggcacccagcaaacauuuuaucaggaccccuccgugcuguacauuagccuccacagacaugaugacgggaauuucuucccuggcucuggagccgucgacgaggugggcgccggguccggagaaggcuuuaacguuaauguggcuugggcugggggacuggaucccccuaugggcgaccccgaguaucuugccgcuuuccggaucgucgugaugccgaucgcccgcgaauuuagcccugaucuggugcucguuucugccggguucgacgcugccgagggccaccccgcgccccugggaggcuaccaugucuccgcuaaauguuuuggguacaugacgcagcagcugaugaaccuugccggaggcgccguggugcuggcucucgaagggggacacgaucugaccgccauuugcgacgcgagcgaggcuugcgucgccgcccuccugggcaacagaguggauccucuuucugaggaaggcuggaagcaaaaaccgaaucugaacgcuauccggucccucgaggccguuauuagagugcauagcaaguauuggggguguaugcagcgccuggcuuccugccccgacagcugggucccucgggugcccggagccgauaaggaagagguugaggcggugacagcccuggcuucucuuagcgucggcauccuggccgaagacagaccuuccgagcagcucguggaagaggaggaacccaugaaucuguga

SEQ ID NO: 70195 - RNA, 861 nt, Artificial Sequence
  derived and/or modified sequence opt5 from HDAC8__Homo_sapiens__NP_001159890
auggaggaacccgaggaaccugccgacagcggccagucccuggugccggucuacaucuauucucccgaguacguuagcaugugcgauucccucgcuaagauuccuaaaagagccucuauggugcacagccugaucgaagcguaugcccuucauaagcaaaugcgggacgaggcuuccggguucuguuaccugaacgaugccgugcucggcauucugcgccuuagacggaaauuugagcgcauccuguaugucgaccucgaucugcaccauggagacgggguggaagaugcuuucucuuuuaccagcaagguuaugacagugucccugcacaaauucagccccggauuuuucccuggcacgggggacgucucugaugugggacucggcaagggcagauacuauuccguuaaugugcccauucaggacgggauccaggaugagaaguacuaccagaucugcgaaagcguccugaaagagguguaucaagccuuuaacccuaaggcugugguccuucagcugggagccgacaccauugcgggcgauccgauguguucuuucaauaugacacccguugggaucggaaaaugccucaaguacauucugcaguggcagcuugccacccugauccucggcgggggaggcuauaaccuggcuaauacagcccgguguuggaccuaccugacaggcgugauucucgggaaaacccuguccagcgagaucccugaccaugaauuuuucacggcuuauggacccgacuacgugcuugagauuaccccuucuugccgccccgauagaaacgaaccgcaccggauccaacagauccugaauuauauuaagggcaaccucaagcacgucguguga

SEQ ID NO: 70196 - RNA, 1767 nt, Artificial Sequence
  derived and/or modified sequence opt5 from HDAC9__Homo_sapiens__NP_001191073
augaugagcucccccgcccagccugaccugauguggaaccucgugccguggguccuguucugcggcuguugcagaaucuuucccgaugggguugcuggacgggagcaacuucuggcccagcagcgcaugcacucuaugauuagcuccguggacgugaagucugaagucccugugggccucgagcccaucagcccucuggaucuuagaaccgaccugcggaugaugaugcccguuguggauccugucgugcgcgaaaaacagcuccaacaggagcugcugcucauucagcagcaacagcagauccagaagcaacugcuuauugcggaguuccagaaacagcaugaaaaucugacaagacaacaccaggcucagcuccaggagcauaucaaggaacugcuugccaucaaacaacagcaggagcugcucgaaaaggagcagaagcuggagcaacagcggcaggaacaggagguugaacgccacagacgggagcaacagcugccgccccuccgcgggaaagacagaggacgggaacgcgccguggcuuccacggaggucaagcagaaacugcaggaguuucuucugucuaagagcgccaccaaagauacaccuaccaacggcaagaaucauuccgugagcagacaccccaagcucugguacacagcugcccaccauaccucucuggaccaauccagcccuccccuuucugggacauccccgagcuauaaauacacccugccuggagcgcaggaugccaaggacgauuucccccuccggaaaacggaaucuuccgugagcuccucuagcccuggcuccggccccagcucucccaacaaugggccuaccggauccgucacagagaacgaaaccagcguucugccgcccacaccucacgcugagcagauggugucucaacagcgcauucugauccaugaagacagcaugaaucuccugucccuuuauaccucucccagccugccuaacauuacgcucggccugcccgccgugccgucccagcuuaaugcuagcaacucucugaaggagaaacagaagugugagacacaaacccucagacagggggucccucugcccggacaguacggcggguccaucccugccucuagcucccacccccacgugacacuggaaggaaaaccucccaauagcucccaucaggcgcuccugcaacaccuucugcucaaggagcagaugcggcagcagaagcugcugguugccggcggcgugccgcuucauccucaaucuccccucgcuaccaaagaaagaauuagccccgggauccgcggaacccacaagcugccucggcauagaccgcugaaccgcacacaguccgcuccccucccucagucuacgcuggcccaacuugucauucagcagcagcaccaacaguuucuggagaaacagaagcaguaucaacagcagauccacaugaauaaacuccugagcaaguccaucgaacagcugaagcaacccggcagccaucuugaggaggccgaagaggaacuccagggggaucaggccaugcaggaggaccgggcuccuucuuccggaaacagcaccagaucugacuccagcgcgugcguggaugacacacugggccaaguuggggccgugaaagucaaggaggaacccguggauucugacgaggaugcucagauucaggaaauggagagcggagaacaagccgccuucaugcagcaggucaucggcaaagaccuggcuccuggcuuugugauuaagguuaucauuuga

SEQ ID NO: 70197 - RNA, 1989 nt, Artificial Sequence
  derived and/or modified sequence opt5 from HDC__Homo_sapiens__NP_002103
augauggagcccgaagaguacagagaacggggccgcgagaugguggacuauaucugccaguaccugagcaccgucagagaacggcgcguuacaccugaugugcaaccgggguaucucagagcccagcugcccgaguccgcuccugaggaccccgauucuugggacagcauuuucggagauaucgaacggauuaucaugccuggcgugguccacuggcagucuccccauaugcacgccuacuauccugcgcuuacguccuggccgagccugcucggggacaugcuggcugaugccauuaacugucuuggauuuaccugggccuccucucccgcuugcacagagcuggaaaugaaugugauggacuggcucgccaagaugcugggccugccugagcauuuccuccaccaucaccccagcucccaagggggaggcguucugcagagcaccgugucugaguccacacuuaucgcucugcucgccgcgcgcaaaaacaagauccuggaaaugaaaaccagcgagccugaugccgacgaaucuugucuuaaugcuagacuggucgccuacgcuuccgaucaggcccacagcucuguggagaaggcgggccucauuucccugguuaaaaugaaguuucugcccguggacgauaacuucagccucagaggggaagcccugcagaaggcuaucgaggaggacaaacagcgcggacuugucccgguguuugugugcgccacacugggcaccacgggggucugugcuuucgacugccucuccgaacugggaccuauuugugccagagagggccuuuggcugcauaucgaugccgcuuaugcggggaccgccuuucucugccccgaguuccggggauuucugaagggcauugaauacgcugacucuuucacauuuaauccuagcaaauggaugaugguucacuucgauuguaccggcuuuugggugaaggacaaauacaagcugcaacagacauucuccgugaaccccaucuaucuccgccaugccaauagcggggucgccaccgauuucaugcacuggcagauuccccugucuagacgguuucgcuccgugaaacuuugguucguuauccggagcuuuggagugaagaaccugcaggcucacguccggcauggcacggaaauggccaaguacuucgagucucucgugagaaaugacccuagcuuugagaucccggcgaaacgccaccuggggcuuguuguguuccggcugaagggacccaacugccucacagaaaauguccugaaagagauugcuaaggccggcagacuguuucucaucccugccaccauucaagauaaacugaucauucgcuucacagugaccucccaguuuaccacacgggacgauauccuuagagacuggaaccugauccgcgaugcugccacgcucauucugucucagcauuguaccagccaacccuccccucgggucgggaaucugaucagccagauuagaggagcucgcgccugggcgugcggcacaucucuucaguccgugagcggcgccggggacgaccccguucaggcucggaagaucauuaagcaaccgcagagagugggagccggcccuaugaaacgcgaaaacgggcuccaccuggagacccugcucgaucccgucgacgauugcuucucugaagaggcuccugacgccacaaagcauaaacuguccagcuuucuuuucuccuaucugucugugcagaccaagaaaaagacgguucggagccucuccuguaauucugugcccgucagcgcgcagaagccucugcccacagaggccuccgugaaaaacggaggcagcucuagagugcggaucuuuucccgcuucccggaagauaugaugaugcugaagaaaagcgcuuucaagaaacuuaucaaguuuuacucuguuccuuccuuccccgagugcagcucucaaugugggcuccagcugcccugcuguccucugcaggccauggucuga

SEQ ID NO: 70198 - RNA, 615 nt, Artificial Sequence
  derived and/or modified sequence opt5 from HDDC2__Homo_sapiens__NP_057147
auggccagcguguccucugcuaccuucagcggccacggggccagaucccugcuccaguuucugcggcuugucggacaacugaagcgcguucccagaacaggcuggguguaccggaacgugcagcgcccugagucugucagcgaccauauguauagaauggcggugauggcuaugguuaucaaagaugaccggcucaauaaggaucgcugcgugagacuggcccuuguccacgacauggccgaauguauugugggggauaucgcuccggccgacaacauucccaaagaggaaaagcaucggcgcgaggaagaggcuaugaaacagaucacgcagcugcucccugaggaucugagaaaggaacuguacgagcucugggaagaguaugagacccaauccucugccgaagcgaaguucguuaaacagcuggaccagugcgagaugauucuucaggccagcgaauacgaggaucuggaacacaagcccggacggcuccaagacuuuuaugauuccacagcuggcaaauucaaucauccugagaucgugcagcuggucagcgagcuugaagccgagcgcucuaccaacaucgcugccgcggccuccgaaccccacagcuga

SEQ ID NO: 70199 - RNA, 771 nt, Artificial Sequence
  derived and/or modified sequence opt5 from HDGF__Homo_sapiens__NP_001119522
augcaccccgagggcgggcaguucgugccucaacugcucggacaucugcuugccaccaagcugaaaagauuucuccugagcaagggcgggcggcgcgcucagaucccggacgucuccagagccacaccccacacgauugaugaaaugccugaggcggcuguuaaaucuaccgccaacaaguaccagguguucuuuuucggaacacaugaaaccgccuuucuuggccccaaagaccuguucccuuaugaggaaagcaaggagaaguuugggaaacccaauaagcggaaaggauucuccgagggccucugggaaaucgagaacaauccuacagugaaggcuucuggcuaccagagcucccagaaaaagucuugcgucgaggaaccggagcccgaaccugaggccgcugaaggggauggagacaagaaaggcaacgccgaggggagcuccgaugaagagggaaagcuggugauugacgagcccgcgaaagaaaagaaugagaaaggcgcccugaagcgcagagcuggggaucuccuggaagacagcccuaaacggcccaaggaggccgaaaacccggagggagaggaaaaggaggcugccacccuugaaguugagcgcccucugcccauggaaguggagaaaaauucuacaccuuccgagcccggcagcggcagagggcccccucaagaagaggaagaggaggaagaugaggaagaggaagcgaccaaggaggacgccgaggcuccgggaauccgggaucacgaaucucucuga

SEQ ID NO: 70200 - RNA, 756 nt, Artificial Sequence
  derived and/or modified sequence opt5 from HDGFL1__Homo_sapiens__NP_612641
augagcgccuacggcaugcccauguauaaguccggggaccugguguucgcuaaacucaagggauacgcccacuggccugcgagaaucgagcauaugacccagccgaaccgguaucaagucuuuuucuuuggcacacacgaaacggcuuuccugucucccaaacgccuuuuuccuuacaaggagugcaaagaaaaguucgggaagcccaauaaaagacggggauuuagcgccggccugugggagauugaaaacaauccuaccguucaggccuccgauuguccccucgcuucugagaaggggagcggagacggcccuuggccggagcccgaagccgcugagggcgaugaagacaaaccuacacaugccgggggaggcggggaugagcugggaaagcccgacgaugacaaaccuaccgaggaagagaagggcccccuuaagcgcuccgcgggggauccgccugaagacgcccccaaaagaccuaaggaggcugcccccgaucaggaagaggaggcugaagccgagcgggcggccgaagcugagcgcgccgcugccgccgcugcggccacagcuguggacgaagagucucccuuccugguggccgucgagaacggaagcgccccuuccgaaccgggccucgugugcgagcccccucagcccgaagaggaggaacugagagaggaagagguugcugaugaagaggccagccaagaguggcacgcggaagcuccuggcgggggagaccgggacucucuguga

SEQ ID NO: 70201 - RNA, 612 nt, Artificial Sequence
  derived and/or modified sequence opt5 from HDGFRP3__Homo_sapiens__NP_057157
auggccagaccccggccucgcgaguacaaggcuggcgaccugguguucgccaaaaugaagggguauccgcacuggcccgcgagaaucgaugaacucccugagggagcugucaaacccccugccaacaaguaccccaucuuuuucuuuggcacccaugaaacagccuuccuggggccuaaagaccuuuuuccguauaaggaguacaaggauaaauucggaaagagcaauaaacggaagggcuuuaacgaagggcugugggagauugagaauaaccccggaguuaaauucacgggcuaucaggcuauucaacagcaguccucuagcgaaaccgagggcgaagggggaaauacagccgacgcuuccucugaggaggaaggcgaucgcguggaggaagacgggaagggaaagcggaaaaacgagaaggccggcagcaaaagaaagaaauccuacaccucuaagaaaagcuccaagcagagccgcaagucuccuggggaugaagacgauaaagacugcaaggaggaggaaaauaaauccagcucugagggaggcgaugcgggcaacgacacaagaaauaccacauccgaucuccaaaagaccagcgaagggacguga

SEQ ID NO: 70202 - RNA, 756 nt, Artificial Sequence
  derived and/or modified sequence opt5 from HDHD1__Homo_sapiens__NP_001129037
auggccgcucccccucagccggugacccaccugaucuucgacauggauggccuccugcuuggguacacaggaagcauugucgccgcggcuuccggcgagucuagcagagggcugcaaucccgguggacggacaccgaacgccucuauucuguuguguuucaggagaucugcaacagauacgauaagaaauauagcugggacgugaagucccuggucaugggcaaaaaggcccuugaagccgcucagauuaucauugaugugcugcagcuccccaugucuaaagaggaacugguugaggagagccaaacaaagcugaaggaaguguucccuaccgccgcucucaugcccggagccgagaaacugaucauccaucuucggaagcacgggauuccuuuugcgcuggccacauccagcggaucugcuuccuucgacaugaaaaccagccgccauaaggaauuuuucucucucuuuucccacaucguccugggcgaugaccccgaggugcagcauggcaaaccugauccggacauuuuccuugccugugcuaagagauuuucucccccucccgccauggagaagugccugguuuucgaagaugcgccuaaugggguggaggccgcucucgccgcuggaaugcaggucgugauggugcccgacggcaaccugagccgggaucugacaaccaaagccacgcucguccuuaauucccugcaggacuuucaaccggaacuguucgggcucccuagcuacgaguga

SEQ ID NO: 70203 - RNA, 3708 nt, Artificial Sequence
  derived and/or modified sequence opt5 from HDLBP__Homo_sapiens__NP_001230829
augcaccuggccgagagagaccgguggcuuuucguggcuaccgucaugaugcauuuuguuagcaucaaguccggcuuccccgggcugugcgugggagugcgcucuacaaugagcuccgucgccgugcuuacgcaggaaucuuuugcggagcacagaagcggccugguuccucaacagauuaaaguggcuacccucaacuccgaagaggaaucugauccgcccacauacaaggacgccuucccuccccugccugagaaagccgcuugucuugagagcgcccaggaacccgcuggggccuggggaaauaagauccggccuauuaaagcguccgucaucacccagguguuucauguuccgcuggaggaacgcaaguauaaggauaugaaccaauucggcgagggggagcaggccaaaauuugccucgaaaucaugcagagaacaggagcucaccuggagcugagccucgccaaggaccagggccugucuaucaugguguccggcaaacuugaugcugucaugaaggcccggaaagacauuguggcgcgccugcaaacccaggccagcgcuacaguggccauccccaaggaacaucacagauuugucauugggaagaauggagagaaacuccaggaucuggaacuuaagaccgcuacgaaaauccagauuccucggcccgacgauccuucuaaccaaaucaagauuaccggcacaaaagaggggaucgagaaggcccgccacgaaguucugcucaucuccgccgagcaggacaaaagagcuguggaacggcuggagguggaaaaggcguuccaucccuuuauugccggaccguacaaucgccuggucggcgagaucaugcaggagaccgggacaagaauuaacaucccucccccuagcgugaaucggaccgaaauuguuuucacgggagagaaggaacaacucgcucaggccguggcccgcaucaaaaagaucuaugaggaaaaagcuaacucuuuuacagucuccagcguggccgcgcccuccuggcugcacagauucauuaucggcaagaaaggccagaaucuugcuaagauuacccagcaaaugcccaagguucauaucgaguuuacagagggggaagauaaaauuacccuggagggaccuaccgaagacgugaacgucgcccaggagcagaucgagggcauggugaaggaucucaucaaucggauggacuacgucgaaauuaacaucgaccacaaauuccacagacaucugauugggaagucuggagccaauaucaaccgcauuaaagaucaguauaaggugagcguucggaucccgcccgacuccgaaaagagcaaucuuauuagaaucgaaggcgauccucaaggggugcagcaggcuaaacgcgagcugcucgaacuggccucucggauggagaacgagagaacaaaggaccugaucauugaacagcgcuuccaccggacgaucauuggacaaaaaggcgagagaauccgcgaaauucgggauaaguuucccgaggucaucaucaacuucccugaccccgcucagaaauccgauauugugcagcucagaggcccgaagaaugaaguugagaaguguaccaaauacaugcagaagaugguggccgaccuggucgagaacagcuauucuaucagcgugccuauuuuuaaacaauuccauaagaauaucauugggaaaggaggcgcgaacaucaagaaaauccgcgaagaguccaauacaaagauugaucuucccgccgaaaacucuaauagcgagaccaucauuaucacagggaagcgggcuaacugcgaagccgcuagaucccggauucugagcauccagaaagaccucgccaauaucgcggagguggagguuucuauuccugccaagcugcacaacucccuuaucggaaccaaaggccgccugauuagaagcaucauggaagagugugggggcguccauauucacuuucccguggaaggaucuggcuccgauacgguggucauccgggggccuagcuccgacguggagaaggcuaaaaagcagcuccugcaccuggccgaggaaaagcaaacaaaaucuuucaccguugacauuagagcuaagcccgaguaccauaaauuucucaucggaaagggcgggggaaaaauccgcaaggugcgggauagcaccggcgccagagucauuuucccggccgcugaagacaaggaucaggaccugaucacaauuaucgggaaagaggaugcggugcgcgaagcccagaaggagcuugaggcucugauucagaaucucgacaacguuguggaagauuccaugcuggucgacccuaaacaccauagacacuuugugauccggcgcggccaaguucugagagagaucgccgaagaguacggaggcgugauggucucuuucccccggagcgggacccaguccgauaaggugacacuuaaaggagccaaggacugcguggaagcugccaagaaacgcauucaggagaucauugaggaucucgaagcgcaggucacgcuggagugugcuaucccccaaaaguuucacagaagcguuaugggcccuaaagggucucggauucagcagaucacccgcgacuucuccgugcagaucaaguuuccggauagagaagagaaugccgugcauagcacagaacccgucgugcaagagaacggagacgaggccggcgaagggcgggaggcuaaagacugcgauccuggcucuccccgcagaugugacauuaucauuaucuccggacggaaggaaaaaugcgaggccgcgaaggaggcucuggaagcccucguuccugugaccauugaggucgaagugcccuucgaucugcacagauauguuaucggccagaaggggagcggcauucgcaaaaugauggacgaguucgaagugaauauccaugucccugcccccgagcuucagucugauaucauugcuaucacaggacuggccgcuaaccucgaccgggccaaggcggggcugcuggagagagugaaagaacuucaagccgagcaggaagaucgcgcucuccggagcuuuaagcuguccguuaccguggacccgaaauaccacccuaagauuaucggaagaaagggcgccgucauuacgcagauccgccuggagcaugaugugaacauccaguuccccgacaaagaugacgggaaucaaccucaggaucagauuaccaucacaggcuaugaaaagaacaccgaggcugcccgggacgccauucucagaaucgugggagagcuggaacagauggucagcgaggacguuccccuugaucaccgcgugcacgcucggauuaucggcgcgagagggaaagccauccggaagauuauggacgaauuuaaaguggauauccgcuucccgcaaucuggagcuccugaccccaauugugucacagugaccggccugccugagaacguugaagaggccauugaucauauccucaaucuggaggaagaguaccuggccgacguggucgauuccgaagcucuccagguguauaugaagccucccgcccacgaggaggcgaaggcucccagcagaggguuuguugugcgggacgccccguggacggccuccucuagcgaaaaagcucccgauauguccucuagcgaggaguucccuuccuuuggagcccaggucgcgcccaagacacucccuuggggccccaaacgcuga

SEQ ID NO: 70204 - RNA, 6435 nt, Artificial Sequence
  derived and/or modified sequence opt5 from HEATR1__Homo_sapiens__NP_060542
augaccagccuggcucaacaacuccaaagacuggcccuuccgcaguccgacgcuucucugcucagccgggaugagguggcgucccugcuuuucgacccuaaggaagcugccacaaucgaucgcgacacggccuuugcuauuggcugcaccgggcuggaggaacuccugggcaucgauccgucuuucgagcaguuugaagcgccccuguucagccaacucgcuaaaacacuggagagauccguccagaccaaggccguuaacaaacagcuugacgagaauauuucucuguuucucauccaccugagcccuuacuuccuucugaagcccgcccagaaaugucucgaauggcugauucaucgguuucacauccaucuguauaaccaagauucccucaucgccugcgugcugccuuaccacgagacacgcauuuucgugagagucauccagcuucugaagauuaauaacagcaagcaucggugguuuuggcuccugcccgugaaacagucuggcguuccucuugcuaaggggacccugaucacacacuguuauaaagaccucggcuucauggauuuuauuugcucccuggugaccaagagcgucaaaguguucgccgaauacccgggaucuuccgcucagcugcgcguucuccuggccuuuuaugccagcacgaucgugucugcccuugucgcugccgaggacguguccgauaauauuaucgcuaagcuguuccccuacauccaaaaggggcucaaaagcucccugccugacuauagagccgccaccuacaugauuaucugucagauuucugugaaggucacaauggagaacaccuucguuaauagccuugcuucccagaucauuaaaacacugaccaagauccccagccucaucaaagauggacugucuugccugauugugcuccugcaacggcagaagccugaaucccuuggcaaaaagcccuuuccgcaccuguguaacgugccugaccucaucacgauucugcauggcaucagcgagacauacgacgucucuccccugcuucacuauaugcucccucaucuggugguuagcauuauccaccacgugaccggggaagagacagaaggaauggauggccagaucuacaagcgccaucuggaggcgauucucaccaaaaucucccugaagaauaaccuugaccaucugcuggccucucugcuguucgaggaauauauuagcuacuccagccaggaggaaauggauucuaauaaagucucccuucucaacgagcaauuucugccccugaucagacuccuggaaagcaaguauccccggacccuugacgugguucuggaggagcaccucaaagaaauugcugaucugaagaagcaggagcuguuccaccaguuugugucucuuuccacaagcgggggaaaauaccaguuccucgccgacuccgauacgucucugaugcugagccucaaucauccucuggccccgguccgcauccuugcuaugaaccaccugaagaaaauuaugaagaccuccaaagaaggcguggacgagucuuuuaucaaggaagccguccucgcgagacugggggaugacaauaucgaugugguucugagcgcuauuuccgccuucgagaucuuuaaggagcacuucagcucugaagugacaauuuccaaccuucucaaccuguuucaacgggccgagcugagcaaaaauggagaaugguaugagguccucaagaucgcugccgacauucugaucaaagaggaaauccuuucugagaacgaccagcuguccaaucaggugguugugugccuccugcccuucauggucauuaacaaugaugacaccgaaagcgcugagaugaagaucgccauuuaccugucuaaaagcggcaucuguucccuucauccucugcuccgcggcugggaagaggcgcuggagaacgugauuaagagcacaaagcccgggaaacucaucggaguggccaaucagaagaugaucgaacugcuugcugauaacauuaaucugggcgacccuucuuccaugcucaaaaugguugaggaucugaucagcgucggggaagaggaauccuuuaaccugaagcaaaaagugaccuuccacgugauucuuucuguccuggugagcugcuguuccucucucaaggagacgcauuuccccuuugccaucagaguuuucagccugcuccagaaaaagauuaagaaacuggaguccgugaucacagcugucgaaaucccgucugaguggcacauugaacuuaugcuggaccggggaaucccuguggagcucugggcccacuacguugaagaacugaauagcacccagagaguggcggucgaggauuccguguuucugguuuucagccuuaagaaauuuauuuaugcccugaaggcucccaaaucuuucccuaagggcgacaucugguggaaccccgaacagcucaaggaggauucccgcgacuaccugcaucuccugauugggcuuuuugaaaugaugcugaauggagccgaugcugugcacuuccggguccugaugaaacucuuuaucaaggugcaucuggaggacguguuccaacuuuuuaaauucugcagcguccuguggaccuauggaucuucccucagcaacccucugaauugcucuguuaagacagugcuccagacccaggcccuguacgugggcugugccaugcuuuccagccagaagacacagugcaagcaccagcuggcuuccauuagcucucccgucgugacgagccugcucaucaaccugggguccccgguuaaggaggugagacgcgcggccauccagugucuucaagcucugucuggagucgccagcccuuuuuaucucauuaucgaucaucugauuuccaaagccgaagagaucaccucugacgcugccuacgugauucaggaccucgcgacacuguucgaagaacuucagcgggaaaagaaacucaagagccaccagaaacuguccgagacccucaagaaccugcuuucuugcguuuauagcugucccuccuacaucgcuaaggaucugaugaaagugcuccaaggcgucaauggggagauggugcugagccagcuccugcccauggccgaacagcuucuggagaagauccagaaagaaccuacagccguucugaaggacgaggcuauggugcuccaccugacccuuggaaaauacaacgaguucucugucucccugcucaaugaggaucccaagagccuggacauuuuuaucaaagccgugcauacgaccaaggagcuguaugcgggcaugcccacaauucaaaucaccgcucucgaaaagauuacaaaaccuuucuuugccgccaucucugaugagaaggugcagcagaaacuucugagaaugcuguucgaccuccuggucaacugcaaaaauucccacugugcucaaaccguuagcuccguguuuaaagggaucucugugaacgccgaacagguccgcauugagcuugaacccccugauaaggcuaagccccugggcacggugcagcagaaacggagacaaaagaugcagcagaaaaagagccaggaccucgaguccguucaagaggugggaggcagcuacuggcagcgcgucacacugauccuggaacuccuucagcauaaaaagaagcugcggucuccucagauucuggugcccacccucuucaaucugcuuuccagaugccuggagccgcucccucaagaacaggggaacauggaguauacaaaacagcugauccugagcugucuccuuaauauuugccagaagcugucucccgauggaggcaaaaucccuaaggacauucuggaugaggaaaaauuuaacguugagcucaucgugcaauguauccgccugagcgaaaugccccagacccaccaucacgcccuucugcuccuggggaccgucgcgggaauuuucccggacaaggugcugcacaauaucauguccauuuuuacauucaugggcgccaacgucaugcggcucgaugacacguacucuuuucaggugaucaauaagaccguuaaaauggugauuccugcucuuauccaaagcgacuccggggauucuaucgaggucagcagaaacguggaagagauuguugugaagaucauuuccgucuucguggacgcccugccccaugugccugagcaccggcgccugcccauccucguucagcuggucgauacacuuggcgcugaaaaauuccuguggauucuccugauccugcucuuugagcaguaugugaccaagacagugcuugccgccgcuuacggagaaaaagacgcgauccuggaggccgauaccgaguucugguuuagcgucugcugcgaguucucugugcagcaucaaauucagucccugaugaauauccuccaguaucugcuuaagcugcccgaggaaaaggaggaaacgauuccuaaagcuguuagcuuuaacaaguccgagucucaggaagagaugcuccaaguguucaacgucgagacacacaccagcaaacagcugagacacuuuaaguuccuguccgugucuuuuaugagccagcuccuuuccagcaauaacuuccugaaaaagguuguggaaucuggcgggccggagauccugaaaggacucgaagaacggcugcuugagaccguccugggcuacauuuccgccguggcccagagcauggaaagaaaugcugacaagcucacaguuaaguuuuggcgcgcccugcugucuaaagcguacgaucuccuugacaaggugaacgcucugcugcccaccgagacauucaucccugucauucgggggcucgugggaaauccccugccuuccgugagacgcaaagcccuugaucugcucaacaauaagcugcaacagaacaucagcuggaaaaagacgaucgucaccagauuucugaagcucguucccgaccuucuggccauugugcagcggaaaaagaaagaaggcgaggaagaacaagcuaucaaucgccagacagcccuguauacccucaagcugcuuuguaaaaacuucggggcggagaauccugauccguucgugcccguccugaacacagcugugaagcucauugccccugaaagaaaggaggagaaaaauguucugggcucugcccugcucugcaucgcugaggugaccagcacgcuugaagcccuggcuauuccccagcugccuucccucaugcccucucugcuuaccacaaugaagaacaccagcgagcuggucuccagcgagguguaccuccuguccgcccuggcggcccuccagaaaguuguggaaacacugccgcauuuuaucucuccuuaucuugagggaauccugagccaagucauucaccucgaaaagaucaccuccgagaugggcucugcuagccaggccaauauucggcugacaucccuuaaaaagacccuggcuacgacacucgcgccccgcgugcugcugcccgccaucaagaaaaccuacaagcagauugagaaaaacuggaagaaccauauggggccuuucaugucuauccuccaggagcacaucggagucaugaaaaaggaggaacugaccagccaucaaucccagcuuacagccuuuuuccuggaggcgcucgacuuuagagcccagcacagcgaaaaugaccuggaggaggugggcaaaaccgaaaacuguauuaucgauugccuuguugcuaugguggugaagcugucugaggucacguuccggccccucuuuuucaagcuguuugacugggccaaaacagaagaugccccuaaggaccgccugcucaccuucuauaaucuggcugauuguauugccgagaaacuuaaggggcuguuuacacucuucgcgggacaccugguuaaaccguuugcugacacccuuaaccaggugaauaucuccaagacagaugaagccuucuucgacagcgagaacgaucccgagaagugcugucugcuccugcaauuuauucugaauugccucuacaaaaucuuccuguuugacacccagcauuucauuucuaaggaaagagccgaggcucuuaugaugccucugguggaucagcucgaaaaccggcugggcggggaggaaaaauuucaggagcgcgucacgaagcaccuuauccccuguaucgcccaauucuccguggcgauggccgacgauagccuguggaaaccucucaauuaucagauucugcugaagaccagagacucuucccccaagguucgguuugcugcccucaucacagugcuggcucuugccgagaaacugaaggaaaacuacauuguccuccugccggagagcaucccuuuccuugcugaacugauggaggacgaaugcgaggagguggaacaucagugucagaaaaccauucagcagcucgagacaguccugggcgaaccccugcaguccuacuuuuga

SEQ ID NO: 70205 - RNA, 2043 nt, Artificial Sequence
  derived and/or modified sequence opt5 from HEATR3__Homo_sapiens__NP_891552
augggcaagagcagaaccaaacgguucaagcgcccccaguuuuccccuacaggggacugccaagccgaggcugccgcggcugccaacggaacgggcggggaagaggaugacggaccggccgcugaacugcucgagaaacugcagcaccccucugccgaagugagagagugugcuugcgccggccuugcgcggcugguccagcagcgcccugcccuccccgggcuggcuagacgggaugccguucgcagacuuggaccucugcuccuggaccccagccuggcugugcgggagaccgccgcgggcgcccuccgcaaucuguccgcuuguggcggguucgaagugugcgaugacauggucacaaaggauaucaugaccccucuuguggcccugcucaaagaguguucugcuggacuggacagcaacgaaaugucccuucaagagaagaaggaucagaauagaaacucuauugagaauaucgccaacgaaacaguuaaugugcuguggaacauuugcgaguguagcucccgggccgucagcaucuuuaauaaagaaggcugccucgagauugugcugaaguaccugucucgcuucccgaccaacguugaccucgcuaucuccguggcguauugucugcagacagucaccgaagauaaucccgagcuucugaaaucuuuuagcgccacggcucucaacaugcuggaguccgcccuucugagcccugugucuuccauggaaagccuccugcugaagacccucguggccgggacaaucuggaaucugaaagacauuauccccugcaagucccaggcugagauuaucaacgcccuucugaagauucucucugaaguccugggaauggaugcgggcgagaugguuauccaaaugaaagaagcugagacccagagacuuaagacagccgccgaggcugaagagauucuggaaaauaccaacggggacgaccucaucgaggaugacgaaauggagggaaucagccauaaacggcgcgugagacggaagacguucguguccgaucugcugccucccacagacaaagagcucagagaaaccauugcccugcuuacagcucagcagaccgcccuggagaucauugucaacauguguugcaaugaagauccgagcgacgaugagugggaggaacucucuuccagcgacgagucugaugcguuuauggaaaacagcuucuccgagugcggcggccaacuguuuucuccucugugucuuagccacgaagugcauaccgcccucacaaauuaccugauccccaagaaaauuuucgagaagacggcuuuuccuaacuccaucgccguugaccugugcagccgcaaucccaccuggaagccccucauccggaaaaugaacacaauucaguguagagcucuguucugccuucagucucuggugucccuccuggaugucgagcaccuugggggagccgcggcccugcaaacccucgcucagcaucugagccagcugcucuuuucucagccugacuucgccaagcacguggacuuccuggaagcuaucuccagcgcccuucgcgcccugcuccaaacaauggcuuccaaaaauauuucucaguguaugaccccggaucagcugaugacgcugugcaaggcgggcauccacagcuccaacguuggggugcgggucaauguggucucuauucuuggaaucacaggcagcgugcucgccaaagaggacgggacccuggaaacccugaagaacaucggauguuuucuccuggagguuacaaccaaggaucccucccuuguggucgcuggcgaagcccuggacgcccucuucgauguguuugcugacggcaaagaggccgagagagcgagcauucagaucaagcugcugucugcucuuaaagaguuccaaccuguuuuuaagaugaaaauucgcaaggaagggcggggaaauuauuccacagaucagcucugcgugcuggacaacgucaagaugaaucugagacgcuucaucgccuaccaggaaacgguggagaaacggcucaccagcuga

SEQ ID NO: 70206 - RNA, 6216 nt, Artificial Sequence
  derived and/or modified sequence opt5 from HEATR5B__Homo_sapiens__NP_061897
auggaacuggcccacagccuccugcuuaacgaagaagcucuggcccaaaucaccgaagcgaagagacccguguucauuuuugaguggcuccgguuccuggacaaaguccuuguugcugccaauaagacagaugugaaagaaaagcagaaaaagcugguggagcagcucacgggacugaucuccucuagcccugggccucccacccgcaagcugcucgccaaaaaccuggcugcccuuuacuccauuggagacacauuuaccgucuuccagacacuggauaagugcaaugacaucauuagaaacaaagaugacaccgcugccuaucuccccacaaagcuggcggccguggcuuguguuggagccuuuuacgagaaaauggggcggaugcuuggaucugcuuuccccgaaaccgugaauaaccugcucaagagccugaaguccgccgagucucagggccgcagcgaaauccugaugucccuccaaaaaguccugagcgggcuuggaggcgcggccgcuucuucccauagagauaucuauaagaaugcccggagccugcucacggaccgcucuauggcugugagaugcgccguugccaaaugucugcuugagcugcagaacgaggcuguguuuauguggaccgcggaacucgagaauauugccacacugugcuucaaggcucuggaaaacuccaauuacggcguccggguggccgugagcaaacuccuggggaccgucauggccacagcucuuaugccuaagcaggccaccguuaugcgccagaacgugaaaagagcgacguuugaugaggugcuggaacucauggcuacaggauuccugcggggcgggucuggauuucuuaaguccggcggggagaugcugaaggucggaggcagcgugaaucgcgagguuagagugggcgucacccaagccuaugugguuuucgugacaacccucgggggacaguggcuggaacgguccuuugccaccuuccugucucacguccucgaccuggugagccauccccgcgcuacacagacgcacgucgaggccguguacuccagacgguguguuagcuucauccuuagagcuaccgugggcucucugcucggggaaaaagcccagauugcggccgcuaaggagaucugccaagccauuggaaaacagaugaaggcugucgaagccgugguuaacgauacauccggcgagaauaaaagcggggcggccgacaucgcugccucucagcaugugauggucugugcucugcaagagcugggaagccuugugcagucccucaacgccaccgccucuccucugauucaggaagcuagcaucggccugcucgagaucgugacauccguucugcuucaccccagcauggcggcccgccuggcugccgccuggugccuccggugugucgcuguggcccugcccuuucagcugaccccuuuccuugauagaugcgcggaacgccucaacaaucugaagacgucucccgaggcuguguccggcuauagcuuugccauggccgcucugcucgggggaguccaccaauguccucugggcauuccccaugccaaggggaaaauggugguuucuaucgcggaagaccuucugcggacagcugcccagaacuccagacucagccugcagcgcacccaggccggauggcugcuucucggcgcucugaugacccuggggccguccgugguccgguaccaccucccuaagaugcugcuucuguggagaaauguguucccccgcucucucaaagagcuggaggccgaaaaggcucggggcgacagcuuuacauggcaaguuacccuggagggcagagccggcgcgcuuugcgccaugcgcuccuucguggcucauugcccugaacuccugacagaggaugucauucggaaacugaugacgcccaucgagugugccaugaccaugaugucucacauucccagcgugaugaaggcucacggggcccaucucaaggccuccgcugcgaugguuagacugcggcuuuacgacauccuggcccuccugccuccgaaaacauaugaaggcagcuuuaacgcucugcuucgcgagcugguggccgaguucacccucacagauaauucugccaacaccacgaccucccugcucagaagccugugccacuacgacgauucuguccuucugggcuccuggcuccaggagacagaccauaagagcaucgaagaucagcugcagcccaauucugcuagcggguccggagcccuggagcacgacccuagcucuauuuaucuucggauccccgcgggcgaggcugugccugggccccugccgcucggcguguccgucauugaugccagcguugcccuguuuggagugguguucccucaugucuccuacaaacacagacuccaaaugcuggaccacuuugcugaaugugugaagcaggccaaaggcguucgccagcaggcggugcaacuuaacaucuucaccgcuguccugucugcccucaaggggcuggccgagaauaagagcacacugggacccgaagaggugcggaaauccgcucuuacccugguuaugggcccucucgauaaccccaauccuauucugagaugcgccgcuggggaagcccucggacgcauggcccagguggucggcgaggcgacguuuaucgcuagaauggcccaguauucuuucgacaagcugaaaagcgcucgggacgugguuucccgcacagggcauucucuugcccugggcugucugcacagauacgugggaggcaucgggagcggacaacaucucaagaccuccgucagcauucugcuugcccuggcucaggauggcacaucucccgaggugcagaccuggucccuccacagccuggcgcucaucguggacucuuccgggccgauguaucggggauacgucgaaccuacccugagccuuguucugacacugcuccugacggugccgcccucucacaccgaggugcaucagugccuuggccgcugucugggggccauuaucacaaccgucggcccugaacuccaaggaaacggcgcuacaaccuccacgauuagaagcuccugccugguggggugugccaucacacaggaucacagcgacucucucguucaggccgcugccauuagcugccugcagcaacuucauauguucgcgccgcggcacgugaaucuguccucucugguccccagccucugugugcaucugugcuccucucaccuucugcuccgcagagcugccguugccugccugcggcagcucgcucagcgcgaggccgcggaagugugugaguacgccaugagccuggcuaaaaacaccggagauaaggaguccucuagcgccaaugucuccccuuuugcucccggcgugagcucuagaaccgacauccacugccggcaucagggggucaacaucacagaaaccggacuugagggccugcuguucggcaugcucgauagagaaacagaccgcaaacuguguuccgauauucacgacacgcuugggcauaugcugagcucucucgccguggagaagcugucccacuggcugaugcucugcaaggauguucuugcugccagcuccgacaugucuaccgcgacacugcugagcuccggaaaagaugaggaagccgagaagaaagacgaaauggacgaugacaccauguuuacaacccucggcgaggaagauaagagcaaaccuuucguggcuccccggugggccacgagagucuuugcugccgacugucugugccgcaucauuaaccuuugugagaaugccgaucaagcucauuucgaccuggcgcucgcccggucugcuaagcugagaaacccuaccaaugaucugcucgugcuucaccuguccgaccugauccgcauggccuuuauggccgcuacagaucacagcaaccagcuccggauggccgggcugcaggcgcuugaggacauuaucaagaaauucgccucuguucccgaaccggaguuuccuggacaugugauccuggaacaauaucaggcuaaugucggcgccgcucucagacccgccuucagccaggauaccccuuccgacauuaucgcgaaggccugccagguguguucuacauggauugggagcggagugguuuccgaucugaacgaccugcgccggguccacaaucuccuugugucuagccuggacaaagugcaagcuggcaagggcuccagcucucagcuguacagagaguccgccaccacaauggaaaaacucgcuguccugaaggccugggcugagguguauguuguggccaugaacaucaagaaagaggcggaaagcaagcccaaacgggccauuaagaauaccgaugacgaugacgaugacugcgggacgaucgaugagcuuccgccugacucccugaucacacucguccagcccgaacugccuacccugucucgccucuggcuugcugcccugaaagauuacgcucugcucacccugcccgccgaguuuagcucccagcuucccccugacggaggcgccuucuauacaccggaaaccauugauacggcgagacugcauuaccggaacucuugggcucccauccuccacgccguggcucuguggcugaauagcacaggguuuaccuguuccgagagcacagaggccgccgcuauuucuggacuccaaaagcgcuccaccagcguuaaccuuaaucaggccucuggcgcggugggguccgccaagagccugccugaaaucaacaaagacagaaugcaccugauucucggagucucuauccaguuccugugcagcccccggccugaggaacccaucgagcaugugacagcuugccuucaggcccugcacacccuccuggacuccccuuaugcuagaguucauauugccgaggaucaacugaucggcguggaacuccuuucuguccugcaccgccugcuccugacguggaauccgagcuccgugcagcuucuggugaccggcgucguucagcagauugugcgggcggcccaagacuaccuccaggagaagagaaacacacugaacgaagaugacauggagaaagaggcuuguaccgugcugggggagggaggcgauagcgggggacucauccccggcaagucccuugucuucgccacaauggagcugcugauguuuauucucgugcgccauaugccucaccugucuaccaaaguuagcgacucccccucucacaucgcuacgaagacacggcuuagcgaagaguccgccagacugguggcugccaccgucacaauucucucugaucugccuagccugugcucccccgcgggguguaugaccauccucccgaccauccuuuuccugauugcccgcauccugaaagacacagcuauuaagagcgccgauaaucaggugccuccgcccguuucugcugcccuccaaggaaucaaguccauugugacgcugagcauggccaaaaccgaagcgggcguccagaagcaguggacagcucuuauccggucuacccuggccugcauccucgaguacucccagccugaagacagcgugcccacaccugaugaggucucuaugcugaccgccauugcucuguuucucugguccgccagcaacgagaucauuggcgugcaaucccuucagaauggguguaugaacagauucaaaaaugcucugaacagcugcgacccguggguucaggccaaguguuaucagcugcuccugucuguguuucaacauagcaaucgcgcgcuuuccacgcccuacauccacucucuggccccuauuguggucgaaaaacucaaggcuguugagagaaaccggcccgccagcaauaucgaacugcuggcugugcaggagggaaucaaggugcucgaaacacuggucgcccuuggcgaggagcagaaccgcgugcagcugcucgcgcugcuuguuccuacccugauuuccuaucuccuggaugaaaauucuuucgccagcgcuuccucugccagcaaagaccugcaugaguuugcucuccaaaaccugaugcacaucgggccccuuuacccgcacgccuucaagaccgugaugggagcugccccugaacugaaagucagacucgagacagcggugcgggccucccaggcuagcaaggccaaagccgcugcccgccagcccgcgccugcuauucauucugcccccaccaucaagcugaagacauccuuuuucuga

SEQ ID NO: 70207 - RNA, 3546 nt, Artificial Sequence
  derived and/or modified sequence opt5 from HEATR6__Homo_sapiens__NP_071353
auggccgcugugcaggucguuggcagcuggcccuccgugcaaccuagagaggccccgcgggaagcgauccccgagcgcgggaacggauucagacugcucucugcucggcugugcgcccuucgcccugacgauagcuccucugccagaaccgaaauucaucugcucuuugaccagcugaucagcgagaauuacuccgaaggcucugggguggcucccgaggaugucagcgcccuucuggugcaggcuugucggcucguuccucugaaccagaaucaccugguguccaaggucagccaacucauucaccaucugcuuaaccgccuccaggugaucguugacgagcagcaccuggauuuccugcuugccuauacaauuucugcgauccaucagugcuccagcuggacgcacagagaaauccugcaagcccucgcugcccugguguacuguaauggaucuaaaugccagaaguaucugcccgagcuccugggcaacaccgggcuucugaugaaacucuccgaccuggcucagagcgauccugaaguccggcgcgccgcggugcacuguauggccaaucuuugccugucugugccgggacagcccuaccucgaggagccuuaucaaaacgucuguuuucaggcuuuccugacaauucugcagucccccaagagcuccgacauggaugacaucaccuuuugcaugcuccugcaaaaugcccuuaaaggcauucagucucugcucaacggcgggagaaugaagcugacacagaccgaugaacuuggagcucugcucgccguucugaagaaauucauguuucauggccugccugggcucaauaucgagaugcccacagugcuguacccgaccccucuuccccaguaugacggacggacgccuauuaagccccaacagagcgaauccagcgccucucgccccacccugaacaaaaagaaaaaguccaaggugaaaccuaagaaaauccagcagggcgaggaagaggagaaggaaagcucuggggagauugaagcugcgccggucacaggaaccggcagagugaaucuccacgagggcaacacauggugucccagcucccuggggguucaaucucugccucuugauggaagcggcgccgcugaaaaagacgggguguccagcucuuucuccuccucuuccuggaagcgggucagcuccucugagagcgacuuuuccgaugccgagggaggcaugcagucuaaaaugcgcagcuaccaggccaaggugagacagggggcucucguuugcuuccuguccaccaucaagagcaucgaaaagaaggugcuguacggauauuggucugccuuuauucccgacacgccugagcucggcagcccccaaagcgucucucugaugacacuuacccugaaagauccguccccuaagacacgggcgugugcucuccaggugcugagcgccauccuggaaggcucuaaacaguuccuuagcgucgccgaggacaccuccgaucauagacgcgcuuuuacccccuucagcgugaugauugccugcucuauccgggaacuccacagaugccugcugcucgcucugguugccgaguccagcucccagacagugacgcaaauuaucaagugucuugcgaaucuggucucuaacgccccuuacgaccgccucaagcugagccugcuuaccaaaguguggaaccagaucaagcccuauauucggcacaaagauguuaaugugagagucuccucucucacacugcugggggcuaucgugagcacccaugccccucuccccgaggugcagcugcuucugcaacagccgugcuccucuggacucggcaacagcaauuccgcuacaccucaccugagcccucccgacugguggaagaaagcccccgcggggccgucucuggaagagaccuccguuagcucucccaagggauccagcgaaccuuguuggcuuauucgccucugcaucucuauugucgugcugcccaaggaggauuccuguagcggcuccgacgccgggagcgcugccggcucuacguacgagccuagccccaugcggcuggaagcucuccaggugcugacacuucuggccagaggauauuucuccaugacccaggccuaccucauggagcugggcgaagucaucugcaaauguaugggggaggcugauccuucuauccaacugcauggagcgaaacuucuggaggaacucggcaccgggcugauucagcaguauaaacccgacagcacagccgcuccggaccagcgcgccccuguguuucucguugugauguucuggaccaugaugcugaacggaccccuuccucgggcccugcaaaauuccgagcaccccacacuccaggcuucugccugcgaugcgcugagcuccauccugccggaggcuuuuucuaaccuuccuaaugacagacagaugcuguguauuacgguccuccugggccucaacgauagcaagaaucgccuggugaaagccgccaccucccgggcucuugggguuuacgugcuguuccccugccucagacaggacgucaucuuuguggccgaugcggcuaacgccauucugaugagccuggaagacaagucucuuaauguucgggccaaggcugccuggucccugggcaaccucacagauacccugaucgugaauauggaaacaccugaccccagcuuccaagaggaauuuucuggacuccugcuucugaaaaugcugcgcuccgcuauugaggccagcaaggauaaagacaaggucaaauccaacgcggugagagcccucggcaaucugcuucauuuccugcagcccucucacaucgagaagccuaccuuugcugaaaucauugaggaaagcauccaggcccucauuuccacggugcugaccgaggcugccaugaaaguccgguggaacgccuguuacgcuauggggaacguuuucaagaauccggcgcucccccugggaacagccccuuggaccagccaggcuuauaacgcccuuacaucuguggugaccuccugcaagaauuuuaaagucagaauccgcagcgccgcugcccugucugugcccggcaagcgggaacaauacgggagcguugaucaguaugcgagaauuuggaacgcucuggugacggcccuccagaaauccgaggacacaaucgauuuccuggaguuuaaguacugcgucucucuucgcacccaaaucugucaggcccugauucaccuccugagccucgcuuccgccucugaccugccuugcaugaaagaaacacuugagcugagcggaaauauggugcaguccuauauccugcaguuccucaagagcggcgcggaaggggacgauaccggcgcuccccauucuccucaagagagagaccagaugguucggauggcccugaagcacaugggauccauucaggccccgaccggcgauacagcucgcagagccaucaugggguuccuugaggaaauucuggcuguguguuuugacagcuccggaucucagggcgcccuccccgggcugacgaaccaauga

SEQ ID NO: 70208 - RNA, 570 nt, Artificial Sequence
  derived and/or modified sequence opt5 from HEBP1__Homo_sapiens__NP_057071
augcugggcaugaucaagaacagccucuucggguccguggagaccuggcccuggcagguccugucuaaaggagacaaggaagagguugccuacgaagagagagcuugcgaaggcgggaaauuugccacaguggaggugacggauaagccugucgacgaggcgcuucgggaagcuaugccgaaaguggccaaguaugccggaggcaccaaugauaaggggauuggaaugggcaugacaguucccaucagcuucgcuguguuuccuaacgaggacggcucccugcagaaaaagcucaaagucugguuccgcauucccaaucaauuucagucugauccucccgccccuagcgacaaguccgugaaaaucgaagagagagaggggauuaccguuuacucuaugcaguucggaggcuaugcuaaggaagccgauuacguggcgcaagccacacggcugcgcgcugcccuugaggggaccgcuacauauagaggagacaucuacuuuuguaccggcuaugauccgcccaugaagccuuacgggcggcgcaacgaaaucuggcugcucaaaacguga

SEQ ID NO: 70209 - RNA, 618 nt, Artificial Sequence
  derived and/or modified sequence opt5 from HEBP2__Homo_sapiens__NP_055135
auggccgagccccugcagccugacccgggcgcugccgaagaugcggcugcccaagccguggagacccccggguggaaggcuccugaagacgccggaccccagccuggcagcuacgagaucagacacuaugggcccgcuaaaugggucuccacaucuguugaaagcauggauugggacuccgccauucagacgggauucaccaagcucaacucuuacauccagggcaaaaaugagaaggagaugaaaauuaagaugacagcgccugugaccagcuauguggaaccgggguccggacccuuuucugagagcacaaucaccauuucccuguacaucccuagcgaacaacaguucgaucccccucggccccuugagucugacgucuuuaucgaggaucgcgccgaaaugacaguguucguuagauccuuugacggcuucagcucugcucagaagaaccaggagcaacugcucacccuggccuccauucuucgggaagauggcaaaguguuugacgagaaggucuauuacacggcuggguauaauagcccggugaaacugcucaaccgcaauaacgaaguuuggcugauccagaagaaugagccuaccaaagagaacgaauga

SEQ ID NO: 70210 - RNA, 1632 nt, Artificial Sequence
  derived and/or modified sequence opt5 from HECA__Homo_sapiens__NP_057301
augcccaacccuaagaauagcaaaggcgggagaaagaacaaacgggccaauuccucuggagacgagcaggaaaacggcgcuggggcccuggcggcugccggagccgcuggcgccgcugccgggggagcgcucgccgcugccgcuggcugcggcgccgcggccgcuggggccccgggagcuggcggggccgccggagcuggcggggcgggaaccggcgccgcuaaugccgccgcugccgcgggcgcugccgccgcuggggaugccaagaacgaggcucccugugccacaccucugaucugcagcuucggacgccccguggaccuugaaaaagaugacuaccaaaaggucguuuguaauaacgagcacugcccuuguuccacguggaugcaucugcagugcuuuuaugaaugggagucuagcauucucgugcaguucaauuguaucggcagagcgcgguccuggaacgagaagcagugccgccaaaauauguggaccaaaaagggguacgaucuggccuuuagauucuguucuugccgguguggacagggccaccuuaaaaaggacacagauugguaucaggugaaacgcaugcaggacgaaaagaagaaaaagagcggguccgagaaaaacaccggaagacccccuggcgaagcugccgaggaggcuaagaaaugccggccgcccaauaagccucaaaaaggccccagccaugaucugccucgcagacacucuauggaccggcagaacucccaggaaaaggccgucggggcggccgcuuacggagcccgcagccccggcgggucuccgggacaguccccucccacaggcuauagcauucucucuccugcucauuuuuccgggcccagaagcucccgguaccugggcgaguuccugaagaaugccauccaccucgaaccccacaaaaaggccauggcuggaggccauguguuucgcaacgcgcacuucgauuauucuccugccgggcuggcuguucauagaggaggccacuuugacaccccggugcaauuccuucggagacuggaucucagcgagcugcuuacacacauuccccgccauaaacugaacaccuuucacguccggauggaagacgacgcccagguggggcagggagaggaucucagaaaguucauccuggccgcucuguccgccagccaucgcaauguugugaacugcgcgcucugucaccgggcucugccugucuuugagcaauucccccuuguggacggcacgcuguuccucucuccuuccagacaugaugaaaucgaguacgacgugcccugccaucugcaggggcgccuuaugcaccuguacgccgucuguguugauugccucgaaggcgugcacaaaauuaucuguauuaagugcaagagccggugggacggaucuuggcaccagcugggcaccauguauacauacgauauccuggccgcuagcccguguugccaggccagacucaauuguaaacauugcgggaagccugugauugacguccgcaucggaaugcaauauuuuuccgaguacucuaacgugcagcaguguccccacugcggcaaucuggauuaucacuucguuaaaccuuuuagcuccuucaaggugcuugaagcguacuga

SEQ ID NO: 70211 - RNA, 2343 nt, Artificial Sequence
  derived and/or modified sequence opt5 from HECTD2__Homo_sapiens__NP_001271203
augagcgaggccgugagaguccccuccccugcuaccccgcugguuguggccgcggcugcccccgaggaacggaagggcaaagaaucugagcgcgaaaagcucccucccaucgugagcgccggggcuggagccacagcuggccuggacagaggggccaaaggacagauuuccacguucucuagcuuuaucuccgcggucucuccuaagaaagaggccgcugagaaccggagcucccccgcccaccuuguguucccuaauauuaagaacguucgcgaaccgcccccuaucugccuggaugugagacaaaagcagcggaccagcauggacgcuucuuccagcgagaugaaagcccccguccucccugaacccauucugccgauccagccuaagacagugaaagauuuucaggaggacguugagaaggugaaaucuuccggcgauuggaaggcgguccaugacuucuaccuuaccacauuugauagcuuccccgaacugaaugccgcuuuuaagaaagacgccaccgcuucuuucaacacaaucgaggauuccgggauuaaugccaaguuugugaacgccguguaugacacccuccugaauacgccucaagauguccagaaaaccguucugaagggaaucauuaacagccuccugcgcgaauggaaaggccccagaacaaaggacgaucuucgggcuuacuucauccugcuccagaauccccaguuuaacaauaccuccacauaugugauuuacgcgcaucugcuucgccaaaucgccacccugguggaggcugaccaccacuuccucguccauugguuuaaaaagcaguauucuagacugagccagaagcgguucaaacagcugguggaacgccuccugcaauucauuucccuuagacuguuuccugccaagccggaggaguuucccccuaucacgaaauguagcugguggauccccucugccgcuaagguucucgcccugcuuaacacagcgaauaaccuggugcacccuccccucauuccguacaccgacuucuauaauuccacacuggaucacaucgaccugauggaagaguaccauaccuggcagaacuucggcaacagccaccgguuuucuuucugccaguacccuuuugucauuagcguggcugccaaaaagaucauuauccaacgcgauuccgaacagcagaugaucaauauugccagacagucucucguugacaaggugagccggagacaacgccccgauaugaacauccuguuccuuaauaugaaaguccggagaacccaucugguguccgacagccucgaugagcugacacgcaagcgggcugaccuuaaaaagaaacugaaggucacguuugugggggaagccggacucgauaugggcgggcugaccaaggagugguuccugcuccugauuagacagaucuuucacccugacuauggaauguucacauaccacaaagauucucauugucacugguuuuccagcuucaagugcgacaacuauucugaguuccgccuuguuggcauucugauggggcucgcuguguacaauuccaucacccuggacauccgguuucccccuuguugcuauaaaaagcugcuuagcccgcccauuaucccuuccgaucagaacauucccgucggaaucuguaaugugacaguugacgaucucugccagauuaugcccgaacuggcccauggccugucugagcuccugagccacgaaggcaacguggaggaagacuucuacuccaccuuucaagucuuccaggaggaguuugggaucauuaaaucuuauaaucuuaagccuggaggcgauaagaucagcgugacgaaccagaauagaaaagaauacgugcagcuguacacagacuuccuccugaacaaguccaucuauaaacaauuugcggccuucuacuauggguuucauagcguuugugcuucuaaugcccugaugcuucuccgcccggaggaagucgagauucuggugugcggaucccccgaucuggacaugcacgcucuccagcggagcacccaguacgauggcuaugccaagaccgaccugacaaucaaauacuucugggaugugguccuuggguuuccucuggaccuccagaagaaacugcugcacuucaccacaggaucugauagagugcccguuggcggcauggcggaccuuaacuuuaagauuuccaagaaugagacgagcaccaacugucucccuguggcccauacaugcuucaaccaacugugccugcccccuuauaaaucuaagaaagaccucaagcagaaacugaucauugggaucagcaauuccgaaggauucggccuugaguga

SEQ ID NO: 70212 - RNA, 12855 nt, Artificial Sequence
  derived and/or modified sequence opt5 from HECTD4__Homo_sapiens__NP_001103132
augggccugcuccugguguucccccuuauucagagccaguccagaacagacccuucucugugcaacauuacagccgaggugcuccugaauugucuucgggauugccagccccugagccucacgaaggagcccgcugacugucugaacgggaucgagacacugcucugcuccuggcuggaagagacaucugauaccggaagacacauuccucacaaacagaaggaaaaugccgcggcugcccuuguugcccuggcuugugccagaggcagccucaaaacauuugugcacaccgugcaucugcuucagaagcaaacagaccuggggucccuccccgucgcugaugugcuguaccggcugcuccugcuugagggaggcccugggucucccagcugccugcucggaggcaaacacaucguuuccuggggcuaugaggacaugcugccugcccccgauagcaacaccgggucuuccagcgaaaauaaggacgccgaucuuggacgcugucugacggccgacggccucuaccuguauaccacaaacucuguggggagaggagucuccaagcugggcagcgggcuccacggaacccugcggggcuucguguacugccgcaaugaggaacuugagcccggcuggguugcuuuugggucuggaucccugcuccacagaccugugagcuucgauaacaaaccccacucccuguuucaggucauugaccagaauacacuucaggugugucaaguggucccuaugcccgccaaccaucugccgaucggcucuaccaugagcacgguucaccucuccagcgaugggacauauuucuacuggaucuggucuccugcuucccugaaugagaagacccccaaaggacauagcguguuuauggacauuuucgaacugguggucgagaacggcguguuuguugccaauccucuccaggaacggacaauccugaugcgcaaggagggggaaucugcgaaaagcauuaacgagaugcuucuguccagacucucucgguaucgcgccagccccuccgcuacccuggccgcucugaccggaagcacaaucucuaauacgcuuaaggaggaccaggccgccaacaccuccugcggccucccccugaagaugcugagaaaaacaccuauuuacaccuguggcacauaccucgugaugcuggucccgcccccugggggaagcggaucuagcgcuacccggagccuuuucgggggaacguccggccugucuagccucaagauccuggcguccucucugguguauaacauuagcgaugggcaguuuacaucccgcgccgaccuuaucgaugcugccggcagcucucucggaagaggcgcccugguucccgggcugggagcuugcuacgacaccgugaauaacaugcucuggaccugcuccaaugauuauaucgaccaaugguguaacccuggcaaucaggccuuccacuacgucugccagcggcugggggugagccacauuaucacagaacccaaagaggaagcgauuaccacaaacgaggucaucaaucaacuucugcaucacgugggagcuauguguauucaucagcucaaccugcuggccacgaauccgaaccuuccuaucaccucuguucucggcaagcagcaccccaucgaagcccaucaccuguccagcauuugcgauaucauggagaaagcuauggugaauggggacacauguauuaucagaugcauucuggucguguuucagguuguguucaaguucuuuuucucuccucaaaccgagcgcaaccgggauaucaucagacgcagcggccuccugcuuuggcagcugcucauggcccccaaagaccagauuuguccugaaauccagaaggaggucugccuggcuauuuccagcggacugaauauccuuuaucccggcgaaacagagauuaacaaucuccugaagcuggugcucaccgaaggggagcggaacucuggacugucccaacuuagagaugugauccugacgaaccucgccgagcagcugcagaauaaccgcuuuggcagcgacgaagacgaucacuaccggcugaaugacgagcuucugcauuauauucucaaaaucguugucagagaauccuguauccugauuaccaagugccagacagugucuaaagaugacuuccaaaagcuccugagcaccgugccggcggccuccucuugucuucgcuaccugauggcuguccagaaccaccuccugagcaauacaauccugauuaaaccugaugagaacgacgauuccgacucuagccuucagggggagacccugaaggugcaggaacucaagguuuccauccuggcccucgcuacgcaaauucugacaggaugcgaugaggugcuugaaaugcugcagcaggucaccacagcccucaucaauagcgacaucgcggaucgggagcaaagacugaaaggccuggaacaggugaccaaggccaccaugcuugggcaucugcuccccguucugcucacaucucugaugcaccccaaccuucagacgcugauuauggcugacgcccugaugccucagcucgugcaacugguccuuuacaccucccagacagcucugcuccugaaaacccagugcccgguguuugccgagguuggcuguagccccugcggagccccugaucagaagugucgccucuuccccgacgagcggaugcuggaagagaaagaggaaccuggcuuucuuacagggcugaagauccccgcuccuugggcggccggaaagaccguggaaacgguccaccccgugagagacaauuauaaauucaaggagacagugcauauuccgggcgcucggugccuguaccuccgcuuugauucuagauguuccagccaauaugacuacgauaaacuggucaucuaugccgggccuaacaccaauucucggaagguugccgaguacggaggcaacacccuuggguauggcuccagaagcgugcugggaacaggcuggcccaaagaccucgugaagugcauuuccccucccagccugaauuucaaggucgaaggggauaccgugacauuuucuuucgagaugcgcagcggacgggaacacaacacgccggacaaagcuauguggggcuuugccuguaccguuagagcgcaggaguccucugaagaugugagcgggggacucccuuuccuggucgaccuugcucugggccuguccgugcucgccugcucuaugcugcgcauccuuuacaauggccccgagaucacaaaggaggaagaggccugucaggaacugcucagaagcaaacugcuccagcggugccaauggcagguugaggcuaacggggugauuuccccugcccugacccccucucccagcccucuuccgcugacaaucgaggaagaucgcgaguucaccuaccccuccgacguccuggugccucccguuggaaacuauuuugaucucccucgcauucggcugcccccuggcaucaugauuaaacuucgcgaaaucagcgggagagcgcggccgcaguuccgccccucuaucaaagaggugauucaaccugacgucauggaagagauggugguguccugugucaucaagcaucugaaucucguugaugcucugcagagccugauuaacuuucaguaccaggaggaacacgccgaggaauaugaccuccuuugcaaaaucaugggagagacguucaagaagcugaaugccauggaaagacaacugcagucuguggcugagcucgagcagaaauggcaguccgaaguggacgaugccaugcaaggcaagcuggagaacaauaugcccuuuuucuacgacuaucauuuuaacgaaaauaaaaugaaggagcuugaacugcucugcagcaugaaagaggucuccuucgaugggaacgaccuggagaauauggugcugucucuccgggaaaaguuucuucaggagguuaacagccugauucagaagccuucccacccccuggcuaaaaccaagacacucgugaaaagccugaugaaucgcgccgaacuucugcuccacgucaccaucgcggcccagucuggacugacaagauccauuagcggcaccccggcugagaccccugccuguaagucugcuagcgagaccaaagugaucucccaugccguucggcaacccguguuccugagaucuaugagcgcccccuccgaucucgaaaugaucggcaacgaggaccuugaauuuacgcgcgcuaaucagcggagacgccacgucacaucucaucggagcuccagcuucacccugcugcagucucucgcgauugaggauuccagagacaagccuaccuacagcgugcugcuugggcagcuguuugccuucaucggaacaaaccccgaucaagcugucuccucuagcuccuuccuccuggccgcccagacccgcuggcggagaggcaauacgcgcaagcaggcucuggugcacaugcgggaacuccuuacagccgcgguuagagucggcggggucacccaucugguggggccuguuacaauggugcugcaagggggaccgcggauugaggagcugacaugcggcggcauggucgaacaggugcaggaggcuuuuggggaaacaaugaccucugugguuagccugugugcccgcuaucccaucgccugcgcuaacuccauuggacuucuguguacgaucccuuacaccagaagcgaggaaaaaugccucguccggucuggccuggugcagcugauggaccgccucuguucccuuagcaaccaaacagagucuuccagcucugagaagcagaccaaaaagcagaaaguggccacaauggcgugggcugccuuccagguccuggccaauagaugcguggaaugggagaaggaagaagggggaagcaccgaagcuguucacuccggccuggcccggcaagugucuagccuccugacgaaccaccuugcuagagccacagaguguugcgggaaucaggcggccggaaacgaugcucugcaggacguccucucccugcugaaugaccucagccgcucccauaucggcaaggccauucuuucucagcccgcuugugugagcaaacugcugucccuccugcuugaucaacggccuucucccaagcugguucucaucauucugcagcugugcagagccgcccucccgcuuaugagcguggaggacugcggcaacgucgaacugccucccugguccuacucugugccuagccucaauagcgagcaggaagaucccagcgacccugcuucuaaaaucgcgucccuccugcuugccaagcuggcugauuauguugugcccgggugucaaaccguccucagcccgacagccucugagccugacaccacccugacaaaaacgucccccaagaacagccugaaaggagauaaggaccccggcgaggaaucugaggccguggaugggaagcucuccauuuuuauccacaaacgcgaagaccagagcucccaugaggugcuucagccucugcugagcucuagcgaaggacggccguucagacucggcaccggggcuaauauggagaaggucguuaaaauggaucgcgacaugacaaagggaggcugcugugaggugaucaccgaagaggccgcggcugcccugcggaaagccacaaagugggcucaguccggccuuauugugucuaucgggcccccugucgaaagcauuaaccccgagaccguguccggacugucuacgggcgauaagaaaaagacagcccaaaccagcaucugcagagaacgcaauuccgagcucgcgagaaccgacccuguucggcccuuuauuucugggcacguggccaacagcauggcugccgaggucaucgcucugcugcacucccuccuuauggccccugaaagcaaugcugcccagauuuggacaaccacagcggagaaagugcugucucgcgcccugauguacaucccgcagcucggaaaguaugcugaauccauccuggagaacggcuccucuuccgggagaaaacuugccaagcugcagcggauugcucgccaagccguugccgcucucugugcgcugggaggcuucaaggaaacgaucaaaauuggcagcgaggugcagguccuggggagaggaaucuccggcucuauugggguggucgccagcaucaaugagcaggaaggaaucgcuaccgugcgguuucccccuauugacugcagaaagacaucccaggccagcgauacccucacaaucccccugucucgccuuuguguuccucgguccgaggcccugccccuccauaaacugagcauuaccgaaaagguggugcaagcuguccagucuaugcuucugccgcaggagggcagccucuccauccacacgucucugccugccaccggggacggaagcgcgcccguuauggccguggugagacugcucgcugagauucgcacacgggccugccuggucauggcucagcuucuggaagauucccucuucugugaggaauuuauccaacagugccccgccgcgguggagguucugaaccuuguggcccaggaauguucugcuggcgagagacuggccgucguggagguccaaugcgaacggcuccgcaugcuguacagagacugcgcucggccucccccuccgccccugcaggccgaucgcagacagccuaaagagaucaccuggagccccucccggguguucccucccguucgcgcuuguauguuuagcucucaucucacauccgugaccuuccuggccgacccgagcgcgggcgggggacuuccuagaggcacauucauuuaugccacgagcccccugccuguccaggcucccucuuuuuacugggaaaucgagauugugagcuauggggauaccgacgaugacacaggaccuaucguuuccuucggcuuuaccaccgaagccgagaagcgggauggggcuuggacaaaucccgugggcacgugccucuuccacaacaacggacgcgccguccauuacaauggcucuagccugcuucaauggaaguccgugagacuggacgugacccucagcccgggggauguugccggaauuggcugggagcggacagaagggaccccuccgcccccuggacagccggcgaaaggcagagucuacuuuacauauugugggcagcgccugucucccuaccuggaggacguguccggcggaauguggccugugguccacauccagaagaaaaacaccaagacgcgggcuaauuucggcagcagacccuuugccuaugcugaagggcaagcccaccgcaacgccgcugaccucugcacagaucuggccgaggaaauuucugcgaauuucgaggcccuuccuuuugcuauggccuccgacagcgauaacgacgcuggaaccucuaucgccuccgaucccggcacccaugggccucccugucggaucgcggccguugcuacagcccagcagcaguacgacagcgauaccucuugccacuauaaaguggagcugagcuacgaaaauuucauuacauccggaccggacccucaucccccucccaucgcugaugacgagagcgaugacgacgaugacgaugacauuccgcaagaagaucacuaugcccuccuggugaaggcuugggagaccaaggucuuuccuacgaucagacgccgguucagaaacgaggccgaacgcaaauccggccuugaccagauuaagggggcgcugcagcucggcaugguggauaucgcccggcaaacaguugaguuucuguacgaagagaauggaggcauccccagagaccuguaccuccccaccauugaagauaucaaagacgaggcuaacaaguucacaauugauaaagugcgcaaggggcugaccgucgugacgcggucuccugacagcaauaacguugccuccucugcugugggaaccgcccuucccaaauucgccaucagaggcaugcugaagacauuugggcuccacggagucgugcuggauguggacagcgucaaugagcuuguucagguggaaaccuaucugcgcuccgagggcgugcucgucagauacugguauccuauugacaugcuggaacggccgcccgcgggcuaccgcagaacagcuaccaacgggcuggugacacucgauaauaccaaccugcagauccaucgggagcuucugagaugugaagccgcccucgcucggcuguauugccgcauggcccuucugaacaucuucgcuccuaagcucccccaccuguuuacgagacuguuccauauuccugccauccgggacauuacacucgagcaucugcagcuucugucuaaucaacuccuggcgcccccucuuccggauggaaccaucagcuccagcucuauucugcucgcccagucccugcagcauuguauccacagccagaacugcucugcuaccgaccuguuuuaccaaggcaauucccagacaguucgcgaguggcuuaacguggccauuaccagaacacugcaccagggggaagagagccuccuggaacucacgaaacagaucuguucuuuccugcaaaccgcucccgagcaguuuccuuccgaagaguuccccaucagcgagucuaaggucaauauggaugugaacuuuccuggagccgcguucguuguggucuccugcaaagaaagccagagcggcuuucggaaggacuccucucuuuauaaagcccccugggcucgcgugcugguuuacgggcugggacauaaggugaagagaaauggccaacucaaccugauugaggccgcuugcuacccgcgggaugccagcccugcuaauacaggccuugcgccgcccccuaccgcggaccaguaucccuccgucgugcugucuacagaucgcguccacaucaaacucggggugagcccuccgcccggagccguucuggugcuccauucccugccucuggaguucccccuugcuauggccuuugccgagcagcugcucucuuggaaaagcgaggacuccgaaggcaaaagcgaggaugaaccugacaccauucccacgucuguccugcuucaggugguggagcugcucgggaacuuccuguggaccacagacauggcugccuguguuaaggaacucguguuccaucugcuggcggagcuucugagaaccguccacacacucgagcaacggcgccauccggcuggacuguccagcucuaucgcccuucagcugaauccuugccucgccaugcugauggcucugcaguccgaacuccacaaacuguacgaugaggaaacccagaacugggugagcggcggggccuguggaggcuccggcggggcugccgcgggagaccaaggcagauuuucuacguauuuccaugcccuuauggaggggugccuggcuguugccgaagugacacuccccaccaauaugagcgucacagcuuccggagugaccucugccaccgcgccuaaccugagcgauuccuccucuuccagcucuagcucccccggccagacaccgcagucuccuagccuucuguccaagcggaagaaagucaagaugaaacgcgagaaggccuccucuuccgggaaaagacagagcucccggacgguggacucugaucccaccguucucagcauuggaggcuccaagcccgaggacaugcugugguuucacagagcucugacacuccugaucauccuucgccaucugacccggaaggauccucaaggccucggggugacaucugacgccauugcugaugccugucaggcccuggucggacccaccgcucacagcagacuucuggugaucuccggcauuccuacgcaccucgacgaagggguugugcgcggagcgauccggaaagccugcaaugcucauggcggggucuucaaggaugagauuuacaucccgcugcaggaagaggacaccaagaagcccaaagauaaggccgaaggaggcgacggcaaaguggagccugagaagacccuggccuuucccgggaccgacucuauggaagugagcacauccagcucucucaccccugcuauguccaucagcgccucugcguccacaagccaggcuucuauuuguagcucccaaggaaucagccagacgguuuccgaucugucugucgacccccuuccugccggccuggagcucccgauucccccugggcugcuugaaccccacgccgugagcucccaggagucucuggauaucagccucugcuccaccggaucucugggcagccuggggucccucggagagccucuggacaacgcugaaacagccagcgugucugauaugggcuccauguauaccgucacaagccuugacaaccaaccccuggcugccagaccgauuaagggcuucgcggugguugagauccgcucucgggccaaaauugaaaagaucagagcuucccucuuuaauaacaaugaucugaucgggcuuagcucucuggacggagaggaugaacucauggagauguccaccgaggaaauucugacggugagcgucgugaaccagucucuguucgacacccagggcuccccugggcucgaggauuacuuuaaugacaaaagcaucaagggagaaaaacugguucccggcgcccgcgaggugcuuacagaaauuuucaaguccugugcucauagcgagcagacccugucucucacacccgccaagccuauccgggucagcgauauuuaucuguccaaagagcaaaucaacucucagacccccgggaaucuucugcaccucuuuuucacaaacgugagaccuccgaagaaaguucuggaagaccagcugacccagauccuccgcaaguacggagugcccaaaccuaaguuugacaagagcaaauacuccaaggcgggcaaagagcaacaucccgucaagguggugucuacgaaacggccuauuacaaagcccccggccaaggauaaagcuguccugaauagcguuuccagaaccgcccuuagcgaaaagaaaccuaccgugaagcccaaaucuccugagaaguccaaacccgacgaaaaggauccugaaaagagccccaccaagaagcaggaggugccggaagagaaauaucugacgcucgaaggcuuccacaaguucgucaucgaccgggcuagacaggauauucgcucuguguggcgggccauccuguccugcggguacgaccugcacuuugagagaugugccugcauugauguucgccaugcucagaaagcgagcagaaaguggacccucgagauggacguggcccuuguccaauauaucaaccagcugugucggcaccuggcuaucacacccgcccgccuccauccucacgaaguguaccuggaucccgccgacgcugccgauccuagaguugcgugccuucugaaugugccgauugagucucuccggcugcgcuucgcucugcuucagucccucaacaccacacuggaaaccuuuuuccugccccucgucgagcugagacaaacaccuauguauacccacagcaucgccgcccuucugaaggaagcuaaaggacucaucuuuuacgacacgaaggugaccgucaugaaucgggugcugaacgccacaguucagcgcaccgcugaccaugccgcgcccgagaucacacuggauccucuugagauugugggcggggaaaucagagccuccgaaaauucuuauuucugccaggcugcccggcagcucgcuagcguccccuccagccaacugugugugaaacuggccucuggaggcgacccuaccuacgcguuuaacauccgcuucacgggggaagagguucacggcacauccggcagcuuuagacauuuccucuggcaagugugcaaggaacugcagucuagcucccuuucucugcuccugcugugucccagcuccgccgucaacaaaaauaagggcaaguacauucuuaccccgagcccuaucacauauggggaggagcagcuccugcacuuucugggacaacuccugggcauugcuauccgggccgaugugccccuuccucuggaccuccugcccucuuucuggaaaacccuggugggggaaccgcuugauccugagcaggaccuccaggaagcugauauucugacguacaacuauguuaagaaauuugaguccaucaaugacgaaaccgagcuggaggcccucugcgccgaaauugcuagccagcaucuggcgacagagucucccgauucccccaacaagccuuguugccgcuucaccuaccuuacaaugaccggagaagaggucgagcuguguagcagaggccggcacauccucguggccugggaaaauaaagacaucuaugcugccgccauuagaucccugcgccugcgggagcuucaaaacguggaaugcgucacagcugugagagccgggcucggcucuaucauuccccugcagcugcucaccaugcugagcccucuugagauggaacugcgcacguguggacucccguacaucaaucuggaguuccugaaggcgcacacaauguaucagguuggccuuauggagaccgaucagcauauugaauuuuucuggggagcucucgagauguuuacccaagaggagcugugcaaguucaucaaauuugccuguaaccaggaacggauccccuucacaugcccuugcaaggacggaggccccgauaccgcccacgugccucccuacccgaugaaaauugcuccucccgacgggacagccggauccccugacucuagauacauccgcgucgagacguguauguuuaugauuaagcugccccaguauagcucccucgagaucaugcuggaaaaacuucggugcgcuauucauuacagagaggauccucugagcggcuga

SEQ ID NO: 70213 - RNA, 4719 nt, Artificial Sequence
  derived and/or modified sequence opt5 from HECW1__Homo_sapiens__NP_001273988
augcugcuccaccugugcagcgugaagaaccuuuaccagaauagauuccugggccucgccgcuauggccucccccucucggaacagccaaucccgcagacgguguaaagagccucugcgcuauucuuacaauccggaccaguuucauaacauggaucuuagagggggaccccacgacggcgucaccaucccucggagcacauccgauacggaccugguuaccucugauagccgcuccacacucaugguguccucuuccuauuacagcauugggcauucucaggaccuggugauccacugggauauuaaggaagaggucgacgcgggagauuggaucggcauguaucugauugacgaagugcucuccgagaauuuccuggauuacaaaaacagagggguuaauggaagccaucggggccagaucaucuggaagauugacgcuucuuccuauuuuguggaacccgagaccaaaaucugcuucaaguacuaccacggcgucagcggggcccuucgcgccacaaccccuuccgugacaguuaagaacucugcugcccccauuuuuaaaagcaucggagcugaugagaccgugcaaggccagggguccagacggcugauuagcuucucucucuccgacuuucaggccaugggacugaagaaaggcauguucuuuaauccugacccguaucuuaagaucagcauucagcccgggaaacacucuaucuucccugcgcugccccaucacggacaagaacgcagaagcaagaucauuggcaacacggucaauccuaucuggcaggccgagcaguuuuccuucgugucucuccccaccgaugugcuggaaauugaggucaaggacaaauuugcuaagagccggccgaucauuaaacgcuuccugggcaagcucuccaugccuguucagagacugcuugagcggcaugccaucggggauagaguggugagcuacacacugggacgccggcuccccaccgaccacgucucuggccaacugcaguucagauuugaaaucacauccagcauucacccugaugacgaggaaaucucucuuuccaccgagcccgaaagcgcucagauucaagauucccccaugaacaaucugauggagucugggagcggagagccucgcuccgaagccccggagucuagcgaauccuggaaacccgagcagcucggcgaagggagcgugccugacggacccggcaaccagucuaucgagcugucccggccugcggaggaagccgcuguuauuacggaggccggcgaucaggggauggugagcgucggacccgaaggcgcuggggagcugcucgcccaagugcagaaggacauccagccggccccuucugcugaggagcuggcggagcagcuugaucugggagaagaggccuccgcucuccugcuugaagacggcgaggcccccgccagcacaaaagaggaaccucuggaggaagaggcuaccacacaaucuagagccgggcgcgaagaggaggaaaaggagcaggaagaggaaggcgacguuagcacccucgagcagggagagggccggcugcagcugagagcguccgugaagcgcaaaagccggcccuguucucucccugucuccgaacuggagaccgugaucgcuagcgccugcggggaucccgaaacaccgagaacgcauuauauucgcauccacacccuucugcauuccaugccuucugcccaaggaggcagcgcugccgaggaagaggacggggcugaggaagaguccacacucaaggauucuagcgaaaaagacggacuguccgaggucgauaccguggccgcggaccccucugcccuggaggaagaucgggaggaacccgagggcgcuacaccugggaccgcccacccgggccauagcggaggccacuuccccucccuugcuaauggggccgcgcaggacggagauacgcacccuagcacaggcucugaauccgacagcucucccagacaagggggagaucauuccugugagggcugcgacgccagcuguugcucuccuuccuguuacagcuccagcugcuauucuaccagcuguuacuccucuagcugcuauuccgcuucuugcuacagccccuccuguuacaacgggaaccgguuugccucucacacccgcuucagcuccguugauagcgcuaagauuucugaguccacaguguuuagcucucaggacgacgaagaggaagaaaauuccgccuucgaaagcgucccugauuccaugcaaucucccgagcucgacccggagagcaccaacggcgccggaccuuggcaggaugaacuggcugcgcccuccggccauguggagagaagcccugaagggcuggagucucccguugccggaccguccaaucggagagaagacugggaggcucgcaucgauagccacggccggguguuuuaugucgaccacgugaacagaacaacgaccuggcagcgcccuacagccgccgcuacccccgaugggaugagacggucuggaagcauucaacagauggagcagcucaaucgcagauaccagaacauccaacggacaauugccaccgaacgcuccgaggaagacucuggcagccaguccugcgagcaggcgccugcugggggcggaggcgggggaggcucugauagcgaggccgaauccagccagucuucccuggaccuuagacgggaggggagccugucccccguuaauucucagaaaaucacgcuccugcugcagagccccgccgugaaguucaucaccaacccugaauuuuucacaguccuucaugcuaauuauuccgccuaccgcguguuuaccucuagcacaugucucaagcacaugauucugaaagugagacgggaugcgcgcaacuucgagagauaucagcauaaucgggaccuggucaacuuuaucaauauguucgcugauaccagacucgaacugccgcgcggaugggagauuaagacggaccagcaaggcaaauccuucuuuguggaccacaacagccgggccacaaccuucaucgauccccgcauuccucuucagaauggccgccugcccaaccaucucacacaccggcagcaucugcaaagacugcgcucuuacuccgccggggaggcuagcgaaguuucucggaacagaggagccucccuucucgcucgcccuggccacagccugguggccgcgauccggucucagcaccagcaugagagccugccccucgccuauaaugacaagaucgucgcuuuucugagacagccuaacauuuucgaaaugcuucaagagcggcagccgucccuggcccgcaaucacacccucagagaaaagauccauuacauucggaccgaggggaaccacggacuggagaagcugucuugcgaugcugaccuugugauccuccugagccuguuugaagaggaaauuauguccuacguuccccuccaggccgccuuccacccuggcuauagcuuuucccccagauguucuccuugcagcagcccccaaaauucuccggggcugcagagagcuagcgcgcgggccccuucccccuacagacgcgauuucgaggcuaaacuucggaacuuuuauagaaaacuggaagccaagggauucggccagggccccgggaaaaucaagcucaucauucgccgggaccaucugcuggagggaacauuuaaucaggugauggccuacucuagaaaagagcuucagcgcaacaagcuguaugucacguucgugggcgaagaggggcucgauuacagcggaccuucccgggaauuuuucuuccugcucagccaagagcuguuuaaucccuauuacggccuuuucgaguacucugcuaacgacaccuauacaguucagaucuccccuaugagcgccuuuguggaaaaucaccuggagugguucagauuuucugggcgcauucucggacuggcgcugauccaucaguaccuucuggaugcuuucuuuaccagaccguucuauaaggcccuccugcggcuccccugugaccuguccgaucuugaauaccuggacgaggaauuucaccagagccuccaauggaugaaagacaacaauauuacagauauccuggaccugaccuucacggucaacgaggagguguuuggccaggugacagaacgcgagcuuaagucuggcggggccaauacccaggucaccgagaaaaacaagaaagaauauaucgaaagaaugguuaaguggcggguggagcgcggagugguccaacagacagaggcucuggugagaggcuucuacgaaguuguggauucccggcucgucagcguguucgacgccagagagcuggaacucguuauugcggggaccgcugagaucgaucugaacgacuggcgcaauaacacagaauaucggggaggcuaccacgaugggcaucuugugauuagaugguuuugggccgccgucgagcgcuucaauaacgagcagcggcugagacugcuccaguuugugacgggaaccuccagcguuccuuacgaaggcuucgcugcccugcggggcucuaaugggcuucgcagauuuugcaucgagaaauggggaaagauuacaagccugccccgggcucacaccuguuucaaccgccucgaccugccucccuauccguccuacucuaugcucuaugaaaagcugcuuacagccguggaggagaccagcacguuuggccuggaauga

SEQ ID NO: 70214 - RNA, 4719 nt, Artificial Sequence
  derived and/or modified sequence opt5 from HECW2__Homo_sapiens__NP_065811
auggccagcuccgcuagagagcaccuccucuucgugcggcgcagaaacccccagaugcgguacacccugucuccugaaaaucuucaaagccuggccgcgcaguccucuaugccggagaacaugacacuccagcgcgcuaauagcgacacggaucuggucaccuccgaaucuagaagcucccuuacagccagcauguaugaguacacccugggccaggcccaaaaccucaucaucuuuugggacauuaaggaagagguugaucccucugacuggauugggcuguaucauaucgaugaaaauuccccugcuaacuucugggacagcaaaaaucggggagugacaggcacccagaaggggcagauuguguggcgcaucgaacccggaccuuacuuuauggagcccgaaaucaaaauuugcuucaaguauuaccacggcaucucuggggcccugagagcuacaaccccuuguauuacggucaaaaacccggccgugaugaugggagcggagggcauggagggcggggccuccggaaaucuccauagccggaagcugguuucuuuuacccuuuccgaucugcgcgcugugggccucaagaaagggauguucuuuaaccccgacccuuaucugaagaugagcauccagcccggcaaaaaguccucuuucccuacaugcgcccaccauggacaagaaagacggagcaccauuaucuccaauacaaccaaccccauuuggcaccgcgagaaauacagcuuuuucgcccuucugacggauguccucgaaaucgagaucaaggacaaguuugcuaaaucuagaccgauuaucaagcgguuccuggggaaacugacaauuccugugcagcgccuccuggaaagacaggcgaucggagaucagaugcuuuccuacaaucugggccggagacuccccgccgaccacguuagcggcuaucugcaauuuaagguggaggucaccucuagcgugcaugaggaugcuuccccugaagccguggggacaauucuuggagucaacucuguuaauggcgaccuggggagccccuccgacgaugaggacaugcccggaagccaccaugauucucagguguguuccaacggcccugugagcgaagacucugcugccgaugggaccccgaaacacuccuuccgcaccagcuccacacucgagaucgacacggaggagcugaccucuacaagcucccggaccucucccccuagaggacgccaggauagccugaacgacuaccucgaugccaucgagcacaauggccauucccggcccggcacagcuaccugcagcgaaagaucuaugggggcguccccuaagcugcgcagcucuuuccccacggacacacggcuuaacgccaugcugcacauugauuccgacgaggaagaccaugaguuucaacaggaucucggauauccgagcucucuggaagaggagggcgggcuuaucauguucagcagagcuucccgcgccgacgauggaagccugaccucucagaccaaacucgaagacaauccugucgagaacgaagaggccuccacacacgaggcugccagcuuugaagauaagcccgagaaucugccugaacuggcggaguccucucuccccgcuggcccugcccccgaagagggggagggcggaccggaaccucagcccagcgccgaccaaggcuccgcugagcugugugggucucaggaaguggaucagcccaccagcggagccgacacaggcacguccgaugcuucugggggaagccggagagccguuuccgagaccgaaagccuugaccagggcucugagccuucccaagugagcucugagacagaaccguccgaucccgcgcgcaccgagagcgucucugaagccuccacacggccugagggggaaagcgaccuggagugcgcugauuccagcuguaacgagucugugaccacgcagcucagcuccguugacaccagaugcucuagccuggaauccgcccgguuccccgagaccccugcuuuuucuagccaggaagaggaggacggcgccugugcggccgaacccacauccucuggaccugcugagggcagccaggaauccgugugcacagccgggagccugcccgucgugcaagucccgucuggagaggaugaaggcccuggggcugaguccgccaccgugcccgaccaggaggaacuuggagagguuuggcagcgcagaggcagccucgaaggggccgcugcggccgcugagucuccuccccaggaagagggcuccgccggagaggcccaaggcacgugugaaggggcuacagcccaggaggaaggagcgaccggcgggagccaggcuaauggacaucaaccgcugcggucccugccuucugugagacaggaugucagccgcuaccagcggguggacgaggcccugcccccuaacugggaagccagaauugauucccacggccgcaucuucuauguugaccacgugaauagaacaaccaccuggcagcggcccacagcucccccugccccgcaaguccugcagcgcagcaacucuauucagcagauggagcaacuuaauagacgguaccaguccauccgcagaacgaugaccaacgagcggcccgaagagaauacaaacgcgaucgauggggcuggcgaagaggccgacuuucaucaggccagcgcugauuuccgcagagagaauauucugccucacucuaccagccggucccgcaucacacuccugcugcagucucccccugugaaguuucuuauuagccccgaguucuuuaccgugcuccauuccaacccuucugccuauagaauguucacgaacaauacaugccugaaacacaugaucaccaagguucggagagacacccaccauuuugaacgcuaccaacacaaccgggaucuggucggauuccucaauauguucgcuaacaaacagcuggaacuuccgagaggcugggagaugaagcaugaccaccaggggaaagccuuuuucguggaucauaauagccgcacaaccacauuuauugacccccggcugccucuccaauccagcagacccacgucugcgcuggugcaccgccagcaccugacccggcagagaucccauagcgccggagaagucggcgaggacucccgccacgcugggccucccgugcuuccgcggccuucuagcacauucaacaccguuuccagaccccaguaccaagauauggugcccgucgccuauaaugacaagaucguggcuuuucuccggcagccuaacauuuucgagauccugcaggaacgccagcccgaucugacaagaaaucauucucuccgggagaagauccaauuuauucgcaccgaaggaacgccuggccugguuagacuuagcuccgacgccgaucuggugaugcuccugagccuguucgaggaagagaucaugucuuacgucccgccccacgcccuucuccauccuuccuauugccagagcccccggggcucuccuguguccagcccccagaacucuccggggacccagagagcuaaugcgcgcgccccugcucccuacaaacgggacuuugaggccaagcugagaaacuucuaucgcaaacuggaaacaaagggauacggccaagggccuggaaaacucaagcugauuauccggagagaucaccuucuggaggacgccuuuaaucagauuaugggcuauagccgcaaggaucuccagcggaacaaacuguacguuaccuucgugggggaagagggacuggacuacuccggccccucuagagaauuuuucuuccuugucagccgcgagcuguuuaauccuuauuacggccucuucgaguauuccgcuaacgauacauacaccgugcagaucagccccauguccgccuuuguggacaaccaccaugaaugguucagauuuucugggcggauccugggacucgcgcugauucaccaauaucuucuggacgcuuucuuuacacgcccguucuacaaggcccuccugagaauccugugugaucuuagcgaccuggaguaucucgaugaagaguuucaucagucccugcaguggaugaaagacaaugauauucacgacauccucgaucugaccuucacggucaacgaggaaguuuuuggccaaauuacagagcgggaacuuaagccugggggagccaauauccccgugaccgagaaaaacaagaaggaauacaucgagcgcauggugaaauggagaauugagcggggcgucgugcagcagaccgaaucucugguuagaggguucuacgagguggucgacgcucgccucgugagcguuuucgaugcccgggaacuggagcuggugaucgcgggaacagcugaaauugaccuuuccgauuggagaaauaacaccgaguaucgcggcggcuaccacgacaaucauaucgucauucggugguuuugggccgccguggagagauucaacaaugaacagcggcugcgccuccugcaauuuguuacggggacaucuagcauccccuaugagggauucgcuucccucagaggcagcaacgggccucggcgcuuuugcguggaaaaguggggaaaaaucaccgcccugccgagagcucacacauguuucaaucggcuugaucugcccccuuaccccucuuuuuccaugcuguaugagaagcuccugaccgccgucgaagagacaagcaccuucggccuugaguga

SEQ ID NO: 70215 - RNA, 4146 nt, Artificial Sequence
  derived and/or modified sequence opt5 from HEG1__Homo_sapiens__NP_065784
auggccagccccagagcuucccgguggccuccgccccugcuccugcuucugcucccucugcuucugcuucccccugccgcgcccggcacccgcgacccuccgcccucuccugcuagacgggcccugagccuggcuccccucgccggggccggacuggagcuucagcuggaacgcagaccugagcgggaacccccgccuacacccccucgcgagagacggggccccgcuacgcccgggccuuccuaccgcgccccggaacccggagcggccacccaaagaggcccuucugggcgggcuccccgcggaggcagcgccgaugcugccuggaagcacuggccugaguccaacacagaggcgcauguggaaaauaucaccuucuaucagaaccaggaggacuuuucuacagucagcuccaaagaaggcguuauggugcagaccagcgggaagucucacgccgcuuccgaugcccccgagaaucucacacugcuugcugagaccgccgacgccagaggacggagcgggucuuccagccgcacgaacuucaccauucugccggugggguacucucucgaaaucgcuacagcgcugaccucccaaagcggaaaucuggccuccgagucucuccaucugccuagcuccagcucugaauuugaugagagaauugcugccuuccagacaaaauccggcaccgccagcgaaauggggacggagcgggcuaugggacuuucugaggaauggacaguccacagccaggaggccaccacauccgcguggucucccagcuuucugccugcucucgaaaugggcgagcugaccacccccuccagaaagcgcaacagcucuggcccugaccuuuccuggcugcauuucuaucggacagccgccagcucuccccuccuggaucuguccagcuccucugaaagcacggagaaacucaauaacuccaccgggcugcagucuagcuccgugagccaaacaaagaccaugcacguugcuacaguguuuaccgacggaggcccgagaacgcuucgcucucugacagucucccucgggccugugagcaagaccgagggauuccccaaagauucucggaucgccaccacauccagcucuguucugcuuagccccuccgcuguggaaagcagacgcaauucucgggucaccggcaacccuggggacgaggaauuuauugagccguccacagaaaaugaguucggacugacgagccucagauggcagaacgauucccccaccuuuggcgagcaccagcuggccucuagcuccgaagugcagaauggcucuccuaugagccaaacagagaccgugucccgcucugucgcgcccaugcggggcggagaaaucacagcccauuggcugcucaccaacagcacgaccuccgcugacguuacaggcagcucugccuccuacccugagggggugaaugcuagcgugcugacccaguucucugauuccacaguccagagcggaggcucucacaccgcccuuggggacagauccuauagcgaguccagcucuacgagcuccucugaaagccugaacuccucugcgccccgcggcgagcggagcaucgccggaauuuccuacggccaagugagagggacagcuaucgaacagcggaccucuagcgaccauacagaucacaccuaucucuccagcaccuuuacaaagggagagcgcgcccugcugucuauuacggacaacuccagcagcuccgauaucguugaaagcuccaccucuuacauuaaaaucagcaauuccagccacucugaguacuccagcuucuuccaugcucagacagagagaucuaacauuagcuccuaugacggcgaauacgcccagccuucuaccgagagccccgugcuucacacauccaaucucccgucuuauaccccuacgaucaacaugcccaauacaagcgucgugcuggauaccgacgccgaauuuguuuccgauucuucuuccagcuccucuagcuccucuagcuccucuagcuccgggccuccccugccgcucccuagcgugucucaaucccaucaccuguucagcucuauccuucccagcacccgggcuuccguccaucugcucaagucuacaagcgacgcguccaccccuuggagcuccucucccagcccccugccugugucccugacaacgucuaccagcgccccgcuuuccgucucucagacaacccucccccagagcuccagcacaccugugcugcccagagcucgcgagaccccuguuacgucuuuucagaccuccacaaugaccagcuucaugacaaugcugcacucuucccaaaccgccgaucucaaaagccagucuacaccccaccaggaaaaggugauuaccgaguccaagagcccuucccuggucagccuuccgacggagucuacaaaagccgugaccaccaacagcccccugccucccucccucacagaaucuagcaccgagcagacgcugccugcuacauccaccaaucuggcccaaaugucucccacauuuaccacaaccauccuuaagacgagccagccgcucaugaccacaccuggaacccuguccucuacagcgagccugguuaccggccccauugcugugcagacgacagccgggaaacagcucucccugacccaucccgaaauccuugucccucaaauuagcacagagggcggaaucucuaccgaacggaacagagugaucguggacgccaccacaggccugauuccccucacguccguuccuaccagcgcuaaggagaugacaaccaaacugggggucacagccgaguacucuccggcgucccgcagccugggaaccucccccucuccucagacgacaguggugagcaccgcugaagaucuugcccccaaguccgccaccuucgcuguccagagcucuacacaauccccuaccacagugagcucuagcgccuccguuaauucuugcgcugugaaccccugucuccacaauggcgagugcgucgccgacaacacgagcagaggguaucauugucggugcccgccuuccuggcagggagacgauuguucuguggacguuaaugaaugccugagcaaccccuguccuuccaccgcgaugugcaauaacacacagggcagcuuuaucuguaaaugccccgugggguaccagcuggagaagggcauuuguaaccucguccgcaccuucgugacagaguuuaagcugaaaagaaccuuccuuaauacgaccguugaaaagcacucugaucugcaagagguggaaaacgagaucacaaaaacccucaauaugugcuuuuccgcccugccuagcuauauucgguccacaguccacgcuucucgcgaaagcaacgccguggugaucucccugcagaccacauucucucuugcuagcaaugucacgcuguuugaccucgccgauagaaugcagaagugcguuaacuccuguaaaagcucugccgaggugugccagcugcucggaucccaacggcgcaucuucagagcuggcagccuguguaagcggaagucucccgagugcgacaaagauaccuccauuuguacagaccuugaugggguggcgcugugccaguguaagagcggauacuuccaguuuaauaaaauggaccauucuugccgcgccugugaagauggcuacagacucgagaacgaaaccugcauguccuguccguucgggcugggaggccugaauugcgggaacccuuaucagcuuaucaccgucgugauugcugccgccggcggaggccugcuccugauccucgggauugcucugaucguuacaugcugucggaagaauaaaaacgacauuagcaagcucaucuuuaagucuggagauuuccaaaugagccccuacgccgaguaucccaaaaauccuagaucccaggaauggggccgcgaggcgaucgagaugcacgaaaacgggagcacgaagaaucugcuccagaugaccgacguguacuauuccccgacaucuguccggaaccccgagcuggaaagaaacggacuguacccugcuuauaccggccuucccggcagccgccauuccugcauuuuuccugggcaauacaaucccucuuucaucagcgacgagucccggagacgcgauuacuuuuga

SEQ ID NO: 70216 - RNA, 2655 nt, Artificial Sequence
  derived and/or modified sequence opt5 from HELLS__Homo_sapiens__NP_001275996
augcccgccgagagaccugcuggcagcgggggauccgaagccccggcgaugguggagcagcuggacaccgcugucaucacacccgccaugcucgaagaggaagaacaacuggaggccgcuggccuugaacgggagcgcaagaugcuggaaaaagccagaaugucuugggaucgggagagcacggagauucgcuacagacggcuccagcaucugcuugaaaaguccaacaucuauucuaaauuccugcucaccaagauggagcagcagcaacuggaggagcagaaaaagaaggaaaaacuggagcgcaagaaagagagccucaagguuaaaaaggggaaaaauuccauugacgcuucugaagagaaaccugugaugagaaagaaacggggacgcgaagaugagagcuacaacaucuccgaagugaugagcaaggaggagauucugucugucgccaaaaagaauaaaaaggaaaacgaggacgaaaauuccagcucuacaaaccuuugcguggaggaucugcagaagaauaaagacuccaacagcaucaucaaggauagacucucugaaaccguucggcagaauacaaaauuuuucuuugaccccgugcgcaaguguaacggccaaccuguccccuuccagcagccuaaacacuuuaccgggggagugaugagaugguaucagguugagggcauggaguggcugcggaugcuuugggaaaauggcauuaacgggauccuggcggaugagaugggacucggcaagacagugcaaugcauugccaccaucgcucugaugauucagcgcggggucccgggacccuuccugguguguggcccucucuccacgcugcccaauuggauggccgaauuuaagagauucaccccugacauccccacaaugcuuuaccacgggacccaggaggagcggcaaaaacuggugagaaacauuuauaagcgcaaaggaacacuccagauccauccggucguuaucaccagcuuugaaauugcuaugcgggauagaaaugcccugcagcacugcuacuggaaguaucuuaucguggacgagggccaucgcauuaaaaacaugaagugucggcugaucagagaacucaagcgcuucaacgcggauaauaaacugcugcucacgggcacaccucugcagaacaaucuuuccgagcuguggucucuccugaacuuucuucugcccgacguguucgacgaucucaagagcuuugaauccugguucgacauuaccagccugucugagacagccgaggauaucaucgcuaaagaacgggagcaaaauguccugcacaugcuccaccaggaacgcauuccuagaauguacguguccgaguucaccgacgaaggguuuuucgagggaaagcugcccagccggaaagaucuuuacgacaucagacccuaugagaacaccuaccugcucaagcugcauacaaauuuugaaauucugacgccuuuccuucuccgccggcugaagucugauguugcccuggaggugccgcccaaaagagaagucgugguuuaugcuccucucagcaagaaacaggagaucuuuuacaccgccauugugaaccggacaaucgccaauauguucggcuccucugaaaaggagaccaucgagcugagccccacagggcgcccuaaaagacggaccagaaaguccauuaacuauagcaaaaucgacgauuuucccaaugaacuugagaagcugauuucucagauccaaccggaagucgaccgcgagcgggcuguggucgaggugaacauuccuguugaauccgaggugaaucucaagcugcagaacaucaugaugcugcuuagaaaaugcuguaaucaccccuaccucauugaauauccuaucgaucccgucacgcaggaguucaagaucgacgaggaacuggugacaaacagcggaaaauuucugauucucgaccgcaugcugccugagcuuaagaaaagaggccauaagguucuccuguucucucagaugaccuccaugcuggauauccugauggacuacugccaccuucgggauuuuaacuucagccgccucgacggguccaugucuuacagcgaaagagagaagaauaugcacuccuuuaacaccgaucccgaaguguucauuuuccuggucucuacacgggcgggaggccugggcaucaaucucaccgccgcugacacagugauuaucuaugauagcgacuggaacccgcaauccgaucugcaggcccaggaccgcugucauagaaucgggcagacgaaaccugugguugucuaccggcuugugaccgccaauacaauugaucaaaagaucguggagcgcgcugccgcgaaaagaaagcuggaaaaacucauuauccacaagaaccauuuuaagggaggccagagcgggcugaaucugucuaaaaacuuccuugaccccaaggagcucauggagcugcugaaaucccgggauuaugaacgcgagauuaagggaagcagagaaaaagucaucucugacaaggaccucgagcugcuucuggaucgguccgaccucaucgaucagaugaaugcuagcggccccauuaaggaaaagauggggaucuuuaagauucuggagaacucugaggacagcuccccugaaugccuguucuga

SEQ ID NO: 70217 - RNA, 3306 nt, Artificial Sequence
  derived and/or modified sequence opt5 from HELQ__Homo_sapiens__NP_598375
auggacgagugcggcagcagaauccggcgcagagugucccugcccaagcggaaccgcccuucucucggguguauuuucggagccccgaccgcugccgaacuggagcccggcgaugaagggaaagaggaagaggagauggucgcggaaaauagacggcgcaagacagcuggaguucuuccuguggaggugcagccccugcuccugagcgacuccccugaaugccuuguccugggcgggggagauacgaaccccgaccuccugagacacaugccuaccgaucggggcgugggcgaccaaccgaaugauucugagguugacauguuuggggauuacgacagcuucacagagaacuccuuuaucgcccagguggaugaccuggaacagaaauauaugcagcuccccgagcauaagaaacacgccaccgauuucgcuacagaaaaucuguguucugagagcauuaagaacaaacuuuccaucaccacaauuggaaaucugaccgaacuccaaacggacaaacauaccgagaaccagagcggcuacgagggggucacaaucgaaccuggagccgaccugcuuuaugaugugcccucuucccaggcuaucuacuuugagaaucugcagaacagcucuaaugaccucggcgaucacuccaugaaggaacgcgacuggaaaucuagcucccauaacaccguuaaugaggaacugccucacaacugcauugagcaaccccagcagaaugaugagagcuccucuaaggugagaacaagcuccgacaugaaccggcgcaaaagcaucaaggaucaccugaagaacgccaugaccgggaaugcgaaagcccagacgccgauuuucucuagauccaagcaacucaaagacacacugcuuagcgaagagaucaacgucgcuaagaaaaccguggaaucuagcuccaaugaucugggaccuuuuuauucucuccccagcaaggugcgggaccuguacgcccaguucaaaggcauugagaaacuuuaugaauggcagcauacaugucugacccucaacuccguccaagagcgcaagaaucugaucuacagccugccuaccucuggcgggaaaacacucguugcugagauucugaugcuucaggaacugcucugcuguagaaaggaugugcugaugauccuucccuacguggccaucguccaggagaaaauuuccggacugagcucuuuuggcaucgaacucggguucuuuguggaggaguaugcgggauccaagggccgguuucccccuacgaaaagacgcgaaaagaaaagccuguacauugccaccaucgagaaggggcacucccugguuaacucucucauugaaacaggacggaucgacagccugggccuuguggucguggacgagcugcauaugaucggcgaaggguccagaggagcuacccucgagaugacacuggccaagauucuguauaccucuaaaacgacacagaucauuggcaugagcgcuacccuuaauaacguugaggaucuccaaaaguuucugcaggccgaauacuauaccucccaguuccgcccgguggagcugaaagaauaccucaagaucaaugacacaauuuaugaggucgauagcaaggccgaaaacgggaugaccuucucucggcugcuuaauuacaaauacuccgacacacugaagaaaauggaucccgaccaccucguggcucuggucacggaggugaucccuaacuauagcugccugguuuucugucccucuaagaaaaauugcgagaacguggcggaaaugaucuguaaguuccuuuccaaggaguaccucaaacacaaggaaaaagagaagugcgaagucauuaaaaaucugaagaacaucggaaacggcaaucugugcccugugcucaaaagaaccauucccuuugggguugccuaucaucacagcggccugacaucugaugagcgcaaacuucuggaggaggcuuacagcaccggagugcucugucuguucacaugcaccuccacgcuggccgccggcgucaaccuuccggcucggagagugauccuccgcgccccuuauguggcgaaggaauuucugaagcggaaucaguacaagcaaaugauugggagagcuggacgcgccggcaucgacaccauuggggaaagcauccugauccuccaggagaaagauaagcagcagguucuggagcuuauuacaaaaccccuggaaaacuguuauucucaucucguccaagaguucaccaagggaauccagacacuguuucugucccuuauuggccucaagaucgccaccaaucuggacgauauuuaccacuucaugaacgggacguuuuucggcgugcagcagaaagugcugcucaaggaaaagagccugugggagaucacagucgaaucccuucgguaccugaccgagaagggacuccugcaaaaagacacaaucuauaagucugaggaagaggugcaguacaauuuucauauuaccaagcugggcagagcuagcuucaaagggaccaucgaucuugccuauugcgacauucuguaccgggaccucaagaaaggacuggaaggccucguucuggagucccuucugcaccucaucuaucugacaacgccuuacgaucuggugucucaguguaaccccgacuggaugauuuauuuucgccaauucagccagcuuuccccugcugaacagaaugucgccgcgauccugggggugucugagagcuucaucggaaagaaagccuccggccaggcuauugggaagaagguugauaaaaacguggucaauagacucuaccugagcuuugugcucuacacccugcuuaaggagacaaacaucuggaccguuucugaaaaauucaauaugccccggggcuauauucaaaaccugcucacaggaaccgccuccuuuagcucuugcgugcugcacuucugugaggaacuggaggaauuuugggucuacagagcccuucugguggagcucacgaagaaacugacauauugcgugaaggcugagcucaucccgcugauggaagucaccggcguucuugaggggcgcgcgaaacagcuguacuccgccggauauaagagccugaugcaucucgcuaaugccaacccugaagugcuggugcggaccauugaccaccuuucuagacgccaggcuaagcagaucgucuccagcgccaaaaugcugcuccaugagaaggccgaggcucugcaagaagagguggaggaacuccugagacuucccuccgauuuccccggcgcgguugccagcucuacagacaaggcuuga

SEQ ID NO: 70218 - RNA, 729 nt, Artificial Sequence
  derived and/or modified sequence opt5 from HELT__Homo_sapiens__NP_001287710
augagcgacaagcugaaagagagaaagcggacccccgugucccacaaagucaucgaaaagcgcagacgggaucgcauuaacagaugccucaaugagcugggcaaaacaguuccuauggcccuugcuaagcagucuagcgggaagcuggaaaaagccgagauccucgaaaugacggugcaauaccugcgggcgcuucauuccgcugacuucccgcgcggaagagagaaggccgagcugcucgccgaauuugcuaacuauuuccacuacggcuaucaugaguguaugaaaaaucuggugcacuaccugaccacagucgaacggauggagaccaaggauacaaaauaugcccgcauucucgcuuuucugcagucuaaggccagacuuggggcggagcccgccuucccuccccugggaagccucccugaacccgacuuuuccuaccagcugcauccugcuggcccggaguucgccgggcacucucccggagaagcugccguguuuccucagggcagcggcgcggggcccuucccuuggcccccgggagccgcucgguccccugcccuucccuaucugccuagcgcucccguuccccucgccucuccugcccaacagcacuccccguuucugacccccgugcagggccuggaucgccauuaccucaaccugaucgggcacgcucauccuaaugcgcuuaaccugcacacaccccagcacccucccguccucuga

SEQ ID NO: 70219 - RNA, 7950 nt, Artificial Sequence
  derived and/or modified sequence opt5 from HELZ2__Homo_sapiens__NP_001032412
auggccgugugggaggcugaacagcugggcgggcugcaacggggcgaccugcuuacacccccugcccccgauggcgacgggcggaccgcgccccugggacagccucccggcgcucagcucuacugcccugccugucugguuacgugccacagccaggaggccuucgaaaaccauugugcuuccucugagcacgcccaaaugguugcuuuugaucaggcccuucccugggaacaccgcagcccuccgcccgggcugagcaaguucgagcucugcccuaagcccgaccugugugaguauggagaugcgugcaccaaggcccacucugcucaggaacugcaggagugggugagacggacccaagccguggaacuccgcggccaggcugccuggcaggacggccuggucccuuaccaggagagacuucuggcggaguaucaacggagcuccucugaagugcucguucuggccgagacccuugauggggugcgcgucacguguaaucagccccugauguaccaggcucaagaaagaaagacccaguauagcuggacauuugccgugcauuccgaggaaccgcuccugcacguugcucugcucaagcaggagccuggagccgacuucagccugguggcccccggccuuccucccgggcggcuguacgcucgcggagagagauuucggguccccucuuccaccgcggauuuccaggugggcgugcgcguccaagccgcuagcuuugggacguucgaacaguggguuguguuugacuucggaagacggccugugcuccugcagaaacuuggccugcagcucggccaagggcgcagaccgggacccugccggaaccuggcccugggccacccugaggaaauggagagauggcauaccgggaaucgccacgucgugcccggaguugaacggacagccgagcagaccgcucucauggccaaguauaagggcccugcgcuggcucuugaguuuaacagaucuuccguggccagcgggcccaucucuccgacaaauuaccgccagcggaugcaucaguuccuguacgaagaggaagccgcucaacagcagcucgucgccaagcugacccuuagaggacagguguuucugaagacggcucuccaaaccccugcccugaacaugcuguucgcgcccccuggcgcccucuaugcugagguucccgugccuuccagccugaugcccgauaccgaccagggcuuccuucuggggcgcgccgucuccacagcucucguggccccggucccugcgcccgauaauaccguguuugaaguucggcuggagagacgcgccucuagcgagcaggcucuguggcuucuccugcccgcccgguguugccuggcucucggacugcaaccugaagccagacuugugcuggagguccaguuccagauugacccgaugaccuuucgccucuggcaccaggccguggacacacugcccgaggaacaacugguugugccugaucuucccacgugugcucucccucggcccugguccgucccuccccugagacggggcaaccgcaaacaggagcuggcgguggcccucaucgcuggguggggaccgggcgacgggagacgggugccuccccugcuuauuuacggcccuuucggaaccggcaagacauauacccuggccauggccagccucgaaguuaucagacgccccgagacaaaaguccugauuugcacccacacaaauucugcugccgauaucuacauccgggaauauuuucauucccacgugagcgggggacauccggaggcgacaccucugagagugauguacaccgaccgcccccuuucucagaccgauccugucacacuccaguauugcugucugaccgacgauagacaggcuuuccggccgcccacacgcgccgaacuggccagacaccgggugguugugacgaccacaagccaggcucgcgagcucagagucccugugggcuuuuucucccauauucugaucgacgaggccgcgcagaugcuugaaugcgaggcucugaccccgcucgccuacgccucucacgggacacggcugguucuggcuggagaucacaugcaagugacaccccgccuuuuuagcgucgccagagcucgggccgcggaacauacgcuccugcaccgccuguuccucuguuaccaacaggagacccaugaaguggccagacagucccggcugguuuuucacgagaacuauagaugcacagacgcuauugugagcuucaucucucgccacuuuuacgucgccaagggcaauccuauucaugcucgggggaaggugcccccucaccccagacauuauccucuuauguucugucacguggccggcuccccggaucgcgacaugagcauggccucuuggcugaaccucgcugagaucgcgcaagucguugaaaaagugcaggaggccuacaauaccuggcccuccugcuggggaggccgggaacagagauguauuugcguggucagccauggggcucagguguccgcccugcgccaagagcugcggagacgcgaccuuggacagguuucugugggcagcuucgaaauccugccugggcggcaguuuagagucgugguucucuccacagugcacaccugucagucucugcucagccccggagcccuggcuccugaguucuuuacggaugcccggguccuuaacacagugcugacccgcgcgcaaucccagcucguuguggucggcgacgcuguggcccugugcagcuucggggccuguggcaagcugugggagucuuuuaucagagaaugcguggagcggcacuccgucugccccgaaggacuuagcauggagcagguugagcagggcguggcucaacgcagacgguggccgccuagagggacacaggccggagcggcuggcaauugggaagccgcccccgagcccgugggggaucuggcugaggaacaggccgcugucgugaccgccaugguuaaagcggaaccuggagacgaggcccucucucccgcuucccgcgauauuaccgccacaacggcucagaccgaggccgccgcugcgccugccggcgacgcugugaaggaagaugucgugccgggggccugugccgcuggcgccgcggcugccgccggaguugagagcacagaagcugaggacgccgaagcggauuucuggcccugggacggcgagcugaacgccgaugacgcuauccuccgggagcugcuugaugaaucucaaaaagugauggucaccgugggggaggacggacugcucgacacagucgccagaccugaaagccugcagcaggcucgccuguaugagaaccuucccccugccgcucugcggaagcuccugcaugccgaacccgagagauaccgccacugcuccuuugugccggagaccuucgaacgggcgagcgccauuccucucgaugacgcuucuuccggccccauccaaguuagagggcgccuggauuguggaauggccuuugcuggcgacgaggugcuuguccagcugcugagcggcgauaaagccccugaagggagacuccggggacgcgugcugggcguucuuaagagaaagcggcaugagcuggccuucgugugccgcauggacacgugggaucccagaauuauggucccuaucaauggguccgugacaaaaaucuuuguggcugagcucaaggaccccucucagguuccgauuuauagccugcggaaaggaagacuccagcgcgucggccuggaacggcuuaccgcggaggccagacacucccgccuguucugggugcaaaucgugcuguggcggcagggguuuuacuacccucucggaauugucagagaagugcugcccgaggcuucuaccugggaacagggccuucggauccugggccucgaguauagccugcgcguucccccuuccgaucaggccacaauuaccaaggugcuccaaaaauaccauacagagcuggggagagucgccggacggcgcgaagacuguagagcuuuccuuacguucaccguggauccgcagggcgccugcaaccuggacgaugcgcugucuguucgggaccucgggccccgcugugagguggccguccacaucacagacguggcuagcuuuguuccuagagauggagugcuggacgucgaagcccggcgccagggcgcugccuucuaugcgcccgggagagagccugugcccaugcuuccugccucccugugccaggaugugcucagccugcucccgggacgggacagacuggcuaucucucuuuuucugaccauggaaaaggccuccggccaacucaagagccuccgcuucgcucccucugucguucaguccgaucggcagcugagcuacgaggaggccgaagaggugauuagacaacacccuggcgcugggcgcgaacuucccgcccggcuggacucuguggaugcgugugucguggccgcuugcuauuuuuccagacuccugcgccggcauagacugcgcagcgacuguuucuacgagcagccugaugaagacggaacacucggcuuucgggccgcucacaucaugguuaaagaguauaugauucaguucaauagacuuguggccgaguuucuggucggguccgaaugcacccgcacggugacaccccugcgguggcagccggccccuagaagccaacagcucaaggcgcugugcgagaaacauggagaucgcguuccccuuucucugcaccucggccaccaucugcacgggggaggcggcucucccccugacacaagacugcaucuccuugcuucccuguggaaacaggugcaguucgccgcucggacccaagacuacgaacagauggucgaucuggugacaaccgacgauaugcaccccuuucucgccccugccgggcgcgaccugagaaaagcucuugagcgguccgccuucggaagaugugcgcggggccaucagcagcaagggggacacuacagccugcaggucgauugguauacaugggccaccuccccgauccgcagauaccucgacgugguucugcagcggcagauucugcucgcucuuggccacgggggaucugccuauagcgcucgcgauaucgacggccugugccaagccuucucccugcagcaugcgcucgcccagucuuaccaaagacgggcucgcagccugcaccuugccgugcagcugaaggcucagccccucgauaagcugggcuuuguggucgacguugaggccggguccagauguuuccggcugcucuuuccuagcaaccgcgaaacgcuucccgauccuugccccgugccguauggaucucugcagcuggcugagcauccucacgcccucgcgggcagacccgggcugcggcuucuguggcgcagacggguguacuccgcccaaggaagcucuccuccccucccucugcccggcacagucccggacccucacacccuggcuguggaaaccgcccucuggaaacagcuucuggagcugguugaacuccagcgcuggcccgaggcugccgcccugauucaggagaagggggaagcgucccaaagacgggagcuugugcagguccagagaagccauuguggacacuuccuggaaguggcucgcgagcucggcuccggcgauacacugcagguccaacuggggaccucucuccagcauggauuucuugugcccagcccucagcuguggacgguugccccgggcuucucccugugccucgaacacguggagcggcccggggacuguuuuagcggaagagucuaucgcgccccucgggacagauaccgcgauguggacgaguacgcuugcguuugggaacccuucugugcccuggagucugcuacaggcgccguggcggaaaaugauuccgucacccuucaacaucugagcgugucuugggaggccagccggacaccucaggggcagcuccagggagcuuuuagacuggaagccgcuuuccuggaggagaacugcgccgacaucaauuuuuccuguugcuaucucugcauccgccuugaaggccugcccgcgccuaccgccucuccccggccgggcccuagcucccuggggcccggacucaacguggauccuggcacauacaccuggguugcucacgggcaaacgcaggacugggaucaggagagacgcgccgaccggcaggaagcucccagacggguccaccuguucgugcaucacaugggaauggagaaagugccggaggaaguccuuagaccuggcacccuguuuacaguugagcuccugcccaagcaacugcccgaucuccgcaaagaagaggccgugcgggggcuugaagaggcuucuccucuggugaccagcauugcccugggcagacccgucccucagccgcucugucgcgugauccccuccagauuccuggagcggcagacauauaauauuccuggaggccgccauaaacuuaaccccagccagaauguugcggugagagaagcccuggagaagccuuucaccgucauccaagggcccccuggaacgggcaaaacaauuguggggcuccacaucgucuuuugguuccacaagucuaaccaggaacaggugcaaccgggaggacccccuagaggggagaaacgccugggcggacccugcauccuguacuguggcccuuccaauaagagcgucgacgugcucgcugggcuucugcugagacggauggaacucaaaccccugcgcguguauuccgagcaggccgaggccucugaauuuccggucccuagaguuggaagccggaaacuucugcgcaaaucccccagagagggccggcccaaccagucucuccgcagcauuacccugcaucacagaauccggcaggcuccuaaucccuacuccagcgaaauuaaggccuucgauacaagacugcaacgcggggagcucuuuucucgggaagaccuggugugguauaagaaagugcuuugggaggcgagaaaguucgagcuggaucgccaugaagucauccucugcaccuguuccugcgcugccagcgccucucugaaaauucuugacgugcggcagauccugguugacgaggcuggaauggccaccgaaccugagacacucaucccgcuggugcaguuuccccaggcugagaaggucgugcugcucggcgaucacaaacaacugagaccuguugugaagaacgaacgccuucagaaccuggggcucgaccggucccuguucgagagauaccaugaagaugcccacaugcuugacacgcaguaccgcaugcacgagggcauuugugcguuucccagcgucgccuucuauaagucuaaacugaagaccuggcagggacuccggagaccucccagcgugcugggccaugcugggaaagaauccugcccgguuaucuuuggacacgugcaaggccaugagcggucucugcucgucagcacagaugaggggaaugaaaacuccaaggccaaucuggaggaaguggcugaggucgugcgcauuaccaaacagcuuacacugggaagaaccguugaaccucaggacaucgccgugcucacgcccuacaacgcgcaggccagcgagauuuccaaggcucugcggcgcgagggcaucgccggcgucgcugugucuagcaucacaaagucccaagggucugaauggagauaugugcuuguuagcaccgugcggaccugugccaaauccgaucuggaccagagaccuacaaagucuuggcucaaaaaguuccugggauuugucguggaucccaaucagguuaacguggccgucacccgcgcucaagagggccugugccucauuggggaccaucugcuucugcgguguugcccgcucuggagaagccugcuugauuucugcgaagcgcagcagacacuggugccugccggacagguccgcgugugucggagacccacgaugcccuccuga

SEQ ID NO: 70220 - RNA, 5829 nt, Artificial Sequence
  derived and/or modified sequence opt5 from HELZ__Homo_sapiens__NP_055692
auggaggaccgccgggcugaaaagagcugcgaacaggcuugugaaucccugaaacgccaagauuacgagauggcccucaagcacugcaccgaagcgcugcuuucucugggccaguauagcauggcugacuucacagggcccuguccucucgagaucgagcgcauuaaaaucgaaucccugcuuuaccggauugccucuuuucugcagcucaagaacuaugugcaggccgaugaggacugccgccauguccugggagaaggccuggcuaaaggggaggaugccuucagagcuguucucuguugcaugcaacugaagggaaaacuucagccggugagcacgauccuggccaaaucccucaccggcgagucucugaaugggauggugacaaaggaccuuacccggcugaaaacacuccugagcgaaaccgagacagccaccuccaacgcccugagcggauaccacgucgaagaucucgacgagggcucuuguaauggcuggcauuuuagacccccucccagagggauuacguccagcgaagaguauacccugugcaagcgguuccuugagcagggaaucugucgcuacggcgcucagugcacaucugcccacucccaagaagaacucgcugaauggcagaaaagauaugccagccggcucaucaagcugaagcagcagaacgagaauaaacaacuuucuggguccuacauggaaacccugauugagaaguggaugaacagccucuccccugagaaagugcugucugaauguaucgagggaguuaagguggaacauaaucccgaucugagcgucacaguguccaccaaaaagagccaccagacguggacauuugcccugaccugcaaaccugcccgcaugcuguacagaguugcccuucuguaugacgcccaccggccccauuucucuauuaucgcuauuuccgccggcgauagcacaacccaggugucucaagagguccccgaaaacugccaggaguggaucgggggaaagauggcccagaauggccucgaccacuacguguauaaggugggcauugcuuuuaacaccgagaucuucgggacauuucgccagacgaucgucuucgauuuuggacuggaaccuguucuuaugcaaagagugaugauugacgcggccagcaccgaggaccuggaauaccucaugcaugcuaaacagcagcuggugacaaccgccaagcggugggauuccucuagcaaaacaaucauugacuucgagcccaaugagaccacggaucuggaaaagucccuccugaucagauaucagauuccucuuagcgccgaccaacuguuuacacagucuguccucgauaaaucccugaccaagagcaacuaccagucucgccugcacgaccuucucuauaucgaggaaaucgcucaguacaaggagauuuccaaauucaaucugaaggugcaacugcagauccucgccagcuucaugcugaccggcguuuccgggggagcgaaauacgcucagaacggccagcuuuuugggcgguucaagcugacagaaacccucucugaggauacacuggccggaagacuggugaugacgaaagucaaugccguguaucuucuccccguuccgaagcaaaagcuggugcagacccagggcacaaaagagaaggucuacgaagcuaccauugaggagaagaccaaggaguauaucuuucugcgccucagccgggaauguugcgaggagcugaaccuuagaccugacugugauacccaaguggaacugcaguuccagcucaaccgccugccccugugcgagaugcacuacgcccuugaccggauuaaagauaauggcguccucuuuccugacaucuccaugacgcccaccauccccuggucuccuaacagacagugggacgaacaacuggauccgcgccugaaugcuaagcagaaggaggccgugcucgcgauuacaacaccccuggccauccagcuuccucccguucugauuaucgggccuuauggaacaggcaaaaccuucacgcucgcucaggccgugaagcauauucugcaacagcaggaaacacggauccugauuuguacccacagcaacuccgcugccgaccuuuacaucaaagauuaucuccaucccuacgucgaggcggggaauccgcaggccagaccucugcgcguguacuuucggaacagauggguuaagacagugcaccccgucgugcaucaauauugccugaucagcucugcucacuccaccuuccagaugccucagaaagaggacauucucaagcaccgggugguugucgugacccugaauacaagccaauaccuuugucagcuggaucucgaacccggauuuuucacgcauauccugcuggacgaggccgcucaggccauggaaugcgagaccauuaugccucuugcccuggcuacacagaacacccgcaucgugcucgcgggcgaucacaugcaacugucucccuuugucuauuccgaguucgccagagaacggaaucuccaugugagccugcuugacagacuguacgagcacuauccggcugaauuuccuugucgcauucuccugugcgagaacuaccggucucacgaagccaucaucaauuauacaagcgagcuguucuacgaggggaaacuuauggccuccggcaagcagcccgcucauaaggauuucuacccccugaccuuuuucacggccagaggagaagacguucaggagaaaaacagcacagcguuuuauaauaacgcugaaguguucgaggucguggaacgcguugaggagcucagacggaaguggccuguggccuggggcaaacuggaugacgggucuauuggagucgugaccccguacgccgaucagguuuuucgcaucagagcugaacuccggaagaaacgccuguccgacgugaaugucgagagagugcuuaacgugcaaggcaagcaguuccggguccuguuucucagcaccguucgcacaagacacaccuguaagcauaaacagacacccauuaagaaaaaggaacagcugcuggaggacuccacggaagaucuugacuauggguuccugucuaacuacaaacuccugaauaccgccaucacacgggcgcaaagccucguggcuguggucggagauccuauugcccugugcuccaucggccgcugcagaaaguuuugggagcgguucaucgcccuuugucacgagaacucuagccugcaugggauuaccuuugaacagaucaaggcucagcuggaggcccucgaacugaaaaagacauaugugcuuaauccccuggcuccugaguucauucccagagcccuccgccugcagcacuccggcucuaccaacaaacaacagcagagcccucccaagggaaaaucccuccaccauacgcaaaaugaccacuuucagaacgauggcaucguucagccgaauccuagcgugcugauugggaaccccauccgggcguacaccccucccccgccucuuggaccccauccuaaucugggcaagucucccucccccguccagagaaucgacccucacacagggaccagcauucuguaugugccggccguuuacggaggcaacguggucaugucugugccccucccuguucccuggacaggguaccaaggccgcuucgcuguggauccucggaucauuacccaucaggccgcuauggccuauaauaugaaccugcuucagacacacggaagaggcucccccaucccuuacgggcugggacaccauccgcccgucaccauuggccagccucaaaaucagcaccaggagaaggaccagcaugaacaaaaccgcaaugggaaaagcgauacgaacaacucuggacccgagaucaauaagauucggacaccugagaaaaagcccaccgagccgaaacagguggaccucgaauccaacccucagaauagaagccccgagucccgccccagcguggucuauccuucuaccaaguucccccggaaagauaaccugaauccuagacacaucaaccucccgcugcccgccccucacgcucaauacgcgauccccaaucggcauuuucacccucuuccccagcugccgcgcccucccuucccuauuccccagcagcauacacugcucaaccaacagcagaauaaccugccugagcagcccaaucaaaucccgccucagcccaaccagguugugcagcaacagagccagcuuaaucagcaaccccagcagccuccgccccaacuguccccugccuaucaggcuggccccaacaaugccuuuuucaacucugccguggcucacagaccucagucucccccugccgaagcggucauuccggagcagcaacccccucccaugcuccaggaagggcauuccccucugcgggcuaucgcccagcccggcccgauucucccuucccaccugaacagcuuuaucgacgagaaucccuccggacuucccaucggcgaagcccuggaucgcauucacgggucuguggcucuggagacccucagacagcaacaggcccgguuccagcaguggagcgagcaucacgcguuucugucccaaggaagcguuccuuacccccaucaccaccauccucaccuucagcaucugccgcagcccccucucggccugcaccaacccccugugagagcugacuggaagcugacgucuuccgccgaagacgaggucgaaacaaccuauagccgcuuccaggaucucauccgggagcuuucucauagagaccaguccgaaacacgcgagcuggccgagaugcccccgccucagagccggcugcuccaauacagacaggugcagucccgcucucccccugcuguucccagcccucccuccagcaccgaucacucuucccacuuuagcaacuucaaugacaacucucgggauauugaaguggccagcaauccggcuuuuccucagagacugccgccccaaaucuucaacuccccuuucucucuuccgagcgagcaucuggcgcccccuccccucaaguaccuggcgccugacggggccuggacauuugcuaaucugcagcagaaccaccucaugggacccggcuucccuuauggccuucccccgcugccucauagacccccucagaaucccuuuguccaaauucagaaccaccagcacgccaucgggcaagaaccguuccauccucuguccucuagaaccgugagcuccagcucucuccccucccuggaggaguacgaaccccggggaccuggccgcccccuuuaucagagacggaucagcuccucuagcguccagccuugcuccgaggaagugucuacgccgcaggauagccuggcucaauguaaagagcuccaggaccacuccaaucagagcucuuuuaacuucuccagccccgaaucuuggguuaauaccacauccagcaccccuuaccagaacauucccugcaaugggucuagccgcacagcccaaccuagagagcugaucgcgcccccuaagaccgugaaaccgcccgaggaucagcugaaguccgaaaaccucgaggucucuagcuccuuuaauuauagcgugcuucagcaucugggacaguucccuccccugaugccuaacaaacaaauugcugaauccgcgaacucuagcagcccccagucuagcgccggcgggaagccggcuauguccuacgccucugcccuccgggcuccucccaagcccagaccucccccugagcaggccaaaaagagcuccgacccgcugagccuuuuucaggaacugucucucggauccagcucuggcuccaauggcuucuauagcuacuuuaaauga

SEQ ID NO: 70221 - RNA, 1455 nt, Artificial Sequence
  derived and/or modified sequence opt5 from HEMGN__Homo_sapiens__XP_011517148
auggaccugggcaaggaucagagccaccucaaacaucaccaaacccccgacccucaucaggaggaaaaccacuccccggaggugaucgggacauggucucugagaaaucgggaacuucugcgcaagagaaaagccgagguccaugaaaaggagacgagccaguggcuguucggagagcagaaaaagcggaagcaacagcgcaccggcaaagggaacagacggggacgcaagagacagcagaauacagaacucaaaguugagccccaaccucagauugaaaaggagaucguggagaaagcucuugcccccauugaaaagaagaccgagccucccggcuccaucacaaaaguguuuccuucugucgcgagcccgcagaaggugguucccgaagaacacuucuccgaaauuugccaggagucuaacaucuaccaagagaauuuuagcgaauaucaggagaucgcugugcagaaccacuccagcgaaaccugucaacaugucucugagccugaagaucugucccccaaaauguaccaggagauuagcgugcuccaggacaauucuuccaagaucugccaggauaugaaagagccugaagacaacagccccaauacaugucaaguuauuucugugauccaggaucacccguucaagauguaucaggacauggccaaacgggaggaucuggccccuaagaugugccaggaagcugccguccccaagauucugccuugucccaccuccgaggacacggcugaucucgccgggugcagccugcaagcguaccccaaaccugacgugccgaagggauauauccuugauaccgaccagaaccccgccgaaccugaggaguacaaugaaacagaccagggcauugcugagaccgaaggccuguuucccaaaauccaggagaucgccgagccuaaggaucucuccacaaaaacccaucaagaaucugcugagcccaaguaucugccgcacaagacguguaacgaaauuaucgugccuaaagcccccagccacaagacaauucaggagaccccucauuccgaagacuacagcaucgagauuaaucaggagacacccgggucugaaaaauacuccccugagaccuaucaggaaauccccggacuugaggaauacagcccggagaucuaucaagagaccucucagcuggaagaguacagcccugaaauuuaucaggagacacccggccccgaagaucucuccacggagaccuacaagaacaaagacgucccuaaggagugcuucccggaaccccaccaagagacagggggaccucagggccaggaucccaaggcgcaucaggaagacgccaaagaugcuuauaccuuuccucaagagaugaaggagaaacccaaggaggagccugggauccccgccauucugaaugaaucucacccggagaacgacguuuacagcuacgugcuguucuga

SEQ ID NO: 70222 - RNA, 1251 nt, Artificial Sequence
  derived and/or modified sequence opt5 from HEPACAM__Homo_sapiens__NP_689935
augaagagagagcggggcgcccugagccgcgcuuccagagcccuccggcuggcgcccuucguguaccuucugcucauccagaccgacccucuggaaggggucaacauuacaucuccgguucgccuuauccacggaacggugggcaaaagcgcucugcucuccgugcaauauucuagcaccuccucugauagacccgucgugaaguggcagcugaaacgggacaagccuguuacagugguccagagcauugggaccgaggugaucggaacacugcgccccgauuacagagaccggauucgccucuuugaaaauggcucccugcuucugagcgaucuccagcuggccgacgaggggaccuaugaaguugagaucucuaucacagaugacaccuucacgggagagaaaaccauuaaccuuacaguggaugucccuaucuccagaccccaagugcugguggccagcaccacaguccucgaacugucugaggcuuuuacccugaauugcucccaugaaaacggcacgaagccuagcuacacauggcucaaggacggcaaaccgcugcuuaaugauucucggaugcugcucucccccgaccagaagguucugaccauuacacgcgugcuuauggaggaugacgaccuguauagcuguaugguggagaacccuaucucccaggggagaucucuccccgucaaaauuaccguguaccggcgcagcucccuguauaucauucugagcaccggaggcaucuuccuccugguuacacuugugacggucugcgccuguuggaagccuucuaaaagaaagcagaagaaacuggaaaagcaaaauucccucgaguacauggaucagaacgacgaucggcugaaacccgaagcugacacccuuccgagaagcggggagcaggaacgcaagaauccuauggcccuguacauccucaaagauaaggacucucccgagacagaggaaaacccugcgcccgagccccggagcgccaccgaaccuggaccgcccggcuauuccgugucuccugcuguucccgggagaagcccuggacugcccauucgcuccgcccggagauacccgcgcagcccugcucggucucccgccacaggcagaacccacuccagcccuccccgcgcgccuucuucccccggccggagcagauccgccucucgcacgcugcggacagcuggggugcauaucauuagagagcaggaugaagccggaccggucgagaucagcgcuuga

SEQ ID NO: 70223 - RNA, 3483 nt, Artificial Sequence
  derived and/or modified sequence opt5 from HEPH__Homo_sapiens__NP_001124332
augugggccauggagagcggccaucugcucugggcucugcuuuucaugcagucccuguggccccaacucaccgacggggccacaagaguguacuaucugggaauccgggauguccaguggaacuacgcgccuaagggccgcaauguuauuacgaaccagccgcuugacucugauaucguggcuagcuccuuucugaaaucugacaagaauagaauugggggaaccuauaaaaagacaaucuacaaagaauauaaggaugacagcuacaccgaugagguggcccagcccgccuggcucggcuuccuggggccuguccugcaagcugaagugggagacguuauucucauccaccugaagaacuuugccacacggcccuauaccauccacccucauggcguguucuacgagaaagauuccgaaggcucucuuuaccccgacgggagcuccggaccucugaaggcugaugacagcgucccgcccggcgggucucacauuuauaauuggacaaucccugagggacaugcccccaccgaugcggacccugccugccucacguggauuuaccacucccacguggacgcuccccgcgauaucgccaccggccugauugggccgcuuaucacauguaaaagaggagcucuggacggcaacagcccuccccagcggcaggauguugaccaugacuuuuuccuccuguuuucuguggucgaugagaaucuguccuggcaccucaacgaaaauauugccaccuauugcagcgauccugcgucuguggacaaggaggaugaaacauuccaggaguccaaccgcaugcaugccaucaauggcuuuguguucgggaaccugcccgagcuuaauaugugugcucaaaagagagucgccuggcaccuguuuggaaugggcaacgaaaucgacguucacaccgcuuucuuucaugggcagaugcucacgacacggggacaccauaccgauguggccaauauuuuccccgccacauucgugaccgcugagauggucccuugggaaccgggcaccuggcugaucagcugccaggugaacucccacuuucgcgacgggaugcaggcgcuuuacaagguuaagucuuguagcauggcucccccuguggaccugcucacaggaaaagucagacaauauuucauugaggcccaugaaauccagugggauuacggccccaugggccacgacggguccacgggaaagaaccugcgggagccuggcagcauuucugauaaauuuuuccagaaguccagcucucgcaucgggggaaccuauuggaaagugagauacgaggccuuucaagacgaaacauuccaggagaagaugcaccuggaagaggaucggcaucucggcauccuggggcccguuauucgcgccgaagugggcgacaccauccaggucguguuuuacaauagagcuagccagccguucuccaugcaaccucacggagucuuuuaugagaaagauuacgagggcacaguguauaacgacgggucuagcuaccccggacuuguugccaagccuuucgaaaaggugaccuaucgguggacggugcccccucaugcgggccccacagcucaggauccggccugccugaccuggauguacuuuuccgccgcugacccuauuagagauaccaauagcgggcucgucggaccccugcuuguuugucgcgccggcgcucugggggccgacggcaaacagaagggaguggauaaagaguucuuucuccuguucacaguccuggacgaaaacaagucuugguauuccaaugcgaaccaggccgcugccaugcucgacuuccggcugcuuagcgaggauaucgaaggcuuucaagacucuaauagaaugcacgcuauuaacggguuccuguuuuccaaucucccccgccuggauaugugcaaaggagacaccguggccuggcaucugcuuggccucgggacagagacggaugugcacggaguuauguuccagggcaacaccguccagcugcaggggaugcggaagggcgcggccaugcuguuuccucacacauucgugauggcuaucaugcaaccggacaaucucggaaccuuugagaucuacugucaggccggcagccauagagaagcugggaugcgcgccauuuacaacgugucccagugccccggacaccaggccacaccucggcaaagauaucaggcugcgcgcaucuacuauauuauggccgaggaagucgagugggauuacugucccgaccggucuugggagagagaauggcauaaucagagcgagaaggauuccuauggcuacaucuuccugucuaacaaagacgggcuucugggaagccgcuauaagaaagcuguguuucgggaauacaccgauggcacguuccggauuccuagaccccgcaccgggccugaggaacaccucggcauccugggaccccugauuaagggcgagguuggggacauccuuacaguggucuuuaaaaauaacgccuccagaccguacagcgugcacgcccauggaguucucgagucuaccacaguguggccucuggcugccgaacccggcgaggucgugaccuaucaauggaacaucccugaacgguccgggcccggaccgaaugauagcgcgugcguuucuuggauuuacuauuccgcuguggacccuaucaaggacauguacagcggccuggucggcccccucgccauuugccagaaggggauccuggagccucacggaggcagaucugauauggaccgcgaguucgcccuucuguuucucauuuucgaugaaaacaaaagcugguaucuggaggaaaauguggcuacgcaugggucccaggaccccggaagcaucaaccugcaggaugagacauuccuugaaucuaauaagaugcacgccaucaacggcaaacucuacgcgaaucugcgggggcugaccauguaucaaggagagagaguggcuugguacaugcucgccaugggccaggacgucgaucugcauacaauucacuuucacgccgaauccuuccuuuaccgcaacggcgagaauuauagagcugacguuguggaucuguuucccgggaccuucgagguggucgaaaugguggccagcaacccuggaaccuggcucaugcauugucacguuacagaccaugugcacgcuggcauggagacgcuguuuaccgucuucucccggacagaacaccugucuccgcuuaccgugaucacaaaggagaccgagaaaguucccccucgcgauauugaagaggggaaugugaagaugcucggaaugcagauccccauuaagaacgucgaaaugcuggccagcgugcugguugcgaucuccgugacgcuccugcuugucgugcuggcccucggcgggguggucugguaccagcauagacaacggaaacugcgcagaaaucggcgcucuauccuggacgacagcuuuaaacuucuguccuucaaacaguga

SEQ ID NO: 70224 - RNA, 267 nt, Artificial Sequence
  derived and/or modified sequence opt5 from HEPN1__Homo_sapiens__NP_001032647
augggcaacugggggcugggaaucgcccccuggguggacggcgagagcgaacucgaguucagacggcuggggaugcagggaccucuugaagcucugcgcagacgggaguggaauacccaacgcgccuccuuuucuuucagcuuucucauugcgcuguccccgcacacagucgauuacugccauucuuaugaacuuuucaacagacgguggcacggccauguucuggcuacgcagcgccccagccucuuuauccugaugcugguguga

SEQ ID NO: 70225 - RNA, 14586 nt, Artificial Sequence
  derived and/or modified sequence opt5 from HERC1__Homo_sapiens__NP_003913
auggcgaccaugauucccccugugaagcugaaauggcucgagcaccugaacagcuccuggauuaccgaagacucugagagcaucgcuacgcgggaaggcgucgccguucuuuacuccaagcuggugucuaauaaagagguggucccgcucccccaacaggugcugugccuuaaggggccucagcugcccgauuucgaacgggagagccucuccucugacgagcaggaucauuaucuggacgcgcugcucagcucccagcuggcucuugccaaaaugguuuguagcgauucuccuuuugccggcgcucugcgcaagagacuccuggugcuucagcgggucuucuacgcccuguccaacaaguaucacgacaaaggcaaggugaaacagcagcagcauagccccgaaucuuccagcgggucugcugauguucacuccgugagcgagcgcccuagauccucuaccgacgcccucaucgaaaugggaguccggacaggccugagccugcucuuugcgcugcuucgccaguccuggaugaugccggugagcgggcccggacugucucucugcaaugaugugauccauaccgccauugaggucguuuccagccugccuccccuuucucuggcuaacgagagcaagaucccucccaugggccucgacugucugucccaggugaccaccuuccugaaaggcgugacaaucccgaacucuggggccgauacccucggaagacggcuggcuagcgaacuucugcucggccuggccgcgcagcgcgggucccuuagauaccugcucgaguggauugaaauggcccugggagcuagcgccgucgugcacacgauggagaagggcaagcugcucucuucccaggaagggaugaucagcuuugacugcuucaugaccauucugaugcagaugcggcgcucucuuggauccagcgcugauagaucccaguggcgggagccuacacgcaccucugacggccuguguagccucuaugaggccgcccugugccuguuugaagagguuuguagaauggcuuccgacuacucucggacaugcgcgagccccgauuccauccagaccggcgacgccccuauugugagcgaaacgugugaggucuaugugugggggucuaacuccagccaccaacuuguugaaggaacacaggagaaaauccuccagcccaagcuggcucccucuuucuccgaugcccagaccauugaggccggccaauacugcacauuugugaucagcaccgacgggucugucagagcuuguggaaaaggcagcuacgggcgccugggacucggcgauuccaauaaccagagcacccugaagaaacuuacauucgaaccucaucggucuaucaagaaaguguccagcuccaagggcucugacgggcacacgcuggccuuuaccacagagggagaagucuucagcuggggcgauggggacuauggaaagcucggccaugggaauagcucuacccagaaauacccgaagcugauucagggcccccugcaaggaaaagugguugugugcgucagcgcgggcuauagacacuccgcugccgugacagaggauggggaacuuuacaccuggggagagggcgacuuugggcgccucggacacggcgauucuaacagccggaauaucccuacgcugguuaaggacauuuccaacgugggggaggucagcugcggaucuucccauacaaucgcccugagcaaagacggaagaaccguguggucuuucggcgggggagauaauggcaagcucgggcacggagacaccaaccgcguguauaagcccaaaguuauugaagcucugcagggcauguucauccggaaggucugugccgggucccagagcucucuugcucugacauccaccggccagguguacgccuggggaugcggcgcgugucucgggugcggaagcuccgaggccacagcucugagaccuaaacugaucgaagaacuugccgcuacgcgcauuguggaugucagcaucggcgacucucauugucucgcccugagccacgauaaugagguguaugcgugggggaacaacuccaugggacaaugcggccagggcaauucuaccgggcccauuacaaagccgaaaaagguuagcggacuggacggcaucgccauucagcagaucuccgcugggaccucucauagccucgccuggacagcucugccucgggauagacaaguggucgccuggcaccgccccuacuguguggaccuugaagaguccaccuuuucucaucugcggagcuuccucgaaagauacugcgauaagaucaacuccgagauuccuccccugccuuuucccagcucucgggaacaucacuccuuccugaaacuuugucucaagcugcugagcaaucaucucgcccuggcucuugcgggaggcguugccacgucuauccuggggcgccaggcuggaccgcucagaaaccugcuguuucggcuuauggacuccaccgugccugaugagauucaggaggucgugaucgaaacacugagcguuggcgccaccaugcuccugccgccccugagagagcgcauggaacugcuucacucccugcucccucaaggcccggaccggugggagucucugagcaaagggcagagaaugcagcuggauauuauccuuacaucccugcaggaccacacccauguggccagccuccugggauauucuucccccagcgacgcugccgaucucucuagcgucugcacgggcuacgggaaucuguccgaccaaccuuauggaacacagucuugucaccccgauacccaucuugcggaaauucugaugaagacacuccugcgcaaccugggcuucuacaccgaccaggcuuuuggggagcuugagaaaaauagcgauaaguuccugcucggaaccuccucuagcgaaaacucccagccugcccaucugcacgagcuccugugcagccuucaaaagcagcugcuggccuuuugccacaucaauaacaucucugaaaauuccagcuccguggcucuccugcacaaacaccuucagcugcuccugccccacgccacagacauuuauucuagaagcgcgaaccuccugaaggaguccccuuggaauggcucugugggcgaaaaacuucgggaugucaucuacguuagcgcugccggguccaugcugugucagauugugaacagccugcuccugcuucccgugucugucgcccgcccgcugcucuccuaucugcucgaccugcuuccuccccuggauugccugaauagacuccugccugcugccgaccuucuggaggaucaagagcuccaguggccccugcauggaggcccggaacucaucgacccugcugggcugccccuuccucagcccgcccaaagcuggguguggcugguugaucuggagcggacgauugcgcuccugaucggacgcugucuuggcgggaugcugcagggaucucccguguccccugaagaacaggacaccgccuacuggaugaagacaccccucuucagcgacggcgucgagauggauacaccccagcuggacaaaugcaugucuugucugcucgaaguggcucuuagcggcaacgaggaacaaaagccuuuugauuacaaacugagacccgagaucgccguuuauguggaccuggcucucgggugcuccaaggaaccugcccggucucuguggauuagcaugcaggauuacgccgucuccaaggacugggauagcgcuacacuuuccaacgagucucugcucgacaccgugagccgcuucguucuggcggcccugcucaaacacacgaaucuucugucccaggcuuguggagagucuagauaucagcccggcaagcaucugagcgaaguguaccggugcgucuauaaagugcgcuccagacuccuggccuguaagaaccuugagcugauccaaacacggucuagcuccagagaucgcuggauuagcgaaaaucaggacucugccgauguggacccucaggagcacuccuuuacccggaccaucgacgaagaggcugagauggaagaacaggccgaaagagaucgcgaggaagggcacccggagcccgaggacgaagaggaagaacgggagcaugaagucaugacagcgggaaaaauuuuccaaugcuuccucagcgcuagagagguugcccgcucucgggauagagaccgcaugaacuccggcgccgggagcggagcucgggccgaugacccucccccucagucucagcaggaaagacggguguccaccgaucugcccgagggccaagacguguacacagcggcuuguaauagcgucauccaccgcugcgcccugcucauccuuggcguguccccgguuauugaugaacugcagaagagacgggaggaggggcagcugcaacagccuagcacgucugccagcgaaggaggcgggcucaugacccgcuccgagucucugacagcugaaagcagacuugugcauaccucccccaacuaucggcugaucaagucuagaagcgaguccgaccucucucagcccgaaagcgaugaggagggauacgcccuguccggccgccggaaugucgaccuggaucucgcugccagccacagaaaacgcgggccuaugcacucucagcuugaaucccugagcgacucuugggcgcggcugaagcauuccagagacuggcucugcaacagcuccuacucuuuugagagcgauuucgaccugacaaaaucccuuggagugcacacccugauugaaaauguugugagcuuugucucuggcgaugugggcaacgcccccggguucaaggagccugaagaguccaugagcacgucuccgcaagcuagcaucauugccauggagcagcagcagcuccgcgcugaacugcggcuggaggcccuccaucaaauccuuguccugcuguccggaauggaagagaaaggcucuaucagccucgccggguccagacugucuagcggauuucaguccagcacccuucugacaucugugcgccuccaguuccuggcuggcuguuuugggcugggaaccguuggccacacaggcgggaagggagaguccggcagacuccaucacuaucaggacgggauucgggcggccaagcgcaauauccaaauugaaauccagguggcuguccacaaaauuuaccagcaacuuagcgccacccuggagagagcccugcaggcuaacaagcaucacaucgaagcccagcagcggcuccugcuugugacaguuuucgcgcuguccgugcauuaucaacccgucgaugugucucucgcuauuagcaccggacugcugaaugugcucucccagcuuugcggcacggacacaaugcuggggcagccucugcagcuccugcccaaaaccggaguuucucaacuuagcaccgcccugaaggucgccuccacacgccuccugcagauccuggcuaucaccacgggcacauacgccgauaaacucagcccuaagguggugcagucucuucuggaccugcucuguucccagcugaagaaccuucugagccaaaccggcguccuccacauggcgucuuuuggggagggagaacaggaggauggcgaggaagaggagaagaagguggacuccagcggggagacagagaagaaggauuucagagccgcucugcggaaacagcacgccgcugagcugcaucucggagacuuucuuguuuuccugagacgcguggucucuuccaaggccauucagagcaaaauggcuucucccaaguggaccgaggugcugcucaauaucgccagccaaaagugcuccagcggcauuccgcugguugggaaccuucggacaagacugcucgcgcugcacgugcuggaagccguccucccugcuugugaguccggcguggaagaugaccagauggcccagaucguugagcgccuguuuucucuucugagcgacugcaugugggaaacccccauugcucaagccaaacaugccauccagaucaaggagaaagagcaggaaauuaagcuccagaaacaaggagagcuggaagaggaggaugaaaaccuuccuauccaggagguguccuucgaccccgaaaaggcucaguguugccuggucgagaauggccagauucucacgcacgggucuggaggcaagggguauggacuggcgagcaccggcgugacauccggguguuaccaauggaaauucuauaucgugaaggaaaaccggggcaaugagggaaccugcgucggcguuucuagauggccugugcaugauuuuaaccaccggacaaccagcgacauguggcuguaccgcgccuacuccgggaaucucuaucacaacggagagcagacgcugacacuuagcucuuucacccagggcgauuuuauuacaugugugcuggacauggaagcuagaaccaucuccuucgggaaaaauggagaggaacccaagcucgccuuugaggaugucgacgccgcugaacuguacccgugcgugauguucuauagcucuaacccuggcgagaaaguuaagaucugcgauaugcagaugcgggggacccccagagaccuucugcccggcgauccuauuuguuccccgguggccgcgguccucgccgaggcuacaauccaacugauuagaauccugcaucggacggaccgcuggaccuacugcauuaauaagaaaaugauggaaagacuccacaagaucaaaauuuguaucaaggagagcggacagaaacugaagaagucucgguccgugcagagccgcgaagagaacgaaaugagagaggagaaagaaucuaaggaggaagagaaaggcaagcauacacggcacgggcuugccgaccuguccgagcuccaacugagaacccuuugcaucgaaguuuggcccgugcuggcugucauuggaggcguggaugccgggcuccgcgucggaggccggugugugcacaaacagacaggcagacaugcgacccugcuggggguugugaaggagggaagcacgagcgccaaggugcagugggacgaagcugagaucacaauuuccuuuccuaccuucuggucucccagcgauaccccucucuauaaucuggaacccugcgagccucuuccguuugacgucgcccgcuuccggggccugacagcuuccguucuccuggaucuuaccuaccugacaggggugcacgaggacaugggaaaacagucuacgaagagacaugagaagaagcaccgccaugagagcgaagagaaaggcgauguggaacaaaagcccgaguccgagucugcccucgacaugcggaccgggcugacaagcgaugacgucaaaucccagagcaccacaucuuccaagagcgaaaacgagaucgcuucuuuuucccuggauccuacccuccccagcguggaaucccagcaccagauuacggagggaaagcgcaaaaaucacgaacauaugucuaagaaccacgacguugcccaaagcgagauccgcgcggugcagcuguccuaucuuuaccugggcgccaugaaaucucucagcgcucugcuuggcuguuccaaguacgccgagcugcuccugaucccuaaaguccuggcugaaaaugggcauaacagcgauugcgccucuucccccgugguccacgaggacguggaaaugcgggccgcgcuccaguuccugaugagacauaugguuaagcgcgcugugaugcggagcccgauuaagagagcccuuggacuggcugaccucgagcgcgcccaggccaugaucuauaaacuggucgugcacggccuucuggaggaucaauucgggggaaagauuaaacaggaaaucgaccagcaagcugaggaaucugauccugcccagcaggcgcagacccccguuacaaccagccccuccgccucuagcacaaccuccuuuauguccucuucccucgaggacacaacgaccgcuacaaccccugugaccgauacagaaacgguccccgccagcgaguccccuggcgugaugccgcugucucugcucagacaaauguucagcuccuaccccaccacaaccgugcugccuacacggcgcgcucagacacccccuauuucuagccuucccacguccccgucugacgagguugggagacggcagagccugacauccccugauagccagucugccagacccgcgaaccggaccgcccucuccgacccuagcucucgccuguccaccucucccccucccccggcuaucgccgucccucuucuggaaaugggauuuucccucagacaaaucgcuaaggccauggaggcuacaggcgcccggggcgaagcggaugcccagaauauuaccgugcuggcuauguggaugaucgagcaccccgggcaugaagacgaggaggaaccccagagcggauccacagccgauagccgcccuggcgcugccgugcugggguccggaggcaaaucuaacgacccguguuaucuucagagccccggggacauuccuuccgccgaugcggcugagauggaagagggauucucugaaagccccgacaaucuggaucacaccgagaacgccgccuccggcucuggcccuagcgcuagagggcgguccgccgucacgcgcagacauaaguuugaccucgcugcccggacacugcucgcgcgcgccgcuggacuguacagaagcguucaagcccaccggaaucagucucgcagagagggcaucucccuucagcaggaucccggggcucuguaugacuucaaccuggaugaagaacucgaaauugaccuggaugacgaggccauggaggcgauguuuggacaagaucuuaccagcgacaaugauauccugggcauguggauuccugaagugcucgacuggcccacauggcacgugugcgagucugaagaccgggaggaagucgugguuugugagcugugcgagugcuccguggucagcuucaaccagcauaugaagcgcaaucacccgggguguggaagaucugccaaccggcagggcuacagauccaauggcagcuauguggaugggugguuuggaggcgaaugcgggucuggaaacccuuacuaccuccuguguggaaccugccgcgagaaauaucuggcuaugaagacgaaauccaagagcaccuccagcgaacgguacaaagggcaagcccccgaccuuaucggaaagcaggauucuguuuaugaggaagacugggauaugcuggacguggaugaggacgagaagcucacaggcgaagaggaguucgagcugcuugcuggcccucuggggcucaaugauagacgcaucguccccgaaccggugcaguuuccugacagcgauccccugggagccuccguggcuauggucaccgccacaaacucuauggaggagacccucaugcagauuggcugucaugggagcguugaaaaauccucuagcggacggaucacacugggcgagcaagcggccgcucuggccaauccccacgacagagugguggcccuucgccgggucaccgcugccgcccaggugcugcucgcuagaacgaugguuaugcgcgcccugucccuucugagcgugucuggguccagcugcucucucgccgcuggacuggaaucccugggccucacagauauucggacccuggucagacuuaugugucuggccgcugccggccgcgcggggcucagcaccucuccuuccgccauggcuagcacauccgagcggucuagaggaggccauagcaaggccaacaaacccaucuccugccuggcuuaccuuagcaccgccguggggugucuggcgucuaaugccccuuccgcugccaagcuccugguucagcugugcacacagaaccucauuagcgcugccacgggagugaaccugaccacagucgacgacucuauccaacggaaauuccuuccgagcuuucugagaggcaucgccgaggaaaauaagcucgugaccucccccaacuucguugugacacaggcucuggucgcgcuucuggccgauaaaggggcuaagcuccgcccuaauuaugacaagucugagguggagaaaaagggcccccuggagcuggccaacgcccucgcugccuguugccugagcucccggcuuagcucucagcacagacagugggcggcucaacagcugguccgcacccucgccgcccacgauagagacaaucagacgacccugcaaacacuugcugauaugggaggcgaccugcggaaaugcuccuucauuaagcucgaagcccaucagaaccgcgugaugaccuguguuuggugcaauaaaaaggggcugcuggcuacaagcggaaacgauggcaccaucagaguguggaaugucacgaagaaacaguacucucuccagcaaacauguguguuuaaccggcuggagggggacgccgaggaaucccuuggaagcccuuccgaucccucuuucagcccuguguccuggucuauuagcggcaaguaucuggcgggggcccucgagaaaaugguuaauaucuggcaagugaacggcggaaagggccuggucgacauucagccgcacuggguguccgcucuugccuggcccgaagaggggccugcuaccgccuggagcggagaaucucccgagcugcuccugguuggccgcauggaugggucccugggacucaucgagguggucgacgugagcacaaugcauagacgggaacuggagcacugcuaccgcaaagacgucucugugaccuguaucgcgugguuuuccgaagauagaccuuucgccguuggcuacuuugacgggaaacuucugcucggcaccaaggagccccuggaaaaaggaggcauugugcuuaucgaugcucacaaggacacacugauuagcaugaaaugggauccgacggggcauauccucaugaccugcgccaaggaggacucugucaaacuguggggauccauuagcggcuguuggugcugucugcacagccucugccauccuuccaucgugaaugggauugcuuggugucggcugcccggaaagggcucuaaacuucagcugcucauggccacagggugccaaagcggccugguuuguguguggcgcaucccccaggauaccacacagaccaacgucacguccgccgagggauggugggaacaggagucuaauugccaagacggcuauagaaaaagcuccggggcuaagugcguguaccagcugcggggacacaucacaccugugcgcaccguugcguucucuagcgauggccucgcccuugucuccgggggacugggcggccugaugaacauuuggucucucagagacgggagcgugcugcagaccguggucaucggauccggcgcuauucagacaaccguguggauccccgaaguugggguggccgccuguagcaaccggucuaaagauguccuugugguuaauugcacagcugagugggccgcggcuaaccaugugcuggccacguguagaaccgcccucaagcaacagggaguccugggccugaauauggcuccuugcaugcgcgccuuucuugagcggcucccgaugaugcugcaggaacaauaugcuuacgagaaaccccacgugguuuguggggaccagcuggugcacuccccuuauaugcagugccucgccagccuggcggucggacuucaucuggaucagcuccuguguaaucccccugugcccccgcaccaucaaaauugccugccugaccccgccucuuggaacccuaaugaaugggcuuggcuugaguguuucuccacaaccauuaaggccgcugaagcccucacaaacggcgcgcaguuucccgagagcuucaccgugccggaccuggagccuguccccgaagaugagcugguuuuucucauggacaauucuaaauggaucaacggcauggaugaacagaucauguccugggccacgagcagacccgaggacuggcaccucgggggcaagugcgauguguaccuuuggggcgcugggcgccauggacagcuggccgaagcuggccggaaugugauggucccugccgccgcucccuccuucagccaagcgcaacaggugauuugugggcagaacugcaccuuuguuauccaagccaauggaacagugcucgcuugcggcgagggcucuuaugggagacugggacagggcaacagcgacgaucugcacguccuuaccgugauuuccgcccuccagggguucguugugacacaacuggucaccucuuguggaagcgacggccacuccauggcccugacagagucuggggaaguguucagcuggggagauggcgacuacggcaagcucgggcauggaaauuccgaucgccagcggagaccucgccagaucgaggcucugcagggcgaagaggucgugcaaaugucuugcggguuuaaacacagcgccguugugaccuccgacggaaaacuuuucacguuuggcaacggggauuacggacggcugggccucggcaacacaagcaauaaaaagcugccggaaagagucaccgcgcuggagggguaucagauuggacagguggcuuguggccuuaaccauacccucgccguuucugccgacggguccauggugugggcuuucggagacggcgauuacgggaaacugggacugggcaauagcacagccaagucuagcccccagaagaucgacguccucugcggcaucgggauuaaaaagguggcuuguggaacgcaauuuagcguggcccugaccaaagauggccacguuuauacauucgggcaggaccggcuuaucggacugccugagggccgcgcgagaaaccacaaucggccccagcagauuccuguccucgccggggugaucauugaagauguggcugucggagccgagcauacccuggcucuggccuccaacggcgacguguacgcguggggcucuaauagcgaagggcaacuuggacucggccacacaaaccauguucgcgagcccacccuggugacagggcugcagggaaagaaugucagacagaucuccgccggccggugccacagcgcugccuggaccgcuccuccggugcccccuagagcccccgggguuucugugccucuccaacugggccuucccgauacggucccgccucaguauggagcgcugcgcgagguguccauucauaccgugcgggccagacuccgccugcuguaccacuuuagcgaccuuauguauucuuccuggcggcuccugaaccugagccccaauaaccaaaauucuacaagccacuacaacgcuggcaccugggggaucguucagggacaacucagaccccugcuugccccucgcgucuacacacugcccauggugagauccaucggcaaaaccauggugcaggggaagaauuauggaccucagauuacggucaagcggaucucuacacgcggcagaaaauguaagccgauuuucguucagaucgcucggcaaguggugaaacucaacgccagcgaucugcgccugcccuccagagccuggaaggucaaacuugugggggaaggcgcugacgaugccggaggcguuuuugacgacaccauuacagagaugugccaggaacucgagaccgggaucguggaucugcugaucccuagccccaacgcgacggcugaagucggauacaaucgggaccgcuuccucuuuaacccuucugccugucuggaugagcaucuuaugcaguucaaguuucugggcauucucauggggguggccaucagaaccaagaaaccccuggaccugcaccuugcuccgcucguuuggaagcagcugugcugugugccucugacacucgaggaucuggaagaggucgaccuucuguaugugcaaacccucaauuccauucugcauaucgaagauagcggaauuacagaggaauccuuccacgagaugaucccccuggacucuuucgugggccagagcgccgaugggaaaauggucccuaucauucccggcggaaacuccaucccucuuaccuuuucuaaucggaaggaguacguugaaagagcgauugaguaucgccuccacgaaauggacagacagguggcugccgugagagagggcaugagcuggaucguccccguuccgcugcugucccuccugacagccaaacagcuugaacaaauggugugcgggaugcccgagauuagcguggagguccugaagaaggugguucgcuaccgggaaguggaugagcagcaucagcucguccaaugguucuggcacacccuggaagaguuuucuaacgaggaaagagugcuguucaugcgcuuuguuuccggacggagcagacuuccugcuaauacggccgacaucucucagcgguuccagaucaugaaaguggaucgccccuaugacucccucccuacaagccagaccugcuuuuuccaacugagacugccgcccuacucuucccagcucgucauggcugagcggcugcgcuacgccauuaacaauuguagaagcaucgacauggauaacuauaugcuuucucggaauguggacaacgcggaaggcagcgauaccgacuacuga

SEQ ID NO: 70226 - RNA, 14505 nt, Artificial Sequence
  derived and/or modified sequence opt5 from HERC2__Homo_sapiens__NP_004658
augcccagcgaauccuucugccuggccgcucaggccagacucgacucuaaguggcugaagaccgauauccaacuugccuuuacacgggacggccugugugggcucuggaacgaaauggugaaggauggagagauuguuuacacgggcaccgaaagcacacagaauggggagcugccuccgagaaaggacgauuccguugaacccucuggaaccaagaaggaggaccuuaacgauaaggagaagaaggacgaagaggaaaccccugcucccaucuauagagccaagagcauucuggauuccuggguguggggcaaacagccugacgugaaugagcucaaggagugccugucugugcuggugaaagaacagcaagcccucgcuguucagagcgccaccacaacccuguccgcccuucggcugaagcagcgccucgugauccuggagagauacuucauugcccuuaaccggacggucuuucaggaaaaugugaagguuaaauggaaaagcucugggaucucccugcccccuguggauaaaaagagcucucgcccggcgggaaaaggcgucgagggccucgccagaguggggucccgggcugcccugagcuucgcuuuugccuuccugcgcagagcguggcggucuggagaagacgccgaucucuguuccgagcugcuucaagagagccuggacgcucuccgcgcccugcccgaggcuucccuuuuugacgagucuaccgugagcuccgucuggcuggaaguuguggagagagccacacgguuccuccgcagcguggucaccggcgaugugcacgggacacccgcuaccaagggacccggcucuaucccucugcaggaccagcaucuggcucucgcgauucugcuugaacuggccguucagagagggacgcucucccaaaugcugagcgcuauccuucugcuccugcagcugugggauucuggagcccaggagacagacaacgagcggagcgcccaaggcaccuccgcuccccuccugccgcuucugcagagauuucagucuauuaucugccgcaaagaugccccucacagcgaaggcgacaugcaucuccuguccgggccccugagcccuaaugagucuuuccuucgguaucucacacugccccaggauaacgaacuggcgauugaccucagacaaaccgcuguggucgugauggcccaccuggaucgccuugccacccccuguaugccuccgcugugcuccagccccacaucucauaagggaucccuccaggagguuaucggcugggggcugauuggauggaaguacuaugcuaaugugaucggcccuauccagugugaagggcuggccaaccuuggagucacgcagauugcuugcgccgagaaacgguuucucauccugagcagaaauggccgcguguacacccaagcguauaacuccgacacacuggcgccucagcucguccagggccuggcuucucggaauauugugaagaucgccgcucacagcgaugggcaccauuaccuugcccuggcggccaccggagagguuuacuccuggggcuguggggacggaggcagacucgggcacggcgacacagugccucuggaagaacccaaagucauuucugcuuucagcggaaagcaggccggcaaacaugugguucacaucgcuugcggguccaccuauagcgccgccaucacggcugaaggagagcuguacacauggggccgcgggaacuauggacggcuuggccacgggucuuccgaggaugaagcgauuccgaugcucguggccggccugaagggacugaaggucaucgacguggcuuguggcagcggggaugcccaaacccucgccgugaccgagaauggacagguuuggucuuggggcgacggggauuacggaaaacugggcagagggggcuccgacggaugcaagacaccuaaacuuauugaaaagcugcaggaucucgacgucgugaaagugcgcugcggcagccaguuuucuaucgcucugaccaaggaugggcaagucuauagcuggggaaagggcgacaaccagcggcuggggcauggaacagaggaacacgugagauaccccaaacuucucgagggccugcaggggaagaaaguuauugauguggccgcgggcuccacgcauugucuggcucucaccgaggacagcgaaguccacucuuggggauccaacgaucaaugccagcauuucgacacacugcgggugaccaagccugagcccgccgcccuuccuggccuggacacaaaacacaucguugggaucgcuuguggacccgcccagagcuucgcgugguccucuugcagcgaaugguccauuggccuccgcgugccguuugucguggauaucuguucuaugaccuucgagcagcuggaccugcuucugagacaaguuagcgaagggauggauggauccgcugacuggccucccccgcaggagaaggagugcguggccgucgccacgcucaaucugcuccggcugcagcuucacgcugccauuucucaucagguggauccugaauuucugggccucggccuggggagcauccugcuuaacucccugaagcaaaccguggucacacucgcuagcucugccggaguucuguccaccgugcagagcgcggcccaggcugugcuccagucuggcugguccguccugcuuccgacagccgaggaaagagcucgcgcccugagcgcccuccugcccugugcugugucugggaaugagguuaacauuuccccuggacggagauucaugaucgaccugcuugugggcagccugauggcggaugggggacucgaauccgcccugcacgcugccauuaccgccgagauccaagacaucgaggcuaaaaaggaagcccagaaagagaaggaaauugaugagcaggaggcgaaugcuagcacguuucaucgcucuagaacaccccucgacaaagaucugaucaacaccggcauuugcgaaagcuccggcaagcaaugucuuccucugguccagcugauccagcagcuccugcggaauauugccucucaaacaguggcccgccuuaaagacguugcuagacggaucagcuccugccuggauuucgagcagcacucucgcgaaagaagcgccucccucgaccugcuccugcgguuucagcgccuucugaucucuaagcuguaucccggggagagcauuggacagaccuccgacaucagcucuccugaacucaugggcguggggucccugcuuaagaaauacaccgcgcugcucuguacacacauuggagauauccugcccgucgcugccagcauugccucuacguccuggagacauuucgcugagguggccuacaucguugagggcgacuuuaccggggugcuccugccggaacuugucgugagcaucgugcugcugcucuccaagaacgcuggacugaugcaagaggccggcgcggucccucuucugggcgggcuccuggaacaccucgaucgguucaaucaucuggcccccggaaaagagcgcgacgaucacgaagaacuugcuuggccuggcauuauggagucuuucuucacagggcagaacugcagaaauaacgaagagguuacccugauccggaaggccgaccuggaaaaucauaacaaagauggaggcuuuuggacagugauugacgggaagguguaugauaucaaggacuuccagacccagagccucacgggaaauuccauucuggcucaauucgccggcgaggaucccgucguggcccuugaagcugcgcugcaguuugaggacacaagagagagcaugcacgccuucugcguuggccaguaccucgaaccggaccaggagaucgugaccaucccugaucuggggucucuguccagcccccucauugacaccgaacgcaaccuuggacugcugcucggccugcacgcuucuuaucuugccaugagcacaccucugucccccgucgagaucgagugugccaaauggcuccaaucuagcaucuuuuccgggggacugcagaccucucagauccauuacagcuauaacgaagagaaggaugaagaccacugcuccagccccggcgggaccccugcuucuaaaucccggcuguguagccauagacgcgcccucggagaucacucccaagcguuccuucaggcuauugccgacaauaacauccaggaucauaaugugaaggacuuucugugccagauugagcgguacuguagacaaugccaccugacgaccccgaucauguuucccccugaacaccccguugaggaggugggccgccuccugcuuuguugccugcucaaacaugaagaucugggccacgucgcccugucucucgugcaugcuggggcccuuggaaucgagcaggucaagcaccggacacugccuaagagcgugguugacguguguagagucguguaucaggcgaaaugcucccugauuaagacccaccaggaacaaggccgcucuuacaaagagguuugugcccccgugaucgaacggcucagauuucuguucaacgagcuucggccugcugucugcaaugaucugagcauuauguccaaguuuaaacuccugagcucucugccgcgcuggagacggaucgcccagaagauuauccgcgagagacggaagaaaagagugcccaagaaaccugaauccacagacgaugaggaaaagaucgggaacgaggaaagcgaccucgaggaggcuugcauucuuccccauucuccuaucaauguggacaaacgccccauugccaucaaguccccgaaagauaaguggcagccucugcugagcaccguuacgggaguccacaaguacaaauggcucaagcagaacgugcaaggccuguauccccagucuccccuucugagcaccauugcugaguucgcccucaaagaggaaccuguggacgucgagaagaugcggaaaugucugcugaagcagcucgagagagcggaagugcgccuugaggggaucgauacaauccugaagcuggccuccaaaaauuuucuccugcccucuguucaauacgcuauguucugcggauggcagcggcuuauuccugaaggcaucgacauuggcgagccgcugaccgauugucucaaggacguggaucugauucccccuuuuaacagaaugcugcucgaagucacauucgggaaacuuuaugccugggcugugcagaauauucgcaacguucugauggacgccagcgccaaguucaaagagcugggaauccagcccgugccucuccaaaccauuacaaaugagaaccccuccggcccgagccuggggaccaucccucaggcucgguuucuucuggucaugcucuccaugcugacgcugcagcauggagcgaauaaccucgaucuucugcugaacucuggcaugcucgcccugacacagaccgcucuuagacugaucgggcccagcugcgacaauguggaagaggauaugaacgccuccgcccaaggagcuucugccaccguucucgaagagacacgcaaggaaaccgcgccugugcagcugcccgucagcggcccugagcuggccgcuaugaugaagauuggcacgagagugaugagagggguggacuggaaauggggagaucaggacggacccccgccugggcucggacgcgucaucggcgagcuuggggaagacggcuggauuagaguucagugggauacaggauccaccaauucuuaccggaugggcaaggaggggaaauaugaccugaagcuggccgaacuccccgcugccgcgcaacccagcgccgaggauuccgacacagaagaugacagcgaggcugagcagaccgaacgcaacauccacccuacagccaugauguucaccucuacgauuaaucugcuucagacccugugucucuccgcuggagugcaugccgagaucaugcagagcgaagcuacaaaaacccugugcggccugcucagaaugcuuguggagucugggacaaccgauaagacguccagcccgaaccggcuggucuacagagagcaacaccgcucuugguguacacugggauuugugcgguccaucgcccucacaccccagguuugcggcgcgcugagcuccccucaguggauuacacuucugaugaagguggucgaagggcacgcccccuucaccgcuaccagccuccaaagacagauccuggccgugcaucugcuccaggcuguucugccuucuugggacaaaacagagcgcgcccgggauaugaagugucuuguggaaaaacuguuugacuuccucggcagccugcuuacgaccugcuccucugaugucccccugcucagagagagcacacugcggcgcagacgggugcgcccucaggccucccugaccgcgacacacucuagcacccucgcugaagaggucguggcccugcuuagaacgcugcauucccucacacaauggaauggacugauuaacaaguauaucaauucucagcuucggagcauuacccacuccuuuguuggccgcccgagcgagggggcucagcuggaagacuacuuccccgacucugagaacccugaagugggaggccucauggccgugcuggccgucaucgggggaaucgauggcagacugcggcucgggggccagguuaugcacgacgaguuuggagaaggcaccgugacacgcauuacccccaaagggaagaucacagugcaauucuccgauaugagaacgugucgggucugcccucugaaucagcuuaagccccugccggcuguggccuuuaacguuaauaaccucccuuucaccgagcccaugcugagcgugugggcgcagcuugucaaucuggccggaucuaaacucgagaagcauaaaauuaagaaauccacaaagcaggcuuucgccggccaaguggaccuggaucugcucagaugccagcagcugaaacuuuacauccugaaggcugggcgcgcccuccugagccaccaagacaaacuucggcagauucugucccagcccgcgguccaggaaaccggaacagugcauaccgaugacggcgccguugugucuccugaucucggcgacaugagccccgaggggccucaaccgcccaugauccugcugcagcagcuccuggcuuccgccacgcagccuagccccgucaaagcuauuuuugauaagcaagaacuugaggccgcugcccuggcggugugucagugccucgccguugaaucuacccacccuuccagccccggauucgaggacuguucuagcuccgaggcuacaaccccgguggccguccagcauaucagaccugcucgcgugaaacggagaaagcagucucccgugccugcccugcccaucguuguccaacuuauggaaaugggcuuuagccgccggaacauugaguucgcccugaaaucccucacaggggcgucuggaaacgcuagcucccugccuggcguggaagcccuggugggguggcuccuggaucacagcgacauccaggucaccgagcuuucugacgccgauacaguuuccgacgaguauagcgaugaagaggugguggaagacgucgaugacgcugccuacuccaugucuacgggagcugugguuaccgagagccagacauauaagaagagagccgauuuucuguccaaugacgauuacgcgguguauguccgcgaaaacauucaagugggcaugaugguucggugcuguagagccuacgaggaggugugcgaaggcgacgucgggaaagugaucaagcucgaucgcgacggacugcacgaccuuaaugugcagugugauuggcagcagaaaggcgggaccuauuggguccgguacauucauguugagcugaucggauacccucccccuucuagcuccagccacaucaagauuggcgacaaagugagagugaaggcuucugucaccacacccaaguauaaauggggguccgugacgcaucaaagcguuggaguggucaaggccuucucugcuaacggcaaagauaucauuguggacuuuccccagcagucccacuggaccggccuccugagcgaaauggagcugguuccuucuauccacccgggggugacaugcgauggaugucagauguuccccauuaauggcucccgcuuuaagugcagaaacugugacgauuucgacuuuugcgaaaccugcuucaaaacaaagaagcauaauacccggcacacguuugggcgcaucaacgagccuggacaaagcgccgucuucuguggcagaucugggaaacagcucaagcggugccauagcucccagcccggaaugcugcuugauagcugguccagaauggugaaaucucugaauguuagcuccucugugaaccaggcgagccggcucaucgacggcuccgagccuuguuggcaaucuagcggcucccaggggaagcacuggauucgccuggaaaucuuccccgauguccuugugcauagacugaaaaugauugucgacccugccgauagcucuuacaugcccucccucgugguugugagcggaggcaauucucugaacaaucugaucgagcuuaagacaauuaacaucaauccguccgacaccaccgucccucugcucaacgacugcacagaauaucaccgguacauugagaucgcuaucaaacagugucgcagcucugggauugauugcaagauccacggacugauucuccugggcagaauccgggccgaagaggaggaccuugcugccgugcccuuucuggcuuccgauaaugaagaggaagaggacgagaaggggaacagcggaucucugauucgcaaaaaggccgcgggccucgaauccgccgcuaccaucagaacaaaaguguucguuuggggccugaacgauaaggaccagcuugggggacugaaaggcagcaagaucaaggugccuagcuuuuccgagacccucucugcccugaaugucgugcaaguugccgggggaagcaaaucccucuucgcugugacggucgaaggcaagguguaugccuguggggaggcgacaaacggacggcugggccugggcauuucuagcgggaccguccccaucccgcgccagauuacagcucuuuccucuuacgugguuaaaaagguggccguccauagcggaggcagacacgccaccgcucugacgguggaugggaaagucuuuuccuggggagaaggcgacgaugggaagcucggacauuucagccggaugaauugcgacaagccucgccugaucgaggcccuuaaaaccaagcggauucgggauaucgcuuguggaucuucccacagcgccgcgcugacaucuuccggcgagcucuauaccugggggcugggagaauacggccgccucgggcauggagacaacacaacccagcugaaacccaagauggugaaaguccugcuuggccacagagugauccaaguggccugcgggagccgggaugcucagacacuggcccucaccgacgagggccuggucuuuuccuggggagacggcgauuucgggaaacuuggaagaggcgggucugaaggauguaauauuccccagaacaucgagcgccugaauggccagggggucugccaaauugaaugcggcgcucaguuuagccucgcccugacgaaguccggagugguguggacauggggcaaaggggacuacuuccggcugggacacggcucugauguccaugugagaaagccucagguuguggaggggcuccgcggcaagaagaucguccacguggcgguuggcgcccugcauugucuugcugugaccgacagcgggcaggucuaugccuggggcgauaacgaccacggacaacagggcaaugggaccacaaccgugaaccggaaacccacacugguucagggacucgagggccagaagauuacgagaguggcuugcggguccagccacucugucgccuggaccacaguggauguggccaccccuuccguccaugaaccgguucuguuucaaacagcucgcgacccccuuggagcgagcuaccugggcgugccuucugaugccgacagcuccgcugccucuaauaaaaucagcggggccuccaacagcaagcccaaucggccuucucucgcuaagauucugcugucccucgauggcaaccuggccaaacagcaggcgcuuagccacauccugaccgcucuccaaaucauguaugccagagacgccguggucggagcucugaugcccgccgcuaugauugccccuguggaguguccguccuucucuagcgcggcccccuccgacgcuucugccauggcuagcccuaugaauggcgaagagugcaugcuugccguugauaucgaagaccgccugucccccaacccuuggcaggagaagcgggagauugugucuagcgaagaugcggucacgcccuccgccgugaccccgagcgcuccuucugccuccgcuagacccuuuauccccguuacagacgaucucggggccgccagcauuaucgcugagaccaugacaaaaaccaaggaagacguggagucucagaacaaagcggccggaccugagccccaggcucuggaugaguucacgucccugcucaucgccgacgauacacgcgucguggucgaccugcuuaagcugagcguguguucucgggccggcgauagagggcgggacguucucagcgcugugcuguccggaaugggcaccgccuacccucaagucgcggauaugcuucuggagcucugcgugacagaacuggaggacguugcuaccgacagccaguccggcagacugucuagccagccgguggucguggaauccucucaucccuauaccgaugacacaagcacguccgggaccgugaagauuccuggagccgagggccuccgcguugaguucgaucggcaguguucuacagaaagacgccacgacccccugaccgucauggauggggugaauagaaucgugagcguccgguccggacgcgaguggagcgacuggucuuccgaacuucgcauuccuggcgaugagcugaaauggaaguuuaucagcgacgggucugugaacggauggggcuggcgguucacaguuuaccccauuaugccggccgcuggcccuaaagaacuccuguccgaucgcugcgugcuuagcugucccucuauggaccugguuacaugccuccuggauuuuagacugaaucucgccuccaaccggagcaucgugccucgccuggcugccucucuugcggccugugcucaacuguccgcccucgcugccagccauagaaugugggcgcugcagcggcuucgcaagcugcucacgacagaguucgggcaguccaucaauauuaacagacugcugggagagaaugacggcgaaacccgggcccucagcuuuaccgggucugcucuggccgcucuuguuaaaggacugcccgaggcccuccagcgccaauucgaauaugaggauccgaucgugagaggcgggaagcagcugcugcacagccccuuuuucaagguccucguggcccuugcuugcgaccuggaacuggacacacuccccuguugcgcggagacccacaaaugggccugguuucggagauacugcauggcuucccgcguggccguugcccuggauaagcggacaccccuuccuagacuguuccucgacgaggucgcuaaaaagauucgcgaacugauggccgauucugagaacauggacgugcugcaugaaagccacgauaucuuuaaacgggagcaggacgagcagcuugugcaauggaugaauagacgccccgaugacuggacgcucuccgcgggaggcucuggcaccauuuacggguggggacauaaccaccggggccagcucgggggcaucgaaggcgcuaaggucaagguuccuacaccgugugaggcccuggccacccucagacccgugcagcugaucgggggagaacaaacacuuuucgcugugaccgccgauggcaaacuguaugcuacgggcuacggggccggaggccgccucgggauuggaggcaccgagagcgucuccacaccuacccugcuggaaagcauccagcacguguuuauuaagaaaguugcggucaauucugggggaaagcauugccuugcccucuccagcgagggcgaggucuauucuuggggcgaagcugaggacgggaaacugggacacggcaaccggucccccugugauagaccucgggugaucgaaagccugcgcgggauugagguuguggacgucgccgcuggaggcgcccauucugcgugcgugacagccgcuggggaccucuacaccuggggaaagggcagauauggccggcuggggcacuccgauagcgaagaccagcuuaagcccaaacugguggaggcccuccagggacaucgcgucguugauaucgcuuguggcuccggggacgcccaaacacugugccugaccgaugacgauacgguguggucuuggggagacggcgauuacgggaaacuuggaagaggcggcagcgacggguguaaagugccuaugaagauugauucccucacaggacugggcgucguuaaaguggagugcgggagccaguucucuguggcgcugaccaaguccggagccgucuauaccuggggcaaaggggacuaccaccggcucggccacggaagcgaugaccaugugagacgcccgcggcagguucagggccugcaagggaagaaggugaucgcuaucgccacaggaucucuucacugugucugcuguacggaagacggcgagguguacaccuggggagauaaugacgaagggcagcugggcgaugggacaaccaacgcuauucagagaccccgccucguugccgcccugcagggcaaaaaggugaaucgggucgcuugcggaagcgcccauacacuggcgugguccaccucuaaaccugcuagcgccggcaaacuucccgcccaagugccuauggaguauaaccaccuccaggaaauccccauuaucgcucugagaaaccgccugcuccugcuucaucaccuguccgaacuguucugcccguguauuccuauguuugaccuggaggggagccuggaugaaacaggacuuggccccucugucggguucgacacccucagaggaauccugaucucccagggcaaagaggccgcguuucggaaggugguucaagcuacgauggugcgcgauagacagcacgggcccgucguggaacugaaucggauucaggugaagcgcagcagaucuaaaggcggacucgccggcccugacgggaccaaguccguuuucggacagaugugcgccaaaaugagcuccuuuggccccgauucucugcuucugccucaucgggucuggaaggugaaauucgugggggagagcguugacgauuguggaggcggguacuccgagucuaucgcugaaauuugcgaggaacuccaaaacggccugacaccgcugcuuaucgucacccccaauggacgcgacgagagcggcgccaacagagauuguuaucuccuguccccugcugcccgggcgcccgugcacagcucuauguuuagauuccugggggugcuccugggaauugccauccgcacaggcuccccucuuagccugaaucucgcugaacccgucuggaagcagcuggccgggaugucucugaccaucgcugaccuuuccgagguggacaaggauuuuauuccgggacucauguacauccgggacaacgaggccacgagcgaagaguucgaagcgaugucucugccuuuuacaguucccuccgccagcggccaggauauucagcugagcuccaaacauacccacaucacacucgacaauagagcugaguaugugcgccuggccauuaacuaccggcuucacgaguucgaugagcaagucgcugccgugagagagggcauggcccgcguugugccugucccccugcucucucuguuuaccggguaugaacuggagacgauggugugcggaagcccugacaucccccuucaucuccugaaguccguggcuaccuacaaaggcauugaaccgucugccagccugauccagugguucugggagguuauggaauccuucucuaauacagagcggagccucuuucugagauucgucugggggcggacccgccuucccagaacaaucgcggauuuucggggacgcgacuucgugauucaggugcuggauaaguacaacccucccgaccacuuucucccugaguccuauaccuguuucuuucugcugaaacuuccgagauacucuugcaagcagguccucgaagagaagcugaaauaugcuauccauuucuguaagagcauugauacagacgacuacgcccggaucgcccugaccggcgaacccgcugccgaugacuccagcgaugacucugauaaugaggacguggauuccuuugcgagcgacucuacgcaagauuaucucacagggcacuga

SEQ ID NO: 70227 - RNA, 2799 nt, Artificial Sequence
  derived and/or modified sequence opt5 from HERC3__Homo_sapiens__NP_001258531
augaccacagaggacagcguggccguccccagacugauccagaagcucaaccaacagacgauucugcagguuuccugcggcaauuggcacugucuugcucuggccgcggaugggcaguucuuuaccuggggcaaaaacucucauggacaacucgggcugggaaaggaguucccuagccaggcuuccccgcagcgggugcgcucucuugagggcaucccccuggcccagguggccgcugggggagcccacagcuuugcucucucccugucuggcgccgucuucggcugggggaugaauaacgcgggacaacugggccucagcgacgaaaaagauagagaguccccuugccaugugaagcugcuucggacacagaaaguuguguacauuagcuguggggaagaacacaccgccguccugacaaagucuggaggcguguuuaccuucggggcuggauccugcggccagcucggccaugacagcaugaaugaugagguuaacccccgcagagugcuggaacuuauggggucugaggucacacagaucgccuguggacggcaacacacccuggcuuuugugccuuccagcggccucauuuaugccuucgggugcggagcgcgcggccagcuggggacgggacacaccuguaaugugaagugccccucuccugucaaaggcuacugggccgcucauuccggccagcugagcgccagagcugaccgguuuaaguaucacaucguuaaacaaaucuucuccgggggagaucagacauuugugcucuguucuaaguacgaaaacuauagcccggccguggacuuccgcaccaugaaucaggcccauuacacaucccugauuaacgaugagaccaucgcugucuggagacagaaacuuagcgagcacaauaacgcgaauacgauuaacggcgugguucaaauccugucuuccgccgcuugcuggaaugggagcuuucucgaaaagaagauugacgagcacuucaaaacaucucccaagaucccuggaauugaucugaacagcacccgggugcuuuucgaaaaacugaugaacucccagcauucuaugauccucgagcagauccugaauagcuuugaauccugucugauuccccagcucucuagcuccccucccgacgucgaggccaugcgcaucuaucugauucuuccggaguucccucugcuccaagauagcaaguacuacaucacacugaccauuccccuugccauggcuauccugagacucgacaccaacccuucuaaagugcuggacaauugguggucccagguuugccccaaguauuuuaugaaacuggugaaccucuacaagggcgccguccuguaucuucugcgggggcgcaagacauuccucauccccgugcuguuuaauaacuacauuacggcggcucugaaacuucucgaaaagcuguauaaagucaaucugaaggugaaacacguugaguacgauaccuucuauaucccugaaauuagcaaccucguggacauccaggaggauuaccugaugugguuucuucaucaggccggcaugaaggccagaccguccauuauccaagacacagucacccugugcucuuaccccuucaucuuugaugcucaggccaagacaaaaaugcuccagaccgacgcugaacugcagaugcaaguggccguuaauggagcgaaccugcagaauguguucaugcuucucacgcuggagccucugcucgcccggagccccuuucugguccuucacgugagacgcaacaaucuggugggcgaugcucuccgggagcuguccauucauucugacaucgaucugaagaaaccucuuaagguuauuuucgacggggaagaggccgucgaugcuggaggcgugacaaaagaauuuuuccuccugcugcucaaggagcugcuuaaccccaucuaugggauguucaccuacuaucaggacagcaaucugcucugguuuuccgacaccuguuucguggaacacaacugguuucaccugauuggaaucacaugcggccuggccauuuacaacagcaccgucguggaucuucauuucccgcucgcgcuguauaagaaacugcucaauguuaagccugggcuggaggaccuuaaagagcugucucccacagaaggcagaucccuccaagagcugcuggauuacccuggagaagacguggaggagacguuuugucuuaacuucaccaucugccgcgaaagcuauggcgucaucgagcagaagaaacugauucccgggggagauaaugugacaguuuguaaggacaaccggcaggaauuuguggaugccuacgucaauuacguguuccagaucucuguucacgagugguauaccgcuuuuuccagcggcuuccucaaggugugcgggggaaaaguccuggaacucuuucaaccuucugagcugagagccaugauggugggcaacagcaauuacaacugggaggaacuugaggaaacagcuauuuauaagggggacuacuccgccacccaucccacggugaaacuguucugggagaccuuucacgaguucccgcucgaaaagaaaaagaaauuccugcuguuucuuacaggcagcgaucgcaucccuauuuauggaauggccucucugcagaucgucauccaguccaccgcuagcggcgaggaauaccuccccguugcgcacacauguuauaaucugcucgaccugcccaaguacuccucuaaggagauucuuagcgcccggcugacccaggcucucgauaacuacgaaggguucucccuggccuga

SEQ ID NO: 70228 - RNA, 3075 nt, Artificial Sequence
  derived and/or modified sequence opt5 from HERC5__Homo_sapiens__NP_057407
auggagagacggagccgcagaaagucccggcgcaacggcagaucuaccgccgggaaagcugccgcgacacagcccgcuaagagcccuggagcccaacuguggcuguucccguccgccgcuggccugcaccgggcccuucugcgcagaguggaagucacgcggcagcucugcuguucucccgggcgccuggcuguucuugagagaggaggcgccgggguccaggugcaucagcugcucgcgggaagcggcggcgcccggaccccuaaaugcaucaagcuggggaaaaauaugaagauucacuccguggaccaaggagcugaacauaugcugauccucucuagcgauggcaagcccuuugaguacgacaacuauuccaugaaacaccuccgcuucgaaagcauucuucaggagaagaaaaucauucagaucacauguggggauuaccauucucuggcccucuccaagggaggcgagcuguuugcuugggggcagaaucuucacggacaacugggcgugggcagaaaauucccuagcaccacaacaccccagaucguugaacaccucgccggggugccucuggcgcagauuucugccggagaggcucauuccauggcccugagcaugucuggcaacaucuauuccugggggaagaaugaaugcggacagcucggccuggggcacaccgagagcaaggacgauccgucccuuauugagggacuggacaaccaaaaagucgaauuuguggcuuguggcggcucucauagcgcccuccugacccaggaugggcuucuguucacguuuggagccggcaagcacgggcagcucggacacaauuccacccaaaacgagcugcggcccugccugguugcugaacucgugggcuaccgcgucacacagaucgcgugugggagauggcauacccuggccuaugugagcgaccuuggcaaaguguucucuuuuggauccggcaaggaugggcagcugggaaauggcgggacacgggaccagcucaugccucugcccgucaaaguuagcucuagcgaggaacuuaagcuggagucccacaccucugagaaagaacucauuaugaucgcuggaggcaaccaaagcauucugcuguggaucaagaaggaaaauuccuacgugaaccucaaaagaacgaucccuacacugaaugaagggaccgugaagcgcuggauugccgaugucgagacaaaacgguggcagagcaccaagagagaaauccaggagauuuucucuucccccgccugccuuaccggcagcuuucugcgcaaacggagaacaacggagaugaugccgguguaucucgaccugaacaaggcucgcaauaucuucaaggaacugacccagaaagauuggauuacaaacaugaucaccacaugucuuaaggacaaccuccugaaacggcugccuuuucauucucccccucaagaggcccucgaaaucuucuuccugcuucccgagugccccaugaugcacauuuccaauaacugggaaagccugguugugccuuuugcgaaggucguguguaaaauguccgaccagucuagccucguucuggaggaguacugggcuacccugcaggaauccacguucucuaaacuugugcagauguuuaagacagccgucaucugccaacucgauuacugggacgagagcgccgaagagaauggaaacgugcaggcucugcuggagaugcucaaaaagcugcauagagucaaucaggugaaaugccagcuuccggaauccauuuuccaaguugaugagcugcuccaccgccugaacuuuuucguggaagucugucggagauaucuguggaagaugaccguggacgccagcgagaauguucagugcugugugaucuuuucucacuuccccuuuauuuucaacaaucuuuccaaaaucaagcuccugcauaccgauacacugcucaagaucgaaagcaaaaagcacaaggcuuaccugcgcucugccgcgauugaggaggaacgggaguccgaauuugcccuuagaccuaccuucgaccugacaguccggcgcaaccaucucaucgaggaugugcugaaucagcugagccaauuugaaaacgaggaccuuagaaaggagcucugggugucuuucagcggcgaaauuggguaugaucugggaggcguuaaaaaggaguucuuuuacugccuguucgcugaaaugauccagcccgaguaugggauguuuauguacccugaaggagccuccuguaugugguuccccgucaaaccgaaguuugagaagaaacgguauuucuuuuucggcgugcucugcgggcugagccuuuuuaauuguaacguggcuaaucugccuuucccccucgcccuguuuaagaaacugcuugaccagaugccuucucuggaggaucucaaggaacugucccccgaccucggcaaaaaccugcagacgcuucuggacgaugagggagacaacuucgaagaggucuuuuacauucacuucaaugugcacugggauagaaacgacaccaaucucaucccuaacggcagcuccauuacaguuaaucaaaccaacaagcgcgauuacgugucuaaguauaucaauuacaucuucaacgacagcgucaaagcgguguaugaggaauuucggagaggguucuacaagaugugcgaugaggacauuaucaaacuguuucaucccgaggagcugaaggauguuauugugggaaauacagacuaugauuggaaaaccuucgaaaagaacgcccgcuacgagccgggcuauaauuccucucacccuacgaucgucauguuuuggaaggcuuuccauaaacuuacccuggaggaaaagaaaaaguuucucguguuccugacagggaccgacagacuccagaugaaagaucugaacaauaugaagauuacauuuuguugccccgagagcuggaacgaacgggaccccauccgcgcccuuaccuguuucuccguucuguuucucccuaaguacucuacgauggagacaguggaagaggcucugcaggaggccaucaauaacaacagaggauucggcuga

SEQ ID NO: 70229 - RNA, 2961 nt, Artificial Sequence
  derived and/or modified sequence opt5 from HERC6__Homo_sapiens__NP_001158608
auguacuucugcuggggcgccgacagcagagagcugcagcggcgcagaaccgcugggucccccggagccgaacuccugcaagcggcuucuggcgagcggcacagccuucugcuccugacaaaccaucgcgugcuuuccuguggggauaauucuagaggacagcugggccggcgcggggcccagagaggagaacucccugagccgauccaggcccuggaaacgcugauugucgaccucguuagcugcggcaaggagcacucccuggcugugugucauaaaggccggguguuugccuggggagcugggucugagggccaacuugggaucggagaguucaaggaaauuagcuuuacccccaaaaagaucaugacacugaacgauauuaaaaucauccaggucuccugcggccacuaucauagccucgcccugucuaaggacucccagguguucagcugggggaaaaauucucacggacagcuuggccugggcaaggaauuuccuucccaagcgagcccccagcgcguuagaucucucgaggggauuccucuggcccagguggcugccggaggcgcucacuccuucgcccugagccucugugggaccuccuuuggauggggcucuaacagcgcggggcagcuggcccuuuccggacggaauguccccgugcaaagcaacaagccucugucuguuggcgcucucaaaaaucugggcguggucuacaucuccugcggggaugcccauacagcugugcuuacccaggacggaaagguguucacauuuggcgauaaccgcagcgggcagcugggauauucuccgacccccgagaaaagaggcccucaacucgucgaacggauugacgggcugguuagccagaucgauuguggcuccuaccacacgcuggccuaugugcauaccacaggacagguggucucuuucggccacgggcccagcgacaccuccaagccuacacaccccgaggcccucaccgaaaauuuugauauuagcugccugaucucugcugaggacuucguggauguucaggugaagcauauuuuugcgggaacguacgccaacuucgucacaacccaccaagacacauccagcacccgcgcuccgggcaaaacccuuccugaaaucucuagaaucucccagagcauggccgagaaguggauugccgugaaacggagauccacagagcaugaaauggcuaagucugagauccgcaugauuuucagcucccccgccugucugacggcgucuuuucucaaaaagcgggggaccggagaaacaaccagcaucgacguugaucuggagauggcuagagacacauucaaaaagcugaccaagaaagaauggauuuccagcaugaucacgacaugccuugaggaugaccuccugcgcgcccugccuugucacucuccccaucaggaggcccucuccguguuucugcuucugcccgaaugcccugucaugcacgauagcaagaauuggaaaaaccucguggucccguucgcuaaggccgugugcgagaugucuaaacagucccugcaaguucugaagaaguguugggcuuuucuucaggaaagcucucucaauccccugauccagaugcugaaagccgcgauuaucagccagcuccugcaccaaaccaagaccgagcaggaccauugcaacgugaaagcccuucugggcaugaugaaggaacuccacaaagucaauaaggcuaacugucggcugccugagaacacauucaauauuaacgagcuguccaaucuucucaacuuuuauaucgauagagggcgccagcuguuccgggacaaucaucugaugagcgaaaagaaagccuacaugcucaugcacgagaccauucugcagaagaaagaugaauuucccccuucucccagauucauccuucgcgugcggagaucccgccugguuaaggacgcucuccggcaacugagccaggccgaggcgacagauuuuugcaaagugcuggucguggaguucaucaacgaaauuuguccggaguccggcggagugucuagcgaauuuuuccacugcauguucgaggaaaugacgaagccugaguacggcauguuuauguaucccgagaugggguccuguaugugguucccugccaagcccaaaccugaaaagaaaagauacuuucuuuucggaaugcucugcggccugucucuguuuaaucucaacguugcuaaucugcccuucccgcuugcccuguauaagaaacuccuggaccagaagccuagccuggaggaccuuaaagaacucagcccccggcuggggaagucucugcaagagguccucgaugacgcugccgaugacaucggagaugcccuguguauucgcuuuagcauccauugggaccagaacgauguggaccuuauucccaauggcaucuccauuccuguggaucagaccaacaagagagacuacgucagcaaauauaucgauuacaucuucaaugugucuguuaaggcuguguaugaagaguuucagcggggguucuacagagucugcgagaaagaaauucugcgccacuuuuacccggaggaacucaugacagcgaucauuggcaacaccgacuaugauuggaagcaauucgagcaaaauuccaaauacgaacagggauaucagaagucccaucccacaauccagcuguuuuggaaggccuuccacaaacugacccuugacgagaagaaaaaguuccuguuuuuccucacgggccgggacagacugcaugcucgcgggauucagaaaauggagaucguguuuagauguccugaaaccuucucugagcgggaucaccccacauccauuaccugccacaacauccucagccugccuaaguacucuacaauggaacgcauggaggaggcccuucagguugccaucaacaauaacagaggauuugugucccccaugcugacccagagcuga

SEQ ID NO: 70230 - RNA, 1173 nt, Artificial Sequence
  derived and/or modified sequence opt5 from HERPUD1__Homo_sapiens__NP_001010989
auggagagcgaaaccgagcccgaaccugugacacugcucgucaaguccccgaaccagagacaccgggaccuggagcuuucuggcgaucgcggguggagcguuggacaucugaaagcccaccucuccagaguguaccccgaacggccucgccccgaggaccaaagacugaucuauucuggcaagcugcugcucgaucaucagugccugcgggaccugcucccuaaagagaagcgccacgugcugcaucuugucuguaaugugaaaagccccuccaagaugccugaaauuaacgcuaagguugccgagucuacggaggaaccggcggggagcaauagaggacaguaccccgaggauuccagcucugacggccugcggcagcgcgaagugcucagaaaccuguccagcccugggugggagaauaucucucggcccgaagcugcccaacaggccuuccagggacuuggcccuggcuuuuccggguauacccccuacggauggcugcagcucagcugguuccaacagauuuaugcucgccaguacuauaugcaguaccuggccgcuacagccgcgucuggcgccuuugucccgccucccuccgcucaagagaucccugugguuagcgcccccgcucccgccccuauucacaaccaguucccggcggaaaaucagcccgccaaccaaaaugcugccccucagguggucgugaaccccggggcuaaucagaaccugagaaugaaugcccagggaggcccuaucguggaggaggaugacgaaaucaaccgggauuggcucgacuggaccuacuccgccgcuacauuuucugucuuccugagcauucuuuauuuuuacuccagccugucucgcuuccucaugguuaugggggcgaccguggugauguaucugcaccaugucggaugguuucccuucagaccgcggccugugcaaaauuuucccaacgauggcccucccccugacguugugaaccaggaucccaauaacaaucuucaggagggcacagacccggaaaccgaggacccuaaccaccuuccucccgauagagacguccucgauggggaacagacgucccccagcuucaugucuaccgccuggcugguguuuaaaacauucuucgcuagccugcucccggagggacccccugccaucgccaauuga

SEQ ID NO: 70231 - RNA, 843 nt, Artificial Sequence
  derived and/or modified sequence opt5 from HES1__Homo_sapiens__NP_005515
augcccgccgacaucauggagaagaacagcuccucuccuguggcugccaccccggcgagcgucaauacaacgcccgauaaaccuaagaccgcuuccgaacacagaaaaucuagcaagcccauuauggagaaacggcgcagagcccggaucaacgaaucccugucucagcucaagacacugauucuugacgcccugaagaaagauagcucccgccauagcaagcucgagaaagcugacauccuggaaaugaccguuaagcaccuuagaaaucugcaacgggcccagaugacagcugcccucucuaccgauccuuccgugcugggcaaauaccgcgcgggguucagcgagugcaugaacgaggugacaagauuucugucuaccugugaaggagucaauacggaggugcggacccgccuccugggccaucuugccaacugcaugacacagauuaaugcuaugaccuaucccgggcagccucacccggcccugcaagcucccccucccccucccccgggaccuggcgggccccagcaugccccuuucgcgcccccucccccgcucguucccaucccuggaggcgccgcucccccucccggcggggccccguguaagcugggaucccaggcuggcgaagccgccaagguguuugggggauuccaggucgugccugcucccgacggccaauuugcguuccuuaucccuaacggggccuuugcucacagcggacccguuauuccuguguacacaucuaauuccggcaccagcgucggccccaacgccguguccccgucuagcgggccuucccugacggccgauagcauguggagacccuggcggaauuga

SEQ ID NO: 70232 - RNA, 522 nt, Artificial Sequence
  derived and/or modified sequence opt5 from HES2__Homo_sapiens__XP_011539915
augggccugcccagacgggccggggacgcugccgagcuccgcaagagccugaaaccucuucuggaaaagagacggcgcgcgagaaucaaccagucccucucucaacugaaaggacuuauucugccgcuccugggccgggagaauagcaacugcuccaagcuggaaaaagcugaugugcucgagaugaccguccgcuuccugcaggaacuucccgccucuagcuggccuacagccgcuccccugccuugugacuccuacagagagggguauucugccugcguugcucggcucgcccgcgugcugcccgcguguagagugcuugagccugccgucagcgcucggcugcucgaacaccuguggcgcagagccgcuuccgccacgcuggauggaggccgggcgggggacagcucuggaccguccgcccccgcuccugcccccgcuagcgccccugagcccgccucugcuccggugccuuccccucccagcccucccugcggccccggccucuggcgcccgugguga

SEQ ID NO: 70233 - RNA, 669 nt, Artificial Sequence
  derived and/or modified sequence opt5 from HES6__Homo_sapiens__NP_001136325
auggcucccccugccgccccgggcagagaccggguggggcgcgaggaugaagacggaugggagaccagaggcgaucggaaggcgcgcaaaccccuggucgaaaagaaaagacgggcucgcaucaacgagagccuccaggaacugagacuucugcucgccggggccgaggcuaagcuggagaaugccgaaguucuugagcugacagugcggcgcgugcaaggaguccucagaggccgggcucgcgaaagagagcagcugcaggccgaggcguccgaacgguucgccgcuggguacauucagugcaugcacgaggugcacacguuuguuucuaccugucaagccaucgacgcuacaguggccgcggaacugcucaaccaucugcuugagagcaugccucugcgcgaaggauccucuuuccaggaucuccugggcgacgcccuugcugggcccccuagagcccccggccggagcggauggccugcuggcggggccccgggaucccccauuccuucucccccuggccccggggaugaccugugcagcgaucucgaggaggccccggaagcugagcugucccaggcgccugccgaaggacccgaccuggucccugcugcccucggcagccugaccacagcccagaucgcuagaucuguguggcgccccugguga

SEQ ID NO: 70234 - RNA, 693 nt, Artificial Sequence
  derived and/or modified sequence opt5 from HES7__Homo_sapiens__NP_001159439
auggugaccagagaccgggccgagaaccgcgauggccccaagaugcucaaaccucucgucgaaaagagacggcgcgacagaaucaaucggagccuggaggaacuucgccugcuccugcuugagagaacacgggaucagaaccugcgcaauccgaaacucgaaaaggccgagauucuggaguucgccguuggguaccugagagaacggucccgcguggagcccccugcggcugccgcccccggagugccuagaucucccguccaagacgcugaagcccucgcuagcugcuaucuguccggcuuucgggagugucuucugcgccucgccgcguucgcccacgaugcuucuccugccgcuagagcccagcuguuuagcgcgcuucauggguaccugcggccgaaacccccuagacccaagccuguggacccccgcccgccugcuccccggccuucccucgaucccgccgcccccgcucugggaccugcccugcaccagagaccgcccguucaucagggccacccuucuccccgcugcgccuggagcccuucccucuguagcccccgggcuggggacucuggagcgccggccccucugacgggccuucugcccccucccccucccccgcauagacaagauggcgcuccuaaggcuccccugcccccuccgcccgccuucuggcgcccuuggcccuga

SEQ ID NO: 70235 - RNA, 558 nt, Artificial Sequence
  derived and/or modified sequence opt5 from HESX1__Homo_sapiens__NP_003856
augagccccucccugcaggagggcgcccaacucggggaaaacaagccuucuaccugcagcuucuccaucgagcgcauucugggacuugaccagaaaaaggauugugugccgcugaugaaaccccaccggccuugggcugacacaugcucuagcuccggcaaggaugggaaucucugucugcauguccccaacccucccucuggaaucagcuuuccuuccguuguggaccacccgaugcccgaagagagagccagcaaauacgaaaauuauuucucugcguccgagagacuuagccugaagcgggagcucucuugguaccgcggcagacggccucgcacggcuuuuacccagaaccagauugaagugcuggagaaugucuucagagugaacugcuaucccgggaucgauauucgggaagaccuggcccaaaagcucaaucuggaggaggaucgcauccagaucugguuucagaacagacgggccaaacuuaagcgcucccauagagaaagccaguuccugauggcuaaaaagaauuuuaacacaaaucuccuggaguga

SEQ ID NO: 70236 - RNA, 1590 nt, Artificial Sequence
  derived and/or modified sequence opt5 from HEXA__Homo_sapiens__NP_000511
augaccagcuccagacugugguucucucuccugcuugccgcugccuuugcgggccgggcuacagcccuguggcccuggccucagaacuuccaaacgagcgaccagcgcuacgugcucuauccgaauaacuuucaguuccaguacgaugucuccucugccgcucaacccgggugcagcguucuggacgaggccuuucagagauaucgggaucuucuguucggauccggcucuuggccucgccccuaccucaccgggaagagacacacacuggaaaagaaugugcugguggucagcgugguuaccccuggauguaaccagcuccccacacuggaguccguggaaaauuauacccuuacaaucaacgacgaucagugccugcuccugagcgagaccgucuggggcgcucuuagagggcuggaaacguuuucucaacucguguggaaguccgccgagggaaccuucuuuauuaauaaaacagagaucgaagacuucccucgcuuuccgcauagaggccugcugcucgauaccagccggcacuaccugccccuuucuuccauucuggacacacucgauguuauggcguauaacaagcugaauguguuccauuggcaccuugucgacgauccuagcuuucccuacgagucuuucaccuucccugaacugaugcgcaaaggcuccuacaaccccgugacgcauaucuauacagcccaggacgugaaggaggucauugaguacgcuagacuccgggggauccgcguucuggccgaauuugauaccccgggacacacacugagcuggggcccugggauccccggacuccugaccccuuguuauuccggcucugagcccagcgggaccuucggacccgugaauccuucccuuaacaauacauacgaauuuaugagcacguucuuucuggaggugucuuccgucuucccggacuuuuaucuccaccugggcggcgacgaaguggauuuuaccugcuggaaaagcaaccccgagauucaggacuucaugcggaaaaagggguucggagaggauuuuaaacagcuugaaucuuucuacauccaaacacugcucgacauuguuagcuccuauggcaagggguacguggucuggcaggagguguuugauaauaaaguuaagauccagccugacaccauuauccaaguguggcgggaagauauucccgucaacuacaugaaggagcuggaacuggugacaaaagcuggauuccgcgcccuccugucugcgccuugguaucuuaacagaaucagcuacggccccgacuggaaggauuucuauaucgucgagccgcuggccuuugaggggaccccugaacagaaagcucucgugauuggaggcgaggccuguauguggggcgaauacguugacaauacgaaccuggugccccggcuguggccuagagcuggggccgucgccgagcgccuuugguccaauaagcucacaagcgaucugaccuucgcuuaugaacggcugucucauuuuagaugcgagcuccugcgccggggagugcaggcgcagccccuuaacguuggcuucugugagcaagaauuugagcagaccuga

SEQ ID NO: 70237 - RNA, 1671 nt, Artificial Sequence
  derived and/or modified sequence opt5 from HEXB__Homo_sapiens__NP_000512
auggagcugugcggccucgggcugcccagaccuccgaugcuucuggcccuccugcuugcuacccugcucgccgcgaugcuggcucugcucacacagguggcccuggucguucaaguggccgaagcugcccgggcucccagcguguccgccaagccuggacccgcgcuuuggccucugccccucucugucaaaaugacgccuaaccugcuucaccuggccccggagaauuucuacaucagccauucccccaacucuaccgcuggcccuagcuguacacuccuggaagaggccuuucgcagauaucacggguacauuuucggauuuuauaaguggcaucacgaacccgcugaguuccaggccaaaacccaggugcagcaacugcucguuuccaucacacugcagucugagugcgacgcguuuccuaauauuagcuccgaugaaagcuacacccuucuggugaaggagcccgucgccgugcucaaagcuaaccggguuuggggcgcccugcgcgggcuugaaacauucucucagcugguguaucaggacuccuacggaaccuuuacgaucaaugagagcaccauuaucgauucuccgagauucucccaucggggcauccucauugacacaagccgccacuaucugccugucaagaucauucugaagacccucgaugcuauggccuuuaacaaauucaaugugcugcacuggcauaucguggacgaucaaucuuuucccuaccaguccauuacauucccugagcuuagcaacaagggcuccuacucucugagccacgucuauacccccaaugacguuagaauggugaucgaauacgcccggcuccgcgggauuagagugcugcccgaguuugauacgccuggacauacacuuuccuggggcaaagggcagaaggaccugcucaccccguguuauagccggcagaacaaacuggauucuuucggacccaucaauccuacacugaacaccaccuacuccuuccucacaacguuuuucaaggaaaucagcgaggucuuucccgaccaauucauucaccugggcggggaugaaguggaguuuaagugcugggagucuaauccuaaaauccaggacuucaugcgccagaagggauuuggcaccgacuucaaaaagcuggagagcuuuuauauucaaaaaguucuugauaucauugcuacaaucaacaagggcuccaucguguggcaggaagucuucgacgauaaagcgaagcucgcccccgggaccauuguggaaguuuggaaggacucugcuuacccggaggaacugagcagagugacagccuccggauuuccugucauccugagcgcccccugguaucuugaucucauuucuuacggccaggacuggcggaaauacuauaagguggagccucuggauuucgggggaacccagaaacaaaagcagcuguuuaucggcggggaggcuugucucuggggagaauacgucgacgccacgaaucugacaccccgccuuuggccuagagcguccgcugugggcgagcggcuguggagcucuaaagauguuagagacauggaugacgccuaugaccgccucacccggcacagaugccgcaugguggaacggggcauugccgcucagccccuguacgccggguauuguaaccaugagaacauguga

SEQ ID NO: 70238 - RNA, 1758 nt, Artificial Sequence
  derived and/or modified sequence opt5 from HEXDC__Homo_sapiens__NP_775891
augagcggcuccacccccuuccagaugagacuggugcaccucgaccugaagggggccccuccgaaagucucuuaccuuagcgagaucuuuccccuguuccgggcucucggagccaacggccugcuuauugaauaugaggauauguuuccuuacgaagggccccugcgccuccugagagcgaaguaugcuuacuccccuucugagaucaaagaaauucugcaucucgccggacugaaugagcuugagguuaucccccuggugcaaacauucggccacauggaauuugugcucaagcauacggccuucgcucaccuccgggaggucgggagcuuuccuugcacccuuaacccgcaugaagccgagucccuggcucucgugggagccaugauugaccagguucuggagcugcaccccggcgcgcagcgccuccacaucggcugugaugaaguguauuaccugggggagggagaagccucuagacgguggcuucagcaagagcagaauagcacaggcaaacugugccucucccauaugcgcgcugucgccagcggggugaaggcuagacggccuucuguuacaccccuggugugggacgauaugcuucgcgaccugccugaagaucagcucgccgcguccggagucccccagcugguggagccggugcugugggacuauaccgccgaucucgacguccacggcaagguucugcuuaugcaaaaauacagacgguguggguucccucagcugugggcugccagcgcuuuuaagggagccaccggccccucucaggccgugccucccguggagcaucaccuccgcaaccacguccaguggcugcaaguggcuggcuccgggcccacagauagccuucagggaaucauucugaccggcuggcagagauacgaccauuauucuguucucugcgaacugcugccugcgggggugccgucccucgccgcuugucugcaacuucugcuccggggaggcuucgaugaggacgucaaagccaagguggaaaaucugcuggggaucagcucccuugagaaaacggaccccguucgccaggccccuugcucucccccuuguccccuccugccgcugccuuuucccagaccuuggcggcagcuguucagcgcuggacuguccgccggcagaggccccgcgccuagccuugcugccaccucucugccccucucccacaagagcgccucuauuugcgcugcccuguggaugcgcuguuggcgggcuacagggaugagccuggccggauccgcgccgaccacagccucuggcagcuccagcaccagaucuugguuuuccacgagcucuccucagcgcuccgcuagcuggcauuccggggcccccucuugccggagcuggagacuucccuguuccuggcucucuacacgcaugccuuggcggagcggauggagaaagaccugcacaccggcuugcuccggcuguaaacugugcugucgcaccagcgcccggugccugcccccuagaugucaucccccugcgcucgccgggacccugcuucgcacacccgaaggccgggcucacgccagaggacugcuccuggaggcuggcggggcccugcacugccaaauggccugggcuauccgggcgcacgugggagucgugccuucuggccccgccgucuccuguccgcauagcgugccugaggggcccggacagccucuuggcgaacgccucgagaacacggaagggucuuccaccggcagacccgcucuguga

SEQ ID NO: 70239 - RNA, 1080 nt, Artificial Sequence
  derived and/or modified sequence opt5 from HEXIM1__Homo_sapiens__NP_006451
auggccgagcccuuccugagcgaauaccagcaccaaccucagaccuccaacugcacaggcgcugccgcggugcaggaggaacucaauccggagagacccccuggggcugaagaacggguccccgaggaagacucucgcuggcagagcagagccuuuccucaacugggaggccggcccgggccugagggagaaggcucccuugagucucagccgcccccucugcagacgcaggccugucccgagagcuccugccuccgcgaaggggagaagggacaaaacggcgaugacucuagcgcuggcggggauuucccucccccggccgaaguugagccuacccccgaagcugagcugcuugcccagccuugucaugacuccgaggcgagcaaacugggagcccccgcugccggcggggaagaggaauggggacagcagcaaagacagcucggcaagaaaaagcaccggcgcagacccucuaaaaagaagcggcauuggaaaccuuauuacaagcugacaugggaggagaaaaagaaauuugaugagaagcagucccugcgcgcuagcagaauccgggccgagauguucgcgaaggggcaaccgguggcccccuauaauaccacacaguuucucauggacgaucacgaccaggaggaaccugaucugaaaaccggacuuuacucuaagcgcgcugccgcuaaauccgacgauacaagcgacgaugacuucauggaagagggcggcgaagaggacgggggaucugauggcaugggaggggacggcuccgaguuucugcagagagauuucagcgaaaccuaugagcgguaccauacggaaucccuccaaaacaugucuaagcaggagcugauuaaagaguaucuugaacuggagaagugccucagccgcauggaagacgagaauaacagacugcggcuggaauccaaaagacucgggggagaugacgcccgcgugcgggagcuggagcuugaacuggauagacuccgcgccgagaaucugcagcuucugaccgaaaacgagcuccaccggcagcaagaaagagcuccccugagcaaguuuggcgacuga

SEQ ID NO: 70240 - RNA, 927 nt, Artificial Sequence
  derived and/or modified sequence opt5 from HEY1__Homo_sapiens__NP_001035798
augaagagagcccaccccgaguacagcuccucugacagcgaacuggaugagaccaucgaaguggagaaagaauccgcugacgagaacggcaaucucucuagcgcccugggguccaugucuccuacaacgagcucccagauucuugcgcggaagcgcagacggggaaucauugagaaacgcagacgggaucgcaucaacaauagccugucugaacucagacggcuggucccguccgcuuucgagaagcaaguuauggaacagggcagcgccaaacuugagaaggccgagauucugcagaugaccguggaccaucucaagaugcugcacacagcugggggaaaaggcuauuuugaugcccaugcucuggccauggacuaccgcucucucggguucagagaaugccuggcggagguggcccgguaucuuuccaucaucgaaggacuggaugcuagcgacccccuccgcgucagacuggugucucaccuuaacaauuacgccucccagcgggaggcugccagcggcgcgcaugccggccuggggcacauuccuuggggaaccguuuuuggccaccauccccacaucgcucauccucuccugcugccccaaaacgggcacggaaaugccggcacaaccgcuuccccuacagaaccgcaccaucaggggcgccucggaucugcccaccccgaggccccugcucugagagcgcccccuagcggcucccuuggccccgugcugccggucgugaccagcgccucuaagcucuccccuccccugcuuagcucuguugcuagccuguccgccuucccuuuuucuuucgggagcuuucaucuccugucccccaacgcccugagccccucugcuccuacgcaggccgcgaaucucggaaaaccguaucggcccuggggcaccgagauuggggcuuucuga

SEQ ID NO: 70241 - RNA, 1014 nt, Artificial Sequence
  derived and/or modified sequence opt5 from HEY2__Homo_sapiens__NP_036391
augaagagacccugcgaggaaaccacaagcgaguccgacauggaugaaacgaucgacgugggcucugagaacaauuacagcgggcaguccaccucuagcgucauucggcugaacuccccuacaaccacaucucaaaucauggcccgcaaaaagagacggggaauuaucgaaaaacgcagacgggaucgcauuaauaacagccucuccgagcugagacggcuuguuccgaccgcuuucgagaagcagggcagcgccaaacuggaaaaggcggagauccuccagaugacaguggaccaccugaagaugcuucaggcuaccgggggaaaaggcuauuuugaugcccaugcccuggcuauggacuucaugucuaucggguuucgcgaaugucucacggagguggccagauaccuguccagcgucgagggacuggauucuuccgacccccuccgggugcgccugguuagccaccuuucuaccugcgcuacacaaagagaagccgcggccaugaccuccagcauggcucaucaccaucacccucugcacccccaucacugggccgcugccuuccaucaccucccugcggcccugcuucagcccaauggccugcacgcuuccgagucuacaccuugucggcucagcaccacguccgaagugccgcccgcccauggcagcgcucugcugacagccaccuuugcccacgcugauucugcgcuccgcaugccuuccacagggagcgucgcccccugcgugccuccccugucuaccagccuucugucccucucugcuaccguucaugccgccgcugccgcggcuacagccgccgcucacagcuucccgcuguccuuugccggagcuuucccuaugcuucccccuaacgccgcggccgcuguggccgcugccacggcgauuagcccuccccugucugucuccgccaccagcucuccccagcagacauccagcggcaccaauaacaagccguauagacccugggggacagaggugggagcuuuuuga

SEQ ID NO: 70242 - RNA, 1047 nt, Artificial Sequence
  derived and/or modified sequence opt5 from HFE__Homo_sapiens__NP_000401
augggccccagagcccggccugcucugcuccugcuuaugcugcuccagaccgccgugcugcaagggcgccuucugagaagccacucccuccauuaccuguucaugggagcgucugagcaggaccugggccucagccuguuugaagcucuuggguaugucgaugaccagcuguucguguuuuacgaucacgagucccggcgcguggaaccgagaacacccugggugucuagccggaucuccucucagauguggcuccaacugagccagucccuuaagggaugggaccauauguucacggucgauuuuuggaccauuauggagaaccacaaucauagcaaagaaucucacacacugcagguuauccucggcugcgagaugcaggaggacaacuccaccgaaggguauuggaaguacggauaugauggccaagaccaccuggaguucuguccugauacacuggacuggcgcgccgccgaacccagagcuuggccuaccaaacucgagugggagcggcauaagauucgcgccagacagaaucgggcuuaccuggaacgcgauugccccgcccagcuucagcaacugcucgagcugggcagagggguucuugaccaacaggugccuccgcuggucaaagugacacaccauguuaccagcucugugacgacccuccggugucgcgcgcugaacuauuacccccagaauaucacaaugaaguggcugaaggauaaacagccuauggacgccaaggaauuugagcccaaagacguccucccuaacggagauggcaccuaccagggguggauuacacuggcugugcccccgggagaggaacagagauauaccugccaaguggagcacccuggccuugaccagccccugaucgucaucugggaaccuucccccagcgggacgcucguuauuggagugaucucuggcauugccguguucgucgugauccuguuuauuggcauccuuuucauuauccugcggaagagacaggggucccgcggagcuaugggccacuacguucucgccgagcgggaauga

SEQ ID NO: 70243 - RNA, 4308 nt, Artificial Sequence
  derived and/or modified sequence opt5 from HFM1__Homo_sapiens__XP_011539154
augcuuaagagcaacgacugccucuucucccuggagaaucuguuuuucgaaaaacccgaugagguggaaaaccacccugacaaugagaagucucuggauugguuucucccgcccgccccucugaucagcgaaauucccgacacccaggagcuugaggaggaacuggaaucccauaaacuccugggccaagagaagagaccuaaaaugcugacaucuaaccucaagaucacgaaugaggauaccaacuacauuagccugacacagaaguuccaguuugcuuuccccuccgacaaauaugaacaggaugaccuuaaucuggagggggucggaaacaaugaucucucucacaucgccggcaagcugaccuacgcgagccaaaaauauaagaaccauauugggacagaaaucgcuccugagaaauccguuccggacgauaccaaacuugugaauuuugccgaagacaagggagagagcacaucuguguuccggaaacgccuguuuaagaucuccgauaacauucacggcagcgccuacucuaaugacaacgagcucgacucccauaucgggagcgucaaaauugugcagaccgaaaugaauaagggaaaaucuagaaacuauuccaacagcaagcagaaauuccaguacuccgcuaauguuuuuacggccaacaaugcuuucucugccagcgagaucggcgaaggcauguuuaaggcgcccuccuucagcguggccuuccaaccucacgauauucaggaggucaccgaaaacgggcugggaucucugaaggcugugacagagauccccgccaaauuucgguccauuuucaaggaguuuccuuauuucaauuacauccagagcaaggcuuuugacgaucuccuguacaccgaccgcaacuucguuaucugugcccccacaggcucugggaagaccguggucuuugaacuugcgauuacgagacugcucauggaggugccgcugccuuggcuuaauaucaaaauuguguauauggcccccaucaaggcucugugcagccagcgguucgaugacuggaaggaaaaauuuggaccuauuggccucaacuguaaggagcugacaggggauaccgucauggacgaucuguucgaaauccaacacgcccauaucauuaugacaacccccgagaaaugggacuccaugacccgcaaguggagagauaauucucucguucagcuggugcggcuuuuucugaucgacgaggugcacauugucaaagacgaaaaccgcggacccacacucgaggugguugugagcagaaugaagacgguccaguccgugagccaaacccugaagaauacaucuaccgcuaucccuaugcgguucguugccguguccgccacaauuccgaacgcugaagauaucgcggaguggcuuagcgacggcgagcgccccgccgucugccugaaaauggaugaaucucauagaccugugaagcuccagaaagucgugcugggcuuucccuguuccagcaaucagaccgaguucaaguucgaccugacgcucaacuacaaaaucgcuuccguuauucagauguauucugaucaaaagccuacacugguguuuugcgccacccggaaggggguccagcaggccgcuagcgugcuuguuaaagacgccaaguucaucaugaccguggaacagaaacaacgccugcagaaguacgcguauuccgucagagauucuaaacuccgggacauucugaaggauggagcugccuaccaccacgccggcauggagcugagcgacagaaaagugguggaaggggcuuuuacaguuggagaucuucccguccucuucaccacauccacgcuggccaugggcgugaaucugccggcucaucucguggucaucaagagcaccaugcacuaugccgggggacuguuugaggaguacucugaaacagacauucuucagaugaucggccgcgcgggccggccucaguucgauaccacagccaccgcugugauuaugacgagacuguccacccgcgacaaguacauccaaaugcucgccugucgggacacaguugagagcucucugcauagacaccugaucgaacaucuuaacgcugagauugugcuccacaccaucacagaugucaacauugccguggaauggauccgcuccacccugcuguauauucgggcgcucaaaaaucccagccacuacggguuugccucuggacugaacaaggacggcaucgaggcuaaacuucaggagcugugccucaagaaucugaacgaucugagcucccuugaccucaucaaaauggaugaagggguuaauuucaagccuacggaggccggaagacugauggcuugguauuacauuacauuugaaaccgugaagaaauucuauacaaucagcggcaaggagacccugucugaccucgucacccugauugccggguguaaagaauuucuugauauccagcugcgcauuaacgagaagaaaacacucaauacgcugaacaaggaccccaaucggaucaccaucagauucccuauggagggccgcauuaagacacgggaaaugaaagugaacugccugauccaggcccaacuuggauguauucccauccaggauuuugcucucacccaggacacagcgaagauuuucagacauggcucccggaucacccgcuggcugagcgauuucguugccgcucaagagaaaaaguuugccgugcugcucaauucccugauccuugccaaaugcuucagaugcaagcugugggaaaacucucuccacgucagcaagcagcuggagaaaauugggaucacgcuguccaaugcuauugugaacgccggacuuacaucuuuuaagaaaaucgaggaaaccgacgcgcgggagcuggaacucauucugaauagacauccgccuuucggcacccagaucaaggagacagugauguaccuccccaaauaugaacugaaggucgagcagauuacccgcuacagcgauacaacggcugagauccuuguuaccgugauccugcggaacuuugaacaacuccagacaaaaagaaccgccuccgacucucacuacgugacacugauuaucggggacgccgauaaccaggucguguaucugcacaagauuaccgacagcguucuucugaaggcuggauccugggccaaaaagaucgcggugaaacgcgcucucaagagcgaggaucugucuauuaaucucaucuccagcgaguucgucggccuggacauccagcaaaaacuuacgguguuuuaccuggaacccaagagauucgggaaccagauuaccaugcagcggaagucugaaacacagaucucccauagcaaacacucugauauuuccaccaucgccggcccuaauaagggaacaaccgccagcaaaaagccgggcaaccgcgaguguaaucaucucugcaaauccaagcacacaugugggcaugacugcuguaagauuggaguugcucagaaaagcgagaucaaggaaucuaccaucagcuccuaucugucugaucugagaaaccggaaugccgugagcuccgugcccccugucaaacgccuuaagauucaaaugaacaaaucucagagcguugaccugaaggaguuuggcuucacgcccaagccuucccuccccucuaucagcagauccgaauaccugaauauuagcgagcucccuaucauggaacaaugggaucagcccgagauuuaugggaaagugcggcaggagccgucugaauaccaggacaaggagguccugaacgugaauuuugaacuuggaaacgaggugugggaugacuucgacgaugagaaucuggaagucacauccuucagcaccgacaccgagaaaacaaagaucucuggcuuugggaacacccuguccagcuccacgcgcggcucuaaacucccucugcaagaaagcaaguccaaguuccagagagagaugagcaauucuuuuguuuccagccacgaaaugucugauauuagccuuuccaacucugcuaugcccaaauucagcgccuccucuaugacaaagcugccucagcaggcgggaaacgccgugaucgugcacuuucaagagcggaaaccccagaaucucagcccggagaucgaaaagcagugcuucaccuuuuccgagaaaaacccuaauagcucuaacuauaagaaagucgacuucuuuauucgcaauuccgaauguaagaaggagguggauuucagcauguaccaucccgacgaugaagcugacgagaugaaaucccugcucggcaucuuugaugggauuuucuga

SEQ ID NO: 70244 - RNA, 1338 nt, Artificial Sequence
  derived and/or modified sequence opt5 from HGD__Homo_sapiens__NP_000178
auggccgagcugaaguacaucagcggcuucgggaacgaaugcuccucugaggaccccagauguccuggaagccucccggaaggccagaauaacccccaagugugcccuuauaaucuguacgcugagcagcuuuccgggucugccuuuaccuguccccggagcacaaacaaacgcuccuggcuguaucggauucucccuucugucagccacaagcccuucgaauccaucgaugagggacagguuacgcauaauugggacgagguggauccugacccgaaccagcugagauggaaacccuuugaaauuccuaaggcgagccagaaaaagguggauuucgucucuggccuucacacccugugcggggcuggagacaucaaguccaauaacggccucgccauucauaucuuucuguguaauacaagcauggagaaccgcugcuucuacaauucugauggcgacuuucugaucgugccccagaaagggaaccuccugauuuauaccgaguucggaaagaugcuuguucagccuaaugaaaucugugugauucagagaggcaugcgguuuuccaucgaugucuucgaggaaacacgcggguacauucuggagguguauggaguucacuuugaacuccccgaccugggcccgaucggggccaacggacuugcuaauccuagagauuuccugauucccaucgccugguacgaggaccggcaagugccuggcggcuacaccgucaucaacaaauaucaggggaagcucuuugcugccaaacaggaugugagccccuucaacguggucgcguggcauggaaauuacacacccuauaaguacaaccugaagaauuucaugguuauuaacucuguggccuuugaccacgcugacccuuccaucuucaccgugcugacggccaaaagcguccgcccgggcguggcuauugccgauuuuguuaucuuucccccuagauggggaguggcggacaagaccuuccggcccccuuauuaccaccgcaauugcauguccgaguucauggggcucauuagaggccauuaugaagccaaacaagggggauuucugcccggcggcgggucucuucacagcacaaugaccccgcauggaccugaugcugacuguuucgagaaggccuccaaagucaagcuggcucccgaacggaucgccgauggcacaauggccuuuauguucgagagcucucucucccuggcugugaccaaaugggggcuuaaggcgagccgcugccuggacgaaaacuaccacaaguguugggagccucucaaaucucacuuuacgcccaauagcagaaacccugccgaacccaauuga

SEQ ID NO: 70245 - RNA, 1968 nt, Artificial Sequence
  derived and/or modified sequence opt5 from HGFAC__Homo_sapiens__NP_001519
augggcagaugggccugggugcccagcccuuggccgcccccugggcugggacccuuccuccugcuucugcuccugcuucugcuccugccucggggcuuucagccccaaccugggggaaaccgcaccgaguccccggaacccaaugcuacagccacgccugcgauccccaccauucuggucacaucuguuaccagcgagaccccugcuacauccgcccccgaagccgagggcccgcagucugggggacucccucccccucccagagcugugcccagcuccucuagcccucaggcccaggcucugacagaagacggccggccgugccgcuuccccuuuagauacggcgggcggaugcuucacgccuguaccuccgagggaagcgcgcaucgcaaguggugcgccacgacccacaacuaugauagagaccgggcuuggggcuacuguguggaggccacaccucccccugggggacccgcugcccuggauccgugcgcgucuggcccuugucucaaugggggauccugcagcaacacccaagacccccagucuuaucauuguuccugcccucgcgccuucacaggcaaagauuguggcaccgaaaagugcuuugacgagacgagauacgaauaucuggaagggggagaucggugggcucgcgucagacagggccacguggagcagugugagugcuucgggggacggacauggugcgagggcacccgccauacagccugucuuagcucucccugccugaaugggggaaccugucaccucaucguugcuaccggcacaacggugugcgccuguccucccggcuuugccgggagacugugcaacauugaaccggacgagcgguguuuccugggaaauggcaccggguacagaggagucgcuuccacaagcgcguccggccucucuugccuggccuggaacagcgaucuucuguaucaagaacuccacguggacuccguuggggcugccgcccugcuuggccugggaccucaugcuuacugucgcaaucccgauaacgacgagcggcccuggugcuacguggucaaagauagcgcccucucuugggaguauuguagacuggaagcgugcgagucccugacccgcgugcagcucagcccugaccugcuugcuacacugccggaacccgccucuccuggccggcaggccugcgggagacgccacaagaaacggaccuuucucagaccccgcaucauuggaggcagcuccucucugccugggagccaucccuggcuugcugccaucuacaucggagacuccuucugugcuggcagccuggugcacacgugcugggucguuucugccgcgcacuguuuuucccauagcccuccccgggauucuguguccgugguccucgggcagcacuucuuuaauagaacaaccgacgugacccaaacauucggcauugagaaguauaucccguacacccuguauagcguuuucaacccuuccgaucaugaccuggugcucauucgccugaagaaaaagggagaucggugcgccacaagaucucaguuuguccagcccaucugucuuccugaacccggcagcacguucccggcugggcacaaaugccaaauugccggauggggccaucuggacgagaauguguccggguacucuagcucccuccgggaggcucugguuccucugguggccgaucacaaguguagcucucccgaagucuauggagcggacaucuccccuaacaugcuuugcgccggcuacuuugauuguaaaagcgacgcuugccagggggauucuggcggaccccucgccugugagaagaauggcguggcuuaccuguaugggauuaucuccuggggagacggcugcgggcgccugcacaagcccggagucuacaccagaguggccaacuauguugacuggaucaacgaucggauuagaccuccgcgccggcucguggcccccagcuga

SEQ ID NO: 70246 - RNA, 2187 nt, Artificial Sequence
  derived and/or modified sequence opt5 from HGF__Homo_sapiens__NP_000592
augugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuuga

SEQ ID NO: 70247 - RNA, 1173 nt, Artificial Sequence
  derived and/or modified sequence opt5 from HGH1__Homo_sapiens__NP_057542
augggcgaggccggggcuggagccggcgcgagcgggggacccgaagccuccccugaggccgaaguggucaagcugcucccguuccuggcccccggcgcuagagccgaccuucaggcugccgcgguucggcacgugcuggcccucaccgggugcggaccuggccgcgcucugcuugccggccaagcugcccugcuccaggcgcugauggagcuggcccccgcuucugccccugcuagagaugccgcccgggcucucgugaaccuggcggccgaccccgggcuucaugaaacacugcucgcugccgauccuggacugccggcccgccuuaugggcagagcucuggacccccaguggccuugggccgaggaggcggcugccgcccucgcuaaucugagccgggaacccgccccuugugcugcccugauggcggcccucgcugccgcugagcccgccgauuccgggcuggaacgccuugucagagcgcugugcacgccgggauacaacgcccgggcuccucuccacuaucuggcuccccuucugucuaaucucagccagcgcccugcugccagagccuuucugcuggaccccgaucggugugugguucaacgccuccugccccuuacccaguacccugacuccucugugagacggggcggggucgugggaacacugcgcaacugcuguuucgagcauagacaccaugaguggcuccugggcccggaaguugauauccuucccuuucugcuccugccucuggcuggccccgaggacuucagcgaagaggaaauggagcggcucccuguggaucugcaguaucuucccccggacaaacagagagagccugaugcggacauucgcaagaugcuggucgaagccaucaugcuccugaccgcuacagcccccgggcggcaacaggugagagaccagggagccuaccugauucuucgcgagcuccacuccugggaaccugagcccgaugugcggaccgcuugcgaaaaacugauccagguccugauuggcgacgagccugagagagggauggaaaaucuccuggagguucaagugcccgaagauguggagcagcagcuucaacagcuggacugucgcgaacaggagcagcucgagcgggaacuggccccggagccuugggucgaaagagcgacacccaccuga

SEQ ID NO: 70248 - RNA, 2334 nt, Artificial Sequence
  derived and/or modified sequence opt5 from HGS__Homo_sapiens__NP_004703
augggcagagggagcggaaccuucgagcggcugcucgacaaggccacaucccagcugcuucuggaaacggauugggagucuauccuccaaauuugcgaccugauccgccagggcgauacccaggcuaaauacgccgugaacagcauuaagaaaaaggucaaugacaaaaacccccacguugcgcuuuaugcucuggaagugauggaguccguggucaagaauugugggcagacagugcaugaugaaguugccaacaagcaaaccauggaggagcucaaagaccugcugaagagacagguggaagucaaugugcggaacaaaauccucuaccugauucaggccugggcucacgccuuucgcaaugagccuaaguauaaaguugugcaggauacauaccaaaucaugaaggucgaaggacauguguucccggaguuuaaggagucugacgcuauguucgccgcggaaagagcccccgauuggguggacgcugaggaaugccaccggugucgcguccaguuuggcguuaugaccagaaaacaucacugccgggccugugggcagaucuucugcggaaaguguagcuccaaauauucuacaauuccuaaguuuggcaucgagaaagaagugcgcgugugcgagcccuguuacgagcagcuuaacagaaaggcugaaggcaaagccaccagcacgaccgagcugccucccgaauaucucacauccccucugagccaacagucucagcuuccgcccaagcgggaugagaccgcgcugcaagaagaggaggaacuccagcuggcccuggcucucucccagagcgaggccgaagagaaggaacgccugagacagaaaucuacauacaccuccuacccuaaggcugagcccaugccuagcgccucuuccgcucccccggccagcucccuuuauucuagcccugucaauuccagcgcgccccuggccgaggacauugauccugaacucgcucgguaccugaaccgcaauuauugggagaaaaagcaagaagaggccagaaaaucucccacgcccuccgccccugugccgcuuacagagcccgcugcccagccuggggaaggacacgcggcucccaccaacguuguggagaauccucugcccgaaacagacagccagccgaucccucccucuggcgggccuuucagcgagccccaguuucauaacggagaauccgaggagucucacgaacaauuccucaaggcccugcagaaugccgucaccaccuuugugaaccggaugaaaagcaaccauaugagaggccgcuccauuacaaaugacagcgcuguucugucucucuuccaguccaucaacgggaugcacccucagcugcuugagcugcucaaucaacuggaugaacggagacuuuacuaugagggacugcaggacaagcucgcccagauucgcgaugcucggggcgcccugagcgcgcugagagaggaacaccgcgagaagcuccggagagccgcugaagaggccgaacgccagcggcaaauccagcuggcucagaaacuugagaucaugagacaaaagaaacaggaauaccuggaggugcagcgccagcucgccauucaacggcugcaggagcaggaaaaggagagacagaugcggcuggaacaacagaagcagacgguccagaugcgcgcgcaaaugcccgccuuuccgcuuccuuaugcucagcuccaggccaugcccgcugccggcggggugcuguaccaacccucuggaccugccuccuucccgagcaccuucucccccgcuggcucugucgaggggagcccuaugcauggaguguacaugucccagcccgcgccugccgcuggccccuauccuucuaugcccagcacagccgccgacccguccaugguuagcgcuuacauguauccugccggggcgaccggagcucaggccgcuccccaggcccaagccggcccuacagcgucucccgcuuacuccagcuaucagccgaccccuacggccggcuaccagaacguggccucucaggcuccccaaucccugccugccaucagccagccuccccagucuagcacaaugggguauaugggaucccagagcgucucuaugggcuaccaacccuacaauaugcagaaccucaugaccacccugccgucccaggaugcuagccuucccccucagcaacccuauauugccgggcagcagccuauguaccaacagauggcgcccuccggaggcccuccgcagcagcaacccccuguggcccagcagccccaggcucaagggccucccgcccagggcucugaggcucagcugaucagcuuugacuga

SEQ ID NO: 70249 - RNA, 1908 nt, Artificial Sequence
  derived and/or modified sequence opt5 from HGSNAT__Homo_sapiens__NP_689632
augagcggcgccgggagagcucuggccgcgcuccugcuugcugccuccgugcugucugccgcucuccuggcccccggaggcagcuccgggcgggacgcucaggccgcgccuccgcgcgaucuugacaagaaaagacacgccgagcugaagauggaucaagcucuccugcugauccauaacgaacuccuguggaccaaucuuacagucuacuggaaaucugagugcuguuaucacugccuguuccagguucucgugaacgugccccagagcccuaaggccggaaaacccuccgcugccgcggccucugucagcacgcagcauggcuccauucugcaacuuaaugacacccuggaagagaaggaagugugucggcucgaguaccgcuuuggggaguucggaaacuauagccugcugguuaagaauauccacaacggcgugucugaaauugcuugcgaucucgccgucaaugaggacccuguggauuccaaccugcccguuagcaucgcuuuucuuauuggccuggccgugaucaucgucauuucuuuccucagacugcuucugucccucgacgauuuuaauaacuggaucagcaaagccauuucuucccgggaaacagaccgccugaucaauagcgagcugggguccccuucuagaaccgauccgcucgacggagaugugcagcccgcuacauggcggcugagcgcgcuuccuccccgccugagauccguggacaccuuccggggcauugcccucauccugauggucuuuguuaacuacgggggaggcaaguauugguacuucaaacaugcuagcuggaaugggcuuacaguggccgaccugguguuuccuugguucgucuuuauuaugggaucuuccaucuuccucagcaugaccucuauccugcagcgcggcuguagcaaguuuagacugcucggcaaaauugccuggcgguccuuccugcuuaucugcauugggaucauuaucgugaaccccaauuauugucugggaccgcucucuugggauaagguucgcaucccuggcgugcugcagagacugggggucacguacuucgugguugcugugcuugagcuccuguuugccaagcccgucccugaacacugcgcgagcgagcgguccugucugagccucagagacauuaccucuuccuggccccaauggcugcuuauccuggugcucgaaggacuguggcugggccuuacauuccuccugcccgucccugggugcccgaccggauaccugggccccggcgggauuggagauuuuggcaaauauccuaacuguacagggggagcugccggcuacaucgaccgccuccugcuuggggaugaccaccuguaucagcaucccagcucugccgugcucuaccacaccgagguugcuuaugauccugaaggcauucugggaacgaucaacuccaucgugauggccuuccugggcguccaggcugggaagauucuucucuacuauaaagcccggacaaaggacauccugauuagauuuaccgcguggugcugcauccugggacucauuagcguggcccugacaaaaguuuccgagaaugagggcuucauccccgugaacaagaaucuuuggucucugagcuacgucaccacccucuccucuuuugcuuucuuuauucugcuggugcuuuacccggugguugaugucaaagggcucuggacaggaacgccuuucuuuuaucccggcaugaacagcauccugguguacguggggcaugaagucuucgagaauuauuuuccuuuccaguggaagcugaaggacaaccaaucccacaaagaacaccucacccagaauaucguggccacagcucuguggguucuuauugccuacauccuguaucgcaagaaaauuuucuggaagaucuga

SEQ ID NO: 70250 - RNA, 1071 nt, Artificial Sequence
  derived and/or modified sequence opt5 from HHAT__Homo_sapiens__NP_001164035
augcugcccagaugggagcucgcccuguaccuucuggcuagccucggcuuccacuuuuauuccuucuacgaaguguauaaggucucucgggagcaugaagaggaacuggaccaggaguuugagcuugaaaccgauacacuguucgggggacucaaaaaggacgccacggauuuugaguggagcuucuggauggaauggggcaaacaauggcugguuuggcugcuccuggggcacaugguggugucccagauggcgacccuucuggcucgcaagaugcagcagcaagagcaugacucucucaaagccagccugugcguccuugcccugggacucggcagacugcuguguuggugguggcucgcugagcugauggcccaccuuauguacaugcaugcuaucuauuccucuauuccucugcucgaaacagugagcugcuggacccuugggggacuggcccuggcgcagguucucuuuuucuacgugaaguaucugguccuguuuggcgugccggcccuccugaugcggcuugauggccugacacccccugcucucccccgcuguguuuccaccauguucagcuuuacagggauguggagauacuucgacgugggacugcacaacuuucuuauccgguacgucuauauuccugugggcgggucucagcacggacugcucggcacccuguucuccacggccaugaccuucgcuuuugugagcuacuggcaugggggauaugauuaccuguggugcugggccgcgcucaauuggcugggcgucacaguugagaacggcgugcgcagacuuguggaaacccccuguauccaggacucucuggcccgguauuucuccccucaagcucgcagacgguuucacgccgcucucgccagcugcucuacauccaugcugauucugagcaaucuugucuuccucgggggaaacgaggugggcaagaccuacuggaaucgcaucuuuauccagggguggccguggguuacgcuguccgugcugggauuccucuauuguuacucucaugucggcauugccugggcucagacauacgcgaccgauuga

SEQ ID NO: 70251 - RNA, 1515 nt, Artificial Sequence
  derived and/or modified sequence opt5 from HHATL__Homo_sapiens__NP_065758
augggcaucaagaccgcccugcccgcugccgagcucgggcuguacagccuugugcuguccggagcgcucgcuuaugccggcagagggcugcuugaagccucucaggacggagcucaccggaaagccuuccgcgagagcgucagaccuggcugggaauacauugggcggaagauggauguugcugacuuugagugggugaugugguucacauccuuucgcaacgugaucauuuucgcccugucuggacauguccucuuugcgaaacugugcacgaugguggccccgaagcugagaagcuggauguaugcuguuuacggcgcccucgcugugaugggcaccauggggcccugguaucugcuucugcuccugggacacugugucggccuuuacguggccucccugcucgggcaaccuuggcugugccugggacucggccuggcgucucuugccagcuucaaaauggauccccugaucuccuggcagagcggguuuguuacaggaaccuucgaccuccaggaagugcuguuucauggcgggucuuccuucacaguccuucgguguaccagcuuugcucuggagucuugcgcccacccugaucgccauuauucccucgcugaccugcugaaguacaauuucuaccuccccuuuuucuucuuuggcccuauuaugacauucgauagauuucacgcccaggugagccaaguggagccgguccggcgcgaaggagagcuguggcacaucagagcccaggcuggccuuucuguuguggcgaucauggccguggacauuuucuuucauuucuuuuauauccugaccauucccuccgaucucaaguucgcuaaccggcugccugacagcgcccuugccgggcuggcuuacuccaaucucgucuaugauugggugaaagccgcgguucuguuuggaguggucaacacgguggcuugucuggaccaccucgaucccccucagcccccgaagugcaucaccgcccuguacguuuucgccgaaacacauuuugaccgcggcauuaaugacuggcuuuguaaauauguguacaaccacaucgggggagagcacucugcugucauuccugagcuggccgcuaccguggccacauucgcgaucaccacgcucuggcugggccccugcgauaucgucuaucuguggagcuuucuuaauuguuucggccucaacuucgaacuguggaugcagaagcuggccgagugggggccucucgcuagaauugaagccucccugagcgugcaaaugucucggcgcguuagagcucuuuuuggagccaugaauuucugggcgaucauuauguacaaccuggugucccucaauagccugaaauuuacagagcuggucgcccggagacuucuccugaccggcuucccccagacaacccugucuauccucuuugugaccuacugcgggguucagcuggugaaggaacgcgagcggacacuugcucuggaggaggaacagaagcaagacaaagaaaagcccgaguga

SEQ ID NO: 70252 - RNA, 813 nt, Artificial Sequence
  derived and/or modified sequence opt5 from HHEX__Homo_sapiens__NP_002720
augcaguacccccacccuggcccggccgcuggggccgugggagucccccuguaugcgccuacaccccuccugcaaccugcucaucccaccccuuucuacaucgaggacauucuuggcagagggccggccgcccccacgccugcucccacccugccuagccccaacuccucuuuuacaagccucguuuccccguaucggaccccuguguacgaacccacaccuauccaccccgccuucucucaucacagcgcugccgcgcuggccgcugccuauggacccggcggguuuggaggcccucuuuacccguucccccgcaccgugaaugauuauacacaugcucugcucagacacgacccucugggcaagccccugcucugguccccuuuucugcagcggccccuucacaaacgcaaagggggacaggucagauucucuaacgaucagaccauugagcuggaaaagaaguuugagacgcaaaaauaccucagcccgccugaacggaagcgccuggccaagaugcuucagcuguccgagagacaggugaaaaccugguuccagaaucggcgcgcgaaguggagacggcucaaacaagagaacccccagagcaauaagaaagaggaacuggaaucucuggacuccagcugcgaucagcgccaggaccucccuucugagcaaaacaagggcgccucccuggauagcucucaguguucccccagcccugcuucccaggaggaccuugaaucugagaucagcgaagauuccgaccaagagguugauauugaaggggacaagagcuacuuuaaugccggauga

SEQ ID NO: 70253 - RNA, 2103 nt, Artificial Sequence
  derived and/or modified sequence opt5 from HHIP__Homo_sapiens__NP_071920
augcugaagaugcucagcuucaaacugcuucugcucgccguggcucugggauuuuucgagggggacgccaaguuuggagaaagaaacgagggcuccggggcgcggcgcagacggugccuuaauggaaaucccccuaaacgccugaagagacgggaucgcagaaugaugucucagcucgaacugcugagcggcggggagaugcucuguggaggcuucuacccgcggcuguccugcugucuucgcucugacagccccggccuggggagacucgaaaacaaaaucuuuuccgucaccaacaauacagagugcggaaagcugcuugaggaaauuaagugugcucugugcucuccucacagccaaucccucuuccauagccccgagcgggaaguucuggagcgcgaucuggugcucccucugcuuuguaaagacuauugcaaggaguuuuucuacacguguagaggccacauccccggguuucugcagaccacagccgaugaguucugcuuuuauuacgcccggaaagacggaggccucuguuucccugauuuuccgcgcaaacaggugagagggcccgcuucuaacuaucuggaccagauggaagaauacgauaaggucgaggaaauuucccggaagcauaagcacaauugcuucugcauccaagaggugguuagcggacuuagacagccugugggcgcccugcauucuggcgacgggucccagcgccucuucauucuggagaaagaaggauaugucaagauccugacccccgagggcgaaaucuuuaaagagccuuaccucgauauucacaagcuggugcagagcgggaucaaaggaggcgacgaacgggggcuucugucucucgcuuuccaccccaacuacaagaaaaauggaaagcuguauguuuccuacacaaccaaccaagagagaugggccauuggcccgcaugaucacauccuucgcguggucgaguauacagugagccggaagaauccucaucagguggaccugagaaccgcgcgcgucuuucucgaaguugccgagcugcaccggaaacaccugggcgggcagcuccuguucggacccgacggcuuucuuuacauuauccugggggauggaaugauuacgcucgacgauauggaagagauggacggccuguccgauuucaccgggucugugcugagacuugacguggauacagacauguguaacgucccuuauagcaucccccgcuccaauccccauuuuaacagcaccaaucagccuccggaaguguucgcucacggccuccaugaucccggacggugcgccguugacagacacccuacagauaucaacauuaaccugaccauccuguguucugacuccaauggcaagaaccgcagcucugcucggauucuccaaaucauuaaagggaaggacuacgagagcgagcccucccugcuugaauuuaaaccuuucucuaauggaccccuggugggcggguuugucuauagaggaugccagagcgagcggcucuacggcuccuacguguucggggaucgcaacggcaauuuucugacgcugcagcaaagcccgguuacaaagcaguggcaggaaaagccucuuugucucggaaccucuggcuccugcagaggguauuucagcggacauauccugggcuucggggaggacgagcugggagaaguguacauccucucuuccagcaaauccaugacacagacccacaacggcaagcuguauaaaauugucgaucccaagcggccucuuaugcccgaggaauguagagccaccgugcaaccugcgcagacacugacgucugagugcagccgccucugucggaauggguacugcacccccacaggcaaauguugcugcuccccgggaugggaaggcgacuuuuguagaaccgccaagugcgagccugcuugucgccacgggggagucugcgugagacccaacaagugucugugcaaaaagggcuaucuggggccccagugugagcagguugaucggaauauccgcagagugacacgggccggcauucuugaccaaaucauugauaugaccucuuaccuccuggaccugacgagcuauaucgucuga

SEQ ID NO: 70254 - RNA, 2349 nt, Artificial Sequence
  derived and/or modified sequence opt5 from HHIPL1__Homo_sapiens__NP_001120730
auggccagagcucgggccggcgcgcugcucgcucugugggugcuuggggccgccgcucacccccagugccuggacuuccgcccuccguuuagacccacccaaccucuccggcugugugcccaguacagcgauuucggaugcugugacgagggccgcgaugcugaacuuacaagacgguuuugggcccuggcgucccgcgucgacgccgcugagugggccgcuugcgccggguaugcgagagaucuccugugucaggaaugcucucccuacgccgcucaucuguaugacgccgaggauccuuucacgccccuccggaccguuccuggacugugucaggacuacugccuugauauguggcacaagugucgcggccuguuuagacaucucagcacagaccaagaacugugggcucuugaggggaaccuggcccgguucugccgcuaucucucccuggaugacaccgauuacuguuuuccguaucugcucgugaauaaaaaccuuaauucuaaccugggacacguggucgccgacgcuaagggcugccugcagcucugccuggaggaaguggcgaauggccuuagaaaccccguugccauggugcaugcucgggacgggacacaccgcuucuuugucgccgaacaggugggacugguuugggccuaccucccugauagaagccggcugggcaaacccuuccugaauaucuccagagugguccucaccucuccuugggaaggggacgagcgcggauuucugggcauugcuuuccaccccagcuuucagcauaaccggagacuuuacguguauuacuccguggggauccgcagcucugaguggauucggaucuccgaguucagagucagcgaggaugacgaaaaugccguugaucacucuuccgagcgcauuauccuggaagugaaggagccggcgagcaaccauaauggaggccaacuccuguucggcgacgauggguaucuuuacaucuuuacaggagacggcgggauggcuggagauccuuucggcaccuuugggaacgcccagaauaaaucugcccugcucggaaaggugcugcggauugacgucgauagaaaggagcgcggccugcccuauggcaucccucccgacaaccccuucgugggggacccugcugcccagccggaaguuuacgcucucggagugcggaauauguggagauguuccuuugaucgcggcgaccccagcuccgggacgggacggggcagacuguucugcggggaugucggccagaacaaauuugaggaaguggacguuguggagcggggaggcaacuauggguggcgcgccagagaaggauucgaguguuacgaucggucucuuugcgcgaauaccagccugaacgaccuccugccuauuuuugccuacccccacacagucggcaaguccgugaccgggggauaugucuacagaggcugugaguauccuaaucugaacgggcuuuacaucuucggcgauuuuaugagcggacgccucaugucucugcaagaaaaucccggcacagggcaguggcaguauuccgagauuugcaugggacacggccaaaccugugaguucccggggcugaucaacaauuacuauccuuacauuaucagcuuuggagaagacgaagcuggcgagcucuacuucaugucuacgggggagcccagcgccacagcuccucggggcgugguuuauaaaaucauugaugccuccagacgcgcgcccccuggaaagugccagauccagcccgcccaggugaaaauuagaucucggcugaucccguucgucccuaaggaaaaguuuauucccaaaacccgcagcacacccagaccuaccgcucgggccccgacccgcgcucccagacggggccgcccuacagccgcucccccugcccccacgccuagacccgcgcggccgacccaacagccugggucccgcagaggaggcgggcggagacgcggacggcuuaacagcgccucuagagcuuuccgcgacggcgaggugcggcugguuagacccgccgggcucuccagcggcucuggacgcguggaagucuuugugggcgggcgguggggaacagugugugaugacuccuggaauaucagcggcgccgcuguugucugcagacagcugggguucgccuacgcggugcgcgcugugaagcgggccgaguuuggacagggcggcucccugccuauccuucucgaugacgucagaugugccgggugggagcggaaccugcuggaaugccaacauaauggagugggcacccacaacugcgagcaugacgaagaugcugggguuguguguucucaccagaaucccgaccucuga

SEQ ID NO: 70255 - RNA, 1596 nt, Artificial Sequence
  derived and/or modified sequence opt5 from HHLA1__Homo_sapiens__NP_001138567
augcugggcuuccucagcagagggcccuccaugaagcugugcaugggacuugccugugugcugucucucuggaacaccgucagcggcaucaaaggggaggcuaagaaagaaaagggaaugacauuucugccuacgaccguuuccggccuucgggaggaagaacgcaaagaaaaggggguggccuuccuggcgacaaccgagcucccggcuagaucuauugaccugagcgcccugaaucucacagagcuggugaacggaaugcuuucccgggcccugaaggauucuaaaaaguuuuucagccuccuguccgucaccagcuacucuuccuuugcuuuccacaaauuuagcguggccguuuauaauaucucuaaccuuaagacaguggaccccgcuaaauucccuacccgcuacugcuauugucugaauaacagaacgaaugaucucuccgacuuuaccgcccugcuggucgauauuaucggcaacagcacaucuuaccucaccgaaauuuucaaguccacaagcauccuguccgugaaucagucuaacgagagcgacugcaucuuuauuuguguuaugaccggcaaguccgggcggaaucuuagcgauuucugggaaaucgaggagaaauaucccauuaucaacuacacguuuacaucuggacuguccggcgugcucggggcggccacccgcggaacagcuagaaccagcaagccuaccacaaaaucucaaaagacgcugcccagcaccuccccuggccauuggacacagucuaccccgugggccagcgcccuucgguccagccccuggacagaaaccgccgcgccuucugagacggaagagacacugaauaccgggagacccccugaacuccccgcccgcgcuaccgccacaugguucuccgcuagccacacccugccggcccuggccacacggcgcgucgcuagaacgcaguggcucaccgcggaccggcagacaugggccucuauuuccagcgugccuugggcucaaaccaucuccgagaaaaagcccggaggcucucugugggagacacgcagcuccccucccaccacggccggcaccgaagaggccaugaacacaaccucucuucuggcucccgccgcggaaauuauggcuacaccugggagcccgucccaggccagccccacccucggagccuucacgcauggcacacagaccccuucucccacaaaagcuaccgccccuagauauccccagaccggggaucuguccgcugaguggccguuuacagccggagaggagccugugcuugucccccggccucaccaaguuagcagaugcccccagccucuguucaaggugggcgcgauggccgcugcuccccucacgcuggcuauccagcgccugaauccgugucucauggagcugugccaguuuuuccaacagugucuuugcaugucucagcgguccccuagaaccgaagacaugcgcuacugucuggaguacuauagcugguuucucaagaacgccacauacaucugccaacgggugaaaagagucucucauagccacacccugaagcagaaaugccuggaaaacauuuguaaguccguguga

SEQ ID NO: 70256 - RNA, 1194 nt, Artificial Sequence
  derived and/or modified sequence opt5 from HHLA2__Homo_sapiens__NP_001269487
augaaggcccagaccgcucugagcuucuuucucauccugauuacaucccuuucuggcagccaagggaucuucccccuggccuuuuucauuuacgugccuaugaacgagcagaucgucauuggaagacucgacgaagauaucauccugccguccucuuuugagcggggcagcgaaguugugauucacuggaaauaucaggacuccuacaaggugcauucuuauuacaaagggagcgaucaccuugagucccaggacccccgcuaugcgaauagaacgagccuguucuacaacgaaauccaaaauggaaacgcuucucucuuuuuccggcgcgucucccugcuggaugagggcauuuauaccugcuacguggggacagccauccagguuauuaccaauaaggugguccucaaagugggaguuuuucugacaccugugaugaaguacgagaagagaaacaccaauagcuuccuuaucuguucuguccuguccguguauccccggccuauuaucacauggaaaauggacaacacccccaucagcgaaaauaacauggaggaaacgggcucucucgauuccuuuagcauuaauuccccucugaacaucaccggcucuaauagcuccuacgagugcacaauugagaacagccuucugaagcagaccuggacagggcgcuggaccaugaaagacggacuccauaagaugcagucugaacacgugucccugagcugucaaccggucaaugauuauuucucucccaaccaggacuuuaaaguuacguggagcagaaugaaguccggcacauucucugugcuggccuacuaucucagcuccagccagaacaccaucauuaaugagucucgguucuccuggaacaaggaacugaucaaucagagcgauuuuucuaugaaccuuauggaccugaaucucuccgauagcggggaguaccugugcaacaucuccucugacgaauauacacuucugaccauucauaccgugcacgucgagccuagccaagagacagcuucccacaauaaaggacucuggauccuggugcccucugccauucuggcugccuuccuccugaucuggagcguuaaguguugccgcgaaagauguugcgugccucccggcgagcgguguccguccgcgccugacaacggggaagagaaugucccccuuagcggaaaaguguga

SEQ ID NO: 70257 - RNA, 1359 nt, Artificial Sequence
  derived and/or modified sequence opt5 from HIAT1__Homo_sapiens__XP_011540259
augacccagggcaagaaaaagaaaagagccgcuaaccggagcaucaugcuggccaagaaaauuaucauuaaggacgggggaacaccccaaggcaucggguccccuucuguguaccacgcggucauuguuaucuuccucgaguuuuucgcuuggggacugcuuacggccccgacccugguggugcuccaugaaacauuucccaagcacaccuuccugaugaauggccuuauccagggggucaaaggacugcucagcuuucuguccgccccucugauuggcgcucucucugauguguggggccgcaagagcuuccugcuucugacaguuuucuuuaccugcgcccccaucccucucaugaaaauuucccccuggugguauuuugcugugaucucugucagcgggguguucgccguuacauuuuccguggucuucgcguacguggccgacauuacccaggagcaugaaagaagcauggcuuauggacuggugucugccacguuugcugccucccuugucaccagcccugcgaucggcgccuaccuggggcggguuuauggagauucucucguggugguccuggcuacagccauugcucugcucgacaucuguuucauccugguggccguuccggagucccuucccgaaaagaugcgcccugccagcuggggcgcucccauuucuugggagcaggcggauccuuucgccaucaugaaauuuucccccgagagcguggcugccuucauugccguccuggggauccucuccauuaucgcucaaaccaucgugcugucucuucugaugagaagcauuggaaacaagaauacaauccuccugggccugggcuuucagauucuccagcuggccugguacggguucggauccgaaccguggaugaugugggcggcuggcgccguugccgcuaugagcucuaucaccuuuccugccguguccgcucuugucagccggacggccgacgcggaucagcaaggggugguccagggaaugauuacaggcauccgcgggcugugcaacggacucggccccgcccuguauggcuucaucuuuuacauuuuccacguggagcuuaaggaacugccuaucaccgggacagaccucggaaccaauaccucuccccagcaucacuuugagcagaacagcauuauccccggcccuccguuccuguuuggggcuuguuccguucugcucgcccugcuuguggcucuguucauucccgagcacacaaaucucucucugagaagcuccagcuggcggaaacauugcggaucucacucccauccucacaacacgcaagcccccggcgaagcgaaggagccucugcuucaggauaccaaugucuga

SEQ ID NO: 70258 - RNA, 1011 nt, Artificial Sequence
  derived and/or modified sequence opt5 from HIBADH__Homo_sapiens__NP_689953
auggccgcuagccugagacuccugggcgccgcguccgggcuucgguacuggucucgcagacugcggcccgcugccggcagcuucgccgcugugugcucccgcucugucgccagcaagaccccuguuggauuuaucgggcucggaaacaugggcaauccgauggcuaaaaaccugaugaagcacggguauccccuuauuaucuacgacguguucccugaugccuguaaagaguuucaggacgcgggagaacaaguggucuccucucccgccgauguggcugagaaggccgacagaauuaucacaaugcugccuacgagcauuaaugcuaucgaagccuauuccggcgcgaacggcauccucaaaaagguuaagaaagggagccugcugauugauucuuccaccaucgaccccgccgugagcaaggagcucgcuaaagaagucgagaagaugggagccguguucauggaugcuccuguuucuggcggggugggagccgcccgguccggcaaucugacauuuauggucgggggaguggaggacgaguucgcugcggcccaggaacuucugggcugcaugggcagcaacguggucuacuguggggcuguuggaaccggccaggccgccaaaauuugcaauaacaugcuccuggcuaucucuaugauugggacagccgaagcgaugaaucuuggaauccgccugggccucgauccgaagcugcuggcuaagauucucaacauguccagcgggagauguugguccucugacaccuauaaucccgugccuggagugauggauggcguccccagcgccaacaauuaccagggcggguuuggaacaacccugauggccaaagaccuuggccuggcucaagauuccgccacgagcaccaagucuccuauccuccuggggucccuugcucaucagaucuaucggaugaugugcgccaaaggauacagcaagaaagacuucucuagcguguuucaguuccugcgcgaggaggaaacauuuuga

SEQ ID NO: 70259 - RNA, 1161 nt, Artificial Sequence
  derived and/or modified sequence opt5 from HIBCH__Homo_sapiens__NP_055177
augggccagagagagauguggcggcugaugagccgcuucaacgccuuuaagagaaccaauacaauccuccaccaucugcggauguccaaacacacggacgcugccgaagaggugcuucuggaaaagaaagggugcaccggagucauuacacucaaccgccccaaguuccugaaugcgcuuacccugaacaugaucagacaaauuuacccucagcucaaaaagugggagcaggauccggaaacauuucugaucauuaucaagggcgcugggggaaaagccuucugugccggcggggacauccggguuauuucugaggcugagaaggccaaacagaagaucgcucccguguuuuuccgcgaagaguauaugcugaauaacgccgugggaagcugccaaaaaccuuacgucgcgcucauucauggcaucaccaugggcgggggagugggccuguccguucacgggcaguuuagaguggccacagaaaagugucuuuucgcuaugcccgagaccgccauuggacuguuuccugaugucggcgggggauauuuccucccccggcugcagggcaaacuuggcuacuuucuggcucucacgggguuccgccugaagggaagagacguguaucgggccggcaucgcgacccauuuuguugauucugagaagcuggccaugcucgaagaggaccugcuugcucugaaaagcccuuccaaggaaaauauugccucugugcucgagaacuaccacacagaaagcaaaaucgaucgcgacaaguccuucauccuggaggagcacauggauaaaauuaauagcugcuucucugcuaacaccgucgaagagaucauugaaaaucuucagcaagacggguccagcuuugcccuggagcagcucaaggugaucaacaagaugucuccgacaucccugaaaauuacccugagacagcucauggaaggaagcucuaagacgcugcaggaggugcuuacaauggaguaucggcugucccaagccuguaugcgcggccaugauuuccacgaaggggucagagcuguucucaucgacaaagaucagagccccaaguggaaaccugcggaccugaaggaggugaccgaagaggaccuuaauaaccauuuuaagucccugggaucuagcgaucucaaauucuga

SEQ ID NO: 70260 - RNA, 2202 nt, Artificial Sequence
  derived and/or modified sequence opt5 from HIC1__Homo_sapiens__NP_001091672
augaccuuccccgaggccgacauccugcucaagagcggcgaaugcgcugggcagacaaugcuggauacgauggaggccccuggacacuccagacaacuucugcuccagcugaacaaucagcggaccaaaggcuuucuuugugacgugauuaucgucguucagaacgcgcuguuccgcgcucauaagaaugugcucgccgccucuagcgcuuaccugaaaucccuggugguccacgauaaccuccugaaucuugaccaugauauggugucuccggccguuuuuagacuggugcucgacuucauuuauacagggcggcuggcugauggagccgaagcggccgcugccgcugccgucgcgcccggcgccgagccuagccuuggggcugugcuggccgcugccuccuaccuccaaauccccgaccugguugcccugugcaagaaacgccucaagagacacggaaaguauugucaucugcggggcggcgggggaggcgggggaggcuacgcuccuuaugggcgccccggaagaggccuucgggcggccaccccugugauucaggcuugcuacccgucucccgucggcccucccccucccccggccgccgaaccucccagcgggccugaggcugccgugaacacacacugugcggagcuguaugcuuccggacccggccccgccgccgcucucugcgccagcgaacgcagauguucuccucugugcgggcuugaucuguccaaaaagagcccgcccggaucugcugccccugagcggccccucgcggaacgcgagcugccucccagaccggacuccccucccagcgccggcccugcugccuacaaagagcccccucuggcucuccccucucugccgccucuucccuuucagaagcuggaagaggccgcgcccccuuccgauccguucagagggggaagcggcucccccggcccugaacccccugggcgccccgacggaccuucucuccuguacagauggaugaaacacgagcccggccuugggagcuauggagaugaacugggccgggagagaggguccccgagcgagcgcugugaggaacggggcggagacgccgcugugucuccuggcgggcccccucucggacuggcucccccgccuagauaccccggcucccuggacgggccuggagccggcggggauggcgacgauuauaagagcucuagcgaagagaccggauccucugaagaccccagcccucccggcgggcaucucgagggauacccgugcccccaccuggccuauggcgagccugaauccuuuggggauaaucuuuacgucuguauccccugcggaaagggcuucccuagcucugagcagcugaacgcccauguugaagcucacguggaggaagaggaggcgcucuaugggcgcgccgaagcugccgagguggccgcuggcgccgcgggacugggacccccuuuugggggaggcggggacaaagucgcuggagccccgggcgggcugggcgaacuucuccggcccuacagaugcgccuccugugauaagagcuacaaagacccugcuacacugcgccaacacgagaagacccauuggcugacgcggcccuauccuugcaccaucuguggcaaaaaguucacacagagaggcaccaugacacgccacaugcggucucaucucgggcugaaacccuuugccugcgaugcguguggaaugagauucacccgccaguaccggcuuacggagcacaugcggauucauuccggcgaaaagccguaugagugccaggugugugggggaaaguuugcucaacagcggaaucugaucagccacaugaaaaugcacgccguuggcggcgccgcuggggccgcuggagcccucgcgggccuugggggacugccuggcgugcccgggcccgacggaaagggcaaacuggauuucccugaaggcgucuucgccguggcucgccucacagccgagcagcugucccugaagcaacaggacaaagcugccgccgcugaacuccuggcgcagaccacacauuuucuucacgaccccaagguugcccuggagucucucuacccucuggcuaaguucaccgccgagcuggggcuuagcccggauaaagccgcugaagugcucucccagggagcccaucuggcggcuggccccgacgggagaaccauugaucgguuuucuccuacauga

SEQ ID NO: 70261 - RNA, 1848 nt, Artificial Sequence
  derived and/or modified sequence opt5 from HIC2__Homo_sapiens__NP_055909
auggugagcggcccccuggcccucagauggugcgcuugggccgggcggggagacaugggcccugauauggagcugccgucccacucuaagcagcuucugcuccaacugaaccagcagcgcaccaaaggguuccuuugugacgucaucauuaugguugaaaauagcaucuuuagagcgcauaagaacgugcuggcugccuccucuauuuacuucaaaagccucgugcugcacgauaaucugaucaaccucgacacagauauggucuccucuacgguguuucagcaaauucuggacuucaucuauaccggaaaacuucugcccagcgaucagccugccgagcccaauuuuuccacacuccugaccgcugccagcuaccuucagcugccugaacucgcugcccugugccggcgcaagcugaagagagcgggcaagcccuucgggucuggacgggccggcuccacaggcauggggcgcccuccgagaagccagcggcucucuaccgcuuccguuauccaagcccgcuaucagggacugguggacggcagaaaaggggcucaugcgccccaggagcuuccucaggccaagggaagcgaugacgaacuguuucucggcgggucuaaccaagauuccguccagggacugggccgggccgugugucccgcuggcggggaggccggacuuggcgggugcagcuccucuacaaauggaagcuccggcgggugugagcaggaacugggacucgaccugagcaaaaagucuccuccccugccgccugcuacccccggcccucaccucacgcccgaugacgccgcccaacuguccgacagccagcauggcucucccccugcugcgagcgccccgcccguugcuaacuccgccucuuacagcgagcuugggggaaccccugaugaacccauggaccuggagggcgccgaggauaaucaccucucccugcuugaagcuccugggggacagccccgcaaaagccugagacacucuacacggaagaaggaguggggcaaaaaggaaccgguggccggguccccuuucgagcgcagagaagcgggccccaaaggaccuugccccggcgaggagggggaaggagucggcgaccgggugccuaacgggauucucgcuagcggagccggccccucugggccguauggcgagccucccuaccccuguaaggaagaggaagagaauggaaaagaugccuccgaggacagcgcucaguccggcucugaagggggaagcggccaugccuccgcucacuauauguacagacaagagggguacgaaaccgugucuuauggagauaaccuguacgucugcaucccuugugccaagggcuuuccgagcuccgagcagcugaaugcgcauguugaaacacacaccgaggaggaacucuucauuaaagaggaaggggccuaugagacgggcagcggaggcgcugaggaagaggccgaagaccugucugcucccuccgccgcguacacagccgagccucgccccuuuaagugcagcgugugugaaaagaccuauaaagauccugcuacacuucggcagcacgagaagacccauuggcugaccagacccuucccuugcaacaucugcgggaaaauguuuacacagcgcggaacgaugacccggcacaugagaucucaucucggccugaagcccuucgccugugacgagugcgggaugcgcuucacacggcaauacagacugaccgaacacaugcgcgugcauuccggagagaaaccguaugaaugucagcuuugcggcgggaaguuuacacagcagcggaaucucauuagccaccugagaaugcacaccucuccuagcuga

SEQ ID NO: 70262 - RNA, 2367 nt, Artificial Sequence
  derived and/or modified sequence opt5 from HID1__Homo_sapiens__NP_085133
augggcagcaccgacuccaagcugaacuucagaaaagccgugauccagcucacaacgaagacccaacccgucgaggcuacagaugacgccuuuugggaucaguucugggcggacaccgcuacaucuguucaggauguguuugcccuggugccugccgcugaaauucgggccguccgcgaggaaagcccguccaaucuugcuacccugugcuacaaagccguggagaagcucguucagggggcggaaucuggaugucacagcgagaaagagaagcaaaucgugcugaacugcuccagacuucugacacggguccuccccuauauuuucgaagacccugauuggcgcggcuuuuucuggucuaccgugcccggggccggaagaggcgggcagggagaggaagacgaugagcaugcucggccucuggccgagagccugcuccuggcuaucgccgaccuucuguuuugucccgauuucacgguucagucccaccgcagaagcaccguggacucugcggaagauguccauucccucgacagcugcgaguacauuugggaagccggcgugggcuuugcucacucuccucagccgaauuauauccaugacaugaaccggauggagcugcuuaagcugcuccugacauguuucuccgaagccauguaccugcccccugcucccgagagcgggucuaccaauccuugggugcaauuuuucugcuccacagagaaccgccacgcccucccccuguuuaccagccuucugaauacggucugugccuaugauccgguuggauacggcaucccuuauaaccaccuccuguucuccgacuacagagaaccccuuguggaggaagcugcccaggugcugauugucacacucgaucaugacucugcgagcuccgcuagcccuaccguggaugggacaaccaccggaacagccauggacgaugccgacccucccggccccgagaaucuguucguuaacuaccugucucggauccaccgcgaagaggauuuucaguucauucucaaagggaucgcuagacugcuuuccaauccgcugcuccagacguaucugcccaacagcaccaagaaaauucaauuucaucaggagcuucuggugcuguucuggaagcugugcgacuuuaauaaaaaguuccuguuuuucguccucaagucuagcgaugugcuggacauccuuguuccuauucuguuuuuccucaacgacgcccgggcggaucagucccgcgugggacugaugcacaucggcgucuuuauccugcuucuccugucuggcgaaagaaauuucggggugcggcugaacaaacccuacagcauuagagucccuauggacauccccguguuuacaggaacccacgcugaucuccugauuguuguguuccauaagaucauuacauccggccaccaacgccuucagccgcuguucgacugucuccugaccaucgucgugaacguuagcccuuaucugaaaucucuuuccauggugacggccaauaagcuccugcaucugcucgaggccuuuagcacaaccugguuccuguuuucugcugcccagaaccaccaucuugucuucuuucugcucgaaguguucaauaacaucauucaguaccaauuugaugggaauagcaaccugguguaugcuaucauucggaaaagaagcaucuuccaccagcuggccaaucuucccaccgacccucccacaauucacaaggcgcuccagcgccggagacgcaccccugagccccugucccggacaggaucucaggaaggcacgagcauggagggguccagaccggccgcuccugccgagcccggaacccugaaaacaucucucguugcuacccccggcaucgauaagcugacagaaaagagccaagucuccgaggacggcacccuucgcagccuggaaccugagccgcagcagucucucgaggaugggucccccgccaaaggagaaccuagccaggcguggcgggagcaaagacgccccucuacguccagcgccucuggccaguggagcccuacccccgaaugggugcuguccuggaaguccaaacugccucuucagacaaucaugcggcuccuccaggugcuggucccccaaguggagaagauuugcaucgacaaagggcucaccgaugaaucugagauucugagauuucuucagcauggaacacugguuggccuccugccggugccucaccccauccugauucggaaguaccaggcuaacuccgggaccgccaugugguuccgcacguauauguggggcgucaucuaccuuagaaauguggacccucccguuugguacgauacagacgugaagcuguuugagauucaacgggucuga

SEQ ID NO: 70263 - RNA, 2553 nt, Artificial Sequence
  derived and/or modified sequence opt5 from HIF1A__Homo_sapiens__NP_001230013
augagcucccagugcagaucucuggagaacaaguucguguuucucaaagaaggccuggggaauagcaagcccgaggaacuugaggaaauccggauugagaacggacgcaucuccucugagagacggaaagaaaagagccgcgacgccgcuagaucccggcgcucuaaagagagcgaagucuucuacgagcuggcccaccaacucccucugccgcauaauguuuccagccaccuugauaaggcgucugugaugagacugaccauuuccuaucuccgggugcgcaagcugcuggacgcuggcgaucucgacaucgaggaugacaugaaagcccagaugaacuguuuuuaccugaaggcccuugauggguucgucauggugcugacagacgauggagacaugauuuauaucagcgauaauguuaacaaauacaugggccucacgcaguuugaacugaccgggcauucuguguucgacuuuacacaccccugcgaucaugaggaaaugagagagaugcuuacccaccggaauggacuggucaagaaaggcaaggaacagaacacacaacgcuccuucuuucucagaaugaaguguacccugacaagccggggccgcaccaugaauaucaaaucugcuacguggaaggugcugcacugcaccgggcauauucacguuuaugacacaaacuccaaucagccucaguguggauacaaaaagcccccuaugaccugccucgugcugaucugugagcccauuccucauccgagcaacaucgagauuccccuugacuccaaaacauuccugucuagacacagccucgauaugaaguuuuccuauugcgacgaacggaucaccgagcugaugggcuacgaaccugaggaacuucuggggagaagcauuuacgaguauuaccacgcccucgauucugaccaucugacgaaaacacaccaugauauguucaccaagggacaggucacaaccggccaauaucgcaugcuggcuaagagagggggauacguguggguggagacccaggccacagucaucuauaauacgaaaaacucccagccccaguguaucguuugcgugaauuacguggucagcggcauuauccaacacgaccucauuuucucucugcagcagaccgaaugugugcuuaagccuguugagagcuccgauaugaaaaugacacaacuguucaccaagguggaaucugaggacacaagcucccucuucgauaaacugaagaaggaacccgacgcgcuuacccugcucgccccggcugccggcgauacgaucauuagccuggacuuugggucuaacgacacagagaccgaugaccagcagcuggaggaagucccucucuauaacgaugugaugcugcccuccccuaaugagaaacuucagaacaucaaucuggcuaugagcccccuccccaccgccgaaacaccuaagccgcugcggucuuccgcggaccccgcccugaaccaagagguugcucuuaaacucgagccuaaucccgaaagccuggagcuguccuucaccaugccucagauccaggaucagacacccucuccgagcgacggauccacgcgccaaucuagcccugaacccaacuccccuagcgaguacugcuuuuacguggauucugacauggucaaugaauuuaagcucgagcugguggagaaacuuuuugccgaagauaccgaggcuaagaaccccuucuccacacaggacaccgaucuggaccucgaaaugcuggccccuuauauucccauggaugacgacuuucagcugcggagcuucgaucagcuuucuccgcucgaguccagcucugccagcccugaauccgcuagcccccaaucuacagucaccguguuucagcagacgcagauccaagagcccaccgcgaaugccacaaccacaaccgcuacgacagacgagcugaagaccguuacaaaagauagaauggaagacauuaagauccugauugccuccccuagcccgacccauauccacaaagagaccacauccgccacgucuagccccuaccgcgauacccagucccggacagcuucuccuaacagagccggcaagggggugaucgaacagaccgagaaaagccacccccgcuccccuaauguccucucuguggcgcugagccaacggacaaccguucccgaagaggagcuuaacccuaagauucuggcucuccagaaugcccagagaaagcgcaaaauggaacaugacggaucccuguuccaggccgugggcaucgggacgcugcuucaacagcccgaugaccacgcugccacaaccagccucucuuggaagcgggucaaaggaugcaaguccagcgagcagaacggcauggaacagaaaaccauuauccugauuccgucugaucuggcuuguagacuccugggccaauccauggacgagagcgggcuuccucagcugacaucuuaugauugcgaggugaaugcccccauccagggaucccggaaccuccugcagggcgaggaacugcuucgcgcgcucgaccaagugaacuga

SEQ ID NO: 70264 - RNA, 1050 nt, Artificial Sequence
  derived and/or modified sequence opt5 from HIF1AN__Homo_sapiens__NP_060372
auggccgcuaccgccgcggaggcuguggccagcggcuccggggaacccagagaggaagccggagcucugggcccugccugggacgagucucagcuccggagcuacuccuucccgacacgccccaucccuagacugucucaaagcgauccccgggcugaagaacuuauugagaacgaggagccugucguucugacggacaccaaucucguguaucccgcccugaagugggaucuugaauaccugcaggagaacaucgggaauggagacuuuuccguguauucugcgagcacacacaaauuccucuacuaugaugagaagaaaauggccaacuuucagaauuucaagccucgcuccaacagagaagagaugaaauuucaugaauuugucgagaagcugcaggacauucaacagcggggcggggaggaacgccuguaccuccagcagacccugaaugauacagugggaagaaagaucguuauggacuuucuuggcuucaacuggaauuggauuaacaaacaacagggcaagcggggguggggacagcugaccagcaaucuccugcuuaucggcauggaggggaacgugacaccggcucacuaugaugaacagcaaaauuucuucgcccagaucaaaggauacaagcgcugcauucuguuucccccugaccaguucgagugucucuaccccuauccuguccaucaccccugcgauagacaaucucagguggacuuugauaacccggacuacgaacgguucccuaauuuccagaacguugugggcuaugagaccgucguggggcccggagacgugcuguacaucccuauguauugguggcaucacauugaaucccugcucaacggcggcaucacgauuaccgucaauuuuugguacaaaggggcucccacacccaagcgcaucgaguauccucugaaggcccaccagaaaguugcgauuaugagaaacaucgagaagaugcuuggagaagcccugggcaauccgcaagagguggggccccuccugaacaccaugaucaaaggacgguacaauuga

SEQ ID NO: 70265 - RNA, 2004 nt, Artificial Sequence
  derived and/or modified sequence opt5 from HIF3A__Homo_sapiens__NP_690007
auggacuggcaggaucacagaagcaccacagagcugcggaaggaaaaaucccgcgacgccgcuagaucucggcgcagccaagagacggaagugcucuaccagcuggcccauacccuucccuucgcgagaggcgucuccgcucaccuggauaaggccucuaucaugcggcucacaauuagcuaucugcgcaugcauagacuuugcgccgcuggggaguggaaccagguuggagccggcggggaaccucuggacgcuuguuaccucaaagcccuggagggauuugugauggugcugaccgcggagggcgauauggccuaucucuccgaaaaugucucuaagcaccuggggcuuagccagcuggagcucaucggacauuccauuuucgacuuuauccacccgugcgaucaagaggaacugcaggacgcucuuacaccccagcagacccugagccggcgcaaaguggaggccccuacagaaagauguuucucucuccggaugaaguccacccugacgagccgcggcagaacccugaaccucaaggcugccacauggaaaguucugaauugcucuggccacaugcgggcguacaagcccccugcccaaaccucccccgcugggagcccugauucugagccgccccuucagugucuggugcucauuugcgaagccaucccucaucccggaucccuggagccuccccuuggccgcggggcuuuucugagcagacacucccucgacaugaaauucacauauugugaugaccggaucgccgaagucgccggauacucuccggaugaccugauuggcugcagcgcuuaugaguacauccaugcgcuggacuccgaugccgugagcaagucuauucacacccuccuguccaaagggcaggcuguuacgggacaguacagauuucuugcccgcagcggcggcuaucuguggacacaaacccaggccacaguggucucugggggacggggcccucagagcgaguccaucgugugugugcacuuccucauuucucaagucgaagagaccgggguugugcugagccuugaacagaccgagcagcauuccagacgccccauccagcggggagcuccuagccaaaaggacacacccaaccccggcgauucucuggacacgccugggccgcgcauucucgccuuucugcaucccccuucccugagcgaagcggcucucgccgccgaucccagacgguucugcucuccugaccugagacgccuucugggacccauccucgauggcgcuuccguggccgcuaccccgagcacaccucuggccacccggcacccccaguccccucugucugcggaccuucccgaugagcucccugucggcacagagaaugugcacagacuguuuaccagcgggaaggacacggaagccguugagacagaucuggacaucgcucaggacgccgaugcucucgaccuggaaaugcuugcccccuacauuuccauggaugacgauuuccagcugaacgcgucugagcaacucccgcgcgccuaucaucggccucugggagcugugcccagaccccgggcccgcagcuuucacggccuguccccuccggcucuugaacccagccuccugccuagaugggggucugacccccggcuguccuguagcucuccuuccagaggagaucccagcgccucuagcccuauggccggcgcucgcaaacggacccucgcgcaguccagcgaggacgaggaugaaggggucgagcugcuuggcgugagacccccgaagcgcucuccuucccccgaacacgagaauuuccuccuguucccucugagccuguccuuucuucucaccggaggccccgccccggggucucugcaggacccuagcacaccccugcucaaccugaaugagccucuuggacugggccccucccuccugucucccuacagcgaugaagacaccacacagccugggggaccguuccaacccagagcuggcuccgcccaggccgauuga

SEQ ID NO: 70266 - RNA, 324 nt, Artificial Sequence
  derived and/or modified sequence opt5 from HIGD1A__Homo_sapiens__NP_001093138
auggagcagaagcugguggaagagauccuccaagccauuaccaugagcacagacacgggcgucucccugcccucuuacgaagaggaucaggggagcaaacuuaucagaaaggcuaaagaagccccuuucguuccggugggaauugcgggcuuugcugccaucguggccuaugggcuguacaagcucaaaucccggggaaacaccaagaugucuauucaccugauccauaugcgcgucgcugcccagggcuucgugguuggggcuaugacagugggaaugggcuauagcauguacagagaguuuugggccaagcccaaaccuuga

SEQ ID NO: 70267 - RNA, 294 nt, Artificial Sequence
  derived and/or modified sequence opt5 from HIGD1C__Homo_sapiens__NP_001103089
augagcuccgacaaccaguggucugccgaugaggacgaaggccaacugagcagacucauccggaagucccgcgauucucccuucgugccuauugggaucgcuggauuugucaccguugugagcugcggccuguacaaacuuaaguauagacgggaccagaaaauguccauucaccugauccauaugcgcguggccgcgcagggguucgucgugggagcuguuacacucggcgugcuguacucuauguauaaggauuacauuagaccgcgguuuuucagcgaguccaaaaaguga

SEQ ID NO: 70268 - RNA, 321 nt, Artificial Sequence
  derived and/or modified sequence opt5 from HIGD2A__Homo_sapiens__NP_620175
auggccacccccggcccugugaucccggagguccccuucgaaccuagcaagcccccuguuauugaggggcugucccccacaguguacagaaacccugaaucuuuuaaggagaaguucgugcggaaaacgcgcgaaaauccggucgugcccaucggaugccucgcuaccgccgcggcucugacauauggccuuuacagcuuucacagagggaacucccagcggucucaacugaugaugcgcaccagaauugccgcccagggauucacaguugcugccauccuccugggccuugcugugaccgccaugaaaagccggccuuga

SEQ ID NO: 70269 - RNA, 192 nt, Artificial Sequence
  derived and/or modified sequence opt5 from HILPDA__Homo_sapiens__NP_001092256
augaagcacgugcugaaccucuaccugcuuggcgucguucugacccuccugagcaucuucgugagagugauggagucccuugaagggcugcucgagucucccagcccuggaacauccuggacgacccggucucagcuggccaauacagaaccgaccaaaggccugcccgaccauccuagccgcuccauguga

SEQ ID NO: 70270 - RNA, 1260 nt, Artificial Sequence
  derived and/or modified sequence opt5 from HINFP__Homo_sapiens__NP_001230188
augcccccuccgggcaaggugcccagaaaagagaaccuguggcuccagugcgaaugggggagcuguuccuucgucugcucuaccauggagaaguuuuucgaacacguuacacaacaucugcagcagcaccuucauggaagcggcgaggaagaggaggaagaggaagaggacgauccucuggaggaagaguuuuccugucucuggcaggaaugcggguucuguucucuggacagcuccgccgaucuuauccggcacguguacuuucauugcuaucacacgaaacugaagcaauggggacuccaggcucugcagucucaggccgaccugggccccuguauucucgauuuccaaagccgcaaugugaucccugacauucccgaucacuuucugugccuuugggagcauugugaaaacuccuucgacaauccugagugguuuuacagacacgucgaggcgcauagccugugcugugaauaugaggcuguggggaaagauaacccgguugugcucugcggauggaagggcugcaccuguacauucaaggaccggucuaaacugcgcgaacaccuuagaucccacacccaggagaaggucguggccugccccacauguggcgggauguuugccaauaacaccaaauuccuggaucauauccggcgccagacaagccucgaccagcaacacuuucagugcucucauuguuccaagagauucgcuaccgaacggcugcugcgcgaucacaugagaaaucauguuaaccacuacaaaugcccucucugugacaugacgugcccccugccuagcucucuucggaaucacaugcgcuucagacauuccgaggaccggcccuuuaagugugauugcugugacuauagcugcaagaaccugauugaucuccagaaacaccuggacacccauuccgaggaaccggccuaccgcugcgauuucgagaauuguacauuuucugcuagaagccuuugcuccaucaagagccacuaucggaaagugcacgaaggagacucugagccuagauacaagugucaugucugcgauaaauguuucacccgcggcaacaaucugacagugcaccuccggaagaaacaucaauuuaaguggcccuccgggcacccuagauuccgccugggacauuuuugcaucccccugcccggcuucgccgcgcucuacgccccuaccagcccggggacgcggaacaugaagauggcuauuuguggaugcucuugguuugccacaagaguguga

SEQ ID NO: 70271 - RNA, 381 nt, Artificial Sequence
  derived and/or modified sequence opt5 from HINT1__Homo_sapiens__NP_005331
auggccgacgagaucgcuaaggcccagguggcgagacccggcggggauaccauuuucggaaaaaucauucggaaggaaaucccugcuaaaauuaucuuugaggacgaucgcugccuggccuuccacgacaucagcccgcaagcccccacacauuuucucgucauuccuaagaaacacaucucccagauuucuguugcugaagaugacgaugagagccugcuuggccaucugaugaucguggggaagaagugugccgcugaccucggacugaacaaaggcuacagaaugguggucaaugaaggguccgauggaggccagucuguguaucacguucaucuucacgugcugggcgggcggcagaugcacuggcccccuggauga

SEQ ID NO: 70272 - RNA, 492 nt, Artificial Sequence
  derived and/or modified sequence opt5 from HINT2__Homo_sapiens__NP_115982
auggccgcugccgugguccuggcggcuggccucagagccgcccggcgcgcuguugccgcuaccggggugagaggaggccaggugcgcggggccgcgggagucacagacggcaacgagguggccaaggcucaacaggccacgcccgggggagcugccccuaccaucuucagccggauucuggauaaaucccuuccggcggacauccuguacgaagaucagcagugccucguuuuuagagacguggcuccccaagccccuguccacuuccuggugauucccaagaaaccuaucccccggauuucucaggccgaggaagaggaucagcagcuucugggccaucuccugcugguugcuaagcaaacagccaaagccgaaggccucggggacggauaucgccuggugaucaaugauggcaagcugggggcucagagcgucuaccaccuucauauccacgugcucggaggcagacagcugcaguggccuccgggguga

SEQ ID NO: 70273 - RNA, 2961 nt, Artificial Sequence
  derived and/or modified sequence opt5 from HIP1__Homo_sapiens__NP_001230127
auggacagaauggccagcuccaugaaacaggugcccaacccucugccgaaaguccucucucggcgcggcguuggggcuggacuggaggccgcggaaagagagagcuucgaacggacccaaacaguguccaucaauaaggcuauuaacacgcaggagguggccgucaaagaaaagcacgccagaaccugcauccuuggcacacaucacgagaaaggggcucagaccuuuuggucugugguuaauagacugccccucagcuccaacgccgugcuguguuggaaguucugccaugucuuucacaaacuucugcgggauggacauccuaaugugcucaaggacucucugcgcuacagaaacgagcugagcgauaugucccggauguggggccaccucagcgaaggguauggacagcuguguucuauuuaccuuaagcugcuccgcacaaaaauggaguaucacaccaagaaucccagauucccuggcaaccugcaaauguccgaccggcagcuugaugaagcuggcgagagcgacguuaauaacuuuuuccagcugacaguggagauguuugauuaccucgaaugcgagcugaaucuguuccagaccgucuuuaacucucucgacaugucccgcagcgugucugugacggccgcggggcaauguagacuggcuccccuuauccaggucauucuggauugcucccaucucuaugacuacaccguuaaacugcuuuucaagcugcacagcugucucccugccgauacacugcagggacaucgggaccgcuuuauggaacaguucaccaagcugaaagaucucuuuuauagauccucuaaucugcaauacuucaagcggcuuauccagaucccgcagcugcccgagaacccucccaauuuccucagagccagcgcucuguccgaacacauuagcccugugguggucauccccgccgaggcgucuuccccggacagcgagccugugcuugaaaaagacgaucugauggacauggaugccucucaacagaaccucuuugacaacaaguucgaugacauuuuuggcagcuccuucucuagcgaucccuuuaauuucaacucccagaaugggguuaacaaagacgagaaggaucaccugaucgaacgccuguaccgggagauuagcggacucaaagcucagcuggaaaauaugaagacagagucucaaagagugguccuucagcugaagggccauguguccgagcucgaagccgaccuggcugagcagcagcaucugcgccaacaggccgccgaugacugcgaauuucuucgggcugagcucgacgaacugagacgccagcgggaggauaccgagaaagcgcagagaagccugucugaaaucgagcgcaaggcccaagcuaacgaacagcgguauuccaaacucaaggagaaauacagcgagcugguucagaaucacgccgaccuucugagaaagaacgccgaagugacgaagcaggucuccauggcucgccaagcccagguggaucucgagcgggaaaagaaggagcuggaagacucucuggagagaauuagcgaucaggggcaacggaaaacacaggagcagcuugaaguccucgagucccugaagcaggaacuggcgaccucucaacgcgagcuccaggugcugcagggaagccuugaaacauccgcucagagcgaggccaauugggccgcugaguucgccgaacuggagaaagaaagagacucucucguuuccggcgcugcccaccgggaggaggagcugagcgcgcugagaaaggagcuucaagauacccagcucaagcuggccucuaccgaagaguccaugugucagcuggcuaaagaccagcgcaagaugcuccuggugggcagccggaaagccgcugaacaagucauccaggaugcccuuaaccagcuggaggagccuccccucaucucuugcgcggggagcgccgaccaucugcuguccacagugacgagcauuucuuccuguaucgaacaacuugaaaagagcuggucccaguaucucgcuugccccgaagauauuucuggacugcugcacagcaucacccuccuggcccaccuuacauccgacgcuauugcccauggcgccaccacaugccugagagcuccuccggagcccgcggauucucucaccgaagccuguaaacaguacgggcgcgagacgcuggcuuaucuggccagccuugaggaagagggaucccuggaaaaugccgacucuacagcuaugagaaacugccucagcaagaucaaggccaucggcgaggaacugcucccucgggggcuggacauuaaacaggaggagcuuggagaucugguugacaaggaaauggcggcuaccuccgccgccaucgagaccgcuacagcccgcauugaaggcaccgcgagccccaaagaguuuuacgcuaaaaauucuagauggacagaaggccucaucuccgccagcaaggccgugggguggggagcuacggucaugguggaugccgcugaccuggugguucaaggccgggggaaguucgaggagcugauggucuguucucacgaaauugccgcguccaccgcccagcuuguggcugccagcaaagugaaggcugauaaggacucuccuaaccuggcccagcuccagcaagccucccgcggagucaaucaggcuacagcgggcgugguugccagcaccaucuccgggaaaagccagaucgaggaaacagauaacauggacuuuucuagcaugacccugacgcagauuaagagacaagagauggauucccaggugcggguccucgagcuggaaaacgagcuucagaaagaacgccagaagcugggcgagcuccgcaaaaagcauuaugaacuggcuggaguggccgagggcugggaggaagggaccgaggccucucccccgacacugcaagaaguugugaccgagaaggaauga

SEQ ID NO: 70274 - RNA, 3207 nt, Artificial Sequence
  derived and/or modified sequence opt5 from HIP1R__Homo_sapiens__NP_003950
augaacagcaucaagaaugugcccgccagaguccugucccggcgcccuggccacucucucgaggcugaaagagagcaguucgacaaaacccaagccauuagcaucuccaaggcgauuaacacacaggaagcuccgguuaaagagaagcaugcccggcgcaucauucuggggacgcaccaugaaaaaggagccuuuaccuucuggucuuacgcuaucggccuuccccugccuagcuccucuauccucagcuggaaguuuugccacgugcugcauaaggugcuuagagaugggcaccccaauguccugcacgacugucagcgguaucgcuccaacauuagagagaucggagaucucuggggccaucugcacgaccgguacgggcagcuggugaauguuuauacaaaacuccugcuuaccaagauuagcuuccaucugaaacacccucaauuucccgccggacucgaggugacagaugaaguccuggagaaggcugccggcaccgacgugaacaauaucuuccagcuuacaguugaaauguuugauuacauggacugcgagcugaaacucucugaguccguguuccgccagcugaacaccgcgauugccgucagccagaugucuuccggccaauguagacuggcuccucucauccaggugauucaggauugcagccaccuguaucauuacacggugaaacuucuguuuaagcuccacucuugucugccggccgacacccuucaggggcaucgggaucgcuuccacgaacaauuucauucccugagaaauuucuuucggcgcgcuagcgacaugcucuauuucaaaagacugauccagaucccccggcugccugagggacccccuaacuuccucagagccuccgcgcuggccgaacacauuaagcccgucguugugaucccggaggaagcuccugaggaugaggaacccgagaaucuuauugaaaucucuacaggcccucccgccggggagcccguggucguggcugaccuguuugaccagaccuucggaccuccgaacggcagcguuaaagaugaccgcgaucuccaaauugaaucccugaagcgggagguggagaugcuuagaagcgaacuggagaaaaucaagcucgaagcccagcgcuacaucgcccagcugaaaucucaggucaaugcucuggagggggaacucgaggagcaacggaagcagaagcagaaagcgcugguggacaacgaacagcuuagacacgagcuggcccaacuccgcgcugcccagcuggaaggagagcggucccagggccugagagaggaagccgagcgcaaggcuagcgccacagaagcgcgguacaauaaacuuaaggagaaacauucugaacucguucacgugcaugcugagcugcugagaaagaacgccgauaccgccaagcagcucacggucacacaacagagccaggaggaaguggcucgcgucaaagagcagcuggccuuucaaguggaacagguuaagcgggaguccgaacuuaaacuggaggagaagucugaccagcucgaaaaacugaagagagagcuggaagcuaaggccggcgagcuugcgcgggcccaagaagcucucagccacaccgagcaguccaaaagcgagcugucuucccgccuggauacacucagcgccgaaaaggacgcucugucuggggccgugagacagcgggaggcggaucuucuggccgcucagucccucgucagagaaaccgaggccgcucugagccgcgagcaacagcgguccucucaggaacagggagagcugcaaggcagacuugccgaacgcgagagccaggaacaggggcucagacagcggcugcuggacgagcaauucgccgugcuccgcggagcugcggccgaggcugccggcauucugcaggaugccguuuccaaacuugacgacccccugcaccucagaugcaccucuagcccugauuaucuggugucccgggcucaggaagcccuggacgcggucagcacacuugaggaagggcaugcucaauaccucacgucucuggccgaugccuccgcucugguggccgcgcucacccgcuuuagccaccuggcugccgacacaaucauuaacggaggcgccaccucucaucuugcucccacagauccugccgacagacugaucgauaccugucgggagugcggcgcucgcgcccucgaacugauggggcagcugcaggaccagcaagcgcuuagacacaugcaggccucccuggugcggacgccccuccagggcauucugcagcucggacaagagcugaagccgaaaagccuugauguucgccaggaggaacugggggcugucguggacaaggagauggccgcuacaucugccgccaucgaagaugcugugagacggaucgaggacaugaugaaucaggcgagacaugccagcuccggagucaagcucgaagugaacgagcgcauucugaauagcuguaccgaucugaugaaagcuauccggcuucugguuaccacaucuaccucccuccagaaggagauuguggaaagcggcagaggggccgccacacaacaggaguucuaugcuaaaaacucccgcuggacggaaggccugaucucugccagcaaggcggucggauggggcgcuacccagcucguggaggccgccgacaaaguugugcugcacacagggaaguacgaggaacuuauugucugcucccacgagaucgcugccucuaccgcgcagcugguggcugccagcaaaguuaaggccaauaagcauuccccucaccucucucggcugcaagaauguagcagaacagugaacgagcgcgcugccaaugucguggcuuccaccaaaagcggacaggaacagauugaggaccgggauacgauggacuuuucuggccugucccuuaucaagcugaaaaagcaagagauggaaacccaggugagaguccucgagcuggaaaagacacucgaggccgaacgcaugcggcugggggagcuuagaaagcagcauuauguucuggcgggagccagcggcucucccggggaggaaguggcuauccggccuuccaccgcuccccgcagcgugacaaccaagaaaccuccccuggcccagaagccgucugucgccccuagacaagaucaccagcucgacaaaaaggauggcauuuaccccgcccagcuggugaacuauuga

SEQ ID NO: 70275 - RNA, 2349 nt, Artificial Sequence
  derived and/or modified sequence opt5 from HIPK1__Homo_sapiens__XP_011539282
augaccuucuacagcuggauccccuaucacagacaggccccucugaaccaucggcgcgugugcuccgcugagggcgccgggucuccgggacccgcgcucgacccuagauggcugcccacagaagcucaccuucuggaggcccaucggcuccugcuucaaagcguccugugugaucgcccuagagaauccauucagcuccacuuucggcugucuauggccagccagcugcagguuuucucucccccuuccgugagcuccagcgcuuuuugcucugccaagaaacucaagaucgagccguccggcugggacgugagcgggcaaucuuccaaugauaaauacuauacgcauagcaagacccugcccgcuacacagggacaggccaacucuucccaccaggucgcgaauuucaacauuccugccuacgaccaaggccuucugcuccccgcuccugccguggaacacaucguugugaccgcugccgauagcuccgggucugcggccacaagcaccuuucaguccagccagacacugacccaucgcucuaaugucucccuucuggagcccuaucagaaauguggacucaagagaaagagcgaggaaguggacucuaacggcagcguucaaauuaucgaggaacacccgccucugaugcugcagaaucggacgguggucggcgcugccgcuaccacaaccacagugaccacgaaauccucuagcuccagcggggagggagauuaccagcucgugcaacaugagauccugugcucuaugacaaacuccuaugaaguccuugaguuccugggccgcgggaccuuuggacagguugccaaguguuggaaaagaagcacaaaggaaauuguggccaucaaaauucucaagaaucaccccucuuacgcucggcagggccagaucgagguguccauucugagccgccuuuccucugaaaacgcggacgaguacaauuucgucagaagcuaugagugcuuucaacacaagaaccauaccugucugguguucgaaaugcucgagcagaaucuguacgauuuucugaaacagaacaaguucuccccucucccccugaaauauauccggcccauucuucagcaaguugccaccgcucugaugaagcucaaaucucuggggcuuauccacgccgaccugaagccugaaaauaucaugcucguggauccgguccgccagcccuacagagugaaaguuauugacuuuggaagcgccucccaugugagcaaggcugucugcucuacauaucugcagucccgguacuauagagccccugagaucauucugggccuccccuucugugaagcgaucgauauguggagccugggcugcgugauugcugagcuuuuccugggguggccucucuaccccggagccucugaguacgaccagauccgcuauaucucccaaacgcagggccugccggccgaauaccugcuuagcgcugggaccaagacaacccgguuuuucaacagagacccuaaccucggauauccccuguggcgccugaaaacaccugaggaacacgagcucgaaaccggcauuaagucuaaagaggcccggaaguacaucuuuaauugucuggaugacauggcucaggucaacaugagcacggaucuugaggggacagacaugcuggccgaaaaagcggauagacgcgaguauauugaccuccugaagaagaugcugaccaucgaugccgacaaacggauuacaccccuuaagacccucaaucaucaguucgugaccaugacacaucugcuggauuuuccucacuccaaccacguuaaaagcugcuuccaaaauauggaaaucugcaagagacgcgugcacauguacgacacggucucucagaucaaaucccccuuuaccacacauguggcuccgaacaccagcacaaaucucaccauguccuucucuaaccagcugaauacgguucacaaccaagccagcgugcuugcuuccucuagcaccgccgcggccgcuacacugucccucgccaauucugaugucagccugcugaacuaucaguccgcucuuuacccuagcucugccgcccccgugcccggaguggcucagcagggcguuucccuccaaccuggcaccacacagauuuguacccagacggacccguuucagcaaacauucaucgucugucccccugcguuucagaccgggcugcaggccacaaccaagcacagcggauuccccgugcggauggacaaugcugugccuauugucccccaggccccugccgcucaaccccugcagauccagucuggcgugcucacccaaacaugcagagagaagauuucccgccauagcuga

SEQ ID NO: 70276 - RNA, 3516 nt, Artificial Sequence
  derived and/or modified sequence opt5 from HIPK2__Homo_sapiens__NP_001106710
auggcccccguguacgagggcauggcuagccacguccagguuuucuccccucauacccugcaaucuagcgccuuuugcuccgugaagaaacucaagaucgaaccgucuagcaacugggacaugacaggguauggaucccacucuaaaguguacagccaguccaagaauauuccccugagccagccugcgacgaccacagucucuaccucccuucccgugccuaaccccagccugccuuaugagcagacaaucguuuucccgggcucuaccgggcauauuguggucacauccgcuagcucuaccuccgugacgggacaaguucucggcgggccccacaaucugaugagacggagcaccgugucccuucuggauacauaccagaaauguggacucaagcgcaagucugaagagaucgaaaacaccagcuccguccagauuaucgaggagcauccucccaugauccagaauaacgccagcggcgccacaguggcuaccgccacgacaucuaccgcuacauccaaaaauagcggcucuaacagcgaaggggacuaucaacuggugcagcacgagguccugugcuccaugaccaauaccuacgaaguucucgaguuucugggaagaggcacauucggacagguggugaaguguuggaaacgggggacgaacgagauugucgccaucaagauucuuaaaaaucacccuucuuaugcgcgccagggccaaaucgaagugagcauucuggccagacucuccaccgagagcgcugaugacuacaacuuuguucgggccuacgaaugcuuccagcauaagaaucacacaugucugguguuugagaugcuugaacagaaccuguaugauuuccucaagcaaaauaaauuuucuccccugccgcugaaguacauccgcccuguccuccaacagguggcuaccgcccugaugaaacuuaagucccuggggcucauucaugcggaccugaaacccgagaacaucaugcuuguugauccuagcagacagcccuaucgggugaaggucaucgacuucggaucugccucccacgugagcaaagcugucugcuccacauaccugcagucucgcuauuacagagcccccgagauuauccucggccugccuuuuugugaagcuauugauauguggagccugggcugcgugaucgccgaacucuuccugggguggccgcuuuaucccggagccuccgaauacgaccagauucgguacaucucucagacccagggccugccugcugaguaucuccugagcgcggggacgaagacaacccgcuuuuucaacagagauaccgacucccccuacccucuuuggcggcugaagacacccgaugaccacgaagccgagaccggaaucaaaagcaaggaggcucgcaaauauauuuucaauugucucgacgauauggcccaaguuaacaugacaacggaccuggaaggcucugauaugcugguggagaaggccgacagacgggaauuuaucgaucuccugaaaaagaugcuuaccauugacgcugauaagagaaucacaccgauugagacccugaaucauccuuucgucacaaugacccaccuccuggacuuuccccauuccacgcacgugaaaagcugcuuccagaacauggaaaucuguaagcgccggguuaauauguacgauaccgugaaccagucuaaaacaccuuuuaucacccaugucgcccccuccacaagcaccaaucugacgaugacauucaacaaucagcuuaccacagugcacaaccaaccuucugcggcuagcauggccgccguggcucagagauccaugccccuccagaccgggaccgcccagauuugcgcucgcccggacccuuuucaacaggcccugaucguuugcccucccggauuccagggccugcaagcgagccccucuaagcacgccggcuauuccguccggauggagaaugcugugccgauugugacacaggcccccggggcucagccucuccagauccaacccggacugcuugcccagcaggcguggccuagcggcacgcagcaaauucugcuucccccugccuggcagcagcugaccggggucgcuacacauaccuccgugcagcacgccacaguuauccccgagaccauggcuggaacgcaacagcuggccgauuggagaaacacacaugcccacggcucucacuacaauccgauuaugcagcaaccugcucuccucaccgggcaugugacccugcccgcggcccagccucugaacgucggcguggcucacguuaugcgccagcagcccacaagcaccacauccucucggaaaagcaagcaacaucaguccucugugagaaaugucagcacgugugaaguguccagcucucaggccaucuccagcccgcagcgcucuaagcggguuaaagagaacaccccucccagaugcgccauggugcacuccagcccugcuuguucuacauccgugaccugcggauggggcgacgucgccagcuccacaacccgcgaacggcaaagacagacgaucgugauucccgacacccccagcccuacagucucuguuaucaccauuagcuccgauacagacgaggaggaggagcagaagcaugcgccgaccucuacagugagcaaacagcggaagaacgugaucuccugugucaccgugcacgauucucccuauagcgacuccucuagcaauacguccccuuacagcguucaacagcgcgcugggcacaacaaugccaacgccuuugauacaaaaggaucucucgaaaaucauugcaccggcaaccccagaaccauuaucgugccuccccugaagacacaggcuuccgagguccuuguggaaugugacagccugguuccugugaauaccucucaccauuccagcuccuacaagucuaaaagcuccagcaacgucacgucuacauccgggcacagcucuggaagcuccucuggcgccaucaccuaucggcagcaaagaccggggccccauuuccagcagcaacagccucucaaucugagccaggcgcagcaacacauuacaaccgaucgcacaggcucccaccggagacagcaggcuuacaucacccccacgauggcccaggccccuuauucuuuuccccauaacagcccgucccacggaaccgugcauccucaccuggcugccgcugccgcggccgcucaccuucccacacaaccccaucucuacaccuauacagccccugcugcccugggcagcaccgggacgguugcccaccugguggcuucucagggauccgcgcgccauacaguccagcacaccgccuaccccgcuagcauugugcaucaggugccugucuccaugggcccgagaguucuccccucuccuacaauccaccccagccaauauccugcccaguucgcccaccagaccuacauuuccgcuucucccgccagcaccguguacacaggguauccgcuguccccugcgaaggugaaucaauaccccuauaucuga

SEQ ID NO: 70277 - RNA, 3585 nt, Artificial Sequence
  derived and/or modified sequence opt5 from HIPK3__Homo_sapiens__NP_001265092
auggccagccaggugcuggucuaucccccuuacguuuaccaaacccaguccucugcuuucugcagcgugaagaaacucaagguggagccguccucuugugucuuucaggaaagaaacuauccccggacauacgugaauggccgcaacuucgggaauagccacccucccacgaaaggauccgccuuucagaccaagaucccuuucaacagaccccggggccauaauuuuucucugcaaacaagcgcgguugugcuuaaaaacaccgcuggggccacaaaggucauugccgcucaggcccagcaggcucacgugcaagccccucagaucggagcguggcgcaauagacugcauuuccucgagggcccgcagcggugcgggcugaagcgcaaauccgaggaacuugacaaccacagcucugccaugcagauuguugaugaacuguccauccuccccgcuaugcugcaaaccaauaugggaaacccugugacagucgugaccgccacgaccggcagcaagcagaauuguacaaccggcgagggggacuaucagcuggugcaacaugagguccucugcucuaugaaaaacacauacgaaguucuggauuuucuuggaagaggcaccuucggacagguggugaaguguuggaaacgggggacgaaugagauugucgcuaucaagauccugaagaaccaccccuccuaugcccgccagggccagauugaagugagcauccucgcgagacugucuacagagaaugccgacgaguacaacuuuguucgggcuuacgaaugcuuccaacaccgcaaccauaccugucuuguguuugagaugcuggaacagaaucucuaugauuuccugaaacagaacaaguuuuccccucugccccucaaagucauuagaccgauccugcagcaaguggccacagcucuuaagaaacuuaagagccucgggcugauucacgccgaccuuaaaccugagaauaucaugcugguugaucccgugcggcagccuuaccgcgucaaggugauugacuucggauccgccucucaugucagcaagaccgugugcuccaccuaucuccagagcagauacuaucgggcucccgaaaucauccugggccugcccuucugugaggcgauugauauguggucucucggcugcguuaucgccgagcuguuucuuggguggccucuguacccgggagcucucgaauaugaccagauuagauacaucucccaaacacagggccugcccggggagcagcuucugaacgugggaacgaaaagcacccgcuucuuuuguaaggaaacagauaugucucacagcggcuggcggcucaaaacccuggaggaacacgaggccgagacagggaugaaguccaaagaagccagaaaguacauuuucaauucucuggacgaugucgcucaugugaacaccguuauggaccucgagggaagcgaccugcuugccgaaaaggcggaucgccgggaguuugugucccugcucaaaaagaugcugcugaucgacgcugaucuuagaaucacgccugccgaaacacucaaucaccccuucgucaacaugaaacaucugcuggacuuuccucacagcaaucaugugaagucuugcuuccacauuauggauaucugcaaaucccaccucaacagcugugacaccaauaaccauaauaagaccucucugcuucgccccguggccuccagcuccacagcuacccugacagccaacuuuacgaagauuggcacccuccggucucaggcucugacaaccagcgcccacuccguuguccaucacggcaucccgcugcaagcggggacagcccaguucggaugcggcgaugcuuuucagcaaacccuuauuaucuguccucccgccauccaggggauuccugcuacgcacggaaaacccaccucuuauagcaucagaguggacaauacagugccucucgucacccaggcccccgcggugcagccgcugcaaauucgcccuggcguucugucccagacauggagcgggcggacccagcagaugcucgugcccgccuggcaacaggucacgccccuggcuccugccacaaccacacuuaccucugaguccguggcuggcagccauagacugggagauuggggcaagaugaucucuugcuccaaccacuacaacagcguuaugccgcagccccuccugaccaaucagauuacacugucugccccucaacccgugagcgucgggaucgcccaugugguuuggccucagcccgcuacgaccaaaaagaacaaacagugucaaaaucgcuccaacagccuucagaauacaaacauuccucacucugcguucaucucccccaagaucauuaauggaaaggacguggaggaagucagcugcaucgagacccaggauaaccaaaauuccgaaggcgaggcccggaacuguugcgagacaucuauuagacaggacagcgacuccucugugagcgauaaacagcggcagaccaucauuaucgcugacuccccgucuccugccgugagcgucaucacgauuuccagcgauacagacgaagaggaaaccucucagcgccauucccucagagaguguaaggggagccuggauugcgaagccugucaaucuacccugaauaucgaccggaugugcucccucagcucucccgauuccacacugagcaccuccagcucuggacagagcuccccuucucccugcaaaagaccgaacagcauguccgacgaggagcaggaaucuagcugugauacaguugacggcuccccuacgucugauagcuccgggcacgacagccccuuugcugagucuaccuucguggaagauacacacgagaauaccgaacuuguguccagcgccgacacagagaccaagccugcggucugcucugugguugugccucccgucgagcuggaaaacggccucaaugcugacgagcauauggccaacacggauuccauuugucagccccugaucaaaggacgcagcgccccgggccggcugaaccaacccuccgcuguggggaccagacagcagaagcugacaucugccuuccagcaacagcaccucaauuuuagccagguucaacauuucggauccggccaccaggaauggaacgggaauuuuggacaucgcagacagcaggcguauauuccuaccagcgugacaucuaaccccuucacccugucccacggcagcccuaaucacacagcuguccaugcccaccuggccgggaacacccaucucggcggacaacccacgcugcuuccuuacccgucuagcgcuacacuguccucugccgcucccguggcccaccuccuggcgagcccuugcaccucccggcccaugcugcagcacccuaccuauaauaucucucaucccagcggcaucguucaccaggugccggucgggcuuaacccucgccugcuccccucccccacaauucaucagacccaauacaaaccuaucuuucccccucacagcuauauugccgcuucuccggccuacacgggauucccccuguccccuacaaagcucagccaguaccccuauauguga

SEQ ID NO: 70278 - RNA, 3054 nt, Artificial Sequence
  derived and/or modified sequence opt5 from HIRA__Homo_sapiens__NP_003316
augaagcugcucaaacccaccugggugaaccacaauggcaagccuaucuucagcgucgacauucauccggaugggacaaaauuugccacgggaggccaggggcaagacuccggaaagguugugaucuggaacaugucucccgugcugcaggaggaugacgaaaaagaugagaauauuccuaagaugcuuugccagauggacaaccaccuggcuugugucaauugcgugagauggagcaacuccggcauguaccucgccucugggggagaugacaagcugaucaugguuuggaaacgggcgaccuauauuggccccagcacaguguucggcuccucugggaagcuggcuaaugucgaacaguggcgcugugugagcauccugagaaaccauuccggagauguuauggacguggccuggagcccucacgaugccuggcucgcuucuugcuccgucgacaauaccguggugaucuggaacgccgucaaauuucccgagauucuggcuacacugcggggccauagcgggcucguuaagggacugaccugggauccugugggcaaauacaucgccucucaagcggacgaccgcucccuuaagguguggagaacacuggauuggcagcucgaaaccagcauuacgaagccguucgacgagugugggggaaccacacacguccugcggcuuucuuggucccccgauggccacuaucuggugagcgcccaugcuaugaauaacuccggcccuaccgcccagaucauugagcgcgaaggguggaaaacaaauauggacuuuguuggacacagaaaggcugugaccgucgugaaauucaaccccaagaucuuuaaaaagaaacagaagaauggcucuagcgccaagccuuccugccccuacuguugcugugcgguugggagcaaagaucggucucucuccguguggcugacgugccugaagcgcccgcucgucgugauucaugagcuguucgacaaaagcaucauggauaucucuuggacacuuaacggacugggcauucucgucuguagcauggacggguccguggccuuucuggauuucucucaagacgaacuuggagauccucugagcgaggaggaaaaguccagaauccaccagagcaccuauggcaaaucucucgcuauuaugacagaggcccagcuguccaccgcuguuaucgaaaaccccgagaugcugaaguaccagcggcgccaacagcagcaacagcucgaccaaaagagcgccgccaccagagaaaugggcucugcuacauccguggcgggggucgugaauggagagagccuggaggacauucggaaaaaccuucugaagaaacagguugaaacgcgcaccgccgauggcagacggagaaucacaccucucugcaucgcucagcuggacaccggggauuuuuccacagccuucuuuaauucuauuccccuuagcggaucccuggccggcaccaugcucucuagccacuccagcccccagcugcugccucucgacucuuccacgccgaacagcuucggggcuucuaagcccugcacagagccuguggucgccgcguccgcucgccccgccggcgauagcgugaauaaagacucuaugaacgccaccagcaccccugcugcccugucccccagcgugcuuacaaccccgucuaagaucgaaccuaugaaggcuuucgauucccgguuuacagagagaagcaaagccacgcccggagcgccugcccugaccuccaugacacccaccgcuguugaacgccucaaggagcagaaucuggucaaagagcugcggccuagagaccuucucgaaucuagcuccgauucugacgagaaggugccccuggccaaagcuagcucccugucuaagcgcaagcucgaacuggagguggaaacagucgagaaaaagaaaaagggccggccgagaaaagauagccgccuuaugccugugucccugagcguucagucucccgccgcgcucaccgccgagaaggaagcuaugugucuguccgcccccgcucuggcccuuaaacucccuauuccgagcccccaacgggccuucacgcuucaggugucuuccgacccuagcauguauaucgaggucgaaaacgaggugaccguugucgggggagugaagcugucuagacucaagugcaaucgcgagggcaaagaaugggagacagugcugaccucccggauucuuacagcugcggggagcugugauguugugugcgucgccugugaaaagagaaugcuguccguguuuucuaccugcggacggcgccuccugagccccauccugcuuccuagccccaucuccacgcuccauuguacaggcucuuacgugauggcucugaccgccgccgcuacacugagcgucugggacguucacagacaggugguggucgugaaagaggaaucccuccauucuauucuggccgggagcgacaugaccguuucccagauccuucugacccaacacggcauuccugugaugaaccucucugauggaaaggcguacugcuucaaucccagccuguccacauggaaccuggucagcgacaaacaggauucucuugcucagugugccgacuuucgguccagccucccgucucaggaugccaugcugugcuccggcccucuggcuaucauucaagggagaacgagcaauuccggacgccaggccgcgagacucuucucugugccccauguugugcagcaagagaccacacuggcuuaucuugagaaccaggucgccgccgcucugacccuccagagcucccacgaauaccggcacuggcugcugguguaugcccgcuaccuuguuaaugagggcuuugaauauagacugcgggagaucuguaaggaccuccuggggccugugcauuacagcacaggaucucagugggaauccaccgucgugggccuccgcaagagagagcugcuuaaagagcugcuccccgugauugggcaaaaccugcgguuccagcgccuguuuacggaaugccaggagcagcuugauauccugagagacaaguga

SEQ ID NO: 70279 - RNA, 1671 nt, Artificial Sequence
  derived and/or modified sequence opt5 from HIRIP3__Homo_sapiens__NP_003600
auggccagagagaaggaaaugcaggaguucacccggagcuuuuuccgcggcagacccgaccuguccacacucacgcacucuaucgugcggcgcagauaccuggcucauagcgggcggucccaccuugaaccugaggaaaaacaagcccugaagcgccucgucgaggaggaacugcuuaaaaugcagguugaugaggcggcuucuagagaagacaagcuggaucucaccaaaaagggaaagcggccgcccacaccuugcagcgaccccgagcgcaaaagauuucgguucaacuccgagucugaaagcggcuccgaggccagcucuccugauuauuuugggcccccugccaagaauggaguggcugccgaaguguccccggcuaaagaggaaaacccccgcagagccagcaaggcggucgaggagucuuccgacgaggaacggcagcgcgaucugccugcccagagaggcgaagagagcucugaagaggaggaaaaaggguacaagggaaagacccggaaaaagcccgugguuaaaaagcaagcuccuggcaaagccuccgugagcagaaagcaggcucgcgaggaauccgaggaaucugaggccgagcccguccagcggacagcgaaaaagguggaaggcaauaaggggaccaaaagccugaaggaguccgaacaggagagcgaggaagagauucucgcccaaaagaaggaacagagagaggaagagguugaggaagaggaaaaagaggaagacgaggagaagggagauuggaagccgcgcacacggucuaacggcagacgcaaauccgcucgggaagagagaagcuguaagcagaaaucucaggccaagcgccugcuuggggacagcgauuccgaagaggaacaaaaagaggcugccucuagcggagacgauuccggccgggacagagagccucccgugcagcgcaagagcgaagaccggacccagcugaaagggggaaaaagacucucuggcuccagcgaggaugaagaggacucuggcaagggggagccuacggccaaaggaucccggaagauggcucgccugggcagcaccuccggggaagagucugaucuugaaagagaggucagcgacuccgaagcgggaggcgggccccaaggagagcggaaaaauagaucuagcaagaaguccagccgcaaaggccggacaagaucuuccucuagcuccagcgauggcucucccgaggccaaagggggaaaggcuggcagcgggcgcagaggagaagaccauccugccgugaugcggcugaagcgcuauaucagagccugcggcgcucaccggaacuacaaaaagcuccugggguccuguugcagccauaaagagcgccugucuauucucagagccgaacuggaggcgcuuggcaugaagggaaccccgucccugggcaagugucgggcucucaaagaacagcgcgaggaggccgccgaaguggcuagccuggaugucgccaauaucauuuccgggucuggaagaccccggcgcagaacagcuuggaacccucuuggcgaggccgcgcccccuggggaacuguaucggagaacccucgacagcgaugaggaacgcccccggccggccccucccgacuggucccacaugagaggaaucaucucuagcgauggcgaguccaauuga

SEQ ID NO: 70280 - RNA, 648 nt, Artificial Sequence
  derived and/or modified sequence opt5 from HIST1H1A__Homo_sapiens__NP_005316
augagcgagaccgugcccccugccccggcugccuccgcggcucccgaaaagccucuggccggcaaaaaggccaaaaagcccgcuaaagccgcugccgcgucuaagaagaaaccugccgggcccagcgucuccgagcucaucguucaggcugccucuagcuccaaggaaagaggaggcgugucucuggcugcccuuaaaaaggcgcuggccgcugccggguacgacguggagaaaaacaauagccggauuaagcucggaaucaagucccuggucagcaaaggcacacuugugcaaacgaaggggaccggagcuucuggcuccuucaaacugaacaagaaagccagcucuguugaaacaaagccuggcgccuccaaaguggcuaccaagacaaaggcgaccggggccagcaaaaagcucaaaaaggcuacaggagccucuaaaaaguccgucaagaccccgaaaaaggccaaaaagcccgcugccacgcgcaaaagcuccaagaauccuaagaaacccaagaccgugaaaccuaagaaaguugcgaagucucccgcuaaggccaaagccgugaagccgaaagcugccaaggcuagagucacaaaaccuaagaccgccaaacccaagaaggcggccccuaaaaagaaauga

SEQ ID NO: 70281 - RNA, 681 nt, Artificial Sequence
  derived and/or modified sequence opt5 from HIST1H1B__Homo_sapiens__NP_005313
augagcgagaccgcccccgcugaaacagccacgccugcgccgguggagaagucccccgcuaaaaagaaagccaccaagaaagccgcuggcgccggggcugccaagagaaaggcgacaggaccucccgucucugaacugaucaccaaagccguugcugccagcaaggagcggaacggccucucccuggcugcccuuaaaaaggcgcuggccgcugggggauacgacguggaaaagaauaacucucgcauuaagcucggccugaaaagccuuguguccaaagggacacugguccagaccaagggaacaggcgccucuggcagcuucaaacucaauaagaaagcugccuccggggaggccaagccuaaagcuaagaaggcgggagccgcuaaagccaagaaacccgccggcgcuaccccuaagaaagccaagaaggcggcuggggccaaaaaggccgugaaaaagacgccgaaaaaggcuaagaaacccgccgcugccggaguuaagaaaguggccaagagcccuaaaaaggcgaaggcugccgcuaaacccaagaaagccaccaagucuccugcgaaacccaaggccgucaaaccgaaggcugccaagccuaaagcugccaagcccaaagccgcuaagccuaaagcggccaaggcuaagaaagccgccgcuaagaaaaaguga

SEQ ID NO: 70282 - RNA, 642 nt, Artificial Sequence
  derived and/or modified sequence opt5 from HIST1H1C__Homo_sapiens__NP_005310
augagcgagaccgcccccgcugccccugcggcugccccgcccgccgaaaaggcuccugugaaaaagaaagccgcuaagaaagccggcgggacacccagaaaggcguccggaccucccgucucugagcugaucacgaaggccguugcugccagcaaagaacgguccggcgugucucucgcugcccugaagaaagcgcuugccgcugccggguacgacguggagaagaacaauagccgcauuaaacugggacucaagucccuggucucuaagggcacccuugugcagacaaaagggaccggagcuagcggcuccuucaagcugaacaaaaaggccgccagcggcgaagcuaaaccuaagguuaaaaaggccgggggaacaaagccgaaaaagcccgugggcgcggcuaaaaagccuaaaaaggccgccgggggagcuacccccaagaaaucugccaagaaaacaccuaagaaagcgaagaagcccgcugccgccaccgucacgaaaaagguggcuaaauccccgaagaaagccaagguugcuaagccuaaaaaggccgcgaaaagcgccgcuaaggccgugaaacccaaggcugccaaaccuaaggucgugaagcccaaaaaggcggcccccaaaaagaaauga

SEQ ID NO: 70283 - RNA, 666 nt, Artificial Sequence
  derived and/or modified sequence opt5 from HIST1H1D__Homo_sapiens__NP_005311
augagcgagaccgcuccccuggccccuacaaucccggcccccgcggaaaagacgccugugaaaaagaaagcuaagaaagccggcgccaccgcugggaagagaaaggccuccggacccccugucucugagcucauuacaaaagcuguugccgcgagcaaggaacgguccggcgugucucuggccgcucuuaaaaaggcccuggcugccgcgggguacgacguggagaaaaacaauagccgcaucaagcucggacugaagucccuugucucuaaaggcacccuggugcagacaaaggggaccggagccagcggcuccuucaaacucaacaagaaagcugccagcggcgaagggaagcccaaagcuaagaaggccggagccgcuaaaccuagaaagccggcgggcgccgcuaaaaagcccaaaaagguugccggggccgcuacaccuaagaaaucuauuaagaaaacccccaagaaagugaagaagccugccacggcggcuggaaccaaaaaggucgccaaauccgccaagaaagugaagacaccccaaccgaagaaagcugccaagagcccugcuaaagccaaggcgcccaaaccuaaggccgcuaaacccaagucuggcaagcccaaaguuaccaaggccaaaaaggcugccccuaaaaagaaguga

SEQ ID NO: 70284 - RNA, 660 nt, Artificial Sequence
  derived and/or modified sequence opt5 from HIST1H1E__Homo_sapiens__NP_005312
augagcgagaccgcccccgcugccccugcggcuccggcccccgccgaaaagacaccugugaaaaagaaagcuagaaaguccgccggcgcugccaaacggaaggcgucugggcccccugucagcgagcugaucacgaaggccguugcugccuccaaagaacgcucuggagugagccucgcugcccugaagaaagcgcuugccgcugccggcuacgacguggagaagaacaauuccagaauuaaacuggggcucaagucucuggucagcaagggaacccuugugcagacaaaaggcaccggggcuuccggcagcuucaagcugaacaaaaaggccgccucuggagaagcuaaacccaaggcgaaaaaggccggcgcugccaaggccaaaaagccugcuggggccgcgaaaaagccgaaaaaggcuacaggagccgccacccccaagaaauccgcuaagaaaacaccuaagaaagccaagaagcccgcugccgcggccggcgcuaaaaaggccaaaagcccuaagaaagcuaaggccgcgaagcccaaaaaggccccgaaaucuccugcuaaggccaaagcuguuaagcccaaagccgccaagccuaagaccgcuaaacccaaggcggccaaacccaagaaagcugccgccaagaagaaauga

SEQ ID NO: 70285 - RNA, 624 nt, Artificial Sequence
  derived and/or modified sequence opt5 from HIST1H1T__Homo_sapiens__NP_005314
augagcgagaccgugcccgccgcuuccgccucugcgggcgucgcugccauggaaaagcugccuacgaaaaagagagggcggaaaccggccggacucaucagcgcuucccgcaagguucccaaccugucugugagcaaacuuauuacagaggcccuguccgugucucaggaaagagucggcaugagccucguggcucugaagaaggcccuugcggccgcuggguacgacguugagaaaaauaacucccggaucaagcugagccucaaaucucuggugaauaagggcauucugguccaaacccgcggaacaggggccuccggcagcuucaaacucucuaagaaggugaucccuaaauccaccagaagcaaggcuaaaaagucuguuuccgccaaaacaaagaaacuggugcuuagccgggauuccaagucucccaagaccgcgaaaacaaacaagcgcgccaaaaagccuagagcuaccacgcccaaaaccguccggagcggacgcaaggccaagggcgcuaaagggaagcagcagcagaaauccccugugaaggccagagccagcaaaucuaagcugacacaacaccaugaagugaauguccggaaggcuaccuccaaaaaguga

SEQ ID NO: 70286 - RNA, 393 nt, Artificial Sequence
  derived and/or modified sequence opt5 from HIST1H2AE__Homo_sapiens__NP_066390
augagcggcagagggaagcagggaggcaaagcccgggcuaaggccaaaacccgcuccucuagagcggggcugcaguuccccgugggacggguccaccgccuccugagaaagggcaacuacagcgagcggguuggggcuggagccccuguguaucuugccgcugugcuggaauaccucacagccgagauccuggaacuugcuggcaaugccgcgcgcgacaacaaaaagacgagaauuaucccgcggcaucugcagcucgccauucgcaaugaugaggaacugaacaagcugcucggcagagucaccaucgcucaagggggagugcugcccaauauucaggccguucuucugccuaaaaagacagagucccaccauaaagcuaagggcaaauga

SEQ ID NO: 70287 - RNA, 387 nt, Artificial Sequence
  derived and/or modified sequence opt5 from HIST1H2AH__Homo_sapiens__NP_542163
augagcggcagagggaagcagggaggcaaagcccgggcuaaggccaaaacccgcuccucuagagcggggcugcaguuccccgugggacggguccaccgccuccugagaaagggcaacuacgcugagcggguuggggccggagccccuguguaucuugcugccgugcuggaauaccucacagcugagauccuggaacuugccggcaaugcggcccgcgacaacaaaaagacgagaauuaucccgcggcaucugcagcucgcuauucgcaaugaugaggaacugaacaagcugcucggcaaagucaccaucgcccaagggggagugcugcccaauauucaggcuguucuucugccuaagaaaacagagagccaccauaaggccaaauga

SEQ ID NO: 70288 - RNA, 381 nt, Artificial Sequence
  derived and/or modified sequence opt5 from HIST1H2BG__Homo_sapiens__NP_003509
augcccgagccugccaagagcgcuccggcccccaaaaagggcuccaaaaaggcggugaccaaagcucagaagaaggacgggaaaaagagaaaacggucucgcaaggaaagcuacuccgucuauguuuacaaagugcugaagcaagugcacccugauacaggaaucucuagcaaggccaugggcauuaugaacuccuucgucaaugacaucuuugagagaauugccggggaggcuucucggcucgcccauuauaacaaacgcagcacgaucaccuccagagaaauucagacagcugugcggcugcuucugcccggagaacucgccaagcacgcgguuagcgagggcaccaaagccgugacaaaguacaccucuuccaaauga

SEQ ID NO: 70289 - RNA, 381 nt, Artificial Sequence
  derived and/or modified sequence opt5 from HIST1H2BH__Homo_sapiens__NP_003515
augcccgacccugccaagagcgcuccggcccccaaaaagggcuccaaaaaggcggugaccaaagcucagaagaaggaugggaaaaagagaaaacggucucgcaaggagagcuacuccgucuauguuuacaaagugcugaagcaagugcacccugacacaggaaucucuagcaaggccaugggcauuaugaacuccuucgucaaugauaucuuugaaagaauugccggggaggcuucucggcucgcccauuauaacaaacgcagcacgaucaccuccagagaaauucagacagcugugcggcugcuucugcccggagagcucgccaagcacgcgguuagcgaaggcaccaaagccgugacaaaguacaccucuuccaaauga

SEQ ID NO: 70290 - RNA, 381 nt, Artificial Sequence
  derived and/or modified sequence opt5 from HIST1H2BM__Homo_sapiens__NP_003512
augcccgagccugugaaguccgccccgguccccaaaaagggcuccaaaaaggcuaucaacaaagcccagaagaaggacgggaaaaagagaaaacggucucgcaaggaaagcuacuccguuuauguguacaaagugcugaagcaaguccacccugauaccggaauuucuagcaaggcgaugggcaucaugaauagcuucgugaacgacauuuuugagagaaucgcuggggaagccucucggcucgcccauuauaauaaacgcagcacaauuacguccagagagauccagaccgcuguucggcugcuucugcccggagaacucgccaagcacgcugugagcgagggcacaaaagccgucaccaaguacacaucuuccaaauga

SEQ ID NO: 70291 - RNA, 411 nt, Artificial Sequence
  derived and/or modified sequence opt5 from HIST1H3G__Homo_sapiens__NP_003525
auggccagaaccaagcagacagcucggaaaagcacgggcgggaaggcgccccgcaaacaacuggccaccaaggcugccagaaaauccgccccugcuacaggaggcgugaagaagccgcaccgguaccgccccgggaccgucgcccucagagagauccggcgcuaucagaaaucuacagaacugcuuauuagaaagcugccuuuccagcggcucguucgcgagaucgcucaggacuuuaaaaccgaucugagauuccaaagcuccgccgugauggcgcuucaggaagccugcgaggcuuaccuggugggacucuuugaagacacaaaccugugugccauucaugcuaagcgggucaccaucaugcccaaagauauucagcuggcccgcagaauccggggcgagcgcgcguga

SEQ ID NO: 70292 - RNA, 312 nt, Artificial Sequence
  derived and/or modified sequence opt5 from HIST1H4D__Homo_sapiens__NP_003530
augagcggcagagggaagggaggcaaagggcugggaaagggcggggccaaacggcaccgcaaggugcucagagacaacauccagggaauuaccaaacccgcuauccggcgccuggccagacggggcggcgucaagcgcauuuccgggcuuaucuacgaggaaacaagaggaguucugaagguguuccucgagaaugugauucgggaugcggucacguauaccgaacaugcuaaacgcaagacagugaccgccauggacguuguguacgcccugaaaagacaaggccggacacuuuauggguuuggaggcuga

SEQ ID NO: 70293 - RNA, 411 nt, Artificial Sequence
  derived and/or modified sequence opt5 from HIST3H3__Homo_sapiens__NP_003484
auggccagaaccaagcagacagcucggaaaagcacgggcgggaaggcgccccgcaaacaacuggccaccaagguggcuagaaaauccgccccugccacaggaggcgucaagaagccgcaccgguaccgccccgggaccguugcucucagagagauccggcgcuaucagaaaucuacagaacugcuuauuagaaagcugccuuuccagcggcucaugcgcgagaucgcccaggacuuuaaaaccgaucugagauuccaaagcuccgcugugauggcccuucaggaagcgugcgagucuuaccuggugggacucuuugaagacacaaaccugugugucauucaugccaagcgggugaccaucaugcccaaagauauucagcuggcucgcagaauccggggcgagcgcgccuga

SEQ ID NO: 70294 - RNA, 8157 nt, Artificial Sequence
  derived and/or modified sequence opt5 from HIVEP1__Homo_sapiens__XP_011512855
augccccggaccaagcagauccacccucggaaccugcgcgacaaaauugaggaagcccaaaaggagcucaauggcgcugaagugagcaaaaaggagauccugcaggccggggucaaaggaaccuccgaaucucuuaagggcguuaagcgcaagaagauuguggccgagaaccaccugaaaaagaucccgaaaagcccccuccggaauccucugcaggcuaagcacaagcagaacacggaggaauccucuuucgccgugcuucacagcgccuccgagucucacaaaaagcaaaauuacauucccgucaaaaacgggaagcaguuuaccaaacagaauggagaaaccccuggcaucaucgcugaggccagcaaguccgaggaaagcgugucucccaaaaagccucuguuccuccagcaaccguccgagcugcgcagauggcggagcgaaggggcugaucccgccaaguuuucugaccuggaugagcagugcgacuccagcucucucuccagcaaaacccgcaccgauaacuccgaauguauuucuagccauugcggaaccacauccccuagcuauaccaauacggccuucgacguucugcuuaaggccauggagcccgagcugucuacccucucccagaaaggcagcccuugugcuaucaagacagaaaaacugagacccaacaagaccgcccggucuccgccuaaacuuaaaaauagcuccauggaugcucccaaccagacaucucaagagcugguggccgaaagccaguccagcugcaccucuuacacgguccacauguccgcggcccagaagaaugagcaaggcgcuaugcagagcgccucucaccucuaucaucagcacgaacauuuugugccuaaauccaaccagcacaaucaacagcugcccggguguagcggauucacaggcucccugaccaaccuccagaaccaggagaaugcuaagcuggagcaaguuuacaacauugccgugacaucuagcgucgggcuuaccucccccucuagccgcucccaggugaccccucagaaucagcaaauggacagcgccucuccgcuguccaucagccccgcuaacucuacacaguccccucccaugccuauuuauaauagcacgcacguggcgucugucguuaaccagagcguggaacagaugugcaaucuccugcuuaaagaucaaaagcccaagaaacagggaaaguacaucugugaguauugcaacagagccugugcuaaaccguccgugcugcucaagcauauucggagccacaccggcgaacgcccuuaccccugcgucacauguggguuuucuuucaaaaccaaguccaaucuguacaagcauaaaaagagccacgcccauacaaucaaacugggacucgugcugcagccugacgccggcggccuuuuucugucccacgagucucccaaggcucucagcauccacuccgauguugaagacucuggggagagcgaggaagagggagccaccgaugaaagacaacaugaccugggcgcgauggagcuucagccugugcacauuaucaaacggauguccaacgcugagacgcugcucaagucuagcuucacacccuccagcccggaaaaugucauuggggacuuucugcugcaggaucgcucugccgagucccaggccgugaccgaacucccuaaaguugugguccaucacgugaccgucagcccccugagaacagacucucccaaggcuauggauccuaagccggagcuuuccagcgcccaaaaacagaaggaccuccaagugaccaacguucagccccucucugcuaauaugucccaaggaggcgugagccggcuggaaacaaacgaaaauucccaccagaaaggggauaugaacccucuggagggaaagcaggacagccaugucggcacggugcacgcccagcuucaaagacagcaggcgaccgauuauucucaagaacagcagggcaaacuccugagcccccgcucccuggggucuacagacagcggauacuucucccggucugagagcgccgaucagaccguuuccccucccacaccuuuugcuagacgccuccccucuaccgaacaagacagcggccgguccaacgggccgagcgccgcucuggugacgaccucuacaccuuccgcccuucccaccggagagaaggcgcugcuccugccuggccagaugagacccccgcuggccacaaagacccuugaggaaagaaucagcaaacucauuucugauaaugaggcucuggucgacgacaagcagcuggauuccgugaaaccucggagaacgagccucucccgccgggggucuaucgacagccccaaguccuauaucuucaaagauagcuuccaguuugaccugaagccugugggcagacgcacaucuuccagcucugauauucccaagagccccuucaccccuacagaaaaauccaagcaaguuuuucuucugucugucccgagccucgacugccugcccaucacccgguccaacucuaugccuaccacaggauacagcgccgugcccgcuaauauuaucccucccccucauccgcugagaggcucccagagcuucgaugacaaaauuggggccuuuuaugaugacguguucgucucuggacccaacgccccugugccccaguccggccacccucggacgcuuguucgccaggcugcgaucgaggauagcuccgccaaugaaucucaugugcucgggaccggacaaagccuggacgagucccaccagggcugccacgcugccggggaagccaugucugucagaagcaaggcucuggcccagggcccccauaucgagaaaaagaagucccaccagggacggggcacaauguuugagugugaaaccugcagaaaccgcuaccggaaacucgagaauuucgaaaaccauaagaaauuuuauuguagcgagcugcacgggccgaagacaaaaguggcgaugagagagccugaacauucucccguucccggaggccuucaaccucagauucugcacuaccgcguggcuggguccagcggaaucugggagcagacaccccaaauuagaaagcggcgcaaaaugaagucugucggcgaugacgaagaacugcagcagaaugaauccgggacgagcccuaagucuagcgagggccugcaguuccaaaacgcccugggaugcaauccgucccuucccaaacacaacgugacaaucagaucugaccagcagcauaagaauauucagcuccaaaacagccacauccaucugguugcccggggcccugagcagaccauggaucccaaacuguccaccauuauggaacagcagaucagcuccgcugcccaagacaagaucgagcuccagcgccacgggacaggaauuucugugauccagcacaccaauagccuguccagaccuaacucuuuugauaaacccgaaccguucgagcgggcgagcccugucuccuuucaagaacuuaaccgcacaggcaagucugggagccugaaggugauuggaaucucccaggaggagagccaucccucuagagacggcucccacccucaucagcucgcucugagcgaugcccugagaggggaacuucaggagucuucccgcaaaagccccucugaaagacacgugcugggccaaccuucccggcucgucagacagcauaauauucagguucccgagauccuggugacggaggaaccggaccgcgaucucgaggcccagugucacgaccaagaaaagagcgagaaauucuccuggccucagcggagcgaaacccugucuaaacuucccacagagaaacugcccccuaagaagaaaagacuccgccuggcugagaucgaacacagcuccaccgagucuagcuucgauuccacacugucucggagccuuuccagagaaucuagccugucccauaccagcucuuuuuccgccagccucgacauugaggaugugucuaagacggaggcuuccccgaaaaucgacuuccugaacaaggccgaguuucucaugauucccgcgggacugaauacccuuaacgucccuggcugccaccgcgagaugcggagaacagccagcgaacagaucaauuguacccagacauccauggaggugucugaucugcgcagcaaauccuucgacugcgggagcauuacacccccucaaacaacaccccucacggaacugcagccuccgucuucccccagccggguuggagugacaggccaugucccucugcuugagagacggcgcgggccccuggugagacagaucucucucaacaucgcuccugacagccaccugucccccguucacccgaccucuuuucagaauaccgcccucccuagcgugaacgcuguccccuaccaaggaccccagcugacauccaccucucuugccgaguucagcgccaauacgcugcauucccagacacaagugaaggaucugcaggcugagaccagcaacucuuccagcacaaauguuuuuccugugcagcagcucugugacauuaaccugcuuaaucaaauccacgcgcccccuucccaucagucuacccagcugagccuccaggucuccacacaaggcucuaagccggauaaaaacagcgugcuguccggcagcucuaaguccgaggacugcuucgcccccaaauaucagcuccacugucagguguuuaccagcgggccuucuugcuccagcaaucccguccauucucugccuaaccagguuauuuccgaucccgugggaacggaccacugcgugaccagcgcuacacuuccgaccaagcugaucgauucuaugagcaacucccacccucugcugcccccugaacugcggccccuuggcagccaaguccagaaagugccuuccucuuucaugcugcccauucgccuccagagcuccguuccggccuacuguuuugccacacugaccucucucccucaaauccuggugacgcaggaccuucccaaucagcccaucugccagacaaaccauagcgucgugccuauuuccgaggaacaaaauucuguuccgacccugcagaaggggcaccagaacgcucugcccaauccugagaaggaguuccucugugagaacguguuuagcgagaugucccagaauagcucucuguccgaaagccuucccaucacacagaagauuucugucggaagacuguccccucagcaggagagcucugccuccagcaagcggaugcucucucccgcgaacucccuggauaucgcuauggaaaaacaucagaagagagccaaagacgagaauggcgccgugugcgcuaccgauguccgcccucucgaggcccugagcagccgggugaacgaagcguccaagcaaaagaaacccauucuuguuagacagguguguaccacagagccgcuggacggggucaugcuggaaaaagacguguucucucagccugagaucagcaaugaagcuguuaaccucacgaaugugcugcccgccgauaacuccucuaccggaugcagcaaauucgucgugauugagccuaucuccgagcuucaagaauuugagaauaucaagucuagcacaucccugacccucacagugcgcagcucucccgccccguccgaaaacacccacauuagcccucugaaauguacggacaauaaccaggagcggaagucucccggcguuaaaaaccagggcgauaaggucaauauccaggaacaaucccagcagcccgugacaagccugucccucuucaacauuaaggacacccagcaacuugcuuuuccuucucugaaaaccacaaccaauuucacauggugcuaucugcucagacagaagucccugcaccuuccccagaaagaucagaagacguccgccuacaccgacuggacagugucugcuagcaacccuaauccgcuggggcuccccaccaaagucgcccuggcgcugcucaacuccaagcaaaauacaggaaagagccuuuauugucaggccaucaccacgcauucuaaauccgaucugcugguguacagcucuaaguggaaaagcucccucucuaagcgcgcucugggcaaccagaaaagcaccguuguggaguuuuccaauaaggacgccagcgagauuaacucugaacaggauaaggaaaauucccuuaucaaaagcgaaccucggagaaucaagauuuucgacgggggauauaaauccaacgaggaauacgucuacgugcgcggcagagggcggggaaaguauaucugcgaggaguguggcauucgcugcaaaaagcccucuaugcugaaaaagcacaucagaacacauaccgauguucggccuuaccacugcacauauuguaauuuuagcuucaagaccaaaggcaaccucacaaagcauaugaaauccaaggcucacucuaaaaagugcguggaccugggggucagcgugggacugauugaugaacaagacacggaggaauccgacgagaagcagcgcuuuucuuacgagagaagcggcuaugaucucgaagaguccgacgggcccgaugaagacgauaaugagaacgaagacgaugacgaggauagccaggccgagucuguucuuuccgccaccccuagcgugacagcuucuccgcaacaucugcccucccggagcucucugcaggacccugucagcaccgaugaagacgugagaaucaccgauuguuucuccggagugcauacagaccccauggacguccucccucgcgcgcugcuuacgcggaugaccguucugagcacagcccaguccgauuacaacagaaaaacccucucucccggcaaggcucgccagcgggccgccagagacgagaaugauacaaucccgagcguggacaccucccggucuccuugccaccaaaugagcguggauuaucccgaauccgaggaaauucugcgcucuagcauggcugggaaagccgucgcgaucacgcagucccccagcucugugagacugccucccgcugccgccgagcauuccccucagacagcugccggaaugccgagcguugcgucuccccacccugacccccaggagcaaaagcagcagauuacccuccagccuacccccggccuuccguccccucauacacaccuguuuagccaucugccccuccauucucaacagcagucccggaccccuuacaacauggugcccgucggcgggauccacgugguuccggccggacugacauacagcaccuucgugccucuucaagcuggccccguccagcugacgauucccgccgugucugucgugcaucgcacacucgggacccacagaaauacaguuaccgaaguguccggaacgaccaacccugcuggcguggccgagcugagcuccgucguucccuguaucccuauugggcagauccgggugccgggacugcagaaucucagcacacccggccuucaaucucugccuagccuguccauggaaaccgugaacaucgucggccucgcuaauacaaacauggcgccccaggugcacccucccgggcuggcgcuuaaugccguuggacuccaggugcucaccgcuaacccuucuagccaguccucuccggcgccccaagcucauauuccuggccugcagauccugaauauugcccuccccacacuuaucccuagcgucucccagguggccgucgaugcucagggggcgcccgagaugccggccagccaaucuaaggcuugcgaaacccagccuaagcagacguccguggccagcgccaaccagguuucucgcacagagagcccccaaggacugcccaccgugcagagagagaaugcuaagaaaguccugaacccucccgccccugcgggcgaccacgcccggcucgaugggcugagcaagauggacaccgaaaaagcugccucugcuaaucaugugaagccgaaacccgagcuuacauccauucagggacaaccugccagcaccucccagccccugcucaaggcgcacucugaaguuuucacaaagccuagcggccagcagacgcugucccccgaucgccaagugccgagaccuaccgcccugccccggagacagccuacaguccauuuuagcgacgugucuuccgacgaugacgaggaucgccucgugaucgcuaccuga

SEQ ID NO: 70295 - RNA, 7341 nt, Artificial Sequence
  derived and/or modified sequence opt5 from HIVEP2__Homo_sapiens__NP_006725
auggacaccggcgauacagcccuggggcagaaggcuacgagcagauccggcgagaccgacaaagccucuggccgguggagacaggaacagagcgcggugaucaagauguccacauucgggucucacgagggacagagacagccccaaauugaaccugagcagaucggcaacaccgcuagcgcccagcucuuuggguccggaaaacuggccucuccgagcgaagucguucagcaaguggcugagaagcaguaucccccucaucggcccuccccuuacagcugccagcacucucuuuccuucccccagcauagccugccucaaggcgugaugcacucuacaaaaccgcaucagucccucgagggacccccuuggcuguuucccgggccucuucccagcgucgccucugaagaucuguucccguuuccuauucacggacacuccggcggguacccccgcaagaagaucagcucccucaauccugcuuauucucaguacagccaaaaauccauugagcaggccgaagaggcccauaagaaagagcacaagcccaaaaagcccggaaaguauaucugcccuuacugcagcagagccugugcuaaaccgucugugcugaagaaacauauccggucccacaccggcgaacgccccuauccuugcauucccuguggguucagcuuuaagacaaaaucuaaccuguacaagcacagaaaaagccaugcccacgcuaucaaggccggacucguuccuuucaccgaguccgcggugucuaagcuggaccuugaagccggcuuuauugaugucgaggcugaaauccauagcgacggcgagcaguccacggauaccgacgaggaaagcucucuguucgccgaggcuuccgauaaaaugagccccgggccgccuauuccccucgacaucgccucucggggaggcuaccacgggucccuggaagagagccuuggaggcccuaugaaggugcccauucugaucaucccuaaauccgggauuccccucccgaaugaaucuagccaguauaucggaccugauaugcugcccaaccccucccugaauacaaaggccgacgauucucauaccguuaaacaaaagcucgcucugcgccuuagcgagaagaaaggccaggacuccgagccuagccugaaccuccugucuccgcacuccaagggcagcacagacucuggguacuuuuccagaagcgaaucugcggagcagcagauuuccccucccaauaccaacgccaaauccuaugaagagaucauuuucggaaaguacugccggcuuagcccccgcaaugcucugucugugacgacaaccucccaagaaagagccgccaugggccggaaagggaucauggagccucucccccacgucaacacacgccuggaugugaagauguuugaggacccugugagccagcugauccccuccaagggagaugucgacccgucucagaccagcaugcucaaauccaccaaguucaauucugaaagcagacagccucaaauuauccccuccucuauucggaacgagggcaaacuguauccugcuaauuuccaggggagcaaccccguucuucuggaagccccgguggauuccagcccucucaucagaucuaauuccgugcccacaagcucugcgacgaaccugaccauuccucccucccuucgcggcagccauucuuuugacgagcggaugacaggauccgaugacgucuucuaccccggcaccguggggaucccuccgcagagaaugcugcgccggcaggcugccuuugagcuccccagcguucaagaaggacacguggaggucgaacaucacggcagaaugcugaaggggaucuccagcucuagccugaaagagaagaagcucuccccuggagaucgcgugggcuaugacuacgauguuugucggaaacccuacaagaaaugggaagacucugagacaccuaagcagaacuauagagacauuagcugccuguccucucuuaaacacgggggcgaguacuucauggaucccguggucccucugcagggagugccgagcauguuuggcaccacgugugaaaaucgcaagcggagaaaagagaaguccgucggggacgaagaggauacacccaugaucugcucuagcauuguguccaccccuguuggaaucauggccagcgacuaugaucccaagcuccaaaugcaggaaggcgugcgcucuggguucgcuauggccggacaugagaaccugucccacggccauaccgagcgguuugacccuuguagaccccagcugcagccggggagcccuucucuugucuccgaagagagccccuccgcuauugauucugacaaaaugagcgaucucggcggacggaagcccccuggcaaugugaucuccguuauucaacacacaaacagccugucucgccccaauuccuucgaaagaagcgagucugccgaacugguggcgugcacccaggacaaagccccuagcccguccgagacaugcgauucugagaucagcgaagcucccgucuccccugagugggcgcccccuggggacggagcugaaucuggcgggaagcccagcccgucccaacaggugcaacagcagagcuaccauacgcagccucggcucgugagacaacacaacauccagguucccgagauucgcgucaccgaggaaccugauaaacccgagaaggaaaaggaggcccagucuaaagaaccugagaagcccguggaggaauuucaauggccgcagcgguccgagacacugagccagcuuccugcggaaaaacugccgcccaagaaaaagagacuccgccuggccgacauggagcacuccucuggagaaagcuccuucgagucuaccggcacagggcugagcagauccccuagccaggagucuaaucuuucccauagcucuagcuuuagcaugucuuucgaacgggaggaaaccagcaagcucuccgcucugccgaaacaagacgaguuuggcaagcacucugaguuccugacggugcccgccggaagcuauucccucagcgucccuggccaucaccaucagaaagagaugcgcagauguuccucugagcagaugcccugcccucaccccgcugaagugccugagguucggagcaaguccuucgauuacgggaaccugucucacgccccggugagcggagccgcugcguccaccgucucucccagccgcgaacgcaaaaaguguuuucuugugcggcaggccuccuucagcggcucuccugagaucucccaaggggagguuggaauggaccagagcgugaagcaggaacagcuggagcaucuccacgcuggccugcgcucuggcuggcaucacgggcccccugccguccugcccccgcuucaacaggaagauccuggaaaacagguggccggccccugucccccucucuccagcgggccccugcaccuggcucagccucaaauuaugcauauggacucucaggagucccucagaaauccgcugauccagcccacaagcuauaugaccuccaagcaccuuccugaacaaccccaucuguuuccucaccaggagacaauucccuucagcccgauccagaacgcccucuuucaguuccaauacccuaccguuuguauggugcaucugcccgcgcagcagccucccugguggcaggcucacuuuccucaccccuucgcccaacauccgcagaaaucuuacggaaagccuagcuuucagacggagauccacuccucuuauccccuggaacaugucgccgagcacacaggcaaaaagcccgcugaauacgcccacaccaaagagcagacauauccuugcuacagcggggcguccggacuucauccgaagaaucuccugcccaaguucccuucugaucaaagcuccaaaucuaccgaaacccccagcgaacaggugcugcaggaggacuuugcuuccgccaacgccggcagccuccaaucucugccuggcacagugguccccguucggauucagacgcacgugccuuccuaugggagcgugauguacaccucuaucucccagauucuuggacagaauagccccgcuaucgucauuuguaagguggaugaaaacaugacacaacgcacccugguuacaaaugccgcuaugcagggcaucggguucaacaucgcccaggugcucggacagcaugcgggccuggagaaauauccgauuuggaaggccccucaaacccugccccuugggcuggaauccucuaucccucucugccugcccagcacguccgacagcgucgcuacacucggaggcucuaaaagaaugcuguccccggccagcucucuugagcuguuuauggaaaccaagcagcagaagcgggugaaagaggagaagauguacggccagauuguugaagaacucagcgcuguggaacugaccaacuccgauaucaaaaaggaccugucuagaccucaaaaaccccagcuuguccgccaggggugugccagcgagcccaaggauggacugcaguccggcucuagcuccuucagcucucucuccccuagcuccucucaagacuaccccagcguguccccuucuagccgggagccguuccugcccuccaaggaaaugcucagcgggucuagagccccucugcccggacagaaauccagcggcccuucugaguccaaggaaagcucugaugagcuugacauugacgaaacagcuuccgauaugagcaugucuccccagagcuccagccugccugcgggggacggacaacucgaggaggaaggcaaaggccacaagcgcccgguugggaugcuggugcggauggccuccgcucccucuggaaaugucgccgauagcacccugcuucugacagacauggccgauuuucagcagauccuccaguucccuucccugagaacgaccacaaccgugucuuggugcuuucucaacuauacaaaacccaauuacgugcaacaggcuaccuucaagagcuccgucuaugccucuugguguaucagcuccugcaacccuaaucccagcggccugaacacgaagaccacacuugcgcugcugcgcucuaaacagaagauuaccgcugagaucuacacacucgccgccaugcaucggccggggaccggaaaacugacauccagcucugcuuggaagcaguuuacccaaaugaaaccugacgccuccuuccuuuuuggcagcaagcuggaaagaaagcucguugggaauauucugaaagagcgcggaaagggcgauauccacggcgacaaagauauugggucuaagcagacggaacccauccggauuaaaaucuucgagggaggcuauaaguccaacgaggacuacguguaugugagagggcggggacgcggcaaauacaucugcgaagagugugggauuagaugcaagaagcccagcaugcucaaaaagcacauccggacacauaccgauguccgcccuuacguguguaaacugugcaauuuugcguucaagaccaaaggaaaccuuacaaagcacaugaagucuaaagcucauaugaagaaaugucuggaacugggcguuuccaugaccagcguggacgacacggagacagaagaggccgagaaucucgaagaucugcacaaggccgcugagaaacacagcauguccucuauuagcaccgaccaucaguuuuccgaugccgaagagucugacggcgaggauggggacgauaacgacgaugacgaugaagacgaggaugacuucgacgaucagggagaccuuacacccaagaccagaagccgguccacaucuccucaaccgcccagauucagcucccugccugucaaugugggcgcuguuccccacggggugccuagcgauucuucccucggacauagcucucugaucuccuaucucgucacccugcccagcauucgcgugacgcagcuuaugaccccguccgacucuugcgaagauacacagaugaccgaguaccaacggcuguuucagagcaaguccacagacucugaaccugauaaagacagacuggauauccccagcuguauggacgaggagugcaugcucccuuccgaacccuccucuagcccgcgcgauuucagcccuucuagccaccauuccucucccggcuaugacagcucccccugucgggauaacagcccuaagagauaccugauccccaaaggggaccuuucuccucgccggcaccuguccccgagacgcgaccucagccccaugagacaccuguccccucggaaggaggccgcgcuccgcagagaaaugucucagcgggaugucagcccccgcagacaucuguccccucggagacccgugucuccuggaaaagacauuaccgcccgccgggaucuuagcccgagacgcgagcggagauauaugacgacaauccgggcucccuccccucgcagagcccuguaccacaaucccccucugucuaugggccaguaucuccaagcugaacccauuguucugggcccgccuaaccuucggcgcgggcugccccaggugcccuacuuuagccucuacggagaccaggagggcgccuaugagcauccuggguccagccuguuccccgaaggaccuaacgauuacgucuuuucucaucugccccuccacucccagcaacaggugagagcccccaucccuaugguucccgugggcgggauucagaugguccacagcaugccucccgcucuuucuucccugcacccgagcccuacccugccccucccuauggagggcuucgaagagaagaagggagcgucuggcgagagcuuuuccaaagaccccuaugugcugagcaagcagcaugagaaacgggggccucacgcccuucaauccucuggacccccgagcacacccuccucuccucgccugcucaugaagcagagcaccuccgaggauucucugaaugcuaccgaaagagagcaggaagagaacauccaaacaugcacgaaagccaucgccagccugcggauugcuaccgaggaagccgcgcuccuuggccccgaccagccugcucgcgugcaggagccgcaucagaauccccugggguccgcccacguuagcaucagacacuucucucggccugaacccggacaaccuuguacauccgccacccaucccgaucugcacgacggcgagaaggauaacuuugggacaagccagaccccucucgcucauucuacguucuacuccaaaagcugcgucgacgacaagcagcuggauuuucacucuuccaaggaacuuuccucuagcacagaggagagcaaagaccccuccagcgaaaagucucagcugcauuga

SEQ ID NO: 70296 - RNA, 2085 nt, Artificial Sequence
  derived and/or modified sequence opt5 from HJURP__Homo_sapiens__NP_001269891
augcugggcacccucagagccauggagggggaagacguggaggaugaccagcugcuucaaaagcugcgggcuagccgcagacgguuccagcgcagaaugcagcggcucaucgaaaaauacaaccagcccuuugaggauacaccugucguucaaauggccacgcugaccuaugaaacaccgcagggacuucgcauuuggggcgggagacugaucaaggagcggaaugagggagaaauucagcccgcggugccucagagcccccucaaaaacgagcugcgcagaaaguaccugacccaaguggacauccuccugcagggcgcugaauauuucgagugcgccgggaaucgggccggacgcgaugucagagugacaccucuucccucucuggcuagcccugccguuccggcucccggcuacuguucccggauuucucgcaaaagcccuggcgaccccgccaagccugcguccucucccagagagugggauccgcuccacccuagcuccaccgacauggcccuggugccccggaacgauagccuuucucugcaggaaacauccuccucuuccuuucucagcucucagccuuucgaggacgaugacaucugcaaugucaccaucuccgaucuguaugcugggaugcugcauagcauguccagacuccugucuacgaagcccagcuccauuaucagcaccaaaacauuuauuaugcaaaacuggaauagccgccggagacaccgcuacaagucccggaugaacaaaaccuauuguaagggagccagacgcagccagcggucuagcaaagaaaauuucauccccugcuccgagccugugaagggcacaggggcucuuagagacuguaagaacguucuggacgugucuugccgcaaaaccggacucaagcuggaaaaagccuuucuugaggucaaucggccgcagauucauaagcuggaucccagcuggaaagagagaaaggugacgccuuccaaauacagcucucucaucuacuucgacuccagcgcgacauauaaccuggaugaagagaaucgcuuucggacccugaaguggcucauuucucccgugaagaucgucuccagaccuacaauccggcaaggccacggggaaaaccgccagagagagauugaaauccgguucgaccagcugcauagagaguacugucuuagcccccgcaaucagccgcggagaaugugccugccugauuccugggccaugaacauguaucgcggaggccccgcuucuccuggcgggcuccaaggacuggagaccagacggcuuagccugcccuccucuaaagccaaggcuaaaagccucuccgaagccuuugagaaccugggcaagcgcagccuggaagccgggagaugucucccuaaaucugacuccucuucuucccugcccaagaccaauccgacacacagcgcuacgcggccucagcagaccucugaucuucacguucagggaaacagcuccggcauuuuccgcaagagcgugucucccuccaaaacacugagcgugcccgacaaggaggucccugggcauggaagaaaucgguacgaugaaaucaaagaggaguuugacaagcuccaccaaaaauauugccugaaguccccgggccagaugaccgugccccuguguauuggcguuucuacagauaaggcgagcauggaagugcgcuaccagaccgagggguuccuuggaaaacucaacccugacccccauuuccagggcuuucaaaagcugccuuccucuccccuggggugcagaaaaagccuccugggauccacggccaucgaagcuccuucuagcacaugcgucgcccgggccaucacccgcgacggcaccagagaucaccaguuccccgcuaagcggccgagacuuuccgagccucaggggagcggccgccagggaaauucucugggcgccuccgacgggguggauaacacaguucggcccggagaccaaggcucuagcucccagccuaauagcgaggaaagaggggagaacaccucuuaucgcauggaagagaaauccgauuuuaugcucgaaaagcuggagacaaagagcguguga

SEQ ID NO: 70297 - RNA, 2754 nt, Artificial Sequence
  derived and/or modified sequence opt5 from HK1__Homo_sapiens__NP_000179
augaucgccgcucagcugcucgccuacuauuucaccgagcugaaggacgaucaagugaaaaagauugacaaauaccuuuaugcgaugagacugagcgaugaaacacucaucgacauuaugacgcgguuucgcaaggagaugaaaaacggccuguccagagauuucaaucccaccgcuacagucaagaugcuuccuaccuuuguucggucuaucccggacgggagcgaaaagggagauuucauugcccuggaccucggcggguccucuuuucgcauccugagaguccaggugaaccacgagaaaaaucagaacgugcauauggaaagcgagguguacgauacacccgagaauaucguucacggauccggcucucagcuguucgaccauguggccgaaugccucggggauuuuauggagaagcggaaaauuaaggacaaaaagcugccugucggauucaccuuuagcuuccccugucaacaguccaagaucgaugaagcuauucuuaucacauggaccaaacgcuuuaaggccagcggcguggagggcgcugacguugugaaacugcucaacaaggccauuaaaaagagaggggacuaugaugcgaauaucgucgccguggugaacgacacggucggaaccaugaugacaugcggcuacgaugaccagcacugugagguugggcugauuaucggaaccggcacaaaugcuugcuauauggaagaacuucggcauaucgaucugguggaaggggacgagggacgcauguguauuaacaccgaauggggcgccuucggcgaugacgggucucucgaggauaucagaacggaguuugaccgggaaauugaucgcggaucccugaauccuggcaaacagcuguucgagaagauggugagcgggauguaccucggagaacuggucagacuuauccuggugaagauggcuaaagagggccuccuguucgaagggcggauuacacccgagcuucugacccgcggaaaguuuaacacaucugacguuuccgccaucgagaaaaauaaggaaggccuccacaacgcgaaagagauccugaccagacugggcguggaaccuagcgacgaugacugcgucucugugcaacacguuuguaccauuguguccuuccggagcgccaaucucgucgcugccacacugggggcuauccuuaacagacugcgcgauaacaagggaacgccgcggcucagaaccacagugggcgucgacgggucccuguacaagacccauccccaguauucucgccgguuucacaaaacacuuagacgccuggugccugauagcgacguucgguuccuccuguccgagagcggaucuggcaagggggccgccauggugaccgcugucgcguacagacuggccgaacagcaucgccagauugaggagacgcucgcucacuuucaccugacaaaagauaugcuucuggaagugaagaaacggaugagagccgagauggaacucggccugcgcaagcaaacccauaauaacgccguugugaagaugcugcccuccuucguccggagaaccccugacggaacagagaauggcgauuuucuugcucucgaccugggaggaaccaacuuccgggugcugcucgugaaaauccgcagcggcaagaaaagaacaguugagaugcacaauaagauuuaugccauccccaucgaaauuaugcaggggacgggagaggaacuguuugaucauaucgucucuugcauuagcgacuuccuugauuacaugggcaucaaagggccgcggaugccucugggcuuuaccuucuccuuucccugucagcaaacaucucucgacgcggggauucugaucaccuggacaaagggcuucaaggcuaccgacugcguggggcacgauguggucacgcugcuuagagacgccauuaaacgccgggaggaguucgaucucgacgugguugccguggucaacgauaccgugggaacaaugaugaccugugcuuaugaggagccuacaugcgaaguuggccugaucguggggaccggaagcaaugccugcuacauggaggaaaugaagaacgucgagaugguggaaggcgaccaggggcagauguguaucaauauggaguggggcgcuuuuggagauaacggcugccuggacgauauuagaacgcauuaugaccgccucguugaugaguacucccugaaugccgggaaacagagauacgaaaagaugaucagcggaauguaucuuggcgagauugugcggaacauccugauugacuucacaaagaagggguuucucuuccgcggacaaaucucugaaacccugaaaacaagaggcaucuuugagaccaaguuccugucccagauugaaagcgaucggcuugcgcuccugcagguccgcgccauccugcagcaacucgggcuuaauucuaccugugacgacuccauucuggugaagacagugugcggcgucguuagcagacgggcugcccagcuguguggagcuggcauggccgcggugguggauaaaauccgcgagaacagagggcucgaccggcugaaugucacggugggaguugauggcacccuguacaaacuucacccccacuuuucccgcauuaugcaucagacagugaaagagcucucucccaagugcaacgucagcuuccugcuguccgaagacgggucuggaaaaggcgccgcucucaucaccgccgugggcguuagacugcggacagaggcuagcuccuga

SEQ ID NO: 70298 - RNA, 2754 nt, Artificial Sequence
  derived and/or modified sequence opt5 from HK2__Homo_sapiens__NP_000180
augaucgccagccaucugcucgcuuacuucuuuaccgagcugaaccacgaccaggugcaaaaggucgaucaguaucuuuaccacaugagacuguccgacgaaacacuccuggagauuucuaaacgguuccgcaaggaaauggagaaaggccuuggggccacgacccaucccacagcggcuguuaagaugcugccuaccuuugugagaagcacaccggauggaaccgaacacggcgaguuccucgcccuggaccucgggggaacaaauuuucgggugcugugggucaaagugaccgauaacggccugcagaagguugagauggaaaaucagaucuaugccauucccgaggacaucaugcgcggguccggaacgcaacuuuucgaucauauugcugaaugccuggccaacuuuauggacaagcuccagaucaaagauaagaaacugccucuuggcuucaccuuuucuuuccccugucaccagacaaagcuggacgagagcuuucucguguccuggaccaaaggcuucaagucuagcggggucgagggaagagaugugguugcucugauccggaaggccauucagcgcagaggcgacuuugauaucgacauuguggcggucgugaaugacacaguggggaccaugaugacgugcggauacgaugaccacaacugugaaaucggccugauugucgggacaggauccaaugccugcuauauggaggaaaugcggcauaucgauaugguugagggcgacgaaggccgcauguguauuaacauggaguggggagcuuucggggaugacggcagccucaaugauaucagaaccgaguucgaccaagaaaucgauauggggucucugaacccuggaaaacagcuuuuugagaagaugauuuccggcauguacaugggggaacuggugcggcucauccuggugaaaauggccaaggaggaacuucuguucggaggcaaacucagccccgagcugcugaauacaggccgcuuugagaccaaggacauuucugauaucgaaggggagaaagacggaauuagaaaggcucgggaaguccucaugcgccugggccuugacccuacccaggaggauugcguggccacacacagaaucugucagaucguuuccacgcggagcgcgucucugugcgccgcuacccucgccgcugugcugcaaagaauuaaggaaaacaaaggggaggagcgccuucgguccacaaucggagucgacggcagcguguauaagaaacauccgcacuucgccaagagacugcacaaaaccguucgccggcucgugcccgggugugaugucagauuucugcgcuccgaagacggcucuggaaagggcgccgcuauggugacagcggucgccuaccggcuggcugaucagcauagagcccgccagaagacccucgagcaucugcaacuuagccacgaccagcugcucgaagugaaacggagaaugaagguugagauggagcgcgggcuguccaaagaaacgcacgccagcgcuccugugaagaugcugcccacauacgucugcgccaccccugauggaaccgagaaaggcgacuuccuugcgcucgaucucgggggaacaaauuuucgggugcugcugguuagagugcggaacggcaaguggggcggggucgaaaugcauaauaagauuuaugcuaucccccaggaggugaugcacggaaccggcgacgaacuguucgaucacauugugcaguguaucgccgacuuucuugaguacauggggaugaaaggaguuucucugccgcucggcuucacauuuuccuucccuugccaacagaacagccuggaugagucuauccugcuuaaguggacgaaaggguuuaaggccagcggaugcgaaggcgaggacgucgugacccuccugaaagaagcuauucaucgcagagaggaguucgaccuggauguggucgccgugguuaacgacacaguggggaccaugaugacauguggcuucgaagauccccacugcgaggucggacucaucgugggcaccggguccaaugcuuguuauauggaagagaugcggaacguugaacugguggagggagaagagggcagaaugugcgucaauauggaguggggagccuuuggggacaacggcugucuugaugacuuccgcacggaauuugauguggcgguugacgagcugucucucaauccugggaagcagcgguucgaaaagaugauuagcggcauguaccugggagagaucgugagaaacauucugaucgauuuuaccaaacgcggccuucucuucagagggcggauuuccgagcgccugaagacaagaggaaucuuugaaaccaaauuccugagccagaucgagucugacugccucgcccugcuucaaguccgggcuauucugcagcaucucggccuggaauccacaugugaugacagcaucauugugaaggaggugugcaccgucguugcccgcagagcugcccagcuguguggggcgggaauggccgcugugguggaucggauccgcgaaaauagaggccuugacgcccucaaagucacggugggcguugacgggacacuguauaagcugcacccccacuuugcuaaagugaugcaugagaccgucaaggaucucgcccccaagugcgacgugucuuuccugcaguccgaggauggaagcggcaaaggggccgcucuuauuacagcgguugccugucggauccgcgaagcuggacaaagauga

SEQ ID NO: 70299 - RNA, 2772 nt, Artificial Sequence
  derived and/or modified sequence opt5 from HK3__Homo_sapiens__NP_002106
auggacagcaucggcuccucugggcugagacagggagaggaaacccucagcugcuccgaggaaggccugcccgggccuucugauagcuccgagcuugugcaagaaugucugcagcaguucaaggucacacgggcccagcuccaacagauucaggcuucucugcuuggaagcauggagcaggcccugcgcggccaagcguccccggcucccgccguuagaaugcucccuacguacguggggagcacaccccacggaaccgagcagggcgacuuugugguccuggaacugggcgccaccggggcuucucuccgggugcuguggguuacacuuaccggaaucgagggccaucgcguggaaccuagaucccaggaguucgucauuccccaggaggugaugcugggggccggacaacagcucuuugauuucgcugcccacugccugagcgaauuucuugacgcgcagccuguuaacaaacaaggccugcagcucggguucucuuuuuccuucccgugucaucagacaggacuggaucggagcacccugaucucuuggacgaagggcuuucgcugcuccggcguggaggggcaggacgucgugcaacuccugagagaugccauucggcgccagggagcuuauaauaucgacguggucgccguugugaacgauaccgugggcacaaugauggggugugaacccggagucagaccuugcgaggugggccuuguuguggacaccgggacaaaugcuuguuacauggaagaggcccggcacgucgcggugcuggaugaggaccgcggaagaguuugcgugagcgucgaauggggcuccuucucugaugacggcgcccucgggcccgugcugaccacguuugaccauacacuugaucacgagagccugaacccuggagcucagcgguucgagaaaaugaucggcgggcucuaucugggagagcugguccgccucgugcuggcccaccuugcuagauguggcguucuguuugggggcugcaccucccccgcccuccugagccagggaucuauucuucuggaacauguggccgagauggaggacccguccacaggcgcugcgcggguccacgccauccuccaagaucuggggcugagcccuggagcuucugacguggaacucguucagcaugugugugccgccgucugcaccagagcugcccagcugugcgcggcugcccuugccgcugugcugagcugucuccagcacucccgcgagcaacagacccugcaaguggccguugcuacaggcgggcgggucugcgaaagacacccccgcuucuguucugugcugcagggaacggugaugcuucucgccccugagugcgaugucagccugauucccuccguggacggcgggggccggggaguugcgauggugaccgccgucgcugccagacuggcugcccaucgccggcuccuggaagagacacuugcgcccuucagacugaaucacgaucaacucgccgcugugcaggcccagaugcgcaaggcuauggccaaaggccugagaggggaggccagcucucugcggaugcuuccuaccuuuguucgcgcuacaccggacggauccgaacggggcgauuuccucgcgcuggaccucgggggaaccaacuuuagagugcugcugguccgggugacgacaggcguucaaaucaccagcgagauuuacucuauccccgaaaccguggcccagggguccggccagcagcuuuucgaucauauugucgacuguaucguggacuuucaacagaagcagggacugagcggccagucccucccucugggguucacauuuucuuuccccugccgccaacugggacuugaucagggcauccuccugaauuggaccaagggguuuaaagcuagcgacugugagggacaggauguggucucccugcucagagaggccauuacacggagacaggccguugaacugaacgugguggcuaucgucaaugacacggugggcaccaugaugucuugcggguaugaggauccucgcugugaaauuggccuuaucguuggaacaggcaccaacgccugcuacauggaggaacugcggaauguggcggggguccccggagacagcggcagaauguguauuaacauggaguggggagcuuucggggaugacggcucccucgccaugcugagcacacgcuuugaugccucuguggaccaggcuuccaucaauccgggcaagcagagauucgagaaaaugaucagcgggauguaucugggagaaauuguucggcacauccuucuccaucugaccucucugggcgugcucuuucgcgggcagcaaauucagagacugcagacgcgggauaucuucaagaccaaauuccuuuccgagauugaaagcgacucucuggcccuccgccaggucagagcgauccuggaggaucugggacuuccucugacaagcgacgacgcucucauggugcuggaaguuugccaagccgugucccagcgggccgcucagcucugcggcgccggggucgcugccgugguggagaagauccgcgagaacagaggacuggaagaacuugcggucagcguuggcguggauggcacccuguacaagcuccacccccgguuuucuucccugguggccgcuacaguccgcgaacuggccccuagaugugugguuaccuuccuucagagcgaggacggguccggaaaaggcgcugcccuggugacggccgucgcuugccggcucgcgcaacugacaagaguguga

SEQ ID NO: 70300 - RNA, 2754 nt, Artificial Sequence
  derived and/or modified sequence opt5 from HKDC1__Homo_sapiens__NP_079406
auguucgccgugcaccugauggcuuuuuacuucagcaagcucaaagaggaccagaucaagaaagucgauagauuucuguaucauaugcggcuuuccgacgauacccugcucgacauuaugcgcagauuccgggccgaaauggagaagggccuggcgaaagauacaaaccccacggcugccguuaagaugcuuccuaccuuugugcgcgccaucccggacgggucugaaaauggagaguuccugagccucgaucugggcggguccaaguuuagagugcugaaaguccaaguggcugaagagggaaagcggcacguucagauggagucucaguucuaccccacaccuaacgaaauuauccgcggcaaugggaccgagcucuuugaauauguggccgacugccuggcugauuucaugaaaacaaaggaccuuaaacauaagaagcugccccucggacugaccuuuagcuucccuuguagacagacaaaacuugaggagggcguccugcucuccuggaccaagaaauuuaaggcccggggcgugcaagauacggacguugugucucgccugaccaaagcgaugagacggcacaaggauauggacgucgacauucuggcccucgugaacgauacaguggggaccaugaugacaugcgcuuacgacgaucccuauugugaagucggaguuaucaucggcaccgggacgaaugccugcuacauggaggacaugagcaacauugaucugguggaaggagacgagggccgcauguguaucaauacagaauggggagcuuucggggaugacggcgcccuugaggauauuagaaccgaguucgaccgggaacuggaucucggcucccugaacccugggaaacagcuuuuugagaagaugaucagcggacuguaucucggcgaacuggugcgccugauucuccugaagauggcgaaagccgggcuucuguucggaggcgagaagucuuccgcucuccauacaaaagggaagaucgaaaccagacacgucgccgcuauggagaaauacaaggagggacuggccaauacccgggaaauucuuguggaccugggccucgagccgagcgaagccgacugcaucgcuguucagcacguguguacaaucgucucuuuuagauccgcgaaccugugcgccgcugcccuggccgcuauucucacgcgccugcgggagaauaagaaaguggaaagacuucgcaccacaguuggcauggaugggacccuguacaagauccauccccaguauccuaaacggcuccacaagguggucagaaaacuggugcccagcugugacguccgcuuccugcuuucugaguccggaagcacaaagggcgccgcgauggugaccgcuguugccucccgggugcaagcccagagaaagcagauugaucgcguccucgcucuguuucagcugacgcgggagcaacucguggacguucaggccaaaaugagagcugaacuggaguacgggcuuaagaaaaagucucauggacuggccacagugcgcaugcucccuaccuaugucugcggccugcccgaugggaccgaaaaaggcaaguuccuggcgcuugaccucggaggcacaaacuuucgggugcugcuggugaagaucagaagcgggcggcgcuccguuagaauguacaauaaaauuuucgccaucccgcucgagaucaugcagggaaccggcgaggaacuguuugaucacauuguccaauguaucgcugacuuccuugauuauauggggcugaagggagccagccucccucugggcuuuacauucucuuuucccugccggcagauguccauugacaaagggacgcugaucggcuggaccaagggauucaaagcuacagauugcgagggcgaagacgugguggauaugcuuagagaggccauuaagcgccggaacgaguucgaccucgacaucgucgcggugguuaaugauaccguggggacaaugaugaccuguggauacgaagacccuaacugcgagaucggccugauugccgggacgggaagcaacauguguuauauggaagauaugagaaauaucgagauggucgaaggcggggagggcaaaaugugcauuaacaccgaauggggaggcuuuggggacaauggauguaucgaugacauucgcacaagauacgauaccgagguggacgagggcucucugaaccccgggaagcagcgguacgaaaagaugacaagcggaauguaucucggcgagaucguucgccagauucugaucgaucuuaccaaacaagggcugcuguucagaggccagaucuccgaacggcugcgcacgagaggaauuuuugagacaaaguuccugucucagaucgaaagcgaccggcuugcucuccuccaggugcgccggauucugcaacagcucggccuggauuccacaugcgaggacagcaucgucgugaaagagguuuguggggccgugucuagacgcgcugcccagcuuugcggagccggccuggcugcgauugucgaaaagagacgggaggaucaggggcucgaacaccugagaaucaccgugggaguggacggcacccuguacaaacuucauccccacuuuucccgcauccugcaagagaccgucaaggagcucgccccucggugugacguuacauucaugcugagcgaagauggcucugggaagggagcugcccucauuacggccguggcuaaaagacugcagcaggcccagaaggagaauuga

SEQ ID NO: 70301 - RNA, 1098 nt, Artificial Sequence
  derived and/or modified sequence opt5 from HLA-A__Homo_sapiens__NP_001229687
auggccgugauggcucccagaacccugcuccugcuucugagcggcgcccucgcgcugacacagacgugggcugggucccacucuaugcgguacuucuuuaccagcgucucccgcccuggaagaggcgagccgcgguucaucgccguuggguauguggacgauacacaauuugugcgcuucgacucugaugccgcuagccagaagauggaacccagagccccuuggauugagcaggaaggacccgaguacugggaccaggaaacccggaacaugaaagcucauucccaaacagaucgcgccaaucuuggcacccugagaggguauuacaaccagucugaggacggaagccacacaauccagauuauguauggcugcgaugucggcccugacgggcgguuucuccgcggauacagacaggaugcguaugacggcaaggauuacaucgcccugaaugaggaccugcgguccuggaccgcugccgauauggcugcccaaauuacgaaacgcaagugggaagcggugcaugccgcugagcagagacggguuuaccucgaagggcgcuguguggacggacugagacgguaucuugagaacggcaaagagacccugcagagaacagaucccccuaagacccacaugacacaucacccgaucagcgaccacgaagccacccuccgcugcugggcucugggguucuaccccgccgagaucacgcuuacauggcagcgggacggagaagaucaaacccaggacacagagcuggucgaaaccagaccugccggcgauggcaccuuucagaagugggcugcggugguugugcccucuggggaggagcaacgcuauacaugucauguccagcacgaaggacucccuaaaccccugacgcugcggugggagcucuccagccagccgaccauuccuaucgugggcauuaucgccgggcuggugcuucugggagcugucauuacaggcgccguuguggccgcugugauguggagacgcaagucuuccgaccggaaagggggaagcuacacccaggccgcgucuuccgauagcgcucaaggcuccgacgucucucucacagccugcaagguguga

SEQ ID NO: 70302 - RNA, 1089 nt, Artificial Sequence
  derived and/or modified sequence opt5 from HLA-B__Homo_sapiens__NP_005505
augcuggugauggcccccagaaccguccuccugcuucugagcgcugcccucgcgcugacagagacgugggcuggcucccacucuaugcgguacuucuauaccagcguuucccgcccugggagaggagaaccgcgguuuaucucugugggcuacguggacgauacacaguucguccgcuuugacagcgaugccgccucccccagagaggaaccucgggcucccuggauugagcaagaagggccugaguauugggaccgcaacacccagaucuacaaggcccaggcucagacagauagagagucucuucggaaucugcgcggauauuacaaccaaagcgaagccggcucccauacccuccagagcauguaugggugcgacgugggacccgauggcagacugcugcggggccacgaccaguacgcguacgaugggaaggacuauauugcccucaaugaggaucugcgcucuuggacagcugccgacaccgcugcccagaucacgcaaagaaagugggaagcggcccgggaggcugagcagcgcagagccuaccuugaaggagaguguguugaauggcugcggagauaucucgagaacggcaaagauaagcuggaacgcgcugacccuccgaaaacccaugugacacaccaucccauuuccgaccacgaggccacccuucggugcugggcccugggguucuacccugcugagaucacacucaccuggcagagagauggagaagaccagacgcaagauacagagcuggucgaaacccgccccgcgggcgaccggacauuucagaagugggccgcugugguugugccuagcggggaggaacagagauauaccugucacguccaacaugagggacugcccaagccgcucacccugcgcugggagccuucuucccagagcacagugcccaucgugggcauugucgccggccuugccguucuggcugugguggucaucggggccgugguugcggcugugaugugccggagaaaaucuuccggaggcaaagggggaagcuacucccaggccgccuguucugauagcgcucagggcuccgacgucagccucacggccuga

SEQ ID NO: 70303 - RNA, 1101 nt, Artificial Sequence
  derived and/or modified sequence opt5 from HLA-C__Homo_sapiens__NP_001229971
augagagugauggcuccccgggcccugcuccugcuucugagcggcgggcucgcccugaccgagacaugggcgugcucccacucuaugcgcuacuucgacacggcugucagcagaccuggacggggcgaaccgcgcuuuaucuccguuggguacguggaugacacccaguucgugagauuugauucugacgccgccagcccccggggagagccucgcgcucccugggucgaacaagagggcccugaauacugggauagagagacacagaacuauaagcggcaggcccaggcugaccgcgugucccuuagaaaucugcggggguacuauaaccaaucugaggauggaagccauacccuccagcgcauguacggcugugaccugggccccgaugggagacugcuccggggauaugaccaguccgccuacgauggcaaagacuacaucgcgcugaaugaagaucuucgcagcuggacagccgcugacaccgccgcucagaucacacaaagaaagcuggaggccgcgcgggccgcugaacagcucagagccuaucuggaggggaccugcguugaguggcuucgccgguaccuggaaaacggaaaagagacgcuccagagagcugaaccuccgaagacccacgugacacaucacccccugucugaccaugaggccacccugcgcuguugggcccucggcuucuauccugcugaaauuacacugaccuggcagcgggauggggaggaccaaacgcaggauacagagcuugucgaaaccagacccgcgggagacggcacauuucagaaaugggccgcugugguugugccuuccggccaagagcagcgcuauaccugccacaugcagcacgaagggcugcaggagccccucacccugagcugggaaccgucuucccaaccuacaauccccauuaugggaaucgucgccggccuugccgugcuggugguccucgcuguucugggggccguggugacggcgaugaugugucggagaaagagcucuggaggcaaagggggauccugcagccaggcugccuguuccaauucugcccagggcagcgaugagucccugauuaccugcaaggcuuga

SEQ ID NO: 70304 - RNA, 786 nt, Artificial Sequence
  derived and/or modified sequence opt5 from HLA-DMA__Homo_sapiens__NP_006111
augggccacgagcagaaccaaggggccgcucugcuccagaugcugccccuucuguggcuccugccucauagcugggccgugccggaagcgcccaccccuauguggcccgacgaucuucagaaucacacauuccugcauacggucuacugccaggacggauccccuucuguuggccucagcgaggcuuaugaugaagaccaacuguuuuucuuugauuucucccagaacaccagagugccccggcugccugaguuugccgacugggcccaggaacagggggaugcuccggccauccucuucgacaaggaguuuugugaguggaugauucaacagaucggacccaaacuggauggcaagauuccugugucucgcggguuccccaucgcugaagucuuuacacuuaaaccucuggaguucggaaagcccaauacccucgugugcuuuguuagcaaccuguucccgccuaugcuuacagugaauuggcagcaccauuccguccccguggaaggcuuuggcccuaccuucguuucugccguggacgggcugagcuuccaggcguuuuccuaccucaacuucacacccgagcccagcgauaucuuuucuuguauugucacccacgagaucgacagauauacggccauugcuuacugggugccucggaaugcccugccguccgaucugcucgaaaacgugcugugcggagucgcuuucggccuugggguucugggaaucauugugggcaucgugcucauuaucuauuuucgcaaacccuguagcggggacuga

SEQ ID NO: 70305 - RNA, 792 nt, Artificial Sequence
  derived and/or modified sequence opt5 from HLA-DMB__Homo_sapiens__NP_002109
augaucaccuuccugccccuccugcuuggccugagccucgggugcaccggagccggcggguuuguggcucacgucgaguccacgugucugcuugacgaugccggaaccccuaaggacuucacauacugcauuucuuuuaacaaagaucugcucaccuguugggacccggaagagaauaagauggcgcccugcgaguucggcguucugaacagccuggcuaaugugcucucccagcaucugaaccaaaaagauacacuuaugcagagacugcggaaugggcuccagaacugugccacccacacacagccuuuuuggggaucucugaccaaucgcacgagacccccuagcgugcaagucgccaagaccacacccuucaacacccgggaaccugugaugcuugcuugcuauguuuggggcuuuuacccggccgaagugacaaucaccuggcgcaaaaauggcaagcuggucaugccccauuccucugcucacaagacggcccagccuaacggggacuggacauaucagacccucagccaucuggcgcugacacccuccuacggagauaccuauaccugugugguugagcacacaggcgccccugagcccauucucagagacuggacgccggggcugagcccuaugcagacccuuaaagugucugucuccgcugugacacugggacucggccugaucauuuucagccuuggggugaucucuuggcggcgcgccggacacuccagcuacacaccccugccuggcucuaauuauuccgaaggcuggcauaucagcuga

SEQ ID NO: 70306 - RNA, 753 nt, Artificial Sequence
  derived and/or modified sequence opt5 from HLA-DOA__Homo_sapiens__NP_002110
auggcccugagagcuggccucgugcugggguuccacacccuuaugacacugcucagcccccaggaggccggagcgacgaaggcugaccauaugggcuccuacgggccugccuuuuaucaaucuuacggagccagcggccaguucacccacgaauuugaugaggaacagcuguucuccgucgaccuuaaaaagucugaggcuguuuggcggcugccggaauuuggggauuucgcccgcuuugacccccagggaggccucgcuggcaucgccgcgauuaaagcccaucuggauauccugguggagagaagcaaccggucccgcgcuauuaaugugccucccagagucacagugcucccuaagucucggguugagcuggggcaacccaacauccuuauuugcaucguggacaauaucuucccuccggucauuaacaucaccuggcugcgcaauggacagacagugaccgaaggcguugcccagaccagcuuuuauucccagcccgaucaccucuucagaaaauuucauuaccugccuuucgugcccagcgcugaggacgucuaugauugucaaguggaacacugggggcuugacgccccucugcuccggcacugggagcuccaggugcccauuccgccucccgaugcgauggagacacuggucugcgcccugggacuggcuaucggccuuguuggguuucuggugggaacggugcucauuaucaugggcaccuacgucucuuccgugccucgcuga

SEQ ID NO: 70307 - RNA, 822 nt, Artificial Sequence
  derived and/or modified sequence opt5 from HLA-DOB__Homo_sapiens__NP_002111
augggcagcgggugggugcccugggucguugcccugcucgugaaccugaccagacuugacuccucuaugacacagggaacggauagcccugaggacuucgugauccaagcuaaggccgauugcuacuuuaccaauggcacagaaaaaguccaguucgugguucgguuuauuuucaaccuggaggaauaugugcgcuuugacuccgaugucgggauguucguggcgcucaccaagcugggacagccggacgcugagcaguggaacucuagacuugaucugcucgaacggagccgccaagccguugacggcguguguagacacaauuaccggcugggggcccccuuuacagucggacgcaaagugcagccugaggugaccgucuaucccgagagaacaccucugcuccaucagcacaaucugcuucauugcuccguuaccggcuucuaccccggcgauaucaagauuaaaugguuucugaacgggcaggaggaacgggcuggagugaugucuacgggcccuauccgcaauggggacuggaccuuccaaacaguggucaugcucgaaaugaccccggagcugggacacguguauacaugucuuguugaucauagcucccugcucagccccgugucugucgaguggagagcccaguccgaauacagcuggcggaagaugcugucuggcauugcugccuuucugcucgggcugaucuuccuucuggugggaaucguuauucagcuccgcgcgcagaagggcuaugugagaacccaaauguccggcaacgaggucagccgggccgugcugcuuccucagucuugcuga

SEQ ID NO: 70308 - RNA, 783 nt, Artificial Sequence
  derived and/or modified sequence opt5 from HLA-DPA1__Homo_sapiens__NP_001229454
augagacccgaggaccggauguuccacauccgcgccgugauucugagagcucucagccuggccuuucuucugucccuccggggcgcgggggcuaucaaggccgaucaugucucuaccuacgccgcuuucguucagacacaccgcccuacgggagaauuuauguucgaguuugacgaagaugagauguucuauguggaccuggauaaaaaggaaaccguguggcaucuugaggaguuuggccaagccuucagcuuugaagcucaagggggacuggccaacauugcgauccucaauaacaaucugaacacacugauucagagauccaaucacacccaggccacaaacgacccgcccgaggucaccguguucccuaaagaacccguugagcucggccagccuaauacacugaucugccauaucgauaaguuuuucccucccgugcuuaacgucaccuggcuguguaauggggagcucgugacggaaggaguugcugagucucuguuucuuccgcggaccgacuacagcuuccacaaauuccacuaucugacauuugugcccuccgccgaagauuucuacgacugccgcgucgagcauuggggccucgaucagccucugcugaagcacugggaagcucaggagcccauucagaugccugagaccacagaaaccgugcucugugcccugggccuugugcuggggcucgucggaaucauuguuggcacggugcugaucauuaagucucuuagaagcgggcaugacccccgggcgcaaggaacacuguga

SEQ ID NO: 70309 - RNA, 777 nt, Artificial Sequence
  derived and/or modified sequence opt5 from HLA-DPB1__Homo_sapiens__NP_002112
augauggugcugcaggucagcgccgcucccagaaccguugcccucacagcgcugcuuauggugcugcucacguccgugguccaaggccgggcuaccccugagaacuaccuguuccaggggcgccaggaaugcuaugccuuuaauggaacacagagauuccuugagcgguacaucuauaaccgcgaagaguuugccagauucgacucugaugugggcgaauuucgggcuguuaccgagcuggggcgcccggccgcugaguacuggaauagccaaaaggacauucucgaagagaaaagagccgugcccgaucggaugugucgccacaacuaugaacugggaggcccuaugacacugcagagacggguccagccccgcgugaauguuuccccuucuaagaaagggccccuccagcaucacaaccugcuugugugccaugucaccgacuucuacccuggaagcauccaagugagaugguuucugaauggccaggaggagacagcgggcguggucuccaccaaccucauucggaauggggauuggacguuccagauccugguuaugcuugaaaugaccccgcagcaaggagacguguauacaugucagguggagcacaccucucuggauagccccgucacaguggaauggaaggcccaguccgacagcgcucgcucuaaaacccucacgggcgccgggggauuuguucugggccugauuaucugcggggugggaaucuucaugcauagacgguccaagaagguccaaagaggcagcgcuuga

SEQ ID NO: 70310 - RNA, 768 nt, Artificial Sequence
  derived and/or modified sequence opt5 from HLA-DQA1__Homo_sapiens__NP_002113
augauccugaacaaggcccuccugcuuggcgcucuggcccucaccacagugaugagccccugcgggggagaggacauugucgcggaucacguugcuuccuguggcgugaaucuguaccaguucuaugggccuucuggacaauacacgcaugaauuugacggcgaugagcaguucuauguggaccuugaaagaaaagagaccgccuggcgguggccggaauuuagcaaguucgggggauuugauccccagggcgcccugcgcaacauggcugucgccaaacacaaucucaacaucaugauuaagagauacaauuccacagcugccaccaacgaggugccugagguuacaguguucucuaaaagccccgucacccugggccagccuaauacacugaucugccucguggacaacauuuuucccccuguugugaauaucaccuggcuguccaacgggcaaucugucacggaaggagugagcgagaccuccuuccuuagcaagucugaucauuccuuuuucaagaucagcuaucugacauuucucccgucugcggacgaaauuuacgauuguaaaguggagcacuggggccuggaccagccccuucugaagcauugggagccugaaauccccgccccuauguccgagcucaccgaaacagucguuugcgcucuggggcugagcgugggacucaugggcauuguggucgggaccguguucaucauucagggacugcggucuguuggcgccucccgccaccagggcccccuuuga

SEQ ID NO: 70311 - RNA, 768 nt, Artificial Sequence
  derived and/or modified sequence opt5 from HLA-DQA2__Homo_sapiens__NP_064440
augauccugaacaaggcccuccugcuuggcgcucuggcccucaccgcggugaugagccccugcgggggagaggacauugucgcugaucacguugccuccuacggcgugaauuucuaucagucucaugggccuagcggacaauacacacacgaauuugacggcgaugaggaguucuauguggaccuggaaacgaaagaaaccgucuggcagcuuccgauguuuuccaaguucaucucuuuugauccccagagcgcccugagaaacauggcuguggggaaacauacacucgaguucaugaugcggcaguccaauucuaccgccgcuacaaacgagguuccugaagugaccgucuuuagcaaguuccccgugacacugggacaaccuaauacccugauuugucucguugacaacaucuuucccccuguggucaauauuacguggcuguccaacggccacagcgugaccgagggcgugucugaaacauccuuccuuagcaaaucugaucauuccuuuuucaagaucagcuaccugaccuuucucccgucugccgacgagaucuaugauugcaaggucgagcacugggggcuggacgaaccccuucugaaacacugggagccugaaauucccgcgccuauguccgagcucacagaaacccugguuugugcccugggacucagcgugggccugauggggaucguggucggaacgguguucauuauccagggccuucgcuccguuggggcuucuagacaucagggacugcucuga

SEQ ID NO: 70312 - RNA, 810 nt, Artificial Sequence
  derived and/or modified sequence opt5 from HLA-DQB1__Homo_sapiens__NP_001230890
augagcuggaagaaagcccugagaauccccggcgaccuccggguggcuaccgucacacugaugcuugccaugcuguccucucuccuggcggaggggcgcgauagcccugaagacuucguuuuucaguucaagggaaugugcuacuuuacgaacggcaccgagagagugcggcuugugacacgcuauauuuacaauagagaagaguaugcucgguucgauuccgacgucgggguguaccgcgccguuaccccgcaaggaagacccgaugccgaauauuggaacucucagaaagaggugcuggagggcacacgggcugaacucgacaccgucugucgccacaauuacgagguggccuuuagagggauccugcagcggcgcguugaaccuacagugaccauuagccccuccagaacggaggcucugaaccaucacaaucuccuggucugcucugugaccgauuucuauccuggacagaucaaggugcggugguuucgcaacgaccaagaggaaacagccggcgucguuagcacaccccuuauuagaaauggcgauuggaccuuccagauccuggugaugcucgagaugaccccucagcggggcgacguguacacgugucaugucgaacacccgucccugcagagccccaucacaguggaguggagagcgcaaucugaauccgcccagagcaaaaugcuuucuggaguuggcggguuugugcugggacucauuuuccugggccuggggcucaucauucgccagcggucccagaagggaccucaagggcccccucccgcuggccugcuucauuga

SEQ ID NO: 70313 - RNA, 684 nt, Artificial Sequence
  derived and/or modified sequence opt5 from HLA-DQB2__Homo_sapiens__NP_001185787
auggcccugcagauccccggcggguucugggcugccgcggugaccgucaugcucguuaugcugagcacaccuguggcugaggccagagacuuuccgaaggauuuccuugugcaauuuaaaggaaugugcuacuucacgaacggcaccgaacggguccgcgggguggccagauauauuuacaaucgggaggaauauggacgcuuugacuccgauguuggcgaguuccaggcugugacagaacuggggagaucuaucgaggacuggaacaauuacaaggauuuucucgagcaggaacgggccgcugucgacaaagugugucgccacaacuaugaggccgaacugagaaccacacuucagcggcaaguugagcccaccgugacaauuagcccuucccgcaccgaggcgcugaaucaucacaaccuccuggucugcucugugacggauuucuaccccgcccagaucaaggugagaugguuucggaaugaccaggaagagaccgcuggagucguuagcacaucccugauucgcaacggcgauuggaccuuccagauccucgugaugcuggaaaucacaccucaaagaggcgacauuuauaccugucagguggagcaucccucucuucagagcccuaucacggucgaauggcggccgcgcgggcccccucccgccggacugcuccacuga

SEQ ID NO: 70314 - RNA, 765 nt, Artificial Sequence
  derived and/or modified sequence opt5 from HLA-DRA__Homo_sapiens__NP_061984
auggccaucagcggcgugcccguccugggguucuuuauuaucgcuguucucauguccgcccaggagucuugggcgauuaaggaagaacacgugaucauucaagcugaguucuaccugaacccugaccagagcggagaguuuauguucgauuuugacggcgaugaaaucuuccauguggacauggccaaaaaggagaccgucuggagacuugaggaauuugggcgguucgccuccuuugaggcucagggagcccuggcuaauaucgccguggauaaagcgaaccucgaaauuaugacaaagcgcucuaauuauacgccgaucaccaacguucccccugaggugacaguccugaccaauagccccguggagcuuagagaaccuaacguucugauuugcuucaucgacaaauuuacacccccuguggucaaugugaccuggcuccggaacggcaagccggugacaaccggggucuccgagacgguuuuccugccccgcgaagaucaccuguuuagaaaguuccauuaccucccuuuccugcccucuaccgaggacguguaugauugucggguggaacacuggggacuugacgagccucugcucaaacauugggaguuugaugcccccagcccgcugccugaaacaaccgagaaugucgugugcgcucuuggccugacaguuggccucguggggauuaucauuggaaccaucuucaucauuaagggccugcgcaaauccaacgccgcugaaagacgggggccccuguga

SEQ ID NO: 70315 - RNA, 801 nt, Artificial Sequence
  derived and/or modified sequence opt5 from HLA-DRB1__Homo_sapiens__NP_001230894
auggugugccugagacuccccggcgggagcuguauggccguccugaccguuacacuuauggugcuguccucuccucucgcucuggccggagacacgcggccgcgcuuccuugaguacagcaccuccgaaugccacuuuuucaacggcacagagagagugcgguaucuggaucgcuacuuucauaaucaggaagagaacgucagauucgacucugaugugggggaauuucgggcgguuaccgagcucggacgccccgacgcugaguauuggaauagccaaaaggaucugcuggaacagaaaagaggccggguggacaacuacugucgccacaauuauggggucguggaguccuucacaguucagagacgggugcauccuaaggucaccguguaccccucuaaaacacagccucuccaacaccauaaccugcuugugugcagcgucuccggauuuuaucccggcagcaucgaaguucgcugguucagaaauggccaggaggagaagaccgggguggugucuacgggacugauucacaacggcgauuggaccuuucagacacucgucaugcuggaaaccgugccucgguccggggagguuuacacaugucagguggaacacccgagcgucaccucuccccuuacgguggaguggcgcgccagauccgaaagcgcccaaucuaaaaugcuguccggaguuggcggguucgugcucggacugcuguuucucggcgcuggccuguucaucuacuuucggaaucagaaggggcauagcggacuucagccuagaggcuuccuguccuga

SEQ ID NO: 70316 - RNA, 801 nt, Artificial Sequence
  derived and/or modified sequence opt5 from HLA-DRB3__Homo_sapiens__NP_072049
auggugugccugaagcuccccggcgggagcucccuggccgcucuuaccgucacacugaugguucucucuagcagacuggccuucgcgggagacacgcggccucgcuuucuugagcugagaaaauccgaaugucacuucuuuaacggcaccgagcgggugcgcuaccucgauagauauuuccauaaucaggaagaguuucugcgguucgacucugaugugggggaauaccgcgcugucacagagcugggaagaccgguggccgagagcuggaacucccaaaaggaccuccuggaacagaaacggggccgcguugauaauuauugcagacacaacuacggggugggagagucuuuuaccguccagcggcgcgugcauccccagguuacaguguauccugccaagacccaaccccuucagcaccauaaucugcucgucuguagcguguccggcuucuacccuggcagcaucgaagugagaugguuucggaacgggcaggaggagaaagcuggagucguuucuacaggccugauucagaauggggacuggaccuuccaaacgcuugugaugcuggaaaccgugccccgcuccggagaggucuauacaugccagguggaacacccuagcguuaccucugcccucacaguggaguggagagcucgguccgaaagcgcccagucuaagaugcuguccggcgucgggggauuugugcugggccuccuguuccuuggcgcggggcuguuuaucuacuucagaaaccagaagggacacagcggccuccaaccgaccggguuccuguccuga

SEQ ID NO: 70317 - RNA, 801 nt, Artificial Sequence
  derived and/or modified sequence opt5 from HLA-DRB4__Homo_sapiens__NP_068818
auggugugccugaagcuccccggcgggagcuguauggccgcucugaccgucacacuuacgguucuguccucuccucucgcccuggcgggagacacccagccgagauuccuugagcaagcuaaaugcgaaugucacuuucugaacggcacagagcggguguggaaucucauccgcuacauuuauaaccaggaagaguacgccagauauaauagcgaucugggggaauaccaggccgugaccgagcugggacggcccgacgcugaguauuggaacucccagaaggaucuccuggaacgcagacgggccgaggucgacacauacugccgcuauaauuacggcgugguugaaucuuucaccgugcaaagacggguccagccuaaagugacaguuuaccccagcaagacccagccucuucagcaucacaaccugcucguguguuccgucaauggguuuuaucccggaucuaucgaggugcgcugguucagaaacggccaagaggaaaaagcuggcguggucagcacggggcugauucagaauggagauuggaccuuucagacacuuguuaugcuggagaccgugccucgguccggcgaaguguacacaugccaggucgagcauccgagcaugaugucuccccucaccgugcaaugguccgcccgcagcgaaucugcgcaguccaagaugcugagcgggguuggaggcuucgugcuggggcuccuguuucuuggaacgggccuguucaucuauuuuagaaaccagaagggccacucugggcuccaaccuacaggacugcuuuccuga

SEQ ID NO: 70318 - RNA, 801 nt, Artificial Sequence
  derived and/or modified sequence opt5 from HLA-DRB5__Homo_sapiens__NP_002116
auggugugccugaagcuccccggcgggagcuacauggccaaacugaccgucacacuuaugguucuguccucuccucucgcucuggccggagacacgagaccgcgguuccuucagcaagauaaguaugagugucacuuuuucaacggcaccgaacgcgugagauuucugcaucgggacaucuacaaucaggaggaagaucuccgcuucgacagcgaugugggggaguauagagcggucacagaacugggacggcccgacgcugaguacuggaacucccagaaagauuuucuggaggaccgcagagccgccguggauaccuauugccggcacaauuacggcguuggggaaucuuucacagugcagcgcagagucgagccuaaggugaccguuuaucccgcucggacacaaacccuccagcaucacaaccugcuuguguguagcgucaauggauuuuacccuggcuccauugaagugcgcugguucagaaacucucaggaggagaaagccggcguggucagcacggggcugauccagaauggagacuggaccuuucaaacacucguuaugcuggaaaccgugccccgguccggcgagguguacacaugccaggucgaacauccuagcgugaccucuccgcuuacgguugaguggcgcgcucaguccgaaagcgcccagucuaagaugcuguccggggugggaggcuucguccucgggcugcuguuucucggagcgggccuguucauuuauuuuaagaaccaaaaaggccacagcgggcuucaccccacaggacuggugucuuga

SEQ ID NO: 70319 - RNA, 1077 nt, Artificial Sequence
  derived and/or modified sequence opt5 from HLA-E__Homo_sapiens__NP_005507
augguggacggcacccugcuccugcuucugagcgaggcccucgcucugacacagacgugggccgggucccacucucuuaaguacuuccauaccagcgucuccagacccggacggggcgaaccucgcuuuaucucuguuggguauguggaugacacacaauucgugagauuugauaacgacgcggcuagcccgcggauggucccccgcgccccuuggauggagcaggaaggauccgaguacugggauagagaaacccggucugcccgcgacacagcucagauuuucagagugaaucugcggacccuccgcggcuauuacaaccagagcgaggccgggucccacacacugcaauggaugcauggaugcgagcugggccccgauggcagauuucuccggggguaugaacaguucgcuuacgacggaaaagauuaucugacccuuaaugaggaccugcgcagcuggacggccguugauaccgcggcccagaucucugaacagaaguccaacgacgcuagcgaggccgagcaccaaagagcuuaccucgaagauacauguguggaguggcugcauaaauaccuugaaaagggcaaagagacccugcuccaccuggaaccucccaagacacacgucacccaucacccuauuucugaccaugaggccacgcugcggugcugggcgcucggguuuuauccggccgagaucacacugaccuggcagcaggacggagaaggccacacacaggauaccgagcuuguggaaacccgccccgcuggggacggaacauuccaaaagugggccgcuguuguggucccuuccggcgaggaacagagauacacgugucacgugcagcaugagggccugcccgagccugugacccuccgguggaaacccgccagccaaccgacaauuccuaucgucgggaucauugccggacugguucuucugggcucugugguguccggggcugucguggcggccguuaucuggagaaagaaaagcuccggaggcaaagggggaucuuauagcaaggcugaaugguccgauagcgcccagggcucugagucccacagccucuga

SEQ ID NO: 70320 - RNA, 765 nt, Artificial Sequence
  derived and/or modified sequence opt5 from HLA-F__Homo_sapiens__NP_001091948
auggcccccagaagccugcuccugcuucuguccggcgcucucgcccugaccgacacaugggcggggucucacagccuucgguacuucuccacggcugugucucgcccuggaagaggcgagccgcgguauaucgccgucgaauacguugaugacacccaguuucugcgcuucgauagcgacgccgcuauucccagaauggagccucgggaacccuggguggagcaagaagggccucaguauugggaguggacaaccggauacgccaaggcuaacgcccagacagaucgcguggcgcucagaaaucugcugcggcgcuauaaccaguccgaggccggcucucauacccuccaagggaugaauggaugcgacaugggccccgauggcagacugcuucggggguaccaccagcaugcuuaugacggaaaagauuacaucagccugaacgaagaccuccgcuccuggacagccgcugauaccgucgcccagauuacgcagagauuuuacgaggcggaagaguaugccgaggaguuccggaccuaccuggaaggcgaaugucuugagcugcuccgcagauaucuggaaaaugggaaggagacacugcaacgggcugagcagagcccucagccgaccauccccauugugggaaucguugccggccucgugguccugggggcugugguuacaggagccguggucgccgcugugauguggcgcaaaaagucuuccgacagaaaccggggcagcuacucucaggcggccguguga

SEQ ID NO: 70321 - RNA, 1017 nt, Artificial Sequence
  derived and/or modified sequence opt5 from HLA-G__Homo_sapiens__NP_002118
augguggucauggcccccagaacccuguuccuccugcuuagcggcgcucugacacucacggagaccugggccgggucccacucuaugcgguacuuuagcgcggcuguuucccgcccuggaagaggcgaaccgcgguucaucgccaugggguauguggacgauacacaguuugugcgcuucgacucugauagcgccugccccagaauggagccucgggcucccugggucgaacaagagggaccugaauacugggaggaggaaacccgcaacacaaaggcccaugcucagaccgacagaaugaaucugcagacacuucggggcuauuacaaccaguccgaggccucuagccacacccugcaauggaugauugggugugaucucggauccgacggccgccugcugagaggcuaugaacaguacgcguaugaugggaaagacuaccucgcccugaaugaggaucuucggagcuggacggcugccgacaccgcugcccagaucucuaagcgcaaaugcgaggcggccaacguggcugaacagagacgggccuaccuggagggaacauguguugaauggcuccaucgcuaucuggagaauggcaaggaaaugcuucaaagagcugaucccccuaaaacccacgugacacaucacccggucuuugacuacgaggccacccugcggugcugggcccucggguucuaucccgcugagauuauccugacguggcagagagauggagaagaccagacacaggacguggagcugguugaaacccgcccugcgggcgaugggacauuucaaaagugggccgcuguggucgugcccuccggagaggaacagcgguacaccugucacgugcagcaugagggccucccugagccccugaugcuuagauggaagcaaagcucucugccgaccauuccuaucaugggcaucgucgccgggcucguugugcuggccgcuguggucacaggagccgcgguggcugccguucuuuggcgcaaaaaguccagcgacuga

SEQ ID NO: 70322 - RNA, 2622 nt, Artificial Sequence
  derived and/or modified sequence opt5 from HLCS__Homo_sapiens__XP_005261010
augcugaucacccucugcuaccuguaucuuugggccagauggggccggcgccccgcugagcuggugagagccacaguccggcgccucagagcgagccgguguuccuucacguuuugcggggcugccgcccagccuccgggagcucgcguuugucugucuagaggcgggcggguguucugcgugagcgacucccaaucuauugaagaucuuaacaagugggcccuguuucucgucagccccuucauccuggaggcugaacacauugccuuugugaccgaguccaucuggguucagucugaaaaucugcagcgcagcuccagcucugagacaauugugaaaugguccgacuguugccucccucuggcguguagacccggagauccuuaccggcuuaucgccgaggcuagcgucgacaacuucucuaagcugggcguggccuuuauggaagaucgccuccauauggacaaugggcugguuccccagaaaaucguguccguccaccuucaagauagcacccugaaggaggugaaagaccaggugucuaacaagcaggcucagauucucgaaccuaagccggagcccucccuggagaucaaaccugaacaagauggaauggagcaugucggcagagacgaucccaaggcccugggcgaggagccuaaacagcggcgcgggagcgcguccggaucugaacccgccggcgacagcgauagagggggaggcccgguugagcacuaucaucuccaccuguccagcugccacgagugucuugaacuggaaaauucuacaauugaauccgugaaguucgcuagcgccgagaacaucccugaccuccccuacgacuauucuagcucccuggaaucuguggcugaugagaccagcccugagcgggaagggagacgcgucaaucuuacaggaaaagcccccaacauucugcucuacgugggcuccgacagccaggaggcccugggccgguuucaugaaguuagaucugugcuggcugauugcgucgacaucgauuccuauauucucuaccaccuucuugaggacagcgcgcugcgcgaucccuggaccgacaauugucuccugcuugugaucgccacgcgggaaucuaucccugaggaucuguaccagaaguucauggcuuaucucucccaagggggaaagguucugggccugagcuccucuuuuaccuucgggggauuucaggugacaagcaaaggcgcccuccauaagaccguccagaaccugguguucuccaaagccgaccaaucugaggucaagcugagcgugcuguccagcgggugcagauaccaggaaggaccgguucgccucucucccggccggcugcagggccaccuggagaaugaagauaaagacagaaugauugugcacgucccuuucgggacacgcggaggcgaggcugugcuuugccagguucaucucgagcugcccccuuccagcaacaucgugcaaacccccgaagacuuuaaucugcucaagucuuccaacuuccggagauaugagguccugcgcgaaauucuuacgacacuggggcucagcugugauaugaaacaggugccggcccugaccccucuguaccuucucucugcggcugaggaaauccgggacccccugaugcaguggcugggaaagcacguggauagcgagggcgagauuaaguccgggcagcucagccugagauuuguuucuuccuaugucagcgaaguggagaucacaccuuccugcauccccguggucaccaauauggaagccuucucuagcgagcauuuuaaccuugaaauuuaccggcaaaaccugcagaccaaacagcucggcaaggugauccuguucgccgagguuacaccuacgaccaugcgccugcuugacggacucauguuucagacaccccaagagaugggccugauugugaucgcugccagacagaccgaagggaaaggacggggcgggaaugucuggcuguccccggugggaugugcucucucuacacugcuuauuagcaucccucugagaucccagcucggccagcgcauccccuucguucaacaccugaugucuguggccgucguggaggcgguucggagcauucccgaauaucaggauaucaaccugagagugaaguggccuaaugacauuuacuacuccgaucuuaugaaaaucgggggcguccucgugaacagcacccugaugggagagacguuuuauauucugaucggcugcggguucaaugugacaaacucuaauccgaccauuuguaucaacgaccucaucaccgaauacaauaagcagcauaaggccgagcugaaaccccuucgcgcugauuaucugauugccagagucguuacagugcucgagaagcugaucaaagaauuucaagacaagggaccuaacuccgugcugccccuuuacuaucgguacuggguccacagcggccaacaggugcaccuggggucugcugagggaccuaaaguuuccauugugggccucgaugacagcggguuccugcagguccaucaggaaggcggagaggugguuaccgugcaccccgauggcaauucuuuugacaugcuccgcaaccugauccuuccuaagagacgguga

SEQ ID NO: 70323 - RNA, 888 nt, Artificial Sequence
  derived and/or modified sequence opt5 from HLF__Homo_sapiens__NP_002117
auggagaagaugagcagaccccugccucucaacccgaccuucauucccccucccuacggcgugcugcggucccuucuggaaaauccucucaaacugccccuucaccaugaggacgccuuuucuaaggauaaagacaaggagaaaaagcuggaugacgagagcaacuccccuacagucccgcagucugcuuuccucgggcccacgcugugggauaagacccugccuuaugacggagauacauuucaacucgaauacauggaccuggaggaguuccuuagcgaaaauggcauucccccuucccccucucagcacgaucauagcccgcacccucccgggcugcagccugccuccagcgcggcucccucuguuauggaccucuccagccgcgccucugcuccccugcauccuggaaucccgucccccaacugcaugcagagcccuaucagacccggccaacuucugccugccaaucggaacacccccucuccgaucgauccugacacaauucaggugcccgugggguaugaaccugaucccgccgaccucgcucuguccagcaucccuggacaggaaauguuugacccccgcaaaagaaaguucuccgaggaggaacugaaaccgcagccuaugaucaagaaagcccggaaggucuuuauucccgaugaccucaaggaugacaaauacugggcgcgcagacggaagaauaacauggccgcuaaacgcucuagagaugcccggcgccugaaggagaaucaaaucgcuauuagagccagcuuccuugaaaaagagaacuccgcgcugcggcaggaaguggccgaccuccgcaaggagcugggcaaauguaagaauauccuugcuaaguaugaggccagacacggcccccuguga

SEQ ID NO: 70324 - RNA, 3030 nt, Artificial Sequence
  derived and/or modified sequence opt5 from HLTF__Homo_sapiens__NP_003062
augagcuggauguucaagagagaccccguguggaaauaccugcagaccguccaauauggcguucacgggaacuuuccucggcucuccuacccgacauucuuuccccgcuucgaguuucaggaugugaucccucccgacgauuuccugacgucugacgaagagguggauagcguccuuuuuggaucccugagaggccaugugguugggcuccgguauuacaccggaguggucaauaacaaugaaaugguggcccugcagcgcgacccuaacaaucccuaugauaagaacgcuauuaaaguuaauaacgugaauggcaaccaggucgggcaccuuaagaaagagcuggccggagcgcucgcuuacaucauggacaauaagcuggcccaaauugaaggcguggugccuuucggcgccaacaaugcuuuuacaaugccgcugcauaugaccuucugggggaaggaggagaacagaaaagccgucucugaucagcucaagaaacacggauuuaagcugggccccgcuccuaaaacacuuggguucaaucuggaaagcggauggggcuccgggcgggccggacccucuuauagcaugccuguucaugcggccgugcagaugaccacagagcagcucaagaccgaauuugacaagcuguucgaggaucuuaaagaggacgauaagacgcacgaaauggagcccgcugaagccaucgagaccccgcugcucccucaccaaaaacaggcucuggccuggauggugucccgcgaaaacagcaaggagcugcccccuuucugggagcagagaaacgaccucuacuacaauacaauuaccaacuuuucugaaaaagaccggcccgagaauguccauggcggcauccuggcggaugacauggggcuuggaaagacacugaccgccaucgcugugauucucacgaacuuccacgauggccgcccccugccuaucgaaagaguuaaaaagaaucuucugaagaaagaguauaacgugaaugacgauuccaugaagcucgggggaaacaauacaagcgaaaaagccgacggccugucuaaggaugcuucccggugcagcgagcagccgucuauuuccgacaucaaagaaaagagcaaguuucgcauguccgaacugucuagcuccagacccaaacggcgcaagaccgccguccaauacauugagagcucugauuccgaagagaucgaaacaagcgagcucccucagaaaaugaaggggaaacugaagaacgugcagucugagaccaagggacgggccaaagcuggcagcuccaagguuauugaagacguggcguucgccugugcucuuaccucuagcguccccacaacgaaaaagaaaaugcugaagaagggcgccugcgccguggagggguccaaaaagaccgaugucgaagagagaccuagaacaacccucaucaucuguccccugagcgugcuuucuaauuggauugaccaauuuggacagcauaucaaauccgacguucaccugaacuucuauguguacuauggcccggaucgcauucgggagccugcucuccugagcaagcaggacaucguccugacaaccuacaauauucucacgcacgauuaugggacaaaaggagacucuccccugcauuccaucagauggcuucgcgugauccuggaugaaggccacgccauucggaacccuaaugcgcagcaaaccaaggcuguucucgaccuggagagcgaaagacgcugggugcugaccgggacacccauccagaacucccuuaaagaucucuggucucugcugagcuuucucaagcugaagccuuucauugaccgggagugguggcauagaaccauccagcgccccgucacaaugggcgaugaaggaggccuucggagacugcagucccucauuaaaaacaucacgcugcgccggaccaagacaucuaaaaucaaggggaaaccggugcuggagcuuccugagagaaagguguuuauucaacacaucacccucagcgacgaagaacggaagauuuaccaguccguuaaaaaugaaggacgcgccacaaucggcagauacuucaacgaggggaccguccuggcccauuaugcugaugugcugggacuccugcuucggcugagacagauuugcugucacacguaccuccugaccaaugccgugagcucuaacggccccuccgggaaugacacacccgaggagcugcgcaagaaacuuauccggaagaugaaacucauucugagcucuggcuccgaugaggaaugcgcuaucugucuggacagccucaccgucccugugaucacacacugcgcccauguguuuuguaagccgugcauuugucagguuauccaaaacgagcagccccacgcgaagugcccucugugcagaaaugacauucaugaagauaaccuucuggagugucccccugaggagcucgcccgcgacucugagaaaaagagcgauauggaauggaccuccagcucuaaaaucaaugcucugaugcacgcccugacggaccuuagaaagaaaaaccccaauauuaagucccucgucgugagccaguucacaaccuuucugucccugaucgagaucccucucaaggcuucuggauucguuuucacacggcuggauggcagcauggcccagaaaaagcgcguggaauccauucaaugcuuucagaacaccgaggcggggucucccaccaucaugcuucugagccucaaagccggaggcgucgggcugaaucuguccgcugccucuagaguguuccuuauggacccggcuuggaacccugccgccgaggaucaguguuuugaccggugccaccgccugggacaaaagcaggaaguuauuaucacaaaauucauugugaaggauagcgucgaggaaaauaugcucaaaauccagaacaagaagagagagcuggcugcgggcgccuuugggacgaaaaagcccaacgcugacgaaaugaaacaggccaagaucaaugagauucggacccucaucgaucuguga

SEQ ID NO: 70325 - RNA, 1467 nt, Artificial Sequence
  derived and/or modified sequence opt5 from HLX__Homo_sapiens__NP_068777
auguucgccgcuggccuggcccccuuuuacgcgagcaacuucucccucuggucugcugccuauugcagcuccgccgggccuggaggcuguucuuuuccgcuggaccccgcugccgugaagaaaccuagcuucugcaucgcugauauucuucacgccggggucggagaccugggcgcggcccccgaggggcucgcuggagccuccgcugccgcgcugaccgcccaucuuggcucuguucacccucaugcuagcuuucaggccgcugccagaagcccccugcggccuacaccggugguggcccccuccgaagucccugcuggcuucccccaacgccucucuccucuguccgcggccuaccaccaucaccacccccagcagcagcaacagcagcagcaaccgcagcagcagcaaccucccccuccucccagagcuggggcccugcagcccccggccagcggaacgcgggugguucccaauccucaucacucuggcuccgcucccgccccuagcucuaaggaucucaaauuugggaucgaccgcauucuguccgcggaguucgaucccaaggugaaagaaggaaacacccuuagagaccugacaagccuccugaccggcgggcggccggcuggaguccaucuuuccggccugcagccuucugccggccaauuuuucgccagccucgaucccaucaaugaggcuuccgccauucugagcccucugaacucuaauccccgcaacuccgugcagcaccaguuucaggacacauucccugggcccuaugcuguucucaccaaggauacaaugccgcaaaccuacaagagaaaacggagcuggucucgcgccguguuuagcaaucugcagagaaagggacuugaaaaacgguucgagauccagaaguaugucacgaaaccugaccgcaagcagcuggcggccaugcucggccugaccgaugcucaagugaaggugugguuccagaacagacggaugaaauggcgccacuccaaggaggcccaggcucagaaagacaaggauaaagaagccggggagaagcccucuggaggcgcgcccgccgcugacggggaacaagacgagagaagcccuucccggagcgagggagaagccgagucugaauccagcgauucugagucccuugacauggcuccgagcgauacagaaagaaccgagggcuccgagcgcucucugcaucagacaaccgucaucaaagcccccguuacgggcgcccucauuacagcuagcuccgcggggucuggaggcagcuccgggggaggcgggaauagcuuuucuuucuccagcgccucuucccugagcucuagcuccaccagcgcuggcugugccucuucccugggaggcgggggagccagcgaacuccugccugcuacacagcccaccgccuccucugcgccuaagagccccgagccugcucagggcgcccuugggugccuguga

SEQ ID NO: 70326 - RNA, 1134 nt, Artificial Sequence
  derived and/or modified sequence opt5 from HM13__Homo_sapiens__NP_110416
auggacagcgcccuguccgauccccacaacggcucugcugaggccgggggaccuaccaauagcacaacgagaccgcccuccaccccugaaggcaucgcgcucgcuuacgggucucugcuucugauggcccuccugcccauuuucuuuggagcccuucggagcgugcgcugcgcuagaggcaagaacgccuccgacaugccugagacaaucaccucucgggaugcugcccgcuuccccauuaucgcgagcuguacacugcucgggcuguaucuguuuuucaaaaucuuuucccaggaauacauuaaucuccugcuuagcauguauuucuuuguccugggaauccucgcccugucucauaccauuuccccuuucaugaacaaguuuuucccggcuagcuuucccaauagacaauaccagcuucuguucacacagggcucuggcgagaacaaagaagagaucauuaauuaugaguuugacaccaaggaucucguuugccuggggcuguccagcaucgugggagugugguaccuccugcggaaacacuggauugccaacaaucuuuucggccuggcuuucucucucaacggggucgaacugcuucaucugaauaacguguccacgggauguauccuccugggcgggcuguuuauuuaugacguuuucuggguguuuggaaccaaugucauggugacaguugccaagagcuucgaggcgccuaucaagcucguguuuccccaggaucugcuugaaaaaggccuggaggccaacaauuucgcuaugcucggccugggggacgucgugaucccuggaauuuuuaucgcccuucugcuccgcuucgauauuucccugaagaaaaacacccacacauacuuuuacaccucuuucgcugccuauaucuuuggccuggggcucacgauuuucaucaugcauaucuuuaagcacgcccaacccgcucugcuuuaccuggugccggcgugcauuggauucccuguccucguugcccuggcuaaaggcgaggugacagaaauguucagcuaugaggaauccaaccccaaggacccugccgccgugaccgagagcaaggaagggacagaggcuucugccuccaaaggacuggagaagaaagaaaaguga

SEQ ID NO: 70327 - RNA, 1263 nt, Artificial Sequence
  derived and/or modified sequence opt5 from HMBOX1__Homo_sapiens__NP_001129198
augcugagcuccuuccccgugguccuccuggagaccaugucucacuacacagacgaaccuagauuuacgaucgagcagauugaucuucugcaacggcuccgcagaaccggcaugacaaagcaugaaauccugcacgcccuugagacccuggaccggcucgaucaggaacauagcgacaaauucgggcgcagauccucuuauggaggcagcuccuacgggaacucuacaaauaacguuccggcuagcuccagcaccgccacagcgucuacccagacgcagcacuccggaaugagccccucuccuuccaauagcuaugauaccucuccccaaccuugcacaaccaaccagaauggccgggagaacaaugagcgccuguccacaagcaacgggaagaugucccccaccagauaccaugcuaauucuaugggacagcggagcuauuccuuugaagccagcgaggaagaccuggauguggacgauaaaguggaggagcucaugcgcagagacucuuccgucauuaaggaagagaucaaagccuuccuggcuaaccggcgcauuagccaggccgugguugcucaagugacgggcaucucucagagcagaaucucccacuggcuucugcagcagggcucugaucucagcgaacaaaagaagcgggccuuuuaccgcugguaucagcuggagaaaacaaauccuggggcgacccuuuccaugagaccggcccccauuccuaucgaagaccccgaguggcggcagacaccucccccggucagcgcuaccucuggaaccuucagacugcgccggggcuccagauuuacauggcgcaaggagugucucgccgugauggaaagcuacuucaacgagaaucaauacccugaugaagcuaaacgggaggaaauugccaacgcgugcaaugccguuauccagaagcccgggaaaaagcugucugaccuggagagagugacgucccucaaggucuauaacugguuugcuaaccgccggaaagagauuaagagacgcgccaauaucgaagcugccauucuggagagccacggaaucgacgugcaguccccuggcgggcauucuaacagcgaugacguggauggaaaugacuacuccgaacaggaugacucuaccagccacuccgaucaucaagaccccaucagccuugccgucgagauggcugcgguuaaccacacaauucuggcccucgcucggcagggcgccaaugaaaucaaaaccgaggcccuggaugacgauuga

SEQ ID NO: 70328 - RNA, 1086 nt, Artificial Sequence
  derived and/or modified sequence opt5 from HMBS__Homo_sapiens__NP_000181
augagcggcaacgggaaugccgcugccaccgcggaggaaaacucccccaagaugagagugauccgggucggaacacgcaaaucucagcuggcucggauucaaacggacagcguuguggccacccucaaggccuccuacccuggccugcaguucgagaucauugcuaugucuacaaccggggauaaaauccuugacacagcccugagcaagauuggagaaaaaucccucuuuaccaaggagcuggaacacgcucuugagaagaaugagguggaucuggucgugcauucucucaaagaccugccgacaguucugcccccuggcuucaccaucggggccaucugcaagagagaaaacccccacgaugcgguggucuuucauccuaaauucgugggaaagacgcucgagacccugcccgaaaagagcguugugggcacauccagccuucgcagagccgcucagcugcagcggaaauuuccucaccucgaguuccgcucuauuagaggcaaucugaacacccggcuucgcaagcuggacgagcaacaggaauuuuccgccaucauucucgcuacagccgggcugcagagaaugggauggcauaaucgggucggccagauccugcacccggaggaauguauguaugcgguggggcaaggagcccucggcguggagguccgcgcuaaagaucaggacauucuggaucuuguuggggugcugcacgaccccgaaacccuccugagaugcaucgccgagcgggcuuuccuucgccaucuggagggaggcuguagcgugccugucgccgugcacacggccaugaaggauggccagcucuaccugacagggggaguuuggucucuggacggcuccgauagcauucaggaaaccaugcaagcuacaauccaugugcccgcgcagcacgaggacgggccugaagacgauccccagcucgucggaaucaccgccagaaacauuccgcggggcccucaacuggcugcccagaaucuugggaucucucuggccaaccuccugcuuuccaaaggagcuaagaauauucuggacguggccagacagcucaacgaugcgcacuga

SEQ ID NO: 70329 - RNA, 16908 nt, Artificial Sequence
  derived and/or modified sequence opt5 from HMCN1__Homo_sapiens__NP_114141
augaucagcugggaggugguccacaccguuuuccuguuugcccuccuguacuccucucuugcucaggacgccagcccccaguccgaaauuagagcggaggaaaucccugagggagcuucuacccuggccuucguguuugaugugacggggagcauguacgacgaucucguccaggugauugaaggagccuccaagauccuggagaccucucuuaaacggccgaagagaccccuguucaacuuugcucucguuccuuuccaugaccccgagauuggaccugugacaaucaccaccgaucccaaaaaguuucaguacgaacugagagagcuguauguccaaggagggggagacugcccugaaaugagcaucggggccauuaaaaucgcucucgagauuucccugccggggagcuucaucuacguguuuaccgaugcccggucuaaggacuauagacuuacacacgagguucugcaacucauucagcagaagcagucccaaguggucuucgugcugaccggagauugcgacgauagaacgcauaucggcuacaaaguguaugaagagauugccagcaccucuuccgggcaggucuuucaccuugacaagaaacagguuaaugaagugcugaaguggguggaggaagccguccaggcuagcaaagugcaucuccugucuacagaucaccuggagcaagccguuaacaccuggcggauccccuucgacccuucccucaaggaggugacagucagccuguccggacccucuccuaugaucgaaauuagaaauccccuuggcaagcugaucaaaaagggguuuggacuccacgagcugcuuaacauucauaauagcgcuaaagugguuaacgugaaggaaccggaggccggcauguggaccgucaaaacguccagcucugggagacacuccgugcggaucacaggacugagcaccauugacuuccgcgccggcuucucuagaaagccuacacucgauuuuaaaaagaccgucagccggcccgugcagggcaucccuaccuacguucugcugaauacauccgggaucucuacgcccgcccgcauugaccuccuggaacuucugagcaucuccggaagcucucucaagaccauucccgugaaauacuauccucauagaaagccguacggcaucuggaacauuuccgauuucgugcccccuaaugaggccuuuuuccugaaagugacaggguaugacaaggaugacuaccuuuuucagcggguuagcucuguguccuucagcuccaucguccccgaugcuccuaaagugaccaugcccgagaagacaccgggauauuaccugcaaccuggccagauccccugcucuguggacagccuccugccuuuuacccuguccuucguucgcaacggggucacgcucggaguggaucaguaucugaaggaaucugcuagcgugaaucuugacauugccaaagucacacuguccgaugagggcuuuuacgaauguaucgccgugagcucugcuggcaccgggagagcgcagaccuucuuugacguuuccgagcccccucccgugauucaagucccgaacaaugugacaguuaccccuggagaacgggccgugcucacaugccugaucauuagcgcugucgacuacaaccugacguggcagagaaaugaucgcgacgugcggcuugccgagcccgccagaauccgcacccucgcuaaccugucucuggagcucaaguccguuaaauucaacgaugccggcgaauaucacuguauggugagcucugaagggggaagcuccgcggcuagcgucuuucugacagugcaggaacccccuaaggugaccgucaugccgaaaaaucagucuuucacaggcggguccgagguuagcauuaugugcuccgccaccggcuaccccaagccuaagaucgccuggacggugaacgacauguucaucgugggaucucaccgguauagaaugaccagcgauggcacacuuuuuauuaaaaaugcugcccccaaggacgcugggaucuacggaugucuggccuccaacucugcgggcaccgauaaacaaaauagcacacuccgcuauauugaggccccuaagcugauggucgugcaguccgaacugcuuguugcucucggggacaucaccgugauggagugcaaaacgucuggaaucccgccuccccaggucaagugguucaagggcgaucuggaacugcggccgagcacauuucucaucaucgacccucugcuugggcugcucaaaauucaggagacccaagaucuggacgccggcgauuacacauguguggcuaucaacgaagccggacgggccaccggcaagauuacccuggacguugggagcccucccguguucauccaggagcccgccgacgucagcauggagauuggaucuaaugugacacuuccgugcuauguucagggcuacccugaacccacgaucaaauggcgccggcucgauaacaugccuaucuuuuccagacccuucagcgugucuuccauuagccagcugcgcaccggggcucuguuuauccucaaucugugggccucugacaagggaacauacauuugugaggcugaaaaccaauucggcaaaauccaguccgagaccacagucaccgugacggggcuuguggcgccccucauuggcaucagcccuuccgucgccaauguuaucgaaggacagcaacucacacugccgugcacccugcuugcuggcaaccccauuccugagcggagauggaucaagaauagcgcgaugcuccugcagaaccccuauauuaccgugcggucugaugggagccugcauaucgagcgcgugcagcuccaggacggaggcgaauacacaugcgucgccuccaauguggcugggaccaacaacaaaacaacgucuguugugguccacgugcugccuaccauucaacauggacagcagauccuuagcacaauugagggcauccccguuacccugccuuguaaggccuccgggaauccgaagcccucugugaucuggagcaaaaagggcgaacucauuuccacaucuagcgccaaauuuuccgcuggagccgauggcagccuguaugucgugucuccugggggagaggaauccggcgaguacgucugcaccgcgacgaacaccgcuggguaugccaagagaaaagugcagcugacaguuuacgugcggcccagagucuucggagaccaacgcggccuuagccaggauaagccuguggagaucucuguucuggccggcgaagaggugacccuccccugugaagucaagucccugccgccucccauuaucacaugggcuaaagagacccagcucauuagccccuuuuccccucggcacacauuccugcccucugggagcaugaagaucaccgagacgagaacauccgacagcggaauguaucuuugcguggccaccaauaucgcgggcaacgugacccaggcuguuaaacugaauguccaugugccuccgaagauucaacgcgggcccaaacaccucaaggugcaggucggacagagaguggauaucccuuguaacgcccaaggcacaccccugccuguuauuaccuggucuaagggaggauccacgaugcugguggacggcgaacaccaugucagcaaucccgauggcacacuuucuaucgaccaggccaccccgagcgaugcugggauuuacacaugcguggccaccaacaucgcuggaacagacgagaccgaaaucacgcugcacguucaggagccucccaccguggaagaccucgagccucccuacaauacaaccuuucaggagcgggucgccaaccaacgcauugaguucccuugucccgcgaaaggcacaccgaagccuaccaucaaauggcugcauaaugggagagagcucacgggacgggaacccggcauuuccauccuggaggaugggacacuucuggugauugccucuguuacccccuaugacaacggagaauacaucugcguggcugucaaugaggccggcacaaccgagcgcaaguauaaccucaaagugcacgugccuccggucauuaaggauaaggaacagguuaccaaugugagcgugcugcugaaccagcuuacaaaccuguucugugaggucgaaggcacgcccuccccuaucaucaugugguacaaagacaaugugcagguuaccgagucuagcacaauucaaaccgugaacaaugggaagauccucaaacuguuuagagcuacacccgaagaugccggacgguauuccugcaaggccauuaacaucgcuggcaccagccagaaauacuucaauauugacguccucgugccucccacgaucaucgggacaaacuuuccuaaugagguuucugugguccugaaccgcgauguggcgcuugagugucaggucaagggaaccccguuccccgacauucacugguuuaaagauggcaagccucuguuccugggggaccccaauguggaacuccuggauagaggacagguucuucaucugaagaacgcccggcgcaaugacaaaggcagauaucaaugcaccguguccaacgcugccggcaagcaggccaaagacaucaagcucacaauuuacaucccucccagcauuaaagggggaaaugugaccacagauaucuccguccugaucaacucucucauuaagcuggagugcgaaacgcggggccuuccgaugccugcuaucaccugguacaaggacgggcagcccauuaugagcuccucucaggcccuguauaucgauaaaggacaauaccugcacauucccagagcgcagguuagcgacuccgcuacauauaccugucauguggccaauguggccggcacagcugaaaaguccuuucacgucgauguguacguuccucccaugaucgaggggaaccucgccaccccucugaacaaacagguggucauugcgcauucucuuacgcuggaaugcaaggcugccggaaauccgucccccauccucaccuggcugaaagacggcgugccugucaaggccaacgauaauauccgcauugaggcuggcgggaagaaacucgaaaucaugagcgcccaagagauugaccggggacaguauaucuguguggcuacaucuguugccggcgaaaaggagauuaaauacgagguggauguccuggugcccccugcgaucgaagggggagacgagaccuccuauuucaucguuauggugaacaaucuucuggaacuggauugccacgucacaggcucucccccucccaccauuauguggcucaaggacgggcagcugaucgaugagagagacggauuuaaaauucuucugaacggccgcaagcucgugaucgcccaggcucaaguguccaauacaggccuguaccgguguauggccgcuaacacggccggggaccacaagaaagaguucgagguuaccguccaugugcccccuacaauuaagagcuccggacucucugagagaguggucguuaaauacaagcccguggcccugcagugcaucgcuaauggcaucccuaaccccagcauuaccuggcuuaaagaugaccagccggugaauaccgcgcaggggaaccugaagauccaauccagcggacgcguccugcagauugccaagacacuccuggaagaugcuggccgguauacguguguggccaccaaugccgcuggggagacacagcagcacauccaacuucauguucacgaaccucccucccuggaggacgccggaaaaaugcucaacgaaaccgugcuggucucuaaucccgugcagcuggagugcaaggcggcuggcaacccuguuccggugauuacaugguacaaagauaauagacuccuuagcggcuccaccucuaugacguuucugaaccgcgggcagaucauugacaucgagagcgcccaaaucuccgaugccggaauuuauaagugugucgcuaucaacucugccggcgcgacagaacuguucuacagccuccaggugcauguggcccccuccauuagcgggucuaauaacauggucgcuguuguggugaauaacccuguccggcuggagugcgaagccagaggaauccccgcuccuucccuuaccuggcugaaagacggcagccccgugucuuccuucagcaaugggcuccagguucugucuggcggacggauucuggcccucaccuccgcucagaucagcgauacaggccgcuauaccuguguggccgucaacgcggccggggagaagcaaagagacaucgaucuucggguguacguuccucccaauauuaugggagaggaacagaacguguccguccugaucagccaggcuguggagcugcucugccagucugacgccauuccgccucccacacugaccuggcuuaaagauggccacccucugcucaagaagcccgggcugagcaucuccgaaaaucgcucuguucugaaaauugaggacgcucaagugcaggacacgggaagauauacaugcgaagccaccaacgucgccggcaagacagagaaaaauuacaacgugaauaucugggucccgccuaacaucgggggcagcgaugagcucacccagcuuacggugauugaaggaaaucugaucucccugcucugugagucuagcggcauuccgcccccuaaccugaucuggaagaaaaaggggucccccguucuuaccgacucuaugggacgggugcgcauucugagcggcgggcgccagcuccaaaucuccauugcugaaaagagcgaugcggcccuguacucuugcgucgcuuccaacguggccggaacagccaaaaaggaguauaaucugcaggucuacauccggccuaccaucacaaacagcggcucucacccgaccgaaauuaucguuacaagagggaaauccauuagccucgagugugaggugcagggcauucccccucccaccgucacguggaugaaggacggacauccucuuauuaaagcuaagggcguggaaauccuggaugaggggcacauccugcagcucaagaauauucauguuuccgacacaggacgcuaugugugcgucgccgugaacgucgcgggcaugaccgauaaaaaguacgaccugucugugcacgcgcccccuagcaucauugggaaucaccgguccccggaaaacaucagcguuguggagaaaaauucugucucccuuaccugugaagcuagcggcauuccccugccuucuaucacaugguuuaaggauggcuggcccgugagccucuccaacucuguuagaauccugagcggcgggcgcaugcugcggcucaugcaaaccacaauggaggacgccggacaguauacgugcguggucagaaaugcugccggcgaggaacgcaaaauuuucgggcuuuccgugcuggugccuccccauaucguuggagagaacacccuggaagaugucaaggugaaggagaaacagucugugacacucaccugugaggucacaggcaauccggugccugaaauuaccuggcacaaggacgggcaaccccugcaggaggacgaagcgcaucacaucauuagcggaggcagauuucuucagaucacgaacguucaggugccccauaccggccgguacacaugccuggccuccagcccugcugggcacaaaucucgcuccuucagccucaaugucuuugugucccccaccaucgccggaguuggcucugaugggaacccugaggacgugacagucauucugaauagcccgaccucccuggugugugaggcuuacucuuaucccccugccacgaucacaugguucaaggauggaacaccccucgaaagcaacagaaacauucggauccuuccuggcgggcgcacacugcaaauucugaaugcucaggaggacaacgccggaagauacuccugcguugcgaccaaugaagccggcgagaugaucaaacacuaugaagugaaggucuacauucccccgaucaucaacaaaggcgaucucugggggccuggacugagccccaaggaggugaagauuaaagugaauaacacccuuacacuggaaugugaggcuuaugccaucccuucugcuucccucagcugguacaaggacggccagccccugaaaucugaugaccaugucaauauugccgccaacgggcacacgcugcagaucaaggaggcgcaaauuuccgauaccggacgguauacaugcguugcuagcaauaucgccggcgaagacgagcucgauuuugacgugaacauccaggugccgccuucuuuccagaaacuuugggaaauugggaauaugcuggauaccggaagaaacggcgaggcuaaggacgucaucauuaauaaccccaucucccuguacugcgaaacaaaugccgcgcccccucccacccucacgugguauaaggacggccauccucugacaagcucugauaaagugcuuauucugcccgggggacgcguucuccagaucccccgggcuaagguggaggacgccggcagauacaccugugucgcggugaacgaggccggggaagauagccugcaauacgacguucgcgugcuggucccucccaucauuaaaggagcuaacuccgaucucccugaggaagugaccguccuugugaauaagagcgcccugaucgagugccuguccucuggcagccccgcuccucggaacuccuggcagaaagacgggcagccgcuccuggaggaugaccaccacaaguuucuuucuaauggacgcauucugcaaauccucaacacacagauuaccgauaucggccgguauguuuguguggccgaaaauacagcgggcagcgccaagaaauacuucaaccugaauguccaugugcccccuuccguuauugggcccaagucugagaaccugacgguggucgugaauaacuuuaucagccugaccugcgaaguguccggauucccucccccggaccuuagcuggcugaaaaaugagcagccuaucaagcugaacacaaauacccucauuguucccggcgggcgcacacugcagaucauuagagcuaaagucucugauggaggcgaauauaccuguaucgccauuaaccaagcuggggaguccaagaagaaauuuagccuuacgguguacgugcccccuucuaucaaggaccacgacuccgagagccugucugucgugaauguucgggaaggaaccuccgugagccucgagugcgaaucuaacgccgugcccccuccggugaucacaugguauaaaaacggccgcaugauuaccgaguccacacauguugaaauccuggcugauggccagaugcugcacauuaagaaagccgaggugagcgacaccgggcaguacgucuguagagcgaucaauguggccggacgggaugacaagaacuuccaucucaauguguauguucccccuagcauugagggccccgaacgcgaggucaucguggaaacaaucuccaacccugugacccugacgugcgaugcuacagggauucccccgccuaccaucgccuggcuuaaaaaucacaagagaauugagaacucugacagccuggaaguccggauccucuccggaggcucuaagcugcagauugcucgcagccaacacuccgauucugggaauuacaccuguaucgccagcaacauggagggaaaagcccagaaguacuauuuccuuuccauucagguucccccuagcguggcgggcgcugagauccccucugacguguccguccugcucggcgaaaauguggagcugguuugcaacgccaaugggaucccuacaccccugauucaguggcucaaagauggaaagccgaucgccagcggcgaaacggagcgcauucgggugucugcuaacggguccacccugaauaucuacggagcccuuacaagcgacaccggcaaauauacaugugucgcuaccaaccccgccggggaggaagauagaauuuuuaaucugaacguguacguuacaccuaccauccgcggcaacaaggacgaggcggaaaagcucaugacgcugguggauaccuccaucaauauugagugccgggccacaggaacacccccuccgcaaaucaacuggcuuaaaaauggccugccccucccucugucuagccauauuagacugcucgcugccgggcaggucauccgcauugugcgggcucagguguccgacgucgccguuuauacaugcguggcgucuaacagagccggaguggacaauaagcacuacaaccugcaagucuucgcucccccuaauauggauaacagcaugggcaccgaagagaucacgguucuuaaaggguccagcacaucuauggccuguaucaccgacggaacacccgcuccuuccauggccuggcugcgcgauggccagccccucgggcuggacgcucaucuuaccgugagcacgcacggcauggugcugcagcuccugaaggccgagaccgaagauucuggaaaauauacaugcauugcgagcaaugaggccggcgaagucuccaagcacuuuauccugaaggugcucgagccgccucauauuaacgggucugaggaacacgaggaaaucagcguuauugugaauaacccccuggagcuuaccuguaucgcuuccggcauuccugcccccaaaaugacauggaugaaggacggccggccgcugccucagaccgaucaaguccagacacucgggggaggcgaagugcugagaaucagcaccgcccagguugaggacacggggcgcuacacaugccuugcuucuucccccgccggcgaugacgauaaagaauaccuggugcggguccaugugcccccuaauaucgcgggaaccgacgagcccagagauauuaccguccuccgcaaccggcaggucacacuggaguguaagagcgacgcuguuccuccgcccgugaucaccuggcugagaaauggcgaacgccuccaagccacaccuagaguccggauucuguccgggggacgcuaucuucagaucaacaacgccgaccugggcgauacggcuaauuauaccugcguggccucuaacauugcugggaaaacaaccagagaguucauccucacagugaauguucccccuaacaucaagggaggcccccagagccuggucauucuucugaauaaguccaccgugcucgaauguaucgccgagggggugccgacgccucggauuaccuggagaaaagacggcgcgguucuggccggaaaccacgcucgguauucuauccuggagaauggcuuucuccauauucagagcgcccacgucacagauaccgggcgcuaccugugcauggcuacaaacgccgcgggaaccgacagacggcgcaucgaucuucaagugcacgugcccccuuccaucgcccccggcccuacgaauaugacagucauugugaacguucagaccacacuggcuugugaagccaccgggauccccaagccgucuauuaauuggcgcaaaaacggacaucuccugaauguggaccagaaccagaauagcuaucggcuucuguccagcggcucucucgucaucauuucccccagcguggaugacaccgcuacauacgagugcacgguuaccaacggcgccggggaugacaagcgcacaguggaucugaccguccaagugccucccucuaucgccgacgaaccuacagacuuccuggugaccaaacacgcucccgcgguuauuacguguacagccuccggagucccuuuuccgagcauccauuggaccaagaacggcaucagacuccugcccagaggggauggauaucgcauucuuucuagcggcgcuaucgagauucuggccacccagcucaaucacgccgggagauacacaugcguggcucggaacgccgcgggauccgcucaucgccacgugacccugcacguccaugaaccucccgugauccagccucaacccagcgagcuucacguuauucugaauaacccgauccuccugccuugcgaggccacaggcacgcccuccccuuucaucaccuggcagaaggaaggcauuaaugugaacacaucugggagaaaucaugccguccugcccagcggaggccuucagaucucccgggcugugcgcgaggacgccgggaccuacauguguguugcucagaacccggccggaacagcgcugggcaaaauuaagcucaaugugcaagucccucccgugaucucuccccaccugaaagaauauguuauugccguggauaagccuaucacccucagcugcgaggcugacgggcugcccccuccggauaucacguggcacaaagacggcagagccauugucgaauccauccggcagagagugcuuucuagcggcucccugcagauugcuuuugugcagcccggcgaugccgggcauuacaccuguauggcggccaacgucgcuggaagcucuagcacaagcaccaagcugacaguucacgugccuccccgcauccggucuaccgagggccauuauacagugaaugagaacucccaagccauucucccuugcgucgcugacgggauccccaccccugccaucaauuggaaaaaggauaacgugcugcuugccaaucugcucggaaaguacacggcugaaccguauggcgagcugauucucgaaaacguugugcuggaggacagcggguucuacacaugugucgcgaauaacgccgcuggagaagauacccacaccgugucucugacaguucaugugcuucccacguuuaccgagcugccuggcgacgucucccucaacaaaggcgagcagcugagacuuagcugcaaggccacagggaucccccugccuaaacucaccuggacauucaauaacaauauuauccccgcccacuuugauucugugaacggacacuccgaacuggucauugagcgcgugagcaaggaagacuccggcaccuauguuuguacagcugagaauagcgugggguucgucaaagccaucggauucguguacguuaaggagccgcccguguuuaagggcgacuacccuucuaacuggauugaaccccucgggggaaaugcgauccugaacugcgaggucaaaggcgauccuacccccacgauccaguggaaucggaagggcguggacauugaaaucagccauagaauuagacagcuggggaacggaucccuugcuaucuauggcaccgugaaugaggaugccggggacuacacauguguugccaccaacgaagcuggagucguggagcggucuaugagccugacacuccaauccccuccgauuaucacccuggagcccguggaaacggucaucaaugccggcgggaaaauuauccuuaacugccaggcuacaggagagccucagcccaccauuacauggucuagacaaggccacagcaucuccugggaugaccgcgugaauguucugagcaacaacucucucuauauugccgaugcgcagaaggaagacaccuccgaguucgaauguguggcccggaaucugaugggcagcguccuggugagaguuccugugaucguccaggugcaugggggauuuucucagugguccgcuuggcgcgccugcagcguuaccuguggcaaagggauccaaaagcggucuagacucugcaaccagccccugccggcuaauggaggcaagccuugccagggguccgaucuugagaugcggaacugucagaauaaacccugcccuguggacggaagcugguccgaguggucucugugggaagaguguacaagaagcugcggccgcggcaaccaaacgcggaccagaacauguaauaaccccuccguccagcacgggggacgcccuugcgaaggcaaugccguggagauuaucauguguaacauuagacccugcccggugcacggggcguggagcgccuggcagcccuggggaaccuguucugaauccugcggcaaggggacacagacccgggcucgccucuguaauaacccucccccugccuucggcggaagcuacugcgauggcgcugagacgcaaaugcaggucugcaaugagagaaacugucccauccaugggaaaugggccacaugggccucuuggagcgcuugcuccguuucuuguggaggcggggcgcggcagcgcaccagaggaugcagcgacccggugccucaguauggcgggcggaagugugaaggcuccgaugugcaaagcgacuuuugcaauucugaccccuguccuacccacggaaacuggucccccuggagcggcugggggacaugcucucgcaccuguaacggaggccagaugagacgguaccgcacaugcgauaauccucccccguccaacgggggcagagccuguggcgggccugacagccagauucaacggugcaauacggauaugugccccgucgacggcuccuggggaucuuggcauagcuggucccaguguucugcuagcugcggcgggggagagaaaacccgcaagagacugugugaucacccugugcccguuaagggcgggcggccgugccccggagacacaacccaggugacaagauguaacguccaggccugcccuggcgggccccaacgcgcccggggcuccgugaucggaaauauuaacgauguugaguucggcaucgcuuuucuuaaugccaccaucacggacagcccuaacucugauaccagaauuauccgcgcgaaaauuacaaaugugccccggucccuggggagcgcuaugagaaagaucgucucuauucucaacccuaucuauuggaccacagccaaagaaaucggagaggccgugaauggcuucacccugacaaacgcuguguuuaagcgcgaaacgcaggucgaguucgccaccggggaaauucugcagaugucccauaucgcucggggacucgacagcgauggcucucugcuucuggacauuguuguguccggcuacgugcuccagcugcaaagcccggccgaggucacaguuaaagacuacaccgaagauuauauccagaccgggcccggacagcuuuacgcguauagcacaagacuguuuacgauugacggcaucuccaucccuuacaccuggaaucacacaguguucuaugaucaggcccaagggcgcaugcccuuucucguggagacccugcacgcuucuagcgucgaguccgacuacaaccagauugaagagacacugggauucaagauccaugccucuauuagcaaaggcgaucgguccaaucaguguccuucuggguucacccucgacagcgugggacccuuuugcgcugaugaagacgagugugccgcgggcaacccgugcucccacucuugucauaacgccaugggcacguacuauugcagcugcccuaaggggcugacaaucgcugccgauggaagaaccugucaagacauugaugaaugcgcucuuggccggcacaccugucaugccgggcaggacugcgauaauacaaucggauccuaccgcuguguugugagaugcggcagcggguuccggcgcaccucugacggacuguccugucaggacauuaacgagugccaggagagcucucccugucaccaaagaugcuuuaaugcgaucggcuccuuccacuguggcugcgaaccuggguaucagcucaagggacggaaaugcauggaugucaacgaguguagacagaaugugugccgccccgaccagcauuguaagaacacacggggcggguacaaaugcaucgaucuguguccuaauggaaugacgaaggccgaaaacggaaccugcauugacaucgaugaguguaaagacgggacacaccaaugcagauauaaucagauuugugaaaacacccgcggaagcuaccggugcguuugucccagaggcuaucgcucucagggcguggggagaccgugcauggauaucaaugagugcgagcagguccccaagccuugugcucaucaaugcuccaacacacccggcagcuuuaaguguauuugcccucccggccagcaccuucugggggacggaaaauccugugccggccucgaacggcugccuaauuacgggacccaguacagcucuuauaaccuggcucgcuucagcccggugagaaauaacuaccaaccccagcagcacuaucggcaguacucccaucucuauucuagcuacuccgaguaucgcaacucuagaacgagccugucccggacccgcagaacaauccggaagaccugcccugaaggaucugaggccagccacgauacaugugucgacaucgaugagugcgaaaauaccgacgccugucaacaugagugcaaaaacacauuuggcuccuaccaguguauuugucccccuggcuaccagcuuacccacaaugggaagacgugccaggauaucgacgaaugucuggagcaaaacgugcauugcggacccaauagaauguguuucaacaugcgcggcagcuaucagugcauugacacaccguguccucccaauuaccagcgggauccuguuucuggguuuugccucaaaaacugucccccgaaugaccuggaaugcgcucuuucccccuaugcccuggaguacaagcucgugagccugccuuucggaaucgcgaccaaccaggaucugauuagacucgucgcuuauacccaagacggcgugaugcacccccgcacaaccuuucugaugguggaugaggaacagacaguuccuuucgcccuucgggacgagaaucugaagggggucguguacacgaccagaccccuccgcgaagccgagacauaucggaugagagugcgggcuucuuccuacagcgccaacggaaccaucgaauaccagacaaccuuuaucguuuauauugcggucuccgcuuacccuuauuga

SEQ ID NO: 70330 - RNA, 1044 nt, Artificial Sequence
  derived and/or modified sequence opt5 from HMG20A__Homo_sapiens__NP_001291433
auggagaaccugaugaccagcuccacacuucccccucuguucgccgacgaagauggcucuaaggagagcaaugaccuugcuacgaccgggcugaaccacccggaagugcccuacuccucuggagccacaagcuccaccaauaacccugaguuugucgaagaucucucucagggccaacugcuucagagcgaguccagcaaugcggcugaggggaacgaacagagacaugaggacgaacagcggucuaaacgcggaggcugguccaaggggagaaaacggaagaaaccccugcgcgauagcaaugccccuaagucuccccucacaggauauguuagauucaugaacgagcggcgcgagcaacugagagccaagcggccugaagugccguuucccgagaucacccgcaugcugggcaaugaaugguccaaacucccucccgaggaaaagcagagauaccuggacgaggcugaucgggacaaagagcgcuauaugaaggaacuugagcaguaccagaaaacagaagccuauaagguguucagcagaaagacccaagaucggcagaaaggcaagucucaccgccaggacgcugccagacaggcgacgcaugaucacgagaaagaaaccgaggucaaggagcgguccguguuugacauuccuaucuucacagaagaguuucugaaccauagcaaagccagagaagcugagcuccgccaacugcggaaguccaauauggaguucgaagagagaaacgccgcucuccagaaacacguugaaucuaugcgcaccgccguggagaagcuggaagucgaugugauucaggagcggagcagaaauacaguucuccaacagcaccuggagacccugcgccaggugcucacguccagcuuugcgucuaugccccugccgggguccggagaaacaccuaccgucgacacaaucgacagcuacaugaaccggcuucauucuauuauccuggccaauccccaggauaacgagaacuucaucgcuaccgugagagaaguggucaaucgccucgaccgguga

SEQ ID NO: 70331 - RNA, 954 nt, Artificial Sequence
  derived and/or modified sequence opt5 from HMG20B__Homo_sapiens__NP_006330
augagccacggccccaagcagccuggggccgcugccgcgccggcuggaggcaaagcccccgggcaacauggaggcuucguggucaccguuaagcaggagagaggggaaggaccucgggccggcgagaaaggcucccacgaagaggaacccgugaagaaacgcggguggccuaagggaaagaaaagaaagaaaauccugcccaacggcccuaaggcuccggugacaggguacguccgguuucucaaugagcgcagagagcagauucggacgcgccaucccgaccugccuuuccccgaaaucaccaaaaugcuuggagccgaguggucuaagcugcagccuacagaaaagcaaagauaucucgaugaggcugagcgggaaaaacagcaguacaugaaggagcugcgcgccuaucagcaaagcgaagcguacaaaaugugcaccgagaagauucaggagaaaaagaucaaaaaggaagacuccucuagcggccuuaugaacacacugcucaaugggcacaagggaggcgauugugacggcuuuuccaccuucgaugugcccauuuuuacagaggaguuccuggaccagaacaaagccagagaagcugaacugcggcgccucagaaagaugaauguugccuuugaggaacagaacgcugugcugcaacggcauacccagucuaugagcuccgcccgcgagagacuugagcaggaacuggcgcucgaggaacggagaacgcuggcccuucaacagcagcugcaggcuguccgccaagcccucaccgcuagcuucgccucucugccggugccugggacaggagagacccccacacugggcacccucgauuuuuauauggcccggcugcacggggcuaucgaaagagacccugcgcagcacgagaaacuuaucguucgcauuaaggagauccuggcccagguggcuuccgaacaucucuga

SEQ ID NO: 70332 - RNA, 291 nt, Artificial Sequence
  derived and/or modified sequence opt5 from HMGA1__Homo_sapiens__NP_665912
augagcgaguccucuagcaaguccucucagccccuggccagcaaacaagaaaaggacggcaccgagaaaagagggcggggacgcccuagaaagcagccgcccaaagaaccuuccgaggugcccacaccuaagcggccccgcggcagaccuaaggggucuaaaaacaagggagcugccaaaacgcggaagaccacaaccacaccgggccgcaaacccagagggcggccuaagaagcucgaaaaagaggaggaagagggaaucagccaggaauccagcgaggaggaacaguga

SEQ ID NO: 70333 - RNA, 357 nt, Artificial Sequence
  derived and/or modified sequence opt5 from HMGA2__Homo_sapiens__NP_001287847
augagcgccagaggcgagggggcuggacagcccuccaccucugcccaaggccagccugcggcuccggcuccccagaagcgggggcgcggaagaccucggaaacagcaacaggaacccacaggcgagccuagccccaagcgcccuagagggcggccgaaaggauccaagaacaaaucucccagcaaggccgcccagaagaaagccgaagcuacgggcgagaagcgcccuagaggccggccccgcaaauggccucagcaagugguccagaagaaacccgcccagguuaauguggcgcugccggggaaggaccacccuggaaaccucaucuaccugcuuuucuccaagaaugccaccuga

SEQ ID NO: 70334 - RNA, 477 nt, Artificial Sequence
  derived and/or modified sequence opt5 from HMGB1__Homo_sapiens__XP_005266425
augggcaagggggaccccaaaaagccuagaggaaaaaugagcuccuacgccuucuuugugcagaccugccgggaggaacacaagaaaaagcauccggaugcuucugucaacuucagcgaguuuuccaagaaauguucugaacgcuggaagacaaugagcgccaaagagaagggcaaauucgaagacauggcgaaggcugauaaggccagauaugagcgggagaugaaaacguacauucccccuaagggggaaaccaaaaagaaauuuaaggaccccaaugccccuaaaagacccccuuccgcuuucuuucuguucugcucugaguaucgcccgaagaucaagggagaacaccccggccucagcaucggggauguugccaaaaagcugggagagauguggaacaauacagcugccgacgauaaacaaccuuacgagaagaaagcggccaaacuuaaggaaaaguaugagaaguuuuga

SEQ ID NO: 70335 - RNA, 630 nt, Artificial Sequence
  derived and/or modified sequence opt5 from HMGB2__Homo_sapiens__NP_001124161
augggcaagggggaccccaacaaaccuagaggaaagaugagcuccuacgccuucuuugugcagaccugccgggaggaacacaaaaagaaacauccggauucuagcgucaauuucgcugaguuuuccaagaaguguucugaacgcuggaaaacaaugagcgccaaggagaaauccaaguucgaagacauggcgaaaucugauaaggcuagauaugaccgggagaugaagaacuacguucccccuaaaggcgauaagaaagggaagaaaaaggaccccaaugccccuaaaagacccccuagcgccuuuuuccuguuuugcuccgagcaccgcccgaagaucaagagcgaacaucccggacucucuauuggcgauacggcuaaaaagcugggggagaugugguccgaacaaagcgccaaagacaagcagccuuaugagcagaaagcugccaaacuuaaggagaaguacgaaaaggauaucgcggccuaucgggcuaaaggaaagucugaggccggcaaaaagggccccgggcgcccuaccggauccaagaaaaagaacgaacccgaggacgaagaggaggaagaggaagaggaagaugaggacgaggaagaggaagaugaggacgaagaguga

SEQ ID NO: 70336 - RNA, 603 nt, Artificial Sequence
  derived and/or modified sequence opt5 from HMGB3__Homo_sapiens__NP_001288157
auggccaagggcgaccccaaaaagccuaaagggaagaugagcgcuuacgccuucuuugugcagaccugcagagaggaacacaaaaagaagaacccggagguccccguuaauuucgcggaauuuuccaaaaaguguucugagcgguggaaaacaaugagcggaaaggaaaaauccaaguucgaugagauggcuaaggccgacaaagugcgcuaugauagagagaugaaggacuacggcccugccaaagggggaaagaaaaagaaagaucccaacgcuccuaagcggcccccuucuggcuuuuuccuguuuugcagcgaguuccgcccgaagaucaaauccacgaaucccgggauuucuaucggagacguggccaagaaacucggcgaaauguggaacaaucugaacgauagcgaaaagcaaccuuauauuaccaaagcugccaaacuuaaggagaaauacgagaaggacgucgcggauuauaaauccaagggcaaauuugacggggccaagggacccgcuaagguggccagaaagaagguugaagaggaagaugaggaagaggaggaagaggaagaggaagaggaggaagaggaagacgaguga

SEQ ID NO: 70337 - RNA, 2667 nt, Artificial Sequence
  derived and/or modified sequence opt5 from HMGCR__Homo_sapiens__NP_000850
augcugagcagacucuuccggaugcacggccuguuuguggccucccaucccugggaggucaucguugggaccgugacacuuacgauuugcaugaugucuaugaacauguucaccggaaauaacaagaucuguggcuggaauuacgaaugcccuaaauuugaggaagacgugcugagcuccgauauuaucauucucacaaucacccgcuguaucgcuauucuguauaucuacuuccaguuucaaaaccuuagacagcuggggucuaaguauauucucggaaucgccggccuguucacaauuuuuagcuccuucgucuuuucuaccgugguuauccacuuccuggacaaagagcucacagggcugaaugaagcgcuuccguuuuuccugcuccugauugaucuuagccgggcuuccacccuggccaaguuugcccucagcucuaacucccaggacgaggugcgcgagaauaucgcuagaggaauggccauccugggccccacguucacccuggaugcucucgucgaaugccuggugauuggcguugggacaaugagcggagugcggcagcuugagaucauguguugcuucggcuguaugucuguccuggccaacuacuuuguguucaugaccuuuuucccugcgugcgugucccucguccuggaacuuagccgcgagucuagagaggggcggcccauuuggcaacugucccauuuugcccgcguucucgaagaggaagagaauaaaccuaaccccgugacacagagagugaagaugaucaugagccugggacugguccucgugcacgcucauucccgguggauugccgacccuucuccgcagaauagcaccgcugauacguccaagguuagccugggccuugacgaaaacgugucuaaacgcaucgagcccuccgucagccuguggcaguucuaucucucuaagaugaucagcauggauauugagcaagugaucacacugucccuugcccugcuccuggcgguuaaauacaucuuuuucgaacagaccgagacagaaucuacccugagccucaagaauccuauuaccucccccguggucacacagaaaaaggugccugacaacuguugcagacgggagcccaugcugguccgcaauaaccagaagugugauagcguggaagaggagacggggauuaacagagaacggaaaguugaggugaucaagccgcuugucgccgaaaccgacacaccuaauagagcuaccuuugugguuggaaacucuucccugcucgauacaagcucugugcuggucacccaagagcccgaaaucgagcugccucgcgagccccggcccaaugaagagugccuucagauucucggcaacgccgaaaaaggcgcuaaguuccuguccgacgccgagaucauucagcuggugaaugccaaacacaucccugcuuauaagcucgagacgcugauggaaacacacgagagaggggugagcauucgccggcaacuucuguccaaaaagcucucugaaccgagcucccugcaguaccugcccuacagagacuauaacuacucucuuguuaugggagcgugcugugagaaugucaucggcuauaugccuauucccguggggguggccggaccucucugccuggaugaaaaggaguuucagguccccauggcuaccaccgagggcugucugguggccagcacaaaccgcgggugccgggccaucggacucggcggcggggcuuccagcagaguucuggccgacggaaugacccgcggcccggugguccggcuuccuagagcgugugauucugcugaagugaaagccuggcuggagacauccgaaggguucgccguuaucaaggaggcuuuugacagcacgucucgcuucgcccggcuccagaaacugcauaccuccauugcuggaagaaaucuguacauccgguuccaaagccgcucuggcgaugccauggggaugaacaugauuagcaagggcacagaaaaagcgcuuuccaagcuccacgaguauuuucccgagaugcagauccuggccgugagcggaaauuacugcaccgacaagaaaccugcugccauuaacuggaucgaaggcagagggaagucugucgugugugaggcuguuauccccgccaaagugguccgggaagugcugaagacaaccacggaggcgaugauugaagugaauaucaacaaaaaucucgucggauccgccauggcuggcagcauugggggauauaacgcccaugcugccaacaucguuaccgccauuuacaucgcuugcggccaggaugcggcccagaaugugggguccucuaacuguaucacacugauggaggcuagcggcccuaccaaugaggaccuuuacauuuccugcacaaugcccucuaucgaaauuggaaccgugggcgggggaacgaaccugcucccgcaacaggccugucugcagaugcugggcguccagggggccugcaaggauaauccuggagagaacgcuagacaacuugcccgcaucgugugcggcacaguuauggcgggggaacucagccugauggcugcccuggccgcuggccaccucgugaagucccacaugauucauaaucggucuaaaaucaaccugcaggaccuucagggagccuguaccaagaaaacagcguga

SEQ ID NO: 70338 - RNA, 1563 nt, Artificial Sequence
  derived and/or modified sequence opt5 from HMGCS1__Homo_sapiens__NP_002121
augcccggcagccugccucucaacgccgaggcuugcuggccgaaggacguggggaucgucgcccuggaaauuuacuuccccucccaguauguugaucaagcggagcuugaaaaauacgacggaguggaugcuggcaaguauaccaucgggcugggacaggccaaaaugggcuuuuguacagacagagaggauauuaauucucucugcaugacggugguccagaaccugauggaacggaauaaccuuagcuacgacuguaucgggcgccuggaggugggaaccgagacaauuaucgauaaguccaaaucuguuaagaccaaucucaugcagcuguucgaagagagcggcaacacagacaucgaaggcauugauaccacaaaugccugcuaugggggaaccgcugccguguuuaacgcugucaauuggaucgaguccucuagcugggacggcagauacgcccuggugguugcgggggauauugccguguaugcuacgggaaacgcccggccuaccggcggggucggagcuguggcccuccugaucggccccaaugcgccucuuauuuucgagcgcggccugagagggacacacaugcaacaugccuacgacuuuuacaagcccgauaugcucuccgaauauccuaucguggacggaaaacugagcauucaguguuaccuuucugcucuggaccggugcuauuccgucuacuguaagaaaauccacgcccaguggcagaaggagggcaacgauaaagacuucacccucaaugauuuuggguucaugaucuuucauagcccguauugcaagcugguucaaaagucucuggcucgcaugcuccugaacgacuuccuuaaugaucagaacagagacaaaaacuccauuuacagcggacuggaagccuuuggcgaugugaagcucgaggacacauauuucgaucgggacguggaaaaagccuuuaugaaggcuucuuccgagcuguucagccagaaaaccaaggcgucccuucuggucucuaaucagaacgggaauauguacacgagcuccguguacggaagccucgccucuguucuggcucaauauagcccccagcagcuggccggcaaacgcaucggcguguucuccuacgggucuggacucgccgcuacacuguauagccuuaaggucacccaagaugccacaccuggcuccgcgcuggacaagauuaccgcuucucucugugaccugaaaagcagacuugauucccggaccgggguggcccccgacguuuuugccgagaacaugaagcugcgcgaagauacacaccaucucgugaauuacaucccucagggaagcauugacucucuguucgagggcacgugguaucuggucagaguggaugaaaaacaccggcgcaccuacgcuagacggcccacaccgaacgacgauacccucgacgagggggucggccuggugcacuccaauaucgccacagaacauaucccuagccccgcuaagaaaguuccuagacuucccgccaccgcggccgagcccgaggcugccgugauuucuaacggagaacacuga

SEQ ID NO: 70339 - RNA, 303 nt, Artificial Sequence
  derived and/or modified sequence opt5 from HMGN1__Homo_sapiens__NP_004956
augcccaagagaaaagugagcuccgccgagggcgcugccaaggaggaaccuaaacggcgcucugcgagacugagcgcuaagccgcccgccaaagucgaagccaagccuaagaaagcugccgcuaaggacaaauccucugauaagaaaguucagaccaaggggaagcggggagccaaaggcaagcaagcggagguggccaaccaggaaacaaaagaggaccuccccgcugagaauggggaaacgaagaccgaggaaagcccugccuccgaugaggcuggagagaaagaagccaagucugacuga

SEQ ID NO: 70340 - RNA, 273 nt, Artificial Sequence
  derived and/or modified sequence opt5 from HMGN4__Homo_sapiens__NP_006344
augcccaagagaaaagccaagggcgacgcuaaaggggauaaggccaaagugaaggacgagccucagcggcgcagcgcgagacuguccgcuaagccggcucccccuaaacccgaaccucggcccaagaaagccucugccaagaaaggagagaagcucccuaagggccgcaaagggaaggccgaugcuggaaaagacggcaacaauccggccaagaacagagaugcgagcacccugcaaucccagaaagccgaagggacaggagacgcuaaguga

SEQ ID NO: 70341 - RNA, 849 nt, Artificial Sequence
  derived and/or modified sequence opt5 from HMGN5__Homo_sapiens__NP_110390
augcccaagagaaaagccgcuggacagggggacaugcggcaagagccuaagcgcagaagcgcccggcuguccgcgaugcucgugccggucacccccgaaguuaaaccuaagcgcacaucuagcuccagaaaaaugaagacgaagucugauaugauggaggaaaacaucgacaccagcgcucaggccguggccgagacaaaacaggaagcuguggucgaggaggauuacaaugaaaacgccaagaauggagaggcuaaaauuaccgaagcccccgcguccgagaaggagaucguggaaguuaaagaggaaaacauugaggacgccacagaaaagggcggggagaagaaagaggcuguggccgcugaagucaagaaugaggaagaggaucagaaagaagacgaggaggaucaaaacgaagagaagggagaagccggcaaagaggacaaggaugaaaaaggggaggaggacggaaaggaagauaagaauggcaacgagaaaggcgaagacgcgaaggagaaagaggaugggaagaaaggagaagacggcaaggggaauggagaggacggcaaggaaaaaggggaggaugaaaaggaggaggaagaccggaaagagaccggagauggcaaggaaaacgaggacggcaaagaaaagggggauaagaaagagggaaaggacgugaaaguuaaggaggaugaaaaagagcgcgaagacggcaaggaggaugaagggggaaaugaggaggaagccggcaaggagaaagaagaccugaaggaggaggaagaggggaaagaagaggaugaaaucaaggaggacgacggcaaaaaggaggaaccucagucuauuguguga

SEQ ID NO: 70342 - RNA, 3879 nt, Artificial Sequence
  derived and/or modified sequence opt5 from HMGXB3__Homo_sapiens__NP_055798
auggacgccagcuacgauggcaccgaggugacagucguuauggaagagaucgaagaggcuuauugcuacacgucccccgggccuccgaagaaaaagaaaaaguauaaaauucacggagaaaagaccaagaaacccagaucugccuaccugcucuauuacuaugacaucuaccugaaggugcagcaagagcuuccucaucugccccagagcgagauuaacaaaaagaucuccgaaucuuggcggcuccugagcguggcggagcgcuccuacuaucuugaaaaagcuaagcuggagaaggagggccucgauccuaauucuaaacugagcgcccugacagccgucgugcccgacauuccuggguucagaaagauccucccgcgguccgauuacaucauuauccccaaaagcucucugcaggaagaccgcuccuguccucagcuugagcugugcguugcucaaaaccagaugagccccaagggaccuccccucgugucuaauaccgccccggaaacagucccuucccacgcuggcauggccgagcagugucuggcgguggaagcccuugcugaggagguuggggcccugacccagagcggagcugugcaagaaauugccacaucugagauccucucccaggauguccugcuggaagacgcgagccucgaggugggcgaaucccaucagcccuaucagaccucucuggugauugaggagacgcuugucaacggcagcccugaucugcccaccgggucccucgccguuccccacccucaagugggagaaagcgugucugucgugacaguuaugagagacuccagcgagucuagcuccucugcuccggccacccaguuuaucaugcugccccuuccugcuuacagcguggucgaaaaucccacauccauuaaacugaccacgacauauacccggcgcggccaugggacaugcaccagcccuggauguucuuucaccuacgugacaagacacaagcccccgaaaugcccuacguguggcaacuuucucgggggaaaguggauccccaaggagaaaccugccaagguuaaaguggaacuggccuccggcgucagcucuaagggcuccguggucaaacggaaucagcaacccgugaccacagagcagaacagcuccaaggagaaugcuucuaagcugacccucgaaaacagcgaggcgguuucccagcugcuuaauguggccccuccccgcgaagucggggaggagucugaaugggaggaagugaucauuagcgaugcucacguucuggugaaagaggccccgggaaacugcggcacagccgucaccaagacgccuguggugaaauccgggguucagcccgaagucacacucggaaccaccgacaaugauagccccggcgcugacgugccuacaccgucugaggggaccuccacaagcucuccccugccugcccccaagaaaccuacgggaguggaccuucugacccccggcuccagagcgccugagcucaagggccgggcucgcgggaagcccagccugcuggccgccgcuagaccgaugcgggccauccucccugcucccgucaacgugggacgcggcucuagcauggggcugccuagagcccggcaagcguucucccuuagcgauaaaacacccucuguuagaaccuguggacugaagccguccacacucaaacagcugggccagccuauucagcaacccagcgggccuggcgaagugaagcugcccuccggacccucuaaucgcaccagccaggucaaagugguugaggugaagccugacauguuuccgcccuauaaguacuccugcacggucacccuugaucucggccuggccacaucucgggggagaggaaaauguaagaacccuagcugcuccuacguguauaccaaccgccauaaaccccggaucugcccuucuuguggcguuaaucuggcuaaggacagaacagaaaagaccacgaaggccauugaggugagcagcccccucccugauguccugaacgcuacagaaccgcuuuccaccgcccagcgcgagauccagcggcaaucuacacugcagcuccugagaaaagugcugcagauccccgagaaugaauccgagcuugcggaaguguucgcccucauucacgagcugaacagcucucgccugauccucuccaaugucagcgaagagaccguuaccauugagcagacaucuugguccaacuacuaugaaagcccuuccacgcaaugccugcuuuguagcucuccccuguuuaaagggggacagaauagccucgcuggcccucaggagugcuggcugcugaccgccucccggcuucaaacagugaccgcucaggugaagaugugucucaacccccauugccuggcccugcacucuuucaucgacauuuacacagggcucuuuaaugucggcaacaaacugcuugugagccuggaucuccuguucgccaucagaaaucagaucaagcugggagaagacccgcgcguuuccauuaacgugguccuuaaaucugugcaggagcaaaccgagaagacgcucacaagcgaagaacugucccagcugcaggaacuccuguguaauggcuauugggcuuuugagugccuuaccguucgggauuacaacgacaugaucugugggauuugcggaguggcgccuaaagucgaaauggcccagagaucugaggagaaugugcuggcucucaagagcguugaguucaccuggcccgaguuucugggcuccaacgaagugaacgucgaggauuucugggccacaauggaaaccgaggugaucgagcaaguggccuuccccgcuagcauuccuaucacaaaguuugacgccucugucauugcgcccuucuuuccuccgcugaugcgcggggcuguuguggugaauacggaaaaagacaagaaccuugauguccagcccgugccuggauccggcagcgcccugguucggcuccugcaggaggggaccuguaaacucgacgaaaucggcucuuauuccgaggaaaagcugcagcaccuucugagacaaugcggaauccccuucggcgccgaggauagcaaagaccagcucugcuuuucccugcuggcucuuuacgagucugugcagaauggggcccgggcgauuagaccuccccgccauuucacaggaggcaagaucuacaaggucuguccgcaccaagugguuugcgggagcaaauaucuggugcggggagaauccgcuagagaucaugucgaccuccuggccagcucucgccacuggccucccguguacgucguggauauggccaccuccguugcucucugugccgaccugugcuauccugagcuuacaaaccagauguggggcagaaaucagggguguuuuagcucucccaccgaaccucccgugagcgucuccugcccggagcugcucgaucagcauuacacgguggacaugaccgagacagaacacucuauucaacacccuguuaccaagacagcuacccggcgcaucgugcaugccggccugcagcccaaccccggagauccuagcgcgggccaccauucccuggcccuuuguccggagcuggcucccuaugccacaauucucgcuucuaucgucgacagcaaaccuaauggggugagacagcggcccaucgccuucgauaacgccacccacuacuaucuguacaaucgccucauggacuuucugacguccagagaaauugugaaccggcagauccacgacauuguucaaagcugccagccuggagaggucgugauccgcgauacacuuuacagacugggcguggcucagauuaagaccgaaaccgaggaggaaggggaggaagaggaagucgcggccguggcugaguga

SEQ ID NO: 70343 - RNA, 1806 nt, Artificial Sequence
  derived and/or modified sequence opt5 from HMGXB4__Homo_sapiens__NP_001003681
auggccuacgacgauagcgugaagaaagaggacugcuucgauggcgaccacaccuuugaagauaucgggcuggcugccggaagaucccagcgggagaagaaacgcucuuauaaggacuuccucagagaagaggaagagauugcggcucaaguccggaacagcuccaaaaagaagcugaaagauucugagcuuuacuuucugggcacagacacgcauaagaaaaagcgcaaacacagcuccgaugacuauuacuauggggauaucucuagccucgaauccagccagaagaagaaaaagaaaucuagcccccaguccaccgacacagccauggaucugcuuaaggccauuaccucuccucuggcugccggauccaaaccgagcaagaaaacaggcgagaagucuuccgggagcuccucucauagcgaauccaagaaagagcaccauagaaagaaaguuagcggaucuuccggcgagcucccccuggaagacggcgggagccacaagucuaaaaagaugaagccucuguacgugaauaccgagacacucacccugcgggaacccgacggacuuaaaaugaagcugauccucagcccuaaagagaagggcuccucuagcguggaugaagaguccuuccaguaucccagccaacaggcuacggucaaaaagucuuccaagaaaagcgcccgcgacgagcagggggcgcugcuucugggacacgaacuccagucuuuucugaagaccgcccggaaaaagcauaaauccagcuccgaugcucacucuagcccuggcccggagggguguggauccgacgccucucaauucgcugaaagccauuccgccaaccuggaucucagcggccuggagcccauucuuguggaaucugacuccagcucuggcggggagcuggaggcgggagaacucguuaucgaugacuccuacagagagaucaagaagaaaaagaaaagcaagaaaucuaagaaaaagaaggauaaagaaaagcacaaagagaagcgccacagcaaauccaagagaagccugggccuuucugccgugccugucggggaagugacaguuaccuccggacccccucccagcauuccguacgcuggcgccgcugccccuccccugccucuccccgggcugcauacagacggacacuccgagaagaaaaagaaaaaggaggaaaaagauaaggagcgggaacgcggcgagaagcccaaaaagaaaaauaugucugccuaucagguguuuugcaaggaguacagagucaccaucguggcugaccauccuggcauugacuucggggaacugagcaaaaagcucgcggagguguggaagcagcugccggaaaaagauaaacuuaucuggaaacagaaggcccaauaucugcagcacaaacagaacaaggcugaggccacgacagucaaacggaaggccuccucuagcgaaggauccaugaagguuaaggcuucuagcgugggcgugcucagcccccaaaagaaauccccucccaccacaaugcugcuuccugccucucccgcgaaggcuccggagaccgagccuauugacgucgccgcccaucugcagcuccugggggaaucccugagccucaucggacaccgccugcaggagaccgaaggcaugguggcuguuucugggucccuuagcgugcugcucgauucuauuaucugugcccugggcccccuggcuugccuuacaacgcagcucccugagcugaauggaugucccaaacaaguccuguccaacacccucgacaauaucgccuacauuaugccuggccuguga

SEQ ID NO: 70344 - RNA, 3459 nt, Artificial Sequence
  derived and/or modified sequence opt5 from HMHA1__Homo_sapiens__NP_001245257
augagcagaggccagcgggugcugaaggggcuccugggaugggucugcaccuggacaugggccuggcgcgccagacuuggcgcccggggguguggacugcacguucucugcccccgcgaccugccucuuccgcccgaggaacugccuagaaaagauggcgcggacgcuguguuccccgggccuucccucgagcccccugccggaucuagcggcgugaaggccacgggcacccugaaacggccgacaucccugucucgccaugcuagcgccgcuggguuuccccucuccggagccgcgucuuggacccugggcagaagccaccgguccccucuuacagccgcuagccccggggaacugccuaccgagggagccggccccgaugucguggaagacaucucucaucuccuggcugauguugcccgcuucgcggaggggcuugagaagcugaaagaaugugugcucagagacgaucugcuggaggcccggcgcccgagagcucacgaaugccucggagaggcccugcgggucaugcaucaaauuaucuccaaguacccucuucugaacacaguggagacccucacggcugccggcacccugauugccaagguuaaggcuuuucacuaugaaagcaauaacgaccuugagaagcaggaguucgaaaaagcgcuggaaacaaucgccguggcuuuuucuuccaccgucagcgaguuccucaugggcgagguggauucuuccacacugcuggccgugcccccuggggacagcucccagucuauggaaagccucuacggacccggcuccgaggggacgcccccuagccuggaagauugugacgccggaugccuuccggcugaggaagucgauguucugcuccagcgcugugagggcgggguggacgccgcgcugcuuuaugcuaagaauauggccaaauacaugaaggaccugauuucuuaucucgagaagagaaccacacuggaaauggaguuugccaaaggacugcaaaagaucgcucacaacugccggcaguccgugaugcaggaaccccauaugccucuccugagcaucuacucucuugcccuggagcaggaucucgaguucggccacagcaugguccaagcugugggcacccugcagacacagaccuuuaugcagccccugacccuuagacgccucgaacaugagaaacggagaaaggaaauuaaagaggccuggcaccgcgcgcaacggaagcugcaggaagccgaguccaaucugagaaaagcuaagcagggguauguucaacgcugugaggaccacgauaaggcccgguuccucguggcuaaagccgaagaggaacaggcgggaucugccccuggcgcugggagcacagccacgaagacccuggacaaaagacgccggcuugaggaagaggcuaagaacaaagccgaggaagccauggcuacauacagaaccugcgucgcggaugccaagacacagaagcaggagcuggaagacaccaaagugacggcucuccgccaaauccaggagguuauucggcaguccgaucagacaaucaagagcgccaccauuucuuacuaucaaaugaugcauaugcagaccgcuccccugccggugcacuuucagaugcugugugaauccagcaaacuuuacgacccuggacagcaauaugcuucucaugucagacagcuccagcgggaucaggagcccgacgugcacuacgauuucgagccucaugucuccgccaaugcguggagccccgugaugcgcgcuagaaaguccucuuuuaacguuagcgacguggcccggccugaagccgcuggcucucccccggaggaagggggcugcacagagggaaccccugccaaagaccacagagcgggccgcgggcaccaaguccauaaguccuggccccugagcaucuccgauagcgacucuggacuggaucccggcccuggggcuggagacuucaagaaauucgaacggacauccagcucuggcacgauguccagcaccgaggagcucguggauccggacgggggcgccggagccucugcuuuugaacaggccgaucugaauggcaugacacccgagcuuccuguugcugugcccagcgggccuuucagacacgaaggacuguccaaggccgcgcgcacccauagacuccggaaacugcgcacacccgccaagugcagagaguguaacagcuaugucuacuuucagggcgcugagugcgaagaguguugccuggccugucacaaaaagugccuugaaacccucgcuauucaaugugggcacaagaaacugcagggacggcugcaacucuucggccaggacuuuucucaugccgcccgcuccgcuccugauggggugcccuucaucgugaagaaaugcguuugugagaucgaaagacgggcgcugcgcacgaagggcauuuauagagucaauggagugaaaacccggguggagaaacuuugccaggccuuugagaacggcaaagaacuggucgagcucagccaggcuuccccgcacgacaucucuaaugugcugaagcuguaccuucgccagcucccugaaccccugauuagcuucagacuguaccaugagcucguugggcuggccaaggauucccuuaaagccgaagcugaggccaaggcggcuucucggggaagacaggacggcagcgaguccgaagccguggccgucgcucuggccgggcgccuccgggagcugcugagagaucuuccucccgaaaaccgcgcgucucugcaauaucuccugcggcaccucagacgcaucguggagguugaacaggacaauaaaaugacaccgggaaaccugggcauuguguuugggccuacccuucugcggcccagaccuacagaggcuaccgucagccucuccagccugguggacuacccccaucaggcccgcguuaucgagacgcugaucgugcacuauggccuugucuucgaagaggaacccgaggagacaccuggaggccaggaugaaucuuccaaccaacgggccgagguggugguccagguuccguaccuggaagcuggggaggccgugguguauccccuccaggaagcugccgcggacggauguagagagagccgggucgugucuaaugauuccgacagcgaucuggaggaagccucugagcuccuguccagcuccgaagcuagcgcccuuggccaccugucuuuucucgagcaacagcagagcgaagccucccuggagguugccucugggagccauuccggaucugaggaacagcuggaggccaccgcucgcgaagacggcgauggcgacgaggaugggccugcgcaacagcuuagcggauucaacacaaaucaguccaacaaugugcugcaggcuccccucccucccaugagacugcggggcgggcgcaugacccucggaucuugcagagaacggcaaccugaguuugucuga

SEQ ID NO: 70345 - RNA, 2178 nt, Artificial Sequence
  derived and/or modified sequence opt5 from HMMR__Homo_sapiens__NP_001136028
augagcuuccccaaggccccucugaaaagauuuaacgacccguccggcugcgcucccucuccuggggccuacgaugugaagacccucgagguccugaaaggacccguuagcuuccagaagucccaacgguuuaaacagcagaaggaaucuaagcagaaucuuaacguggacaaagauacaacgcugccugcgagcgcucgcaaggugaaauccucugagagcaagaaagaaucccaaaagaaugacaaggaucucaaaauccuggagaaggaaauuagaguccuucugcaggagcggggcgcccaggaccgcagaauccaggaucucgagaccgaacuggagaaaauggaagcccggcugaacgcugcccuccgcgagaagacaagccugucugcuaauaacgccacccuugagaaacaacugauugaacucacaagaaccaaugagcugcuuaaguccaaauucagcgaaaacgggaaucagaagaaccugcggauccucucucuggagcugaugaagcuccgcaauaaaagagaaacaaagaugcggggaaugauggcgaaacaggagggcauggagaugaagcugcaagugacccagcgcucccuugaagagagccaggggaaaauugcccagcuggaaggaaagcucguuucuaucgagaaggaaaagaucgacgagaaguccgagacggaaaaacugcuugaguauauugaagagaucagcugugcuuccgaucaaguggaaaaguacaaacuggacauugcccagcucgaggagaaccugaaggaaaagaaugaugagauccugucucucaaacagagccuggaagagaacauugucauccuuuccaaacagguggaggaccugaauguuaaaugccaacuccuggaaaaggagaaagaagaucacgugaacagaaaccgggagcauaaugaaaaccuuaaugcugagaugcagaaccugaagcagaaguuuauucucgagcagcaagaacgcgagaaacugcagcagaaggaacugcagaucgacagccuccugcaacaggagaaagaacuuucuuccagccugcaccagaagcucuguucuuuccaggaggagauggucaaagaaaagaaucuguuugaggaggaacugaaacaaacccuugacgaacucgauaagcugcagcagaaggaggagcaagccgaaagacuggugaaacagcucgaggaagaggccaagagccgggcggaggaacugaaacuucuggaggaaaagcucaaaggcaaggaggcugaacuggagaaguccucugccgcucauacacaggccacccugcuucuccaggagaaauaugacagcauggugcaaucccuggaagaugucacagcccaguucgagagcuacaaggcucugaccgcgucugaaaucgaggaccucaaacuggaaaacuccagccuucaggagaaggccgcuaaagccggcaagaaugccgaggauguucagcaccaaauucuggcuacggaaucuuccaaccaggaguaugugagaaugcuccuggaccugcagacaaagagcgcccuuaaagaaaccgagaucaaggaaauuacaguguccuuucuccagaaaaucaccgaucugcaaaaucagcugaagcagcaagaggaggacuuccgcaaacagcucgaagaugaggaagggcggaaggcggagaaggagaacaccacagcugaacugacggaggaaauuaauaaauggagacuucuguacgaggaacucuauaacaagaccaaacccuuucagcugcagcuggacgccuucgaggucgagaagcaagcccuucucaaugaacauggagcugcccaggagcagcugaacaaaauccgcgauucuuacgcuaagcugcucggccaccagaaucugaaacaaaagaucaagcacgugguuaaacuuaaggacgaaaacagccagcugaaauccgaggugucuaagcuccggugccagcuggccaaaaagaagcagagcgaaacaaaacugcaagaggagcuuaacaagguccuggggauuaaacauuuugacccuuccaaggcguuccaccaugaaagcaaagagaauuucgcccucaagaccccgcugaaggaaggaaacacaaauuguuacagagcucccauggagugccaggaaucuuggaaauga

SEQ ID NO: 70346 - RNA, 867 nt, Artificial Sequence
  derived and/or modified sequence opt5 from HMOX1__Homo_sapiens__NP_002124
auggagagaccccagccugacagcaugccgcaagaucuguccgaagcccucaaggaggcuaccaaagaagugcacacacaggccgagaacgcggaguucaugcggaauuuucagaagggccaggucacgcgcgacggguucaaacugguuauggcuucucuuuaccauaucuauguggcccuggaggaggaaauugagagaaacaaggaaagccccguguuugccccugucuacuuccccgaggagcuccaccggaaagcugcccuggaacaagaucuugcuuuuugguauggaccucgcuggcaggaggugauccccuacaccccugccaugcagagauauguuaagcggcugcaugaagugggccgcacagagccggaacuccuggucgcgcacgccuacaccagauaucugggggaccucuccggaggccaggugcugaagaaaauugcucaaaaggcccuugaucugcccucuagcggggagggacucgcuuucuuuacauucccuaauaucgccuccgcgaccaaauuuaagcagcuguaccggucucgcaugaacagccuugagaugacacccgccguuagacagcgggugauugaagaggcuaaaaccgccuuccugcucaauauccagcuguuugaagaacugcaagaacuccugacgcaugacaccaaggaucaguccccuagccgcgcucccggccuuagacagcgggccucuaacaagguccaagacuccgccccgguggagacaccucgcggcaaacccccucugaauaccagaagccaggcuccccuccugcggugggugcuuacacugucuuuccucgucgcgaccguugccguggggcuguacgcuauguga

SEQ ID NO: 70347 - RNA, 951 nt, Artificial Sequence
  derived and/or modified sequence opt5 from HMOX2__Homo_sapiens__NP_001120676
augagcgccgagguggaaaccuccgagggcgucgacgaaucugagaagaaaaacagcggggcucuggaaaaggagaaucagaugagaauggccgaucucuccgagcugcuuaaagaaggaacaaaggaggcgcacgaccgggcugaaaacacgcaauucguuaaagauuuucugaagggcaauaucaagaaagaacucuucaagcuggccaccacagcccuuuacuuuaccuauucugcucuggaggaggagauggaacgcaacaaagaccaucccgccuucgcuccucucuacuuuccgauggagcugcacagaaaggaagcccugacaaaagauauggaguauuucuuuggggagaauugggaagaacaggugcagugccccaaggcggcccagaaguacguggagcggauucauuauaucggacaaaacgagccugaacuccuggucgcucacgccuacacccgcuauaugggcgaccuuagcgggggacaggugcugaaaaagguugcucagagagcccucaaacugcccuccacaggcgagggcacccaguucuaccuuuuugagaauguggauaacgcgcaacaguucaagcagcuguaccgggcccgcaugaaugcucucgaccugaacaugaaaacgaaggaaagaauugucgaggaagccaauaaggcuuuugaguauaacaugcagaucuucaaugaacuggaucaagccgggucuacccucgcccgggagacacuggaggacggauuuccugugcaugauggcaaaggggacaugcgcaagugucccuucuacgcugcggaacaggauaaaggagcccuugagggcagcuccugcccuuucagaaccgcuauggccguucugcggaagccgagccuccaguuuauucuggccgcugggguggcccuugcggcuggacugcucgccugguauuacauguga

SEQ ID NO: 70348 - RNA, 516 nt, Artificial Sequence
  derived and/or modified sequence opt5 from HMP19__Homo_sapiens__NP_057064
auggugaagcugaacagcaaucccuccgagaaaggcaccaagccuccgucugucgaagacggguuccagacaguuccccucaucacgccucuggaggugaaccaccuucaacugcccgccccugaaaaagugauugucaagaccagaacagaguaccagcccgaacagaaaaauaagggaaaguuucgggugccuaaaaucgcugaguucaccguuacaauucucgugagccuggcccuugcguuucuggcuugcaucgucuuccucgugguuuauaaggccuuuaccuacgaucauuccuguccggagggcuucguguauaaacacaagcgcugcauucccgccucucuggacgcuuacuauagcucccaggauccuaacucuagaagccgguuuuacacagucaucucccauuauagcguggccaaacaaucuaccgcucgcgccaucgggcccuggcuguccgcggccgcugugauucacgaaccuaagcccccgaagacgcagggacauuga

SEQ ID NO: 70349 - RNA, 420 nt, Artificial Sequence
  derived and/or modified sequence opt5 from HMSD__Homo_sapiens__NP_001116838
augagcaucuccucugcccuggcuaugguguucaugggcgccaaggggaacaccgcggcucagaugagccaagcccucugcuuuuccaaaauuggaggcgaggacggggauauccacagaggauuccagucucugcuugucgccauuaaucggacagacacggaauacguucugcgcaccgcuaacggccucuuuggggaaaagagcuaugauuuccugacaggauuuaccgacuccuguggcaaauucuaccaggccacaaucaagcagcuugauuuugugaaugacaccgagaaaucuacaaccagagugaacagcugggucgcugauaagacgaagggcgagaauauucugcuguucuauuuugacaacauccucaauuccuucaucgugagcucucugcaaaacugccagauuuga

SEQ ID NO: 70350 - RNA, 1047 nt, Artificial Sequence
  derived and/or modified sequence opt5 from HMX1__Homo_sapiens__NP_061815
augcccgacgagcugaccgaaccuggcagagccacaccggcucgggccagcuccuuccucaucgagaaccugcuugcggcugaagccaagggggccggacgcgcuacgcagggcgaugggucuagagaggacgaagaggaggaugacgaugaccccgaagaugaggacgccgaacaagcucggcgcagacggcugcagcgcagacggcagcuccuggccggaaccggcccugggggagaggcgcgcgccagagcccuucugggccccggcgcccucgggcugggaccucggcccccuccgggccccgggccucccuuugcucugggaugcggcggggccgcgcgcugguacccuagagcccacggaggcuauggcgggggacucagccccgauacauccgaccgggauucuccggagaccggcgaagagauggggcgcgcugaaggagccuggccuagaggccccgggccuggagcugugcagcgggaggccgccgaacuggcugcgagaggccccgccgcuggcacagaggaggccagcgaacuugccgagguccccgcugccgcgggggaaacccgcggaggcguuggggugggaggcgggcggaaaaagaaaacaagaaccguguucucccgcucucaagucuuucagcuggagagcacguucgaccucaagcgguaccuguccagcgcugaaagagccggccuugccgcuucucugcagcucaccgagacacaggugaaaauuugguuucaaaaucgccggaacaaguggaagagacagcuggccgcugagcuggaagccgcgucccucagcccuccgggagcccagcgccugguucgggugcccguccuuuaucaugagucuccucccgcugccgcugccgcgggcccucccgccacccugccguucccucucgcucccgccgcuccugcucccccucccccgcugcuuggguuuuccggagcccuggcuuacccucucgcggccuuccccgcugccgccagcgugcccuuucugagagcucagaugccuggccugguuuga

SEQ ID NO: 70351 - RNA, 546 nt, Artificial Sequence
  derived and/or modified sequence opt5 from HN1__Homo_sapiens__NP_001002032
augaccacaacgaccacauucaagggcguggaccccaacagcagaaauuccucucggguccugcgcccucccgggggaggcagcaacuuuucccucggguucgaugagccgaccgaacagccuguucggaaaaauaagauggccucuaacaucuuuggaacacccgaggaaaaucaagcuagcugggccaaauccgcgggcgcuaagucuagcgggggaagagaggaccuggaauccagcggccuucagcgcagaaacucuuccgaggccagcucuggcgauuuccuggaccucaaaaagauguggacccagacaugccaggccgcuugggggcgggugaagcgcuccccuugucugcuuagacugugccccgcccgguggccucgcccgcaaugucaccccgaggaaauuccucucgcugccagccccgcgucuuccugggugagcuccgauugcccugagagaugucggucugucugcuuucugcaugccugugaacugcacaaucucagccugaccgugcaucuucuggaccucuuccacuga

SEQ ID NO: 70352 - RNA, 573 nt, Artificial Sequence
  derived and/or modified sequence opt5 from HN1L__Homo_sapiens__NP_653171
auguuccaggugcccgacagcgagggcgggagagccggaucccgggcuaugaagccuccgggcggggaaucuagcaaccuguuuggaucccccgaggaagccaccccuucuagccgccccaauagaauggcguccaacaucuucggcccuacagaggaaccccaaaauauuccuaaacggacgaacccgcccgggggaaagggcucuggcaucuuugaugagagcaccccuguccagacacgccagcaccucaaucccccugggggaaaaaccuccgacauuuucggcagccccguuacagcuaccucuagacuggcccauccgaacaagccuaaagaucacguguuucuuugcgagggggaggaacccaaguccgaccugaaggccgcucggagcaucccugccggagcugaacccggcgagaaagggucugcccgcaaggcgggacccgccaaagagcaggaaccuaugccgacaguggauucccaugagcccagacucggcccucggccccgcagccacaauaagguccugaacccucccggcgggaaaucuuccauuagcuucuacuga

SEQ ID NO: 70353 - RNA, 1896 nt, Artificial Sequence
  derived and/or modified sequence opt5 from HNF1A__Homo_sapiens__NP_000536
auggugagcaagcugucccagcuccaaaccgagcugcuugccgcucugcucgaaucuggccugagcaaagaggcccuuauccaggcgcugggggaacccggaccuuaccuccuggcuggcgaggggccgcuggacaagggagaauccugcggcgggggaagaggcgagcucgccgagcugcccaacggccuuggggaaacacggggaucugaggaugaaacggacgaugacggcgaggauuucaccccucccauucugaaagagcucgaaaaucugagcccugaggaagccgcucaccagaaggccgucguugagacacuucugcaggaagaccccuggcgcguggcuaaaauggugaaguccuaucuccaacagcauaacaucccucagagagaggucguggauaccacagggcugaaucagucucaccugagccaacaucucaacaagggaaccccgaugaaaacacagaagcgggccgcgcuguacaccugguauguucgcaaacagagagagguggcccagcaauuuacgcacgcuggccaagggggacuuauugaagaacccaccggcgacgaacugccuacaaagaaaggccggcgcaauagauucaagugggggcccgccucccagcagauccucuuucaggcuuacgagcggcagaagaacccuagcaaagaggagcgcgagacccuggucgaagaguguaauagagccgaaugcauucagcggggagugucucccucccaagcgcagggccuugggagcaaccugguuacagaggugcgcgucuauaauugguucgccaacagacggaaggaagaggcuuuucgccauaaacucgccauggauaccuacucuggaccgccucccggcccugggcccggacccgcucugccugcccacuccagcccgggccugcccccucccgcccucucuccuuccaaggugcacggcgugagauaugggcagcccgcuacgagcgagacagcggaagucccguccucuagcggaggcccucugguuaccguguccacaccccuucaucaggugagcccuaccgggcuggagcccucucacucccuccugagcaccgaagccaaacuugucucugcugccggaggcccucugcccccggugagcacacucacggcccugcauucccuggagcaaaccucuccugggcucaaucagcagccccagaaccugaucauggcuagccuucccggcguuaugacaaucggaccuggcgagccggccucccuggggcccaccuucacaaauaccggagcgagcacgcucgugauuggccuggcuucuacacaagcccaguccgucccugugaucaacagcauggggucuucccugaccacccuucagcccguucaguuuagccaaccucuccaccccuccuaccagcagccucugaugcccccggugcaaucucacgucacacagagcccuuucauggccaccauggcucagcugcagucuccccaugcccucuacucccacaagccugaaguggcucaauauacacauacgggacugcuuccccagaccaugcugauuacagacaccacaaaucucagcgcccuggcgucccugaccccgacgaaacaggucuuuaccagcgauacagaggccucuuccgaaagcggccuucacaccccugcuucucaggccacaacccuccaugugcccucccaagacccugcugggauccagcaucugcagcccgcccaccggcugagcgcgucucccacgguuagcuccagcucucucgugcuguaccaguccagcgauuccucuaacggccaaagccaccuucugccuuccaaccacucugucauugagacauucaucagcacccagauggccuccucuagccaguga

SEQ ID NO: 70354 - RNA, 1674 nt, Artificial Sequence
  derived and/or modified sequence opt5 from HNF1B__Homo_sapiens__NP_000449
auggugagcaagcugaccucccuccagcaagagcugcuuucugcccugcucagcuccggcgucacaaaagaaguucuggugcaggcucuugaggaacugcuccccucuccuaacuucggggugaagcuggagacgcugccgcucagccccggauccggcgccgaaccugacaccaaacccgucuuucacacacugaccaaugggcaugcgaagggaagacuuucuggcgaugaggggagcgaggacggagaugacuacgauacaccucccauccugaaagaacuccaggcucugaacaccgaggaagccgccgagcagcgggcugagguggaccgcaugcuuuccgaagauccuuggagagccgcuaagaugauuaagggcuauaugcaacagcacaauaucccgcagcgggagguuguggacgucacaggccugaaccagagccaucucucucaacaccugaauaaagggacccccaugaagacgcagaaacgcgccgcgcuguacaccugguaugugagaaagcagcgggaaauucuccgccaguucaaccaaacaguucaguccagcggaaauaugaccgauaaaucuucccaggaccaacugcuuuuucuguucccugaguuuagccagcagucucauggccccgggcaguccgaugacgccugcagcgaaccuacaaacaagaagaugagacggaaucgcuucaaauggggacccgcuucccaacagauccucuaccaggccuaugauagacagaagaacccgucuaaagaggagcgggaagcucugguggaggaauguaaucgcgccgagugccuucaaagaggcgucagcccuuccaaggcgcacgggcugggaagcaaccucgugaccgaagugcgggucuacaauugguuugccaaccgcagaaaagaggaggcuuuccggcagaagcuggccauggacgcuuauucuuccaaucagacgcacagccugaacccccuccugucucauggcagcccucaccaucagcccuccucuagcccucccaacaaacuuuccggcguuagauacagccaacaggggaauaacgaaauuacaucuuccagcaccaucucucaccacggaaauuccgccauggugacaagccaguccgugcugcagcaagucucuccggccagccucgaccccggccauaaccugcuuuccccugaugggaagaugaucucugugagcggaggcgggcugcccccuguuuccacccucaccaauauucacagccugucucaucacaacccccagcagucccaaaaucugaucaugacaccgcucagcggagugauggcuauugcgcagucucugaacacgucccaggcccagagcgucccugugaucaauucuguugcuggcagccuugccgcccugcaacccgugcaguuuucccagcagcuccauagcccucaccaacagccccugaugcagcagucuccuggcucccacauggcucaacagcccuucauggccgcggucacccagcugcaaaacagccauauguacgcucacaagcaggagccgccucaguauucccauacaucucgcuuucccagcgccaugguggucaccgacacauccucuauuagcacccuuacgaauauguccucuagcaaacaguguccccuccaagccugguga

SEQ ID NO: 70355 - RNA, 1425 nt, Artificial Sequence
  derived and/or modified sequence opt5 from HNF4A__Homo_sapiens__NP_000448
augagacugagcaagacccucguggacauggauauggccgacuacuccgcugcccuggaucccgcguauacaacgcuugaguucgaaaacguccagguucugaccaugggcaaugacacaucuccuagcgaggggaccaaccucaaugcuccgaacucccugggagugucugcccuuugcgccaucuguggcgaucgggcuacagggaaacacuacggagccagcuccugcgacggcuguaagggguuuuuccgcagaucugugcggaaaaaucauauguauagcugccgcuuuuccagacaaugugucguggauaaggacaaacggaaccagugccgcuacuguagacugaagaagugcuuccgggcuggaaugaaaaaggaagccguucagaaugagcgcgauagaauuagcacccggcgcagcuccuaugaagacagcucucuccccuccaucaacgcgcugcugcaggccgaggugcucagcagacaaauuacaucuccugucuccggcaucaauggcgauauucgggcuaaaaagaucgccagcaucgcugacgugugugaguccaugaaagaacagcugcuuguucugguggagugggccaaguacauucccgcguuuugcgaacucccucuggaugaccaggucgcccuucugcgcgcucacgccggggagcaucuccugcugggagcuaccaagagaucuaugguguucaaagacgugcuccugcuuggcaacgauuauaucgucccccggcacuguccugagcuggccgaaaugagcagaguuuccauucgcauccucgacgagcuggugcuuccguuucaggaacugcaaauugaugacaaugaguacgccuaccucaaggcuaucauuuucuuugaucccgacgcgaaagggcugagcgauccuggaaagaucaaacggcugagaucucaggugcaggucucccucgaagacuauaucaacgaucgccaguacgacagccggggcagauucggggagcugcuucugcuccugcccacgcuucaaucuauuaccuggcagaugaucgagcagauucaauuuaucaagcuguucggaauggccaaaauugauaaucuccugcaggaaaugcugcucggcggcagcccuuccgacgcuccccaugcccaccacccgcugcauccucaccuuaugcaggagcauauggggacaaacgugaucguugccaauaccaugcccacacaccugucuaacggacagaugugcgaauggccucgcccccggggccaagcugccacccccgagacgccucagccgucucccccugggggauccggcagcgaacccuauaagcuccugccuggggcgguggcuacaaucgucaagccccugucugccauuccgcagccuaccaucacaaaacaggaggugauuuga

SEQ ID NO: 70356 - RNA, 1338 nt, Artificial Sequence
  derived and/or modified sequence opt5 from HNF4G__Homo_sapiens__NP_004124
auggacauggccaacuacagcgaggugcuggaucccaccuauacaacgcucgaguucgaaaccaugcagauccuguacaauuccucugacagcuccgcuccugaaacaucuaugaacaccacagauaauggcgucaacugccuuugugccauuugcggggacagagcgaccggaaagcacuauggcgcuagcuccugugaugggugcaaaggauuuuuccggcgcucuaucagaaagagccauguuuacuccugucgguuuagccgccaaugcgugguggacaaagauaagagaaaucagugucgguauugccgccugagaaaauguuuccgggccggcaugaagaaggaggccguccagaacgaacgcgacagaauuucuacacggcgcuccaccuuugaugggagcaauaucccgucuauuaacacgcucgcucaggccgaggugagaucccggcaaaucagcguuucuucccccggaagcuccaccgacaucaaugugaaaaagauugcuucuaucggcgaugucugcgagagcaugaaacagcagcugcuugugcugguugaaugggccaaguacauuccugcguucugugagcucccccuggacgaucagguggcccugcuccgcgcucacgccggcgaacaucugcuucugggggcuacaaaaagauccaugauguauaaggacauccuccugcuuggaaacaauuacgucauucaccggaacagcugcgagguggagaucucuagaguggccaaucgcguccuggacgaacucguucggccuuuucaagagauucagaucgaugacaacgaauacgcgugccugaaggccaucguguucuuugaucccgacgcuaaaggccuguccgauccugugaagauuaaaaauaugagauuccagguccagaucgggcucgaggacuauauuaacgaucgccaauacgacagccggggaagauuuggcgaacugcuucugcuccugccgacccuucagucuaucacauggcagaugauugagcaaauccaguucgugaagcuguuugggaugguuaaaaucgauaaccuccugcaggagaugcugcucggaggcgccagcaaugacggcucccaucugcaccaccccaugcauccucaccuuucucaggauccccugaccgggcaaacgauucuccugggaccuaugagcacacuugugcaugcugaccagaucuccacccccgaaacaccgcugccuucucccccucagggcagcgggcaggagcaauauaagauugccgccaaccaggcuuccgucaucagccaccagcaccucucuaaacagaagcaacuguga

SEQ ID NO: 70357 - RNA, 156 nt, Artificial Sequence
  derived and/or modified sequence opt5 from HNMT__Homo_sapiens__NP_001019245
auggccagcuccaugagaucucuguucagcgaccacggcaaguacguggaguccuuucggcgcuuccucaaccauucuaccgaacaccagugcaugcaagaguuuauggauaaaaagcugcccgggaucauuggaagauaucagaauuguugcuga

SEQ ID NO: 70358 - RNA, 918 nt, Artificial Sequence
  derived and/or modified sequence opt5 from HNRNPA0__Homo_sapiens__NP_006796
auggagaacagccagcugugcaaacucuucaucggcgggcugaaugugcaaaccuccgaaucuggacuuagaggccacuuugaggccuucgggacacugacggacugugucguuguggugaacccccagaccaagcggagccgcugcuuuggauucgucacauacuccaauguggaagaggcugaugccgcgauggcugccucuccucaugccguugacggcaacaccguggaacucaagagagcugucagccgggaggauuccgcccgcccgggggcucacgccaaagugaagaaacuguuuguuggaggccuuaagggcgacguggcggagggggaucugauugaacauuucucucaguuuggaacagucgagaaggccgaaaucauugcugacaaacagagcggcaagaaaagaggguucggauuuguguauuuccaaaaucacgaugccgcugacaaggccgcgguggucaaauuucaucccauccagggccaccggguugaggugaagaaggccgugccuaaagaggauauuuacuccgggggaggcggcgggggaagcagaucuucccgcggcgggcggggaggccgcgggagaggaggcggccgggaccagaacgggcucagcaagggaggcgggggaggcuauaauucuuacgggggcuauggaggcgggggaggcgggggauacaacgcuuauggcgggggcggaggcggguccagcuacggaggcucugauuacgggaauggauucggcggguuuggcuccuauagccagcaccaauccucuuacggacccaugaaaagcggcgggggaggcgggggaggcggguccagcuggggcggacgcucuaacuccggcccuuauagagggggauacggcgggggaggcggcuaugggggaagcucuuucuga

SEQ ID NO: 70359 - RNA, 963 nt, Artificial Sequence
  derived and/or modified sequence opt5 from HNRNPA1__Homo_sapiens__NP_002127
augagcaaguccgagucucccaaagaaccugagcagcugagaaagcuguucaucggcgggcugagcuuugaaaccacagacgagucccuucggucucacuucgaacaauggggaacgcugaccgauugcguggucaugcgcgacccgaacacaaaaagaagccggggcuuuggguucguuaccuacgccacaguggaggagguggaugcugccaugaaugcgcgcccccauaaggucgacggaagagugguugaaccuaaacgggcugugucccgcgaggauucucagagacccggcgcccaccucaccgucaagaagauuuuuguugggggaaucaaagaagacacagaggagcaucaccuccgggauuauuucgaacaguacggcaagauugaggugaucgaaauuaugaccgaccgcggcagcgggaaaaagagaggauuugccuucgugacguuugaugaccaugauuccgucgacaaaaucgugauccagaaguaucacaccgugaacggccacaauugugagguccggaaggcucuuagcaaacaagaaauggccucugcuuccagcucucagcgcgggagauccggaagcggcaacuucgggggaggccggggcgggggauuuggcgggaaugauaacuucggacgcggcgggaauuuuucuggaagaggcggcuucgggggaucccggggcgggggaggcuacgggggcagcggagacggcuauaacggguucggaaaugacggcuccaacuuugggggaggcgggucuuacaaugauuucggcaacuauaauaaccagagcuccaauuuuggaccuaugaagggcgggaacuucggaggcagaagcucugggcccuacggaggcgggggccaguacuuugccaaaccucgcaaccaaggaggcuaugggggauccagcucuagcuccucuuacggcagcgggcggagauucuga

SEQ ID NO: 70360 - RNA, 1026 nt, Artificial Sequence
  derived and/or modified sequence opt5 from HNRNPA2B1__Homo_sapiens__NP_002128
auggagagagaaaaggagcaguuccggaaacuguuuaucggcgggcucagcuucgaaaccacagaggaaucccugcgcaacuacuaugagcaauggggaaaacuuacggacugcguggucaugagagaucccgccucuaagcggagccgcggcuuuggguucguuaccuuuuccucuauggcugagguggacgccgcgauggcugccagaccucacagcauugauggacggguggucgaaccgaagcgcgccguggcuagagaggaauccggcaaacccggggcccauguuacagugaagaagcuguucgucggaggcaucaaagaggacaccgaggaacaccaucuccgggauuacuuugaggaauauggcaagauugacacaaucgagauuaucaccgaucgccagucugggaaaaagagaggauucggcuuugugacauucgacgaucacgacccuguugauaaaaucgugcugcagaaguaccauaccauuaaugggcacaacgcugaaguccggaaggcccuuagccgccaggagaugcaagaggugcaguccagcagaucuggacggggcgggaauuuuggauucggcgacucccgcggcgggggaggcaacuuugggcccggaccuggcagcaauuucagagggggaucugauggcuauggcuccgggcggggauucggcgacggguacaacggauauggcgggggccccggaggcgggaauuuuggaggcagcccuggguacggaggcgggagaggcggauacggcgggggaggcccgggguauggaaaccagggcgggggcuacggaggcggguaugacaauuacggaggcgggaacuauggaucuggcaauuacaacgauuucgggaauuauaaccagcaacccuccaauuacggcccuaugaaaagcggaaacuuuggcgggucccgcaacaugggaggccccuacgggggaggcaauuauggcccugggggaucuggcgggagcggaggcuacgggggacgguccagauauuga

SEQ ID NO: 70361 - RNA, 1137 nt, Artificial Sequence
  derived and/or modified sequence opt5 from HNRNPA3__Homo_sapiens__XP_005246437
auggaggugaagcccccuccgggcagaccccagccugacagcgggcggcgcagacggcgcagaggagaagagggccacgaucccaaggaaccugagcaacugcggaaacucuucaucgggggacuguccuuugaaaccacagacgauucucuucgcgagcauuucgagaaguggggcacgcugaccgacugcgucguuaugagagauccccagacaaagcggagccgcggguuuggauucgugaccuacuccuguguggaagaggucgacgccgcuaugugcgccagaccucacaaaguggauggccggguuguggaaccgaagcgcgcggucucuagagaggacagcgugaagcccggcgcucaucucacaguuaaaaagauuuuugucgggggaaucaaagaggauaccgaagaguauaaccugcgggacuacuucgaaaaguauggcaaaauugagacaaucgaagugauggaggaucgccaguccgggaagaagagaggauuugccuucgugaccuuugacgaucacgacacgguggacaaaauugucguucagaaguaccauaccaucaauggccacaacugugaggugaaaaaggcccuuucuaaacaagaaaugcagagcgcugggucccagcggggaagaggcggcgggagcggaaauuucaugggccgcgggggaaacuuuggcgggggaggcggcaauuucgggcggggaggcaacuuugggggaagaggcggguauggcggaggcgggggaggcucucgcggguccuacggaggcggggauggcggauauaauggcuucgggggagacggcgggaacuacggaggcgggccuggcuacagcucucggggaggcuaugggggaggcgggcccggauacggcaaucaagggggcggauauggcgggggaggcggguacgauggauauaacgagggcggcaauuucgggggaggcaacuacgggggaggcgggaauuauaacgacuuuggaaauuacuccggccagcagcagagcaacuacggcccuaugaaagggggaucuuucggcgggagauccagcggaucccccuauggcgggggauacggcucuggcgggggaagcggcggguauggaucccgccgguuuuga

SEQ ID NO: 70362 - RNA, 858 nt, Artificial Sequence
  derived and/or modified sequence opt5 from HNRNPAB__Homo_sapiens__NP_004490
augagcgaggccggcgaggaacagcccauggaaaccacaggggcuacggagaacggacacgaagccgugccugagggcgaguccccggcgggggcuggaaccggcgccgccgcuggggccggaggcgcuacagccgcgcccccuucuggcaaucaaaacggggccgaaggagaccagaucaaugcuagcaagaacgaggaagaugccggcaaaauguucgucgggggacuguccugggacaccucuaagaaagaucucaaggacuacuuuacaaaauucggcgagguuguggauugcaccauuaagauggaccccaauacagggagaagccggggauuuggcuucauccuguuuaaggaugcugccuccguggagaaaguccuugaccagaaggaacaucgccuggauggcagagugauugacccuaaaaaggcgauggccaugaaaaaggaucccguuaagaaaaucuucgucgggggacucaacccugaggcuaccgaagagaagauucgggaauauuuuggcgaguucggggagaucgaagccaucgagcugccgauggaccccaaacuuaauaagcgcagaggauuuguguucauuacguuuaaagaagaggaaccugugaagaaaguucuggagaagaaguuccacaccgugucuggcagcaaaugugagaucaaggucgcucagcccaaagaaguguaccaacagcagcaguauggguccggaggccggggcaaccgcaauagagggaaccggggaagcggcgggggaggcgggggcggaggccaagggucuacaaauuacggaaagucccagcgcagaggcgggcaucagaacaauuauaaaccuuacuga

SEQ ID NO: 70363 - RNA, 921 nt, Artificial Sequence
  derived and/or modified sequence opt5 from HNRNPC__Homo_sapiens__XP_011535013
auggccagcaacgugaccaauaagacagaccccagauccaugaacucucgggucuucaucggcaaucugaacacgcucguugugaaaaagagcgauguggaggcuaucuuuuccaaauacgggaagauugucggaugcucugugcacaaaggcuucgccuuuguucaguaugugaaugaacgcaacgcgagagcugccgucgccggggaggacggacggaugauugcuggccaagugcuggauaucaaucuugccgcugaaccuaagguuaaccgcgggaaggccggagugaaaagaagcgcggccgagauguacggcuccgucaccgaacauccgucucccagcccucugcucuccagcucuuucgaccuggauuaugacuuucagcgggauuacuaugaccgcauguacuccuaucccgcuagagugccucccccuccgcccauugcccgggcuguggucccuagcaagcgccagagaguuucuggcaauacaucccggcgcgggaaaagcggauucaacucuaaguccggccagagagggagcuccaaaucuggaaaacuuaagggcgaugaccugcaagccaucaaaaaggagcucacccagaucaaacagaagguggauagccugcuggagaaucucgaaaagauugagaaggaacaguccaaacaagcgguggagaugaagaacgacaagagcgaggaggaacagucuuccagcucugucaaaaaggaugaaacaaaugugaaaauggagagcgaagggggagccgacgacuccgcugaggagggcgaucugcuugacgaugacgauaacgaagaccggggcgaugaccagcuggagcucaucaaggaugacgaaaaagaggccgaagagggggaggaugaccgcgacucugcuaauggagaagaugacagcuga

SEQ ID NO: 70364 - RNA, 864 nt, Artificial Sequence
  derived and/or modified sequence opt5 from HNRNPD__Homo_sapiens__NP_001003810
augagcgaggaacaguucggcggggacggagccgcugccgcggcuaccgccgccgugggcggguccgcuggagagcaggaaggcgccauggucgcugccacacagggggcggccgcugccgcuggaucuggcgccggcacagggggaggcaccgcgagcgggggaacagagggcggguccgccgaaucugagggagcuaagaucgaugccagcaaaaacgaggaagacgagggcaagauguuuauuggcgggcuguccugggauaccacgaaaaaggaccucaaagauuacuucucuaaguuuggagaaguuguggacugcacccugaaacuugaucccaucacaggcagaagccggggguucggauuugugcuguucaaggaguccgagagcgucgacaaggugauggaucagaaagaacacaagcucaauggcaaaguuauugacccuaagcgcgcuaaggccaugaaaaccaaggagccggugaaaaagaucuuugucgggggacugucucccgauacgccugaagagaaaauuagagaauauuucggcggcuuuggggagguggaguccaucgaacuucccauggacaacaagaccaauaaacggcgcggauucuguuuuaucacauucaaggaggaggaaccuguuaagaaaauuauggaaaagaaauaccauaacgugggccugagcaagugcgagaucaaagucgccaugucuaaggagcaguaucaacagcagcagcaauggggguccagaggaggcuuugcugggcgggcgcgcggcagaggaggcgaucagcagagcggguacggaaaggugucucggcgcggcgggcaccaaaauuccuauaaacccuacuga

SEQ ID NO: 70365 - RNA, 1092 nt, Artificial Sequence
  derived and/or modified sequence opt5 from HNRNPDL__Homo_sapiens__NP_001193929
auggaggugcccccuagacugagccacgucccgcccccucucuuccccuccgccccugcuacccuggccucucggagccuuucccauuggcgccccagaccuccgcggcagcuggcgccccuccugccuucucuugcucccagcuccgcccgccaaggcgccagacgggcucagcgccacguuacagcccagcagccuucuagacuggcugggggagccgcgaucaagggcgggcggcgcagacggcccgaccucuuucgcagacauuucaaaagcuccagcauucaacggucugccgcugccgcugccgcgacgcgcaccgccagacagcacccgccugcugauuccagcgugacaauggaagacaugaacgaguacucuaauaucgaagaguuugccgaaggauccaagauuaacgcuagcaaaaaucagcaggaugacggcaagauguucaucgggggacugucuugggauaccuccaaaaaggaccugacagaguaucucagccgguuuggcgagguggucgauugcaccauuaagacagaccccgugaccggcagaucccgcggguucggauuuguucuguucaaagaugccgccucuguggacaagguccuugaacugaaagagcauaagcucgauggcaaacugaucgacccuaagcgggcuaaggcgcuuaaagggaaggaaccucccaaaaagguguuuguuggaggccugagccccgauacguccgaggagcaaaucaaagaauacuucggggccuuuggagagauugaaaacaucgagcucccgauggacaccaagacaaaugaaagacgcggcuucuguuuuauuaccuauacagacgaggagcccgugaaaaagcugcuggaaagccgguaccaccagaucggcucugggaagugcgagauuaaagucgcucagccuaaggaaguguauagacagcaacagcagcaacagaaaggaggccgcggggccgccgcuggaggcagagggggaacccggggccgcggccgggggcagcaguccacguacggaaaggccagcagaggcgggggaaaccaccaaaauaacuaucagcccuacuga

SEQ ID NO: 70366 - RNA, 1248 nt, Artificial Sequence
  derived and/or modified sequence opt5 from HNRNPF__Homo_sapiens__NP_001091676
augaugcugggccccgaagggggagaaggcuucguggucaagcucagagggcugccuuggagcugcuccguugaggacgugcagaacuuucuuucugauuguaccauccacgacggagccgcuggcgugcauuucauuuacacacgggaagggcgccaaagcggagaggccuuugucgaacugggcuccgaggaugacgugaaaauggcgcucaagaaagauagagagucuaugggccaccgguauaucgaaguuuucaagagccaucgcacggagauggacugggugcugaaacacuccgggcccaauucugcugauagcgccaacgacggauuugucagacuucggggccugcccuucgggugcaccaaggaagagauugugcaguuuuucuccggacucgagaucguuccuaauggcauuacacugcccguggauccugaagggaagaucaccggagaggccuuuguccaguucgcuagccaggaacuggccgagaaagcucucggcaagcauaaagaacgcaucggccacagauacauugagguguuuaagucuucccaagaggaagugcggagcuauucugacccgccucugaaauucauguccguccagcgcccggggcccuacgauagaccuggaacagcccggcgcuauaucggcauuguuaagcaggcggggcuugagagaaugcggcccggagccuacagcaccggcuaugggggauacgaagaguacucuggccuguccgacggcuauggguuuacaaccgaucucuucggacgcgaccugagcuacugucuuuccggcauguaugaccacagauacggggauucugaguucacggugcagagcaccacaggacauugcgugcacaugcggggccugccuuauaaggcuaccgagaacgacaucuacaacuuuuucagcccccucaauccggucagagugcauauugagaucgggccugauggccgcguuacaggagaagccgacguggaguuugcuacccacgaagaggccgucgcggccauguccaaagaucgggcuaauaugcaacacagauauauugaacuguuccugaacucuacgacaggcgccuccaauggggcuuacagcucucaggugaugcagggaaugggcguuagcgccgcccaggcuaccuacuccgggcucgagucucaaagcguguccggauguuauggcgcgggguacagcggccagaacucuaugggaggcuaugacuga

SEQ ID NO: 70367 - RNA, 1350 nt, Artificial Sequence
  derived and/or modified sequence opt5 from HNRNPH1__Homo_sapiens__NP_005511
augaugcugggcaccgaagggggagagggcuucguggucaagguuagagggcuccccuggagcugcuccgccgacgaggugcagcgguuuuucucugauuguaaaauccaaaacggagcucagggcauucgcuuuaucuacacaagagaagggcggccuagcggagaggccuucguggaacuggaguccgaggacgaagucaaacuugcgcugaagaaggaucgcgagacgaugggccacagauauguggaaguuuuuaaaucuaauaacguggagauggacuggguccucaagcauaccggcccgaauagccccgauacagcuaacgacggguucgugcggcugcgcggacuuccuuuuggcugcuccaaggaggaaauuguucaguucuuuucugggcuggagaucgugcccaauggaauuacccucccugucgauuuccagggcagaagcacaggggaagccuuugugcaauucgccucccaggagaucgcugaaaaagcccugaagaaacacaaggagcggaucggacaucgcuacauugagaucuuuaaaagcucuagagcugaagugcggacccacuaugaucccccucgcaagcugauggccaugcagagaccgggccccuacgaccggccuggcgcggggcgcggauauaacuccauuggcagaggggccggauucgagcggaugagacgcggcgcuuacgggggaggcuauggcggguacgacgauuacaauggauauaacgacggcuacggguucggaagcgaucgguuuggcagagaccucaauuauuguuucucugggauguccgaccaucgcuacggcgauggaggcagcacauuucagucuaccacggggcacugcguccacaugcggggacugcccuauagagccaccgaaaacgacaucuacaauuucuuuuccccucuuaaccccguucgcgugcauauugagaucggcccggaugggcgggugacaggagaagcugacgucgaguucgccacccacgaggaugcgguggccgcuaugagcaaggacaaagccaauaugcaacauagauauguugaacuguuucucaacuccacagcuggcgccucugggggcgccuacgagcaccgcuacguggaacuguuccuuaauagcaccgcuggagcguccggcggggccuauggaagccagaugaugggcgggaugggacugucuaaccaguccagcuacggcgggccugcuucucagcaacucagcggcggauauggcgggggauacggcgggcaguccucuaugagcggauaugaucagguccugcaagagaacuccagcgacuuucagucuaauauugccuga

SEQ ID NO: 70368 - RNA, 1350 nt, Artificial Sequence
  derived and/or modified sequence opt5 from HNRNPH2__Homo_sapiens__NP_001027565
augaugcugagcaccgagggcagagaaggguucguggucaagguucggggacuccccugguccugcucugccgacgaggugaugcgcuuuuucagcgauuguaaaauccagaacggcacauccgggauuagauuuaucuacacgcgggaaggacgcccuucuggcgaggcuuucguggaacuggagagcgaggaagaggucaaacuugcccugaagaaggacagagaaaccauggggcaccgguauguggagguuuuuaaauccaauucuguggagauggauuggguccucaagcauacaggaccgaacagccccgacaccgcgaaugauggcuucgugcgccugagaggccuuccuuuugggugcuccaaggaagagauuguucaauucuuuagcggacuggaaaucgugcccaacggcaugacacucccugucgacuuccaggggcggucuaccggagaggcuuuugugcaguucgccucccaggaaauugccgagaaagcucugaagaaacacaaggagcgcaucggccauagauacaucgaaauuuuuaaaagcucucgggccgaggugcgcacacacuaugaucccccuagaaagcugauggcuaugcaacggccggggcccuacgaccgcccuggagccggcagaggcuauaauuccaucgggcggggagcgggcuucgaaagaaugcgcagaggggccuacggaggcggguauggaggcuacgaugacuacggcggguauaacgauggauacggcuucgggagcgaccgguuuggacgcgaucucaauuauuguuucucuggcauguccgaccaucgguacggggacggcggaagcuccuuucagucuaccacgggccacugcguccacaugagagggcugcccuaucgcgcuaccgagaacgauauuuacaauuucuuuagcccucuuaaccccaugcggguucauaucgaaauuggaccggacggcagagugacaggggaggccgauguggaguucgcuacccacgaagacgccgucgcggccauggcuaaggauaaagccaauaugcagcaucgcuauguggagcuguuucucaacuccacagcuggaaccagcggcggggccuacgaccacucuuacguugaacuguuccuuaauuccacggccggcgcuagcggaggcgcguaugggucucagaugaugggaggcauggggcugagcaaccaauccucuuacggaggcccugccagccagcagcucuccgggggcuauggaggcggguacggaggccagagcucuauguccggguaugaucaagugcugcaggagaauagcucugacuaccaguccaaccuggcuuga

SEQ ID NO: 70369 - RNA, 1395 nt, Artificial Sequence
  derived and/or modified sequence opt5 from HNRNPK__Homo_sapiens__NP_112553
auggagaccgaacagcccgaggaaacauucccuaacacggagaccaauggcgaauuugggaagagaccggccgaggacauggaggaggaacaggcuuucaaacggagccgcaacacagaugaaaugguggagcugagaauccuccugcaauccaagaaugccggagcggucauuggcaaagggggaaagaacaucaaagcccuucggaccgacuacaaugcuucuguuagcgugcccgauuccucuggcccugagcgcauucugagcaucuccgccgacauugaaacaaucggggagauccucaagaagauuauccccacccuggaagagggacuucagcugccuucucccacagcuaccagccagcucccucuggaauccgaugccguggagugccugaacuaucaacacuacaaaggcagcgacuuugauugugagcucagacugcuuauucaucagucucuggcuggcgggaucauuggagucaagggcgccaaaaucaaggaacuccgggagaauacgcagaccacaauuaaacuguuccaggaaugcuguccgcacuccaccgaccgcgugguucuuaucgggggaaagcccgauagaguggucgagugcaucaagauuauccuggaccucauuagcgaaucuccuaucaaaggccgggcgcaacccuaugauccuaacuuuuacgacgagacauaugauuacgggggauucaccaugauguuugacgaccgcagaggccggcccgugggcuucccgaugcgcgggagaggaggcuuugaucggaugccucccgggcgcggaggcagaccuaugccucccucccggagagacuaugaugacaugagcccccgccgggggccgcccccucccccucccggaagaggcggccgcgggggaucucgggccagaaaucugccgcugccucccccucccccuccccgcggcggggaucucauggcuuacgaccggagaggacgcccgggcgaucgguacgacgggaugguuggcuucuccgccgaugagacgugggacagcgcuauugauacaugguccccuucugaauggcagauggccuaugagccccagggaggcagcggguacgacuauuccuacgcgggaggcagagggagcuauggagaccugggcgggcccaucaucaccacacaggugaccauuccuaaggaucuugccggcucuaucauuggaaaaggcgggcaacgcaucaagcagauucggcaugaauccggagcuagcaucaaaaucgacgagccgcuggaaggcucugaggauagaauuaucaccauuacagggacgcaggaccaaauccagaacgcccaguaccuccugcagaauagcgucaagcaauaugcugauguggagggauuuuga

SEQ ID NO: 70370 - RNA, 1770 nt, Artificial Sequence
  derived and/or modified sequence opt5 from HNRNPL__Homo_sapiens__NP_001524
augagcagacggcugcucccccgcgccgagaagagacggcgcagacuggaacagcggcaacagccugacgagcagcgcagacgguccggcgcuauggugaaaauggccgcggcugggggaggcgggggaggcgggcgcuacuauggaggcggcucugaagggggacgggccccgaagagacuuaaaaccgauaacgccggcgaccagcacgggggaggcgggggaggcggcgggggagcuggcgccgcugggggaggcgggggaggcgagaauuacgaugacccccauaagacgccugccagccccgucguucacauccgcggccugauugauggggugguggaagcggaccucgucgaggcccugcaagaguucggaccuaucuccuaugugguugugaugcccaaaaagagacaggcucuugucgaauuugaggaugugcugggcgccugcaacgcuguuaauuacgccgcggacaaccagauuuauaucgccgggcauccugcuuucgugaauuacucuacaagccagaagauuucccggccgggagauucugacgauagccgcuccgucaacagcgugcuccuguuuaccauccugaaucccaucuauucuauuacaaccgacgugcucuacacaaucuguaacccuugcggccccguccaaagaauuguuaucuuccggaaaaauggggugcaggccaugguggaauuugauuccguccagagcgcucagagagccaaggccucucugaacggcgcugacauuuacuccggauguugcacccuuaaaaucgaguaugcgaagccuacacgccugaauguguucaaaaacgaccaagauaccugggacuacacgaaucccaaccucagcggccagggggauccgggaucuaauccuaacaagcggcagagacaacccccucugcuuggcgaccaccccgccgaguaugggggaccccauggcggguaccacucccacuaucaugaugaaggcuacggaccuccgcccccucacuaugagggccgccggauggggcccccuguuggaggccauagacgcgggcccagccgguacggaccgcaguacggccacccucccccucccccucccccgccugaauaugggccccacgcugacucccccgugcugauggucuacggccucgaucagucuaagaugaacugugacagaguguuuaauguuuucugccuguauggaaacguggagaaagucaaguuuaugaaaagcaagccuggcgccgccaugguggaaauggcugauggguacgccgucgaccgcgcgauuacccaucugaauaacaauuucauguuuggacagaaacucaacguguguguuuccaagcaaccggcuaucaugcccggccagagcuaugggcuggaggauggaucuugcuccuacaaagacuucagcgagucucggaauaacagauuuagcacaccugaacaggccgccaagaaucgcauccagcaccccuccaacgugcuucauuucuucaaugcuccucuggaggucaccgaagagaacuuuuucgaaauuugugacgagcucggcgugaagcggcccucuagcguuaaaguguuuuccggcaagagcgagagaucuuccagcgggcugcuugaaugggagucuaaauccgaugcccuggaaacacucggauuccugaaucacuaucaaaugaagaacccuaauggccccuacccguacacccugaaacucugcuuuagcacggcucagcaugccuccuga

SEQ ID NO: 70371 - RNA, 2193 nt, Artificial Sequence
  derived and/or modified sequence opt5 from HNRNPM__Homo_sapiens__NP_005959
auggccgcuggcguggaggccgcggcugaagucgccgccaccgagaucaagauggaagaggaaagcggggcucccggaguuccuuccggcaacggggccccgggacccaaaggcgagggggagagaccugcucagaaugaaaagcggaaagagaagaacauuaaacgcggaggcaauagauucgaacccuacgccaacccuacaaagcgguaucgcgcguuuaucacgaauauucccuucgacgugaaguggcaaucucugaaagaucucgugaaggagaaagucggcgaggugaccuacguugaacugcuuauggacgccgagggaaagagcagagggugcgcuguggucgaauuuaaaauggaggaauccaugaagaaggccgcugaggugcugaacaaacacucucucagcggccggccucugaagguuaaagaggauccggacggggaacaugcccgcagagcgaugcagaaggugauggccacaaccggaggcauggggaugggacccggcggcccugggaugaucacaauucccccuuccauccuuaauaaccccaauaucccgaacgagauuauccacgcucugcaggccggacggcucggcucuaccgucuucguggcuaaucuggauuauaaagugggguggaagaaacugaaggaagucuuuagcauggccggaguuguggugcgcgccgacauucucgaggauaaggacggcaaauccagagggaucggaacagucaccuucgaacagagcauugaggcugugcaagcgaucucuauguuuaacggccagcugcuuuucgaucggccuaugcauguuaagauggacgagcgcgcccugcccaaaggcgacuuuuucccucccgaaagaccccagcagcucccucacgggcugggaggcauugggaugggacuuggccccgggggccaaccgaucgaugcuaaucaucugaacaagggaaucggcauggggaauauuggaccugccggcauggggauggagggaaucggcuuugggauuaacaaaaugggcggaauggaaggccccuucgggggaggcauggagaacauggggcgguuuggauccggcaugaauauggggcgcaucaacgaaauucucagcaaugcccugaagagaggcgagaucaucgcuaagcagggaggcgggggaggcgggggaucugugccuggcauugagcggauggggcccggcaucgauagacugggaggcgccgggauggaacgcaugggagcgggccucgggcacggaauggaccgggucggcuccgagauugaaagaaugggccuggugauggaccgcauggggagcguugagcggaugggaucuggcaucgagagaauggggccgcuuggacuggaucacauggcuuccagcauugaacgcaugggccagacgauggagcggaucggguccggaguggaaagaaugggcgccggcaugggguucggacucgagcgcauggccgcuccuaucgaccgggucggccagaccauugaaagaauggggucuggaguggagcgcaugggccccgccaucgagcggauggggcugagcauggaaagaauggucccugcuggaaugggcgccggccuugagcggauggggcccgugauggaucgcauggcgacaggacuggaaagaaugggcgccaacaaucucgagcggauggggcuggaaagaaugggagcuaacucccuggagcgcaugggccucgagcggaugggggccaauagccuggaaagaaugggaccugcuaugggccccgcccuuggcgcggggauugagcgcaugggacuggccaugggcgggggaggcggggcuucuuucgacagagccaucgaaauggagcggggaaacuuuggcggcuccuucgcugggagcuuuggaggcgccgggggacaugccccgggcguugcucgcaaagcgugucaaauuuucgugagaaaucucccuuuugauuucaccuggaagaugcugaaagacaaguuuaacgaaugcgggcacguccuuuacgccgauaucaaaauggagaauggaaagucuaagggcuguggcgugguuaaauucgagagccccgaaguggcugagcgggccugccgcaugaugaacgggaugaagcuguccggaagagaaauugacguccggaucgaucgcaaugccuga

SEQ ID NO: 70372 - RNA, 1788 nt, Artificial Sequence
  derived and/or modified sequence opt5 from HNRNPR__Homo_sapiens__NP_001284549
auggccaaccaggugaauggcaacgcuguccaacugaaggaggaagaggaacccauggacaccagcuccguuacacacacggagcauuacaaaacccucaucgaagccgggcugccucagaagguggcggagagacuugaugagauuuuccagacaggacugguggcuuaugucgaccucgaugaacgggccaucgacgcccugcgcgaguuuaaugaagagggcgcucuuucugugcugcagcaauucaaagagagcgaucucucccacguucagaacaagucugccuuucugugcggggugaugaaaaccuacagacagcgggaaaagcagggaagcaagguccaagaguccacaaaaggcccggacgaagcuaagauuaaaguguucguugggaagaucccccgcgaucuguaugaggacgaacucgugccucuguuugagaaagccggacccauuugggaucuuagacugaugauggacccucucucuggccagaaucggggcuacgcguucaucaccuuuugugggaaggaggccgcucaggaagccgucaagcugugcgauagcuaugagauccgccccggaaaacaucuuggcguguguauuuccguggcuaacaauagacuguucgucgggagcaucccuaagaacaaaacaaaggaaaauauucucgaggaauuuucuaaaguuaccgagggacugguggacgugauccuguaccaccagccggaugacaagaaaaagaaccggggcuucugcuuucucgaguaugaagaccauaaguccgccgcgcaagcccgcagacggcugaugagcgggaaagucaagguguggggaaauguugugacggucgagugggcugaucccguggaagaaccugaccccgaaguuauggccaaagugaagguccuuuucgugcgcaaccuggcuaccacagucaccgaggagauucucgaaaaaucuuuuuccgaguucggcaagcuggaaagagugaagaaacuuaaggauuacgccuucguucacuuugaggaccggggcgccgcugugaaagcgauggaugagaugaaugggaaggaaaucgagggagaagagauugaaaucguccuggccaaaccucccgacaagaagcgcaaagagagacaggcugcccggcaggccagcagaucuacagcuuacgaggauuauuacuaucacccgccuccccgcaugccuccucccauccggggcagagggcgcggaggcgggcggggaggcuacggcuaucccccggacuacuauggguacgaagauuacuaugacgauuacuauggauacgacuaucaugacuacagaggcggguaugaggaucccuacuacggauaugacgauggcuacgccgugcgcgggcggggcggaggcagagggggacgcggcgcgccucccccuccccgggggagaggagcuccgccuccccgcggccgggccggguauucccaaagaggcgccccucucggacccccucggggcagccgcgggggaagaggcgggcccgcucagcagcagcggggaagaggcucccgcgggucucggggcaacagaggaggcaauguugggggaaagcgcaaagccgacggcuacaaccaaccggauagcaagagacggcagaccaacaaucagcagaacugggggucccaaccuauugcucagcagccccugcagcaaggaggcgacuauagcgggaauuacggcuauaacaaugauaaccaggaguucuaccaggacacguacggacagcaauggaaauga

SEQ ID NO: 70373 - RNA, 2421 nt, Artificial Sequence
  derived and/or modified sequence opt5 from HNRNPU__Homo_sapiens__NP_004492
augagcuccucucccgugaacgucaagaaacucaagguuagcgaacucaaagaggaacugaagaaaagacggcuuuccgacaagggccugaaggccgaacucauggagcgccugcaggcugcccuugaugacgaagaggcugggggaagaccugcgauggagccgggcaaugggucucuggaucucggaggcgacagcgccgggcgguccggagccggccuggaacaagaggcugccgcuggcggggaugaagaggaggaagaggaagaggaagaggaggaaggaaucucugcccuggacggcgaucagauggagcucggggaagagaacggagcggccggcgcugccgacagcgggcccauggaagaggaggaagcugccuccgaggaugaaaauggagacgaucagggcuuccaggagggcgaagacgagcugggggaugaggaagagggagcgggcgacgaaaacgggcacggagagcaacagccucagcccccugccacccagcaacagcagccccagcaacagcgcggcgcugccaaagaggcugccggaaagagcucugggccuacaucccuuuuugccgugacgguggcuccgcccggcgcgagacagggccaacagcaggccgggggagacggcaaaaccgaacagaaagggggagauaaaaagcggggcgucaagcgcccuagagaggaccaugggcggggcuacuucgaauauauugaggaaaauaaauacagccgcgcuaagucuccccaaccucccguggaggaggaagaugagcacuuugacgauacaguugugugccuggacaccuauaacugugaucuccauuucaaaaucuccagagaccggcugagcgccucuucccuuacaauggagagcuuugccuuccugugggcuggaggccgcgccuccuacggggucucuaagggaaaagugugcuuugaaaugaagguuaccgaaaagauuccggugagacaccucuauacaaaggauaucgacauucaugagguccggaucggcuggagccugaccacguccgggaugcugcucggagaggaagaguucagcuacggcuauucucugaaggggaucaaaaccuguaauugcgaaacagaggauuacggcgaaaaguuugacgagaacgacgugauuaccuguuucgcgaauuuugaguccgaugaaguggagcuuagcuacgcuaaaaacggacaggaccugggcgucgccuucaagaucucuaaagaaguucucgccgggcgcccucuguuuccccacgugcuuugccacaauugugcuguggaguucaacuucggacagaaggagaagccuuauuuucccauucccgaagaguacacauucauccagaaugucccucuggaagauagagugcggggcccgaaagggcccgaggaaaagaaagacugcgagguugugaugaugauuggacucccuggcgccgggaagaccacgugggucacaaaacaugcugccgagaaccccggcaaguauaauauccugggaaccaacacaauuauggauaagaugaugguggcgggcuuuaaaaagcaaauggccgacaccgggaaacugaacacccuccugcagagagcuccucagugucuuggaaaguucaucgaaaucgccgcucgcaaaaagcggaauuuuauucuggaucagacaaacguuagcgccgcggcccaaagacgcaagaugugccucuucgcuggcuuucagcggaaagccguggucgugugucccaaggacgaggauuacaaacagagaacgcagaagaaagcugaagucgaggggaaggaccugccggaacacgccgugcuuaaaaugaagggaaauuucacccugccugagguugccgagugcuuugaugaaaucacauauguggagcuccaaaaggaagaggcucagaaacugcuggaacaguacaaggaggaguccaaaaaggcgcugcccccugagaaaaagcaaaacaccggcucuaagaaaagcaauaagaacaaauccgggaagaaucaguucaaccgcggcggaggccaucgggggagaggaggcuuuaauaugcgcgggggaaacuuccggggcggcgcccccgggaauagaggaggcuauaaccgccgggggaauaugccucagagaggaggcgggggaggcggcagcgggggaauuggcuaccccuacccgcgggcuccugucuuucccgggcgcggaucuuauuccaacagaggcaauuacaacagagggggaaugcccaaccggggcaauuauaaccagaauuuccgcggccgggggaacaauagaggauacaaaaaccaaagccagggcuauaaucaguggcagcaagggcaguucuggggacagaagccuuggucucagcacuaccaccaaggcuauuacuga

SEQ ID NO: 70374 - RNA, 2571 nt, Artificial Sequence
  derived and/or modified sequence opt5 from HNRNPUL1__Homo_sapiens__NP_008971
auggacgugagacggcugaaggucaacgagcuccgcgaggagcugcagagacggggccuugauacccgcgggcugaaagccgaacucgcugagagacugcaagccgcgcuugaagcugaggagcccgacgaugaacgggagcuggacgccgaugacgaaccuggacgcccgggccacaucaaugaggagguugaaacagaagggggaagcgaacucgagggcacggcccagcccccucccccugggcugcagccccaugcugaaccuggaggcuacuccggcccggaugggcacuaugccauggacaacauuaccagacagaaucaauucuacgauacacaggugaucaagcaggagaacgagucuggauaugaacggcgcccccuggagauggaacagcaacaggcuuacagaccugagaugaaaaccgaaaugaagcagggcgcccccaccagcuuucucccucccgaggcgucccagcugaaaccggaccggcaacaguuccagucucgcaagagaccuuaugaggaaaaucgggggcgcggauacuuugagcauagagaagaucggagaggccgcagcccccaaccucccgccgaggaagacgaggaugacuucgacgauacccuuguggcuauugacacauauaacugcgaucugcacuuuaaggucgcccgggacagauccucuggguacccccucaccaucgagggauucgcuuaccuguggagcggcgcccgcgcguccuauggcgugcggagagggcgcguuuguuuugaaaugaaaauuaaugaggaaaucagcgugaagcaucuuccuucuacggagccggauccccacgucgugcggaucggauggucccuggacagcugcucuacccagcucggcgaggaaccuuucuccuacggguauggaggcacagggaaaaagagcaccaacucuagauuugagaauuacggagauaaauucgccgaaaacgacguuauuggcuguuuugcugauuucgagugcggcaaugacguggaacuguccuuuacaaagaacgggaaguggaugggaaucgccuuccgcauucagaaagaggcucugggcgggcaggcccucuauccccacguccuggugaagaauugugccguggaguucaacuuuggacaacgggcugaaccuuacugcagcguccuucccggcuucaccuuuauccagcaucugccgcucuccgagcgcauuagagggacgguuggcccuaaaucuaaggcggaaugugagauccugaugauggugggacuucccgccgcuggcaaaacaaccugggccauuaagcacgccgcuagcaauccuuccaaaaaguauaacauccuggggacaaacgccaucauggauaagaugcgggugaugggacucagacggcagcgcaauuacgcgggcagaugggacguccugauucagcaagcuacccagugccugaaccggcucauccagauugccgcccgcaaaaagagaaauuacauccuggaccagaccaacguguaugggagcgcucaacggagaaaaaugcgccccuucgaaggauuucagagaaaggccauuguuaucuguccuacagaugaggaccuuaaagaucggacgaucaagcgcaccgacgaggaaggcaaggaugugcccgaccaugcuguccuggagaugaaagccaauuucacacucccggaugugggggacuuucuggaugaaguucuuuucauugagcugcagagagaagaggcggacaagcucgugcggcaguacaacgaggaaggccgcaaagccggaccuccgcccgagaagagauuugauaaucggggcgggggaggcuuccgcgggagaggaggcgggggcggauuucaacgguaugaaaaccgcggcccucccgggggaaauagaggcggguuccagaaccggggaggcgggucuggcggaggcgggaauuacagaggaggcuuuaaccgcuccgggggaggcggcuauagccagaaucggugggggaacaauaacagagacaacaauaacucuaauaaccgcggaagcuacaaucgggcuccccaacagcagccucccccucagcaacccccucccccgcagccucccccucagcagcccccgccucccccuuccuauucucccgccagaaaucccccuggcgcuagcaccuacaacaaaaacuccaauaucccggggagcucugccaacacauccacccccacggucagcucuuacuccccuccccaaccuagcuauucccagcccccuuacaaucagggaggcuauucucagggguacacagcgccgcccccucccccucccccgccucccgccuauaacuacggaagcuauggcggcuacaaucccgcuccuuacacacccccuccgcccccuaccgcccaaacauauccccagccuuccuacaaccaguaucaacaguacgcucagcaguggaaucaauauuaccagaaccaggggcaguggcccccguauuacggaaacuacgauuauggcucuuacagcgggaauacccaaggaggcacauccacgcaguga

SEQ ID NO: 70375 - RNA, 495 nt, Artificial Sequence
  derived and/or modified sequence opt5 from HOGA1__Homo_sapiens__NP_001128142
augcugggcccccagguguggagcuccgucagacaagggcucucucggagccugucccgcaacguuggagugugggccucuggcgaggggaagaaaguggacaucgcuggaauuuacccuccggucaccacacccuucacggccaccgcggaaguggauuauggcaaacuugaggaaaaucugcacaagcucgggacauuuccuuucagaggagcuguuggcggcgugugcgcccuggccaacguccuuggggcucaggugugucagcuggagcggcucugcuguaccggacagugggaagacgcccaaaagcugcagcaucgccugaucgagcccaaugcugccguuacaagacgguuuggcauuccugggcucaaaaagaucauggauugguucggauacuauggcgggcccugccgcgcgccucugcaggagcuuagcccggccgaagaggaagcucugagaauggacuuuaccuccaacggauggcucuga

SEQ ID NO: 70376 - RNA, 675 nt, Artificial Sequence
  derived and/or modified sequence opt5 from HOMER1__Homo_sapiens__NP_001264006
augggcgagcagcccaucuucagcaccagagcccacguguuucaaauugacccuaacacaaagaaaaauugggucccgacguccaagcaugcuguuaccgugucuuacuucuaugauagcacacggaacguguaccgcaucauuucccuggacgggucuaaagccaucauuaauagcaccaucacacccaacaugaccuuuacaaagaccucccagaaauucggacagugggcggauucuagagcuaauacggucuauggccucggguuuagcuccgaacaccaucugagcaaggugaccgagcuugaaugcguuucuucccaggccaacgccgugcacacacauaagaccgagcugaaucaaacaauccaggaacucgaggagacccugaaacuuaaggaagaggaaauugagcggcugaaacaggagaucgacaacgcucgcgaacuccaggagcaaagagauagccugacgcagaagcugcaggaagucgagauucggaauaaagaccucgaaggacagcugucugaucuugagcaacgccuggagaagucccagaacgaacaggaggccuucagaaauaaccucaagacacugcuugaaauccuggacggcaaaauuuuugagcucaccgaacugcgggauaaucuggcuaagcuccuggaguguagcuga

SEQ ID NO: 70377 - RNA, 1032 nt, Artificial Sequence
  derived and/or modified sequence opt5 from HOMER2__Homo_sapiens__NP_004830
augggcgagcagcccaucuucaccacaagagcccacguguuucaaauugacccuaacacgaagaaaaauuggaugccggcuagcaagcaggccgucaccguuuccuacuucuaugaugugacacggaacucuuaccgcaucauuagcguggacggggcgaaagucaucauuaauuccaccaucacacccaacaugaccuuuacaaagaccucucagaaauucggacagugggcugauagcagagccaauacgguguuuggccugggguucuccucugaacaacagcucaccaaguuugccgagaaguuccaggaaguuaaagaggcugccaagaucgcuaaagacaagacacaggagaaaauugaaaccagcuccaaccauagccaagccucuuccgugaauggaacagaugacgagaaggcgagccacgccggcccugcuaacacccaucugaagucugaaaaugauaaacuuaagaucgcccugacgcaguccgcugccaacgucaaaaagugggagauugaacuccagacacugcgggagagcaaugcgcgccuuaccacagcccugcaggagucugcugccuccguggaacaauggaaaagacaguuuagcaucugccgggacgagaacgaucgccucagaaauaagauugacgaacuggaggaacaguguuccgagaucaaccgggagaaagaaaagaauacccaacugaagcgcagaauugaggaacucgaggcugaacugcgggagaaagagaccgaacuuaaggaucugcgcaaacagucugagaucaucccccagcucaugagcgaaugcgaguauguuuccgaaaagcuggaggccgccgagagagacaaccagaaccuugaagauaaagugcggagccugaagacagacauugaggaaucuaaguaccgccaaagacaccucaaagucgagcugaaguccuuccuggaggugcucgacgggaaaaucgaugaccugcaugauuuucggagaggacuuagcaagcugggcacggacaauuga

SEQ ID NO: 70378 - RNA, 1077 nt, Artificial Sequence
  derived and/or modified sequence opt5 from HOMER3__Homo_sapiens__NP_001139193
augagcaccgccagagagcagcccaucuucuccacacgggcucacguguuucaaauugacccugccacgaagcgcaacuggaucccggcgggcaaacaugcucugaccgucucuuacuucuaugaugccacaagaaauguuuaccggauuaucagcauugggggagccaaggcuaucaucaacuccaccgugacacccaauaugaccuuuacaaaaaccucucagaaguucggccagugggccgacagccgcgcuaacacgguguaugggcucggauuugccuccgaacagcaccugacccaauucgcggagaaauuucaggaagucaaggaggccgcuagacuugcccgggaaaagucucaggauggcggggagcugacaagcccugcucucggacuggccucccaucaggugcccccuagcccccuuguuucugcgaauggcccuggcgaggaaaaacuguuccgcucccaaagcgccgacgcuccggggcccaccgagagagaacggcucaagaaaaugcugucugagggauccgugggcgagguccagugggaagccgaguuuuucgcucugcaggauagcaacaauaagcucgccggggcccugcgcgaagcuaacgcggccgcugcccaguggagacaacagcuugaggcccagcgggcugaagccgagcgccugagacaacggguggcggagcucgaagcucaggccgccucugagguuacaccuaccggagaaaaagagggccuggggcagggacagucccuugaacaacuggaggcucucgugcagacgaaggaccaggagauucagacacucaagagccaaaccggcggcccccgcgaagcccuggaggcugccgaaagagaggaaacacagcagaaaguccagacccggaaugcggagcuggagcaccaacugagagccauggaacgcucccuugaggaagcucgggccgagagagagcgcgcucgggccgaaguggggagagcggcccagcugcucgaugugucucuguuugagcuuagcgaacugcgcgagggacucgcucggcuggccgaagcugccccuuga

SEQ ID NO: 70379 - RNA, 1653 nt, Artificial Sequence
  derived and/or modified sequence opt5 from HOMEZ__Homo_sapiens__NP_065885
auggugagaggcugggagcccccuccggggcuggacugcgccaucagcgaaggacacaaguccgagggcaccaugcccccuaacaaagaggcuucugggcucagcuccucucccgccggacugauuugucuuccucccaucagcgaggaacugcagcucgucuggacacaagcggcucagacguccgagcuggauucuaaugagcaucuucugaagaccuucagcuacuuuccuuauccgucccucgccgacauugcccugcugugccuccgguacggccugcagauggaaaaaguuaagacaugguucauggcucagcgccuuagaugugggaucagcuggucuuccgaggaaauugaggagacccgggcccgcgugguguauagacgggaucaacugcacuuuaaaagccuccugucuuucacacaucacgcuggaagacccccugaagaggugcccccucccccggucccugcccccgaacagguuggcaucggcaucgggccucccacccuuuccaagcccacacagaccaagggacugaaaguggagccugaagaaccgagccagaugcccccucucccccaaucucaucagaagcugaaagagucccugaugacgccuggcagcggggcguuucccuaccaguccgacuucuggcagcaccuccaaucuagcggacuguccaaggaacaggccggccgcgggccgaaccagagccacggaauuggcaccgcuucuuggaaucauuccacaaccgucccucaaccccaggcccgggauaaaccucccccuaucgcucuuauugccagcucuugcaaggaggaaagcgcguccucugugacacccagcuccagcucuaccuccagcucuuuucagguucuggccaacggcgcuacggccgcuuccaagccgcuccagccucuggggugugugccccaaagcgucucccccucugagcaggcccuuccuccgcaccuggaacccgccuggccucagggacuccgccauaauagcgugcccggcagaguggggccuacagaguaucugucccccgacaugcagcggcaacgcaaaaccaagagaaaaacaaaggagcagcuggcuauccucaaaucuuucuuucugcagugccagugggcgcggcgcgaagauuaccaaaaacuugagcagauuaccggacugccuagacccgaaaucauucagugguucggcgacacccgguaugcccucaagcacgggcagcugaagugguuuagagauaacgcugucccgggagccccuagcuuccaagaccccgccaucccuacacccccgccuuccacgcgcagccuuaaugagcgggcugaaacacccccucugcccauucccccuccgcccccugauauccagccccucgagagauacugggccgcgcaccagcaacugcgcgagaccgacaucccucagcugucucaggcuucccggcucagcacccagcaaguucuggauugguuugacucuagacuuccccagccugccgaagugguggucugucuggacgaggaagaggaggaagaggaagaggaacucccggaggaugacgaggaagaggaagaggaagaggaggaagaugacgaugacgaugacgaugacgugauuauccaggauuga

SEQ ID NO: 70380 - RNA, 2154 nt, Artificial Sequence
  derived and/or modified sequence opt5 from HOOK2__Homo_sapiens__NP_001093646
augagcguggacaaggccgagcugugcggcucccuccugaccuggcuucagacauuccacguccccucuccuugugcuagcccgcaagaucuguccucugggcucgccguugcguacgugcugaaccagaucgaccccagcugguuuaaugaggcuuggcuucagggaauuuccgaggauccuggccccaacuggaaacugaaggugucuaaucucaaaaugguccugagaagccugguggaauauucccaggacguucucgcccauccugugagcgaggaacaucugcccgaugucucucuuaucggggaguucuccgacccugccgagcugggaaagcuccugcaacuugugcugggcugcgcuauuagcugugagaaaaagcaggaucacauccagcggauuaugacgcucgaggaaucuguucagcacguggucauggaggccauccaagagcugaugaccaaggacacaccggauucccugagccccgaaaccuacgggaacuuugacucucagucccgcagauauuacuuccucagcgaggaagcugaggaaggagaugagcugcagcagcggugccuugaccuggagcgccaacucaugcugcuuuccgaagagaaacagucucuggcccaggaaaaugcgggccucagagagcggaugggccgcccugaaggggagggaacacccggccugaccgccaagaaacugcuccugcuucaaagccagcuggagcagcuccaggaagagaacuuuagacuggaauccgggcgggaggaugaacgccuuagaugugcugagcuggagcgggaaguggccgagcuccaacaucgcaaucaggcucugacaagccuggcccaggaagcgcaggcccucaaggacgagauggacgagcugagacaaucuuccgaacgggcuggacagcuugaggccacccugacgagcugccgcagacggcucggcgaacugagagagcugcgcagacaggugcggcagcuugaagaacgcaacgcugggcacgccgagcggaccagacaacucgaagaugagcugcgccgggccggaucucugagagcucagcucgaagcgcagcgccggcagguccaagagcugcagggccagagacaagaagaggccaugaaagcugagaaguggcuuuucgaaugucgcaaucuggaggaaaaguaugagagcguuacaaaagaaaaggagcggcuccuggccgagagagacucccugcgggaagccaacgaggaacuucgcugcgcucagcuccagccuagaggccugacccaggccgaucccucucuggacccgacaagcaccccuguggauaaucucgcggcugagauccugcccgccgagcuucgggaaacgcugcucagacugcaacuggagaacaaacgccuuugucggcaggaagccgcugacagagagcgccaggaagaacuccagagacaccuggaggaugccaaucgggcucgccaugggcuggaaacacaacacagacucaaccagcagcagcuguccgagcuucgggcccaaguggaagaccugcagaaggcgcuccaggagcaaggaggcaaaaccgaagauagcauucugcugaagcgcaaacuugaggagcaucuccagaagcugcacgaagccgaccuggagcuccagagaaagcgggaauacaucgaggaacuggagccucccacagauucuuccaccgcucgcagaauugaggaacuucagcacaaucugcagaaaaaggacgccgaccuccgggcuauggaggaacgcuauagacgguacgucgauaaagccagaauggugaugcaaaccauggagcccaagcagcgcccugcggccggggcuccgcccgagcugcauagccugcggacacagcuuagagaacgcgacguucggaucagacaccuggagauggauuuugaaaaaucucgcucccaacgggagcaggaagagaagcuccugauuagcgccugguacaacaugggaauggcucuccagcagagagccggcgaggaacgcgccccugcucaugcgcaauccuuccuggcccagcagcggcuugcuacgaacucuagacgggggccccugggacgccucgccagccugaaucugagaccuaccgacaagcacuga

SEQ ID NO: 70381 - RNA, 2157 nt, Artificial Sequence
  derived and/or modified sequence opt5 from HOOK3__Homo_sapiens__NP_115786
auguucagcguggagucccuggaaagagccgagcucugcgaaucucugcuuaccuggauccagacauuuaacgucgacgcucccugucaaacgguugaggaucugaccaauggcguggugauggcccagguccuccagaagauugacccugcguacuucgaugaaaacuggcugaaucggaucaaaacagaggugggggacaacuggcgccuuaagauuagcaaucugaaaaagauccucaaaggcauucuggauuauaaccacgagauccugggacagcaaaucaaugacuuuacccucccggauguuaaccugauuggggaacauuccgacgcugccgagcuuggaagaaugcugcagcucauccugggcugcgccgugaauugugaacagaagcaggaguacauucaagcuaucaugaugauggaggaaucuguccagcacgugguuaugacagccauucaggagcuuaugagcaaggaaucccccgugucugcugggaacgaugccuaugucgaccuggaucggcagcucaaaaagaccacagaggaacugaaugaggcgcugagcgccaaagaggaaaucgcucaacgcugccaugagcucgacaugcaaguggccgcucugcaggaagagaaguccagccuucuggccgaaaaccaggugcucauggagagacugaaucagucugauuccauugaggacccuaacagccccgcgggacggcgccaccuucagcugcagacccaacucgaacagcugcaggaggaaacguucagacuggaggccgcuaaagacgauuaccggauccgcugugaagaacucgagaaggaaaucucugagcugagacagcaaaaugacgaacuuaccacacuggccgaugaggcucagucccucaaggacgagauugauguccugcggcauagcucugacaaaguuuccaaacuugaaggccagguggagagcuauaaaaagaaacuggaagaucucggcgaccugcgcagacaggugaagcugcucgaggaaaagaacaccauguacaugcaaaacacagucucccuggaggaggaacuucggaaggccaaugccgcucgcucucagcuggagaccuauaagagacaggugguugaacuccagaaccggcugagcgaggaauccaaaaaggcggauaaacuggacuuugaguacaagagacuuaaagagaagguggauagccuccaaaaggaaaaagaccgccugcggacggagagagacucucugaaggaaacaaucgaggaacuccgcugcguccaggcccaggaggggcaacugaccacacagggacuuaugccucugggcucccaggagagcucugauagccucgcugccgaaauugugacccccgagauccgggaaaaacugauuagacugcagcacgagaauaagaugcuuaaacucaaccaagagggguccgacaaugaaaagaucgcccugcugcagucucuccuggaugacgcuaaccuucgcaagaaugagcuggaaaccgagaaccggcucguuaaucagagacugcuggaagugcagagccaagucgaggagcuucagaaaucccuccaggaucagggaagcaaggccgaagacucugugcugcugaaaaagaaacucgaggaacaccuggagaaacuucaugaagcgaacaaugagcugcaaaagaaacgcgcuaucauugaggaucucgaaccucgguucaacaauuccagccugaagaucgaggaacugcaggaggcccuuagaaagaaggaagaggagaugaaacagauggaggagcgcuacaagaaauaucucgaaaaggccaagucugucauucggacacuggacccgaaacaaaaccagggcgcugcccccgagauccaggcucugaagaaucagcuccaagagagagaucggcuguuucacucccuugaaaaagaguacgaaaagacgaaaagccagcgcgagauggaagagaaguauauuguguccgccugguacaacauggggaugacccugcauaagaaagcggccgaggacagacucgcuucuacaggaagcggccaguccuuccuggcccggcagagacaagcuaccucuagccgccgguccuauccuggccacguucagcccgccacagcgagauga

SEQ ID NO: 70382 - RNA, 222 nt, Artificial Sequence
  derived and/or modified sequence opt5 from HOPX__Homo_sapiens__NP_001138931
augagcgccgagaccgcuuccggccccacagaagaccagguggagauccuggaauacaacuucaauaaggucgauaaacacccugacucuacgacccucugccugauugccgcggaggcugggcuuagcgaagaggagacacaaaagugguuuaaacagagacuggccaaguggcggcgcuccgaaggacucccgucugaguguagaagcguuaccgauuga

SEQ ID NO: 70383 - RNA, 924 nt, Artificial Sequence
  derived and/or modified sequence opt5 from HORMAD2__Homo_sapiens__NP_689723
auggccaccgcucagcugagccacugcaucacaauucauaaggccuccaaagagacgguguuccccucucaaaucaccaacgaacacgagagccucaagauggucaaaaagcuguuugcgacauccauuucuuguaucaccuaccuuagaggccuguucccugaaagcuccuauggggagcggcaucucgacgaucugucucuuaaaauucugcgcgaagacaagaagugcccgggaagccuccacaucaucagauggauucagggcuguuuugaugcucuggagaaacgguaccugcgcauggccguucucacacuguauaccgaccccaugggguccgagaaggugacagaaauguaccaguucaaauuuaaguauaccaaagagggagccacgauggauuucgacagccauucuuccagcaccucuuuugaauccggcacaaauaacgaggauaucaagaaggcuagcgugcuucugauuagaaaacucuacauccugaugcaggaccuugagccucugcccaauaacgucgugcucaccaugaagcugcacuauuacaaugccguuacaccucacgauuaccaaccccugggguucaaagaaggagugaacucucauuuucuccuguucgacaaggagccuauuaauguccaggugggcuuuguuuccaccggcuuccacagcaugaaagugaaggucaugacggaagcuacaaaagugaucgaucuugagaacaaucuguuucgggaaaacuccaccacagagauugcccaucaggggcucgacugcgaugaggaagaggaauguaaugaccacauccagcgcaugaacuucgugugcucucaacagagcuccgaguguagcagaaagaagcggaaagucucugaaccgguuaagguguucauccccaaucgcaaauga

SEQ ID NO: 70384 - RNA, 1233 nt, Artificial Sequence
  derived and/or modified sequence opt5 from HOXA10__Homo_sapiens__NP_061824
augagcgccagaaagggcuaccugcuccccuccccuaacuauccgaccacaaugucuugcagcgagucccccgcugccaauucuuuccugguggacagccuuaucuccucugggcggggagaagcgggcgggggaggcgggggagcuggcggcgggggaggcgggggauacuaugcccacggcggggucuaccugccucccgccgcugaucucccuuauggacugcagagcuguggccuuuuucccacgcugggcgggaaacgcaacgaggccgcuuccccuggaagcggcgggggaggcgggggacucggcccgggcgcccauggguacggacccucuccuauugaccuguggcuggaugcgcccagauccugccggauggaaccucccgacggcccgccucccccuccccaacagcagcccccuccgcccccucagcccccucaacccgccccgcaggcuaccagcuguucuuucgcccagaauaucaaggaggaauccagcuauugccucuacgauucugcugacaaauguccuaagguuuccgccacagcggccgagcuggcucccuuuccucgcgggcccccucccgauggaugcgcccuuggcaccagcuccggggugccggugccuggcuacuucagacugucucaggcuuauggaacagccaaaggcuacgggagcggaggcgggggagcccaacagcucggcgcugggcccuuucccgcgcagccuccgggccggggauucgaccugcccccugcccuugcuuccggcagcgccgaugccgcucgcaaggagagagcccuggacucucccccucccccuacccucgcguguggguccggaggcgggagccagggagaugaagaggcucacgccucuagcuccgccgcugaggaacugucucccgccccgagcgaguccagcaaggcuucuccugaaaaagacucccugggcaacagcaagggggagaaugccgcgaacuggcucacagccaaaucuggccggaagaaacgcugccccuauaccaagcaucaaacgcuggaacuugagaaggaauuucuguucaauauguaccucaccagagagcggcgccuggagauuuccagaagcguccaccuuacagauagacaggugaaaaucugguuucagaaccgcagaaugaagcugaaaaagaugaaucgggaaaaccggauucgcgagcucaccgcuaauuucaacuuuuccuga

SEQ ID NO: 70385 - RNA, 942 nt, Artificial Sequence
  derived and/or modified sequence opt5 from HOXA11__Homo_sapiens__NP_005514
auggacuucgaugagagaggccccugcagcuccaacauguaccugccuucuuguaccuauuacgugagcgggccggacuuuuccucucuccccagcuuccugccucagacacccuccucucggccuaugacguauagcuacuccagcaaucuuccccaaguccagccuguucgcgaagugaccuuuagagaguaugccaucgaaccggcuacaaaguggcacccccggggaaaccuggcccauugcuacucugcggaggaacucgugcaccgcgauugucugcaggcuccuuccgccgccggcguccccggggacgugcuugcuaaaagcucugccaauguuuaucaucacccuacccccgcuguguccagcaacuucuacucuacagucggaagaaauggcgugcugccgcaggccuuugaucaauucuuugagaccgcguacgggacaccugagaaccucgccuccagcgacuaucccggagauaaguccgcugaaaaaggcccucccgccgcuaccgccacgucugcggccgcugccgcugccgccaccggcgcucccgcgacaagcuccagcgacucugggggaggcgggggaugccgggagaccgccgcugccgccgaagagaaggagcgcagacggcgcccugaauccagcucuagcccggaguccucuagcggccauacagaagauaaagcugggggauccagcggccagagaacccggaagaagcgcugucccuacacgaaauaucagauuagagagcuggaacgggaguucuuuuucucuguuuacaucaauaaggagaaacgccugcagcucuccagaaugcugaaccuuacagaccggcaagugaagauuugguuucagaauagacgcaugaaagaaaagaagaucaaccgggauagacugcaguauuacagcgccaauccucuccuguga

SEQ ID NO: 70386 - RNA, 1167 nt, Artificial Sequence
  derived and/or modified sequence opt5 from HOXA13__Homo_sapiens__XP_011513646
augaccgccagcgugcugcuccaccccagauggaucgagccuacagucauguuccuguacgacaacggcgggggacuuguugcugaugaacugaauaagaacauggagggcgccgcggcugccgccgcugccgcugccgcggccgcugccgcuggggccggaggcgggggauuuccgcaucccgcggccgcugccgcuggcggcaauuucuccguggccgccgcugcggccgcugccgccgcugccgcggcuaaccagugccggaaucucauggcccacccugcuccccuggccccuggggccgcuucugccuauagcuccgcgcccggagaagccccuccgucugcugccgcugccgcggccgcugccgcugccgccgcugcggccgcugccgccgcuagcuccucuggcgggcccggaccugccggccccgcgggggcugaggccgccaaacaauguagcccuugcuccgcugccgcgcagucuagcuccggacccgcugcccuuccguacggcuauuuuggcagcggguacuauccuugugcccgcaugggaccccauccuaacgcuauuaagucuugcgcccagcccgcuuccgccgcggccgcugccgcuuucgccgacaaauacauggauacggccggccccgcugcggaagaguuuagcucuagagccaaggaguucgcuuuuuaucaccagggguacgccgccggaccuuaccaucaccaccaaccgaugcccggcuaucuggacaugccugugguccccgggcucggaggcccuggcgaaucccggcaugagccccuggggcugccgauggaaagcuaccagccuugggcucuccccaauggauggaacggccagauguauuguccuaaagagcaggcccaacccccucaccuguggaaguccacccuucccgaugugguuucucauccgagcgacgcguccagcuaccgcagagggcggaagaaacgcgugccuuauacaaagguccagcugaaagagcucgaaagagaguacgcuaccaauaaguucaucacaaaagauaagcggcgcagaauuucugccaccacaaaccuguccgaacgccaggugaccaucugguuucagaaucggagaguuaaggagaaaaaggugauuaacaaacuuaagacgaccagcuga

SEQ ID NO: 70387 - RNA, 1008 nt, Artificial Sequence
  derived and/or modified sequence opt5 from HOXA1__Homo_sapiens__NP_005513
auggacaacgccagaaugaauagcuuccuggaguaccccauccucuccucuggcgauagcgggaccugcuccgcucgggccuauccuucugaccaccgcauuacaacguuucagagcugugcgguguccgcuaacucuugcggaggcgaugacagauuccuggucgggcggggaguucaaaucggcagcccgcaucaccaucaccaucaccaccaucaccauccccagccugccaccuaccagacauccgggaaucuuggagugagcuauucucacuccagcuguggccccucuuacggcucccagaacuuuagcgccccuuauucucccuacgcucugaaucaagaagccgauguguccgggggauauccucagugcgcuccggccgucuacagcggcaaccucuccucucccauggugcagcaccaucaccaucaccagggguacgcgggaggcgccguugggagcccucaauauauucaucacuccuacggacaggagcaccagagccuggcucuugccaccuauaauaacucucugagcccccuccaugcuagccaccaggaagccugucgcucuccugcgagcgagacauccucucccgcccaaaccuucgacuggaugaaggugaaaagaaauccgccuaagacaggcaaagucggcgaauacggguaucugggacagcccaacgcugugcggaccaauuuuacgaccaagcagcugacagagcucgagaaagaguuccauuuuaacaaguaccugacccgcgccagacggguugaaaucgcugccagccuucaacugaaugaaacacaggugaagauuugguuccagaaccgcagaaugaaacagaagaaacgggagaaggagggccuccugccuaucucccccgccacgcccccugggaaugaugaaaaagcugaggaaagcucugagaaguccuccucuuccccgugcguccccagcccuggauccucuaccagcgacacacuuaccacaucccacuga

SEQ ID NO: 70388 - RNA, 1131 nt, Artificial Sequence
  derived and/or modified sequence opt5 from HOXA2__Homo_sapiens__NP_006726
augaacuacgaguucgaaagagagaucggcuuuauuaauagccagcccucccuggccgaaugccucaccucuuucccuccgguggcugacacauuucaaagcuccucuaucaagacgagcacccugucccacucuacacuuauucccccucccuucgagcagaccaucccuagccugaaccccgggucccauccucggcacggagccggcgggcgcccgaaacccagcccugcgggaucuagaggcucccccgucccugcuggggcccuccagcccccggaauauccuuggaugaaggagaaaaaggccgcuaaaaagacagcccugcuucccgcugccgcggccgcugccaccgcugccgcgacaggaccugccugucugagccauaaggagucucucgaaauugcugauggcuccggcgggggaagccggcgccugagaaccgccuacacgaauacccagcugcucgagcuggaaaaagaguuucacuucaacaaguaucuuugccggccccgcagaguugagaucgcugcccugcucgaccugacagaacggcaagugaaagugugguuucagaaucgcagaaugaagcauaaacggcagacccaguguaaggagaaccaaaauucugaaggcaagugcaaaucccuugaggauagcgaaaaggucgaggaggacgaagaggagaaaacacuguucgaacaggcccucuccgugucuggggcucugcuggaacgcgagggauacaccuuucagcagaacgcgcucagccaacagcaggcccccaauggccacaacggggauucccagagcuucccuguuucuccgcugacguccaaugagaagaaccuuaaacacuuucaacaucagagccccacagugccuaauugucugucuaccaugggacagaacugcggcgcuggccucaauaacgacagccccgaagcccuggaggucccuucccuucaagauuucucuguguuuagcacagacuccugucugcagcucagcgaugccguuucucccucccugccggggagccuggacucuccuguggauaucuccgcugacagccucgauuucuucaccgacacccugacaacgauugaccuucagcaccugaacuauuga

SEQ ID NO: 70389 - RNA, 1332 nt, Artificial Sequence
  derived and/or modified sequence opt5 from HOXA3__Homo_sapiens__XP_005249788
augcagaaggccaccuacuaugacagcuccgcuaucuacggcggguaucccuaccaagccgcgaacggauucgcuuauaaugccaaccagcagccuuacccggccucugcugcccugggcgcugauggggaguaucacagacccgccugcagccuccaguccccuucuagcgcgggaggccaucccaaagcccacgaacuguccgaggcuugucuucggacacugucugccccucccagccaaccuccgucccucggggaacccccucugcaucccccucccccgcaggcugccccucccgcgccucagccuccccagcccgccccgcaacccccugcucccacgccugccgcucccccgccucccagcucugccuccccuccccagaaugccagcaacaauccuacccccgcuaacgcggccaagucuccgcuucucaauuccccuacaguggcuaaacagauuuuucccuggaugaaggagagccgccagaacaccaaacaaaagacaucuuccagcuccucuggagaaagcugcgccggcgacaaguccccucccggccaggccagcucuaaaagagcucggaccgccuacacauccgcgcagcuggucgagcuggagaaggaguuccacuuuaaucgcuaccuguguagaccgcggcgcguugaaauggcuaaccuccugaaucuuaccgaaagacaaaucaaaauuugguuccagaaccggcgcaugaaguauaaaaaggaucagaaggggaaaggaaugcugacgagcucuggcgggcagagccccuccagaucuccugugcccccuggagccggcggguaccucaauagcaugcauucccuggugaacagcguccccuaugagccucaaucucccccgccuuuuuccaagcccccucagggaaccuacggccuucccccggccagcuauccugcuucucugcccuccugcgccccucccccucccccgcagaaacgguacacagcugccggcgcgggggccggaggcacccccgacuaugauccucacgcucacgggcuccagggaaauggcagcuacgggacaccccauauccaaggauccccuguguucguuggcggcucuuacguggagcccaugagcaacuccgggccugcccuguuuggacugacccaccucccgcaugcugccucuggcgcgauggacuaugggggagccggcccccuggggagcggccaccaccauggaccuggccccggggaaccucaccccacguacacagaucuuaccggacaucacccgucccagggccgcauucaggaggcuccuaagcugacacaucucuga

SEQ ID NO: 70390 - RNA, 963 nt, Artificial Sequence
  derived and/or modified sequence opt5 from HOXA4__Homo_sapiens__NP_002132
augaccaugagcuccuuccugaucaacucuaauuacauugagcccaaguuuccuccguucgaagaguaugcccagcacagcggcuccgggggagcugacggcgggcccggaggcgggccuggauaccaacagcccccugcgcccccuacacagcaucucccgcugcagcaaccccagcuuccucacgccggcggcgggagagaacccacggcuucuuauuacgccccucggaccgcccgcgagcccgcuuauccggccgcugcccuguacccugcgcauggagccgcugauacagccuaucccuacggcuacagagggggagcuagcccuggccggccuccccagcccgaacagccgcccgcccaagcgaaagggccugcccacggacuccaugcuucccacgugcugcagccccagcuuccucccccgcugcagccucgcgccgugcccccugcugcccccagacggugcgaggccgcuccugcgacccccggcguuccggccggcgggucugcuccugccuguccccuccugcuggccgacaagagcccccucggacugaaaggcaaggagccugugguguauccguggaugaaaaagauccacgucuccgcugugaaccccagcuacaaugggggagaaccuaagcgcucuagaacagccuauacccggcaacagguucuugagcuggaaaaagaguuucauuucaaccgcuaccucacaagacggcgcagaauugagaucgcgcacacccugugccuuuccgaacggcaggucaagauuugguuucaaaaucgcagaaugaaauggaagaaagaucauaagcugcccaacacgaagaugcggagcucuaauuccgcuagcgccucugccggcccucccgggaaagcucagacccaguccccucaccuccacccccauccgcacccuagcacauccacccccgucccuucuagcaucuga

SEQ ID NO: 70391 - RNA, 813 nt, Artificial Sequence
  derived and/or modified sequence opt5 from HOXA5__Homo_sapiens__NP_061975
augagcuccuacuucgugaacucuuuuugcggcagauaucccaaugggccugacuaccagcugcacaacuauggagaucauagcuccgucucugagcaauuccgggacagcgccuccaugcacucuggccgcuacggguauggauacaauggcauggaucucagcguugggagauccggaagcggccauuuuggcucuggggaacgggcucgcuccuaugccgcgagcgcuucugccgccccggcugagcccagauacucccagccugccaccagcacacacucuccccagccugacccccugccuuguuccgcuguggccccgagccccggauccgauucucaucacggcgggaagaacagccuuuccaauagcucuggagcguccgccgacgcuggcagcacgcacaucucuagccgggaaggggugggaaccgccuccggcgcugaggaagaugccccugcgucuagcgagcaggccuccgcucaaagcgagcccucuccugcucccccggcccagccucagauuuaccccuggaugcgcaaacugcauaucucccacgacaacauuggcgggccugaaggaaagagagcccggacagccuauacccgcuaccagacacucgagcuggaaaaagaguuccauuuuaauagauaucuuacccggcgcagacggaucgagauugcucacgcgcugugccucagcgaacgccaaaucaagaucugguuccagaacagacggaugaaauggaagaaggauaauaaacugaagucuauguccauggccgcugccggcggggccuuuagacccuga

SEQ ID NO: 70392 - RNA, 702 nt, Artificial Sequence
  derived and/or modified sequence opt5 from HOXA6__Homo_sapiens__NP_076919
augagcuccuacuucgugaaccccaccuuuccuggcucucugccgagcgggcaggacuccuuccucggacaacugccccuuuaucaggccggcuacgaugcucugagaccuuuucccgccucuuauggggcgagcucccucccugacaagacauacacgucucccugcuucuaucagcagagcaauuccguccuggcuuguaaccgggccagcuacgaguauggagccucuugcuuuuacuccgauaaagaccuuagcggcgcuucuccuuccgggagcggaaagcaacgcggcccgggcgauuaccugcacuucucucccgaacagcaguauaaaccugacuccagcuccgggcagggaaaggcccuccaugaugagggcgcugacagaaaauacaccucucccguuuauccuuggaugcaacggaugaauagcugugccggggcgguguacggaucccacggccgcagagggcggcagacauauacccgcuaccagacacuggaacuggagaaggaauuucauuucaacagauaucucacccggcgcagacggaucgagauugccaaugcucugugccuuacagagcgccagaucaagauuugguuucaaaacagacggaugaaauggaagaaagaaaauaagcugaucaacagcacccagcccucuggagaggauuccgaagccaaagcuggcgaguga

SEQ ID NO: 70393 - RNA, 693 nt, Artificial Sequence
  derived and/or modified sequence opt5 from HOXA7__Homo_sapiens__NP_008827
augagcuccucuuacuaugugaacgcccuguucagcaaguacaccgcuggcgccucccucuuucagaaugcggagcccacaucuugcagcuucgcuccuaacucccaaagaucuggguauggagccggcgccggggcuuuugccagcacggucccgggacuguacaauguuaacucuccccuuuaucagagcccuuucgcuucuggcuacgggcugggagccgacgcguauggcaaucuccccugugccuccuacgaucagaacaucccuggccugugcagcgaccuugcuaaaggggccugugauaagaccgacgaaggagcucugcacggcgccgcggaggccaauuuucggauuuaccccuggaugcgcuccuccgggccugauagaaaacggggacgccagacauauaccagauaccaaacacucgaacuggagaaggaguuccauuuuaaccgguaucugacccgcagacggcgcaucgaaauugcucacgcccucugccugacagagagacagaucaaaauuugguuccagaaucggcgcaugaaguggaagaaagaacauaaggacgagggcccgaccgcugccgccgcucccgaaggggcggugccuagcgccgcugccacggccgcugccgauaaagcggacgaggaggaugacgaugaagaggaagaggacgaagaggaguga

SEQ ID NO: 70394 - RNA, 819 nt, Artificial Sequence
  derived and/or modified sequence opt5 from HOXA9__Homo_sapiens__NP_689952
auggccaccacaggcgcucuggggaacuacuauguggacagcuuccuccugggagccgaugcggcugacgagcuuuccgucggcagauacgcccccgggacgcugggacagccuccgcggcaagccgcuacccucgccgaacaccccgauuuuucuccuugcagcuuccaguccaaggcuacaguuuuuggcgccucuuggaaucccgugcaugcggccggggcuaacgccgugccugcugccgucuaucaccaucaccaucaccaccccuacgugcauccucaggcgccgguugccgcugccgcucccgacggacgcuauaugagaagcuggcuggagccuacccccggcgcccuuuccuucgccggccugccuucuagccggcccuacgggaucaaaccggaaccucucuccgcucgcagaggagauugucccacacuggacacccacacacugagccucaccgauuaugcgugcggcucuccucccguggaccgggagaagcagcccuccgaaggggccuuuagcgagaauaacgcugagaaugaaucuggaggcgauaaaccuccgauugaccccaacaauccugccgccaacuggcugcaugcucgcuccacgagaaagaaacggugucccuacaccaagcaccaaacacuugagcuggaaaaggaguuccucuuuaauauguaccugacccgcgauagacgguaugaggucgcccgccuucugaaccucacagaaagacaggugaaaaucugguuccagaaucggcgcaugaagaugaaaaagauuaacaaagacagagcgaaggaugaguga

SEQ ID NO: 70395 - RNA, 855 nt, Artificial Sequence
  derived and/or modified sequence opt5 from HOXB13__Homo_sapiens__NP_006352
auggaacccggcaacuacgccacccuggacggggcuaaggauaucgaaggacuccugggcgccgggggaggcagaaaucuuguggcgcacagcccucugacaucccauccggcugcccccacgcucaugccugccgucaacuaugcuccccuggaccuuccugggucugccgagcccccuaaacagugccacccgugucccggaguuccucaaggcaccagccccgcuccugugcccuacggcuauuucgggggaggcuacuauuccugccgggugucucgcagcucccugaagccgugugcccaggcggccacacucgcugccuacccugcugaaacccccacagccggggaggaauauccuucuagacccaccgaguuugcguucuaccccggauacccuggcacauaucagccgauggccagcuaccuggaugucuccgugguucagacccugggggcucccggagagccucggcaugacagccuccugcccguggauucuuaucaauccugggcccuugcuggcggcuggaauagccagaugugcugucagggggaacagaacccucccggaccguuuuggaaagccgccuucgcugacucuuccggccaacacccucccgaugcgugcgccuuucgcagagggcggaagaaacgcauuccuuacagcaagggacagcugagagagcucgaacgggaguaugcugccaauaaguucaucacgaaagacaagcgcagaaaaauuucugccgcuaccucccugagcgagcggcagaucacaauuugguuucagaaccgcagagucaaggagaaaaaggugcuugccaagguuaaaaauuccgcgacccccuga

SEQ ID NO: 70396 - RNA, 906 nt, Artificial Sequence
  derived and/or modified sequence opt5 from HOXB1__Homo_sapiens__NP_002135
auggacuacaacagaaugaauagcuuccuggaguauccccucugcaaccggggcccuuccgccuacucugcucacagcgccccgaccuccuuucccccuucuagcgcgcaggcuguggauuccuaugccucugaagggcgcuacggaggcgggcugagcucccccgccuuccaacagaauagcggauauccugcucagcagcccccuucuacacuuggcgucccguuucccuccagcgccccuucuggguacgcucccgccgcguguuccccuagcuauggacccucucaauacuacccgcugggccaguccgagggcgacgggggauauuuccauccuagcuccuacggcgcccagcucgggggacugucugauggcuauggggcuggaggcgccggccccgggccuuacccuccccagcaucccccguauggaaacgaacaaacggcuagcuuugcccccgcguacgccgaccuucuguccgaggauaaggaaaccccuugccccagcgagccuaauacacccaccgcuagaacauucgacuggaugaaaguuaagcggaacccgccuaaaaccgccaaggugucugagcccggccucggguccccuagcggacugcgcacaaauuuuaccacgagacagcugaccgaacucgagaaagaguuccacuuuaacaaguaucugucucgggcucgcagaguggaaaucgccgccacacuugagcugaaugaaacccaggucaagauuugguuccagaaccggcgcaugaaacaaaagaaaagagagcgggaagagggccgcgugcccccugcucccccgggguguccuaaggaagcggccggagaugcuagcgaccaguccacaugcaccucucccgaggccagccccuccagcguuacgucuuga

SEQ ID NO: 70397 - RNA, 1071 nt, Artificial Sequence
  derived and/or modified sequence opt5 from HOXB2__Homo_sapiens__NP_002136
augaacuucgaguuugaaagagagaucggcuucauuaauagccagcccucccuggccgaaugccucaccucuuuuccugcugugcuggagacauuccaaacgagcuccaucaaggaaucuacccuuauuccgcccccucccccuuuugagcagacauuccccagccugcagccuggggccuccacccuccagcggccgcgcucucaaaaacgggcggaggacggacccgcucugccucccccucccccgccuccccuuccugccgccccucccgcucccgaauuuccguggaugaaggagaaaaagagcgccaaaaagcccucccagagcgcuacaucuccuucccccgccgcgagcgccgucccugcuucuggcguugggucccccgccgauggacugggccucccggaagcugggggaggcggcgcccggcgccugagaaccgcguacacaaacacccagcugcucgagcuggagaaggaauuucacuuuaauaaauaucuuugucggccucgcagaguggagaucgccgcucugcucgaccugacggaaagacaggugaaggucugguuccaaaaccgcagaaugaaacauaagcggcagacccagcaccgcgagcccccugauggggaacccgccugcccuggagcucuugaggacauuugugaucccgccgaggaaccggccgcuagcccuggcgggcccucugcguccagagccgcuugggaggccugcugucaucccccugaagugguuccgggagcccugagcgcugacccccggccucucgccgugcgccuggagggcgcgggggcuuccucucccggaugcgcccugagaggcgccggcgggcucgaaccuggaccccugccugaggaugucuuuagcggccggcaggacucccccuuccuuccggaucugaauuucuucgcugccgacagcugucuccaacugucugggggacuuuccccuagccugcagggcucucucgauagccccgugccuuucuccgaggaggaacuggacuuuuucacaucuacccugugcgcuaucgaucuccaguuucccuga

SEQ ID NO: 70398 - RNA, 900 nt, Artificial Sequence
  derived and/or modified sequence opt5 from HOXB3__Homo_sapiens__XP_005257339
augaaggagagcagacagaccuccaaacugaagaacaauucucccggcacagccgaagggugcggaggcgggggaggcgggggaggcggcgggggaagcggcggguccggaggcgggggaggcggcgggggaggcggggacaaaucuccuccgggaagcgcugccuccaagcgggcgcgcacggcuuacaccucugcccaacucguggagcuggaaaaagaguuccacuuuaacagauaucuuugucggccccgcagagucgaaauggccaaucugcucaaccugagcgagcggcagaucaagauuugguuccagaaucgcagaaugaaguacaaaaaggaucagaaagcuaagggccuugccuccagcucugggggaccuucccccgcuggcagcccuccccaaccuaugcagucuacagccggcuuuaugaacgcgcugcauuccaugaccccgagcuaugagucucccuccccucccgccuucgggaaagcucaccagaaugccuacgcucucccuagcaacuaucagcccccgcugaagggaugcggcgccccucaaaaguaucccccuacacccgcgcccgaauacgagccucauguucugcaggccaaugggggagcuuacggcaccccgacaaugcaggggucccccguguacgugggcggaggcggguaugccgacccucugcccccucccgcuggaccgucucucuacggccuuaaccaccugagccaucacccuuccgggaaucucgauuauaacggagcucccccuauggcccccagccagcaccauggcccuugugaaccccacccgaccuacacggaccugucuucccaucacgccccuccuccccaagggcggauccaggaggcgcccaaacuuacccaccuguga

SEQ ID NO: 70399 - RNA, 756 nt, Artificial Sequence
  derived and/or modified sequence opt5 from HOXB4__Homo_sapiens__NP_076920
auggccaugagcuccuuccugaucaacucuaauuacguggaccccaaguuuccuccgugcgaggaauauagccaguccgauuaccuccccucugaccacagcccuggcuauuacgcugggggacaaagacgggaguccucuuuccagcccgaagccggcuuugggcgcagagcggcuuguaccguccagcgguaugccgccugccgcgauccuggacccccuccgcccccucccccucccccgccucccccucccccucccggccugagcccgagagcucccgccccucccccugcuggggcccuucugcccgagccgggacagcggugugaagcgguuuccagcucuccucccccucccccuugcgcccaaaacccccuccauccguccccuagccacucugcuuguaaagagcccgugguguaccccuggaugcgcaagguccauguguccacaguuaauccuaacuaugccggcggcgagccgaaaagaagccggacggcuuacacccgccaacaggugcuggaacuugagaaggaguuccacuacaauagauaucugacacggcgcagacgggucgaaauugcccaugcgcucugccugucugagcgccagaucaaaauuugguuucagaacagacggaugaaguggaagaaagaccacaagcugcccaauaccaaaaucagauccgggggagccgcuggcagcgccgggggaccucccggccgcccuaacgggggaccccgggcucucuga

SEQ ID NO: 70400 - RNA, 810 nt, Artificial Sequence
  derived and/or modified sequence opt5 from HOXB5__Homo_sapiens__NP_002138
augagcuccuacuucgugaacucuuuuagcggcagauaucccaaugggccugacuaccagcugcucaacuauggauccggcucuagccuguccgggucuuaccgggauccggccgcuaugcacaccggaagcuauggcuacaauuauaacgggauggaccuuuccgucaaucgcagcucugccuccagcucucauuucggagcgguuggcgaguccagcagagcuuuucccgccccugcccaagaaccccgguuccgccaggcugccucuuccugcagccuguccucuccugagagccuccccuguacaaacggcgauucccacggggcuaagccuagcgccucuuccccgagcgaccaggcgacgucugccagcuccucugcuaauuuuaccgaaaucgaugaggccagcgcuuccagcgaacccgaggaggccgcgucucagcuguccagcccuucucuugccagagcucaacccgaaccuauggccacauccaccgcugcccccgagggacagacaccgcagauuuucccuuggaugcggaaacugcauaucagccacgacaugaccggccccgaugggaagcgcgccagaacagcuuacacccgguaccagacgcucgaacuggagaaagaguuucauuucaaccgcuaucugaccagacggcgcagaauugaaaucgcgcacgcccucugccuguccgagcggcaaauuaagaucugguuucagaaucgcagaaugaaauggaagaaggacaacaaacuuaagucuaugagccuggcuacagccggauccgccuuccagccuuga

SEQ ID NO: 70401 - RNA, 675 nt, Artificial Sequence
  derived and/or modified sequence opt5 from HOXB6__Homo_sapiens__XP_005257340
augagcuccuacuucgugaacucuaccuuucccgucacacuggccagcggccaggaguccuuccucgggcaacugccucuuuauucuagcggauacgcugacccgcugagacacuaucccgccccuuacggccccgggccuggacaggauaagggcuuugcgacguccucuuauuaucccccugcugggggaggcuacggccgggccgccccgugcgacuacgggcccgcuccugccuucuaccgcgaaaaagagagcgcuugugcccucuccggagcggaugaacagcccccuuuucaucccgagccgagaaagagcgacugcgcccaggauaaaucuguuuucggcgaaaccgaggagcaaaaguguuccacaccuguguaucccuggaugcagcggaugaauagcugcaacucuuccagcuuugggccuucuggacgcagaggccggcagaccuacacacgcuaucagacccuggaacuugagaaagaguuccacuacaauagauaucugacacggcgcagacggaucgaaauugcucaugcccucugucugaccgagcgccaaaucaagauuugguuucagaacagacggaugaaguggaaaaaggaauccaaacugcucagcgcuucccagcugucugccgaggaagaggaagagaagcaggcggaguga

SEQ ID NO: 70402 - RNA, 654 nt, Artificial Sequence
  derived and/or modified sequence opt5 from HOXB7__Homo_sapiens__NP_004493
augagcucccuguacuaugccaacacccucuucucuaaguaccccgcuagcuccucuguguuugccacaggcgcguucccugagcagacgagcugcgcuuuugccuccaauccgcaaagacccggguauggagccggcucuggggcuagcuucgccgcuuccaugcagggacuguacccuggcgggggaggcauggccggccagagcgcggccggggucuaugcugccggauacggccuugaacccucuuccuuuaacaugcacugugcuccuuucgagcagaaucugagcgggguuugccccggagacucugccaaagcggccggcgcuaaggaacaacgggauuccgaccucgccgcugagagcaacuuucgcaucuauccuuggaugagaucuuccgggaccgaucggaaacgcggaagacagacauacacccgguaccagacacuggaacuugagaaggaguuccauuauaaucgcuaccugaccagacggcgcagaauugaaaucgcccacacacucugucugaccgagcggcagauuaaaaucugguuucaaaaccgcagaaugaaguggaagaaagaaaauaagacggccggcccgggcaccacagggcaggaccgggcugaggcggaggaagaggaagaggaauga

SEQ ID NO: 70403 - RNA, 732 nt, Artificial Sequence
  derived and/or modified sequence opt5 from HOXB8__Homo_sapiens__NP_076921
augagcuccuacuucgugaacucucuguuuagcaaguauaaaaccggcgagucccucagacccaauuacuaugacugcggguucgcccaggaucugggaggccggccuacagucguuuacgggccgucuagcggaggcuccuuucaacaccccucucagauccaggaguucuaucaugggccuagcucccuuagcacggcucccuaccagcaaaacccuugugccguggcgugccacggagaccccggcaauuuuuauggcuacgauccucugcagcgccagucucucuucggggcucaggacccggaucuggugcaauacgccgacuguaaacuugccgcugccuccggacugggcgaggaagcugaggggagcgaacagucucccuccccuacccagcucuuucccuggaugagaccucaggccgcggccggacggcgcagaggccggcaaacauauagccgcuaccagacccuggagcuggagaaggaguuccucuuuaaccccuaucugacaagaaagcggcgcauugaagucucucaugcucuugggcugaccgaaagacaggugaaaaucugguuccaaaaucggcgcaugaaguggaagaaagagaacaauaaggauaaauuuccguccagcaagugcgagcaggaagaacucgaaaaacagaagcuggagagagccccugaagcugccgacgagggagaugcgcagaagggcgacaaaaaguga

SEQ ID NO: 70404 - RNA, 753 nt, Artificial Sequence
  derived and/or modified sequence opt5 from HOXB9__Homo_sapiens__NP_076922
augagcaucuccggcacccugucuagcuacuauguggacuccauuaucucucacgagagcgaagaugcucccccugccaaguucccguccgggcaguacgccucuagcagacaacccggacaugcggagcaccucgaauuuccuuccugcagcuuccagcccaaagcuccugucuuuggcgccucuugggcuccccuguccccucaugccagcgggucucuuccguccguuuaucaccccuacauucagccucagggagugcccccugccgagagccgguaucugcgcacauggcucgaacccgcuccgagaggcgaggccgcgccugggcaaggacaggccgcugugaaggccgagccccugcuuggcgcuccuggcgaacugcucaaacaggggacgcccgaguacucucuggaaaccuccgccggacgggaggcgguccugagcaaccagcgccccggcuauggggacaauaagaucugugagggauccgaagauaaagagagaccugaccaaacaaacccgucugccaauuggcuccaugcucggagcucccgcaagaagagaugccccuacaccaaauaccagacacuggaacuugagaaggaguuccuguuuaacauguaucucacccgggaucgcagacacgaaguggcccggcugcuuaaucugagcgagcgccagguuaaaauuugguuccagaacagacggaugaagaugaaaaagaugaauaaggaacaaggcaaagaguga

SEQ ID NO: 70405 - RNA, 1029 nt, Artificial Sequence
  derived and/or modified sequence opt5 from HOXC10__Homo_sapiens__NP_059105
augaccugccccagaaacgugacaccuaauagcuacgccgagccgcuggcugcccccggcgggggagaacgguauucccgcucugcgggcauguacaugcagagcggguccgacuucaacuguggagucaugagaggcugcgggcucgcuccuucucugagcaagcgggaugagggauccucucccagccuugcccugaauacguauccuuccuaccucagccaacuggacucuuggggcgaucccaaagccgcuuaucgccuugaacagccuguuggcagaccgcuguccagcuguucuuaucccccuuccgugaaggaggaaaacgugugcuguauguacagcgccgagaaacgggcuaagucugggcccgaggccgcgcucuacucccacccucugcccgaaagcugccugggagagcaugaagucccggugccuuccuacuaucgcgccucucccagcuacuccgcucucgacaaaaccccucacuguagcggcgccaaugauuuugaggcucccuucgagcagagagccucucugaacccccgggcggaacaucuugaguccccucagcucgggggaaagguuagcuuuccggaaacacccaagucugacagccaaaccccuucccccaaugagaucaaaacagaacagucucuggccggcccuaaggggagccccuccgagagcgagaaagaacgcgcuaaggccgcugauucuuccccggacaccagcgauaacgaggccaaagaagagauuaaggccgaaaauacaaccggaaacuggcugacggcuaagucuggccggaaaaagagaugcccuuauaccaaacaccagacacuugagcuggagaaggaguuccucuuuaauauguaccugacccgcgaaagacggcuggaaaucuccaaaacaauuaaccucaccgaccgccaggugaagaucugguuccaaaauagacggaugaaacugaagaagaugaacagagagaaucgcauucgggaacuuacgagcaacuuuaacuucacauga

SEQ ID NO: 70406 - RNA, 915 nt, Artificial Sequence
  derived and/or modified sequence opt5 from HOXC11__Homo_sapiens__NP_055027
auguucaacagcgugaaucugggcaacuuuugcucccccucuagaaaggaacgcggggccgacuucggagaacggggcagcugugcuuccaaucucuaccugccuucuugcaccuauuacaugccggaguuuagcacagucuccucuuuccuuccccaggccccuagcagacaaaucuccuaucccuacagcgcgcagguuccucccgugcgggaagugucuuaugggcuggagccuuccggaaaauggcaccaucgcaacagcuacucuuccuguuaugcugccgccgaugaacucaugcacagagagugccugccgcccagcacggucaccgagauucuuaugaagaaugaaggcucuuacgggggacaucaccauccuuccgcuccccacgccacacccgcuggcuuuuacagcuccgugaacaaaaauucuguucugccccaggccuucgaccgguuuuucgauaacgcguauuguggcgggggagacccgccugccgagcccccuugcagcggcaagggggaagcuaaaggagagcccgaggccccuccugcuuccggccucgccagccgcgcggaagccggggcugaggccgaagcugaggaagagaauaccaacccgucuuccagcggaucugcccacagcguggccaaggagcccgcuaagggcgcggccccuaaugcucccagaacacggaaaaagcgcuguccuuacuccaaauuucagaucagagaacuggagcgggaguucuuuuucaacgucuauauuaauaaggaaaaacgccugcaacucucuagaaugcugaaccuuaccgaucgccaggugaagaucugguuucagaaucggagaaugaaggagaaaaagcugagccgggacagacuccaguacuucuccggcaacccccugcuuuga

SEQ ID NO: 70407 - RNA, 849 nt, Artificial Sequence
  derived and/or modified sequence opt5 from HOXC12__Homo_sapiens__NP_776272
augggcgagcacaaccugcucaaucccggguucgugggaccucuggucaacauccauaccggcgacacauuuuacuucccgaauuuuagagccagcggggcucagcuucccggacugccuucccucucuuauccccggcgcgauaacguuugcagccuguccuggccuucugccgaacccuguaauggcuacccucaaccguaucuugggagccccgugucccugaacccucccuucggaagaacgugcgagcucgcgcggguggaagacggcaagggcuacuaucgcgagccuugugcugaagggggaggcgggggacugaaaagagaggagcggggccgcgaucccggggccggaccgggcgccgcucugcucccucuggaacccucuggcccucccgcccuuggguuuaaguacgacuaugcugccggaggcgggggaggcgaugggggaggcggcgcggggcccccucacgacccgcccagcugccagucccuggagagcgauucuuccagcucucuccugaaugaaggaaacaaaggcgccggggcuggagacccuggcucccuugucagcccccugaauccugggggcggacucucugccuccggcgcucccugguacccgauuaacagcagaucccggaagaaacgcaagccuuacucuaagcugcagcuggccgagcucgagggggaguuccuggugaaugaauuuaucaccagacagcggcgcagagaacuuagcgaucggcugaaccucuccgaccaacagguuaaaauuugguuccagaaucgcagaaugaagaaaaagcggcugcuucugagagagcaggcgcucagcuuuuucuga

SEQ ID NO: 70408 - RNA, 993 nt, Artificial Sequence
  derived and/or modified sequence opt5 from HOXC13__Homo_sapiens__NP_059106
augaccacaagccugcuccugcaccccagauggccugaaucccuuauguacguguaugaagacucugccgcugagagcggcaucgggggaggcgggggaggcgggggaggcggcaccgggggagccggcgggggaugcuccggcgcgucuccggggaaggcucccagcauggauggacugggcuccucuuguccugccagccauugccgggaccuccugccccacccuguccuuggcagacccccugccccgcugggggcuccccagggagccguuuacacggauauuccugcucccgaagccgcgcgccaaugugccccucccccggcuccucccacauccagcucugccacccucggcuauggguacccuuucggaggcuccuauuacgggugccggcugagccauaacgugaaucugcagcagaaacccugugcuuaucaccccggagacaaguacccugagccgucuggcgcccuccccggcgaugaccuguccagccgcgcgaaagaauuugccuucuacccuucuuuugcuuccagcuaucaggccaugcccggguaccuugauguguccgucgugccuggaaucucuggccaucccgagccgagacacgacgcucugauuccuguugagggguaucaacacugggcccucagcaacggaugggauucccagguguacugcagcaaggaacagucucaguccgcccaucuguggaaaagccccuucccugacgucgugccccuucaaccugagguuucuagcuaucggcgcggcagaaagaagcgggugcccuacacaaaaguccagcugaaggaacucgagaaagaguaugcugcguccaaguuuaucaccaaagaaaagcgcagacggauuucugccacaaccaaucugagcgagcgccaggugacgaucugguuccagaacagacgggugaaggagaaaaaggucguuuccaaaagcaaggcuccgcaucugcacucuaccuga

SEQ ID NO: 70409 - RNA, 795 nt, Artificial Sequence
  derived and/or modified sequence opt5 from HOXC4__Homo_sapiens__NP_705897
augaucaugagcuccuaccugauggacucuaacuauauugaucccaaguucccuccgugcgaggaauacagccaaaauuccuauauccccgagcacucuccugaauacuauggcagaacccgggagagcggguuucagcaucaccaucaggaacucuaucccccucccccuccgcgccccuccuacccugagagacaguacucuuguacaagccugcagggacccggcaacucccgggggcacggaccugcccaagcuggccaucaccaccccgagaaaagccagucucuuugcgaaccggccccucuguccggggcgagcgcuucucccuccccugccccucccgccuguagccagcccgcuccggaccaucccucuuccgccgcuagcaagcagccuauuguguaccccuggaugaaaaagauccacgucuccacgguuaauccuaacuauaauggaggcgagcccaaacgcucuagaaccgccuacacacggcaacaggugcucgaacuggagaaggaguuccauuauaaccgcuaccuuaccagacggcgcagaauugaaaucgcgcacagccugugccucuccgagcggcagaucaagauuugguuucagaaucgcagaaugaaauggaagaaagaucaccggcugccgaacacaaaggugcgcagcgccccucccgcuggcgccgcuccuucuacccuguccgccgcgacacccgggaccagcgaagaccauucucaaagcgccacgccucccgagcagcagagagcugaagauaucacccggcucuga

SEQ ID NO: 70410 - RNA, 669 nt, Artificial Sequence
  derived and/or modified sequence opt5 from HOXC5__Homo_sapiens__NP_061826
augagcuccuacguggccaacucuuucuauaagcagagccccaauaucccugcuuacaacaugcaaaccugcggcaauuauggguccgccucugagguccaggcgagcagauacuguuauggaggccuggaccucuccauuacauuuccgcccccugcucccucuaacagccugcacgggguugauauggccgccaauccucgggcucaucccgaccgcccugccugcuccgcugccgcggccccgggacacgcucccggcagagaugaagccgcuccucuuaaccccgggauguacagccagaaagccgcgcggccugcccuggaggaacgcgcuaagucuuccggagagaucaaagaagaacaggcccaaacgggccagcccgcuggccucagccagccgccugcucccccucagauuuaucccuggaugaccaagcugcauaugucucacgagacagacgggaaaagaucccggaccagcuacacacgcuaccaaacccuugaacuggagaaggaguuccauuuuaauagauaucucacacggcgcagacggaucgagauugccaacaaucugugucugaacgagcgccagaucaagaucugguuccagaauagacggaugaaauggaagaaagauucuaagaugaaauccaaggaagcccucuga

SEQ ID NO: 70411 - RNA, 708 nt, Artificial Sequence
  derived and/or modified sequence opt5 from HOXC6__Homo_sapiens__NP_004494
augaacagcuacuucaccaaucccucccugucuugccaccucgccggcgggcaggacgugcugccuaacgucgcucuuaauagcacagccuaugauccgguuagacauuuuuccacguacggagcggcuguggcccaaaaccggaucuauucuacccccuucuacagcccucaggagaauguggucuuuuccucuagccgcggccccuaugacuacggguccaacagcuucuaucaggaaaaggauaugcugucuaauuguagacagaacacacucggacacaauacccaaacauccauugcccaggacuuuagcucugagcagggccggaccgcuccucaggaucaaaaagccuccauccagauuuaccccuggaugcagcgcaugaacagccauucuggggugggauacggcgcugacagacggcgcggcagacagaucuauucccgguaccaaacacuggaacuugagaaggaguuccacuuuaaucgcuaucugaccagacggcgcagaauugaaaucgccaacgcgcucugccugacggagcggcagaucaaaauuugguuccagaaucgcagaaugaaguggaaaaaggaaagcaaccugaccuccacacucucugggggaggcgggggagccaccgcugauagccugggcgggaaggaggaaaaacgggaggagacagaagaggaaaagcaaaaagaguga

SEQ ID NO: 70412 - RNA, 729 nt, Artificial Sequence
  derived and/or modified sequence opt5 from HOXC8__Homo_sapiens__NP_073149
augagcuccuacuucgugaacccccuguuuucuaaguauaaagccggcgagagccucgaaccugcuuacuaugacugcagauucccgcaguccgucgggcggucucacgcccugguuuacggacccggcgggagcgcgccuggauuucaacaugcuucccaccaugugcaggauuucuuucaccauggcaccucugggaucagcaauuccggauaucagcagaaccccuguagccuuucuugccacggcgacgccuccaaguucuacggcuaugaggcccugccucgccaaagccucuacggggcucagcaggaagccucugugguccaguaccccgauuguaaauccagcgcuaauacaaacucuuccgagggacaaggccaccugaaucagaacagcuccccuucucuuauguuuccguggaugagaccccaugccccugggcggcgcagcggaagacagacguauucccgguaccagacccuggaacucgagaaggaguuccuguuuaaucccuaucugacacgcaaaagacggauugaagugagccacgcgcucggccugaccgagcgccaaguuaagaucugguuccagaacagacggaugaaguggaaaaaggaaaauaacaaagacaaacuuccuggggcccgcgaugaggagaagguggaagaggaaggaaaugaggaagaggagaaggaagaggaagagaaggaagagaacaaagacuga

SEQ ID NO: 70413 - RNA, 783 nt, Artificial Sequence
  derived and/or modified sequence opt5 from HOXC9__Homo_sapiens__NP_008828
augagcgccaccggccccaucuccaacuacuauguggacucucugauuagccacgauaaugaggaccuccuggcuuccagauucccugccacaggggcgcauccggcugccgcccggcccucuggacuugucccugauugcagcgacuuucccuccuguucuuucgcuccuaagcccgccguuuuuagcacguccugggcuccugugccgagccagucuuccguggucuaccaccccuauggcccucaaccccaucugggggccgauacccgcuacaugagaacauggcucgaaccucugagcggagcggugucuuuccccuccuuuccggccggcgggcggcacuaugcucuuaaaccugacgccuaccccggacgcagagcugauugcggcccuggcgaggggcggagcuaucccgacuacauguacggaucucccggcgaacugcgcgauagagccccucagacccucccgucccccgaggcggacgcccuggcugggagcaagcauaaagaagagaaggccgaucuggacccuuccaaccccguugcuaauuggauccacgcccggucuacacgcaaaaagagauguccuuauaccaaguaccagacacucgagcuggaaaaagaguuccuuuuuaacauguaucugacccgggaucgcagauacgaaguggcccggguccucaaucugacggagcgccaggugaagauuugguuccaaaacagacggaugaaaaugaagaaaaugaauaaggagaagaccgacaaagaacagagcuga

SEQ ID NO: 70414 - RNA, 1023 nt, Artificial Sequence
  derived and/or modified sequence opt5 from HOXD10__Homo_sapiens__NP_002139
augagcuuccccaacuccucuccugccgcuaauaccuuucugguggacagccucaucuccgccugcagaucugauagcuucuacuccucuagcgcguccauguauaugccgcccccuagcgcugacaugggcacauacgggaugcagacguguggacugcuucccucucuggccaagcgggaggucaaccaccaaaauaugggcaugaacguucauccuuauauuccccagguggauuccuggaccgacccuaaucgcagcugcagaaucgaacagccggugacacagcaaguccccaccuguucuuuuacaaccaacauuaaagaggaauccaauugcuguauguacagcgauaagcggaacaaacucaucucugccgaggugccuuccuaucagcgccugguucccgaaagcugcccuguggagaaucccgaggucccggugccuggguacuucagacuuucccagacauaugcuaccggaaagacgcaggaauacaacaauucucccgagggcagcuccaccguuaugcugcaacucaacccuagaggggccgcuaaaccccagcugagcgccgcgcagcugcagauggaaaagaagaugaaugagcccgugucuggacaagagccuacaaaagucucccagguggaaagcccggaggccaagggcggccuccccgaggaacgcucuugucuggcugaagugagcgucuccucuccugagguucaggagaaagaaagcaaggaggaaauuaaauccgacacccccacaagcaacuggcuuaccgccaagucugggagaaagaaacggugcccuuacacgaagcaccaaacacuggagcucgaaaaagaguuucuguucaauauguaucuuacccgcgagagacggcuggaaaucuccaagagcgugaaccucacagaucgccaggugaaaaucugguuucagaacagacggaugaagcugaaaaagaugucucgcgagaaucggauucgggaacugaccgcuaaccucaccuucuccuga

SEQ ID NO: 70415 - RNA, 1017 nt, Artificial Sequence
  derived and/or modified sequence opt5 from HOXD11__Homo_sapiens__NP_067015
augaacgacuucgaugagugcggccagagcgccgccuccauguaccugcccgggugugccuauuacguggcgccuucugacuuugcuagcaagccguccuuccucucucaacccagcuccugccagaugaccuuuccuuauucuagcaaucuggcuccccacguccagccuguuagagaaguggccuuccgggauuacggacuugagcgcgccaaauggcccuauagaggcgggggaggcgggggauccgccggcggcgggagcucuggaggcgggccuggaggcgggggaggcggcgcugggggauacgccccguauuacgcggccgcugccgcugccgcggccgcugccgcugccgccgaagaggcugcgaugcagcgggaacugcugcccccugccggccgcagacccgacgugcucuuuaaggcuccugagcccgucugugccgccccggggccuccccauggaccugcuggcgccgcguccaacuucuacagcgcuguggggcggaauggaauccuuccccaaggcuuugaucaguucuaugaggccgcccccggcccuccguuugcugggccccagccucccccucccccggccccuccccagccugaaggagcugccgacaaaggcgauccccgcacaggggcgggaggcgggggcggaucuccuugcacgaaggccacccccggcuccgagccgaaaggggcugccgaaggaagcggcggggacggagagggcccucccggggaggcuggcgccgaaaagucuuccagcgcgguugcuccccaaagaucccggaagaaacgcuguccuuacacaaaguaucagauuagagagcuggaacgggaguucuuuuucaacguguacaucaauaaagaaaagcgccuccagcugucuagaaugcugaaccucaccgaucggcaggucaaaauuugguuucaaaaucgcagaaugaaggagaagaaacugaaccgggacagacuucaguauuucacaggaaauccgcuguucuga

SEQ ID NO: 70416 - RNA, 813 nt, Artificial Sequence
  derived and/or modified sequence opt5 from HOXD12__Homo_sapiens__NP_067016
augugcgagagaagccuguaccgggccggcuauguggggucccuccugaaccuucagucucccgacagcuucuacuuuuccaaucugcgcccuaacggaggccaacucgcugcccugccgcccaucucuuauccuagaggggcgcuucccugggcugccaccccugccagcugugcucccgcccagccugcuggagccacagcguucggcggguuuucccagccguaccuggccggaucuggcccccucggccugcagccucccacggcuaaggaugggccugaagaacaagccaaauucuaugcucccgaagccgcggccggaccggaggaacggggccgcaccagaccuagcuuugcucccgaguccagccuggccccugcugucgccgcccucaaggcugcgaaauacgacuaugccgggguuggacgggcuacacccggcucuaccacacugcuucagggggcccccugcgccccuggauucaaggaugacaccaaaggcccgcugaaucucaacaugacagugcaggcugccggcguggcguccugucugcgccccagccuuccugaugggcugcccuggggagcugccccuggcagagcccggaagaagcgcaaacccuacaccaagcagcaaauugcugagcucgaaaaugaguuucuggucaacgaguucaucaauagacagaaacggaaggagcugucuaaccgccucaaucuguccgaccaacaggugaaaauuugguuucagaacagacggaugaagaagaaacgcguugugcuuagagagcaggcccuggcucucuacuga

SEQ ID NO: 70417 - RNA, 1032 nt, Artificial Sequence
  derived and/or modified sequence opt5 from HOXD13__Homo_sapiens__NP_000514
augagcagagccggcuccugggacauggaugggcugcgggcugacggaggcggggccggaggcgcgcccgcuucuagcuccucuagcuccguggccgccgcugccgcuucugggcagugccgcggauuccucagcgccccugucuuugcgggcacccacuccggcagagccgcugccgcugccgcggccgcugccgcugccgccgcugcggccagcggguucgcuuacccgggaacaucugagcggacgggcuccagcagcuccucuucuuccagcgccguuguggccgcucgccccgaagccccucccgcgaaggaguguccugcucccaccccugccgccgcugccgcugccccgcccuccgcgccugcccugggguauggauaccauuuuggcaacggguauuacucuugcagaaugagccacggagugggccuucaacagaaugcucugaaauccagcccccaugccucucucggcggguucccugucgaaaaguauauggauguguccggacuggcuagcucuagcguucccgccaacgaggugccggcgcgggccaaagaagucuccuuuuaccagggcuauacaucuccuuaccagcacgugcccggguacaucgacaugguuagcaccuucggauccggcgagccucgccaugaggcuuauauuagcauggaaggguaccaaucuuggacacuugccaauggauggaacucccagguguauuguaccaaggaucagccccagggcagccacuuuuggaaaucuuccuuccccggcgacgucgcucugaaucaaccugauaugugcguguacagacgggggcgcaagaagagagugccguauacaaaacuccagcugaaggagcuggaaaacgaguacgccaucaauaaauuuauuaacaaggacaaacggcgcagaaucagcgccgcuaccaaucucuccgagcggcaggucacgauuugguuccagaaccgcagaguuaaggauaagaaaaucgugucuaagcugaaagacaccgugagcuga

SEQ ID NO: 70418 - RNA, 987 nt, Artificial Sequence
  derived and/or modified sequence opt5 from HOXD1__Homo_sapiens__NP_078777
augagcuccuaccuggaguaugugucuugcagcuccucuggcggggucggaggcgacguucucagccuggcccccaaguucuguagauccgaugcccggccuguggcccuucagccggcguuuccccuggggaacggagacggcgcuuucgugucuugccucccucuggccgccgcucgccccagcccuuccccucccgccgcuccggccagacccagcgucccucccccugcggcuccccaauacgcccaguguacccuugaaggggccuaugagccgggagcugccccugcggccgcugccggcggcgcugauuacggguuucugggaucuggccccgccuaugacuucccuggggugcucggacgggccgcugaugacggcgggucccacguucauuacgcgacaagcgccguguuuucuggaggcggcuccuuccugcugagcgggcaggucgauuaugcugccuuuggagaacccggccccuucccugccugccucaaggcuucugccgacgggcacccgggagcguuucagacggcuucccccgccccuggcaccuaccccaagagcguguccccugccucugggcugcccgcugccuucagcacauuugaguggaugaaaguuaagcgcaaugcuuccaaaaagggaaaacuugccgaauacggcgcggccagcccgucuuccgcuaucagaaccaacuucagcacaaaacaacugaccgagcucgagaaggaauuucauuucaauaaauaucugacacgggcccgcagaauugagaucgcuaacugucuucaccugaaugauacccaggugaagauuugguuccagaaccggcgcaugaaacagaagaagagagaacgggagggccuccuggccacggcgaucccugucgcuccccugcaacucccucugucugggaccacacccaccaaauuuauuaagaauccuggaagccccucccagucucaggagccgagcuga

SEQ ID NO: 70419 - RNA, 1299 nt, Artificial Sequence
  derived and/or modified sequence opt5 from HOXD3__Homo_sapiens__XP_006712540
augcuguucgagcagggccaacaggcccucgaacugcccgagugcaccaugcagaaggcugccuacuaugaaaacccugggcuuuuuggaggcuacggguauagcaaaacaacggacaccuacggauauuccacaccgcaccagcccuacccucccccugcggcugccucuagccuggauaccgacuaucccggcuccgccuguucuauccaaagcuccgcuccucucagagccccggcucauaagggggccgagcugaauggaucuugcaugcggcccggcacaggcaacagccaagggggaggcgggggaucccagccucccggccuuaauagcgaacagcagccuccccagccgccucccccuccucccacccugcccccgucuucccccacaaacccugggggaggcgugcccgcgaaaaagccuaaaggcgggcccaaugccuccucuuccagcgcuaccauuucuaagcagaucuucccguggaugaaggagucccgccagaacagcaaacaaaagaauagcugugccacggcuggagagucuugcgaagauaaaagcccucccggcccugccuccaagagaguccggaccgcguacacaagcgcccagcucguugagcuggaaaaagaguuucacuucaaccgcuaccuguguagaccccggcgcguggagauggcuaaucuccugaaccuuaccgaaagacagauuaagaucugguuucaaaaucggcgcaugaaguauaaaaaggaccagaaagccaaggggauucugcauucuccugcuucccagagccccgagagaucuccgccucucggaggcgccgccgggcacguggcuuacagcggacagcugccucccguccccggccuugcguaugaugccccgucucccccugcuuucgccaaaucccaacccaacauguacggccuggccgcuuauacagccccucucagcuccugccugccccagcagaagcgguacgcggcuccugaauuugagccccauccgauggccagcaaugggggaggcuucgccucugcuaaccugcagggguccccuguguauguuggaggcaauuuuguggaaagcauggcccccgcuucugggccugucuucaaccucggccaccugucccaccccagcuccgccucuguggacuacagcugugcggcccaaaucccgggaaaccaucaccauggcccuugcgauccccacccuaccuacacggaccuuuccgcucaccauucuagccaggggcgccugcccgaggcccccaaacucacacaccuguga

SEQ ID NO: 70420 - RNA, 768 nt, Artificial Sequence
  derived and/or modified sequence opt5 from HOXD4__Homo_sapiens__NP_055436
auggugaugagcuccuacauggucaacucuaaguauguugaccccaaauucccuccgugcgaggaauaccugcagggcggguaucucggagagcaaggcgccgauuacuaugggggaggcgcucagggggccgacuuucagcccccuggacuguaccccagaccugauuucggcgaacagcccuuuggcgggagcggaccuggcccgggguccgcgcuucccgcucggggacacggccaagagccugggggacccggcggccauuaugccgccccuggggaacccuguccggcuccucccgccccuccucccgcuccccugccgggagcccgcgcguacucucagagcgaccccaagcagccucccuccggcaccgcccucaaacagccugcugugguguaccccuggaugaagaaaguccacgugaauagcguuaacccgaauuauacagggggagagccuaagagaagccggacggccuacacccgccaacaggugcuggagcuugaaaaggaguuccauuuuaacagauaucugacacggcgcagacggaucgaaauugcucacacccucugccuguccgagcgccagaucaaaauuugguuccagaauagacggaugaaguggaaaaaggaucauaaacugcccaacacaaagggccgcagcagcuccucuucuuccucuucuuccuguagcuccucugucgccccuagccaacaccuccagcccauggcgaaggaccaccauaccgaucugacaacccuuuga

SEQ ID NO: 70421 - RNA, 870 nt, Artificial Sequence
  derived and/or modified sequence opt5 from HOXD8__Homo_sapiens__NP_001186675
augagcuccuacuucgugaacccccuguauucuaaguacaaagccgcugccgcggcugccgccgcugccggcgaggcuaucaauccuaccuauuacgacugccacuuugccccggaagucgggggaagacaugcggccgcugccgcugcccuccagcuguauggcaacagcgcggccggguucccccacgcuccuccccaagcccaugcucacccucaucccuccccuccgcccucuggaacaggcugugggggacgggagggccgcggccaggaauacuuucacccugggggaggcagccccgccgccgcuuaucaggcggccccucccccgccuccccacccucccccucccccgcccccucccccuugcgggggaauugcuugucauggcgagcccgccaaguucuacggguacgauaaucuucagagacaaccgaucuuuacgacccagcaggaagccgagcugguucaguauccugacugcaaauccucuagcggaaacauuggcgaggaucccgaccaccucaaucaauccagcucuccuucccagauguuccccuggaugcggccucaggcucccggccgcagacgggggcgccagacauacagcagauuucaaacccuggaacuugagaaggaguuccuguuuaacccguaucucacacggaaacgcagaaucgaagugucucaugcccuggcgcugaccgagcgccaggugaagauuugguuccagaaucggagaaugaaguggaaaaaggaaaacaauaaagauaaguuuccugucucccggcaagaggugaaagacggagaaacaaagaaggaggcucaggaacucgaggaggaucgcgccgaaggccugaccaacuga

SEQ ID NO: 70422 - RNA, 1059 nt, Artificial Sequence
  derived and/or modified sequence opt5 from HOXD9__Homo_sapiens__NP_055028
augcugggcgggagcgccggaagacucaagauguccucuagcggcacccuguccaacuacuauguggacucucuuaucgggcacgagggagaugaagucuucgcugcccgguuugggcccccuggcccgggagcgcagggccgccccgcuggcguugccgacgggccugccgcuacagccgcugaguucgccagcugcuccuuugcgcccagaucugccguguucagcgcuuccuggagcgccgugccuucucaacccccugcugccgcggccauguccggacuguaccauccguaugugcccccucccccucucgcugccagcgcuucugaacccggccgguacguccgcuccuggauggagccgcugccuggguuucccggaggcgccgggggaggcggcgggggaggcgggggaggcccugggagaggacccagccccggcccuucuggcccggccaaugggcggcacuauggaauuaaacccgaaacgcgcgcugcgccugcccccgcuaccgccgccuccacaaccagcuccucuagcacaucccuuucuagcuccagcaagagaaccgaguguucuguugcucgggagagccagggcuccucugggccugaguucagcugcaacuccuuucugcaggaaaaagccgcggcugccacaggaggcaccgggcccggcgccggaaucggcgcugccacggggaccggaggcagcucugaaccguccgcuuguagcgaucauccuauucccgggugcucucucaaggaggaggaaaaacagcacucccaaccucagcagcagcaacuggaccccaauaacccugccgcgaauuggauccaugcccgcagcacaagaaagaagcggugucccuacaccaaauaucagacacuggagcucgaaaaggaguuccuguuuaacauguaccuuacccgcgauagacgguacgaaguggcucgcauucugaaucucacggagagacaggucaaaaucugguuccagaaccggagaaugaagaugaaaaagauguccaaggagaaaugcccgaagggagacuga

SEQ ID NO: 70423 - RNA, 1548 nt, Artificial Sequence
  derived and/or modified sequence opt5 from HP1BP3__Homo_sapiens__XP_011539836
augcccaucagacggaccgugaacagcacacgcgagacgccuccgaaguccaaacuggccgaaggcgaggaagagaagcccgaaccugacauuucuagcgaggaguccgucucuaccguugaagaacaggaaaaugagacacccccugcuaccagcuccgaggccgaacaacccaaaggggagccugaaaacgaggaaaaggaggagaauaaaucuagcgaagagacaaagaaggaugaaaaagaccaguccaaggagaaagaaaagaaagugaagaagaccaucccgagcugggcgacacucucugcuucccagcuggccagagcccagaaacaaacccccauggcuagcucuccucggcccaagauggaugccauucuuacggaggcuaucaaagccugcuuccagaaguccggagcgagcguggucgccauucgcaaauacaucauccacaaguauccuucucuggagcucgaaagacggggcuaccugcuuaaacaggcucugaagcgcgagcucaacagaggggugauuaagcagguuaaaggaaagggcgccuccgggagcuuuguggucgugcaaaaaucccggaagacaccccagaaaucucgcaauagaaagaaccggagcuccgcuguugacccggaaccucaggugaagcuggaggauguccugccccucgccuucacccgccugugugaaccuaaagaggcgagcuauucucuuaucagaaaguacgugucccaguauuaccccaaacugcggguggacauucgcccccaacuccugaagaaugcccuucagagagcugucgagcggggacagcuggaacaaaucaccggcaaaggcgccagcgggacauuucagcucaagaagucuggagagaaaccucugcugggcgggagccucauggaauaugcuauucuguccgccaucgccgcuaugaacgagccgaagaccugcucuacgacagcgcuuaaaaaguacguucuggagaaucaucccggaaccaacagcaauuaccagaugcaccuccugaaaaagacacuucagaagugugagaaaaacggcuggauggagcaaauuuccgggaagggauucagcggcaccuuucagcugugcuucccuuauuaccccucuccuggcgugcucuuucccaaaaaggaaccggaugacuccagagaugaggacgaagaugaggacgagagcucugaagaggauuccgaagacgaggaaccucccccuaaacgccggcugcagaagaaaacccccgccaagagcccugggaaggcugccuccgugaaacagagaggaucuaagcccgccccgaaagucagcgcugcccaacgcggcaaggcgcggccucugcccaaaaaggcucccccuaaggccaaaacaccggccaagaaaacgagacccuccucuaccgugaucaagaaaccuagcgggggauccagcaagaagcccgcuacaucugcccgcaaagagguuaagcucccuggcaaagggaaguccaccaugaaaaagagcuuccgggugaagaaauga

SEQ ID NO: 70424 - RNA, 582 nt, Artificial Sequence
  derived and/or modified sequence opt5 from HPCAL1__Homo_sapiens__XP_011508650
augggcaagcagaacagcaaacugagacccgaagugcuccaagaccugcgggaaaauaccgaguucacagaucacgaacuucaggagugguacaagggguuucugaaagacugcccuacgggacaucucaccgucgaugaguucaagaaaaucuaugccaacuuuuucccguacggcgacgcuuccaaguuugccgaacacguuuuccgcacauuugauaccaauggggacggaacaauugauuucagagaguuuaucauugcgcugucugugaccagccggggcaaacuugaacagaaacugaagugggcuuucuccauguaugaccucgaugggaacggauacaucucucgcagcgagaugcuggaaauugugcaggccaucuauaaaauggucuccucugugaugaagaugcccgaggacgagagcacaccugaaaagagaaccgauaagaucuuucggcaaauggacacgaauaacgauggcaagcugucccucgaggaguucauucgcggcgccaaaagcgaccccucuaucguuagacugcuucagugugacccuuccagcgcuucucaguuuuga

SEQ ID NO: 70425 - RNA, 1065 nt, Artificial Sequence
  derived and/or modified sequence opt5 from HPD__Homo_sapiens__NP_001165464
augggcuucgagccccuggccuacagagggcucgaaaccggaagccgggagguggucucccacguuaucaagcagggcaaaauuguguuugugcugucuagcgcucuuaacccuuggaauaaggaaaugggggaccaucuggucaaacacggagauggcgugaaggacaucgccuucgagguugaagauugcgacuauauugugcaaaaagcgcgcgagagaggggcuaagaucaugcgggagccgugggucgaacaggauaaguuuggaaaagugaaguucgccguucuccagacauacggcgacacgacccauacacugguggagaaaaugaacuauauuggccaguuucuucccggguacgaagccccugcuuucauggauccccugcucccuaagcugcccaaauguucccuggagaugaucgaccacaucgucggaaaucaaccugaucaggagauggugucugccagcgaaugguaucucaagaaccugcaguuucaucgcuucugguccguggacgauacccagguccacacagaguacucuagccuuagauccauuguuguggcuaauuaugaagagagcaucaagaugccgauuaacgaacccgccccuggcaaaaagaaaucucaaauccaggaguacguggacuacaaugggggagcgggcguccagcacauugcccugaagaccgaggauaucauuacagcuauccggcaucuccgcgaaagagggcuggaguuucuuuccgugcccagcaccuauuacaaacagcugcgggaaaagcucaaaacggccaagaucaagguuaaagagaacauugacgcucuggaagaacugaagauccucguggacuaugaugagaaaggauaccugcuucaaauuuucaccaagccuguccaggaccgccccacacuguuucucgaagugauccagagacacaaucaucaaggcuucggcgccgggaacuuuaauucucuguucaaagcguucgaggaggagcagaaccuucggggaaaucugaccaacauggaaacaaauggcguugugccggggauguga

SEQ ID NO: 70426 - RNA, 801 nt, Artificial Sequence
  derived and/or modified sequence opt5 from HPGD__Homo_sapiens__NP_000851
augcacgugaacggcaaggucgcccugguuaccggggcugcccagggaaucggcagagcguucgcugaggcccuccugcuuaaaggggccaagguggcucugguggacuggaaucucgaagccggaguccaaugcaaagcugcccuggaugagcaguuugaaccccagaagacacuuuucauucagugugacguggcggaucaacagcagcugcgggacacguuucgcaaaguuguggaucauuucggcagacucgacauccuggucaacaaugccggggugaacaaugagaagaacugggaaaagacccugcagauuaaucucguuagcgugaucuccggaacauaccugggccuugauuauaugucuaaacaaaacggcggggagggaggcauuaucaucaauaugagcucccuggcugggcucaugccugucgcccagcagccgguguacugcgcuucuaagcacggaauugugggcuuuacccggagcgccgcgcuggccgcuaaccuuaugaacuccgggguccgccugaaugccaucugucccggauucguuaauacagcuauucucgagucuaucgaaaaagaggaaaacaugggccaguauauugaguacaaggaccauaucaaagauaugauuaaguauuacggcauccuggacccuccccugaucgccaaugggcucauuacccugaucgaggaugacgcccuuaacggagcuauuaugaagaucacaaccagcaaaggcauucacuuucaagauuaugacacgaccccuuuccaggcgaagacacaguga

SEQ ID NO: 70427 - RNA, 600 nt, Artificial Sequence
  derived and/or modified sequence opt5 from HPGDS__Homo_sapiens__NP_055300
augcccaacuacaagcugaccuauuucaauaugagaggccgggccgagaucauucgcuacaucuuugcuuaucucgacauucaguacgaagaucacagaaucgagcaagccgacuggccugaaauuaaaagcacacugccguucgggaagauccccauccuugagguggauggacugacgcuccaucagucccuggcgauugcucgguaucuuaccaaaaacacagaccuggccggcaauaccgaaauggagcagugccacgucgaugccaucguugacacacucgaugacuuuaugucuuguuucccuugggcugagaagaaacaggaugugaaggaacaaauguuuaacgagcugcugaccuacaaugcuccccaucucaugcaggaccuggauacauaucuugggggacgcgaauggcugauuggcaacagcgugaccugggccgacuucuacugggagaucugcuccacgacccuccuggucuuuaagccugaucuucuggacaaucaccccagacucgugacacugcggaaaaagguucaggccauuccugcgguggccaacuggaucaaacgcagaccgcagaccaagcuguga

SEQ ID NO: 70428 - RNA, 1044 nt, Artificial Sequence
  derived and/or modified sequence opt5 from HP__Homo_sapiens__NP_001119574
augagcgcccugggcgcugugaucgcccuccugcuuugggggcagcuguucgcggucgacuccggaaacgauguuaccgacauugcugaugacggcugccccaagccuccggagaucgcccacggguacguggaacauucugugagauaucaauguaaaaauuacuauaagcuccggacagagggagauggcgucuacacgcugaacaaugaaaaacaguggauuaacaaggccgugggggacaaacuucccgagugcgaagcuguuuguggaaagccuaagaaucccgccaacccugugcagcgcauccugggcggccaccucgaugcuaaagggagcuuucccuggcaggccaagauggucucccaucacaaucugaccacaggagcgacccugauuaacgagcaauggcuccugacaaccgccaaaaaucuuuuccugaaccauucugagaaugcuacagccaaggacaucgcuccuacccucacgcuguaugugggcaaaaagcagcuuguugaaaucgagaaggugguccugcacccgaacuacagccagguggauauugggcucaucaaacugaagcagaaaguguccgucaaugaaagaguuaugcccauuugccugccuucuaaggacuaugccgaggugggacgggugggcuacgucagcggguggggacgcaacgcgaauuuuaaauucaccgaucaccucaaguacgugaugcugcccguugccgaccaagaucaguguaucagacauuaugagggcuccacagugccugagaaaaagacccccaagagcccggucggcgugcagccuauucuuaacgaacacacauuuugcgcugggaugucuaaauaccaggaagacaccuguuauggagacgccggcuccgcuuucgccguucaugaucuggaggaagacacgugguacgccacagggauccucagcuuugauaagucuugcgcuguggcggaguauggagucuacgugaaagucaccuccauucaagacugggugcagaagacaaucgccgagaacuga

SEQ ID NO: 70429 - RNA, 1254 nt, Artificial Sequence
  derived and/or modified sequence opt5 from HPN__Homo_sapiens__NP_892028
auggcccagaaggagggcgggagaaccgugcccugcuguagccggccuaaagucgcugcccugacagcgggaacgcuccugcuucugaccgcuaucggcgccgccuccugggcuauuguugccgugcuccugcgcucugaccaagaaccgcuuuaccccgugcaggucagcuccgcugaugccagacugaugguguucgacaagacagaggggaccuggcggcuccugugcucuagccgcuccaacgcgagaguugccggacugucuugugaagagaugggcuuucuccgggcucugacacacagcgaacuugaugugcgcaccgccggggcuaauggaacauccggcuucuuuugcgucgacgagggcagacugccucauacccagcggcuccuggaggugaucagcguuugugauugcccccgcgggagauuccuugccgcgauuugucaggacugcggacggcgcaaacugccuguggauagaaucgucggcgggcgggacacgucucucggacgcuggcccuggcaagugucccugagauaugauggcgcccaccugugugggggaagccuccugucuggcgacugggugcuuaccgcugcccauugcuuuccugaacggaacagaguccugucccgcuggcggguuuucgcuggcgccguggcccaggcuagcccgcacgggcuccagcugggagugcaggcggucguguaccauggcggguaucuucccuuuagagauccuaauucugaggaaaacuccaaugacauugcccugguucaccucagcucuccccugccucugacagaguacauccaacccgugugucucccggcugccggacaggcccuggucgauggcaagaucugcaccgugacaggguggggaaacacccaguauuacggccagcaagcuggcguucuucaggaggcccgcgugccuauuaucuccaaugacgucugcaacggggcggacuucuauggaaaucagauuaaacccaagauguuuugugcuggcuacccugaagggggaaucgaugccugccaaggcgacagcgggggccccuucgugugugaggauuccauuagccggacgcccagauggcgccugugcggaaucgucucuuggggcacagggugugcccucgcucagaagccuggaguguacaccaaaguuuccgacuuucgggaauggauuuuccaggccaucaagacacacagcgaggcuucuggcauggugacccagcuguga

SEQ ID NO: 70430 - RNA, 1047 nt, Artificial Sequence
  derived and/or modified sequence opt5 from HPR__Homo_sapiens__NP_066275
augagcgaccugggcgccgugaucucccuccugcuuugggggagacagcuguucgcucucuacucuggaaacgaugucaccgacauuagcgaugaccgguuucccaagccuccggagaucgccaauggcuauguugaacaccuguuccgcuaccaaugcaaaaacuauuacagacuucggacagagggggauggaguguauacgcugaaugacaagaaacaguggauuaacaaggcggugggcgauaaacuccccgaaugugaggcugucugcgggaagccuaagaaucccgccaacccugugcagcgcauccugggaggccaucuggacgccaaaggcuccuuucccuggcaggcuaagaugguuucucaccauaaucucaccacaggggccacccugauuaacgaacaauggcuucugacaaccgcuaaaaaucucuuccugaaccacagcgagaaugccacagcgaaggauaucgccccuacccuuacgcuguacgugggcaaaaagcagcucgucgagaucgaaaaggugguucugcauccgaacuaucaccagguggacauuggacugaucaaacucaagcagaaaguccuggugaaugagagagugaugcccauuugucuuccuuccaagaacuacgcugaagucgggcggguuggauacgugucuggcugggggcaaagcgauaauuuuaaacugaccgaccaccucaaguaugugaugcugcccgucgccgaucaguacgacugcaucacacauuaugagggauccaccuguccuaaauggaaggcucccaagagcccggugggcguucagccuauucuuaacgagcacacauucugcgugggcaugucuaaauaccaggaagacaccuguuauggggaugccggauccgcguuugccguccaugaccuggaggaagauacgugguacgcugccggcauccucagcuucgacaagucuugcgcuguggccgaguaugggguuuacgugaaagucacauccauucaacacugggugcagaagaccaucgccgaaaacuga

SEQ ID NO: 70431 - RNA, 657 nt, Artificial Sequence
  derived and/or modified sequence opt5 from HPRT1__Homo_sapiens__NP_000185
auggccaccagaagccccggcguggucaucuccgacgaugagccuggguacgaccuggaucucuucugcauuccgaaccacuaugcugaagaccuggagcggguuuuuaucccccauggacuuauuauggaucgcacagaaagacuggcccgggacgugaugaaagagaugggcgggcaccauaucguggcgcucuguguccugaaaggaggcuacaaguucuuugcugaucuucuggacuauauuaaagcccucaaucgcaacucugauagaagcaucccuaugacgguggacuucauccggcugaaguccuacugcaaugaucagucuaccggggacauuaaaguuaucggaggcgaugaccugagcacacucaccggcaagaacgugcugauugucgaagacaucauugauacagggaagaccaugcaaacacuucugucccucgugcgccaguauaaucccaaaaugguuaagguggccucucugcuugucaaaagaaccccucggagcgugggauacaagcccgacuuugugggcuucgagaucccugauaaauuugucguuggguaugcucuggacuacaacgaguacuuccgcgaucucaaucacgugugugugauuuccgaaacgggaaaggccaaguauaaggcuuga

SEQ ID NO: 70432 - RNA, 2103 nt, Artificial Sequence
  derived and/or modified sequence opt5 from HPS1__Homo_sapiens__NP_000186
augaagugcgugcuggucgccaccgagggcgcugaaguucucuucuacuggacagaccaggaguuugaagagagccugagacuuaaauucgggcaauccgaaaacgaggaggaggaacugcccgcccucgaagaucagcugucuacgcuucuggcgccugugaucauuagcuccaugaccaugcucgagaagcugucugacacauauaccuguuuuagcacagagaauggaaacuuccuguacgugcuccaccuguuuggcgaaugccuuuucaucgcuauuaauggggaucauaccgaguccgaaggagaccugcggcgcaaacucuauguccugaaguaccuuuuugaggugcacuucggccugguuacaguggaugggcaucucaucagaaaagaacugcggccgcccgaccuggcccagcgcguccagcucugggagcacuuucaaucucugcuuuggaccuauagcagacugcgggagcaggaacaguguuucgccguggaggcucucgaacgccugauucauccucagcuuugcgagcuguguaucgaagcccucgagagacacguuauccaagcugugaacacgucccccgagcggggaggcgaagaggcccugcacgcguuucugcucguccauagcaagcugcuugccuucuacucuucccacagcgcuucuucccugcgcccugccgaucuccuggcucuuauucugcucgugcaggaccuguaucccagcgaaucuaccgccgaggaugacauccagccuuccccgagacgggcgcgcagcucccagaauauucccgugcaacaggccuggucuccucauagcacaggccccaccgggggauccagcgcugaaacagagaccgauucuuuuucccugccugaggaauacuucacgcccgccccgagcccuggcgaccagucuagcggguccacaaucuggcucgagggaggcacacccccuauggaugcucugcaaauugccgaagacacccuucagacccuggucccccacugccccguuccuucugggccgagacggaucuuccucgacgccaacgugaaggagagcuacuguccccuggugccucacaccauguauugccugccccuuuggcagggaauuaaucucguccugcugacacgcuccccuagcgcuccccucgcgcuggugcuuucucagcugauggauggcuuuuccaugcucgagaaaaagcugaaagaaggcccggagccuggggccagccugagaucucaaccccuuguuggagaccuccggcagagaauggauaaguucgugaaaaaccgcggcgcucaggaaauccaguccacguggcuggaguuuaaggccaaggccuucagcaaauccgaaccugggucuagcugggagcugcuccaggcuuguggaaagcugaaacggcaacuuugcgccaucuacagacugaauuuucucaccacagcgcccucccgcggcgggccucaucugccccagcaccuucaggaccaaguccagcggcuuaugagagagaagcucaccgauuggaaagacuuccugcuggugaagucucgccggaacauuacaaugguuagcuaucucgaagauuuuccgggacuggugcauuucaucuacgucgacagaaccacgggccagaugguggcuccuucccuuaauuguagccagaaaacaucuuccgagcugggcaaggggccccucgccgccuuugucaagaccaaaguguggagccugauucaacuggcucgccgguaucuucagaagggauacaccacacuccuguuccaggaaggcgauuuuuauugcucuuacuuccugugguuugagaacgacaugggguacaaacuccaaaugaucgaaguucccgugcuguccgaugacagcgucccuauuggaaugcuuggcggggacuauuacagaaagcugcuccgcuauuacucuaaaaaucggccgaccgaggccgugagaugcuaugagcugcuggcucugcaccugagcguuauccccacagaucuccuggugcagcaggccggccagcucgcgcggcgccugugggaagccuccagaaucccucuucuguga

SEQ ID NO: 70433 - RNA, 3015 nt, Artificial Sequence
  derived and/or modified sequence opt5 from HPS3__Homo_sapiens__NP_115759
auggugcagcuguacaaccuccaccccuucggcagccaacaggucguuccuugcaagcuggagccggacagauuuugugggggaggccgggaugcccuuuucguggcugccgggugcaaaguggaagcguuugcugucgccggacaggagcugugucagccccgcugcgccuucuccacccucggcagagugcugcggcuugcuuauucugaagccggggacuaccugguugcuaucgaggaaaagaauaaagccacauuucuccgcgcguaugugaacuggagaaauaagcggacggagaacagccgcgucuguauuagaaugaucggacauaauguggagggcccuuucuccaaagccuuucgggaucaaauguacauuaucgaaaugccccugucugaggcuccucugugcauuagcuguugccccguuaagggcgaccuccuggugggguguaccaacaaacuuguccuguucucccucaaguaucagaucaucaaugaagaguuuucucugcuugauuucgagcgcagccugauuauccacauugacaacaucacaccuguggaaguguccuuuugcgucggauacguugccgugaugagcgaucucgaggugcugauugucaagcuggaaucuggcccgaaaaauggggagagagugcaucaccauccccacaagaccaacaaucggauccgcagaacagaagagggaauuuccaacgagaucagccagcucgaaucugacgauuucguuaucugucagaaaccucuggagcuucugggcgaaaaguccgagcaaagcgggcucucugugacccuggaauccacaggacuugcugacgagaagcggaaauauagccacuuucagcaucugcucuaccgcagauucgcccccgauauuuccucuuacguccugagcgacgauaucaagcugcacucccuccagcugcuuccuauuuaucagaccggcagccugacgucugacggcaaaaaucucucccaagagaaggaacugcuuagccuguucugcuuuuucucucucccccaugugggguaccuguauaugguugugaaaagcgucgagcugauguccguguaccaguauccggaaaagucucagcaagcgguccucaccccucaguuucugcacgugaucacaagcaacaaucuucagugcuucaccguucgguguuccgccgcugccgcuagagaggaagaccccuacauggauacaacccugaaagccugcccucccgugagcauggacgucugugcccuccgcauucagcuguuuaucggacugaaggcuaucugccacuucaagaaccauauuauccuucucacgaaagcggagcccgaggccauuccugaacggagacaaucuccgaagcgccugcugucccggaaagauacaagcgugaagaucaaaauucccccuguugcugaggccggcuggaaccucuauaucgugaauaccaucucucccguccagcuguacaaggaaaugguggacuacuccaacacauauaagaccgugaaaacccagagcuguauucaccuucuguccgaggcccaucuccugguuagagcugcccugauggaugcgucucagcuugagccuggggaaaaggcugagcuccuggaagccuuuaaagagagcugcggacaccugggcgacuguuacucccgccucgauucucaacauagccaccugacacuucccuauuacaagauguccgggcugagcauggccgaaguccucgcucggacggacuggaccguggaggauggacugcagaaauaugagagaggccugaucuucuacauuaaucacucucuuuaugaaaaccucgacgaggaacugaaugaggaacuggccgcuaaggugguccagauguuuuacguggccgagccgaagcagguuccucauauccucugcucccccagcaugaaaaacauuaauccucugacagcgaugucuuaccuucgcaagcuggauaccuccggcuucagcucuauccucgugacacugaccaaagccgcugucgcccugaagaugggggaccuugacaugcaccggaacgagaugaaaagccauuccgaaaugaagcucguguguggauuuauucuggagcccagacugcucauccaacagcgcaagggccagaucguuccuacggaacuggcccuucaccugaaagagacacagcccgggcuccugguggcuagcguccugggacuucaaaagaauaacaaaauuggcaucgaagaggcggauucuuucuuuaaggugcugugcgccaaagacgaggauaccauuccgcagcuccugguugacuucugggaagcucagcucguggccugucugccugaugucgugcuucaagagcuguucuuuaagcucaccucccaguauaucuggcggcugagcaaaagacagccucccgacacaacaccccugcggaccuccgaagaucuuauuaaugcuugcucucacuacgggcugaucuauccgugggugcaugucguuaucagcuccgacucucucgccgauaagaacuacacggaggaccugagcaagcuccagucccugauuugcggccccucuuucgauaucgccagcauuaucccuuuucuugagccccuguccgaagacaccauugcuggacucagcgugcacgugcugugucgcacaagacugaaagaguaugaacaaugcaucgauauccuucuggagcgguguccugaagcggucauucccuacgccaaucaugagcucaaggaggaaaacagaacccugugguggaaaaagcuccugccugagcuuugccagcgcaucaaauguggcggggaaaaguaucagcuguaccugucuucccucaaggagacacugagcauuguggcuguugaacuugagcugaaagacuucaugaaugugcuccccgaggacggaaccgccacguuuuuccugccguaccuccuguauugcucucggaagaaaccucuuaccuga

SEQ ID NO: 70434 - RNA, 2127 nt, Artificial Sequence
  derived and/or modified sequence opt5 from HPS4__Homo_sapiens__NP_071364
auggccaccagcacauccacggaggcuaagucugccagcugguggaacuacuucuuucuguaugacggcuccaaagugaaggaagagggggaucccaccagagcgggaaucugcuacuucuauccuucucagacacuccuggaccaacaggaacuucuguguggccagauugcuggggucguucggugcgugagcgauaucuccgacucuccgcccacccucgugcgccugagaaaacuuaaguuugccauuaaagucgauggagacuaccugugggugcucggcugugccguugagcugccugaugugagcugcaagcgguuccuggaccagcucgucggguuuuucaauuuuuauaacggacccgugucccuggcuuacgaaaauuguagccaagaggagcuuucuacagaaugggauaccuucaucgagcagauucugaagaacacauccgaccuccacaaaaucuuuaauagccuguggaaccuugaucagaccaagguugaaccucugcuccugcugaaagccgcucgcauccuccagacgugccaaagaucuccccauauucuggccggcuguauccuuuauaagggccugauuguguccacccagcucccuccgagccugacagcgaaaguccuucugcaccggaccgccccucaggagcagcgccuccccacaggggaggacgcuccccaagaacauggagccgcucugccucccaaugugcagaucauuccgguguucgucaccaaggaggaagccaucucucugcacgaguuuccuguugaacagaugacgagaucccucgcgagccccgccggccugcaagauggguccgcucagcaucacccuaagggaggcucuacaagcgcccuuaaagagaacgcuaccgggcacguggaguccauggccuggacaacccccgaccccaccagcccugacgaagccugcccggauggacggaaggagaauggcugucugucuggccaugaccucgaauccauucgccccgcugggcugcacaacagcgcgagaggagaggugcuuggccugucuagcucccucgggaaagaacuggucuuccugcaggaggagcucgaucugucugaaauccauaucccugaggcccaggaaguggagauggcuagcggacacuuugccuuccuucacguucccgugccugacggccgggcccccuacugcaaggcuucccugagcgccucuuccagccucgaaccgacaccucccgaggauacggcgauuucuucccugcgcccucccagcgcuccugagaugcugacccaacauggggcccaggaacagcuugaggaccaccccggacauuccucucaggccccgaucccuagagcugauccccucccccggcgcacaagacggccucugcugcucccgagacuggaccccggccaacgcggcaauaaacuuccuaccggggaacagggacuggaugaggacgucgauggcgugugugagagccacgccgcucccgggcucgaaugcuccucuggaagcgccaacugccagggcgcggggccuuccgccgacggcauuagcucucggcugacacccgcugaguccuguaugggacugguuagaaugaaucuuuacacccauugcgugaagggccucguccugagccugcucgccgaagaaccucugcuuggggacucugcugccaucgaagagguguaucacuccagccuggcgucucucaacggacuggagguccaccugaaagaaacgcuuccccgcgaugaggccgcuagcacauccagcaccuacaauuucacccauuaugaccggauucagucucuccugauggccaaccugccgcaaguggcuacaccucaggauagacgcuuucuccaggccguuucccugaugcacagcgaguucgcccagcuucccgcucuguacgagaugaccgugcggaacgcguccacagccgucuaugcuuguugcaauccuauccaagaaacguacuuucagcagcucgcccccgccgcuagaucuagcggcuucccgaacccucaagacggggccuuuucccugucuggaaaggcgaagcagaaacugcuuaagcauggcgugaaucuccuguga

SEQ ID NO: 70435 - RNA, 3390 nt, Artificial Sequence
  derived and/or modified sequence opt5 from HPS5__Homo_sapiens__NP_852608
auggccuucgugcccgucaucccugagagcuacucccacguucuggcugaauuugagucucucgacccgcugcuuagcgcccugagacucgauuccucucggcugaagugcaccagcauugcggugucccgcaaauggcuugcucugggcucuagcgggggaggccuccaucugauccagaaggaaggguggaaacacagacuguuccucucccaucgggagggagccauuagccaaguggccuguugccugcacgacgaugacuaugucgcuguggccacaucucagggccuuguuguggucugggaacugaaccaggagcgcagagggaagcccgagcagauguacguguccagcgaacauaaaggacggcgcguuacggcucucuguugggauaccgccauccugagaguguuugucggcgaccacgcgggcaaggugucugccauuaagcucaauacauccaaacaagcuaaggccgcugccgcguucgugauguuuccuguccagaccaucacaaccguugauagcugcguggugcagcuggacuaucucgaugggcggcugcugaucucuucccucacacgcagcuuccugugugacaccgagagagaaaaauuuuggaagauuggaaacaaagagcgggauggcgaguacggggccugcuucuuucccggacgcuguuccggcgggcagcaaccucuuaucuauugcgcuagacccggaucucggaugugggaagucaauuucgacggcgaggugauuagcacgcaccaguuuaagaagcugcucucccugccuccgcuucccguuaucacccugcgcagcgaaccucaguacgaucauacagccgggucuucccagagccucucuuuccccaaacugcugcaccucagcgagcauugugugcugaccuggacagaaagaggcauuuauaucuuuauuccucaaaacguccaggugcuucugugguccgagguuaaggacauccaggacguggcugucugccggaaugagcuuuucugucugcaccuuaacggaaaagugucucaccugagccucaucuccgucgaaagaugcguggagcgccugcugcggagaggccucuggaaucuggccgcccggaccugcugucuuuuccaaaacagcguuauugcuucucgggcgagaaagacgcugacagccgauaaacucgaacaucugaagucccagcuggaccacgggaccuacaaugaucuuaucagccagcucgaggaacugauucugaaauuugagccccucgacucugcuugcuccagccgccgguccucuaucagcucccaugagucuuucagcauucuggauuccggaaucuacagaaucauuagcucucgccggggcucccagagcgacgaagauucuuguucccuucacagccaaacacugucugaggacgaaagauuuaaggaguucaccagccagcaggaagaggaucucccggaccagugcugugggucccauggaaacgaggauaaugugagccacgccccugucauguuugaaaccgacaagaacgagacauuccugcccuuuggcaucccucugcccuuccgcucucccuccccucuugugagccuccaagccguuaaagaauccgugucuagcuuuguccggaagacgaccgagaaaauuggcacacugcacaccuccccggaccugaaggugagacccgagcuccgcggggaugaacagucuugcgaggaagacgugagcuccgauacauguccuaaagaggaagacaccgaggaggaaaaggagguuacgucucccccucccgaagaggaucgcuuccaggaacugaaggucgcuacagccgaggcgaugaccaaacuucaggacccgcuggugcucuuugagagcgaaucccugagaauggugcugcaagaguggcuuagccaucucgaaaagaccuucgcuaugaaagauuuuucuggagucuccgacacagauaauagcucuaugaagcugaaccaggacgugcugcucguuaaugaguccaaaaagggcauccuggaugaagacaacgagaaggagaaacgggauagccuugggaacgaagagucuguggacaagaccgccugcgaaugugucagauccccucgcgagagccuggacgaucucuuccagauuugcucccccugugccaucgcuagcggacugcggaaugaccuggccgagcuuacaacgcucugccuggaacugaacgugcucaauucuaaaaucaagagcaccuccggccacguugaucauacacugcagcaauauucuccugagauucuugcuugccaguuccugaaaaaguacuuuuuccuccugaaccugaagagagccaaagaaagcaucaaacuuuccuauucuaauagccccuccgugugggacaccuuuauugaggggcugaaggaaauggcgucuagcaacccugucuacauggagauggagaagggcgaucuccccacacgccugaaacuccuggacgaugaagugccguucgacuccccucuucugguuguguaugccaccagacucuacgagaaguuuggagaaagcgcucugcggucucugaucaaauucuuucccuccauucuucccagcgauaucauucagcugugucaccaccauccugccgaguuccucgcuuaucuggacucucucgucaagucccgcccggaagaucaaagaagcuccuuucuggagucucuucugcagcccgagagccuccggcuggacuggcugcuucuggccgugucccucgaugcgccucccagcacgucuaccauggacgacgaaggcuacccucgcccccacucccaucugcucagcuggggguacucucagcugauccuucaccugaucaagcugccugccgauuucauuacaaaagagaagaugaccgacaucugcagaagcuguggauuuuggcccggcuaucucauucugugccuugaacuggagcggcgcagagaagccuucacaaauaucguguaccucaacgauaugucccugauggagggggacaauggauggauuccggagaccgucgaagaguggaaacuccugcuucaucugauccagucuaagagcacgcggccugcuccccaagaaucccugaacggcucucucagcgaugggccuucccccaucaauguugagaacguggcucugcuucuggccaaagccaugggcccggaccgcgcuuggagccuccugcaggaguguggacucgcgcuggaacuuucugagaaguuuacaagaaccugcgauauucugcggaucgccgaaaagagacagcgcgcucugauucaguccaugcucgagaaaugugaccgguuccuguggagccaacaggccuga

SEQ ID NO: 70436 - RNA, 2328 nt, Artificial Sequence
  derived and/or modified sequence opt5 from HPS6__Homo_sapiens__NP_079023
augaagagaagcggcacccugcggcuccuguccgaccuuucugccuucgggggagcugcccgccugagagagcucguggcgggcgauagcgcuguccggguucgcgggucccccgacggaagacaucugcuucugcuccggccuccgggcgccguggcuccccagcugcugguggccucucgcgggccuggagccgaacucgagagagcuuggcccgccggccaaccuagcccccuggaugcguuuuuccuuccuuggccggcccggcccgcucugguccucgugugggaauccggccuggccgagguuuggggcgcuggagugggcccuggguggcgcccccuucagucuacagaacugugcccuggaggcggggccagagucguggcgguugccgcucuccggggacgccugguguggugugaggagagacaggcccgggcugaaggccccagcggcuccccggccgccgcuuuuagccacugcgucugugugcgcacgcuggagccuucuggggaagcguccaccagccucggaagaacacacgugcugcuucaucacugccccgccuucggccugcucgcuucuugucggcagcuguuucuugucccuaccgccacaaccuggcccgggguugcccaugugcugcucaucuggucccccggaaaaggcaaggugauggucgcugccccuagacuggggcugagcuacucuaaaucccucaacccgggacgcggcgacacaugggauuuccggacccugcuuagaggccugcccgggcuccugagcccucgcgagccccuugcggugcacacgugggcuccuacaccccaaggacugcuccugcuggacuuuggcgggaccguuucccuccugcagucucacggaggcacccgggccguggggacacuucaggaggccccggucggcccuuggggaagcgcugcccugggcaccuuccaggggacgcucgcuugcgugcugggauccacacuggaacuucucgauaugggcagcgggcaacugcuggagagaaagguucucucuaccgaccgcgugcaucugcuugaacccccugcccccggaauggaggaugaagaggagcuggaaacacggggcaaucucagacugcuguccgcgcuugggcucuuuugugucggcugggaggccccucagggaguggaacugcccagcgcuaaagaccuggucuucgaggaagccugcggcuauuaccagcgccggucucucagaggggcucagcugaccccggaggagcuucgccacagcuccaccuuucgggccccucaagcgcuggccucuauucuccagggacaucugccucccagcgcucugcuuacaaugcucagaacggaacugcgggauuaucgcggccuggagcagcucaaggcccaacugguggcuggggacgaugaagaggccggauggaccgaacuugccgagcaggagguugcuagacugcuccggacagaacugaucggcgaccagcuggcgcagcuuaacaccguguuccaagcccuccccacagcugccuggggcgccacccugagagcucugcagcuccagcuggacgggaauggaaagcuccgcucccaggccccgcccgaugucuggaaaaaggugcugggcgggauuacggcgggaaaagagccucccaacggcauccucccucccuuugaacugcugugucaaugccuuugucagcuggagccucgguggcuucccccguucguugagcuggcucagcagcaagggggaccuggcuggggcgccgggggacccggccucccucuguacagacgcgcccuugcugugcugggggaagagggaacaagacccgaagcccucgagcuggaacugcuucugagcucuggccggccgaaggcgguccuccaggcuguggggcagcuggugcagaaagagcaaugggaccgcgcccucgaugccggacuggcucuuggcccuuccagcccccugcucagaucugagauuuucaagcugcugcuugccgaauuugcucagcaccggcgccuggacgcccaccucccucugcucugcagacugugcccucccgagcuugcgcccgccgaacugcugcuccugcuucggaccuaucugccggaugagguugggcccccuacccccuucccugaacccggggcugagccuccgcucacagucggacugcucaaggcccugcuugagcagaccggcgcucaaggguggcuguccggacccgugcugagcccuuacgaagacauccucugggaucccuccacaccucccccgacgccuccccgcgaccuguga

SEQ ID NO: 70437 - RNA, 1605 nt, Artificial Sequence
  derived and/or modified sequence opt5 from HPSE2__Homo_sapiens__NP_001159716
augagagugcugugcgccuuccccgaggcuaugccuagcuccaacucucggccgcccgccugucucgcgccuggcgcucuguaccuugcccugcuccugcaccuuagccuguccucucaggccggggaccgcagaccccucccugucgaucgggcugccggacugaaggaaaagacccugauccuccuggacguuagcacaaagaaucccgugcgcacggugaacgagaauuuucuuucccugcaacucgauccuucuauuauccaugacggcuggcuggauuuccuuagcuccaaaagacuggucacccucgcucgggggcugagcccggccuuucugcgcuucggaggcaagagaacagacuuucuccaguuccagaaccugcggaaucccgcgaaaucucgcgggggaccuggccccgauuauuaccuuaagaacuaugaagacgauauugugagauccgacguugcccuggauaagcagaaaggcugcaagaucgcucaacacccugacgugaugcucgagcugcagcgggaaaaagccgcucagaugcaucuuguccugcucaaggagcaguuuagcaauaccuacucuaaccugauucugacagagcccaauaacuaucgcaccaugcacgggagagccgugaauggaucccaacucggcaaagauuacauccagcugaaaagccuucugcagccgauccggauuuauucucgcgcgucccucuacgggccuaacaucggaagaccccggaagaauguuauugcccugcuugacggcuucaugaaaguggcugggagcacagucgacgccgugaccuggcagcauuguuacaucgauggaagaguggucaagguuauggacuuucugaaaacgcgccuccuggauacccuguccgaccaaauucggaagauccagaaaguggugaacacauauaccccuggcaagaaaauuuggcucgaaggcgucgugacaaccucugcugggggaacgaauaaccugagcgauuccuacgccgccggcuuccuuuggcugaacacacucgggaugcuggcuaaucagggaaucgacguugugaucagacacagcuuuuucgaucacggcuauaaccaucuggucgaccaaaauuuuaacccccuucccgauuacuggcucucucugcuguauaagcgccucauugggccuaaggugcuggcgguucacguggccggacuucagcggaaaccgagacccggccgcgucauccgggacaagcugagaauuuacgcucauugcaccaaucaccacaaccauaauuaugugcgcggcuccaucacacucuucauuaucaaccugcaccggagccgcaaaaagaucaaacuggccgggacccuuagagauaagcucguccaucaguaccugcugcagccuuacggacaagagggccucaagucuaaaagcgugcagcugaaugggcagccccuuguuaugguggacgacggaacccugccugaacucaagccccggccgcugagagccggccggacacuggucauuccucccgugacgaugggguucuauguugugaaaaacgucaaugcucuugccugucgcuacagauga

SEQ ID NO: 70438 - RNA, 1632 nt, Artificial Sequence
  derived and/or modified sequence opt5 from HPSE__Homo_sapiens__NP_001092010
augcugcucagaagcaagcccgcccugccuccgccccuuaugcugcuccugcuuggcccucuggggccccucuccccuggagcucugccccggccugcccaggcgcaagacguggucgaucuggacuucuuuacccaggagccgcuccaccugguuucucccagcuuccuuuccgugacaaucgaugcuaaccuggccacggacccucgcuuucucauucugcuuggcucucccaaacugagaacccucgcccgggggcugagcccugcuuaccugcgcuucggaggcacaaagaccgauuuucucaucuucgaccccaaaaaggaauccacauuugaggaaagaucuuauuggcagagccaggugaaucaagauauuugcaaauacggguccaucccgccugacgucgaggaaaagcugcggcuugaguggcccuaucaggagcagcugcuccugcgcgaacauuaccagaagaaauucaagaacagcaccuauucuagauccagcguggauguucuuuacacauuugccaauuguucuggacuggaccucauuuucggccugaacgcucugcuccggaccgccgaucugcaauggaacuccagcaaugcgcagcuucugcucgacuauuguucuuccaaaggcuacaauaucagcugggagcuggggaacgaaccuaauuccuuucuuaagaaagccgauaucuucauuaacggaucucagcugggcgaggacuuuauccagcuccacaagcugcugcgcaagagcacguucaaaaaugcuaagcucuacgggcccgacgugggacaacccagacggaaaaccgccaagaugcugaaauccuuccuuaaggcuggcggggaggucauugauagcgugacauggcaucacuauuaccugaacggacgcaccgccacaaaagaagacuuucucaauccugauguucuggacaucuucauuucuuccgugcagaaggucuuucaggugguggagagcaccagaccgggcaagaaagucuggcugggcgaaacgucuagcgcguaugggggaggcgcuccccuucucuccgauacauucgccgccggguuuauguggcuggacaagcugggacucucugcucggaugggcaucgagguugugaugcgccaaguguucuuuggggccggaaacuaccaucuggucgaugaaaauuucgacccucuucccgauuauuggcugagccuccuguuuaaaaagcuggugggcaccaaaguucuuauggccuccgugcagggcagcaagagacggaagcucagagucuaccugcacugcacaaacaccgacaacccucgcuauaaagagggggaucugacccucuacgcuauuaaucugcacaacgugacaaaguaccuucggcugcccuauccguucucuaauaaacagguugacaaguaccuccugagaccucugggaccccauggccuucucuccaaaagcgugcagcugaacgggcugacgcucaagauggucgacgaucaaacccugccuccccuuauggagaagccucugcgccccggaucuucccucggccugccggcguuuagcuauuccuucuuugugauccggaaugccaaagucgcugccugcaucuga

SEQ ID NO: 70439 - RNA, 1389 nt, Artificial Sequence
  derived and/or modified sequence opt5 from HPX__Homo_sapiens__XP_005252940
auggccagagugcugggcgcucccgucgcccucgggcuguggagccuuugcuggucccuggcgaucgcuaccccucucccgcccacaucugcccacggaaacguugccgagggcgaaacgaagccugaccccgaugugaccgagcgguguagcgacgggugguccuucgaugcuacaacccuggacgauaauggaacaaugcuguuuuucaaaggcgaauuuguguggaagucucauaaaugggaccgcgagcuuauuagcgaaagauggaagaacuucccuucccccgucgaugccgcuuuucggcaggggcacaauucuguguuccucaucaaaggagacaagguuuggguguacccuccggagaagaaagagaagggcuaucccaaacugcugcaagaugaauuuccuggcauucccagcccucucgacgccgcggucgagugccaucgcggggaaugucaggccgagggagugcuguucuuucagggcgauagagagugguucugggaccuugcuaccgggacaaugaaggaacgguccuggcccgccguuggaaacugcagcucugcucugcgcuggcucggcagauacuauuguuuucaggggaaucaauuccugcgguuugauccggugcgcggagaggucccucccagauacccucgggacgugcgcgacuauuucaugcccugccccggcagaggccacgggcaucggaacggaaccggccacggaaauuccacgcaccaugggccugaauacaugcgcuguagcccgcaccuugugcugucugcccucaccuccgauaaccauggcgcgacauaugccuucagcgggacccacuacuggagacuggacacaucucgggauggauggcacuccuggcccaucgcucaucaguggccucagggccccagcgccgucgacgcugccuuuuccugggaggaaaaacuguaccucguucagggcacccaaguguauguguuccugacgaaagggggauacacacuugucucuggcuauccuaagagacuggagaaggagguggggacaccccacggaauuauccucgauagcguugacgccgcuuuuaucugcccgggcuccagccgccugcauauuauggcggggcggagacuuugguggcuggaucucaagucuggcgcccaggcuaccuggaccgaacugccuuggccccacgagaaaguggacggagcccuguguauggaaaagucccucggcccuaauagcugcucugccaacgggcccggacuguaccuuauccauggcccuaaucuguauuguuacagcgaugucgagaaacucaacgcugccaaggcgcugccccagccgcagaaugugaccucccuucuggggugcacacacuga

SEQ ID NO: 70440 - RNA, 570 nt, Artificial Sequence
  derived and/or modified sequence opt5 from HRAS__Homo_sapiens__NP_001123914
augaccgaguacaagcugguggucguuggcgccgggggagugggcaaaagcgcucucacaauccagcugauucaaaaccacuucguggacgaauaugaucccacgaucgaggacuccuacagaaagcaggucgugauugauggggaaaccugccuucuggacauccucgauacagccggacaggaggaauauucugcgaugcgggaccaguacaugcgcaccggcgagggguuucuguguguuuucgcuauuaacaacacaaagagcuuugaggauauccaucaauauagagaacagaucaaacgggugaaagacuccgaugacgucccuauggugcuuguuggaaauaagugcgaucuggccgcccgcaccguggagucuagacaggcucaggaccucgcccggagcuacggcauuccguauaucgaaacauccgcuaagacccgccaaggcgucgaggaugccuucuacacgcuggugagagagauucggcagcacaaacugcgcaagcucaaucccccugacgaaucugggcccggauguaugagcugcaaaugugugcuguccuga

SEQ ID NO: 70441 - RNA, 822 nt, Artificial Sequence
  derived and/or modified sequence opt5 from HRASLS__Homo_sapiens__NP_065119
auggugagagccagcugccggcugggcuccgcucgcacccccucuccugccagacggccgcccgggguccgcgcgagccaguccagaggaggcgcugccgggacaguuucugccuggcggcgcugguguuggagauggccuuggcggacggcucccagcgacggauggcgccucccucccggcugccugccugggaccgauggaguggugccgagacccccugccgcucgguccgccgcggcccgccccagagagacaccuggccacacccaacuucccccgggcgcucggcgcagaccucggcuggaaucugagauggccuucaacgacuguuuuagccucaauuaccccgggaacccuugccccggagaucugaucgaagucuucagacccggcuaucagcauugggcucuuuaccugggggacggauaugugauuaauaucgccccuguugauggcauuccggcguccuuuacaagcgccaagucuguguucuccagcaaagcucucgucaagaugcagcugcugaaagacgugguugggaacgauaccuaccgcaucaauaacaaguaugacgagacauaucccccucuccccguggaagagauuaucaaacggucugaguuugucaucggacaggaaguggccuacaaucugcuugugaacaauugugagcacuucgucacccugcucagauacggcgaaggcguuuccgagcaagcuaaccgcgccauuagcacgguggaguuugugaccgccgcugucgggguguucucuuuucugggacuuuucccuaagggccagcgggcgaaguacuauuga

SEQ ID NO: 70442 - RNA, 2100 nt, Artificial Sequence
  derived and/or modified sequence opt5 from HRC__Homo_sapiens__NP_002143
augggccaccauagacccuggcugcacgccagcgugcucugggcuggggucgccucccugcuucugccuccggcgaugacccagcaacuccggggagacggccugggguuccgcaacagaaauaacucuacaggaguugcuggccuuagcgaggaagccuccgccgagcugcggcaucaccuccauucuccccgcgaucacccugacgaaaauaaggaugugagcacggagaacgggcaccauuuuuggucccaccccgacagagaaaaagaggaugaggacgugucuaaggaauacggacaucugcugccuggccaccggagccaggaucacaaagucggcgacgaggggguguccggagaagagguuuucgcugagcauggcgggcaggcccgcggacacagaggccaugggagcgaagauaccgaggacucugcugaacaccggcaucaccuccccucccaccgcagccauucucaccaggaugaggacgaagaugagguggucuccagcgagcaucaccaccauauccugagacacggacaucggggccacgacggcgaagacgaugagggggaagaggaagaggaggaagaggaagaggaagaggaggccucuacagaauauggacaucaagcgcaccgccacagaggccauggguccgaggaagacgaggaugugagcgacggacaccaucaccauggcccuucccaccggcaccaggggcaugaggaagaugacgaugacgaugacgaugacgacgaugacgaugacgaugacgauguuucuauugaguaccgccaccaggcccauagacaccagggacacggcaucgaagaggacgaagaugugagcgacggccaucaccaucgggauccgucccacagacaucgcagccacgaggaggacgauaaugacgacgaugacgucucuaccgaauaugggcaccaagcucaucggcaccaggaucauagaaaggaggaaguggaggccguguccggagaacaccaccaucacguccccgaccaucgccaccagggccaucgggaugaggaggaagacgaggauguuagcacagaaagauggcaccaggggccucaacacgugcaucacggacuuguggacgaggaagaggaggaagaggaaauuaccguccaguuuggccauuacguggcuucucaccagccccgcgggcacaaaagcgaugaggaggacuuccaagaugaauauaagacagagguuccucaucaccaucaccaucgggugcccagagaagaggacgaagaggucuccgccgagcugggccaccaggcgccgucucaccgccagagccaucaggaugaagagaccggacacggccaacggggguccaucaaggaaaugagccaucacccucccggacauacggugguuaaagacagaucucaccuccgcaaggacgauuccgaggaagagaaagagaaggaagaggacccuggcagccacgaagaggaugacgaaucuuccgagcagggggagaaaggaacccaucacggcagccgggaucaggaagacgaggaagaugaggaggaagggcauggccugucccuuaaccaggaggaagaggaagaggaggacaaggaagaggaagaggaagaggaggaugaagagagacgggaggaacgcgccgaagugggagcuccccugucucccgaccacagcgaggaggaagaggaagaggaggaaggccucgaggaagaugagccuagauuuacaauuaucccgaauccccuggaccggagagaagaggccgggggagcuuccucugaggaagagagcggcgaagacaccgggccucaagaugcccaggaguacggaaacuaucagcccggcucccugugcggguacuguagcuucugcaaucgcuguacagaaugcgagucuugucacugcgacgaggaaaacaugggcgagcauugugaucagugccaacacugucaguuuugcuaccucuguccucuggucugcgaaaccgugugcgcccccggauccuaugucgacuacuucucuagcucccuuuaucaggcucuggcggauaugcucgagacgccggaaccuuga

SEQ ID NO: 70443 - RNA, 1578 nt, Artificial Sequence
  derived and/or modified sequence opt5 from HRG__Homo_sapiens__NP_000403
augaaggcccugaucgcugcccuccugcuuauuacccugcaguacagcugcgcggugucccccacagacuguucugcugucgagccugaagccgagaaagcccucgaucugaucaacaagagacggcgcgacggcuaucuuuuccaacugcucagaauugcugaugcccaccuggaccggguugaaaauacgaccguguacuaucuggugcucgauguccaggagagcgacugcuccgugcugucucgcaaauacuggaacgauugugaaccgcccgacagcagacggccuuccgagaucguuauugggcagugcaaggugaucgcuacacgccauucucacgagagccaggaucuuagagucaucgacuuuaauuguaccacauccagcgugucuuccgcccuggcgaacaccaaagauagccccguucucauugacuucuuugaagauacagagcgguaucgcaagcaagccaauaaggcucuggaaaaauacaaggaggagaacgacgacuucgccucuuuuagaguggaucggaucgaacgcgucgcuagagugcggggaggcgaggggaccggauauuucguggacuuuuccguccgcaauugcccuagacaucacuucccccggcauccuaacguuuuuggcuucuguagagccgaucuguuuuacgacguggaagcgcuugaucucgagagcccgaaaaaucuggugauuaacugcgaagucuucgacccccaggagcacgagaauaucaacggggugccuccccaccugggacauccuuuucacuggggcggccaugaacggucuuccacgaccaagcccccguucaaaccucacgggagccgcgaucaccaucacccccauaagccucacgagcauggacccccucccccgcccgacgaaagagaucacucccacggcccuccccucccucaggggcccccgccucugcuucccaugucuuguagcuccugccagcaugccacauucggaaccaauggcgcucaacgccacagccauaacaauaacucuuccgaccugcacccucacaagcaucacagccaugagcagcacccccaugggcaccacccucaugcccaccauccccacgaacaugauacacaccggcagcacccgcauggacaccauccucacggccaccauccccacggccaucacccccaugggcaccacccucauggacaccauccgcacugucacgacuuucaggacuacggccccugcgauccucccccucauaaccaagggcacugcugucauggacacgggcccccucccggccaucucagacgccggggaccgggcaaaggcccuagacccuuccacugccgccagauugggucuguuuaucggcugccuccccuuagaaagggagaggugcugccgcucccugaggcuaauuuucccagcuucccucugccccaccauaaacacccccugaagccugacaaccagccguuuccccaauccgucucugaaagcuguccuggcaaauucaaguccggguuuccccaggugagcauguucuuuacccauacguucccuaaauga

SEQ ID NO: 70444 - RNA, 1464 nt, Artificial Sequence
  derived and/or modified sequence opt5 from HRH1__Homo_sapiens__NP_001091683
augagccugcccaacuccucuugccuccuggaggacaagaugugugaaggcaauaaaaccacaauggccagcccucagcuuaugccgcugguggucguucucuccacgaucugccuggugaccguggggcuuaaccugcucguccuguacgcugugagaucugagcggaagcugcacacaguuggaaaucucuauauugugagccuguccgucgccgaucuuaucgugggcgcgguugugaugcccaugaacauucuguaccuccugaugucuaaauggagccuugggcgcccucugugucucuucuggcuguccauggacuaugucgcuagcaccgccucuaucuuuuccguguucauucugugcaucgauagauaccggagcgugcaacagccccuccgcuaucugaaguacagaacaaaaacccgggccucugcuacaauccuuggagccugguuucuguccuuccucugggucauuccuauccugggcuggaaucauuuuaugcagcagaccagcguucgcagagaagacaagugugagacggauuucuaugacgugaccugguuuaaggugaugacagcuauuaucaacuucuaccuucccacccugcucaugcugugguuuuacgccaaaauuuauaaggcgguccggcaacacugccagcaucgcgaacugaucaauagaucucucccuuccuucagcgagauuaaacugcggccggagaaccccaagggggaugccaaaaagccuggaaaggaaucccccugggaggugcuuaaacgcaagccuaaagacgcuggcggcgggucuguucucaagagccccucccagacaccgaaagaaaugaaaagcccuguggucuuuucucaggaggaugacagagagguggauaagcuguacuguuucccccuggacaucguucacaugcaagccgcugccgaaggauccagccgggauuauguggcggucaaucgcucucauggccagcuuaagaccgacgagcaggggcugaacacgcacggagccagcgaaaucuccgaggaccagaugcucggcgauucucagagcuuuuccagaacagacagcgauaccacaaccgaaaccgcuccugggaagggaaaacugcggucuggcuccaauacaggccuggacuacauuaaguucacguggaaaagacuccgcagccacucucggcaauauguguccgggcugcauaugaacagagagcgcaaggccgcuaaacagcuuggauucaucauggccgccuuuauucugugcuggauccccuacuucaucuuuuucauggucauugcuuuuuguaagaauugcuguaacgagcaccuccauauguucaccaucuggcugggcuauauuaauagcacacugaacccccuuaucuacccucucugcaacgaaaauuuuaagaaaaccuucaagcggauucugcacaucagauccuga

SEQ ID NO: 70445 - RNA, 1194 nt, Artificial Sequence
  derived and/or modified sequence opt5 from HRH2__Homo_sapiens__NP_001124527
auggcccccaacggcaccgcuagcuccuucugccuggacucuacagccuguaagaucacgauuaccgugguccucgcgguucugauccuuauuacaguggcugggaauguggucgugugccuggccguuggacucaacagacggcugcgcaaucuuaccaacuguuuuaucgugagccuggccauuacagaucuccugcugggccuccugguccuuccuuucuccgcuaucuaccagcugucuugcaaauggagcuuugggaagguguucuguaauaucuauaccucccucgacguuaugcugugcacagccucuauucuuaaccuguuuaugaucagccucgauagauacugugcugugauggacccgcugcgguaucccguccuggugaccccugugcgcgucgccauuucccucguucugaucugggugauuagcaucacgcuuucuuuccuguccauucaccucggauggaauagcagaaacgagaccucuaaaggcaaucauacaaccuccaagugcaaagugcaagucaacgaaguguacgggcugguugauggacuugugacauuuuaucugccccuccugaucauguguaucaccuacuaucggauuuucaaggucgcgcgcgaccaggccaagagaaucaaucacauuagcucuuggaaagcugccacgauccgggagcauaaggcuacagugacccuggccgcgguuaugggcgccuuuauuaucugcugguucccuuacuuuacagcuuucguguaccgcggccucagaggggaugacgccaucaacgaaguccuggaggcuauugugcuuuggcugggauaugccaauuccgcccucaaccccauccuguacgcugcgcuuaaucgggauuuucgcaccggcuaucagcagcuguucuguugcagacucgccaaccggaacagccacaaaaccucccugcgcucuaaugcuagccaacuguccagaacacagagccgggaaccuagacagcaggaggagaagccgcucaaacugcaagucuggucugggacggaagugaccgcuccccagggagccacagaccgcccuuggcuuugccugcccgaguguugguccguugaacucacccauagcuucauucaccuguuuauccacucuuucgccaacauucauccuauccccacaaccugccaggagcuguga

SEQ ID NO: 70446 - RNA, 1338 nt, Artificial Sequence
  derived and/or modified sequence opt5 from HRH3__Homo_sapiens__NP_009163
auggagagagcucccccugacggcccgcugaacgccagcggggcccucgcgggagaagcugccgccgcuggcggggcccggggauucuccgcugccuggaccgcggugcuggccgcucuuauggcccugcucaucgucgcuacaguucugggcaaugcccuugugaugcuggcguuuguggccgauucuagccuccgcacgcagaacaauuucuuucugcugaaccucgcuauuuccgacuuccuggucggggccuuuugcaucccccuuuacgugccuuauguucugaccggaagauggacauucggccggggccucuguaagcuguggcuuguggucgauuaccugcucugcaccucuagcgcuuuuaauauugugcugaucuccuaugaccgcuuccugucuguuacaagagccgugagcuaccgggcccaacagggggauacccgcagagcuguccggaaaaugcuccuggugugggugcuugcguuucugcucuauggacccgccauucuguccugggaguaccuuagcggcgggucuuccaucccugaaggacacuguuaugcugaguucuuuuacaacugguacuuccugaucacagccagcacccucgaauuuuucacgcccuuccugucugucaccuuuuucaaucuguccauuuaucucaacauccagcgcagaacacggcugcgccuugacggcgccagagaggcugccgggccugagccgcccccugaagcgcagcccagcccucccccgccucccggaugcuggggcuguuggcaaaagggccauggggaggcuaugccucugcaccgguacggaguuggcgaagccgccgugggggcugaggccggagaggcuacccucggcgggggaggcggcgggggaucuguggccucccccacaagcuccucuggcagcuccagccgcgggaccgaaagaccccggucucugaaaagaggauccaagccuagcgcgucuagcgccucccuugagaaacgcaugaagauggucucucagagcuuuacgcagcgguucagacugucccgcgaucggaagguggcuaaaagccucgccguuauugugucuaucuuuggccugugcugggcuccguauacacugcucaugauuaucagagccgcgugucaugggcacugcguccccgacuacugguaugaaaccuccuucuggcugcuuugggccaauagcgcugugaacccuguucuguacccccucugucaucacucuuuucgccgggccuucacaaagcugcugugcccucagaaacuuaagauucaaccccacuccagccucgagcauuguuggaaauga

SEQ ID NO: 70447 - RNA, 909 nt, Artificial Sequence
  derived and/or modified sequence opt5 from HRH4__Homo_sapiens__NP_001137300
augcccgacaccaacagcacaaucaaucugucccucucuacgagagugacccuggccuucuuuaugagccuugucgcuuucgccauuaugcugggcaacgcgcucguuauccuggcuuuugugguggauaagaaucuucggcaccgcuccucuuacuucuuucugaaccucgccauuagcgacuucuuugucguguccgagucuuggaaagaugaagggagcgagugcgaaccuggauucuuuuccgagugguauauccuggccauuaccagcuuccuggaauuuguuaucccggugauccucgucgcuuacuucaauaugaacauuuauuggucucuguggaagagagaccaucuuucccggugucagagccaccccggccugacagccgugucuuccaauaucugcgggcauagcuuucgcggaagacucucuucccggcgcagccuguccgcuucuacagagguuccugccagcuuccacuccgagagacaacggcgcaaaagcucucuuauguucuccagcagaaccaagaugaacucuaauacaauugcgagcaaaaugggcuccuuuucucagagcgauuccguggcccugcaucagcgggaacacgucgagcuccugcgcgcuagacggcuggccaagagccucgcuauccugcuugggguguucgccguguguugggcgcccuacucucuguuuaccauuguccucuccuucuauagcucugccacgggaccuaaguccguuugguaccgcaucgcuuuuuggcugcagugguucaacagcuuugugaauccccuucuguauccucucugccacaaaagauuccaaaaggccuuucugaaaauuuucuguaucaagaaacagccgcugcccucccagcauucucggagcguguccucuuga

SEQ ID NO: 70448 - RNA, 3570 nt, Artificial Sequence
  derived and/or modified sequence opt5 from HR__Homo_sapiens__NP_005135
auggagagcacccccuccuuccugaagggcacaccuacgugggagaaaaccgccccggaaaacgggaucgugagacaggaacccggaucuccuccccgggacggccuccaccaugggccucugugccuuggagagcccgcuccuuuuuggcgcggcguccugagcacaccggauuccuggcugcccccuggguucccccaaggaccuaaggacaugcugccccuuguugaaggcgagggcccgcagaauggggagagaaaagugaacuggcugggaucuaaggaaggccuccgguggaaagaggccaugcugacccacccucuggcguuuugugggcccgcuugcccuccccgcuguggaccccucaugccugaacauagcggcgggcaccugaaguccgauccgguggccuucagacccuggcauugcccuuuucuucuggagacaaagauucucgagcgggcccccuucugggucccuaccugucugcccccguaccuugugucuggacugccucccgaacacccuugcgacuggccccucacaccucaccccuggguuuauagcggcggccagccgaaagugccuuccgcuuuuagccuggggucuaagggauucuacuauaaagaucccuccaucccccgccuggccaaggagccucucgcugccgcggaaccgggccuguuugggcuuaauagcggaggccaucugcagagagccggggaggcugaacggcccucucuccaccaacgcgacggagagaugggcgccggcagacagcagaacccuuguccccuguuccuugggcagccugauaccguccccuggacguccuggccugcuugucccccgggacuggugcauacccucggcaauguuugggccgggccuggagacggcaaccugggguaccaacugggacccccugcgacaccccggugcccgagcccugagcccccugugacccagcgcggcugcuguucuuccuauccucccacaaaaggcgggggacucggccccugcgggaagugccaggaaggacuggagggcggggccagcggcgcuuccgaaccgucugaggaagucaauaaggccagcggacccagagcuuguccucccucccaccacaccaaacuuaagaaaacguggcugacacggcauagcgagcaguuugagugcccucgcggcugucccgaaguggaggaaagaccuguggcccggcucagagcccugaagcgcgcugggucuccggagguccaaggagcgaugggcucccccgccccuaaacggcccccugaucccuucccggggaccgcugaacagggagccggcggguggcaggagguuagagacacaagcauuggcaacaaggauguggacucuggacaacacgaugagcagaaaggcccucaggacgggcaggccagccuucaagaccccggacugcaggauauccccugccucgcucugccugccaagcuggcgcagugucaguccugcgcucaagccgccggcgaagggggaggccaugcuugucacucucaacaggugcgccggagcccccucgggggcgagcugcagcaggaagaggacaccgccaccaauuccagcucugaggaaggaccuggcuccgggccggauagcagacuuucuacaggacuggcuaagcaucuccuguccggccugggggaccgccuuugccggcuccugagacgcgagcgggaagcccuggcgugggcccagagagagggacagggccccgcugucacggaagauagcccuggcauuccccgcuguugcucccggugucaccacgggcucuuuaacacccauuggagaugcccucggugcucucaccgccuguguguggccugcggaagaguugcuggcacagggcgggccagagagaaagcgggauuccaggagcaaagcgccgaagaguguacccaggaagcuggccaugccgcuugcucccuuaugcugacacaguucgugucuagccaagcccucgccgagcuguccaccgcuaugcaccaggucugggugaaguuugacauccgcgggcacugucccugccaggcggaugcccggguuugggcuccgggagacgccggccagcaaaaagaaagcacgcagaagacaccucccaccccucagcccucuuguaauggcgauacccauagaacaaaauccaucaaggaggagaccccugacagcgccgaaacacccgcugaggaucgcgccgggagaggaccgcugccuugccccucucuuugugaacuccuggcguccacggcugugaagcugugccucggccacgagcggauucauauggccuucgcccccgucaccccugcucugccgagcgacgaccgcaucacaaacauucuugauucuaucauugcccagguggucgaaagaaaaauccaagagaaggcgcuggggcccggacuccgggcuggcccugggcugcgcaaaggacugggccuuccccucagcccugugagaccccggcugccuccgcccggcgcccugcucuggcugcaggagccucagcccuguccucgcagaggguuucaccuuuuccaggaacauuggcggcaaggacagcccguucugguguccggcauucagcgcacccuccaagggaaucuguggggaacagaggcccugggcgcucuugggggacagguccaggcccucagcccgcugggcccuccccagcccucuucccugggcagcaccacguuuugggaaggguucuccuggccugagcucagacccaagucugacgagggaagcgugcugcuucugcaccgggcucucggcgaugaagacaccuccagaguugagaaccuggccgcgucucugccucuuccggaauacugcgcccugcacgggaaacucaaucuggcuagcuaucugcccccuggacucgcccuucgcccccuggagccucaacucugggcugccuacggcgugucuccccaucgggggcaccugggaacaaagaaccugugcgucgaaguggccgaucuuguguccauccugguucaugcugacaccccgcucccugcguggcacagagcccagaaggauuuucugagcggccucgacggcgaggggcuguggucccccggaagccaggucucuacaguguggcauguguuccgcgcucaggaugcccaacggaucagacgcuuucuucagauggucuguccugccggcgcuggggcccuggagcccggagcgccuggcuccugcuaccucgacgcugggcugcggagacgccugcgggaagaguggggagugagcuguuggacccuucugcaggcccccggcgaagccguucucgugccggcuggcgccccucaccagguccaagggcuggugucuacgguuuccgugacacagcacuuccucagccccgagaccucugcgcuguccgcucagcuuugccaucagggacccagccugccuccggauugucaccuccucuaugcccaaauggacugggccgucuuucaggcugugaaaguugccgugggcacacugcaggaagcuaaguga

SEQ ID NO: 70449 - RNA, 276 nt, Artificial Sequence
  derived and/or modified sequence opt5 from HRK__Homo_sapiens__NP_003797
augugccccuguccucugcacagaggccgggggccgcccgccgugugcgcuuguagcgccggacgccucggccugagauccucugcggcucagcuuaccgccgcccggcugaaggcucucggggacgagcugcaucaacgcacaauguggagacggcgcgccagaagccggcgcgcuccugcccccggagcgcuuccuacguacuggcccuggcugugcgccgcugcccaggucgcugcccucgcggccuggcugcugggcagacggaaccucuga

SEQ ID NO: 70450 - RNA, 8553 nt, Artificial Sequence
  derived and/or modified sequence opt5 from HRNR__Homo_sapiens__NP_001009931
augcccaagcugcuccagggcgugaucaccgucauugacguuuucuaccaauaugccacacagcacggggaguacgauacgcugaacaaagcugaacuuaaggagcugcucgaaaaugaguuucaucagauccugaaaaacccuaaugacccggauaccguggacauuauccuucagagccuggauagagaccacaacaagaaaguggauuucacagaauaucuccugaugauuuuuaagcugguccaagcccggaauaagaucaucggaaaagacuacugccagguguccggcucuaagcuccgcgaugacacccaucagcaccaggaggagcaagaagagacagaaaaagaggagaacaagagacaggaaagcuccuucucucauagcuccuggucugcgggggagaaugauagcuauucccggaacguucgcggaagccugaaacccggcaccgaaucuauuuccagacggcuuagcuuucagcgcgacuucucugggcagcacaauuccuacagcggacaaucuuccagcuauggcgagcagaacuccgauucucaccagagcuccggcagagggcaauguggaagcggcucugggcaguccccuaauuacggacagcauggcagcgggucuggacagagcuccucuaacgacacacacggcagcggcuccgggcaaagcucuggauuuucccagcauaagagcucuuccggccagagcuccggguacucucagcacggaagcggcuccgggcacucuagcggauauggccaacauggcucccggagcgggcagucuucccgcggagaaagacaccggagcucuuccggcagcucuagcuccuacgggcagcauggaagcggcucucgccagucccuggggcacggcagacaaggaagcggcucccggcagucucccagccaugugcgccacggguccggaucuggccacagcuccucucaugggcagcacggaagcggcuccagcuauucuuacuccagagggcauuaugagagcggcucuggacagaccuccggcuucgggcaacacgagagcggaucuggccaguccagcggguacuccaagcacggaagcggcucugggcauagcuccucucagggccaacacggaagcacguccggccaggcuucuagcuccgggcagcauggaucuagcucccggcagagcucuuccuauggccaacacgaaagcgccucuagacauuccagcgggcgcggacagcacuccucuggcagcgggcaguccccuggccacggacagcggggcagcgggucuggacaaucccccagcucuggccagcaugggaccggauuuggcagaagcuccucuagcggcccuuacgucuccgggucuggauacagcuccggcuucgggcaccaugagagcucuuccgaacacagcuccggauauacacagcauggcucugggagcggacacuccucuggccacggccagcaugggagccgcuccggacaaagcucucggggcgagagacagggguccagcgccggaucuuccagcucuuacggccagcacgggagcggaucccgccaaucucucggccauagccggcacggcuccgggagcggacaguccccgucucccagcagaggccgccacgaauccgggucucggcagagcuccucuuauggaccucauggcuacgggagcggaagauccagcucucgcggccccuaugaguccggcagcgggcacucuuccggacugggccaucaggagagccggucugggcaauccagcggauacggccagcacggguccagcucuggacauagcuccacccacggccagcacggcucuacaagcgggcaguccucuagcugcggacaacauggcgcuaccuccgggcagucuagcucccacggacagcauggcagcgggucuucccagagcucuagauauggacaacagggcuccggcagcgggcaguccccuucucggggacgccacggcagcgacuuugggcacuccagcucuuacggacagcauggcuccgggagcggauggucuagcuccaauggcccccacggcucugugagcgggcaauccucuggauucggccauaaaagcggguccggacagagcucuggcuacucccagcacgggagcggcuccucucauagcuccggauauagaaagcacggcucucggagcgggcaauccagcagaucugaacagcacggauccagcucuggccuuuccagcucuuacgggcagcauggauccggcagccaccagucuagcgggcauggccgccaaggauccggcagcgggcacuccccgucucggguuagacacggaagcuccucuggccauagcuccucucacgggcagcauggaagcggcacguccuguagcucuuccugcgggcacuaugagagcggcucuggacaggccuccggcuuugggcagcaugaaagcggaucuggccaaggguacucccagcacggaagcgcuucuggccacuucuccagccagggccgccaugggagcacauccggacagucuagcuccucuggccaacacgauagcuccucugggcagagcuccagcuauggacagcaugagucugccucccaccaugcgagcggcagagggcggcacggaucuggcuccggccaaagcccugggcacggacagcgcggcuccgggucuggacagagccccuccuacggcagacaugggucuggaagcggccgguccagcucuuccggccgccacgggagcggaucuggccagagcuccggguucggacauaaaucuagcuccggccaaagcucuggguauacccagcacggauccggcagcggccacuccucuagcuacgaacagcauggguccagaucuggacagagcucccggucugagcaacacggcagcuccagcgggucuuccagcucuuacggacagcauggcuccgggagccgccagucucugggacacggccagcauggcagcggguccggacaaagcccuucccccucuagaggccggcacgggagcggauccggccagucuagcuccuaugggcccuaccgcucuggaagcggcugguccagcucuagaggcccuuaugaguccgggagcggacacucuuccggccucgggcaucgggaaagcagaucuggacaguccagcggcuacgggcagcacggaucuuccagcggccauuccagcacacacggccaacacgggucuaccagcggacaguccucuagcuguggccagcauggggccuccucuggacaaagcuccagccacggccagcaugggucuggcuccagccagucuuccggauauggccgccaggggagcggaucuggccaauccccggggcacggacagcggggcagcggguccagacagucucccagcuacggccgccauggauccggcagcgggcggucuuccagcucuggacagcacggcagcgggcugggagaguccucuggcuuugggcaccaugaaagcuccagcggccaaucuuccagcuauucucagcacggauccggcagcgggcauuccucuggauacggccagcacgggagcagauccggacagucuagccgcggcgagcggcauggguccagcucuggcuccagcucucacuacggacaacacggcuccgggagcagacagucuuccggacauggccgccaggggagcggaagcggccacuccccuucucggggcagacaugggagcggacugggccacuccucuagccacgggcaacauggauccggcucugggcggagcuccucucgcggacccuaugagagcagauccggccacagcucuguguucggccagcaugaauccgggagcggacacucuuccgcuuacagccagcauggcucuggguccggacacuuuugcagccagggccaacacggguccaccagcggacagucuagcacauucgaccaggagggcuccucuacgggccagagcuccucuuaugggcaucggggaagcggcuccucucaaagcuccggguacggacgccacggcgccgggagcggacagucuccuuccagaggccggcauggcagcgggucuggacacuccagcuccuauggccagcacgggucuggaagcggcugguccagcucuuccgggagacauggaagcggcucuggccaguccagcggguuuggacaccaugaaucuagcuccuggcaaucuagcggcuguacccagcacggguccggaagcggccauucuuccagcuacgagcagcacgggucccgcucuggacaaagcucccggggcgaaagacacggcucuagcuccgggagcucuuccagcuauggacagcauggcucugggucccgccagagccucggacacggccagcaugggucuggauccggccaaagccccucuccgagccggggcagacacggguccggaagcggccaguccucuagcuacuccccuuacgggucuggaagcggcugguccucuagccgcgggcccuaugaguccggcagcucucacuccagcggacugggccaucgggagucuagauccgggcagagcucuggauacggccagcacggguccagcuccggacauagcucuacacacggccaacauggguccaccagcggccagucuagcuccugcggacagcacggcgcuucuagcgggcaguccucuagccacggacaacauggcuccgggagcucucaguccagcggauauggccgccaggggucuggcuccggacagagcccuggccacgggcaaagaggauccggcucucggcagagccccuccuacgggcgccauggaagcggcucugggagauccagcucuuccggccagcacggaagcggccuuggggaaucuagcggauucggccaucacgaguccucuagcgggcaauccagcucuuauucccagcacggaagcggcuccggccauucuagcggguacggacagcacggcucccggucugggcagagcucccgcggagaaagacauggcagcucuucccggagcucuuccagauaugggcaacacggaagcggcucucgccaguccagcggccacgggcggcagggaucuggcagcgggcaguccccuagcagaggacgccauggcuccgggcugggacacucuagcucccauggccaacacggcucugggagcggacgguccucuagcagaggccccuacgagucccggagcgggcauucuuccgucuuuggacagcacgaaagcggcucugggcacuccagcgccuacucucagcauggauccggcagcggccacuucuguucccaggggcaacauggaucuacaagcggccaguccagcaccuuugaucaggaggggucuagcacgggacaauccucuagccacggccagcacggguccggaucuagccaguccagcucuuauggccagcaaggcuccgggagcggacagucuccgucccgcggcagacaugggagcggauccggccacucuagcuccuacgggcagcauggaucuggcagcggcugguccagcucuuccgggcggcacggaagcggcucugggcagagcuccggauucggccaucacgagucuagcuccuggcaaagcucuggguauacacagcacggauccggcagcggccauuccucuagcuacgaacagcacgggucccgcucuggacagagcuccagaggcgagcaacaugggagcucuuccggaagcucuuccagcuauggccagcacgggucuggcucccggcagagccucggacauggccagcacgggucuggauccggccaaagcccuagccccucccgcgggagacacggaucuggcagcgggcaguccucuagcuacggccccuauggauccggcucuggguggagcuccagccggggaccuuacgaaucuggcuccgggcauagcucuggacugggccaccgcgaguccagaagcgggcagucuuccggcuacggacaacauggcagcuccucugggcacagcuccacccacggacagcauggcagcgcgucugggcaguccagcucuugcggacagcacggcgccagcuccggccaaucuagcucccaugggcagcacggaagcggcucuucccagagcucuggguauggacggcagggcuccgggagcggacaauccccgggccauggccagagagggucuggaagccgccagucccccucuuacggccggcacgggagcggauccggcagaagcucuuccagcgggcagcacggaccuggccuuggcgaaucuuccggguuuggacaucacgagagcucuagcggccaauccagcucuuauucccagcaugggagcggauccggccacucuagcggguacggacagcacggcucccgcucuggccaaagcucccggggggagagacauggaucuagcuccggcagcucuucccgcuaugggcagcacggaagcggcucucggcaguccagcgggcauggaagacagggcucuggcuccgggcacagccccucccgcggacggcauggcagcgggucuggacacagcuccucucacggccaacaugggagcggauccggcagaucuagcucccgcggcccuuacgaaucucggagcgggcacuccagcguguucggacagcaugagucuggcuccgggcacagcucugcuuauucccagcauggaagcggcuccgggcacuuuuguucucagggacaacacggcagcaccuccggccagagcucuacauucgaccaggaaggguccagcaccggacagucuagcucccauggccaacacgggucuggaagcucccagucuagcuccuacggccagcaagggagcggcucuggacagucccccagcagaggccgccauggguccggaucuggccacagcuccucuuacgggcagcacggaagcggcuccggguggagcucuuccagcggcagacauggaucuggcuccgggcagagcucuggauucggccaccaugagagcuccucuuggcaaagcuccggguauacacagcacggaagcggcuccgggcauucuagcuccuacgagcagcacggcucucggagcggacaguccucucgcggcgaaagacacgggagcuccagcggaucuuccagcucuuauggccaacauggguccggaagccggcagucucugggccacgggcagcauggcuccggaagcggccaguccccuagccccucuagagggcggcacggaagcggcuccgggcaaucuagcuccuacucuccguauggaagcggcuccggcuggucuagcucccgcgggccuuacgagagcggaucuggccacuccagcgggcucggacauagagaaucucgguccggccagagcuccggguauggacagcacggcucuagcuccggccauagcucuacgcacgggcagcauggauccaccagcggccaaucuagcuccugcgggcagcacggagccucuagcggccaguccucuagccacgggcaacauggauccggcagcucucaguccagcggcuacgggcgccagggauccggcucugggcagagccccggacacggccaaagaggguccggaucucggcagagcccuuccuacggccgccauggcagcgggucuggaagauccagcucuuccggccagcacgggagcggacugggcgagucuuccggguuuggacaccaugaaagcucuagcggccaguccagcuccuauucucaacacggcagcggguccggacauucuagcggcuacgggcagcacggaucccggucuggccagagcucccgcggggagagacauggaagcucuuccggcagcucuucccacuauggccagcacgggagcggaucucggcaauccagcggccaugggcgccagggauccggcucugggcagagccccagcagaggacggcacggcuccggccuggggcauucuagcucccacggacaacauggcucugggagcggacgcuccucuagcagaggcccguacgagucccggcucgggcacagcucuguguucggccagcacgaauccggaagcggccauucuuccgcuuauagccagcacggguccggaucuggccauuuuugcagccaggggcaacacggauccacaucuggccagagcuccaccuucgaucaggaggggagcucuacaggccaguccagcucuuacggacacagaggcagcggguccucucaaagcuccggauauggccgccauggggccggaagcggccagucucugucccacgggcggcauggcagcggauccggccagucuagcuccuacgggcagcacggaucuggcagcgggcaauccagcggauacucucagcauggcuccggcagcgggcaggacggauauucuuacuguaagggcggguccaaccacgauggaggcagcucuggguccuauuuucuuagcuucccuucuagcaccucccccuacgaauauguccaggagcaaagaugcuacuuuuaucaguga

SEQ ID NO: 70451 - RNA, 414 nt, Artificial Sequence
  derived and/or modified sequence opt5 from HRSP12__Homo_sapiens__NP_005827
augagcucccugaucagacgggugauuucuaccgccaaggcucccggcgccaucgggccuuacagccaggcgguccucguugaccgcacaauuuauaucuccggacaaauuggcauggauccgucuagcgggcagcugguguccggaggcguggcugaggaagccaaacaggcccuuaagaacaugggggagauccugaaagcugccggaugcgacuucacgaaugucgugaagaccacaguucuccuggcugauaucaacgacuuuaauaccgugaacgaaauuuacaaacaguauuucaagucuaauuuucccgccagagcggccuaccaagucgcugcccuuccuaagggcagccggaucgagauugaagcuguggccauccagggcccccugacaaccgcgucccucuga

SEQ ID NO: 70452 - RNA, 1179 nt, Artificial Sequence
  derived and/or modified sequence opt5 from HS1BP3__Homo_sapiens__NP_071905
augcagagccccgccgugcuggucaccuccagacggcuccaaaacgcucacacaggccuggaccuuacgguuccucagcaucaggaggugcgcgggaagaugaugucuggacacguggaauaccagauccuggucgugaccagacucgccgcguucaaaagcgcuaagcaucggccggaggauguugugcaauuucuggucuccaaaaaguauucugaaauugaggaguucuaccagaaacuuagcucccgcuaugccgccgcuucucugcccccucuccccagaaaggugcuguuuguuggcgaaagcgacauccgggagcgcagagccguguucaaugaaauucugcggugcgucuccaaggaugcugagcucgccgggagcccugaacugcuugaguuucugggaacacgcucucccggcgcggccgggcucaccuccagagacagcucugugcuggauggaacagacucccagaccggcaacgaugaggaggcuuucgacuuuuucgaagaacaggaucaaguggccgaggaaggcccuccgguccagagccuuaaaggggaggacgcugaggaaucucuggaggaagaggaagcccucgauccccugggaaucaugcgguccaagaaaccuaagaaacaccccaagguugcggugaaggccaaaccuagcccccgccugacaauuuuugacgaggagguggauccggacgaaggccucuucgggccuggaagaaagcugucuccccaggacccuuccgaggaugucagcuccguggacccccuuaaacuguuugaugaccccgaucucggcggggcuaucccucugggagacagccuucugcucccggccgcuugugaaucuggcggccccaccccuucccugagccaucgggaugccucuaaggagcuguuccgcguugaagaggaccucgaucagauccugaaucuuggggccgagcccaaaccuaagccccaacugaaaccgaagccucccguggcugcgaagccugucauucccagaaaaccugccgugcccccgaaggcuggaccugccgaagccguugcuggccagcagaaaccccaagagcagauccaggccauggacgaaauggauauucuccaguacauccaagaccacgacacgcccgcgcaggcugccccuagccuguuuuga

SEQ ID NO: 70453 - RNA, 924 nt, Artificial Sequence
  derived and/or modified sequence opt5 from HS3ST1__Homo_sapiens__NP_005105
auggccgcucugcuccugggcgccgugcuucuggucgcgcagccccaacucguuccuagcagaccggcugagcuggggcagcaggaacuucugcggaaggccggaacccuccaggacgaugugcgcgacggcguggcccccaacggguccgcucaacagcugccucagacaaucauuaucggagucagaaaaggcgggacgcgggcccugcucgagaugcugucucuucaccccgauguggcugccgcggaaaaugagguucauuucuuugacugggaggaacacuacagccauggacugggcugguaucucucccagaugccuuucucuuggccccaccaacugaccguggagaagaccccugccuacuuuacaagcccgaaaguccccgaacgcguguauuccaugaacccuucuauuagacuucugcucauccugcgggaucccagcgagcgcguucuguccgacuacacacagguguucuauaaucauaugcagaagcacaaaccuuaccccagcauugaagaguuucucgucagagauggccggcugaacguggacuauaaggcucuuaaucgcucucuguaccacgugcauaugcagaacuggcucagauucuuuccgcugcggcacauccauaucgucgauggggaccgccuuauuagagauccuuuccccgagauccaaaagguugaacgguuucugaaacucuccccucagauuaaugccagcaacuucuacuuuaauaagaccaaaggauucuauugccugcgcgacucuggcagagaucggugucugcacgaguccaaggggagagcucacccccagguggaccccaaacuccugaacaaacuucaugaauacuuucacgagccuaauaagaaguucuucgaacuggugggacgcacauuugacuggcauuga

SEQ ID NO: 70454 - RNA, 1104 nt, Artificial Sequence
  derived and/or modified sequence opt5 from HS3ST2__Homo_sapiens__NP_006034
auggccuacagagugcugggccgggcugggcccccucagccgcgcagagcccggcgccuccuguucgcguuuacccuuagccuguccugcacauaucucuguuacucuuuccugugcuguugcgacgaucuuggaagaagccggcugcucggcgcuccccgcugucugagagggccuuccgccggaggccaaaagcugcuccagaaaucucggcccugcgacccuagcgggcccacgccuuccgagccgucugcccccagcgcuccugccgcugccguccccgcgccucgccuguccggaagcaaccacucuggcucccccaaacuuggcaccaagagacugccgcaggcccucaucguuggggugaagaaaggaggcacacgggcugugcuggaauuuauucgcguccauccugaugugagagcccuugggaccgagccccacuucuuugaccggaauuauggacgcggccuggauugguacagaagccucaugccucggacacuggaaucucagaucacccuggagaagacacccuccuauuucguuacccaagaagcucccagacgcauuuuuaacaugagccgggacacgaagcucaucguggucgugagaaauccuguuacccgcgccauuucugauuacacacagacccuguccaaaaagccggacauccccacauucgaggggcuuagcuuucggaacagaacccugggacucguggaugucuccuggaaugcgauccgcauuggcauguaugugcugcaucuugagucuuggcugcaguacuucccucucgcccagauccacuuugugagcggcgaacggcugauuacggaccccgcuggggagaugggaagaguccaagauuuccugggcaucaaacgcuuuauuacagacaagcauuucuacuucaacaaaaccaagggguuuccuugucucaagaaaacagaauccagccugcuuccccggugccugggaaagucuaaaggcagaacccacguucagaucgauccggaggugauugaccagcuccgcgaguucuaucggccuuacaauaucaaguuuuaugaaaccguggggcaggacuucagaugggaguga

SEQ ID NO: 70455 - RNA, 1221 nt, Artificial Sequence
  derived and/or modified sequence opt5 from HS3ST3A1__Homo_sapiens__NP_006033
auggcucccccuggcccggccagcgcccuguccaccucugcggagccccucagcagauccaucuuccggaaguuucugcuuaugcugugcucucuccugacaagccuuuacguguucuauugucuggcugaacgcugccagacgcucuccgggccugucguuggacugucuggcgggggagaggaagccggcgcccccgggggaggcgugcuggcuggcgggccuagagagcucgccguguggcccgcugccgcgcaacggaaacgccugcuucagcugccucaguggagacggcgcagaccgcccgccccucgggacgauggagaagaggcugccugggaggaagagagccccggccucuccgggggaccuggcgggagcggagcuggcucuaccgucgccgaagcgcccccgggcacacuggcccuucugcucgacgagggguccaagcagcugccucaagcuauuaucauuggagugaaaaagggcgggacccgcgcccugcucgaguuucugagaguucaccccgaugugcgggcugucggagccgaaccucauuucuuugaccgcagcuacgauaaaggccuugccugguauagagaccugaugccccggacacucgaugggcagaucaccauggagaagacacccucuuacuucgugacccgcgaagcuccugcgagaauuuccgccaugagcaaggacacgaaacugaucguugugguccgggauccggugaccagagcuaucucugacuauacacagacccuuuccaagcgccccgauauuccuacauuugagagccugaccuucaaaaaccggacggccggacucaucgacacauccuggucugccauucagaucggcauuuacgcuaagcaccuggaacauuggcugagacacuuucccauccgccaaaugcuguucgugagcggcgagcggcucauuuccgauccugccggggagcuuggaagaguccaggacuuucugggccucaaacgcaucaucaccgacaagcauuucuauuuuaauaagacaaaaggguuccccugucugaagaaagcggaaggaagcucucggccgcacugccuuggcaagaccaaagggagaacccacccugagauugaucgcgaaguugugcggagacugcgcgaguucuaccggcccuuuaaccucaaguucuaccagaugacaggccaugacuuuggaugggauggcuga

SEQ ID NO: 70456 - RNA, 1173 nt, Artificial Sequence
  derived and/or modified sequence opt5 from HS3ST3B1__Homo_sapiens__NP_006032
augggccagagacugagcgggggacgguccugccucgacgugcccggccgccugcuuccucaaccgcccccucccccucccccugucagacggaagcuggcccuccuguucgcuaugcuuuguguuuggcuguacauguuucucuauucuugcgccgggagcugugcggcugccccgggacugcugcuccugggcuccgggucucgcgccgcucacgaucccccugcccuugcuaccgcccccgacggaacaccucccagacugccguuccgggcgccucccgccacgccucucgcuagcggcaaagagauggccgaaggcgcugccucccccgaggaacagucucccgaggugccugauagcccgucccccaucagcuccuuuuucucugggagcggaucuaagcagcugccucaggcgauuaucauuggcgugaaaaagggagggacccgcgcccuucuggaauuucucagaguccaucccgacgugcgggcuguuggcgccgagccucacuucuuugaucgcuccuacgacaaagggcuggcuugguauagagaucugaugccccggacacucgacggacaaaucaccauggagaagacaccgagcuacuucgugacccgcgaagccccugccagaauuucugcuauguccaaggauacaaaacugaucgucgugguucgggaccccgugacccgcgcgaucagcgauuauacgcagacccuuuccaagagaccugacauucccacauuugagucucugaccuucaaaaaccggacagccggccucaucgauaccagcugguccgcuauucagaucggcauuuacgccaagcaucuggaacacuggcuuagacauuuuccuauccgccagaugcuguucgucagcggggagcggcucauuucugaccccgccggagagcugggcagagugcaagacuuucuggggcucaaacgcaucaucacggauaagcacuucuauuucaauaagacaaaaggauuuccgugccugaagaaagcugaaggcuccagccggccucacugucuugggaagaccaaaggaagaacacaucccgagauugaccgcgaagugguccggagacugcgcgaguucuaccggcccuuuaaccucaaguucuaccagaugaccggccacgauuuuggcugggacuga

SEQ ID NO: 70457 - RNA, 1371 nt, Artificial Sequence
  derived and/or modified sequence opt5 from HS3ST4__Homo_sapiens__NP_006031
auggccagauggcccgcuccuccgcccccucccccucccccuccgccccuggccgcgccucccccucccggcgcuagcgccaaggggccgccugcccggaaacuccuguucaugugcacccuuucccugucugugacauaccucuguuauagccugcuuggaggcuccgggucucugcaguuuccccucgcucugcaagagagcccuggagccgcugccgaacccccucccuccccgcccccucccucucugcucccuacgcccguccgccugggcgcgccgagccagccucccgccccucccccucuugacaacgcuucccacggggagcccccggaaccucccgagcagcccgccgcuccuggaaccgauggcuggggccugccgagcgggggaggcggggcccaggacgcguggcucagaacaccccuggccccuucugaaaugaucaccgcucaauccgcccuucccgagcgggaggcucaggaaagcucuacaaccgaugaggaccuggccggacgcagagccgcuaauggcuccagcgaacgcgggggagcgguuucuacaccugauuacggcgagaagaaacucccccaggcccugauuaucggcgugaagaaagggggaacccgggcucugcucgaggccauuagagugcauccugacguccgggccgugggcguugaaccccacuucuuugaucgcaacuaugagaaggggcuggaaugguacagaaaugugaugccgaagacgcuugacggacagaucaccauggagaaaacaccuuccuauuucgucaccaacgaagcucccaagcggauucauagcauggccaaagauaucaagcugaucgugguugugcgcaauccugucacaagagcgauuuccgacuacacccaaacgcucucuaaaaagcccgagaucccgacauuugaggugcuggcuuucaagaaccggacccuuggccugauugaugccagcugguccgccauccgcauugggaucuaugcucuccaccuggaaaauuggcugcaguacuuuccucucagccagauucuguucgugucuggagagagacuuaucgucgaccccgccggcgaaauggcuaaaguucaggauuuucugggccucaagcggguggugacagagaaacauuucuacuuuaacaagaccaaaggguucccuugccugaagaaacccgaagacuccagcgcccccagaugucuuggaaagucuaagggccgcacccacccucggaucgacccggaugucauucacagacugcgcaaauuuuauaagcccuucaaucucauguucuaccaaaugacagggcaggacuuucagugggagcaagaggaaggagauaaauga

SEQ ID NO: 70458 - RNA, 1041 nt, Artificial Sequence
  derived and/or modified sequence opt5 from HS3ST5__Homo_sapiens__NP_705840
augcuguucaagcagcaagccuggcucagacagaaacugcuugugcugggcagccucgcugucgggucccugcuuuaccugguugcccgggugggaucucucgaccgccugcagcccaucugcccuauugagggcagacucgggggagcgcggacccaggcugaauuuccgcuccgcgcccugcaauucaagagaggccuucugcacgaguuucggaaagggaacgccagcaaggaacaggugcgccuccaugaucugguccagcagcuucccaaagcuaucauuaucggagugagaaagggcggcacacgggcccugcucgagaugcugaaucugcacccugcuguugugaaggccucccaagaaauucauuucuuugacaacgaugagaauuaugggaaaggaaucgagugguaccgcaagaaaaugcccuucucuuauccucagcagaucacgauugaaaagagccccgcguacuuuaucaccgaggaagucccugagagaauuuauaaaaugaacuccucuaucaagcuccugauuaucgugcgggagccgacaacccgcgccauuagcgacuacacacagguucuugaaggcaaggagcggaaaaauaagaccuauuacaaauucgaaaagcuggcuaucgaucccaacacaugugaggugaauaccaaauacaaggccgucagaacguccaucuauaccaaacaccucgaacgcuggcugaaguacuuuccuauugagcaauuccaugugguggacggggauagacuuaucacagagccccugccugaacuccagcuggucgagaaguuucugaaccugcccccgcggauuagccaguauaaucuguacuucaacgcuaccagaggauuuuauugccuucgcuucaauaucauuuucaacaaaugucuggccggcucuaaggggcggauccacccugaaguugaccccuccgugaucacaaaacucagaaaguuuuuccacccuuuuaaucaaaaauucuaccagauuaccggacgcacgcugaacuggcccuga

SEQ ID NO: 70459 - RNA, 1029 nt, Artificial Sequence
  derived and/or modified sequence opt5 from HS3ST6__Homo_sapiens__NP_001009606
auggccggcagcgggggacugggcgggggagcuggcgggggacagggcgccggcgcggggcaaggagcugcccucagagccucccgggcucccaugcugcuuguggcccugguccucggcgcuuacugccugugugcccuuccugggcgcugcccgcccgcggccagagcuccugcccccgcuccugcccccucugaaccuagcuccucuguucaccggccgggagcgcccggccugccucucgccagcgggcccggacgcagacgguucccucaggcucugaucgugggcgugaagaaaggcgggacccgcgcccugcucgaauuucugagacuucaucccgacguccgggcucugggauccgagccgcacuucuuugaucgcuguuaugaaagaggccucgccugguaccggucucugaugccucgcacacuugacgggcagauuacgauggagaagacccccagcuauuucgugacaagagaagccccucggcgcauccaugcuaugucccccgauaccaaacugauuguuguggucagaaaccccgugacacgggcgaucagcgacuacgcccagacccucucuaagacaccuggacugccguccuuuagagcucuggccuuccgccacggccucgggcccguugauaccgccuggagcgcugugcggauuggacuguaugcccaacaucuugaccacuggcugagauacuuuccucucucucacuuccuguuugucuccggcgagcgccuugugagcgaucccgcgggcgagguggggcggguccaggacuuccugggacucaaaagaguugugacggauaagcauuuuuauuucaaugcuaccaagggcuuuccuugccugaaaaaggcccaagggggaucucgcccccggugucugggcaaauccaaggggagaccgcacccucgcgugccccaggcccucguccggagacugcaggaguucuaccgcccuuucaaccggagauuuuaccagaugacaggccaggacuucggauggggcuga

SEQ ID NO: 70460 - RNA, 1236 nt, Artificial Sequence
  derived and/or modified sequence opt5 from HS6ST1__Homo_sapiens__NP_004798
augagacggcgcagagccggcgggcggaccaugguggagcgcgcuagcaaguucguccugguuguggccggauccgugugcuuuaugcucauccuguaccaguaugcgggccccgggcuuucucugggagcuccuggcgggagagccccgcccgacgaucucgaccuguucccuacacccgauccucacuacgagaaaaaguauuacuuucccguccgggagcuugaacgcagccugagauucgacaugaaaggagaugacgugauuguuuuucuccauauccaaaagacgggcggcaccacauucgggcggcaccuggugcagaacguccgccuggaggugccuugugauugcagaccgggacagaaaaaguguaccugcuaucggcccaaucgcagagaaacauggcucuuuucccgguucucuaccggcuggagcugugggcugcaugccgacuggacagagcuuaccaacugcguuccuggagugcuggaucgcagagacuccgcugcccuccggacgcccagaaaguuuuacuauauuacccugcuucgcgauccugucucucgguaccugagcgaguggagacacgugcagcgcggcgcuacauggaaaaccucccuccauaugugugacgggcggacacccaccccggaagaacugccucccugcuacgaaggaacggauuggagcggcuguacacugcaagaguucauggacugcccuuauaaucucgccaacaauagacaggugcgcaugcuggcggaccuuucucuggucggcuguuacaaccucuccuuuauccccgaggggaagcgggcccagcugcuucuggaaagcgcuaaaaagaaucucagaggaauggccuucuuuggccugaccgaguuccagcgcaaaacacaauaucuguucgaacggaccuuuaaccucaaguucauuagacccuuuaugcaguacaauucuacccgcgcugggggaguugagguggaugaagacacaauccggagaaucgaggagcugaacgaucuugacaugcagcuguaugauuacgccaaggaccucuuccagcaacgguaucaguacaaacgccagcuggaaagacgggagcaaagacuucgcucccgggaagagagacugcuccaccgcgcgaaggaagcccugccuagagaggaugcugacgagccgggccgggugcccacggaagauuacaugagccacauuaucgagaaaugguga

SEQ ID NO: 70461 - RNA, 1938 nt, Artificial Sequence
  derived and/or modified sequence opt5 from HS6ST2__Homo_sapiens__NP_001070656
auggcccugcccgcuugcgccgugagagaguucgaaccuccgcggcagcccgagcgcggcgcgccugucagaaccacauguccccggcgccacagcagaguugaagcugagcucgccgccucccggccugggucuguggcugccagcgugcgcgcuggacccccuagaggcgucucccauggguuucacacgcggccgcugcuugacaagccccgcaaagccucuagcucccuggcgggagccgcuugcgccccucucuucgcucugcuuucuagaggccggcgcagacggaugcaugugcugcgcagacggugggaucucgggagccuguguagagcccugcucacccgcggacuggcggcccuuggccacucccugaagcauguucucggcgcuaucuuuagcaaaauuuucgggcccauggccucugugggaaacauggacgaaaaguccaauaaacugcuucuggcucucgucaugcuguuucuguucgccgugaucguucuccaauacgugugcccuggcacagagugucagcugcuucggcugcaggccuuuagcucucccgucccggauccuuauagauccgaggacgaaagcucugcucgcuucgugccccgguacaacuuuaccagaggggaucuccugcgcaagguggacuucgauauuaagggagacgaucuuaucgucuuucugcacauucagaaaacaggcgggaccacauucggacggcaccucguuagaaauauccaacuggagcagccuugcgaaugucgcgugggccagaagaaaugcaccugucaucggcccggcaagagagagacguggcuguuuucccgcuucagcaccgggugguccugcggacuccacgcggacuggacagagcugaccucuugugugcccagcgucguggauggcaaacgggacgccagacuucggccuucccgcuggagaaucuuccagauucuggaugcugccagcaaggacaagcgggggucuccgaacacaaaugccggagcuaacucccccagcucuaccaaaacgagaaauacaagcaaguccggcaaaaacuuucauuauaucaccauucuccgcgacccuguuucucgguaccugagcgaauggagacacgugcaacgcggggccacauggaaggcgucccuucacgucugcgauggaagacccccuaccagcgaggaacugcccucuugcuauaccggcgacgauugguccggcuguccgcucaaagaguucauggacugcccuuacaaucuggcuaacaaucgccaggugcggaugcugagcgaucucacacugguuggguguuauaaccuuucugugaugcccgaaaagcagagaaauaaaguccugcucgaguccgccaagagcaaccugaagcauauggccuuuuucggacugacggaguuucagcggaaaacccaauaccuuuucgaaaagacauuuaauaugaacuucaucuccccuuuuacccaguacaacacaacccgcgcuucuagcguggagauuaaugaagagauccagaaaagaauugaaggccucaacuuccuggacauggagcuguauuccuacgccaaggaucucuuucugcaacgguaucaguucaugcgccagaaagagcaccaggaagcuagacggaagcgccaagagcagagaaaguuucuuaaagggcggcugcuccagacgcauuuccagucucaaggacagggccagagccagaaucccaaccaaaaucagucccagaacccuaaucccaacgccaaucagaaccugacacaaaaucugaugcagaaccuuacccagagccucucucaaaaggaaaauagagaguccccgaaacagaacagcgggaaggaacagaaugacaacaccucuaacggcacaaaugauuacaucggauccgucgagaaauggcgcuga

SEQ ID NO: 70462 - RNA, 1416 nt, Artificial Sequence
  derived and/or modified sequence opt5 from HS6ST3__Homo_sapiens__NP_703157
auggacgagagauucaacaaguggcugcucacccccgugcugacacuucuguuugucguuaucauguaccaguaugugagcccuuccugcacgucuagcuguaccaauuucggcgaacaaccgcgggccggggaggcuggacccccugccgugcccggcccugcgcgcagagcucaggcucccccugaagagugggaacggcgcccgcagcugcccccucccccuagagggcccccggagggaccucggggcgccgccgcccccgaggaagaggaugaagaaccuggggacccccgcgagggagaagaggaagaggaagaggaugagcccgacccugaagcuccggagaacggcucccuccccagauuugucccucgguucaauuuuucucuuaaagaucugacacgcuucguggacuuuaacauuaagggcagagauguuaucguguuccuccacauucagaaaaccgggggaacaaccuuuggccggcaucuggucaagaauauccgccuggaacaacccugcagcuguaaagccgggcagaagaagugcacaugucacagaccuggcaaaaaggagaccuggcuguucucccgguuuucuacgggauggagcugcgggcuccaugcggacuggaccgaacuuacaaacugugugcccgccauuauggagaaaaaggauugcccgcgcaaucacucccauaccagaaacuucuacuauaucacaaugcugcgggacccuguuagcagauaccucucugaguggaaacacgugcagcgcggagcuaccuggaagacgucccugcacaugugugauggccggagccccacaccugacgaacuuccuaccugcuaucccggcgaugacuggucuggggucucccugagagaguuuauggacuguacauacaaucucgccaacaaucgccaggugcggaugcuggcugaucugagccucgugggaugcuauaaccugaccuucaugaaugaaucugagagaaacaccauccuucugcaauccgccaagaauaaccucaaaaacauggcguucuuuggccugacagaguuccagcgcaagacgcaguuucuuuucgagcggaccuuuaaucugaaauucauuagccccuuuacacaguucaacaucaccagagccuccaaugucgagauuaacgaaggggcucgccaacggaucgaggaccucaauuuucuggauaugcagcuguacgaauacgccaaggaccucuuccagcaaagauaucaucacacaaaacagcuggagcaucagcgcgaucggcagaagagacgggaggaacgcagacuucaacgggagcacagagaccaccaguggccgaaagaagauggagcugccgagggcaccguuacggaagacuacaacucucagguggugcgcugguga

SEQ ID NO: 70463 - RNA, 231 nt, Artificial Sequence
  derived and/or modified sequence opt5 from HSBP1__Homo_sapiens__NP_001528
auggccgagaccgaccccaagacagugcaggaucugacgagcgucguucaaacccuccugcagcagaugcaggacaaauuccaaacaauguccgaucagaucauuggcagaaucgacgauaugucuagccggauugacgaucuugaaaagaacaucgcugaccugaugacccaggccgggguggaggaacucgaguccgaaaauaaaauuccugcgacacagaagucuuga

SEQ ID NO: 70464 - RNA, 879 nt, Artificial Sequence
  derived and/or modified sequence opt5 from HSD11B1__Homo_sapiens__NP_001193670
auggccuucaugaagaaauaccugcuccccauccugggccuuuuuauggcuuauuacuauuacagcgccaacgaggaguucagaccugaaaugcugcaggggaagaaagugauugucaccggagcguccaagggcaucgggcgggaaauggcuuaucaccucgccaaaaugggagcccauguuguggugacagcucgcucuaaggagacgcugcaaaaggucgugagccacugccuugaacugggcgccgcuuccgcccauuacauugcggggaccauggaggacaugacauuugccgagcaguucguugcucaggccggaaaacucaugggcggccuggauaugcugauccucaaucacauuaccaacacaucucugaaucuuuuucaugacgauauccaccacgugagaaagagcauggaagucaacuuccuguccuaugugguucucaccguggcugcccugccgaugcuuaaacagucuaaugggagcaucgucgugguguccagccuggcgggaaaggucgccuaccccaugguugcugccuacucugcuuccaaauuugcccucgacggcuucuuuagcucuauucggaaggaguauuccgugagccgcgugaacgucucuaucacacugugugugcuggggcucauugauaccgaaacggccaugaaggcuguuuccggaaucgugcauaugcaagcggccccuaaagaggagugcgcucuggaaauuaucaagggcggggcccuuagacaggaggaagucuacuaugacagcucccuguggaccacacuccugauucggaaucccugucgcaaaauccuugaguuccuguacucuaccagcuauaacauggauagauuuaucaauaaguga

SEQ ID NO: 70465 - RNA, 1002 nt, Artificial Sequence
  derived and/or modified sequence opt5 from HSD11B1L__Homo_sapiens__NP_001254797
auggccaaccugggcacccuccagcugcuucccccuagauucaagcgguuuagcugccugucccucccgaauaucuggauuacagggaugcccgugccugcuacgucuguccccuguccuagcgccggaccccaccgcaccaugaaaguucugcuucugacaggccucggggcgcuguucuuugcuuacuauugggacgauaacuucgacccugccucccugcaaggagccagagugcuccugaccggcgcuaaugccggggugggagaggaacuugcuuaccauuaugcccggcugggcucucaccucguccugacagcgcauaccgaggcccuucugcagaaggugguuggcaacugccgcaaacucggggcuccgaagguguuuuacaucgccgcugauauggccagccccgaagcgccugaguccgucgugcaguucgcccuggacaaacugggaggccucgauuaucugguucuuaaucacauugggggagcucccgccggcacaagagcucggucuccucaggccacccgcuggcugaugcaagugaacuuugucagcuacgugcagcucacguccagagcccugcccagccuuaccgacucuaaggggucccugguggucguuagcucucuccugggacgggugccgacauccuucagcaccccuuauucugcugcgaaguuugcccuggauggcuucuuuggcucccuccgcagagaacuggacgugcaggaugucaauguggcuaucacaauguguguucuugggcugcgggaccgcgccagcgccgcugaggccgugagaggagucacccgggugaaagcggcucccggcccuaaggccgcccucgcuguuauucgcgggggagccacgagagcugccggcguguucuaccccuggcgguuuagacugcuuugccugcuccgccgguggcugcccagaccucgcgcgugguucauccggcaggagcugaacgucacagccgcugccgcuuga

SEQ ID NO: 70466 - RNA, 1218 nt, Artificial Sequence
  derived and/or modified sequence opt5 from HSD11B2__Homo_sapiens__NP_000187
auggagagauggcccuggccuagcggcggggccuggcugcucguggcugcccgggcgcugcuucagcugcuccgcuccgaccugagacuuggacggccgcugcucgcugcccuggcccugcucgcugcccuggauuggcuuugccaacgccugcugcccccucccgcugcccucgcgguccuugccgcugccggcuggaucgcucugucuagacucgcccggccucagcgccugcccguugcgaccagagccgugcugauuacagggugugacagcggauucggcaaggaaacggcuaaaaagcucgauuccaugggguuuaccgugcuggccacaguccuugagcugaacucuccuggagcuaucgaacuccggaccugcuguagcccgcgccugagacuucugcagauggaccucacaaaacccggcgauauuucccgggugcuggaguucaccaaggcccacacaaccucuacgggccugugggggcucguuaauaacgccggacauaaugaaguggucgcugacgcggagcugagcccuguggccaccuuucgcuccugcauggagguuaacuucuuuggcgcucuugaacugacaaaagggcuccugccccuucugagaagcucucggggacgcaucgugaccgucggcuccccugccggggauaugcccuacccgugucucggagccuauggcacaagcaaggcugccguggcgcugcugauggacaccuucucuugcgagcuccugccuuggggcgugaaggucuccauuauccagcccggguguuuuaaaacggaaagcguuagaaaugugggacaaugggagaagcggaaacagcuucugcucgcuaaccugccucaggagcugcuucaggccuacggcaaggauuauaucgaacaccuccaugggcaauuccugcacucucugagacucgccauguccgaccugacacccguggucgaugcuauuaccgacgcccuucuggcugcccgcccccggagacgcuacuauccuggacagggccucgggcugauguacuuuauccauuauuaccugccggagggacuucggagacgcuuccuccaggcguuuuucauuagccacugccugccccgggcccugcagccuggccaacccggcacaaccccuccccaggaugcugcccaggacccgaaucucuccccugggcccucuccugcuguggccagauga

SEQ ID NO: 70467 - RNA, 759 nt, Artificial Sequence
  derived and/or modified sequence opt5 from HSD17B10__Homo_sapiens__NP_001032900
auggccgcugccugcagaagcgugaagggccuggucgcgguuaucaccgggggagcuuccggccucgggcuggccacagccgagcggcuugugggacagggcgcuucugccgugcugcucgaccugcccaacagcgggggagaagcucaagccaaaaagcugggcaauaacugugucuucgcgccugccgaugugacguccgagaaagacguucagaccgcucuugcccucgcuaagggcaaauuugggcgcguggaugucgccgugaauugcgcgggaauugccguugcuucuaagacauacaaccugaagaaaggccagacccacacacuggaagacuuccagagagugcucgaugucaaucugauggggaccuuuaacgugauccggcuuguggccggagagaugggccaaaaugaaccggaccaagggggacagcgcggcgucauuaucaacacagcuagcguugccgccuucgagggccagguggggcaggcugcguauuccgccucuaagggaggcauuguggggaugacccugcccaucgcuagagaucucgccccuaucggacuguuuggcacgccccuucugaccagccucccugagaaagucuguaauuuccuggccucccaggugcccuuuccuagccggcugggggacccggcugaauacgcccaucucguucaggcgauuaucgagaaccccuuccugaauggagaagugauucgccuugauggcgcuaucagaaugcagccuuga

SEQ ID NO: 70468 - RNA, 903 nt, Artificial Sequence
  derived and/or modified sequence opt5 from HSD17B11__Homo_sapiens__NP_057329
augaaguuccugcucgacauccugcuucugcucccccugcuuauugugugcagccuggaguccuuugucaaacucuucaucccuaagagacggaaaucuguuaccggcgaaauugugcugaucacaggggccggacacggcauugggcgccugacggcuuacgaguuugccaagcucaaaagcaagcuggugcuuugggauaucaacaagcauggacuggaagagaccgcggcuaaauguaagggccucggggccaaaguccacacauucgugguugacugcuccaauagagaagauaucuauucuagcgccaagaaagugaaggcugagauuggagacgucuccauccuggugaacaaugccggcguuguguacaccucugaucuuuuugcuacacaggacccgcaaauugagaagaccuucgaagucaacgugcuggcccauuuuuggacaaccaaagcguuccuccccgccaugacgaagaauaaccacggccauaucgugaccgucgcuagcgccgcugggcacguuuccgugccuuuucugcuggccuauuguagcucuaaauucgcggccgugggauuucacaagacacucaccgaugagcuggcugcccuucagauuacaggcgucaaaaccacgugccugugucccaauuucgugaacacaggguuuaucaagaauccuuccaccagccucggacccacacuggaaccugaggagguugugaaccggcuuaugcauggcauucugaccgaacagaaaaugaucuucaucccgucuuccauugcuuuccucaccacacuggagcgcauccugcccgaaagauuucucgccguccugaagcggaagauuagcgugaaauucgacgccguuaucggguacaagaugaaagcucaguga

SEQ ID NO: 70469 - RNA, 939 nt, Artificial Sequence
  derived and/or modified sequence opt5 from HSD17B12__Homo_sapiens__NP_057226
auggagagcgcccugcccgcugccggcuuccucuacugggugggggcgggaacagucgcuuaucuggcccuuagaaucuccuacucucuguuuacagcccuccggguuuggggcguggggaacgaagcuggagugggcccugggcugggagagugggccgucgugacgggcagcaccgacggcauugggaaguccuaugcugaggaacuugccaaacacggaaugaagguugugcugaucucucgcagcaaagauaagcucgaccaggucuccucugaaauuaaagagaaguucaagguggagacaagaaccaucgcgguugauuuugccagcgaagacauuuacgauaaaaucaagacaggccuggcugggcuggagaucggcauucucgugaauaacgucggaauguccuaugaauacccggaguauuuccuggacgugcccgaucuugacaaugugaucaaaaagaugauuaacaucaauauucugagcgucugcaaaaugacccaacucguucugccugggaugguggagcggucuaagggagccauccuuaacauuuccagcggcucuggcaugcugcccgugccucuccugacaaucuacuccgcuaccaagacguuugucgauuucuuuagccagugucugcaugaagaguaccgcucuaaagggguguucguucaguccgugcuccccuauuuugucgccaccaagcuggcgaaaaucagaaagccuacacuugacaaaccgagccccgaaaccuucgugaaguccgccauuaaaacaguuggacugcagucucggaccaauggcuaccucauccacgcucugauggggagcauuaucuccaaccuuccuagcuggauuuaucugaagaucgugaugaauaugaacaagucuacgcgcgcccauuaccucaaaaagaccaaaaagaauuga

SEQ ID NO: 70470 - RNA, 795 nt, Artificial Sequence
  derived and/or modified sequence opt5 from HSD17B13__Homo_sapiens__NP_001129702
augaacaucauucuggagauccuccugcuucugauuaccaucauuuacagcuaucucgaaucccuggugaaguucuuuaucccccagagacggaaaucugucgccggcgagaucguucuuauuacaggggcuggacacggcaucgggcgccaaacgaccuacgaguucgccaagagacagagcauucuggugcucugggacaucaauaaagugaagaaagaagucggagaugugacaauuguugugaacaaugcgggcaccgucuauccugcugaccugcuguccacaaaggaugaagagaucaccaagacauuugaggugaacauucucgggcauuucuggaucaccaaagcccugcuuccgucuaugauggaacggaaucacggacauaucguuacgguggccagcgucugcggccacgagggcauucccuaccugaucccuuauuguuccucuaaguuugcugccgugggguuccaucgcggacucaccagcgaacugcaggcucuuggcaaaacagggauuaagaccuccugccugugucccguguuugucaacacaggauucaccaaaaauccuagcacgagacucuggcccguucuggagacagacgagguggugcggucucugaucgauggcauucucaccaacaagaagaugaucuuugucccuuccuacaucaauauuuuccugcgccuucagaaauuucugccggaaagagccagcgcgauccucaaccggaugcaaaauauucaguucgaggccgugguugggcacaagaucaaaaugaaguga

SEQ ID NO: 70471 - RNA, 813 nt, Artificial Sequence
  derived and/or modified sequence opt5 from HSD17B14__Homo_sapiens__NP_057330
auggccaccggcacaagauacgcugggaagguggucguugugacgggaggcgggcggggaaucggcgccgggauugugcgcgcguucgucaacagcggagcuagagugguuaucugcgacaaagaugaguccggcggccgggcccuggaacaggagcuccccggggccguguuuauucugugugacgucacccaagaagaugacgugaagacacuuguuucugagaccauccgcagauucggacggcuggauugcguggucaauaacgcuggccaccauccuccgccccagcgcccugaagagacaagcgcccagggguuuagacagcuccuggagcuuaaucugcucggaaccuauacacugaccaaacuggcucuccccuaccugcggaagucccaaggcaacgugauuaauaucucuagccuugugggggccaucggacaggcgcaggccgucccuuauguugcuacgaaaggcgccgugaccgcuaugacaaaggcccuggcgcucgacgaaucccccuacggcgugcgcgucaacuguauuucuccugggaauaucuggaccccgcugugggaggaacuugccgcucugaugcccgauccuagagccacaauucgggagggaaugcucgcucagccccugggccgcauggggcaaccugccgaggugggagccgcugcgguuuuccuggccagcgaagcuaacuuuugcaccggcaucgagcuccuggugacagggggagccgaacuuggcuauggcuguaaggccuccagaagcacgcccgucgacgcuccggauauuccuucuuga

SEQ ID NO: 70472 - RNA, 987 nt, Artificial Sequence
  derived and/or modified sequence opt5 from HSD17B1__Homo_sapiens__NP_000404
auggccagaaccgugguccugaucacaggcugcagcuccgggauuggacuccaccuggccguucggcuugccucugaccccagccaguccuucaagguguacgcgacgcugcgcgaucucaaaacccaaggcagacugugggaggcugcccgggcccuugcuuguccuccggggucucuggaaacacuccagcuggacgugcgcgauagcaaguccgucgccgcugccagagagcgggugaccgaaggacgcguugacgugcuggucugcaacgcgggccucgggcugcuuggaccccuggaggcccucggcgaagaugcuguggccucuguucuggacgugaaugucgugggcacagugagaaugcuucaggcuuuucugccugauaugaaacggcgcgggagcggaagaguccucguuaccggcuccgucgggggacugaugggccugcccuucaacgacguguauugugccagcaaguuugcgcucgaggggcugugcgagucucuugccgugcugcuccugccuuucggagugcaucuuucccugaucgaauguggccccguucacacagcuuuuauggagaaagugcucggcagcccugaagagguccuggaucggaccgacauucauacguuccaccgcuuuuaccaguaucuggcccauucuaagcaaguguucagagaggcugcccagaauccggaagagguugccgaaguguuucucaccgcucugcgggcgcccaagccuacacuucgcuacuucaccacagagagauuucugccccuccugcggaugagacuugaugacccuuccgggagcaacuaugucaccgccaugcaccgcgaaguguucggagauguccccgcuaaagccgaggccggcgcugaggccgggggaggcgcggggccgggagcugaagacgaggccggccggggcgccgugggggacccugaacugggagaucccccugcugcuccccaguga

SEQ ID NO: 70473 - RNA, 1164 nt, Artificial Sequence
  derived and/or modified sequence opt5 from HSD17B2__Homo_sapiens__NP_002144
augagcaccuucuuuuccgacacagccuggaucugccuggcugugcccacgguccucuguggcaccguuuucugcaaguacaaaaagucuagcgggcagcugugguccuggauggugugucuugccggacugugcgcggugugucuccugauucuuucuccuuuuuggggccugauccucuucagcgucuccugcuuucugauguauacauaccugucugggcaagagcuccugccgguggaucagaaagcuguucuugugaccggaggcgacugugggcugggacacgcccucugcaaguaucuggaugaacuuggcuucacagucuuugccggcgugcugaacgagaaugggcccggagcugaggaacucagacggaccuguagcccucgccuguccguucugcagauggacauuacaaaacccgugcagaucaaggaugccuacagcaaggucgcugccaugcuccaagacagaggccugugggcggugauuaacaaugccggggugcuuggauucccuaccgauggcgaacugcuccugaugacggacuauaaacagugcauggcugucaacuuuuucgggaccguugaggugacaaagaccuuucuuccccugcuccggaaaucuaagggacgccuggugaaugucuccagcaugggcggcggggccccuauggagagacuggcuucuuacggauccagcaaagccgcggugacaauguucucuuccguuaugcggcucgaacugagcaaguggggcaucaagguggccuccauccagcccgggggauuucuuaccaacauugcuggcacgucugauaaaugggagaagcuggaaaaagacauccucgaucaucugccggccgagguccaggaggacuaugggcaagauuacauucuugcucagcgcaauuuccugcuccugaucaacagccuggccuccaaggacuucagcccugugcucagagacauucagcacgccauccuggcuaaaucucccuuugcguacuauacaccuggaaagggcgccuaccuuuggauuugucuggcucauuaucuccccaucggcaucuacgauuauuucgccaaacggcacuuugggcaggacaagccgaugccucgcgcccugagaaugcccaauuacaagaaaaaggcuaccuga

SEQ ID NO: 70474 - RNA, 933 nt, Artificial Sequence
  derived and/or modified sequence opt5 from HSD17B3__Homo_sapiens__NP_000188
augggcgacgugcuggagcaguucuuuauccucaccgggcugcuugucugccuggccugucucgcuaagugcguuagauucagccggugugugcugcuuaacuacuggaaagugcugcccaaguccuuucuccgcucuaugggacaaugggccgucauuacaggcgcgggggauggaaucggcaaggcuuauagcuucgaacuggccaaaagagggcugaaugugguucucauuucccggacgcuggagaaacuugaagccaucgcuaccgagauugaacgcacaaccggaagaucugugaagaucauccaggccgacuuuacaaaggaugacauuuacgagcacaucaaagagaagcuggcuggccucgaaauuggcauccuggucaacaauguggggaugcuuccuaaccugcucccgagccauuuccugaaugcccccgaugagauucagucccugauccacugcaacauuaccucuguugugaaaaugacacagcucauccugaagcauauggaaagccggcaaaaaggacuuauccugaauauuuccagcggcaucgcgcucuuuccuuggccccuguauucuauguacuccgccagcaaggcuuucgucugugccuuuucuaaggcccuucaggaggaguauaaagcuaaggaagugauuauccaggugcugaccccuuacgcggucuccacggccaugaccaaauaucucaacacaaauguuauuaccaagacagcugacgaguucgugaaagaaagccugaacuacgugaccaucgggggagagacgugcggcugucuggcccacgaaauccucgcuggguuucugucucuuauucccgccugggccuucuacuccggagcuuuucagcgccugcuccugacacauuaugucgcguaccuuaagcugaauaccaaagugagauga

SEQ ID NO: 70475 - RNA, 2211 nt, Artificial Sequence
  derived and/or modified sequence opt5 from HSD17B4__Homo_sapiens__NP_000405
augggcagcccccugagauucgacgggcgggugguccucguuaccggagccggcgcugggcugggacgcgccuacgcgcuugcuuuugccgagagaggcgcccuggugguggucaacgaucucgggggagacuucaagggcgugggcaaagggucccuggcugccgauaagguuguggaagagauccggcgcagaggaggcaaagcugucgccaauuaugacucuguggaagagggggaaaagguugugaaaacagcgcuugaugccuuuggacggauugacgucguggugaacaaugcuggcauccugcgcgauagaucuuucgcccggauuuccgacgaggauugggacaucauucaccgcguccaucucagagggucuuuucagguuacgcgggcugccugggagcacaugaagaagcaaaaauacggacgcaucaucaugaccagcuccgcgucuggcauuuauggcaacuucgggcaggccaauuacagcgcugccaagcugggacugcucggccuggcuaacucccuugccaucgaagggagaaaaagcaauauucauugcaacacaaucgccccuaaugcuggaucucggaugacccagacagugaugccggaggaucugguggaagcgcucaagcccgaguaugucgccccucuggugcuuuggcugugucacgaguccugcgaagagaacggcgggcucuuugaaguuggagcuggcuggauuggcaaacugcgcugggagagaacccugggggccaucgugcggcagaagaaucaucccaugacaccugaagccgucaaggcuaacuggaaaaagauuugugacuucgagaaugccagcaaaccccaaucuauccaggaguccaccggaagcaucauugaagugcucucuaagaucgauuccgagggcgggguuagcgcgaaccacacguccagagcuaccucuacagccaccagcggauuugccggcgcuauugggcagaaacugccuccguucuccuacgccuauacagaacuugaggcuaucauguacgcccugggcgugggagcgagcauuaaggaccccaaagaccucaaguuuaucuacgaaggcagcuccgauuucagcugccugccuaccuuuggggucaucauuggacagaagucuaugaugggcgggggacuugccgagauccccggccugagcauuaauuucgcuaaagugcuccacggggagcaauaucuggaacuguacaagccucucccccgcgccggcaaacugaagugugaggcugucguggccgacguucuugauaaaggauccggcguggucaucauuauggacguguauucuuacagcgaaaaggagcugaucugccauaaccaguucucccucuuucugguugggagcggaggcuucgggggaaagcggacgucugauaaagugaaggucgcgguggccaucccgaacagaccucccgacgcugugcuuacagauaccacaucccugaaucaggccgcucucuaucgccugagcggcgacuggaacccucugcacauugaucccaauuuugccucucucgccggguucgacaaacccauccugcauggccuuuguaccuuuggauucuccgcucggagaguucugcagcaauuugcggauaacgacgucagccgcuucaaggccauuaaagcucgguuugccaagccuguguacccgggccagacccuccagacagaaauguggaaggaggggaauagaauccacuuccaaacgaaagugcaggagaccggagacauugucaucuccaacgccuauguggaucuggcucccacaucuggcaccagcgccaagacaccuuccgaagggggaaaacugcagucuaccuuuguuuucgaggaaauuggccgccggcuuaaggacaucgggcccgagguggucaaaaaggugaaugcgguuuuugaguggcacaucacgaagggcggaaacauuggcgcuaaauggacaaucgaucucaagagcggguccggaaaaguguaccagggcccugccaagggggccgcugacaccaccauuauccugagcgaugaagacuucauggaggucgugcugggaaaacucgauccccaaaaggccuucuuuucuggcagacugaaagcgcgcggcaauauuaugcuuucccagaagcugcagaugauccucaaggacuacgcuaaacuguga

SEQ ID NO: 70476 - RNA, 954 nt, Artificial Sequence
  derived and/or modified sequence opt5 from HSD17B6__Homo_sapiens__XP_006719735
auguggcuguaccucgccgcuuucgugggccuguauuaccuucugcacugguauagagagcggcaggucguuagccaucuccaagacaaguacguguuuaucaccgggugcgauuccggauucggcaaccugcuugcccgccagcuggacgcgagagggcuccgggugcuggcugccugucugacagaaaaaggagccgagcagcuccgcggccagacgucugauagacuggaaaccgucacacuugacgugaccaagauggagagcauugcugccgcuacacaauggguuaaagaacacgugggggaucggggacuguggggccucgucaauaacgccggcauccugacccccauuacacuuugcgaguggcugaauaccgaggacuccaugaacaugcucaaggugaaucugaucgggguuauucaggugacgcugucuaugcucccucugguccgcagagcgcggggacgcaucgugaacgugagcuccauccuuggcagagucgccuuuuucguugggggauauugugugucuaaauacggcguggaggcuuuuagcgauauucugcggcgcgaaauccagcauuucggggucaagauuuccaucguggaaccgggauauuuuagaaccggcaugacaaauaugacccagagccucgagcggaugaagcaaucuuggaaagaggcccccaagcacauuaaagaaacauacggccagcaguacuucgacgcucuguauaacaucaugaaggaggggcuucugaauugcuccaccaaccucaaucugguuacggauuguauggaacaugcccugacaagcgugcacccucgcaccagauacucugcgggaugggacgccaaauuuuucuuuauuccccucuccuaucugccuacaagccuugcugauuacauccugacccggucuuggcccaagccugcccaggcugucuga

SEQ ID NO: 70477 - RNA, 468 nt, Artificial Sequence
  derived and/or modified sequence opt5 from HSD17B7__Homo_sapiens__NP_001291441
augagaaaggugguccugaucaccggcgccagcuccgggauuggacucgcucugugcaaacggcuucuggccgaggacgaugaacuccaccugugucuugcgugccgcaacaugucuaaggcugaggccguuugugccgcucugcucgccagccaucccacagcugaagugacgaucgugcaggucgacguguccaaucugcaaucuguuuucagagccagcaaagagcugaagcagcgguuucagcgccucgauugcauuuaccugaacgcgggcaucaugccuaauccgcagcuuaacauuaaagcccuguucuuuggacucuucuccagaaaggugauccacauguuuucuaccgcugaagggcugcuuacacaaggcgacaagaucaccgccgaugggcugcaggaggucuucgagacaaauguguuuggacauuucauucucguuaaaaagcugugggcuuga

SEQ ID NO: 70478 - RNA, 786 nt, Artificial Sequence
  derived and/or modified sequence opt5 from HSD17B8__Homo_sapiens__NP_055049
auggccagccagcugcaaaacagacuccgguccgcucuggcccuugugaccggcgcggggucuggaaucggccgcgcugucagcguuagacuggccggggagggagccacaguggcugccugcgaccucgaucgggcugccgcgcaggaaacggugcgccugcuuggcgggcccggauccaaggagggcccuccgagaggcaaucacgccgcuuuccaggccgacgucucugaagcucgggccgcgcgcugucugcucgaacaggugcaagccugcuuuagcagacccccuuccguuguggucucuugugcugggauuacccaggaugaguuccugcugcauaugagcgaggacgauugggacaaagugaucgccguuaaccucaagggaacauuucuggugacccaggcugccgcccaggcucuugucuccaauggcugccgggggagcauuaucaacauuucuuccaucgugggaaaagugggcaaugucgggcaaacaaacuacgcggccagcaaggcuggaguuaucggccugacccagacagccgcccgcgagcucggcagacacgggauucgguguaauucugugcugcccggauucaucgcuaccccuaugacgcagaaagugccccagaaggucguggauaagauuaccgaaaugaucccuaugggccaucuuggggacccggaggauguugccgacguggucgcguuucuggcuuccgaagauagcggauauauuacaggcaccucuguggagguuacagggggacucuucauguga

SEQ ID NO: 70479 - RNA, 1128 nt, Artificial Sequence
  derived and/or modified sequence opt5 from HSD3B1__Homo_sapiens__XP_011539616
auggccaugaccggcuggagcugccuggugacaggggcuggaggcuuccucgggcagagaaucauucggcugcuugucaaggagaaagaacugaaggagauccgcguucucgacaaagccuuuggacccgaacugagagaggaguucuccaaacuucaaaacaagacgaagcugaccgugcucgagggcgauauucuggacgagccuuuucugaagcgggcgugucaggaugugucugucaucauucacacagcuugcaucaucgacguguucgggguuacccaucgcgaaagcauuaugaaugugaacgucaaaggaacacagcuccugcuugaggccugugugcaggccuccguuccgguguuuaucuacaccucuagcauugaagucgcuggccccaauuccuauaaggagaucauucaaaacggccacgaggaagaaccucuggaaaauacauggcccgccccuuacccccauucuaaaaagcucgcugagaaagccgugcuggcggccaacggguggaaucuuaagaacggaggcacccuguauacgugcgcucucagaccuauguacaucuauggggaaggaagccgguuccuguccgccagcauuaaugaggcucugaacaauaacggcauccucucuuccguggggaaguuuagcaccgucaauccgguuuacgugggaaacguggccugggcgcacauccuggcccuucgcgcucugcaggaucccaaaaaggccccuucuauuagaggccaguucuauuacaucuccgacgauacaccccaucagagcuacgacaaucucaacuauacccugucuaaagaguuuggccuucggcuggauucccgcuggagcuucccucucucccugauguacuggauuggguuucugcucgaaaucgucucuuuccugcuuagacccauuuauacauaccggccgccuuuuaaccgccacaucgugacccugagcaauuccguuuucacguucagcuauaagaaagcucaaagagaccucgccuacaagccccuguauucuugggaggaagccaaacagaagacaguggagugggucggaucccuuguggaucggcacaaggaaacccugaaaagcaagacacaguga

SEQ ID NO: 70480 - RNA, 591 nt, Artificial Sequence
  derived and/or modified sequence opt5 from HSD3B7__Homo_sapiens__NP_001136250
auggccgacagcgcucaggcccaaaagcugguguaccucgucaccggcgggugcggauuccugggcgagcacguugugagaaugcuucugcagcgggaaccccgccucggggagcugagaguguuugaucagcaucuuggaccuuggcuggaggaacucaaaacaggcccgguccgggugacggcgauccagggggacguuacccaagcucacgaaguggccgccgcugucgccggagcucaugugguuauucacacagccggccugguggaugucuucggccgcgcgucccccaagaccauccaugaggugaacgugcaggggacaagaaaugucauugaggccuguguucagaccggaacacgguuucugguguauaccucuagcauggaaguggucggcccuaacacgaaagggcaccccuucuaccgcggaaaugaggacaccccuuaugaagcugugcacagacaucccuacccuugcuccaaggcccucgcugaguggcugguucuugaggccaacggccggaaagcgaugcugccgggguguacaugcuggcagcccggaucuuggagcuccggccaaccuuga

SEQ ID NO: 70481 - RNA, 828 nt, Artificial Sequence
  derived and/or modified sequence opt5 from HSDL1__Homo_sapiens__NP_001139523
auggccgcuguggacagcuucuaccugcucuauagagagaucgcccgguccugcaacuguuacauggaagcgcuggcucuugucggcgccugguauaccgcccgcaagucuauuacaguuaucugcgauuuuuacagccugauuagacuccacuucaucccccggcuggggucccgcgcugaccuuauuaaacaguauggaagaugggccguggugucuggcgcuacggaugggaucggaaaggccuacgcggaggaacuggccagccggggccucaauaucauucugaucucccgcaacgaggaaaaacugcaauauuuuacccagcucucugaggacaagcugugggauauuaucaaugucaacauugcugccgcuagccuuauggugcauguugugcugccugggauggucgagcggaaaaagggagccaucgugacaauuuccagcggcucuuguugcaagccgacaccccagcucgcggccuucuccgcuagcaaagccuaccuggaccacuuuucuagagcccuucaguacgaauaugcuuccaagggcaucuucguucaaagccugaucccuuuuuacguggccaccucuaugaccgcucccuccaauuuccuccaucgcuguagcuggcuggucccuucccccaaaguguaugcgcaccaugccgugucuacacuggggauuagcaagagaaccacgggauacuggucccacagcauccaguuucucuucgcucaguauaugccugaguggcugugggucuggggcgccaacauucuuaaucggucucugcgcaaagaagcccucuccugcaccgcuuga

SEQ ID NO: 70482 - RNA, 1038 nt, Artificial Sequence
  derived and/or modified sequence opt5 from HSDL2__Homo_sapiens__NP_001182751
augcugcccaacaccggcagacucgccgggugcacaguguucaucacgggagcuagccggggcauugggaaggccaucgcgcugaaagcugccaaggacggagccaauauugucaucgcugccaaaaccgcucagccucacccgaaacuucugggcacaauuuacaccgccgcggaggaaaucgaggccguugggggaaaggcucuccccuguaucguggaugugcgcgacgaacaacagauuuccgccgcugucgagaaggccaucaagaaauuuggcgcguauacaauugccaaguacggcaugucuauguaugugcuggggauggcugaagaguucaaaggagagaucgccguuaacgcucuuuggccuaagaccgccauucauacagccgcuauggauaugcugggcgggcccggaaucgaaagccagugcagaaaaguggacauuaucgcggaugccgcuuacuccaucuuucagaagccuaagucuuucaccggcaauuuugucauugacgagaacauccucaaagaagaggggauugagaauuucgauguguaugccaucaagcccggacacccucugcaaccggacuuuuuccuggaugaauaccccgaggccguuagcaaaaagguggaauccacgggcgcugucccugaguuuaaagaagagaagcuccagcugcagcccaaaccucggucuggcgccguggaggaaaccuuccgcauugugaaggacagccuuuccgaugacgucguuaaggcgacacaggcuaucuaucuguuugagcucagcggggaagauggaggcaccugguuccuggaccuuaaaucuaaagggggaaacgugggcuacggggagcccuccgaccaagccgauguggucaugagcaugacaaccgacgauuuugugaagauguucucuggaaagcugaaaccgacgauggccuucauguccggcaagcucaagaucaaaggcaauauggcucuggccauuaagcuggaaaaacucaugaaccagaugaaugcuagacuguga

SEQ ID NO: 70483 - RNA, 1590 nt, Artificial Sequence
  derived and/or modified sequence opt5 from HSF1__Homo_sapiens__NP_005517
auggaccugcccgugggcccuggggccgcuggaccgagcaacguccccgccuuccucaccaagcuguggacacuuguuuccgauccugacacggaugcgcugaucugcuggucucccagcggcaauuccuuucacguguucgaccaggggcaauuugcuaaagaggugcucccuaaguacuucaaacauaacaauauggccucuuuugucagacagcugaacauguauggauuccggaaggugguucacauugaacagggcgggcuugugaaacccgagcgcgaugacaccgaauuucagcauccuuguuuccugagaggacaagagcagcuccuggaaaauaucaagcggaaggucacaagcguguccacccugaaaucugaggauauuaagauccgccaggacagcguuacaaaacuccugaccgaugugcagcuuaugaagggcaaacaagagugcauggacuccaagcugcucgccaugaagcacgaaaacgaggcucuguggagagaagucgccagccuucggcagaaacaugcucagcagcaaaagguggugaauaaacugauucaguuucucaucucucugguccaguccaaccgcauccugggcguuaagagaaaaauuccgcucaugcugaaugauagcgggucugcccacuccaugcccaaguacagccggcaauucucucuugagcacgugcauggauccggcccuuauagcgcgcccuccccugccuacucuagcuccagccuguaugcucccgacgccguggcuucuuccgggccgaucauuagcgauaucacagagcucgccccugcgucucccauggccagcccuggaggcuccauugacgaacgcccccugucuagcuccccucuugucagagugaaagaggaacccccgucucccccucagagcccccggguugaggaggcuuccccugggcgccccagcucuguggacacccugcucuccccgacggcccugaucgauagcauucugagagaguccgagccugcucccgccucugucaccgcccucacagacgcucggggacacaccgauacagaaggccgcccucccagcccucccccgaccuccacgccugagaagugucugucuguggcgugccuugacaagaacgaacugagcgaucaucucgacgccauggauuccaaucuggacaaccuucagacaaugcugagcucucacggcuuuuccguugauaccagcgcucuccuggaccuguucucucccuccgugacaguccccgauaugagccucccugaccuggacucuagccuugccuccauccaggagcugcucagcccgcaagaacccccuagacccccugaggccgaaaauucuucccccgauagcgggaaacagcuggugcacuacaccgcucagccucuguuucuucucgaccccggauccgucgauaccggcucuaacgaccugccggugcuguucgaacucggggagggaagcuauuucuccgaaggcgauggguuugccgaggacccuacaaucucucugcuuacgggaagcgaacccccuaaggcgaaagaucccaccguuuccuga

SEQ ID NO: 70484 - RNA, 1557 nt, Artificial Sequence
  derived and/or modified sequence opt5 from HSF2__Homo_sapiens__NP_001129036
augaagcagagcuccaacgugcccgccuuccugucuaaacucuggacccuggucgaggaaacacacacgaaugaguuuaucaccuggagccaaaacggccaguccuuccuuguucuggacgaacagagauuugcuaaggagauucucccuaaauacuucaagcauaauaacauggccucuuuugugcggcagcugaauauguauggguuccgcaaagugguccacaucgauagcggaauugugaagcaagaaagagacggcccgguugaguuucagcaucccuacuucaagcaggggcaggaugaccuucuggagaacaucaaacggaagguguccucuagcaaaccugaagagaauaagauucgccaagaagaucucacaaaaaucaucuccagcgcgcagaagguccagauuaagcaggagaccaucgagucuagacuguccgaacugaaaagcgagaacgaaucucucuggaaggagguguccgaacugcgggcuaaacacgcccaacagcagcaaguuauucgcaagaucgugcaguuuauugucacacuugugcagaauaaccagcuggugagccucaaaagaaagcggccccugcuucugaauaccaacggagcccagaaaaagaaucucuuccaacauaucgucaaggagccuacagacaaccaccaccauaaaguuccccacucucgcaccgagggccugaagccuagagaacggauuuccgaugacaucaucauuuaugaugugacggacgauaaugcugacgaggaaaacaucccggugauucccgagaccaacgaagaugucaucagcgacccuuccaauugcucucaguaccccgacauugugaucguugaggaugacaacgaggaugaauaugccccugugauccagagcggggagcaaaaugaacccgcucgcgagucccugagcucuggauccgacggcagcucuccgcucaugagcuccgccguccagcugaacggcucuagcucccuuacaagcgaagauccugugaccaugauggacucuauucugaaugauaacaucaaucuccuggggaaaguugagcuucuggacuaccucgauuccauugacuguagccuggaggauuuucaggcgaugcugucuggaagacaguucuccaucgaccccgaccuccugguggauagcgaaaacaagggccuugagacaaccaaaaauaacgucgugcaaccugucuccgaagaggggcggaagucuaagagcaaacccgacaagcagcugauucaguauacggccuuuccccuccuggcuuuccuugauggaaauccugccuccucuguggagcaggcuagcacaaccgccuccagcgaaguucugucuuccguggacaaaccgaucgaggucgaugaacuccuggacagcucucuggaucccgagccuacacaauccaagcucgugcgccuggaaccccuuaccgaggcggaggccagcgaagcuacccuguucuaccucugcgagcuggccccugcuccccuggacucugauaugccgcuucucgacagcuga

SEQ ID NO: 70485 - RNA, 1479 nt, Artificial Sequence
  derived and/or modified sequence opt5 from HSF4__Homo_sapiens__NP_001035757
augcaggaggcccccgcugcccugccuaccgaaccgggccccagcccugugcccgcguuccucgggaagcugugggcucuugucggagacccuggcacagaucaccugaucagauggucccccucugggacgagcuuucucguuuccgaccaaucucgguucgccaaagaggugcugccucaguacuuuaagcauagcaacauggccuccuucgugcgccagcuuaauauguauggauuuagaaaagucgugucuauugaacagggcgggcugcuccggccggagcgcgaucacguugaguuccaacaucccagcuuugugagaggacgggagcagcugcuggagcgcgucagacggaaggugccugcucuccgcggcgacgauggcagauggcggcccgaagaccuggggcgccuucugggagagguucaggcccucagaggcgugcaggaauccaccgaggcucggcugcgcgagcuuagacaacagaacgaaauccuguggcgggaggucgugacacucagacagagccacgggcagcaacaucgcgugauuggaaaacugauccagugccuguucggcccucuccaggccgggcccucuaaugcgggaggcaagcggaagcugucccuuaugcuggaugaaggcagcucuuguccgaccccugccaaauuuaacacaugcccccucccuggggcucugcuucaagaccccuacuucauucagagcccccugccugagaccaaucucggacugagcccgcacagagcccgcggccccaucaucucugauauuccugaagacucccccagcccugaggggacacggcugucccccucuagcgauggaagacgcgagaagggccucgcucugcuuaaagaagaaccggccuccccugggggagacggcgaagcgggccuggcccucgcucccaacgagugugauuuuugcgucaccgccccucccccucugcccguugcuguggugcaggccauccuugaagggaagggauccuucucuccggagggcccucggaaugcccagcaacccgagcccggggacccuagagaaauuccggaccgcggaccccugggccucgaguccggggaucggagcccugaaucucugcugcccccuaugcuccugcagcccccucaggagagcgucgaacccgcuggcccgcuugacgugcugggaccuucccuccagggcagagaguggacgcugauggaucuggacauggagcuuucucucaugcaaccccugguuccugaacgcggggagcccgaacuggcggugaaaggacucaacagcccguccccuggcaaggaucccacccugggggccccucuucugcucgacguccaggcugcccugggaggccccgcccuggggcuucccggcgcucucacaaucuauagcaccccugagucucggacagccuccuaccugggaccggaggcgagccccucuccuuga

SEQ ID NO: 70486 - RNA, 1791 nt, Artificial Sequence
  derived and/or modified sequence opt5 from HSF5__Homo_sapiens__NP_001073908
auggaggcccugcucagcacccccaucaacccuaauaacuucccggcuaagcuguggagacuugucaauucuccccgguaccgcuccauuagaugggacggccgcggggaaggacugcucaucgaucagccucuguuugaggccgaacuucugagcccgccuggccccgggggaggcgggggaacagcgggcgcuggcgccgagccugaacucuucaaaacgaccuccuuuacaucuuucauucggcaacugaaccuguauggguuuagaaaggugguucucggaggccccgggggaggcaaacccgccgggaauggaccucugcaccauuuccacaacccccauuuucggcgcgaccagccucagcuucuggugcaccucaagagacugaccagcgcuaauaaagccaaacuugcugccggccuggaggugcccugccggccgccuaaccgcuuccagagacuccugaucacauccgcgucugccgcuaccgcuccccugcaacaucagcagccucccccucccgccggcccgcggcccgagccucacgggcccgucgccgugggacaguuucaccgcagcuucagacgggauucccucagcccuuacucuuguguuuccacacccagccaugaccacucuaccuauccgcugaagggccuugaucgcacgccugugccccauagaauuuggcaaaauucccuggggaugcacccuggacaggucgaaaccagccccacauuuucugacaagggcgugccuuuccccguucuccagcgguuuccgaccgaggugacauacacccugcagccuuccacgacaagcguccacgugcaacaggggccccagaccaugguguccucuagccaaaaguauuccaacuacacacccagcgcgcaguauucucaggccuacuacccuaccgcuguccuucagugcuguuccccgacccauauggaugcccugagcucuugcguuacacccacggcuagcuccuaugcccacuguaauuacuuccaaaacccuucuaugcagagcuccuaucccguggaguuccucccuagcaauuggcccugcucuaccacagacgaaaacaccaaaacagaggugaaucuggaagccgucuuucagaucguggaugagcugcauuccagcccuaagcucgaaaugguuaaaguggagcccgucgaaaaccaguguccgaccucuccuuccuacagaggacaacacauccuggcuaacagcaauaacuccaaucccugcucugcgagccaggccucccagcuugagccucugacgcccgugggcucugacauuaugagcuucguugugggcacagagcaggcugucgccuguucccucccgcaaagcccugaauauaucuacaccauucauaccgcccagcccguggagaacucuacaauccaggaauccgcugccauucagcaagcgcacgucaagcugaaggagcaccuuaaucauaacccuagccccucuuccgugguuuuugugcaggaagggcccccuuucagcacccaccaggucgaugcuaauaucaaaugccaaacaucuagccgcgagaacauucugccguccgagcagaugggauuucucaucagcgaaaugggccccgccucuaagccuuccgaggacacggggcuggccacccccgcucgguauagagaacaucgcagcaauucccagcagggaaaaucuccugaucugcaccuccugguggacguugccuguaagcaagagcgguuccccaaagaagaggagcuuaaggaauga

SEQ ID NO: 70487 - RNA, 612 nt, Artificial Sequence
  derived and/or modified sequence opt5 from HSFY2__Homo_sapiens__NP_001001877
auggcccacgugagcuccgagacccaggacgucucucccaaggaugaacugacagcuagcgaggccuccacgagaucuccucucugcgaacauaccuucccgggcgacagcgaucugcgguccaugaucgaggaacacgcguuucaaguucuuucucaggggagccugcucgagucccccagcuacacagugugugugucugagccugacaaagaugacgauuuccugucccuuaacuuuccccgcaagcuguggaaaauugucgaaagcgaccaguucaagucuaucuccugggaugagaauggaaccugcauugugaucaacgaggaacucuuuaaaaaggagauucuggaaacaaaggcuccuuauagaaucuuccagaccgacgccaucaagagcuuuguucggcaacugaaucucuacggcuucucuaaaauucagcagaacuuucagcgcuccgccuuccuggcuacauuucuuagcgaggaaaaagaguccucugugcugagcaagaucagauucaccaaaaugaagcucucccggagcucuacguaugaaaaucgcuaccuguguugcaaccuucaucugaaggaugaguccaauuauagcuga

SEQ ID NO: 70488 - RNA, 888 nt, Artificial Sequence
  derived and/or modified sequence opt5 from HSH2D__Homo_sapiens__NP_001278203
augagaggcagccggaugucccagcccccucaaugccugcgcagagcccagucuagcuguugccacuucauggugaagcuccuggacgaugggaccuuuaugaucccgggagagaaagucgcucauacaucccuugacgcccugguuacguuccaccagcagaagcccauugaaccucggcgcgagcuccugacccaacccuguagacagaaagauccugcgaacguggacuacgaagaucuuuuucuguauucuaaugcuguggccgaggaagccgcuugccccgucagcgccccugaggaggcuuccccgaagcccgugcucugucaucagucuaaagaacggaagccuagcgccgagaugaaccgcaucacaaccaaggaagcgacauccagcugucccccuaaaucuccccugggcgagaccagacagaagcuguggcggucccucaaaaugcugccggagcgcgggcaaagaguucggcagcagcuuaagagccaccuggccacagugaaucucucuucccugcuugacguccgcagaagcaccgugauuucuggaccuggcacggggaaaggaucccaggaucauagcggcgaccccaccuccggcgaucggggguacacagacccuugcguugcuaccucucucaagagccccucccaaccccaggccccuaaggaucgcaaagugccgacaagaaaggcugaacggagcgucucuugcaucgaggugacccccggagacagauccuggcaccagauggugguccgcgcccugagcucucaagaaagcaaaccugagcaccagggccuggcggaacccgagaacgaucagcugccugaggaauaucagcaacccccgccuuucgcccccggguacuguuga

SEQ ID NO: 70489 - RNA, 2565 nt, Artificial Sequence
  derived and/or modified sequence opt5 from HSP90AA1__Homo_sapiens__NP_001017963
augcccccuugcagcggcggggacggauccaccccgcccggcccuucucugagagaucgggacugucccgcccagagcgcugaguacccucgcgauagacucgacccccggccuggguccccgucugaagccagcucucccccuuuccugcgcuccagagcgcccgugaacugguaucaagagaaggcucaggucuuucuuuggcaccugaugguuagcggauccacaacgcuccugugccuuuggaaacagccuuuccaugugagcgccuuucccgugaccgccucucuggcuuuccggcagucccaaggcgccgggcagcaccucuacaaggaucugcagccguuuauccugcuccgccugcuuaugccugaagagacacagacccaagaccagcccauggaagaggaggaagucgagacauucgcuuuucaggccgaaauugcgcagcugaugagccucaucauuaauaccuucuauucuaacaaagagaucuuucugagagagcuuauuuccaauagcucugaugcccuggacaagauccgguacgaaucccucacagauccuagcaaacuggacuccggaaaggagcugcauaucaaccucauucccaauaagcaagaucgcacccugacgaucguggacaccggcauuggcaugacaaaagcugaucuuaucaacaaucuggggaccauugccaagucuggaacaaaggcuuucauggaagcccuccaggcgggcgccgacaucagcaugauugggcaguuuggaguuggcuucuauuccgcuuaccugguggccgagaaggucaccgugaucacgaaacacaacgacgaugaacaauaugcuugggagagcucugccgggggauccuuuacaguuagaaccgacacaggcgagcccaugggccgggggaccaaggugauccuucaucugaaggaagaucagaccgaguaccucgaggaacgcagaauuaaagaaaucgucaagaaacacagccaguucauuggauacccuaucacacuguucguggagaaggagcgggacaaagaagugucugaugacgaggccgaagagaaggaagauaaagaggaggaaaaggagaaggaagagaaagagagcgaagacaagccggagauugaagaugucggcuccgacgaggaagaggagaaaaaggauggggacaaaaagaagaaaaagaaaaucaaggaaaaauauaucgaccaggaggaacugaauaagacgaagcccauuuggacccgcaacccugaugacaucacaaaugaggaauacggagaguuuuauaaaucucucaccaacgauugggaggaccaccuggcuguuaagcauuucagcguggaaggccaacuugaguuuagagcgcuucucuucgugccccggagagccccuuuugaucuguucgaaaaucgcaaaaagaaaaacaauauuaaacuuuacguccggagaguguuuaucauggacaacugugaggaacugauucccgaguaucucaacuucauccgcgggguuguggauuccgaggaccugccgcugaauaucagccgggaaaugcuccagcagucuaagauucugaaagucaucagaaagaaccuugugaaaaagugccuggagcucuuuacagaacuggcugaggauaaagagaauuacaagaaauucuaugaacaguuuuccaagaacauuaagcugggaauccacgaggacagccaaaaucgcaaaaagcugucugaacuccugcgguacuacaccuccgccagcggcgaugagaugguuucccugaaagacuauuguacgagaaugaaggaaaaccagaaacauauuuacuauaucacaggcgagaccaaggaucagguggccaauucugcuuucgucgagcgccuccggaagcacgggcuggaagugauuuacaugaucgagccuaucgacgaauauugcguccagcaacuuaaagaguuugaaggaaagacccuggugagcguuacaaaagagggccucgagcugcccgaagacgaggaagagaagaaaaagcaggaagagaagaaaaccaaguucgagaaccuguguaaaauuaugaaggauauccuugaaaagaagguggagaaggucgugguuuccaauagacucgugacaucuccuugcuguauugucacgagcaccuacggguggacagccaacauggaacgcaucaugaaagcgcaggcucugcgggacaauuccaccaugggauauauggccgccaagaaacaccuggagauuaaccccgaucauagcaucaucgagacacucagacagaaggcugaagccgacaaaaaugauaagucugugaaagaccuggugauucuucuguacgagaccgcucuccuguccagcggcuucucucuggaagauccucaaacgcacgccaaccggaucuaccgcaugauuaaacuugggcucggcaucgacgaggaugaccccaccgcggaugacacauccgccgcuguuaccgaagagaugccgccucuggagggagaugacgacacaagcagaauggaagaggucgauuga

SEQ ID NO: 70490 - RNA, 2175 nt, Artificial Sequence
  derived and/or modified sequence opt5 from HSP90AB1__Homo_sapiens__NP_001258898
augcccgaggaagugcaccauggcgaggaagaggucgaaaccuucgccuuucaggcugagaucgcccaacugaugagccucauuaucaacacauucuacuccaauaaggagauuuuucugagagaacuuaucucuaacgcgagcgacgcucuggauaaaauucgguaugagucccucacggacccuucuaagcuggauagcgggaaagaacuuaagaucgacaucauuccgaauccccaggagcgcacccugacacucguugauaccggaaucggcaugacaaaagccgaccugauuaacaaucuggggaccaucgccaaguccggaacaaaggcuuucauggaggcccuccaggcuggcgccgauauuucuaugaucgggcaguuuggagugggcuucuacagcgcguaucugguggccgaaaaagucgugguuauuaccaagcacaacgacgaugagcaauacgcuugggaauccagcgccggcgggucuuuuacggugagagcugaccauggagagccuaucggccgggggaccaaagucauccuucaccugaaggaagaucagacagaguaucucgaggaacgcagagugaaagagguugugaagaagcauucccaguucauuggauaccccaucacccuguaucuugaaaaagagcgggaaaaggagauuagcgacgaugaggccgaagaggaaaaaggcgagaaggaagaggaggacaaagacgaugaagagaagccuaaaaucgaagacgucgggucugaugaggaggacgauuccggaaaggacaagaaaaagaaaacaaagaaaauuaaggaaaaguacaucgaucaggaggaacugaauaaaaccaagcccaucuggacgcgcaacccugacgauauuacacaagaggaauacggcgaguuuuauaaaagccucaccaaugacugggaggaucaccuggcggugaagcacuucucuguggaaggccagcuggaguuuagagcccuccuguucaucccgcggcgcgcucccuuugaccuuuucgaaaacaaaaagaagaaaaauaacauuaagcuguacgucagacggguuuucaucauggacuccugcgaugagcucauuccugaauaucugaauuuuauccgcggggugguggacagcgaggaucuuccccugaacaucuccagagagaugcuccagcagucuaaaauucugaaggucauccggaaaaauauugugaagaagugucuggaacucuucagcgagcuggccgaagacaaagagaacuacaagaaauuuuaugaggcuuucuccaagaaccuuaaacugggaauccaugaggauagcacaaaucgcagacggcucucugagcugcuuagauaccacaccucccaaagcggcgacgaaaugaccucucugagcgaguauguuucccgcaugaaggaaacacagaaaucuauuuacuacaucacgggggagagcaaggaacagguggccaacuccgccuuugucgaacgggugagaaagcgcggauucgagguuguguauaugaccgaaccuauugaugaguacugcguccaacagcucaaagaauuugacggcaagagccuggugucugucacaaaagaggggcuggagcuccccgaagaugaggaagagaagaaaaagauggaagaguccaaggcuaaauucgagaaucuguguaaacuuaugaaggaaauccuggacaagaaaguggagaagguuaccaucagcaaccggcucgugucuuccccgugcuguauugucacaagcaccuauggauggacggcgaauauggaaagaaucaugaaggcccaggcucugcgcgauaacuccacaaugggcuacaugauggccaaaaagcaucuggagauuaauccugaccaccccaucguggaaacccuucggcagaaagccgaggcugauaagaacgacaaagccguuaaggaccucgugguccugcuguuugagaccgcgcuccugucuagcggcuucucccuugaagauccucaaacacacucuaauagaauuuaucgcaugaucaagcuggggcucggaaucgacgaggaugaaguggcugccgaggagcccaacgccgcugugcccgacgaaauuccuccgcuggagggcgaugaagacgccagccggauggaggaaguugauuga

SEQ ID NO: 70491 - RNA, 2412 nt, Artificial Sequence
  derived and/or modified sequence opt5 from HSP90B1__Homo_sapiens__NP_003290
augagagcccugugggugcucggccugugcuguguccuucugaccuucgggagcguucgggcugacgaugagguggacguggauggaacagucgaagaggaccucggcaagucccgcgaagggucuagaacggaugacgaggugguucagcgggaagaggaggccauccaacuggauggacuuaacgcgagccagauucgcgaacugagagagaaauccgaaaaguuugcuuuccaggccgaggugaaucggaugaugaaacucaucauuaacucucuguacaagaauaaagagaucuuucugcgcgaacucauuagcaacgccuccgacgcucuggauaagaucagacuuaucucucugaccgacgagaaugcccucagcggcaacgaagaacugacagucaagauuaaaugcgauaaggagaaaaaucuucugcacgugaccgacacagggguuggaaugacccgggaggagcucgugaagaaccugggcacaaucgcuaaauccggcaccagcgaguuccugaauaagaugacggaggcccaggaagaugggcaaucuaccuccgagcucauuggacaguuuggcgucggguucuauagcgcguuucugguggccgacaaggugaucgucacaucuaaacauaacaaugacacccagcacauuugggaauccgauagcaacgaguucucuguuaucgcugacccccgcggaaauacacuuggcagagggaccacgauuacacuggugcucaaggaggaagccuccgauuaccuggagcuugacaccaucaaaaaccuggugaagaaauauagccaguuuaucaauuucccuauuuacgucugguccucuaagacagaaaccguggaggaaccgauggaggaggaagaggcugccaaagaagagaaggaggaaagcgaugacgaggcggccguugaagaggaagaggaggaaaagaaacccaagaccaaaaagguggagaaaacagucugggauugggaacucaugaacgacaucaagccuauuuggcaacggcccuccaaggagguggaagaggaugaguauaaagccuuuuacaagagcuucucuaaagaauccgacgauccuauggcuuauauccauuuuacggcugagggagaaguuaccuucaagagcauucuguucgugcccacaucugccccucgcggccuguuugacgaguacggcagcaaaaaguccgacuacaucaagcucuaugucagacggguguucaucaccgaugacuuucacgauaugaugccgaaauaccugaacuucgucaagggggugguugacucugaugaccuuccccugaaugugagccgcgaaacacuccagcagcauaaacugcuuaaggucauucggaaaaagcuggugagaaagacccucgauaugaucaaaaagauugccgacgauaaauauaacgacacguuuuggaaggaguucggaacaaauaucaaacugggcguuauugaggaucacuccaacagaacccgccuggcuaagcuccugcgguuucagagcucucaccauccuaccgacaucacaucccuugaucaauacguggaaagaaugaaagagaagcaggacaagaucuauuucauggcggggagcucucgcaaagaagccgaguccagccccuuugucgagcggcugcucaagaaaggauacgaagugauuuaucugaccgagccuguggacgaauacuguauccaggcucugcccgaguucgauggcaagagauuucaaaauguugccaaagaaggggucaaguucgacgaguccgagaagacaaaagaaucucgcgaggccguggaaaaggaguuugaaccgcuucucaacuggaugaaagauaaggcucugaaagacaagauugagaaggccguggucagccagcggcugacggaguccccuugcgcgcucguggcuucucaguacggauggagcggcaauauggaaagaaucaugaaagcccaggccuaucaaaccggcaaggauauuuccacaaacuacuaugcuagccagaaaaagaccuucgagaucaauccccgccacccucugauucgggacaugcuuagacgcaucaaagaagaugaggacgauaagacaguucuggaccucgccgugguccuguucgaaaccgcuacgcugcggucuggguaccuucuccccgauaccaaggccuauggagacagaaucgagcggaugcugcgccugucccucaacauugaucccgacgcgaaaguggaggaagaaccugaagaggagccggaagagacagccgaagacaccacagaggauaccgaacaggacgaggaugaggaaauggacguuggcacggaugaggaagaggaaacagcuaaggagagcaccgccgagaaagacgaacuguga

SEQ ID NO: 70492 - RNA, 2028 nt, Artificial Sequence
  derived and/or modified sequence opt5 from HSPA12A__Homo_sapiens__NP_079291
auggccgacaaggaggcuggcgggagcgauggacccagagaaaccgccccuacauccgcguacucuagcccggcucggucccugggcgacacggggaucacaccccucucuccuagccacauugugaacgauaccgacuccaaugucucugagcagcagagcuuccugguugugguggccgucgauuuuggaaccacauccagcggcuaugccuacucuuucaccaaagaacccgagugcauccaugugaugcgcagaugggaagggggagacccuggcguuuccaaccaaaagacacccaccacgauucuucugaccccugagcggaaauuucacagcuucggcuaugcugcccgcgauuuuuaccaugaccucgauccgaaugaggcuaagcaguggcuguaucuugaaaaauucaagaugaagcugcacacaaccggggaccucacaauggauaccgaccugacggccgcgaacggcaaaaaggugaaagcccuggagaucuuugcuuacgcccuccaguauuucaaggaacaagcucugaaagagcuuucugaucaggccggauccgaguuugaaaauagcgacgucagaugggugauuacaguucccgcgaucuggaagcagccugccaagcaguucaugcggcaagcugccuaccaggcugggcuggccucucccgagaacuccgaacagcucaucauugcccuggagccugaagcugcgagcaucuacugucgcaaacuuagacugcaucagaugauugagcucuccucuaaggccgcugugaauggauauagcggcuccgacaccgucggggccggauuuacacaagccaaagagcacauccggcgcaacagacagagccggaccuuccugguggaaaaugugauuggcgagaucuggucugaacuggaggaaggcgauaaguacgucguuguggacuccgggggaggcaccguggaucucacaguccaccagauucgccugcccgaggggcaucuuaaagagcuguauaaggcuacgggaggcccguacgggagccucggaguggacuaugaauuugagaaacugcuuuacaagaucuucggcgaagauuucaucgagcaauuuaagauuaaaagaccugccgcguggguugaccugaugaucgcuuucgaaucucggaagcgcgccgccgcucccgauagaaccaacccucucaauauuacacugcccuuuagcuucaucgacuauuacaaaaaguuucggggccacuccguggagcaugcccugagaaaaucuaacgucgauuucgugaaguggagcucccaggggaugcuccgcaugagccccgacgcuaugaaugcccuguuuaagccuaccauugauucuaucaucgagcaccuucgggaccuguuccagaaaccggaaguuuccacagugaaguuucucuuccuggucggaggcuuugcggaggcuccccuucugcagcaagccgugcaggccgcuuucggggaccagugcagaauuaucauuccucaggaugucggacucaccauccugaaaggcgccgugcuguuugggcucgaccccgcgguuauuaaggugcgccggagcccucugacguacggcgucggagugcuuaacagauauguugaaggcaaacaucccccggagaagcugcucgugaaggaugggacacgcugguguaccgacgucuucgauaaauucaucucugccgaccaauccguggcucugggagagcuggugaagcggagcuacaccccugccaaacccucccagcuuguuaucgucauuaauaucuauucuagcgaacacgauaacguguccuuuauuacagacccuggcgugaagaaaugcgggacccucagacuggaucugacaggaacgucuggcaccgcuguccccgcccgccgggagauccagacacucaugcaguucggggacaccgaaauuaaggccacagcuaucgauauugcgaccagcaaguccgugaaaguuggcaucgacuuucugaacuacuga

SEQ ID NO: 70493 - RNA, 2061 nt, Artificial Sequence
  derived and/or modified sequence opt5 from HSPA12B__Homo_sapiens__NP_443202
augcuggccgugcccgagaugggccuccaggggcuguacaucggaagcuccccugaaagaucuccgguccccagcccucccggcuccccucggacccaagagucuugcgggauugcuccccuuacaccuagccaguccccgaagcccgaaguucgcgccccucagcaggcgucuuucagcgugguggucgcuaucgacuuuggaacgaccuccagcggcuaugccuucucuuuugccuccgaucccgaggcuauucacaugaugagaaaaugggaagggggagacccuggcguggcccaucaaaagacacccaccugucugcuccugacaccggagggcgcuuuccacagcuuuggguacaccgcccgggauuauuaccaugaccuugauccugaggaagcgcgcgacuggcuguauuucgagaaauuuaagaugaaaauccacucugccacagaucucacccugaagacgcagcuggaagcuguuaacggaaagaccaugcccgcccucgagguguucgcucaugcccugagauuuuuccgggagcacgcgcuucaggaacugcgcgagcaguccccuagccuccccgaaaaagacacagucagaugggugcugaccguucccgccauuuggaagcaaccugcuaaacaguuuaugcgggaggccgcuuaccuugccggccuggugucucgcgaaaaugccgagcagcuccugaucgcucuggagccggaagcggccuccgucuauugcagaaagcuccggcugcaccagcuucuggaucucagcgggcgcgcucccggaggcgggagacugggagagcggcgcuccaucgacucuagcuucagacaagcccgggaacagcuuagacgcucccggcauagcagaacauuucugguggagucuggcgugggcgaacucugggccgagaugcaggcuggggaucgcuacgucguugccgacuguggaggcgggaccguggaucugacggugcaccaacuggagcagccucauggaacacucaaagaacuguacaaggcguccggcgggcccuauggagcugucggcguggaccuugccuucgagcagcugcucugccggauuuucggcgaagacuuuaucgccaccuucaagagacagcgcccugcugccuggguugaucugacaauugcuuuugaggcccggaaaagaaccgcggggccccaccgcgccggagcucuuaacaucagccugccguucucuuuuauugacuucuaccggaagcaaagaggccacaauguggaaaccgcccuccgccggagcuccgucaacuuugugaaauggucuagccaggggaugcugagaauguccugugaggcuaugaaugagcuguuccagccuacaguuagcggaaucauucagcauaucgaagcccuccuggcgcggcccgaggugcaaggcgucaaacuucuguuucucgucgggggcuucgccgaaucugcugugcugcagcacgccgugcaggcugcccugggagcccgcggccuuagaguuguggucccucaugauguggggcucacgauccugaagggagcuguucuguuuggccaggcgcccggggugguccgggugagacgcuccccucucaccuauggagugggcguucugaaccgguucguccccgggagacacccgccugagaaacuucuggugcgcgacggcagacgguggugcacagauguguuugagcgcuucgucgccgcugaacaaagcguggcccucggagaggaaguuagacggucuuacugucccgcccgccccggccagagacgggugcugauuaaucuguauugcugugcugccgaggacgcgcgcuucaucaccgauccuggggucagaaagugcggagcucuuucccucgaacuggagccggccgacuguggccaggauacagccggggcucccccuggacggcgcgagauuagagccgcgaugcaguuuggcgacaccgaaaucaaggugacggcuguugaugugagcacaaaccgguccgucagagccucuauugacuuccugagcaauuga

SEQ ID NO: 70494 - RNA, 1416 nt, Artificial Sequence
  derived and/or modified sequence opt5 from HSPA13__Homo_sapiens__NP_008879
auggccagagagaugaccauccugggcagcgcugugcucacacugcuucuggccggguaccucgcgcagcaauaucugccccuuccuacgccgaaggucauuggaaucgaccugggcaccacauacugcuccguugggguguucuuucccggaaccggcaaagugaaggucauuccugaugaaaacgggcacaucucuauucccagcaugguguccuucacagacaaugauguuuaugugggauacgagucugucgaacucgcugacagcaacccucagaauaccaucuaugaugccaaacgguuuaucggcaagauuuucacagccgaggaacuggaggcugagaucggccgcuaccccuuuaaagugcugaacaagaaugggaugguugaguucuccgugaccucuaacgaaacgauuaccgucagcccugaauaugugggauccagacuccugcuuaagcugaaagagauggccgaggcuuaccucggcaugccgguggccaaugcggucaucagcguucccgccgaauuugaccugaagcagcggaacucuacaauugaggcugccaaucuugcugggcugaaaauccuccgcgugauuaacgaaccuaccgccgcggccauggcuuacggacugcauaaggccgauguguuccacguccuggugaucgaccucggcgggggaacacuggauguuucccuucugaauaaacagggcggcauguuucucaccagagcuaugagcgggaacaauaagcugggaggccaagacuucaaccagcggcuucugcaguaucucuacaagcagaucuaucaaacguacggguuugugcccucucgcaaagaggaaauucauagacugcggcaggccgucgagauggugaagcugaaucucacacugcaccaguccgcccagcuuagcguucugcucaccguggaggaacaagaucgcaaagagccucauucuuccgacacagaacugcccaaggauaaacuuagcuccgcugacgaccacagagucaacucuggauucggccgggggcugagcgauaagaaauccggagagagccaggugcucuuugaaaccgagaucucucgcaagcuguucgacacccugaacgaggaucucuuccagaagauucuggucccgauccaacaggugcuuaaagaaggccaccuggagaagacagaaauugacgagguugugcucgucggcggguccacgagaaucccucggauccgccaggugauucaggaauuuuucggaaaagaucccaauaccagcguugacccugaucuggcgguggucacaggcguggccauccaagcugggauugacggaggcucuuggccccuucaggugagcgcccuggagauccccaacaagcaucuccagaaaaccaauuuuaacuga

SEQ ID NO: 70495 - RNA, 432 nt, Artificial Sequence
  derived and/or modified sequence opt5 from HSPA14__Homo_sapiens__NP_001265134
auggccgcuaucggcgugcaccuggggugcaccagcgccugugucgcgguuuacaaggacggcagagcuggagugguggccaacgaugccggggaccgggucacacccgcugugguugccuauuccgagaaugaagagauugugggacucgcugccaaacagucucgcaucagaaacauuagcaauacggucaugaaggugaaacaaauccugggccggcgcguucuuuccagagauccucagcugcagcagcucccgcaacccuuccagcggugcucuuguagccuguccgaacagccucaugggcagaccggaugcgugcgcggcgcgcaaccccuucaccagcaucagccucagcacucuuggggcagccugcauacagccgacuccagccuccuguuugagucuugguucuguuuuugguggggguga

SEQ ID NO: 70496 - RNA, 1926 nt, Artificial Sequence
  derived and/or modified sequence opt5 from HSPA1A__Homo_sapiens__NP_005336
auggccaaggcugccgcgaucggcauugaccuggggaccacauacagcugcgugggagucuuccagcacggcaaaguugagaucauugcuaacgaucaagggaauagaacgacccccuccuauguggccuuuacagacaccgaacggcucaucggagaugccgcuaagaaccagguggcccugaauccucagaacacagucuucgacgcuaaacgccuuauuggcagaaaguuuggggauccggugguucagucugacaugaaacauuggcccuuccaagugaucaaugauggagacaagccuaagguccaggugagcuacaaaggcgagaccaaggccuuuuaucccgaagagaucuccucuaugguucugacaaaaaugaaggaaauugcggaggccuaccucggcuauccugugaccaacgcugucaucacggugcccgccuacuucaaugauagccagcggcaggcuaccaaagacgccggggugauugcgggacugaacguccuucgcaucauuaaugagccuacagccgcugccaucgcuuauggccuggauagaaccgggaagggagaacggaacguucucauuuuugaccugggcgggggaacauucgauguguccauccugaccaucgacgacggcauuuuugaggugaaggccacggccggcgauacacaccucgggggagaagacuucgauaaucgccuggucaaccauuuuguggaggaguucaaaagaaagcacaaaaaggacaucucucaaaauaaacgggcuguucgcagacuucggaccgcgugugaacgcgccaagagaacacugagcuccagcacccaggcuucucucgagauugauucccuguuugaaggcaucgacuucuacaccagcauuacacgggcccgcuucgaggaacuuugcucugaucuguuuagauccacgcucgagccgguggagaaagcccugcgggacgcuaagcuggauaaggcccagauccaugaccucguccugguugggggaagcaccagaauccccaaagugcagaaacuucugcaagauuucuuuaacggccgcgaccucaauaagucuauuaacccugacgaagcgguggcuuacggggccgccguccaggcugccauccugaugggagauaaguccgagaacgugcaggaccuucugcuccuggaugucgcuccccugagccucggccuggaaacagccggcggggugaugaccgcgcuuauuaaacggaauagcacaaucccuaccaagcaaacgcagauuuucacaaccuauucugacaaccagcccggaguucugauccagguguacgagggcgaaagagccaugaccaaggauaauaaccuccuggggcgcuuugagcuuagcggaaucccgccugcuccccggggcgucccucaaauugaggugacauucgacaucgaugccaaugggauucugaacguuaccgcuacagacaaauccacgggcaaggccaauaaaaucaccauuacaaacgauaagggaagacucagcaaagaagagaucgaacgcauggugcaggaggcggaaaaguauaaggccgaggacgagguccagcgggaaagagugucugcuaaaaaugcccuggaguccuacgcuuuuaacaugaaguccgccguggaagaugagggccugaaagggaagauuucugaggccgacaaaaagaagguucucgauaaaugucaggaagucaucagcuggcuggacgcuaauacccuugcggagaaggacgaguucgaacacaaacgcaaggaacuggagcaagugugcaaccccaucauuuccggacucuaucagggcgccgggggacccggcccugggggcuuuggagcucagggcccgaaagggggaucuggcagcgggcccacaaucgaggaaguggauuga

SEQ ID NO: 70497 - RNA, 1926 nt, Artificial Sequence
  derived and/or modified sequence opt5 from HSPA1L__Homo_sapiens__NP_005518
auggccaccgcuaagggcaucgccauugggaucgaccugggaacaacguacagcugcgugggcgucuuccagcacgggaagguugagauuaucgcgaacgaucaaggaaauagaaccacacccuccuauguggcuuuuaccgacacagaacggcucauuggcgaugccgccaagaaccagguggcuaugaauccucagaacaccgucuucgacgccaaacgccugaucgggagaaaguuuaaugauccggugguucaggcugacaugaaacuuuggcccuuccaagugaucaacgagggaggcaagccuaagguccuggugucuuacaaaggcgaaaauaaggccuuuuaucccgaggaaauuagcuccaugguucucacaaaacugaaggagaccgcggaggccuuccuugggcauccugugacgaacgcugucaucaccgugcccgccuacuuuaaugauucucagcggcaggcuacaaaagacgccggagugauugcgggccugaacguccuccgcaucauuaaugaaccuaccgccgcugccaucgcuuaugggcuggauaagggaggccagggggagagacacguucugauuuucgaccucggaggcggcacauuugaugugagcauccugaccaucgacgaugggauuuucgaagugaaggccacggccggagacacacaucuuggcggggaggacuuugauaaccggcuggucucccacuucguggaggaauuuaaacgcaagcauaaaaaggacaucucucaaaauaaaagagcuguucggcgccucagaaccgcgugugagcgggccaagcgcacacugagcuccagcacccaggcuaaccuugaaauugauucucuguacgagggaaucgacuucuauaccuccauuacaagagcccgguucgaggaacucugcgccgaucuguuucgcggcacgcuggagccgguggaaaaagcucucagagacgccaagauggauaaggcgaaaauccacgacaucguccugguugggggaagcacccggauucccaaggugcagagacuucugcaggauuacuucaauggccgcgaccucaacaaaucuaucaacccugaugaggcuguggccuacggcgccgcuguccaagccgcuauucugaugggggacaaguccgaaaaagugcaggaccuucugcuccuggaugucgcgccccugagccucggacuggagacagccggcggggugaugaccgcccuuaucaagcggaauagcacaauuccuaccaagcagacgcaaaucuuuacaaccuauuccgacaaccagcccggaguucugauccagguguacgaaggcgagagagcuaugaccaaagauaauaaccuccuggggcgcuucgaccuuacaggcauuccgccugcuccccggggagucccucagaucgaggugaccuuugauauugacgccaauggcauccugaacguuacagccacggauaagagcaccgggaaagugaauaagauuacaaucaccaacgacaaaggaagacucuccaaggaagagauugaacgcaugguccuggaugcggagaaguauaaagccgaagacgaggugcaacgggagaagaucgcugccaaaaaugcucuggaaucuuacgccuucaacaugaagucugugguuuccgaugagggccucaaagggaagaucagcgaaucugacaagaauaaaauucuggauaaguguaacgagcuucuguccuggcucgaggucaaucagcuggccgaaaaagacgaguuugaccacaagagaaaagaacuggagcagaugugcaaccccaucauuacaaaacuuuaucagggaggcuguaccgggcccgcuugcggcacgggauacgugccuggccgcccggcgaccgggcccacaaucgaagagguggauuga

SEQ ID NO: 70498 - RNA, 1920 nt, Artificial Sequence
  derived and/or modified sequence opt5 from HSPA2__Homo_sapiens__NP_068814
augagcgccagaggccccgcuaucgggauugaccugggaaccacauacuccugcgugggcgucuuccagcacgggaagguugagaucauugccaacgaucaaggaaaucggacgaccccuucuuauguggcguuuacagacaccgaacgccucaucggcgaugcugccaaaaaccagguggccaugaauccgacaaacaccauuuucgacgcuaagagacugaucgggcggaaauuugaggaugccacaguccagagcgacaugaagcauuggcccuuccgcgugguuuccgaaggaggcaaaccuaaggugcaggucgaguacaagggcgaaaccaaaacguuuuuccccgaggagaucucuagcauggugcuuaccaagaugaaagaaauugcugaggccuaucugggaggaaagguucacuccgcggugaucacagucccugccuacuuuaaugauucucaaagacaggcuaccaaagacgccggcacaauuaccgggcucaacgugcugcggaucauuaaugaacccacggcugccgcgaucgccuauggacuugauaagaagggcugugcugggggagagaaaaacgugcugauuuucgaccucggcggcgggacauuugaugucagcauccugaccaucgaggacggaauuuucgaaguuaaguccacagccggcgauacccaucuugggggagaggacuuugacaaucgcauggugagccaccucgcugaagaguucaaaagaaagcauaaaaaggauaucggcccuaacaaacgggccgugcgcagacugcggaccgccugcgaacgcgcuaagagaacacuuucuuccagcacgcaggcgucuauugagaucgacucccuguacgagggggucgauuuuuauaccagcauuacacgggcccgcuucgaggaacucaaugcugaccuguucagaggaacccuugaaccgguggagaaggcccugcgggaugccaaacucgacaagggccagauccaagaaaucguucuggugggcgggucuacacgcauucccaaaauccagaagcugcuccaggacuuuuucaacggaaaagagcugaauaaguccauuaacccugaugaggcugucgccuacggcgcggcugugcaggccgccauccuuauuggggauaagagcgaaaauguucaagaccugcuccugcuugaugugacgccccugucccucggaaucgagaccgcuggcggggucaugacaccucugaucaaaagaaacaccaccauucccacaaagcagacccagacauuuacgaccuacucugacaaccaaagcuccgugcugguccagguguaugaaggcgagcgggccaugacaaaagacaauaaccuccugggaaaguucgaucuuaccggcaucccgccugcucccagagggguuccucagauugaagugacauuugacaucgaugccaaugggauucugaacgucaccgcggccgacaaaagcacgggcaaggagaauaagaucaccauuacaaacgauaaagggcgccucucuaaggacgauaucgaccggauggugcaggaggcugaaagauacaaauccgaggaugaagccaaucgcgaccggguugcugccaagaacgcgcuggagagcuauaccuacaauaucaaacaaacaguggaggaugaaaagcugagaggaaagauuucugagcaggacaaaaacaagauccuggauaaaugucaggaagucauuaauuggcucgaccgcaaccagauggccgagaaggacgaauaugagcacaaacaaaaggagcuggaacgggugugcaaucccaucauuagcaaacuguaccagggcgggcccggcggaggcuccgggggaggcgggucuggagcuagcggcgggccuaccaucgaggaaguggauuga

SEQ ID NO: 70499 - RNA, 2523 nt, Artificial Sequence
  derived and/or modified sequence opt5 from HSPA4__Homo_sapiens__NP_002145
augagcguggucggcaucgaccugggguuccaguccugcuacguugccguggcuagagccggaggcauugagaccaucgcgaacgaauauucugaucgguguacacccgcuugcauuagcuuugggccuaagaaucgcuccaucggagccgccgcuaaaucucaagugauuagcaacgccaagaauacgguccagggcuucaaaagauuucacgggcgggcuuucuccgacccguuuguggaggccgaaaagucuaaccucgcguacgauaucguucagcugcccaccggacuuacaggcaucaaagugaccuauauggaggaagaacgcaauuucacaaccgagcaggucacagccaugcugcucagcaagcugaaggaaaccgcugaguccgugcuuaaaaagccuguuguggacugugucgugagcgugcccugcuuuuacacggaugccgaaagacggucugucauggacgcuacccaaauugccggccugaacugucuccgccugaugaaugagacaaccgcgguugcccuggcuuaugggaucuacaaacaggaucucccugcccuggaggaaaagcccagaaacgugguguucgucgacaugggacauuccgcuuaucaggugagcguuugcgccuuuaaucggggcaaacuuaaggugcuggccacagcuuucgauaccacgcucgggggacgcaaguuugacgagguccuggugaaccacuucugugaagaguuuggcaaaaaguacaaacuugauauuaagucuaaaaucagagcgcugcuccggcugucccaggaaugcgagaagcugaaaaagcucaugagcgccaaugcuucugaccugccucuuuccauugaguguuucaugaacgauguugacgugagcgggacaaugaaucgcggaaaguuccuggaaaugugcaacgaccuccuggccagagucgagccgccccuucgguccgugcuggaacaaaccaaacucaagaaagaggauaucuacgccgucgaaauugugggcggcgcuacacgcaucccugccguuaaggagaaaaucucuaaguuuuucgggaaggagcugagcaccacccugaaugcggacgaagcugugacaagaggaugugcccuccagugcgccauucugucccccgcuuuuaaaguccgggaguucagcaucacggaugugguuccuuaucccauuucucuuagauggaacuccccggccgaagagggcagcucugacugcgaaguguuuagcaagaaccaugcugccccuuucuccaaaguccugaccuuuuaccgcaaggagcccuucacacucgaggcguauuacucuagcccucaggaucugcccuaucccgacccugccaucgcucaguuuuccgugcaaaaagugaccccgcagagcgaugggucuuccagcaagguuaaggucaaagugcgggugaauguccacggaauuuucucuguguccagcgccucccuuguugaagugcauaagucugaggaaaacgaggagcccauggaaacagaccagaaugcuaaagaggaagagaagaugcaagucgaucaggaggagccucacguggaggaacagcagcaacagacccccgccgagaacaaagcggaaagcgaggaaauggagacgucccaggccggcucuaaggacaagaaaauggaucagccuccccaagcuaagaaagccaagguuaaaacaagcaccguggaccugccgaucgagaaucagcuccuguggcagaucgacagagaaaugcugaaccucuacauugagaaugaagggaagaugaucaugcaggauaaacuggagaaggaacgcaacgacgcuaagaaugccgucgaggaguauguguacgaaaugcgggauaaacuuuccggagaguacgaaaaguuuguuagcgaggacgauagaaacucuuucacccugaaacucgaggacacagaaaauuggcuguaugaggauggcgaagaccaaccuaaacagguguacgucgauaagcuggccgagcuuaagaaccucggccagcccauuaagauccgcuuucaggaauccgaggagcggccuaaacuguucgaggaacuggggaagcaaauucagcaguauaugaaaaucaucagcucuuucaagaauaaagaagaccaauacgaucaccucgacgcugcggauaugaccaagguggagaaguccacaaacgaagccauggaguggaugaauaacaaacugaaccuucagaauaagcagagccugacgauggaccccguggucaaaucuaaggagauugaagcuaaaaucaaggagcucaccagcacauguuccccuauuaucagcaagcccaaaccgaagguugaaccucccaaagaggaacagaagaacgccgagcaaaauggacccguggacggccagggggauaacccuggaccgcaggccgcugagcagggcaccgacacagccgugcccucugauuccgacaaaaagcugccugaaauggauauugacuga

SEQ ID NO: 70500 - RNA, 2520 nt, Artificial Sequence
  derived and/or modified sequence opt5 from HSPA4L__Homo_sapiens__NP_055093
augagcguggucggcaucgaccugggguuccucaacugcuacauugccguugcuagauccggaggcaucgagaccauugccaaugaauauucugaucgguguacacccgcgugcaucagccuggggucccgcacgagagcuauuggaaacgccgccaagucucagaucgugaccaaugugcggaacacaauccacggcuuuaaaaagcugcaugggcgcagcuucgacgauccuauuguccaaaccgagagaauccggcuuccguacgaacuccagaaaaugcccaauggauccgcuggcgugaagguucgcuaucuggaggaagagagaccuuuugccauugaacaggugacaggcaugcuucuggcuaaacucaaggagaccucugagaacgcccugaagaaacccgucgcggacugugugaucagcauuccuuccuucuuuacagaugccgaacggcgcagcguuauggcugccgcucagguggccgggcugaauugccucagacugaugaacgagaccacggcggucgcccuugcuuacggaaucuauaagcaagaccugcccccucucgaugagaaaccgcggaaugugguguucauugacaugggccacucugccuaccagguccugguuugugcuuuuaacaaggggaaacuuaaggugcuggccaccacauucgaucccuaucucggaggccgcaauuuugacgaagcccugguggauuacuucugcgacgaguuuaagaccaaauacaagaucaacgucaaagaaaauuccagagcucugcuccggcuguaucaggagugugaaaaacuuaagaagcugaugagcgcgaacgccucugaucucccucugaauaucgagugcuucaugaacgaccuugacguguccagcaaaaugaaccgcgcucaguuugagcaacugugugccucucuccuggccagaguugaacccccucugaaggcugugauggagcaggccaaucuccagcgggaagauauuuccagcaucgagauugucgggggagcgacaagaauccccgcugugaaggaacagauuaccaaauucuuccugaaggacaucuccacgacacuuaacgccgaugaggccguugcucgcggcugcgcccugcaaugugcuauccucucuccggccuuuaaagugcgggaguucagcauuaccgaccuggucccuuacuccaucacacuuagauggaagaccagcuuugaagauggcucuggggagugcgaaguguucugcaaaaaucaucccgcgccuuuuuccaaggucauuaccuuccacaagaaagagcccuuugaacuggaggccuucuauacaaaccuccaugaggugcccuacccugacgcucgcaucggcagcuuuacgauucagaauguuuucccgcagucugauggagacagcuccaaggugaaagucaaggugcggguuaacauccacgggaucuuuucuguggccagcgcuuccgucauugaaaaacaaaaucuggagggagaucacagcgacgcccccauggaaaccgagacaucuuucaagaacgagaauaaggauaacauggacaaaaugcaaguggaccaggaagagggccaucagaagugucacgcggaacauaccccugaggaagagaucgaucacacaggggccaaaaccaaguccgcugugagcgacaaacaggauagacugaaucagacgcucaagaagggaaaaguuaagucuauugaccugcccauccaguccagccuuugccgccagcugggccaagaucuccugaacuccuauauugagaaugaaggcaaaaugaucaugcaggacaagcuggagaaagaacggaacgaugccaagaaugcugucgaggaauacguguaugacuuuagagaucgccuugggacaguguacgagaaauucauuaccccugaggaccucucuaagcugagcgccguccuggaagauaccgagaacuggcucuacgaagacggagaggaucagcccaaacagguguauguugacaagcugcaagaacuuaagaaauacggccagccgauccagaugaaguauauggagcacgaggaacggccuaaagcccugaacgaccucgggaagaagauccagcuggugaugaaagucauugaggcuuacagaaauaaggaugaacgcuaugaccaucuggaucccacagagauggagaaaguggaaaaguguaucuccgacgcgaugucuuggcuuaacagcaaaaugaaugcccaaaacaagcucucccugacccaggauccuguugugaaggucagcgagauuguggcuaaaucuaaggaacuggacaauuucugcaaccccaucauuuacaaaccuaagcccaaagccgagguuccggaagauaagccuaaggccaauuccgagcacaacggacccauggacggccagagcgggacagagacgaaaucugauuccaccaaggacagcucucaacauacaaaaagcuccggcgaaauggagguggauuga

SEQ ID NO: 70501 - RNA, 1965 nt, Artificial Sequence
  derived and/or modified sequence opt5 from HSPA5__Homo_sapiens__NP_005338
augaagcugagccucguggccgcuaugcugcuucugcucuccgccgcgagagcugaggaagaggacaaaaaggaagaugucggcaccguuguggggaucgaccugggaacaacguacucuugcgugggcgucuucaaaaacgggcggguggagauuaucgccaaugaucagggaaaccgcauuacccccagcuauguugccuuuacaccugaaggcgagagacuuaucggggacgcugccaagaaucaacugaccuccaacccggagaauacaguguucgaugcuaaacggcucauuggacgcaccuggaacgaccccucuguccagcaggauaucaaguuucugccuuucaaggugguugaaaagaagacaaaacccuacauccagguggacauuggcggcgggcaaaccaagacguuugccccugaggaaaucagcgcgaugguccugaccaaaaugaaggagacagccgaggcuuaucucggaaagaaagugacccacgccguggucacaguucccgcuuacuucaaugaugcccagagacaggcgaccaaggacgccggcacgauugcugggcugaacgugaugcggaucauuaaugaaccuacagccgcugccaucgccuauggacuugauaaacgcgagggcgaaaagaacauucugguguuugaccucgggggaggcaccuucgaugucucccugcuuacaaucgacaauggcguguuugagguuguggcuaccaacggggacacccaucugggaggcgaagauuucgaccagagagucauggagcacuuuaucaaacucuacaagaaaaagacagggaaggaugugcggaaagacaaucgcgcgguucaaaagcugagacgggagguggaaaaagccaagcgcgcucugucuagccagcaucaggccagaauugagaucgaauccuucuaugagggagaagauuuuagcgagacgcucacccgggccaaauucgaggaacugaacauggaccuuuuccgcucuacaaugaagccgguccagaaggugcuggaggauuccgaccucaaaaagagcgauauugacgaaaucguccuggugggcgggucuacccggauucccaaaauccaacagcuuguuaaggaguuuuucaauggaaaagaaccuuccagaggcaucaaccccgaugaggcuguggccuacggcgcggcuguccaggccggggugcugagcggagaccaagacacaggcgaucucguucugcuggacguguguccucucacccuggggauugagacggucggaggcgugaugacaaaacuuauccccagaaacaccgugguuccgaccaagaaaucucagaucuuuuccacagccagcgauaaucagccuaccgucacaauuaagguguacgaaggggagcgcccccugacgaaagacaaccaccuccugggcaccuucgaucuuacaggcauuccucccgcuccccggggagugccucagaucgaagucaccuuugagaucgacgugaaugggauucugagaguuacagccgaggauaagggaaccggcaacaaaaauaagaucacgauuaccaacgaccaaaaucgccucacaccggaagagaucgaacggauggugaacgaugcugagaaguucgccgaagaggacaaaaagcugaaagagagaauugauacccgcaaugaacuggaguccuaugcguacucucucaagaaccagaucggggacaaagaaaagcugggaggcaaacuuagcuccgaggauaaggaaacaauggagaaggccgucgaggagaaaauugaauggcuggaaagccaucaggacgcugacaucgaggauuuuaaggccaaaaagaaagaacucgaggagaucgugcagcccauuaucucuaagcuguauggguccgcuggcccucccccuaccggagaagaggacacggccgaaaaggaugagcuguga

SEQ ID NO: 70502 - RNA, 1932 nt, Artificial Sequence
  derived and/or modified sequence opt5 from HSPA6__Homo_sapiens__NP_002146
augcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuucagaguggucuccgaagggggaaagccuaaagugcggguuuguuaccgcggcgaggauaagaccuuuuaucccgaagagauuucuagcauggugcuguccaagaugaaagagacggccgaagcguaccuuggccagccugucaagcacgccgugaucaccgugcccgcuuauuucaacgacucucagagacaggccacaaaagaugcuggggccauugcgggacugaauguccuccggaucaucaacgagccuaccgccgcugccauugcuuacggccuggaccgcagaggggccggagaacggaauguucugaucuuugaucucggcgggggaacauucgacgugagcgugcuguccauugaugccggcgucuuugaggugaaggcuaccgcgggcgacacgcaucuugggggagaggacuucgauaaccgccugguuaaucacuuuauggaagaguucagacggaaacauggcaaggaccucagcgggaacaagcgcgcccugagacggcuuagaacagcuugcgaacgcgccaaacggacccugucuuccagcacacaagccacccucgagaucgauucucuguuugaaggaguggacuucuauaccuccauuacaagagcucgcuucgaggagcuguguagcgaucucuuucggucuacgcuggaaccggucgagaaggcccuuagagacgcgaaacuggauaaggcucagauccacgacgugguucucgugggcggguccacccgcauucccaaaguccagaagcugcuucaggauuucuuuaauggaaaagaacugaacaagagcaucaauccugacgaggccguggccuacggcgcugccguccaagcugccgugcucaugggcgauaagugcgaaaaaguucaggaccugcugcuccuggacguggcgccccuuucccuggggcucgagacagccggaggcgucaugaccacacugauccagcggaacgcuaccauuccuacgaagcaaacacagaccuucaccacauacucugauaaucagcccgggguguuuauccagguuuaugagggagaaagagccaugaccaaagacaacaaccuucugggccgcuucgagcucagcgggauuccgccugcuccccggggcgugccucaaaucgaagucacauuugauauugacgccaauggaauccuguccgugacggcgaccgauagaagcacaggcaaggccaacaaaaucaccauuacaaaugacaaggggcgccugucuaaggaggaaguggagcggaugguucacgaggcugaacaguacaaagccgaggaugaagcucagagagaccgggucgccgccaagaacucccucgaggcucauguguuccacgugaaaggaagccugcaggaggaaucucuucgcgauaagauccccgaggaagacagacggaaaaugcaagauaaguguagagagguccuggcguggcucgaacauaaucagcuggccgagaaggaggaauaugagcaccagaaacgcgaacuggagcagauuugccggcccaucuuuagcagacuuuacggcgggccuggagugccgggcggguccucuuguggcacccaagcucgccagggagaccccagcacgggcccuauuaucgaagagguugauuga

SEQ ID NO: 70503 - RNA, 1941 nt, Artificial Sequence
  derived and/or modified sequence opt5 from HSPA8__Homo_sapiens__NP_006588
augagcaagggccccgccguggggaucgaccugggaaccacauacuccugcgucggcguuuuccagcacgggaaaguggagauuaucgcuaacgaucaaggaaauagaacgaccccuucuuauguggccuuuacagacaccgaacggcucauuggcgaugcggcuaagaaccaggucgccaugaauccgacaaacaccguguucgacgccaaacgccugaucgggagacgguuugaugacgcuguugugcagagcgauaugaagcauuggcccuucauggucgugaaugacgccggacgcccuaaaguucagguggaguacaagggcgaaacaaaguccuuuuaucccgaggaagucucuagcauggugcuuaccaaaaugaaggagauugcugaggccuaccugggcaaaacggugaccaacgcggucguuacagugccugccuauuucaaugauucccaaagacaggcuaccaaggacgccgggacaaucgcuggacucaacgugcugcggaucauuaaugaacccaccgccgcggccaucgcuuacggccuugauaaaaaggucggggccgagcgcaacgugcugauuuuugaccucggaggcgggacguucgauguuucuauccugacaauugaagacggaaucuuugaggugaagucuaccgcuggcgacacacaccugggcggggaggauuucgacaauagaauggucaaccauuuuauugccgaauuuaaacggaagcacaaaaaggauaucuccgagaauaaacgcgccgugagacggcuccgcaccgcuugugaaagagcgaagcggacccugagcagcuccacacaggccagcaucgagauugacucucuuuaugaaggaaucgauuuuuacacguccauuacccgcgcuagauucgaggagcugaacgccgaccucuuccggggcacacuggauccuguugaaaaagcccuuagagacgcuaagcuggauaagagccagauccaugacauugugcucgucgggggaucuacccgcaucccgaaaauccaaaagcugcugcaggauuucuucaauggcaaagagcucaacaaguccauuaaccccgacgaagccguggcguacggggcugccguccaggccgcuauccugagcggagacaaauccgagaaugugcaggaucuucugcuccuggacguuacaccucuuucucugggcauugaaaccgccggcggggugaugacgguccucaucaagcggaacacaaccauucccaccaagcaaacacagaccuuuacaacguauagcgauaaucagccuggagugcugauccaaguuuacgagggcgagagagcuaugaccaaagacaacaaucugcucgggaaguucgaacugacaggaaucccgcccgccccucgcggcgugccccagauugaggucaccuuugauaucgacgcgaacgggauucuuaauguguccgccguggauaaaagcacaggcaaggaaaacaaaaucaccauuacgaaugacaagggacggcugucuaaggaggauaucgaaagaaugguucaggaggcugagaaauauaaggccgaagacgagaaacagcgcgauaaggucuccagcaaaaacucucucgaaagcuacgcuuucaauaugaaggccaccguggaggacgagaagcugcaaggcaaaauuaacgaugaagacaagcagaaaauccuugacaagugcaaugagaucauuaacuggcuggauaaaaaucagacagcggaaaaggaggaauuugagcaccagcaaaaagagcucgaaaagguguguaacccuaucauuaccaagcuguaucaguccgccgggggaaugcccggcgggaugcccggaggcuucccugggggcggagcuccgcccucuggcggggccagcuccggaccuacaaucgaggaagucgacuga

SEQ ID NO: 70504 - RNA, 2040 nt, Artificial Sequence
  derived and/or modified sequence opt5 from HSPA9__Homo_sapiens__NP_004125
augaucagcgccuccagagcugccgcggcucggcuggugggcgccgccgcuucucgcgggcccaccgccgcuagacaccaggacagcuggaacggacucucccaugaggccuuccggcuggucucucgcagagauuacgcgagcgaagccauuaagggcgcuguuguggggaucgaccuuggaacaacgaauagcugcguggccgucauggagggcaaacaagcuaaggugcuggaaaacgccgagggggcgcggaccacaccuucuguuguggccuuuaccgcugauggagaacgccucgucggcaugccggccaaaagacaggcugugacaaaucccaacaauaccuucuaugccacaaagcggcugauuggccgcagauacgacgauccugagguucagaaagacaucaagaacgugcccuuuaagauuguccgggccagcaauggggaugcuuggguggaggcgcacggaaaacuuuauuccccuagccagaucggcgccuucgugcugaugaagaugaaagaaaccgcugagaacuaccucgggcauacggccaagaaugccgucaucaccguucccgcuuauuuuaacgacucucaacgccaggccacaaaagaugcgggacagauuuccggccugaaugugcugagagugaucaacgaaccuaccgcugccgcccucgcuuacgggcuggacaagagcgaggauaaggucauugccguguaugaccuuggaggcggcacauucgauaucucuauucuggagauccagaaagggguuuuugaagugaaguccaccaauggagacacguuccucggcggggaggacuuugaucaagcucugcuucggcacauugucaaagaguucaagcgcgaaacaggaguggaccugaccaaagauaacauggcccuccagagaguucgggaagcggccgagaaggcuaaaugugagcuguccucuuccgugcagacagacaucaaucugccguaccucaccauggauagcuccggccccaagcaucugaacaugaaacuuaccagagcccaguuugaagggaucgucacagaccugauucgccggacgaucgcuccuugccaaaaggccaugcaggaugcggaggugucuaagagcgacauuggagaagucauccucgugggcggcaugaccagaaugcccaaaguucagcaaacagugcaggaucuguucgggcgcgccccuuccaaggcugucaaccccgacgaggccguggcuauuggagccgccauccagggcgggguucuugcuggagaugugaccgacguccugcuccuggacgugacaccgcugagccucggcaucgaaacccugggcggcguguuuacgaaacuuauuaaucggaacacaaccaucccuaccaagaagucucagguuuucuccacagcggccgauggacaaacccaggucgagauuaaagugugucagggcgagagagaaauggcuggggacaauaagcugcucggacaguucacacugaucggcauucccccugcuccccgcggggugccccaaaucgaggucacguuugauaucgacgccaacggaauugugcacguuagcgccaaagauaagggcaccgggcgggaacagcagaucgugauucagucuagcggcggacuuuccaaagacgauaucgagaauauggucaagaacgccgaaaaguacgcggaggaggacagacgcaaaaaggaacggguggaggcuguuaauauggccgaaggcauuauccacgauacagagaccaaaauggaggaguucaaggaccaacugccugccgaugaaugcaacaaacucaaggaagagauuucuaagaugagagaacugcuggcucgcaaagacagcgagacaggggagaauauccggcaggccgcguccagccuccagcaggcuucucugaaacuuuuugaaauggccuauaagaagauggccuccgagagagaaggaagcgggucuuccgggaccggagagcaaaaagaagaucagaaggaggagaaacaguga

SEQ ID NO: 70505 - RNA, 618 nt, Artificial Sequence
  derived and/or modified sequence opt5 from HSPB1__Homo_sapiens__NP_001531
augaccgagagacgggugcccuucagccugcuccgcggcccuuccugggacccguuuagagauugguacccccacucucggcuguucgaccaggccuuugggcuuccucgccugcccgaagaguggagccaauggcucggaggcuccucuuggccuggguaugucagaccccugccuccggcugccaucgaaagccccgcgguugcugccccugccuacucccgggcucuuucucgccagcugagcuccggagugagcgagauuagacauacagccgaucgguggcgcgugucucucgacgucaaccacuucgcucccgaugaacugacggugaagaccaaagacggcguuguggagaucacagggaagcaugaggaaagacaggaugagcacggauauauuucccggugcuuuacccgcaaauacacacugccucccggcgucgacccgacccaggugucuagcucccucagcccugaaggcacacugaccguugaggcccccaugccuaagcuggcgacgcaaucuaaugagaucaccauucccgugacauucgaauccagagcccagcuugggggacccgaggcugccaaaagcgaugaaaccgcugccaaguga

SEQ ID NO: 70506 - RNA, 549 nt, Artificial Sequence
  derived and/or modified sequence opt5 from HSPB2__Homo_sapiens__NP_001532
augagcggcagauccgugccccacgcccauccugcuaccgccgaguacgaguucgcgaacccgucucggcugggggaacagcgcuuuggagaaggccuccugcccgaggaaauccuuacaccuacgcuguaucacggguacuaugucagaccccgggcugccccugccggagagggcagccgcgcuggggccuccgagcucagacugucugaaggaaaguuccaggcuuuucuugacguuagccauuucacccccgaugaggugacagugcggaccgucgacaaucugcucgaaguguccgcccgccacccucaaagacuggaucggcauggcuuuguuucucgcgaguucugcagaacauacgugcugccggcggacgucgaucccuggcgggugcgcgccgcucucagccacgacggcauucugaaccuugaggccccuagagggggacggcaccuggauaccgaaguuaaugagguguauaucucccuccugcccgcuccucccgacccggaagaggaagaggaggccgcgauugucgaaccuuga

SEQ ID NO: 70507 - RNA, 453 nt, Artificial Sequence
  derived and/or modified sequence opt5 from HSPB3__Homo_sapiens__NP_006299
auggccaagaucauucugagacaccucaucgagauucccgugcgguaccaggaagaguucgaagcucgcggccuggaggacugcagacuugaucaugcccuguaugcgcucccugggccgaccaucgucgaccugcggaaaacacgcgcugcccaaagcccucccguugauuccgccgcugaaacgcccccuagagagggaaagucucacuuucagauucuucuggacguggugcaguuccuccccgaggauaucaucauucagaccuuugaaggcuggcugcugaucaaagcccaacaugggacacggauggacgagcacggauucauuagccgcuccuuuaccagacaguacaagcucccugauggcgucgaaaucaaagaccugucugcugugcuuugucaugaugggauucugguuguggaggucaaggacccggugggaacaaaguga

SEQ ID NO: 70508 - RNA, 483 nt, Artificial Sequence
  derived and/or modified sequence opt5 from HSPB6__Homo_sapiens__NP_653218
auggagauccccgugcccguccagccgagcuggcugagacgggccuccgcuccccucccuggccugucugcccccgggcgccuuuucgaccaaagauuuggagaaggccugcucgaggcggaacuggcugcccuuugcccuaccacacuggcccccuacuaucuccgggcuccuagcguugcccugccgguggcucaggugcccacggauccugggcacuucuccguccugcucgacgugaagcauuuuucucccgaggaaauugccguuaaaguggucggagagcacguggagguucaugcgcgccacgaagagagaccugaugaacauggcuucguggcccgggaguuucaccgcagauaccggcugcccccgggggucgacccugcugccgugaccagcgcucuuucccccgagggagugcugucuauccaggccgcgccugccagcgcucaggccccuccucccgcugccgccaaguga

SEQ ID NO: 70509 - RNA, 792 nt, Artificial Sequence
  derived and/or modified sequence opt5 from HSPB7__Homo_sapiens__XP_011539551
augagcggcugcgagcugagcccccucgggcugagagugggacuuucugccggcccugcucacgggcggcgcuucccggcccccagcggaccuuggagaggccugaaccucgcgucccggcagggggcuggacccaagccucgcgacucuagacccuacaaagccgccgcugucggcgccuggcaugcucggccugaagccugugcgcacacccugagcugcccggcccuugcucgccugggcagagcccggcgcagacccuggaugucccaucggacaucuagcacguuucgcgcugagagauccuuccacagcagcuccuccucuuccucuucuuccaccagcuccucugccagccgggcgcucccugcccaagaucccccuauggaaaaggcucuguccauguuuagcgacgauuucgggucuuuuaugcgcccccauuccgagccgcuggccuucccugcugcccaccccacagccagaccuggaggcgcugggaauaucaaaacccucggagacgcguaugaauuugccguugaugugcgggacuucagccccgaggauauuaucgugacaaccucuaacaaucacauugaggucagagcugaaaagcuggccgccgacggcacagugaugaacaccuuugcucauaaaugucagcuucccgaggauguugacccuacgagcgugaccuccgcccugcgcgaagaugggucucucacaauccgggcgagacgccacccgcauaccgagcacguccagcagacauuccggaccgagauuaagaucuga

SEQ ID NO: 70510 - RNA, 591 nt, Artificial Sequence
  derived and/or modified sequence opt5 from HSPB8__Homo_sapiens__NP_055180
auggccgacggccagaugcccuucagcugccacuacccuuccagacugcggcgcgauccguuuagagacucuccccucagcucccggcugcuugaugacggguucggaauggauccuuuucccgacgaucugaccgcuucuuggccugacugggcccucccccgccugagcuccgcguggccuggcacacuuagaucugggauggucccgcggggacccacggcuaccgcccgcuucggcgucccugccgaggggagaacacccccucccuuuccgggagaaccuuggaagguuugugugaacgugcauagcuucaaacccgaggaacugauggucaagaccaaagauggcuauguggagguuuccggcaagcacgaagagaaacaacaggaagggggaaucgugagcaagaauuuuacaaagaaaauucagcucccugcugaggucgaccccgugaccguuuucgccucucugucccccgagggccugcucaucauugaagcuccucaggugccgcccuacagcacauuuggggagucuuccuucaacaaugagcugccucaagauagccaggaagugaccugcacguga

SEQ ID NO: 70511 - RNA, 480 nt, Artificial Sequence
  derived and/or modified sequence opt5 from HSPB9__Homo_sapiens__NP_149971
augcagagagugggcaacaccuucagcaaugagucccgggucgccucucgcugccccagcguugggcuggcugaaagaaaccggguggccacaaugccugugcgccuccugagagacuccccggcggcucaagaggauaaugaccacgcccgggauggauuucagaugaaacuugacgcccauggcuucgcucccgaggaacuggucgugcagguugaugggcaguggcucauggugacgggacaacagcagcuggacguccgcgauccugaaagagugucuuaccggaugagccagaagguucaccgcaagaugcuucccuccaaccugucuccuaccgccaugacauguugccucacccccagcggccaacugugggugagagggcagugugucgcucuggcccucccugaggcgcagacaggaccgagcccccggcugggcucccuuggcucuaaagccuccaaucugacccgcuga

SEQ ID NO: 70512 - RNA, 1467 nt, Artificial Sequence
  derived and/or modified sequence opt5 from HSPBAP1__Homo_sapiens__NP_078886
auggccgcuggcagcgaggccaccacacccgugaucgucgcggcuggggccggaggcgaagagggggaacacguuaagccuuucaaaccggagaaggccaaagaaauuaucaugucccugcagcaacccgcuaucuuuugcaacaugguguucgacuggccugccagacauuggaaugcuaaguaccucucucaggugcugcacggaaaacagauucgguuucgcaugggcaugaaguccauguccacggucccccaguucgagaccacauguaacuauguggaggccacccuugaagaguuucugacauggaauugcgaucaaucuagcauuuccgggccuuucagagacuacgaucauucuaaguuuugggcguaugccgacuacaaauauuucguuagccucuuugaagauaagaccgaccuguuccaggaugugaaaugguccgacuuuggauuccccggccggaacggccaggagagcacacuuuggaucgggucucugggagcucacaccccuugucaucucgauuccuacggcugcaaucuggucuuucaggugcaagggcgcaagagauggcaccuguucccgcccgaggacacgccuuuccucuaucccacccggaucccuuacgaagagagcucuguuuuuagcaaaauuaacguggucaaucccgaucugaagcgcuucccgcaguuuagaaaggcccagcggcacgcugugacacuuagcccuggacaggugcuguucgucccccgccauugguggcacuacguugaaucuaucgacccugugaccguguccauuaacagcuggaucgagcucgaagaggaucaucuggccagagucgaggaagcgauuacacggaugcuugugugugcccugaaaaccgcugagaauccccaaaacacgcgcgccuggcucaaucccacagaaguugaggaaaccucccacgcugugaacugcuguuaucugaaugccgccgucucugcguuuuucgacagaugccggacaagcgaggugguugagauccaggcucugcgcaccgacggcgaacacaugaagaaagaggaacucaacguguguaaucauauggaggucgggcagaccggaucccaaaaccugacaacgggcaccgauaagccugaagccgcuagcccguuuggccccgaccuugugccugucgcccagagaucugaggagcccccuuccgaaagagggggaauuuucggcagcgaugggaaagacuuuguggauaaggacggagagcacuucggcaaacugcauugcgccaagcggcagcagaucaugucuaacagcgaaaaugcuaucgaggagcaaauugccuccaacacaaccacaaccccgcagacguuuaucucuacagaugaccuccuggauugucuuguuaauccccaggugacccgcauugucgcgcagcugcucauccaagggcggagccuguga

SEQ ID NO: 70513 - RNA, 1080 nt, Artificial Sequence
  derived and/or modified sequence opt5 from HSPBP1__Homo_sapiens__NP_001123578
augagcgacgagggcuccagagggucucggcugccccucgcccugccuccggcuagccagggaugcuccucuggcgggggaggcgggggaagcuccgccggcggcucugggaacagcagacccccucgcaaucuucaaggacugcuccagauggcgaucaccgcuggcuccgaggaacccgauccucccccugaaccgaugagcgaggaacggcgccaguggcugcaggaggccaugucugccgcuuucagagggcaacgggaggaaguggagcagaugaaguccugucuucgcguccugagccagcccaugccucccacagccggagaagcugagcaggccgcggaccaacaggagagagaaggcgcccucgagcugcuggcugaucucugcgaaaacauggacaaugccgcugauuuuugucagcugucugggaugcaccuucugguuggacgguaccucgaggccggcgcggccggccugcgcuggagagcugcccagcuuauugggacgugcucccaaaacguggcugccauccaggaacaggugcugggacucggcgcccugcggaaacugcuccgccugcuugacagagaugcuugugacaccguccgggugaaggcgcuguucgccauuagcugccucguucgcgagcaagaggcugggcugcuucaguuucugagacucgauggauucucugugcugaugcgggccaugcagcagcaaguccagaaacugaaggugaaauccgccuuucuccugcagaaucuucugguuggccauccugaacacaaggggacacucuguagcaugggaauggugcagcaacuggucgcucuugugagaaccgagcauucccccuuccacgaacaugugcugggcgcccucugcucucuggucacagacuuuccgcagggcguucgcgagugucgggaaccugagcuggggcucgaggaacugcuuagacaccgcugccagcugcuccagcaacacgaggaauaucaggaggaacuggaguucugugagaagcugcuucagaccugcuuuagcucccccgcggaugacagcauggaucgguga

SEQ ID NO: 70514 - RNA, 1722 nt, Artificial Sequence
  derived and/or modified sequence opt5 from HSPD1__Homo_sapiens__NP_002147
augcugagacuccccaccguguuccggcagaugcgcccugucagcagaguucuggccccgcaccuuacacgggcuuacgccaaggacgugaaauuuggcgcggaugcucgcgcccugaugcuccaagggguggaccugcuugccgaugcugucgccgugacgaugggacccaagggcagaaccguuaucauugagcaguccugggggucuccuaaagugacaaaggacggagucaccguggcuaaaagcaucgaucugaaggacaaguauaaaaacauuggcgccaagcucguucaggauguggcgaauaacacaaaugaagaggccggggacggaaccacaaccgcuacgguccuggcccgguccaucgcuaaagaaggcuucgagaagauuucuaaaggcgccaaccccguggaaauccgcagaggggugaugcuggcggucgaugccguuaucgcugagcucaagaagcagagcaaaccugugaccacacccgaggaaauugcccaaguggcuaccaucuccgccaauggagacaaggagauuggcaacaucauuucugaugccaugaaaaaggucgggcggaaaggagugaucacaguuaaggacggcaaaacccugaaugaugaacuugagauuaucgaggggaugaaguuugaccgcggauacaucagcccuuauuucauuaacacguccaagggccagaaaugcgaauuucaggacgcuuacgugcugcucagcgagaagaaaaucucuuccauucagagcaucgucccggcgcuggaaauugccaaugcucauagaaagccccuugugaucaucgccgaggauguugacggcgaagcccugucuacacucgugcugaaccggcugaaagucgggcuccaaguggucgcugugaaggccccuggauucggcgauaaucgcaagaaccagcugaaagacauggcgauugcuaccgggggagccguuuuuggcgaggaggggcuuacacugaaucucgaagaugugcagccccacgaccugggaaaggucggcgaggugaucguuaccaaagaugacgccaugcuucugaagggcaaaggggauaaggcucagauugaaaagagaauccaagagauuaucgaacagcucgacgugaccacauccgaguaugagaaagaaaagcugaacgagcggcuggccaaacucagcgauggagucgcugugcugaaggugggcgggacgucugacguugaagucaaugagaaaaaggaccgcgugaccgaugcccuuaacgcgacaagagccgcuguggaagagggaaucguccugggcgggggcugugcccuccugcggugcauuccugcucuugacucccugacccccgccaacgaggaucagaagaucggaauugaaaucauuaaaagaacacucaagaucccggcgaugaccauugccaaaaaugcuggcguggaggggagccugaucguugaaaagaucaugcaauccucuagcgaggugggauacgacgccauggcuggcgauuucgucaacaugguggagaaagggauuaucgacccuacgaagguugugcgcacagcccugcucgaugccgcuggagucgcgucccugcuuaccaccgccgaagugguugugacagagauucccaaagaagagaaggacccuggcaugggggcuaugggcggaaugggcgggggaaugggcgggggaauguuuuga

SEQ ID NO: 70515 - RNA, 309 nt, Artificial Sequence
  derived and/or modified sequence opt5 from HSPE1__Homo_sapiens__NP_002148
auggccggccaggcuuucagaaaguuucugccccucuucgaccgggugcuggucgagcgcagcgccgcggaaaccguuacaaaagggggaaucaugcuuccugagaagucccaaggcaaagugcugcaggcuacgguggucgccguggggucuggaagcaagggcaaagggggagaaauucagccgguuuccgugaaggucggcgauaaggugcuccugcccgaguacggcgggaccaaaguugugcuugacgauaaggacuauuuucuguucagagauggagacauccucggcaaauacgucgauuga

SEQ ID NO: 70516 - RNA, 13179 nt, Artificial Sequence
  derived and/or modified sequence opt5 from HSPG2__Homo_sapiens__NP_001278789
augggcuggcgggccgcuggggcccugcuccuggcccuucugcuccacggacggcugcuugcugugacccacggccugcgcgccuacgacgggcucucccugcccgaagacaucgaaaccgucacggccucccagaugagauggacccacucuuaucugagcgacgaugaagacaugcucgcugauuccauuucuggagacgaucugggcagcggggaccuuggauccggcgauuuccaaaugguuuacuuucgggcccuggugaacuucacacgcucuaucgaauauagcccucagcucgaagacgcuggcuccagagaauuucgggaggugagcgaggccgucguggauacccuggaaucugaguaccuuaagauucccggggaccagguuguguccgucguguucaucaaggaacuggauggauggguuuuuguggagcucgacgucggcagcgaggggaaugccgacggagcccagauucaagaaaugcugcugcgcgugaucucuuccggcagcguggcuucuuaugucacaagcccccagggguuccaguuuagacggcucggaaccguuccucaguucccccgcgccugcacagaggcugaauuugccugccauagcuacaacgagugcguggcgcuggaauauagaugugaucggcgcccugacugcagagauauguccgacgagcuuaauugugaggaacccgugcugggcaucucuccuaccuucagccuccuggucgagacgaccucccuuccuccccggcccgaaacaaccauuaugcgccaacccccugugacacacgcgccccagccccugcucccuggcagcguuagaccccugccuugcgggccccaggaggcugccugucggaacggacauugcauccccagagauuaccugugugacggccaggaagauugcgaggacgggucugaugagcucgacuguggaccuccgcccccuugcgaacccaaugaguuuccuugcggcaacgggcacugugcucugaaacuuuggcgcugcgauggagacuucgacugugaagaucggaccgacgaggccaauugccccacgaaaagaccggaagagguguguggcccuacacaauuucgcugcgucuccaccaacauguguauucccgccagcuuccacugcgaugaggaaucugacuguccugaucggagcgacgaguucggcugcaugcccccucaggugguuacacccccgagagaauccauccaggcuucucgcgggcaaaccgugaccuuuacaugugucgcgauuggagugccuacgcccaucauuaauuggcggcugaacuggggccauauccccagccacccuagagucaccgugacauccgaagggggccgcggcacccucaucauucgggauguuaaggagagcgaccagggggccuacacaugcgaagcuaugaaugccagaggcaugguguucggaaucccggauggcguccuggagcuugugccccagcgcgccgggccuugccccgacggacauuuuuaucuggaacacucugcugccugucucccuugcuucuguuuuggcauuaccuccguuugccagagcacgcggagauuccgggaucaaauccgccugagauuugaccagcccgaugacuucaaaggggugaacgucacaaugccugcgcagcccggaaccccgccucugucuuccacccagcuccaaauugaccccagccugcacgaguuucagcuuguggaucugucccggagauuccucgugcaugacucuuuuugggcucugccugaacaguuccugggcaauaagguugauagcuacgggggcucccuucgcuauaacguccgguacgagcucgccagaggaaugcuggagcccgugcagcgcccggacgugguccugaugggcgccggguauagacuccugucucggggacacacaccuacccaacccggcgcucuuaaucagcgccaggugcaguuuagcgaggaacacuggguucacgaauccgggagaccugugcaacgggccgagcugcuccagguccugcagagccuggaagcugugcuuauccaaacaguuuacaacacgaagauggccucugugggacucuccgauaucgcgauggacaccacagucacccaugccacaagccacggccgcgcucacucuguggaggaguguagaugccccauuggguauuccggccugagcugugaaucuugcgaugcccauuucacccggguucccggaggcccuuaccuggggacguguagcggaugcaacuguaauggccacgcuuccagcugcgacccgguguacgggcauugccucaacugucagcacaauaccgagggaccccagugcaacaaauguaaggccggcuucuuuggggaugcgaugaaagccacagcuaccucuugccgcccuugucccugcccuuauaucgacgccuccagacgguucagcgauacauguuuucuggacaccgauggccaggcuacgugcgacgccugugcccccggauacacaggccgcagaugcgaauccugugcuccuggguaugagggaaauccgauucaacccggcgggaagugccggccugucaaccaggaaaucgugagaugcgacgagcgcggaucuaugggcaccagcggcgaggcgugucggugcaaaaauaacguggucgggagacuuuguaaugaaugcgccgauggauccuuccaccugucuacacgcaaccccgacggcugucucaagugcuuuuguauggggguuagccggcauugcaccuccucuagcugguccagagcucagcugcacggagccagcgaggaaccuggccauuucucucugaccaaugccgcuuccacacacacgaccaacgaggggauuuuuagccccacaccgggagagcuuggcuucucuuccuuucaucgccuccugagcggcccuuacuucuggucucugcccucccgguuucucggggauaaggugaccagcuauggaggcgaacugagauucacagugacccagcgcucccaacccgggagcacgccucuucacggacagccccuggucgugcuccagggcaauaacaucauccuggagcaccauguugcccaggaaccuucuccggggcaacccagcacauuuauugugccuuuccgggagcaggcguggcagagacccgacggacaaccugcuacccgggaacaucugcuuauggcccucgccggcaucgauacccugcugauucgcgcuuccuacgcccagcagcccgcggagucuagagucagcggcaucuccauggacguggcuguuccggaggaaacagggcaggauccugcccucgagguggaacaauguucuugucccccuggauaucggggccccagcugucaggacugcgauaccggguacacacgcacgccuuccggacuguaccuuggaaccugcgagagauguucuugccaugggcacagcgaagccugugagcccgagacaggagcuugccagggcugucagcaucacaccgaaggcccgcggugcgagcaaugucagccuggguauuacggagacgcccagagaggcacaccccaggauugccaacugugucccugcuauggggacccugcugccggacaggcggcccacaccuguuuccucgacacggauggccauccgaccugcgacgcuugcucccccgggcacagcggacgccauugugaacggugcgccccuggcuacuauggcaaucccucucaggggcagccuugucaaagagauucccagguccccggaccuauuggcugcaacugugacccgcaggggagcgugucuucccaaugcgaugcugccggacagugucagugcaaagcccagguugagggccugacauguagccacugccgcccccaccauuuucaccuguccgcuucuaacccugacgggugucuucccugcuucuguaugggaaucacccaacagugcgcgagcuccgccuacacacggcaucugauuagcacccacuuugcuccuggcgauuuccagggcuuugcccucgugaauccccagagaaacucucgccugacaggggaguucaccgucgaaccggugccugagggagcccaacucuccuuuggcaauuucgcucagcuggggcaugaguccuuuuauuggcagcuucccgagacguaccagggagacaagguggccgcguacggcgggaaacugcgguauacacucucuuacaccgcuggaccccaaggcagcccucuguccgaucccgacguccagaucaccggcaacaauaucaugcugguugccucucagccugcccuucaagggccggaaagacgcagcuaugagauuauguucagagaggaauuuuggcggcgccccgauggacagccugcuacaagagagcaucugcugauggcccuggcggaccucgaugaacugcuuauccgggcuaccuucuccucugugccccuggccgccagcauuuccgcugugagccucgaggucgcccagccuggccccucuaaccgcccgagagcucuggaaguggaggagugccgguguccucccggguacaucggacuguccugccaggacugugccccuggcuauacgagaacagggagcggccuuuaccugggacacugcgaacucugugagugcaauggccauuccgaccugugucaccccgaaaccggggcgugcucucaaugucagcauaacgccgcuggagaguucugcgaacucugugccccuggcuauuacggggaugcuacagccggaacccccgaggacugccagccgugcgccuguccucugacaaaucccgagaacauguuuagcagaaccugcgaaucccuuggcgcugggggcuaccgguguacggcgugcgagcccggauauaccggccaguacugugaacaaugcgggccuggauauguuggcaauccgucugugcaagggggacagugucugcccgagacaaaccaggccccucuggucguggaaguucaccccgcuagaagcauugugccucaaggcgggucccacagccuccgcugccaggucucuggcucucccccucauuacuucuauuggagccgggaggauggaagacccgugccgagcggcacccagcagcggcaccaaggguccgagcugcauuuuccuagcguccagcccucugacgccggaguguacaucuguacaugccgcaaucuucaccagagcaacaccuccagagccgaacugcucguuacggaggcuccuucuaagcccaucacagugaccgucgaagaacagcggagccaguccgugcgcccgggcgccgauguuacauucauuuguaccgcgaaaagcaaguccccugcuuauacccugguguggacaagacuccauaaugggaaacugcccacgcgggccauggacuuuaacggaauccuuaccauucgcaacguccagcugucugaugccggcacauacgugugcaccggcagcaauauguucgcuauggaccaggggacagccacccugcacgugcaagcguccggaacgcucucugcccccguugucagcauccacccuccccagcugacagugcagccuggccagcuugcugaguuuagaugcuccgccaccgggucuccgacccccacacuggaauggaccggaggcccugggggacaacuccccgcuaaggcccagauucauggcggcauccugcggcucccugcuguggagcccacagaucaggcccaguaccugugucgcgcgcacagcuccgccgggcaacaggucgcuagagccgugcuucauguucacggaggcgggggaccucgggugcaggucagcccggaaagaacgcaagugcacgcuggccgcaccguucggcuguauugcagagccgccggggugcccucugcuacaaucaccuggcgcaaggagggaggcucccugccuccccaggcgcggagcgaaagaacagacauugccacccuccugaucccugcuauuacgaccgccgaugccggcuucuaccuuugugucgcuacaucucccgccgggaccgcgcaggcccgcauccaggugguugugcuguccgcuagcgacgccucuccgccucccgucaaaauugaguccagcucccccagcgugacagagggacaaacccucgaucugaacugcguggucgcuggcucugcccaugcgcagguuacaugguaucggagagggggaagccucccuccccacacacaggugcauggcucccgccugcggcuuccucaggugucuccggccgacagcggggaauacgucuguagaguggagaauggauccggccccaaggaggcuucuaucaccguuagcgugcugcacggcacacauuccgggccuucuuauacccccgucccuggaagcacccgccccauccggauugagccguccagcucucacguggccgaaggccaaacacuggaccucaacugcguugugccugggcaggcucacgcccaggucacguggcauaaaagaggaggcucccugcccgcucgccaccagacccaugggagccuucugagacuccaccaagugacgccugccgauucuggagaguacgucugucaugugguuggcaccuccggcccccuggaggcgagcgugcuggugacaaucgaagccuccgucauuccggggccuauuccgcccguucggauugagucuagcuccagcaccguggcugaaggacagacgcucgaccuuucuugcguggucgccggccaggcucacgcccaagugacaugguauaagcgcgggggaucccugccugccagacaccagguucggggcagcagacuguacaucuuucaggcgucucccgcugaugccgggcaguacgugugucgggcuagcaauggaauggaggccuccauuaccgucaccgugacaggcacccaaggcgccaaccucgcuuauccugccgggucuacacagccgauccgcaucgaacccagcuccucucaggucgcggagggacagacccuggaccuuaauugcgugguuccuggccaaagccaugcccaggugacguggcacaaaagagggggaucccugcccguccggcaucagacacacggcagccuccugcgccuguaccaggcuucuccugccgauuccggggaguauguguguagaguucucggaagcuccgugccccuugaggcuucuguccuggugaccauugagccugccggcagcgugccggcgcugggcguuacacccaccguccggaucgaauccucuagcucccaaguggccgaggggcagacgcucgaccugaacugccuuguggcuggacaggcccacgcucaggucaccuggcauaagcgcggcgggagccugccugccagacaccaaguucauggaucucggcuccgccugcuccaggugacacccgcugauuccggcgaguacgugugcagagucguggggagcucuggcacccaggaagccuccguucucgugacaauucaacagcggcuuagcggaucucacucccagggcgucgcguauccugugcgcaucgagagcucuagcgccucccuggcuaaugggcauacccuggaccucaacugucugguugccagccaggcuccccacacaauuaccugguacaagagaggaggcucccuuccgucucggcaccaaaucguggggagccgccugagaaucccucaggucacgcccgccgauuccggagaauaugugugccaugugucuaauggcgccgggagccgggagacaucccucauugucaccauccagggcucuggaagcucccacguucccagcgugucuccucccauuagaaucgaauccagcucuccuaccguggucgagggccagacacuggaccugaacugugugguugcgcgccaaccgcaggcuauuaucaccugguacaaaagagggggaucccuccccagcagacaucagacacacggcucucaccuucgccugcaucagauguccguggccgauagcggggaguacgucugccgggccaauaacaauaucgacgcucuggaagccucuauugugaucuccguuagcccuagcgcuggaucccccucugccccuggcagcuccaugcccauuagaaucgagucuagcuccucucacguggcggaaggggagacgcucgaccugaacugugucgugccgggccaagcccaugcucagguuaccuggcacaagcgcggaggcagccuuccuucccaucaccagacacgggggagcagacugcgccuccaccaugugucucccgccgauuccggagaauaugucugccgggugaugggcagcucugggccucuggaggcuuccguccuggugaccauugaggccagcggauccucugcgguucacgugcccgccccuggcggggcucccccgaucagaauugaacccagcuccucucgcgucgccgagggccaaacacucgaccuuaaauguguggugccuggacaggcucaugcccagguuaccuggcacaagcggggcgggaaccugcccgcuagacaucaggugcacggaccucugcuccggcugaaucaagucagcccggccgauuccggcgaauacagcugccaggugacggggucuuccggaacccuugaggcgagcguucuggugacaaucgaacccucuagcccuggccccaucccugcccccggccucgcucagccuauuuauaucgaggccuccucuagccacgucaccgaggggcagacacuggaccugaacugugugguccccggacaagcccaugcucaggugaccugguacaaaagaggcgggucccucccggcccgccaccagacgcauggaagccagcuucggcugcaccugguuucuccugcggauuccggcgaauaugugugcagagcugccagcgggcccggaccugagcaagaagccuccuucacagucaccgugcccccgucugagggcagcuccuaccgccucagaucuccuguuauuagcaucgauccgcccuccucuacagugcagcagggccaggaugcuagcuuuaagugucugauucacgacggggccgcuccuaucucccuugaguggaagacccggaaucaagaacuggaggauaacguccauaucagccccaauggaucuauuaucaccauugugggcacacgcccuuccaaccacgggacguauagaugcguggccagcaaugcguacggaguugcccagucugucgugaaccucuccgugcauggcccgcccaccgucagcgugcugccugaagggcccguuugggugaaagucggaaaggcugugacacuggagugcguuucugccggcgaaccucggagcuccgcucgcuggaccagaaucagcuccacacccgccaaacucgagcagcggaccuacggccuuauggacucucacgcggugcugcaaauuagcuccgccaagccgucugaugcugggacguaugucugucuggcccagaaugcucucggaacagcccagaaacagguggagguuaucguggacaccggcgccauggcuccuggggcgccccaaguccaggccgaagaggcugaacugaccguggaggccggacauacagccacccuucgcugcagcgcuacaggcuccccugcccccacgauccacuggucuaagcugagaagcccucuccccuggcagcaccggcuggaaggggauacccugauuaucccgcgcguggcgcagcaagacuccggacaguacauuuguaacgcuacaagccccgccggccaugccgaggcuaccaucauucuccacgucgagucuccucccuaugccacaaccguuccugaacaugcuuccgugcaggccggcgagacggugcagcuucaaugccuggcgcacgggacacccccucugacauuccaguggagcagagucggaucuucccucccgggccgggccaccgcucgcaaugaacugcuucacuuugagagagccgcucccgaagacagcgggcgguacagaugucgcgugacaaacaagguuggaucugccgaggcguucgcccagcugcucgugcaaggcccucccgggucccugccugcuaccagcauccccgccggaucuacaccgaccguccaggugacgccucagcuggagacaaaauccauuggcgcuagcguugaguuccauugcgccgugcccuccgaucggggcacccagcucagaugguuuaaggaagggggacaacuuccucccggccacagcguccaggacggggugcugcgcauccagaaucuggaucagucuugucaaggaaccuauaucugccaggcccauggcccgugggggaaagcucaggcgagcgcccagcucgucauucaagcucugccuuccgugcuuaucaacauucggacaucuguucagacgguggucgugggacacgccguugaguucgagugucuggcccucggcgaccccaagccccaggugaccuggagcaaagucggcgggcaucugagaccuggaaucgugcaauccggcggggugguucgcauugcucacgucgagcuggccgaugcgggacaguaccggugcacagcuaccaaugccgccggcacaacccagucucacgugcuccugcuugugcaggcucugccccaaaucagcaugccucaggaagucagagugccggccggguccgcugccguuuuucccuguaucgcgagcggauauccuacacccgacauuucuugguccaagcucgauggcagccugccucccgacucucgccuugagaacaauaugcugaugcucccuuccgugcggccgcaggaugccggcaccuacgucugcacggcuaccaacagacaggggaaagugaaggccuucgcucaucugcaaguucccgaacggguggucccuuacuuuacacagacccccuauagcuuccugccucuccccacaaucaaggacgccuaccgcaaauuugagauuaagaucaccuucagaccggauucugcggacggaaugcugcuuuauaacggccagaaacgggugcccggguccccuacgaaucuggccaaccgccagcccgacuuuauuagcuucggacucgugggcgggagaccugaauuucgguucgaugcuggcuccggaauggccacaaucagacaccccaccccucuggcucuuggccauuuucacacaguuacccugcuccgcucucugacgcaagggagccugaucgucggagaccucgccccggugaauggcaccucccaggggaaguuccagggacuggaucuuaacgaggagcuguaccucggcggguaucccgacuacggcgccauuccuaaagcuggacugagcucuggcuucaucgggugcgugcgggaacuucgcauccagggagaggaaaucgucuuucacgaucugaaucucacagcgcauggcauuucccacuguccgaccugccgcgaccggccuugucaaaacgggggacagugccaugauagcgagucuagcuccuauguuugugugugccccgccggcuucacagggucuagaugugaacacagccaggcucugcauugccacccggaggccuguggcccugacgcgaccugcgugaaucgccccgauggaagaggcuacacaugucggugccaccuggggcgcuccggacucagaugcgaggaaggcgucaccgugacgacaccuagccugucuggggcuggauccuaccuugcccugcccgcgcucaccaacacccaucacgagcugcggcuugacguugaauuuaagccucuggcucccgauggcgugcuccuguucagcgggggcaagucuggaccggucgaggacuuugugucccuggccaugguuggcgggcaucucgaguuccgcuaugagcugggaagcggccuugccgugcugagauccgcugagccccucgcccuggggcgguggcaccgcgucucugcugaaagacuuaauaaagauggaagccugcgggugaacggcggcagaccugugcuccgcuccucucccggaaagagccaagggcugaaucugcauacacuccuguaccuuggcggggucgagccuuccguuccccugagcccggccaccaacaugucugcgcacuuucggggaugugugggcgaaguguccgucaaugggaaaagacucgaccugacauauagcuuccuuggaucucagggcaucggccagugcuacgacuccagcccuugugagcgccagcccugccaacacggggccacguguaugccugcuggagaguaugaauuucagugccugugucgggauggcuucaagggggaccucugcgagcaugaagagaaccccugucagcugagagaaccuugccugcacggaggcaccugucaggggacacgcugccucugccugcccggauuuucuggcccgcggugucaacagggcuccgggcauggaauugccgagagcgauuggcaccuugagggcagcgggggaaaugacgcuccuggccaguacggggccuauuuccacgaugacggauuucuggcguuccccggccauguuuucuccagaucucucccugaagugcccgagaccaucgaacuggaggugcggacaagcaccgccuccggccuucugcucuggcagggggucgaagugggagaggcuggccaagggaaagauuuuaucucucugggacugcaggacggccaccuuguuuuccgcuaccagcuggggagcggagaggccagacucguguccgaagauccgauuaacgacggcgaguggcaucgggucacggcucugcgcgaaggcagacgggggucuauccaaguggauggagaggaacucguuagcggccgcucccccgggccuaacguggccgucaaugcgaagggaucuguguacauuggcggggcccccgacgucgcuacccugacaggaggcagauuuagcuccggcaucaccgggugcgugaagaaccuuguucugcacagcgcccggccuggagcucccccuccgcagccccuggaucuccagcauagagcccaggccggcgcuaauacacgcccuugucccucuuga

SEQ ID NO: 70517 - RNA, 2445 nt, Artificial Sequence
  derived and/or modified sequence opt5 from HSPH1__Homo_sapiens__NP_001273432
augagcguggucggccuggacguugggucccagucuugcuacaucgccguggcuagagccggaggcauugagaccaucgcgaacgaauuuagcgaucgguguacacccuccgugauuucuuuugggagcaagaaucgcacgaucggagucgcugccaaaaaccaacagauuacccacgccaauaacacaguguccaauuucaagagauuucauggccgggcuuucaacgacccuuuuauccagaaagagaaggaaaaucucucuuaugaucugguuccgcuuaaaaacgggggagugggcaucaaggucauguacaugggcgaggaacaccuguucagcguggagcagauuaccgccaugcuccugacaaaacuuaaggagaccgcugaaaauucccugaagaaacccguuacagacugcgugaucagcgucccuucuuucuucaccgaugccgagcgcagauccgugcucgacgcggcccaaauuguggggcugaacugucugcggcucaugaaugauaugacggcugucgcccugaacuauggaaucuacaagcaggaccuucccagccuggaugaaaaaccucgcauuguuguguuuguggacaugggccauucugcuuuccaggucuccgccugcgcguuuaauaaggggaagcucaaagugcugggaaccgccuucgaucccuuucuuggcgggaagaacuucgacgagaaacugguugagcacuucugugcugaauuuaagacaaaauauaagcucgaugccaaaagcaagaucagagcucugcugcggcucuaccaggagugcgaaaagcugaaaaagcugaugucuuccaauagcaccgaccuuccucucaacauugaguguuucaugaacgacaaagauguguccggaaagaugaaucgcucucaauuugaggaacugugcgccgagcuucugcagaaaaucgaagucccgcucuauagccugcuggagcagacacaucucaagguggaagacguuuccgccguggagaucgucggcggcgcuacccggauucccgcggugaaggaaagaaucgccaaauucuuugggaaggauauuagcacgacacugaacgcugacgaggccgucgcccgcggaugugcccuucagugcgcuauccugucuccugcguucaaagugagagaguuuuccguuaccgaugcugugcccuucccuauuagccucaucuggaaucacgacucugaagauacagagggcguccacgaaguguuuagccggaaccaugccgcccccuucuccaagguucugaccuuucuucgcagagggccguucgagcuggaggcuuuuuacucugacccucaaggagugcccuacccugaagccaaaaucggccgguucgucgugcagaaugugagcgcucagaaggauggggagaaguccagaguuaaagucaaggugcgcgugaacacccacggaauuuucacaaucagcacggccucuauggucgaaaaagugcccaccgaggaaaaugagauguccagcgaggcggacauggaaugucucaaccaacggcccccugagaauccggauacagacgccaacgaaaagaaaguugaccagcccccugaggcuaagaagcccaaaauuaagguggucaauguggaacugccuaucgaggccaaccugguuuggcagcucggcaaagaucugcuuaauauguauauugagaccgaaggcaagaugaucaugcaggacaaacuggagaaggaaagaaacgaugcuaaaaaugccguggaggaauacgucuaugaguuucgcgacaagcucugcgggcccuacgagaaguucaucugcgaacaagaucaucagaacuuucugcggcugcuuacagagaccgaagacuggcucuaugaggaaggagaggaucaggcgaaacaggccuacguggacaagcuggaggaacugaugaaaauuggcacgccgguuaaggugagauuccaagaggcugaggaacgcccuaaaauguuugaggaacucgggcagcggcugcagcacuaugccaagaucgcugccgauuucagaaacaaggacgagaaauacaaucacauugaugaaucugagaugaagaaagucgaaaaguccgugaacgaggugauggaguggaugaauaacgucaugaaugcccaggcuaaaaagagccuugaccaagaucccguugugcgcgcgcaggaaaucaagacaaaaauuaaggagcugaacaauaccugugaaccuguggucacccagcccaaaccuaagaucgagucccccaaacucgaacggacaccgaacggaccuaauauugacaagaaggaggaggaccuggaagauaaaaacaauuuuggcgccgagccuccccaucagaacggggaaugcuaccccaaugagaagaacucugugaauauggaccuggauuga

SEQ ID NO: 70518 - RNA, 831 nt, Artificial Sequence
  derived and/or modified sequence opt5 from HTATIP2__Homo_sapiens__NP_001091990
auggccggccccgcugcccugagcgcggcugccgccgcugcccucgcugccgcgcugcuucugcucagacgggaggacccugggccgggagccggccccuccauggcugaaaccgaggcccugucuaagcuccgcgaagauuucagaaugcagaacaaaagcguguuuauccugggggcuuccggagagacaggccggguccuccugaaggaaauucuggagcaagggcuuuucucuaaaguuacgcugaucggacgcagaaagcugaccuuugacgaggaagccuacaaaaaugugaaccaggagguggucgauuucgaaaagcuggacgauuaugcgagcgccuuucagggccacgacgugggcuucugcugucucgggacaacccggggaaaggcuggcgccgagggguuuguucgcguggauagagacuacguccugaaauccgcugagcuugccaaggccggaggcugcaaacauuucaaucugcucucuagcaagggggcugauaaauccagcaacuuucuguaucuucaggugaagggagaaguugaggcgaagguggaggaacucaaauucgaccgguacucugucuuucgcccuggcgugcugcuuugugauagacaagaaucccggcccggcgaguggcuggugcgcaaguucuuugggagccucccugacucuugggccuccggacacagcguccccguugugacaguggucagagcuaugcugaauaacgugguucggccucgcgauaaacagauggagcuucuggaaaauaaggccauucaugaccucggcaaagcccacgggucucugaagccguga

SEQ ID NO: 70519 - RNA, 174 nt, Artificial Sequence
  derived and/or modified sequence opt5 from HTN1__Homo_sapiens__NP_002150
augaaguucuuuguguucgcccugguccucgcucugaugaucagcaugauuuccgccgacucucacgagaaaagacaucacggcuaccggcgcaaguuucaugaaaaacaccauagccacagagaguuccccuuuuauggggauuacggauccaacuaucuuuacgacaauuga

SEQ ID NO: 70520 - RNA, 156 nt, Artificial Sequence
  derived and/or modified sequence opt5 from HTN3__Homo_sapiens__NP_000191
augaaguucuuuguguucgcccugauccucgcucugaugcuuagcaugaccggcgccgacucccacgcgaaaagacaucacggguacaagcggaaauuucaugagaagcaccauucucaccgcggauauagaagcaacuaccuguaugauaauuga

SEQ ID NO: 70521 - RNA, 1269 nt, Artificial Sequence
  derived and/or modified sequence opt5 from HTR1A__Homo_sapiens__NP_000515
auggacgugcugagccccggccaggggaacaauaccacauccccuccggcccccuucgagacgggaggcaacaccacagggaucucugaugucaccguuagcuaccaagugauuacaucccuccugcuuggaacccugaucuuuugcgcugugcucggcaaugccugugucguggcggcuauugcccuggaaagaucucuucagaacguugccaauuaucugaucgggagccucgcugugacagaccugauggucuccgugcugguucucccuauggccgcucuguaccaggugcuuaacaaguggacccugggacaggucacgugcgaucucuucauugcccuggacgugcuuuguugcaccucuagcauccugcaccucugugcgaucgcccuggaucgguauugggcuauuacagaccccaucgauuacgugaauaaacgcaccccuagacgggccgcugcccugauuucccucacauggcugaucggcuuucuuauuagcauucccccuaugcugggcuggcgcaccccggaggacagaucugaucccgacgcgugcacgaucuccaaggaucauggguauacaaucuacagcaccuucggagccuuuuauaucccucuccugcuuaugcugguccucuacggccggauuuuccgcgcugccagauuucggauccgcaaaacaguuaagaaaguggaaaagaccggggcugacaccagacacggagccucucccgccccucaacccaagaaauccgugaacggcgagagcgggucucggaauuggcgccugggagucgaauccaaggcuggcggcgcgcugugugccaacggggcugugagacagggagaugacggcgccgcccucgagguuauugaggugcaucgggucgggaauagcaaagaacaucugccgcuuccuuccgaggcuggacccacaccuugcgcccccgcgucuuucgaacgcaagaacgagagaaaugcugaggccaaacggaagauggcccuggcuagagaacgcaagacggugaaaacccucggcaucauuauggggacauuuauccuguguuggcuucccuucuuuaucguugcccuggugcucccuuucugcgagagcuccugucacaugccgacccugcugggagcuauuaucaacuggcucggcuacagcaauucucugcuuaaccccgucauuuaugccuacuuuaacaaggacuuccagaaugcguucaaaaagaucauuaaaugcaaguuuugccggcaguga

SEQ ID NO: 70522 - RNA, 1173 nt, Artificial Sequence
  derived and/or modified sequence opt5 from HTR1B__Homo_sapiens__NP_000854
auggaggaacccggcgcccagugcgcuccuccgcccccugccgggagcgagaccugggugccccaagcgaaccuguccucugcuccuagccagaauuguuccgccaaggacuacaucuaucaggauucuauuagccuccccuggaaaguccugcuuguuaugcugcucgcccugaucacacuugcuacgacccuguccaacgccuucgugauugcuacaguguacagaacccggaagcuccacaccccugccaauuaucugaucgcgucucuggccgucacagaccuccuggugagcauucuuguuaugccgaucuccacaauguacaccgugacgggacgcuggacccugggccaggucgugugcgauuuuuggcucagcucugacaucacauguugcaccgcuuccauucugcaucuuuguguuaucgcccuggauagauauugggcuauuacagacgccguggaauacagcgcgaaacggacccccaagcgcgccgcugucaugaucgcccucguguggguguucucuauuuccaucagccugccucccuuuuucuggagacaagcuaaagccgaggaagaggucucugagugcguugugaacacggaucacauucuguauacaguguacuccaccgucggggccuuuuacuucccuacacuccugcuuaucgcucuguauggacggaucuacguggaagcgcgcagccggauucucaagcagacccccaauagaaccggcaagcgccugacaagagcccagcuuaucacggacuccccggggucuaccagcuccguuacaagcauuaacucucgggugccugauguccccuccgagagcggaucuccuguguauguuaaucaggugaaaguccgcgugagcgacgcucugcucgaaaagaaaaagcugauggccgccagagagcggaaagcuaccaagacacugggcaucauucucggcgccuuuaucgucuguuggcugcccuucuuuaucauuucccuugugaugcccaucugcaaggaugcguguugguuccaucuggcuauuuuugacuucuuuaccuggcucggguaccugaacucucuuaucaauccuauuaucuauacgaugagcaacgaggauuucaaacaagccuuccacaagcugauccgcuuuaaaugcacauccuga

SEQ ID NO: 70523 - RNA, 1098 nt, Artificial Sequence
  derived and/or modified sequence opt5 from HTR1E__Homo_sapiens__XP_011534092
augaacaucaccaauugcacaacggaggccagcauggcuauuagacccaagaccaucacagagaaaaugcugauuuguaugacccucguggucaucacaacccugacaacccuucugaaccucgccguuauuauggcgaucggcacgaccaagaaacugcaccagccugcuaauuaccuuaucugcucccuggccgugacagaccuccugguggccguccuggugaugccgcucucuauuaucuauauuguuauggaucgguggaagcugggguacuuccuuugugaaguguggcugagcgucgacaugaccugcuguacaugcuccauccuccaucugugugugauugcucuugaucgcuauugggccaucaccaacgcuauugaauacgccagaaaacggacggcgaagcgcgccgcucugaugauccucacaguuuggaccaucucuauuuuuaucagcaugcccccucuguucuggagaucccaccggcgccugucucccccucccagccaaugcacaauucagcaugaccacgugaucuauaccauuuacuccacccucggagccuuuuauaucccucugacacuuauccugauucucuacuacagaaucuaucaugcugccaagagccuguaccagaaacgggggucuucccgccaccuuagcaauagaucuacggauucccagaacagcuucgcgucuuguaagcugacccaaacauuuugcgucuccgacuucagcaccuccgauccgacaaccgaguuugaaaaauuccacgccucuauucggaucccuccuuuugacaaugaucucgaccaucccggcgagcgccagcagauuagcuccacgagagagcggaaggcugcccgcauccugggacugauccucggcgcuuucauucugagcuggcuucccuuuuucaucaaagaacugauuguggggcucucuaucuauacaguguccagcgaggucgccgauuuucugaccuggcuuggauacguuaacucucugauuaauccccuccuguauaccagcuucaacgaagacuucaagcuggccuuuaagaaacucaucagaugucgggagcacacauga

SEQ ID NO: 70524 - RNA, 1101 nt, Artificial Sequence
  derived and/or modified sequence opt5 from HTR1F__Homo_sapiens__NP_000857
auggacuuccugaacagcuccgaucagaaucucaccucugaggaacugcuuaacagaaugcccagcaagauccuggugucccucacacugucuggccuugcccugaugacgaccacaauuaauagccucgucaucgcugccauuaucguuacccggaaacugcaccauccugcgaacuaccugauuugcucccucgcugugacagacuuucugguggccguccuugugaugccguucucuaucguuuauaucgugcgcgagagcuggauuauggggcaagucgugugugauaucuggcuguccguugacauuaccugcuguacaugcagcauccuccaccugucugccauugcucuugauagauaccgggccaucaccgacgcuguggaauaugcccgcaagagaacgcccaaacaugcgggaauuaugaucaccaucgucuggauuaucuccguguuuauuagcaugccuccccuguucuggcggcaccagggcacaucucgcgaugacgaguguaucauuaagcaugaucacaucguguccaccaucuacagcacauuuggggccuucuauauuccucucgcucugauccugauucucuacuauaaaaucuacagagccgcuaagacccuguaccacaagcggcaggccucucgcauugcgaaagaagaggucaauggacagguucuucuggaguccggcgaaaagagcacgaaauccgugucuacaagcuaugugcucgagaagucccugagcgaccccucuaccgauuuugacaaaauccauuccacagucagaagccuucggucugaguucaagcacgaaaagagcuggcgcagacaaaagaucuccgggacccgggagcgcaaggccgcuaccacacugggacucauucugggcgccuuugugaucugcuggcugccuuucuuuguuaaagaacucguggucaacgugugugauaagugcaaaauuucugaggaaaugagcaauuuccuggcuuggcuuggcuaccugaacucccucaucaauccgcugauuuauacgaucuuuaacgaggacuucaagaaagccuuccagaaacuuguuagaugucggugcuga

SEQ ID NO: 70525 - RNA, 1416 nt, Artificial Sequence
  derived and/or modified sequence opt5 from HTR2A__Homo_sapiens__NP_000612
auggacauccugugcgaggaaaacaccagccucuccucuacaacgaauagccugaugcagcuuaacgaugacaccagacuguacuccaaugauuucaacucuggcgaggccaauacaagcgacgcuuuuaacuggaccguggauuccgaaaaucggacaaaccucucuugugaggggugccugagccccuccugucuuagccugcuccaccuccaagaaaagaauuggucugcccugcucaccgcggucguuauuauccugacaauugcuggaaacauccuugugauuauggccgugucccuggagaaaaagcuccagaaugccaccaacuauuuccugaugagccuugcuaucgccgacaugcugcucggcuuucuggucaugccugugucuaugcugacgauccucuacggguaucgcuggccgcugcccuccaaacuuugcgcuguuuggauuuaccuggaugugcuguucagcaccgccucuaucaugcaucugugugcgauuucccuugacagauaugucgccauccagaauccuauucaccauagccgguuuaacucccgcacaaaggcuuuccugaaaaucauugccguguggaccaucucuguuggaaucagcaugcccauuccuguguuuggccuccaggaugacuccaaggucuucaaggaggggagcugccugcuggcugaugacaauuuugugcucaucggaucuuucguguccuuuuucauuccccugacaaucauggucauuaccuacuuucuuacgaucaaaagccugcaaaaggaagccacacucuguguuucugaucugggcaccagagcgaaacuugccagcuucuccuuccugccucagucuagccucuccagcgagaagcuguuucagcggucuauccaccgcgaaccgggcuccuauacagggagacggaccaugcagagcauuucuaacgagcaaaaggcuugcaaagugcugggaaucguguucuuucucuucgucgugauguggugucccuuuuucauuaccaacaucauggccguuauuugcaaggaguccuguaaugaagacgugaucggcgcucugcuuaacgucuuuguguggaucggguaccugagcuccgccguuaauccucucguguacacacuguucaacaaaacguaucgcucugccuuuagcagauacauucagugccaguauaaggagaauaaaaagccccugcagcuuauccucgucaacaccauuccugcucuggcguacaaauccucucaacugcagaugggacagaagaaaaauagcaagcaagacgccaagacaaccgauaacgacugcuccaugguggcucucggcaaacagcauagcgaagaggccucuaaggauaauuccgacggggucaacgaaaaagugagcuguguuuga

SEQ ID NO: 70526 - RNA, 1446 nt, Artificial Sequence
  derived and/or modified sequence opt5 from HTR2B__Homo_sapiens__NP_000858
auggcccugagcuacagaguguccgagcuccagucuaccauccccgaacacauucugcaaagcacauucguccauguuaucuccucuaacuggagcggccuucagacggaguccauuccugaagagaugaagcagaucguggaggagcaggggaauaaacugcacugggcugcccuccugauucuuauggugaucaucccgaccauuggaggcaacacacuggucauccucgcggugucucuggagaagaaacugcaauaugcuaccaauuacuuucucaugagccuggccguugccgaccuucuggugggacucuucgucaugcccauugcucugcuuacaaucauguuugaagccauguggccucugccccucgugcugugcccugcuuggcuguuccucgauguucuguuuuccaccgccagcauuaugcaucuuugugcgaucucuguggaccgguauauugccaucaagaaacccauccaggcuaaccaguacaauucccgcgccacagcuuucauuaagaucaccgucguguggcugauuagcaucgggauugccaucccugugccgaucaagggcauugagacggaugucgacaaccccaauaacauuaccugcguucucacaaaagaaagauuuggggauuucaugcuguuuggaucucuugcggccuucuuuaccccucuggcuaucaugaucgugacauauuuccucaccauucacgcccugcagaagaaggcuuaccuggugaaaaauaaacccccucaacggcucacguggcugacagucuccaccguguuucagcgcgacgagacacccuguagcucuccggagaagguugccaugcuugauggcuccagaaaggacaaagcccugccuaacagcggcgaugaaacccucaugcggcgcaccuccacaaucgggaagaaaucugugcagacgaucagcaaugagcagagagcuuccaagguccugggaauuguguucuuccuuuuucugcucauguggugccccuucuuuaucaccaacauuacacugguucugugugacagcugcaaucaaaccacacuccagaugcugcuugaaaucuucguguggauuggcuaugucucuuccggggugaacccucuggucuacacccucuuuaauaaaacguuccgggaugcguuuggacgcuacaucacauguaacuauagagccaccaagagcgugaaaacccugcggaagcgcucuagcaagauuuacuucagaaaccccauggcugaaaauuccaaauuuuucaagaaacauggcauccggaacgggaucaaucccgccauguaucagucuccuaugcgccugagaagcuccacaauucaaucuagcuccaucauucuucucgacacccugcugcucacagaaaacgagggagauaagacggaggaacagguuagcuacguguga

SEQ ID NO: 70527 - RNA, 1377 nt, Artificial Sequence
  derived and/or modified sequence opt5 from HTR2C__Homo_sapiens__NP_001243689
auggugaaccugagaaaugccguccacagcuuccucguucaucugaucggccuucugguguggcagugcgacauuuccgugucucccgucgcugccaucgugaccgauauuuuuaacacaagcgacgggggacgguucaaguuuccugauggcguucaaaauuggccggcgcucuccaucgugauuaucaucauuaugacgaucgggggaaacauucuggucaucauggcugugucuauggagaaaaagcugcacaaugccaccaacuacuuccuuaugagccucgccauugcugacaugcugguuggccugcucgugaugccccugucccuucuggccauccucuaugauuacgucuggccucugccccgcuaucuuuguccuguguggauuucucuggacgugcucuuuagcacagcuuccaucaugcaucugugcgccaucagccuggauagauacgucgcgauucggaaucccaucgaacacucucgcuucaacuccagaaccaaagccauuaugaagaucgcuauuguuugggccaucagcaucggggugucugugccuauuccggucaucggacuccgggacgaggaaaaaguguuuguuaauaacacaaccugugugcugaaugaucccaacuucguccuuauuggcuccuuuguggcuuucuuuaucccucugacaauuaugguuaucaccuauugccucacgaucuacgugcugcgcagacaggcccuuaugcugcuccauggccacaccgaggaacccccugggcugagccuggacuuccucaaguguugcaagcggaauacagcggaggaggaaaacucugccaaucccaaccaggaucagaacgcucgcagacggaaaaagaaagagcgcagaccgcggggaaccaugcaagccauuaauaacgaacgcaaggcuuccaaaguccugggcaucguguuuuucgucuuccuuauuauguggugucccuuuuucaucacaaauauucugagcgugcucugcgagaaguccuguaaccagaagcugauggagaaacuucugaauguuuuuguguggaucggguaugucugcucuggaauuaacccucucguguacacccuguucaauaagaucuacagacgggccuuuagcaacuaucugagauguaauuacaaaguugaaaagaaaccucccgugcgccagaucccccgggucgccgcuacggcgcucuccggcagagagcugaacgugaauauuuaucgccacacaaacgaaccugugaucgagaaggccagcgacaaugaaccggggauugagaugcagguugagaaccuugaacugcccgucaauccuucuuccguggugagcgagcggaucucuagcgucuga
